United States Patent 8,969,254 (OLIGONUCLEOTIDE ARRAY FOR TISSUE TYPING) - sequence listing, part 10

SEQ ID NO: 217306 - DNA, 25 bp, Artificial Sequence
  Description of Artificial Sequence: Synthetic oligonucleotide
agtaccggtgcaacggcaccagctc

SEQ ID NO: 217307 - DNA, 24 bp, Artificial Sequence
  Description of Artificial Sequence: Synthetic oligonucleotide
gtaccggtgcaacggcaccagctc

SEQ ID NO: 217308 - DNA, 26 bp, Artificial Sequence
  Description of Artificial Sequence: Synthetic oligonucleotide
taccggtgcaacggcaccagctccaa

SEQ ID NO: 217309 - DNA, 25 bp, Artificial Sequence
  Description of Artificial Sequence: Synthetic oligonucleotide
accggtgcaacggcaccagctccaa

SEQ ID NO: 217310 - DNA, 24 bp, Artificial Sequence
  Description of Artificial Sequence: Synthetic oligonucleotide
ccggtgcaacggcaccagctccaa

SEQ ID NO: 217311 - DNA, 24 bp, Artificial Sequence
  Description of Artificial Sequence: Synthetic oligonucleotide
cggtgcaacggcaccagctccaag

SEQ ID NO: 217312 - DNA, 24 bp, Artificial Sequence
  Description of Artificial Sequence: Synthetic oligonucleotide
ggtgcaacggcaccagctccaagg

SEQ ID NO: 217313 - DNA, 24 bp, Artificial Sequence
  Description of Artificial Sequence: Synthetic oligonucleotide
gtgcaacggcaccagctccaaggg

SEQ ID NO: 217314 - DNA, 25 bp, Artificial Sequence
  Description of Artificial Sequence: Synthetic oligonucleotide
tgcaacggcaccagctccaagggct

SEQ ID NO: 217315 - DNA, 24 bp, Artificial Sequence
  Description of Artificial Sequence: Synthetic oligonucleotide
gcaacggcaccagctccaagggct

SEQ ID NO: 217316 - DNA, 24 bp, Artificial Sequence
  Description of Artificial Sequence: Synthetic oligonucleotide
caacggcaccagctccaagggctc

SEQ ID NO: 217317 - DNA, 24 bp, Artificial Sequence
  Description of Artificial Sequence: Synthetic oligonucleotide
aacggcaccagctccaagggctcc

SEQ ID NO: 217318 - DNA, 23 bp, Artificial Sequence
  Description of Artificial Sequence: Synthetic oligonucleotide
acggcaccagctccaagggctcc

SEQ ID NO: 217319 - DNA, 22 bp, Artificial Sequence
  Description of Artificial Sequence: Synthetic oligonucleotide
cggcaccagctccaagggctcc

SEQ ID NO: 217320 - DNA, 23 bp, Artificial Sequence
  Description of Artificial Sequence: Synthetic oligonucleotide
ggcaccagctccaagggctccga

SEQ ID NO: 217321 - DNA, 23 bp, Artificial Sequence
  Description of Artificial Sequence: Synthetic oligonucleotide
gcaccagctccaagggctccgac

SEQ ID NO: 217322 - DNA, 24 bp, Artificial Sequence
  Description of Artificial Sequence: Synthetic oligonucleotide
caccagctccaagggctccgacca

SEQ ID NO: 217323 - DNA, 24 bp, Artificial Sequence
  Description of Artificial Sequence: Synthetic oligonucleotide
accagctccaagggctccgaccag

SEQ ID NO: 217324 - DNA, 23 bp, Artificial Sequence
  Description of Artificial Sequence: Synthetic oligonucleotide
ccagctccaagggctccgaccag

SEQ ID NO: 217325 - DNA, 23 bp, Artificial Sequence
  Description of Artificial Sequence: Synthetic oligonucleotide
cagctccaagggctccgaccagg

SEQ ID NO: 217326 - DNA, 23 bp, Artificial Sequence
  Description of Artificial Sequence: Synthetic oligonucleotide
agctccaagggctccgaccaggc

SEQ ID NO: 217327 - DNA, 22 bp, Artificial Sequence
  Description of Artificial Sequence: Synthetic oligonucleotide
gctccaagggctccgaccaggc

SEQ ID NO: 217328 - DNA, 24 bp, Artificial Sequence
  Description of Artificial Sequence: Synthetic oligonucleotide
ctccaagggctccgaccaggccat

SEQ ID NO: 217329 - DNA, 26 bp, Artificial Sequence
  Description of Artificial Sequence: Synthetic oligonucleotide
tccaagggctccgaccaggccatcat

SEQ ID NO: 217330 - DNA, 25 bp, Artificial Sequence
  Description of Artificial Sequence: Synthetic oligonucleotide
ccaagggctccgaccaggccatcat

SEQ ID NO: 217331 - DNA, 26 bp, Artificial Sequence
  Description of Artificial Sequence: Synthetic oligonucleotide
caagggctccgaccaggccatcatca

SEQ ID NO: 217332 - DNA, 26 bp, Artificial Sequence
  Description of Artificial Sequence: Synthetic oligonucleotide
aagggctccgaccaggccatcatcac

SEQ ID NO: 217333 - DNA, 25 bp, Artificial Sequence
  Description of Artificial Sequence: Synthetic oligonucleotide
agggctccgaccaggccatcatcac

SEQ ID NO: 217334 - DNA, 24 bp, Artificial Sequence
  Description of Artificial Sequence: Synthetic oligonucleotide
gggctccgaccaggccatcatcac

SEQ ID NO: 217335 - DNA, 24 bp, Artificial Sequence
  Description of Artificial Sequence: Synthetic oligonucleotide
ggctccgaccaggccatcatcacg

SEQ ID NO: 217336 - DNA, 25 bp, Artificial Sequence
  Description of Artificial Sequence: Synthetic oligonucleotide
gctccgaccaggccatcatcacgct

SEQ ID NO: 217337 - DNA, 25 bp, Artificial Sequence
  Description of Artificial Sequence: Synthetic oligonucleotide
ctccgaccaggccatcatcacgctc

SEQ ID NO: 217338 - DNA, 25 bp, Artificial Sequence
  Description of Artificial Sequence: Synthetic oligonucleotide
tccgaccaggccatcatcacgctcc

SEQ ID NO: 217339 - DNA, 24 bp, Artificial Sequence
  Description of Artificial Sequence: Synthetic oligonucleotide
ccgaccaggccatcatcacgctcc

SEQ ID NO: 217340 - DNA, 24 bp, Artificial Sequence
  Description of Artificial Sequence: Synthetic oligonucleotide
cgaccaggccatcatcacgctccg

SEQ ID NO: 217341 - DNA, 24 bp, Artificial Sequence
  Description of Artificial Sequence: Synthetic oligonucleotide
gaccaggccatcatcacgctccgc

SEQ ID NO: 217342 - DNA, 25 bp, Artificial Sequence
  Description of Artificial Sequence: Synthetic oligonucleotide
accaggccatcatcacgctccgcgt

SEQ ID NO: 217343 - DNA, 24 bp, Artificial Sequence
  Description of Artificial Sequence: Synthetic oligonucleotide
ccaggccatcatcacgctccgcgt

SEQ ID NO: 217344 - DNA, 24 bp, Artificial Sequence
  Description of Artificial Sequence: Synthetic oligonucleotide
caggccatcatcacgctccgcgtg

SEQ ID NO: 217345 - DNA, 24 bp, Artificial Sequence
  Description of Artificial Sequence: Synthetic oligonucleotide
aggccatcatcacgctccgcgtgc

SEQ ID NO: 217346 - DNA, 23 bp, Artificial Sequence
  Description of Artificial Sequence: Synthetic oligonucleotide
ggccatcatcacgctccgcgtgc

SEQ ID NO: 217347 - DNA, 23 bp, Artificial Sequence
  Description of Artificial Sequence: Synthetic oligonucleotide
gccatcatcacgctccgcgtgcg

SEQ ID NO: 217348 - DNA, 24 bp, Artificial Sequence
  Description of Artificial Sequence: Synthetic oligonucleotide
ccatcatcacgctccgcgtgcgca

SEQ ID NO: 217349 - DNA, 24 bp, Artificial Sequence
  Description of Artificial Sequence: Synthetic oligonucleotide
catcatcacgctccgcgtgcgcag

SEQ ID NO: 217350 - DNA, 24 bp, Artificial Sequence
  Description of Artificial Sequence: Synthetic oligonucleotide
atcatcacgctccgcgtgcgcagc

SEQ ID NO: 217351 - DNA, 23 bp, Artificial Sequence
  Description of Artificial Sequence: Synthetic oligonucleotide
tcatcacgctccgcgtgcgcagc

SEQ ID NO: 217352 - DNA, 22 bp, Artificial Sequence
  Description of Artificial Sequence: Synthetic oligonucleotide
catcacgctccgcgtgcgcagc

SEQ ID NO: 217353 - DNA, 23 bp, Artificial Sequence
  Description of Artificial Sequence: Synthetic oligonucleotide
atcacgctccgcgtgcgcagcca

SEQ ID NO: 217354 - DNA, 22 bp, Artificial Sequence
  Description of Artificial Sequence: Synthetic oligonucleotide
tcacgctccgcgtgcgcagcca

SEQ ID NO: 217355 - DNA, 21 bp, Artificial Sequence
  Description of Artificial Sequence: Synthetic oligonucleotide
cacgctccgcgtgcgcagcca

SEQ ID NO: 217356 - DNA, 21 bp, Artificial Sequence
  Description of Artificial Sequence: Synthetic oligonucleotide
acgctccgcgtgcgcagccac

SEQ ID NO: 217357 - DNA, 20 bp, Artificial Sequence
  Description of Artificial Sequence: Synthetic oligonucleotide
cgctccgcgtgcgcagccac

SEQ ID NO: 217358 - DNA, 21 bp, Artificial Sequence
  Description of Artificial Sequence: Synthetic oligonucleotide
gctccgcgtgcgcagccacct

SEQ ID NO: 217359 - DNA, 21 bp, Artificial Sequence
  Description of Artificial Sequence: Synthetic oligonucleotide
ctccgcgtgcgcagccacctg

SEQ ID NO: 217360 - DNA, 21 bp, Artificial Sequence
  Description of Artificial Sequence: Synthetic oligonucleotide
tccgcgtgcgcagccacctgg

SEQ ID NO: 217361 - DNA, 20 bp, Artificial Sequence
  Description of Artificial Sequence: Synthetic oligonucleotide
ccgcgtgcgcagccacctgg

SEQ ID NO: 217362 - DNA, 20 bp, Artificial Sequence
  Description of Artificial Sequence: Synthetic oligonucleotide
cgcgtgcgcagccacctggc

SEQ ID NO: 217363 - DNA, 20 bp, Artificial Sequence
  Description of Artificial Sequence: Synthetic oligonucleotide
gcgtgcgcagccacctggcc

SEQ ID NO: 217364 - DNA, 20 bp, Artificial Sequence
  Description of Artificial Sequence: Synthetic oligonucleotide
cgtgcgcagccacctggccg

SEQ ID NO: 217365 - DNA, 20 bp, Artificial Sequence
  Description of Artificial Sequence: Synthetic oligonucleotide
gtgcgcagccacctggccgc

SEQ ID NO: 217366 - DNA, 20 bp, Artificial Sequence
  Description of Artificial Sequence: Synthetic oligonucleotide
tgcgcagccacctggccgcc

SEQ ID NO: 217367 - DNA, 20 bp, Artificial Sequence
  Description of Artificial Sequence: Synthetic oligonucleotide
gcgcagccacctggccgcct

SEQ ID NO: 217368 - DNA, 20 bp, Artificial Sequence
  Description of Artificial Sequence: Synthetic oligonucleotide
cgcagccacctggccgccct

SEQ ID NO: 217369 - DNA, 21 bp, Artificial Sequence
  Description of Artificial Sequence: Synthetic oligonucleotide
gcagccacctggccgccctct

SEQ ID NO: 217370 - DNA, 21 bp, Artificial Sequence
  Description of Artificial Sequence: Synthetic oligonucleotide
cagccacctggccgccctctg

SEQ ID NO: 217371 - DNA, 21 bp, Artificial Sequence
  Description of Artificial Sequence: Synthetic oligonucleotide
agccacctggccgccctctgg

SEQ ID NO: 217372 - DNA, 20 bp, Artificial Sequence
  Description of Artificial Sequence: Synthetic oligonucleotide
gccacctggccgccctctgg

SEQ ID NO: 217373 - DNA, 20 bp, Artificial Sequence
  Description of Artificial Sequence: Synthetic oligonucleotide
ccacctggccgccctctggc

SEQ ID NO: 217374 - DNA, 20 bp, Artificial Sequence
  Description of Artificial Sequence: Synthetic oligonucleotide
cacctggccgccctctggcc

SEQ ID NO: 217375 - DNA, 22 bp, Artificial Sequence
  Description of Artificial Sequence: Synthetic oligonucleotide
acctggccgccctctggccctt

SEQ ID NO: 217376 - DNA, 21 bp, Artificial Sequence
  Description of Artificial Sequence: Synthetic oligonucleotide
cctggccgccctctggccctt

SEQ ID NO: 217377 - DNA, 21 bp, Artificial Sequence
  Description of Artificial Sequence: Synthetic oligonucleotide
ctggccgccctctggcccttc

SEQ ID NO: 217378 - DNA, 22 bp, Artificial Sequence
  Description of Artificial Sequence: Synthetic oligonucleotide
tggccgccctctggcccttcct

SEQ ID NO: 217379 - DNA, 21 bp, Artificial Sequence
  Description of Artificial Sequence: Synthetic oligonucleotide
ggccgccctctggcccttcct

SEQ ID NO: 217380 - DNA, 21 bp, Artificial Sequence
  Description of Artificial Sequence: Synthetic oligonucleotide
gccgccctctggcccttcctg

SEQ ID NO: 217381 - DNA, 21 bp, Artificial Sequence
  Description of Artificial Sequence: Synthetic oligonucleotide
ccgccctctggcccttcctgg

SEQ ID NO: 217382 - DNA, 21 bp, Artificial Sequence
  Description of Artificial Sequence: Synthetic oligonucleotide
cgccctctggcccttcctggg

SEQ ID NO: 217383 - DNA, 23 bp, Artificial Sequence
  Description of Artificial Sequence: Synthetic oligonucleotide
gccctctggcccttcctgggcat

SEQ ID NO: 217384 - DNA, 23 bp, Artificial Sequence
  Description of Artificial Sequence: Synthetic oligonucleotide
ccctctggcccttcctgggcatc

SEQ ID NO: 217385 - DNA, 24 bp, Artificial Sequence
  Description of Artificial Sequence: Synthetic oligonucleotide
cctctggcccttcctgggcatcgt

SEQ ID NO: 217386 - DNA, 24 bp, Artificial Sequence
  Description of Artificial Sequence: Synthetic oligonucleotide
ctctggcccttcctgggcatcgtg

SEQ ID NO: 217387 - DNA, 24 bp, Artificial Sequence
  Description of Artificial Sequence: Synthetic oligonucleotide
tctggcccttcctgggcatcgtgg

SEQ ID NO: 217388 - DNA, 23 bp, Artificial Sequence
  Description of Artificial Sequence: Synthetic oligonucleotide
ctggcccttcctgggcatcgtgg

SEQ ID NO: 217389 - DNA, 24 bp, Artificial Sequence
  Description of Artificial Sequence: Synthetic oligonucleotide
tggcccttcctgggcatcgtggct

SEQ ID NO: 217390 - DNA, 23 bp, Artificial Sequence
  Description of Artificial Sequence: Synthetic oligonucleotide
ggcccttcctgggcatcgtggct

SEQ ID NO: 217391 - DNA, 24 bp, Artificial Sequence
  Description of Artificial Sequence: Synthetic oligonucleotide
gcccttcctgggcatcgtggctga

SEQ ID NO: 217392 - DNA, 24 bp, Artificial Sequence
  Description of Artificial Sequence: Synthetic oligonucleotide
cccttcctgggcatcgtggctgag

SEQ ID NO: 217393 - DNA, 25 bp, Artificial Sequence
  Description of Artificial Sequence: Synthetic oligonucleotide
ccttcctgggcatcgtggctgaggt

SEQ ID NO: 217394 - DNA, 25 bp, Artificial Sequence
  Description of Artificial Sequence: Synthetic oligonucleotide
cttcctgggcatcgtggctgaggtg

SEQ ID NO: 217395 - DNA, 26 bp, Artificial Sequence
  Description of Artificial Sequence: Synthetic oligonucleotide
ttcctgggcatcgtggctgaggtgct

SEQ ID NO: 217396 - DNA, 25 bp, Artificial Sequence
  Description of Artificial Sequence: Synthetic oligonucleotide
tcctgggcatcgtggctgaggtgct

SEQ ID NO: 217397 - DNA, 24 bp, Artificial Sequence
  Description of Artificial Sequence: Synthetic oligonucleotide
cctgggcatcgtggctgaggtgct

SEQ ID NO: 217398 - DNA, 24 bp, Artificial Sequence
  Description of Artificial Sequence: Synthetic oligonucleotide
ctgggcatcgtggctgaggtgctg

SEQ ID NO: 217399 - DNA, 25 bp, Artificial Sequence
  Description of Artificial Sequence: Synthetic oligonucleotide
tgggcatcgtggctgaggtgctggt

SEQ ID NO: 217400 - DNA, 24 bp, Artificial Sequence
  Description of Artificial Sequence: Synthetic oligonucleotide
gggcatcgtggctgaggtgctggt

SEQ ID NO: 217401 - DNA, 24 bp, Artificial Sequence
  Description of Artificial Sequence: Synthetic oligonucleotide
ggcatcgtggctgaggtgctggtg

SEQ ID NO: 217402 - DNA, 25 bp, Artificial Sequence
  Description of Artificial Sequence: Synthetic oligonucleotide
gcatcgtggctgaggtgctggtgct

SEQ ID NO: 217403 - DNA, 25 bp, Artificial Sequence
  Description of Artificial Sequence: Synthetic oligonucleotide
catcgtggctgaggtgctggtgctg

SEQ ID NO: 217404 - DNA, 26 bp, Artificial Sequence
  Description of Artificial Sequence: Synthetic oligonucleotide
atcgtggctgaggtgctggtgctggt

SEQ ID NO: 217405 - DNA, 25 bp, Artificial Sequence
  Description of Artificial Sequence: Synthetic oligonucleotide
tcgtggctgaggtgctggtgctggt

SEQ ID NO: 217406 - DNA, 24 bp, Artificial Sequence
  Description of Artificial Sequence: Synthetic oligonucleotide
cgtggctgaggtgctggtgctggt

SEQ ID NO: 217407 - DNA, 25 bp, Artificial Sequence
  Description of Artificial Sequence: Synthetic oligonucleotide
gtggctgaggtgctggtgctggtca

SEQ ID NO: 217408 - DNA, 25 bp, Artificial Sequence
  Description of Artificial Sequence: Synthetic oligonucleotide
tggctgaggtgctggtgctggtcac

SEQ ID NO: 217409 - DNA, 24 bp, Artificial Sequence
  Description of Artificial Sequence: Synthetic oligonucleotide
ggctgaggtgctggtgctggtcac

SEQ ID NO: 217410 - DNA, 26 bp, Artificial Sequence
  Description of Artificial Sequence: Synthetic oligonucleotide
gctgaggtgctggtgctggtcaccat

SEQ ID NO: 217411 - DNA, 27 bp, Artificial Sequence
  Description of Artificial Sequence: Synthetic oligonucleotide
ctgaggtgctggtgctggtcaccatca

SEQ ID NO: 217412 - DNA, 28 bp, Artificial Sequence
  Description of Artificial Sequence: Synthetic oligonucleotide
tgaggtgctggtgctggtcaccatcatc

SEQ ID NO: 217413 - DNA, 27 bp, Artificial Sequence
  Description of Artificial Sequence: Synthetic oligonucleotide
gaggtgctggtgctggtcaccatcatc

SEQ ID NO: 217414 - DNA, 29 bp, Artificial Sequence
  Description of Artificial Sequence: Synthetic oligonucleotide
aggtgctggtgctggtcaccatcatcttc

SEQ ID NO: 217415 - DNA, 28 bp, Artificial Sequence
  Description of Artificial Sequence: Synthetic oligonucleotide
ggtgctggtgctggtcaccatcatcttc

SEQ ID NO: 217416 - DNA, 30 bp, Artificial Sequence
  Description of Artificial Sequence: Synthetic oligonucleotide
gtgctggtgctggtcaccatcatcttcatc

SEQ ID NO: 217417 - DNA, 32 bp, Artificial Sequence
  Description of Artificial Sequence: Synthetic oligonucleotide
tgctggtgctggtcaccatcatcttcatctac

SEQ ID NO: 217418 - DNA, 31 bp, Artificial Sequence
  Description of Artificial Sequence: Synthetic oligonucleotide
gctggtgctggtcaccatcatcttcatctac

SEQ ID NO: 217419 - DNA, 31 bp, Artificial Sequence
  Description of Artificial Sequence: Synthetic oligonucleotide
ctggtgctggtcaccatcatcttcatctacg

SEQ ID NO: 217420 - DNA, 32 bp, Artificial Sequence
  Description of Artificial Sequence: Synthetic oligonucleotide
tggtgctggtcaccatcatcttcatctacgag

SEQ ID NO: 217421 - DNA, 31 bp, Artificial Sequence
  Description of Artificial Sequence: Synthetic oligonucleotide
ggtgctggtcaccatcatcttcatctacgag

SEQ ID NO: 217422 - DNA, 33 bp, Artificial Sequence
  Description of Artificial Sequence: Synthetic oligonucleotide
gtgctggtcaccatcatcttcatctacgagaag

SEQ ID NO: 217423 - DNA, 33 bp, Artificial Sequence
  Description of Artificial Sequence: Synthetic oligonucleotide
tgctggtcaccatcatcttcatctacgagaagc

SEQ ID NO: 217424 - DNA, 32 bp, Artificial Sequence
  Description of Artificial Sequence: Synthetic oligonucleotide
gctggtcaccatcatcttcatctacgagaagc

SEQ ID NO: 217425 - DNA, 32 bp, Artificial Sequence
  Description of Artificial Sequence: Synthetic oligonucleotide
ctggtcaccatcatcttcatctacgagaagcg

SEQ ID NO: 217426 - DNA, 32 bp, Artificial Sequence
  Description of Artificial Sequence: Synthetic oligonucleotide
tggtcaccatcatcttcatctacgagaagcgc

SEQ ID NO: 217427 - DNA, 31 bp, Artificial Sequence
  Description of Artificial Sequence: Synthetic oligonucleotide
ggtcaccatcatcttcatctacgagaagcgc

SEQ ID NO: 217428 - DNA, 31 bp, Artificial Sequence
  Description of Artificial Sequence: Synthetic oligonucleotide
gtcaccatcatcttcatctacgagaagcgcc

SEQ ID NO: 217429 - DNA, 31 bp, Artificial Sequence
  Description of Artificial Sequence: Synthetic oligonucleotide
tcaccatcatcttcatctacgagaagcgccg

SEQ ID NO: 217430 - DNA, 30 bp, Artificial Sequence
  Description of Artificial Sequence: Synthetic oligonucleotide
caccatcatcttcatctacgagaagcgccg

SEQ ID NO: 217431 - DNA, 30 bp, Artificial Sequence
  Description of Artificial Sequence: Synthetic oligonucleotide
accatcatcttcatctacgagaagcgccgg

SEQ ID NO: 217432 - DNA, 29 bp, Artificial Sequence
  Description of Artificial Sequence: Synthetic oligonucleotide
ccatcatcttcatctacgagaagcgccgg

SEQ ID NO: 217433 - DNA, 31 bp, Artificial Sequence
  Description of Artificial Sequence: Synthetic oligonucleotide
catcatcttcatctacgagaagcgccggaag

SEQ ID NO: 217434 - DNA, 31 bp, Artificial Sequence
  Description of Artificial Sequence: Synthetic oligonucleotide
atcatcttcatctacgagaagcgccggaagc

SEQ ID NO: 217435 - DNA, 30 bp, Artificial Sequence
  Description of Artificial Sequence: Synthetic oligonucleotide
tcatcttcatctacgagaagcgccggaagc

SEQ ID NO: 217436 - DNA, 29 bp, Artificial Sequence
  Description of Artificial Sequence: Synthetic oligonucleotide
catcttcatctacgagaagcgccggaagc

SEQ ID NO: 217437 - DNA, 29 bp, Artificial Sequence
  Description of Artificial Sequence: Synthetic oligonucleotide
atcttcatctacgagaagcgccggaagcc

SEQ ID NO: 217438 - DNA, 28 bp, Artificial Sequence
  Description of Artificial Sequence: Synthetic oligonucleotide
tcttcatctacgagaagcgccggaagcc

SEQ ID NO: 217439 - DNA, 27 bp, Artificial Sequence
  Description of Artificial Sequence: Synthetic oligonucleotide
cttcatctacgagaagcgccggaagcc

SEQ ID NO: 217440 - DNA, 27 bp, Artificial Sequence
  Description of Artificial Sequence: Synthetic oligonucleotide
ttcatctacgagaagcgccggaagccc

SEQ ID NO: 217441 - DNA, 26 bp, Artificial Sequence
  Description of Artificial Sequence: Synthetic oligonucleotide
tcatctacgagaagcgccggaagccc

SEQ ID NO: 217442 - DNA, 25 bp, Artificial Sequence
  Description of Artificial Sequence: Synthetic oligonucleotide
catctacgagaagcgccggaagccc

SEQ ID NO: 217443 - DNA, 26 bp, Artificial Sequence
  Description of Artificial Sequence: Synthetic oligonucleotide
atctacgagaagcgccggaagcccga

SEQ ID NO: 217444 - DNA, 25 bp, Artificial Sequence
  Description of Artificial Sequence: Synthetic oligonucleotide
tctacgagaagcgccggaagcccga

SEQ ID NO: 217445 - DNA, 24 bp, Artificial Sequence
  Description of Artificial Sequence: Synthetic oligonucleotide
ctacgagaagcgccggaagcccga

SEQ ID NO: 217446 - DNA, 24 bp, Artificial Sequence
  Description of Artificial Sequence: Synthetic oligonucleotide
tacgagaagcgccggaagcccgag

SEQ ID NO: 217447 - DNA, 23 bp, Artificial Sequence
  Description of Artificial Sequence: Synthetic oligonucleotide
acgagaagcgccggaagcccgag

SEQ ID NO: 217448 - DNA, 22 bp, Artificial Sequence
  Description of Artificial Sequence: Synthetic oligonucleotide
cgagaagcgccggaagcccgag

SEQ ID NO: 217449 - DNA, 23 bp, Artificial Sequence
  Description of Artificial Sequence: Synthetic oligonucleotide
gagaagcgccggaagcccgagga

SEQ ID NO: 217450 - DNA, 23 bp, Artificial Sequence
  Description of Artificial Sequence: Synthetic oligonucleotide
agaagcgccggaagcccgaggac

SEQ ID NO: 217451 - DNA, 22 bp, Artificial Sequence
  Description of Artificial Sequence: Synthetic oligonucleotide
gaagcgccggaagcccgaggac

SEQ ID NO: 217452 - DNA, 23 bp, Artificial Sequence
  Description of Artificial Sequence: Synthetic oligonucleotide
aagcgccggaagcccgaggacgt

SEQ ID NO: 217453 - DNA, 22 bp, Artificial Sequence
  Description of Artificial Sequence: Synthetic oligonucleotide
agcgccggaagcccgaggacgt

SEQ ID NO: 217454 - DNA, 21 bp, Artificial Sequence
  Description of Artificial Sequence: Synthetic oligonucleotide
gcgccggaagcccgaggacgt

SEQ ID NO: 217455 - DNA, 21 bp, Artificial Sequence
  Description of Artificial Sequence: Synthetic oligonucleotide
cgccggaagcccgaggacgtc

SEQ ID NO: 217456 - DNA, 22 bp, Artificial Sequence
  Description of Artificial Sequence: Synthetic oligonucleotide
gccggaagcccgaggacgtcct

SEQ ID NO: 217457 - DNA, 22 bp, Artificial Sequence
  Description of Artificial Sequence: Synthetic oligonucleotide
ccggaagcccgaggacgtcctg

SEQ ID NO: 217458 - DNA, 24 bp, Artificial Sequence
  Description of Artificial Sequence: Synthetic oligonucleotide
cggaagcccgaggacgtcctggat

SEQ ID NO: 217459 - DNA, 26 bp, Artificial Sequence
  Description of Artificial Sequence: Synthetic oligonucleotide
ggaagcccgaggacgtcctggatgat

SEQ ID NO: 217460 - DNA, 27 bp, Artificial Sequence
  Description of Artificial Sequence: Synthetic oligonucleotide
gaagcccgaggacgtcctggatgatga

SEQ ID NO: 217461 - DNA, 27 bp, Artificial Sequence
  Description of Artificial Sequence: Synthetic oligonucleotide
aagcccgaggacgtcctggatgatgac

SEQ ID NO: 217462 - DNA, 26 bp, Artificial Sequence
  Description of Artificial Sequence: Synthetic oligonucleotide
agcccgaggacgtcctggatgatgac

SEQ ID NO: 217463 - DNA, 25 bp, Artificial Sequence
  Description of Artificial Sequence: Synthetic oligonucleotide
gcccgaggacgtcctggatgatgac

SEQ ID NO: 217464 - DNA, 26 bp, Artificial Sequence
  Description of Artificial Sequence: Synthetic oligonucleotide
cccgaggacgtcctggatgatgacga

SEQ ID NO: 217465 - DNA, 26 bp, Artificial Sequence
  Description of Artificial Sequence: Synthetic oligonucleotide
ccgaggacgtcctggatgatgacgac

SEQ ID NO: 217466 - DNA, 26 bp, Artificial Sequence
  Description of Artificial Sequence: Synthetic oligonucleotide
cgaggacgtcctggatgatgacgacg

SEQ ID NO: 217467 - DNA, 26 bp, Artificial Sequence
  Description of Artificial Sequence: Synthetic oligonucleotide
gaggacgtcctggatgatgacgacgc

SEQ ID NO: 217468 - DNA, 26 bp, Artificial Sequence
  Description of Artificial Sequence: Synthetic oligonucleotide
aggacgtcctggatgatgacgacgcc

SEQ ID NO: 217469 - DNA, 25 bp, Artificial Sequence
  Description of Artificial Sequence: Synthetic oligonucleotide
ggacgtcctggatgatgacgacgcc

SEQ ID NO: 217470 - DNA, 25 bp, Artificial Sequence
  Description of Artificial Sequence: Synthetic oligonucleotide
gacgtcctggatgatgacgacgccg

SEQ ID NO: 217471 - DNA, 25 bp, Artificial Sequence
  Description of Artificial Sequence: Synthetic oligonucleotide
acgtcctggatgatgacgacgccgg

SEQ ID NO: 217472 - DNA, 24 bp, Artificial Sequence
  Description of Artificial Sequence: Synthetic oligonucleotide
cgtcctggatgatgacgacgccgg

SEQ ID NO: 217473 - DNA, 25 bp, Artificial Sequence
  Description of Artificial Sequence: Synthetic oligonucleotide
gtcctggatgatgacgacgccggct

SEQ ID NO: 217474 - DNA, 26 bp, Artificial Sequence
  Description of Artificial Sequence: Synthetic oligonucleotide
tcctggatgatgacgacgccggctct

SEQ ID NO: 217475 - DNA, 25 bp, Artificial Sequence
  Description of Artificial Sequence: Synthetic oligonucleotide
cctggatgatgacgacgccggctct

SEQ ID NO: 217476 - DNA, 25 bp, Artificial Sequence
  Description of Artificial Sequence: Synthetic oligonucleotide
ctggatgatgacgacgccggctctg

SEQ ID NO: 217477 - DNA, 26 bp, Artificial Sequence
  Description of Artificial Sequence: Synthetic oligonucleotide
tggatgatgacgacgccggctctgca

SEQ ID NO: 217478 - DNA, 25 bp, Artificial Sequence
  Description of Artificial Sequence: Synthetic oligonucleotide
ggatgatgacgacgccggctctgca

SEQ ID NO: 217479 - DNA, 25 bp, Artificial Sequence
  Description of Artificial Sequence: Synthetic oligonucleotide
gatgatgacgacgccggctctgcac

SEQ ID NO: 217480 - DNA, 25 bp, Artificial Sequence
  Description of Artificial Sequence: Synthetic oligonucleotide
atgatgacgacgccggctctgcacc

SEQ ID NO: 217481 - DNA, 24 bp, Artificial Sequence
  Description of Artificial Sequence: Synthetic oligonucleotide
tgatgacgacgccggctctgcacc

SEQ ID NO: 217482 - DNA, 23 bp, Artificial Sequence
  Description of Artificial Sequence: Synthetic oligonucleotide
gatgacgacgccggctctgcacc

SEQ ID NO: 217483 - DNA, 23 bp, Artificial Sequence
  Description of Artificial Sequence: Synthetic oligonucleotide
atgacgacgccggctctgcaccc

SEQ ID NO: 217484 - DNA, 22 bp, Artificial Sequence
  Description of Artificial Sequence: Synthetic oligonucleotide
tgacgacgccggctctgcaccc

SEQ ID NO: 217485 - DNA, 21 bp, Artificial Sequence
  Description of Artificial Sequence: Synthetic oligonucleotide
gacgacgccggctctgcaccc

SEQ ID NO: 217486 - DNA, 22 bp, Artificial Sequence
  Description of Artificial Sequence: Synthetic oligonucleotide
acgacgccggctctgcacccct

SEQ ID NO: 217487 - DNA, 21 bp, Artificial Sequence
  Description of Artificial Sequence: Synthetic oligonucleotide
cgacgccggctctgcacccct

SEQ ID NO: 217488 - DNA, 23 bp, Artificial Sequence
  Description of Artificial Sequence: Synthetic oligonucleotide
gacgccggctctgcacccctgaa

SEQ ID NO: 217489 - DNA, 24 bp, Artificial Sequence
  Description of Artificial Sequence: Synthetic oligonucleotide
acgccggctctgcacccctgaaga

SEQ ID NO: 217490 - DNA, 23 bp, Artificial Sequence
  Description of Artificial Sequence: Synthetic oligonucleotide
cgccggctctgcacccctgaaga

SEQ ID NO: 217491 - DNA, 23 bp, Artificial Sequence
  Description of Artificial Sequence: Synthetic oligonucleotide
gccggctctgcacccctgaagag

SEQ ID NO: 217492 - DNA, 24 bp, Artificial Sequence
  Description of Artificial Sequence: Synthetic oligonucleotide
ccggctctgcacccctgaagagca

SEQ ID NO: 217493 - DNA, 24 bp, Artificial Sequence
  Description of Artificial Sequence: Synthetic oligonucleotide
cggctctgcacccctgaagagcag

SEQ ID NO: 217494 - DNA, 24 bp, Artificial Sequence
  Description of Artificial Sequence: Synthetic oligonucleotide
ggctctgcacccctgaagagcagc

SEQ ID NO: 217495 - DNA, 24 bp, Artificial Sequence
  Description of Artificial Sequence: Synthetic oligonucleotide
gctctgcacccctgaagagcagcg

SEQ ID NO: 217496 - DNA, 24 bp, Artificial Sequence
  Description of Artificial Sequence: Synthetic oligonucleotide
ctctgcacccctgaagagcagcgg

SEQ ID NO: 217497 - DNA, 24 bp, Artificial Sequence
  Description of Artificial Sequence: Synthetic oligonucleotide
tctgcacccctgaagagcagcggg

SEQ ID NO: 217498 - DNA, 23 bp, Artificial Sequence
  Description of Artificial Sequence: Synthetic oligonucleotide
ctgcacccctgaagagcagcggg

SEQ ID NO: 217499 - DNA, 24 bp, Artificial Sequence
  Description of Artificial Sequence: Synthetic oligonucleotide
tgcacccctgaagagcagcgggca

SEQ ID NO: 217500 - DNA, 23 bp, Artificial Sequence
  Description of Artificial Sequence: Synthetic oligonucleotide
gcacccctgaagagcagcgggca

SEQ ID NO: 217501 - DNA, 23 bp, Artificial Sequence
  Description of Artificial Sequence: Synthetic oligonucleotide
cacccctgaagagcagcgggcag

SEQ ID NO: 217502 - DNA, 24 bp, Artificial Sequence
  Description of Artificial Sequence: Synthetic oligonucleotide
acccctgaagagcagcgggcagca

SEQ ID NO: 217503 - DNA, 23 bp, Artificial Sequence
  Description of Artificial Sequence: Synthetic oligonucleotide
cccctgaagagcagcgggcagca

SEQ ID NO: 217504 - DNA, 23 bp, Artificial Sequence
  Description of Artificial Sequence: Synthetic oligonucleotide
ccctgaagagcagcgggcagcac

SEQ ID NO: 217505 - DNA, 24 bp, Artificial Sequence
  Description of Artificial Sequence: Synthetic oligonucleotide
cctgaagagcagcgggcagcacca

SEQ ID NO: 217506 - DNA, 27 bp, Artificial Sequence
  Description of Artificial Sequence: Synthetic oligonucleotide
ctgaagagcagcgggcagcaccagaat

SEQ ID NO: 217507 - DNA, 27 bp, Artificial Sequence
  Description of Artificial Sequence: Synthetic oligonucleotide
tgaagagcagcgggcagcaccagaatg

SEQ ID NO: 217508 - DNA, 27 bp, Artificial Sequence
  Description of Artificial Sequence: Synthetic oligonucleotide
gaagagcagcgggcagcaccagaatga

SEQ ID NO: 217509 - DNA, 27 bp, Artificial Sequence
  Description of Artificial Sequence: Synthetic oligonucleotide
aagagcagcgggcagcaccagaatgac

SEQ ID NO: 217510 - DNA, 27 bp, Artificial Sequence
  Description of Artificial Sequence: Synthetic oligonucleotide
agagcagcgggcagcaccagaatgaca

SEQ ID NO: 217511 - DNA, 27 bp, Artificial Sequence
  Description of Artificial Sequence: Synthetic oligonucleotide
gagcagcgggcagcaccagaatgacaa

SEQ ID NO: 217512 - DNA, 28 bp, Artificial Sequence
  Description of Artificial Sequence: Synthetic oligonucleotide
agcagcgggcagcaccagaatgacaaag

SEQ ID NO: 217513 - DNA, 27 bp, Artificial Sequence
  Description of Artificial Sequence: Synthetic oligonucleotide
gcagcgggcagcaccagaatgacaaag

SEQ ID NO: 217514 - DNA, 27 bp, Artificial Sequence
  Description of Artificial Sequence: Synthetic oligonucleotide
cagcgggcagcaccagaatgacaaagg

SEQ ID NO: 217515 - DNA, 27 bp, Artificial Sequence
  Description of Artificial Sequence: Synthetic oligonucleotide
agcgggcagcaccagaatgacaaaggc

SEQ ID NO: 217516 - DNA, 27 bp, Artificial Sequence
  Description of Artificial Sequence: Synthetic oligonucleotide
gcgggcagcaccagaatgacaaaggca

SEQ ID NO: 217517 - DNA, 28 bp, Artificial Sequence
  Description of Artificial Sequence: Synthetic oligonucleotide
cgggcagcaccagaatgacaaaggcaag

SEQ ID NO: 217518 - DNA, 30 bp, Artificial Sequence
  Description of Artificial Sequence: Synthetic oligonucleotide
gggcagcaccagaatgacaaaggcaagaac

SEQ ID NO: 217519 - DNA, 30 bp, Artificial Sequence
  Description of Artificial Sequence: Synthetic oligonucleotide
ggcagcaccagaatgacaaaggcaagaacg

SEQ ID NO: 217520 - DNA, 31 bp, Artificial Sequence
  Description of Artificial Sequence: Synthetic oligonucleotide
gcagcaccagaatgacaaaggcaagaacgtc

SEQ ID NO: 217521 - DNA, 31 bp, Artificial Sequence
  Description of Artificial Sequence: Synthetic oligonucleotide
cagcaccagaatgacaaaggcaagaacgtcc

SEQ ID NO: 217522 - DNA, 31 bp, Artificial Sequence
  Description of Artificial Sequence: Synthetic oligonucleotide
agcaccagaatgacaaaggcaagaacgtccg

SEQ ID NO: 217523 - DNA, 30 bp, Artificial Sequence
  Description of Artificial Sequence: Synthetic oligonucleotide
gcaccagaatgacaaaggcaagaacgtccg

SEQ ID NO: 217524 - DNA, 30 bp, Artificial Sequence
  Description of Artificial Sequence: Synthetic oligonucleotide
caccagaatgacaaaggcaagaacgtccgc

SEQ ID NO: 217525 - DNA, 30 bp, Artificial Sequence
  Description of Artificial Sequence: Synthetic oligonucleotide
accagaatgacaaaggcaagaacgtccgcc

SEQ ID NO: 217526 - DNA, 29 bp, Artificial Sequence
  Description of Artificial Sequence: Synthetic oligonucleotide
ccagaatgacaaaggcaagaacgtccgcc

SEQ ID NO: 217527 - DNA, 30 bp, Artificial Sequence
  Description of Artificial Sequence: Synthetic oligonucleotide
cagaatgacaaaggcaagaacgtccgccag

SEQ ID NO: 217528 - DNA, 31 bp, Artificial Sequence
  Description of Artificial Sequence: Synthetic oligonucleotide
agaatgacaaaggcaagaacgtccgccagag

SEQ ID NO: 217529 - DNA, 30 bp, Artificial Sequence
  Description of Artificial Sequence: Synthetic oligonucleotide
gaatgacaaaggcaagaacgtccgccagag

SEQ ID NO: 217530 - DNA, 30 bp, Artificial Sequence
  Description of Artificial Sequence: Synthetic oligonucleotide
aatgacaaaggcaagaacgtccgccagagg

SEQ ID NO: 217531 - DNA, 29 bp, Artificial Sequence
  Description of Artificial Sequence: Synthetic oligonucleotide
atgacaaaggcaagaacgtccgccagagg

SEQ ID NO: 217532 - DNA, 28 bp, Artificial Sequence
  Description of Artificial Sequence: Synthetic oligonucleotide
tgacaaaggcaagaacgtccgccagagg

SEQ ID NO: 217533 - DNA, 27 bp, Artificial Sequence
  Description of Artificial Sequence: Synthetic oligonucleotide
gacaaaggcaagaacgtccgccagagg

SEQ ID NO: 217534 - DNA, 29 bp, Artificial Sequence
  Description of Artificial Sequence: Synthetic oligonucleotide
acaaaggcaagaacgtccgccagaggaac

SEQ ID NO: 217535 - DNA, 28 bp, Artificial Sequence
  Description of Artificial Sequence: Synthetic oligonucleotide
caaaggcaagaacgtccgccagaggaac

SEQ ID NO: 217536 - DNA, 29 bp, Artificial Sequence
  Description of Artificial Sequence: Synthetic oligonucleotide
aaaggcaagaacgtccgccagaggaactc

SEQ ID NO: 217537 - DNA, 28 bp, Artificial Sequence
  Description of Artificial Sequence: Synthetic oligonucleotide
aaggcaagaacgtccgccagaggaactc

SEQ ID NO: 217538 - DNA, 27 bp, Artificial Sequence
  Description of Artificial Sequence: Synthetic oligonucleotide
aggcaagaacgtccgccagaggaactc

SEQ ID NO: 217539 - DNA, 27 bp, Artificial Sequence
  Description of Artificial Sequence: Synthetic oligonucleotide
ggcaagaacgtccgccagaggaactct

SEQ ID NO: 217540 - DNA, 28 bp, Artificial Sequence
  Description of Artificial Sequence: Synthetic oligonucleotide
gcaagaacgtccgccagaggaactcttc

SEQ ID NO: 217541 - DNA, 28 bp, Artificial Sequence
  Description of Artificial Sequence: Synthetic oligonucleotide
caagaacgtccgccagaggaactcttcc

SEQ ID NO: 217542 - DNA, 29 bp, Artificial Sequence
  Description of Artificial Sequence: Synthetic oligonucleotide
aagaacgtccgccagaggaactcttcctg

SEQ ID NO: 217543 - DNA, 28 bp, Artificial Sequence
  Description of Artificial Sequence: Synthetic oligonucleotide
agaacgtccgccagaggaactcttcctg

SEQ ID NO: 217544 - DNA, 27 bp, Artificial Sequence
  Description of Artificial Sequence: Synthetic oligonucleotide
gaacgtccgccagaggaactcttcctg

SEQ ID NO: 217545 - DNA, 20 bp, Artificial Sequence
  Description of Artificial Sequence: Synthetic oligonucleotide
agcctccggggctgccggca

SEQ ID NO: 217546 - DNA, 20 bp, Artificial Sequence
  Description of Artificial Sequence: Synthetic oligonucleotide
gcctccggggctgccggcat

SEQ ID NO: 217547 - DNA, 20 bp, Artificial Sequence
  Description of Artificial Sequence: Synthetic oligonucleotide
cctccggggctgccggcaca

SEQ ID NO: 217548 - DNA, 21 bp, Artificial Sequence
  Description of Artificial Sequence: Synthetic oligonucleotide
ctccggggctgccggcacagt

SEQ ID NO: 217549 - DNA, 23 bp, Artificial Sequence
  Description of Artificial Sequence: Synthetic oligonucleotide
tccggggctgccggcacagtctt

SEQ ID NO: 217550 - DNA, 22 bp, Artificial Sequence
  Description of Artificial Sequence: Synthetic oligonucleotide
ccggggctgccggcacagtctt

SEQ ID NO: 217551 - DNA, 23 bp, Artificial Sequence
  Description of Artificial Sequence: Synthetic oligonucleotide
cggggctgccggcacagtcttca

SEQ ID NO: 217552 - DNA, 25 bp, Artificial Sequence
  Description of Artificial Sequence: Synthetic oligonucleotide
ggggctgccggcacagtcttcacta

SEQ ID NO: 217553 - DNA, 25 bp, Artificial Sequence
  Description of Artificial Sequence: Synthetic oligonucleotide
gggctgccggcacagtcttcactac

SEQ ID NO: 217554 - DNA, 25 bp, Artificial Sequence
  Description of Artificial Sequence: Synthetic oligonucleotide
ggctgccggcacagtcttcactacc

SEQ ID NO: 217555 - DNA, 27 bp, Artificial Sequence
  Description of Artificial Sequence: Synthetic oligonucleotide
gctgccggcacagtcttcactaccgta

SEQ ID NO: 217556 - DNA, 27 bp, Artificial Sequence
  Description of Artificial Sequence: Synthetic oligonucleotide
ctgccggcacagtcttcactaccgtag

SEQ ID NO: 217557 - DNA, 29 bp, Artificial Sequence
  Description of Artificial Sequence: Synthetic oligonucleotide
tgccggcacagtcttcactaccgtagaag

SEQ ID NO: 217558 - DNA, 28 bp, Artificial Sequence
  Description of Artificial Sequence: Synthetic oligonucleotide
gccggcacagtcttcactaccgtagaag

SEQ ID NO: 217559 - DNA, 26 bp, Artificial Sequence
  Description of Artificial Sequence: Synthetic oligonucleotide
gtggggagagtactcctgcgtcttcc

SEQ ID NO: 217560 - DNA, 26 bp, Artificial Sequence
  Description of Artificial Sequence: Synthetic oligonucleotide
tggggagagtactcctgcgtcttccc

SEQ ID NO: 217561 - DNA, 25 bp, Artificial Sequence
  Description of Artificial Sequence: Synthetic oligonucleotide
ggggagagtactcctgcgtcttccc

SEQ ID NO: 217562 - DNA, 25 bp, Artificial Sequence
  Description of Artificial Sequence: Synthetic oligonucleotide
gggagagtactcctgcgtcttcccc

SEQ ID NO: 217563 - DNA, 25 bp, Artificial Sequence
  Description of Artificial Sequence: Synthetic oligonucleotide
ggagagtactcctgcgtcttccccc

SEQ ID NO: 217564 - DNA, 25 bp, Artificial Sequence
  Description of Artificial Sequence: Synthetic oligonucleotide
gagagtactcctgcgtcttcccccc

SEQ ID NO: 217565 - DNA, 25 bp, Artificial Sequence
  Description of Artificial Sequence: Synthetic oligonucleotide
agagtactcctgcgtcttccccccc

SEQ ID NO: 217566 - DNA, 24 bp, Artificial Sequence
  Description of Artificial Sequence: Synthetic oligonucleotide
gagtactcctgcgtcttccccccc

SEQ ID NO: 217567 - DNA, 25 bp, Artificial Sequence
  Description of Artificial Sequence: Synthetic oligonucleotide
agtactcctgcgtcttcccccccga

SEQ ID NO: 217568 - DNA, 24 bp, Artificial Sequence
  Description of Artificial Sequence: Synthetic oligonucleotide
gtactcctgcgtcttcccccccga

SEQ ID NO: 217569 - DNA, 24 bp, Artificial Sequence
  Description of Artificial Sequence: Synthetic oligonucleotide
tactcctgcgtcttcccccccgag

SEQ ID NO: 217570 - DNA, 23 bp, Artificial Sequence
  Description of Artificial Sequence: Synthetic oligonucleotide
actcctgcgtcttcccccccgag

SEQ ID NO: 217571 - DNA, 22 bp, Artificial Sequence
  Description of Artificial Sequence: Synthetic oligonucleotide
ctcctgcgtcttcccccccgag

SEQ ID NO: 217572 - DNA, 22 bp, Artificial Sequence
  Description of Artificial Sequence: Synthetic oligonucleotide
tcctgcgtcttcccccccgagc

SEQ ID NO: 217573 - DNA, 21 bp, Artificial Sequence
  Description of Artificial Sequence: Synthetic oligonucleotide
cctgcgtcttcccccccgagc

SEQ ID NO: 217574 - DNA, 21 bp, Artificial Sequence
  Description of Artificial Sequence: Synthetic oligonucleotide
ctgcgtcttcccccccgagcc

SEQ ID NO: 217575 - DNA, 23 bp, Artificial Sequence
  Description of Artificial Sequence: Synthetic oligonucleotide
tgcgtcttcccccccgagcccat

SEQ ID NO: 217576 - DNA, 22 bp, Artificial Sequence
  Description of Artificial Sequence: Synthetic oligonucleotide
gcgtcttcccccccgagcccat

SEQ ID NO: 217577 - DNA, 22 bp, Artificial Sequence
  Description of Artificial Sequence: Synthetic oligonucleotide
cgtcttcccccccgagcccatg

SEQ ID NO: 217578 - DNA, 22 bp, Artificial Sequence
  Description of Artificial Sequence: Synthetic oligonucleotide
gtcttcccccccgagcccatgg

SEQ ID NO: 217579 - DNA, 22 bp, Artificial Sequence
  Description of Artificial Sequence: Synthetic oligonucleotide
tcttcccccccgagcccatggg

SEQ ID NO: 217580 - DNA, 21 bp, Artificial Sequence
  Description of Artificial Sequence: Synthetic oligonucleotide
cttcccccccgagcccatggg

SEQ ID NO: 217581 - DNA, 22 bp, Artificial Sequence
  Description of Artificial Sequence: Synthetic oligonucleotide
ttcccccccgagcccatgggca

SEQ ID NO: 217582 - DNA, 21 bp, Artificial Sequence
  Description of Artificial Sequence: Synthetic oligonucleotide
tcccccccgagcccatgggca

SEQ ID NO: 217583 - DNA, 20 bp, Artificial Sequence
  Description of Artificial Sequence: Synthetic oligonucleotide
cccccccgagcccatgggca

SEQ ID NO: 217584 - DNA, 20 bp, Artificial Sequence
  Description of Artificial Sequence: Synthetic oligonucleotide
ccccccgagcccatgggcac

SEQ ID NO: 217585 - DNA, 20 bp, Artificial Sequence
  Description of Artificial Sequence: Synthetic oligonucleotide
cccccgagcccatgggcacg

SEQ ID NO: 217586 - DNA, 23 bp, Artificial Sequence
  Description of Artificial Sequence: Synthetic oligonucleotide
cacgggcctcccagagtgaaggc

SEQ ID NO: 217587 - DNA, 23 bp, Artificial Sequence
  Description of Artificial Sequence: Synthetic oligonucleotide
acgggcctcccagagtgaaggcc

SEQ ID NO: 217588 - DNA, 22 bp, Artificial Sequence
  Description of Artificial Sequence: Synthetic oligonucleotide
cgggcctcccagagtgaaggcc

SEQ ID NO: 217589 - DNA, 23 bp, Artificial Sequence
  Description of Artificial Sequence: Synthetic oligonucleotide
gggcctcccagagtgaaggccgt

SEQ ID NO: 217590 - DNA, 25 bp, Artificial Sequence
  Description of Artificial Sequence: Synthetic oligonucleotide
ggcctcccagagtgaaggccgtgaa

SEQ ID NO: 217591 - DNA, 26 bp, Artificial Sequence
  Description of Artificial Sequence: Synthetic oligonucleotide
gcctcccagagtgaaggccgtgaagt

SEQ ID NO: 217592 - DNA, 26 bp, Artificial Sequence
  Description of Artificial Sequence: Synthetic oligonucleotide
cctcccagagtgaaggccgtgaagtc

SEQ ID NO: 217593 - DNA, 27 bp, Artificial Sequence
  Description of Artificial Sequence: Synthetic oligonucleotide
ctcccagagtgaaggccgtgaagtcgt

SEQ ID NO: 217594 - DNA, 27 bp, Artificial Sequence
  Description of Artificial Sequence: Synthetic oligonucleotide
tcccagagtgaaggccgtgaagtcgtc

SEQ ID NO: 217595 - DNA, 27 bp, Artificial Sequence
  Description of Artificial Sequence: Synthetic oligonucleotide
cccagagtgaaggccgtgaagtcgtca

SEQ ID NO: 217596 - DNA, 27 bp, Artificial Sequence
  Description of Artificial Sequence: Synthetic oligonucleotide
ccagagtgaaggccgtgaagtcgtcag

SEQ ID NO: 217597 - DNA, 29 bp, Artificial Sequence
  Description of Artificial Sequence: Synthetic oligonucleotide
cagagtgaaggccgtgaagtcgtcagaac

SEQ ID NO: 217598 - DNA, 30 bp, Artificial Sequence
  Description of Artificial Sequence: Synthetic oligonucleotide
agagtgaaggccgtgaagtcgtcagaacac

SEQ ID NO: 217599 - DNA, 29 bp, Artificial Sequence
  Description of Artificial Sequence: Synthetic oligonucleotide
gagtgaaggccgtgaagtcgtcagaacac

SEQ ID NO: 217600 - DNA, 31 bp, Artificial Sequence
  Description of Artificial Sequence: Synthetic oligonucleotide
agtgaaggccgtgaagtcgtcagaacacatc

SEQ ID NO: 217601 - DNA, 30 bp, Artificial Sequence
  Description of Artificial Sequence: Synthetic oligonucleotide
gtgaaggccgtgaagtcgtcagaacacatc

SEQ ID NO: 217602 - DNA, 32 bp, Artificial Sequence
  Description of Artificial Sequence: Synthetic oligonucleotide
tgaaggccgtgaagtcgtcagaacacatcaac

SEQ ID NO: 217603 - DNA, 31 bp, Artificial Sequence
  Description of Artificial Sequence: Synthetic oligonucleotide
gaaggccgtgaagtcgtcagaacacatcaac

SEQ ID NO: 217604 - DNA, 31 bp, Artificial Sequence
  Description of Artificial Sequence: Synthetic oligonucleotide
aaggccgtgaagtcgtcagaacacatcaacg

SEQ ID NO: 217605 - DNA, 30 bp, Artificial Sequence
  Description of Artificial Sequence: Synthetic oligonucleotide
aggccgtgaagtcgtcagaacacatcaacg

SEQ ID NO: 217606 - DNA, 29 bp, Artificial Sequence
  Description of Artificial Sequence: Synthetic oligonucleotide
ggccgtgaagtcgtcagaacacatcaacg

SEQ ID NO: 217607 - DNA, 30 bp, Artificial Sequence
  Description of Artificial Sequence: Synthetic oligonucleotide
gccgtgaagtcgtcagaacacatcaacgag

SEQ ID NO: 217608 - DNA, 30 bp, Artificial Sequence
  Description of Artificial Sequence: Synthetic oligonucleotide
ccgtgaagtcgtcagaacacatcaacgagg

SEQ ID NO: 217609 - DNA, 30 bp, Artificial Sequence
  Description of Artificial Sequence: Synthetic oligonucleotide
cgtgaagtcgtcagaacacatcaacgaggg

SEQ ID NO: 217610 - DNA, 25 bp, Artificial Sequence
  Description of Artificial Sequence: Synthetic oligonucleotide
caggccatcatcacgctccgcgtgt

SEQ ID NO: 217611 - DNA, 25 bp, Artificial Sequence
  Description of Artificial Sequence: Synthetic oligonucleotide
aggccatcatcacgctccgcgtgtg

SEQ ID NO: 217612 - DNA, 24 bp, Artificial Sequence
  Description of Artificial Sequence: Synthetic oligonucleotide
ggccatcatcacgctccgcgtgtg

SEQ ID NO: 217613 - DNA, 25 bp, Artificial Sequence
  Description of Artificial Sequence: Synthetic oligonucleotide
gccatcatcacgctccgcgtgtgca

SEQ ID NO: 217614 - DNA, 25 bp, Artificial Sequence
  Description of Artificial Sequence: Synthetic oligonucleotide
ccatcatcacgctccgcgtgtgcag

SEQ ID NO: 217615 - DNA, 25 bp, Artificial Sequence
  Description of Artificial Sequence: Synthetic oligonucleotide
catcatcacgctccgcgtgtgcagc

SEQ ID NO: 217616 - DNA, 26 bp, Artificial Sequence
  Description of Artificial Sequence: Synthetic oligonucleotide
atcatcacgctccgcgtgtgcagcca

SEQ ID NO: 217617 - DNA, 25 bp, Artificial Sequence
  Description of Artificial Sequence: Synthetic oligonucleotide
tcatcacgctccgcgtgtgcagcca

SEQ ID NO: 217618 - DNA, 24 bp, Artificial Sequence
  Description of Artificial Sequence: Synthetic oligonucleotide
catcacgctccgcgtgtgcagcca

SEQ ID NO: 217619 - DNA, 24 bp, Artificial Sequence
  Description of Artificial Sequence: Synthetic oligonucleotide
atcacgctccgcgtgtgcagccac

SEQ ID NO: 217620 - DNA, 23 bp, Artificial Sequence
  Description of Artificial Sequence: Synthetic oligonucleotide
tcacgctccgcgtgtgcagccac

SEQ ID NO: 217621 - DNA, 22 bp, Artificial Sequence
  Description of Artificial Sequence: Synthetic oligonucleotide
cacgctccgcgtgtgcagccac

SEQ ID NO: 217622 - DNA, 23 bp, Artificial Sequence
  Description of Artificial Sequence: Synthetic oligonucleotide
acgctccgcgtgtgcagccacct

SEQ ID NO: 217623 - DNA, 22 bp, Artificial Sequence
  Description of Artificial Sequence: Synthetic oligonucleotide
cgctccgcgtgtgcagccacct

SEQ ID NO: 217624 - DNA, 22 bp, Artificial Sequence
  Description of Artificial Sequence: Synthetic oligonucleotide
gctccgcgtgtgcagccacctg

SEQ ID NO: 217625 - DNA, 22 bp, Artificial Sequence
  Description of Artificial Sequence: Synthetic oligonucleotide
ctccgcgtgtgcagccacctgg

SEQ ID NO: 217626 - DNA, 22 bp, Artificial Sequence
  Description of Artificial Sequence: Synthetic oligonucleotide
tccgcgtgtgcagccacctggc

SEQ ID NO: 217627 - DNA, 21 bp, Artificial Sequence
  Description of Artificial Sequence: Synthetic oligonucleotide
ccgcgtgtgcagccacctggc

SEQ ID NO: 217628 - DNA, 21 bp, Artificial Sequence
  Description of Artificial Sequence: Synthetic oligonucleotide
cgcgtgtgcagccacctggcc

SEQ ID NO: 217629 - DNA, 21 bp, Artificial Sequence
  Description of Artificial Sequence: Synthetic oligonucleotide
gcgtgtgcagccacctggccg

SEQ ID NO: 217630 - DNA, 21 bp, Artificial Sequence
  Description of Artificial Sequence: Synthetic oligonucleotide
cgtgtgcagccacctggccgc

SEQ ID NO: 217631 - DNA, 21 bp, Artificial Sequence
  Description of Artificial Sequence: Synthetic oligonucleotide
gtgtgcagccacctggccgcc

SEQ ID NO: 217632 - DNA, 22 bp, Artificial Sequence
  Description of Artificial Sequence: Synthetic oligonucleotide
tgtgcagccacctggccgccct

SEQ ID NO: 217633 - DNA, 21 bp, Artificial Sequence
  Description of Artificial Sequence: Synthetic oligonucleotide
gtgcagccacctggccgccct

SEQ ID NO: 217634 - DNA, 22 bp, Artificial Sequence
  Description of Artificial Sequence: Synthetic oligonucleotide
tgcagccacctggccgccctct

SEQ ID NO: 217635 - DNA, 20 bp, Artificial Sequence
  Description of Artificial Sequence: Synthetic oligonucleotide
acctggccgccctctggccc

SEQ ID NO: 217636 - DNA, 20 bp, Artificial Sequence
  Description of Artificial Sequence: Synthetic oligonucleotide
cctggccgccctctggccct

SEQ ID NO: 217637 - DNA, 20 bp, Artificial Sequence
  Description of Artificial Sequence: Synthetic oligonucleotide
ctggccgccctctggcccct

SEQ ID NO: 217638 - DNA, 20 bp, Artificial Sequence
  Description of Artificial Sequence: Synthetic oligonucleotide
tggccgccctctggcccctc

SEQ ID NO: 217639 - DNA, 20 bp, Artificial Sequence
  Description of Artificial Sequence: Synthetic oligonucleotide
ggccgccctctggcccctct

SEQ ID NO: 217640 - DNA, 20 bp, Artificial Sequence
  Description of Artificial Sequence: Synthetic oligonucleotide
gccgccctctggcccctcct

SEQ ID NO: 217641 - DNA, 20 bp, Artificial Sequence
  Description of Artificial Sequence: Synthetic oligonucleotide
ccgccctctggcccctcctg

SEQ ID NO: 217642 - DNA, 20 bp, Artificial Sequence
  Description of Artificial Sequence: Synthetic oligonucleotide
cgccctctggcccctcctgg

SEQ ID NO: 217643 - DNA, 20 bp, Artificial Sequence
  Description of Artificial Sequence: Synthetic oligonucleotide
gccctctggcccctcctggg

SEQ ID NO: 217644 - DNA, 22 bp, Artificial Sequence
  Description of Artificial Sequence: Synthetic oligonucleotide
ccctctggcccctcctgggcat

SEQ ID NO: 217645 - DNA, 22 bp, Artificial Sequence
  Description of Artificial Sequence: Synthetic oligonucleotide
cctctggcccctcctgggcatc

SEQ ID NO: 217646 - DNA, 23 bp, Artificial Sequence
  Description of Artificial Sequence: Synthetic oligonucleotide
ctctggcccctcctgggcatcgt

SEQ ID NO: 217647 - DNA, 23 bp, Artificial Sequence
  Description of Artificial Sequence: Synthetic oligonucleotide
tctggcccctcctgggcatcgtg

SEQ ID NO: 217648 - DNA, 22 bp, Artificial Sequence
  Description of Artificial Sequence: Synthetic oligonucleotide
ctggcccctcctgggcatcgtg

SEQ ID NO: 217649 - DNA, 22 bp, Artificial Sequence
  Description of Artificial Sequence: Synthetic oligonucleotide
tggcccctcctgggcatcgtgg

SEQ ID NO: 217650 - DNA, 21 bp, Artificial Sequence
  Description of Artificial Sequence: Synthetic oligonucleotide
ggcccctcctgggcatcgtgg

SEQ ID NO: 217651 - DNA, 22 bp, Artificial Sequence
  Description of Artificial Sequence: Synthetic oligonucleotide
gcccctcctgggcatcgtggct

SEQ ID NO: 217652 - DNA, 23 bp, Artificial Sequence
  Description of Artificial Sequence: Synthetic oligonucleotide
cccctcctgggcatcgtggctga

SEQ ID NO: 217653 - DNA, 23 bp, Artificial Sequence
  Description of Artificial Sequence: Synthetic oligonucleotide
ccctcctgggcatcgtggctgag

SEQ ID NO: 217654 - DNA, 24 bp, Artificial Sequence
  Description of Artificial Sequence: Synthetic oligonucleotide
cctcctgggcatcgtggctgaggt

SEQ ID NO: 217655 - DNA, 24 bp, Artificial Sequence
  Description of Artificial Sequence: Synthetic oligonucleotide
ctcctgggcatcgtggctgaggtg

SEQ ID NO: 217656 - DNA, 26 bp, Artificial Sequence
  Description of Artificial Sequence: Synthetic oligonucleotide
gggctgccggcacagtcttcactact

SEQ ID NO: 217657 - DNA, 27 bp, Artificial Sequence
  Description of Artificial Sequence: Synthetic oligonucleotide
ggctgccggcacagtcttcactactgt

SEQ ID NO: 217658 - DNA, 28 bp, Artificial Sequence
  Description of Artificial Sequence: Synthetic oligonucleotide
gctgccggcacagtcttcactactgtag

SEQ ID NO: 217659 - DNA, 30 bp, Artificial Sequence
  Description of Artificial Sequence: Synthetic oligonucleotide
ctgccggcacagtcttcactactgtagaag

SEQ ID NO: 217660 - DNA, 31 bp, Artificial Sequence
  Description of Artificial Sequence: Synthetic oligonucleotide
tgccggcacagtcttcactactgtagaagac

SEQ ID NO: 217661 - DNA, 30 bp, Artificial Sequence
  Description of Artificial Sequence: Synthetic oligonucleotide
gccggcacagtcttcactactgtagaagac

SEQ ID NO: 217662 - DNA, 30 bp, Artificial Sequence
  Description of Artificial Sequence: Synthetic oligonucleotide
ccggcacagtcttcactactgtagaagacc

SEQ ID NO: 217663 - DNA, 32 bp, Artificial Sequence
  Description of Artificial Sequence: Synthetic oligonucleotide
cggcacagtcttcactactgtagaagaccttg

SEQ ID NO: 217664 - DNA, 32 bp, Artificial Sequence
  Description of Artificial Sequence: Synthetic oligonucleotide
ggcacagtcttcactactgtagaagaccttgg

SEQ ID NO: 217665 - DNA, 32 bp, Artificial Sequence
  Description of Artificial Sequence: Synthetic oligonucleotide
gcacagtcttcactactgtagaagaccttggc

SEQ ID NO: 217666 - DNA, 33 bp, Artificial Sequence
  Description of Artificial Sequence: Synthetic oligonucleotide
cacagtcttcactactgtagaagaccttggctc

SEQ ID NO: 217667 - DNA, 33 bp, Artificial Sequence
  Description of Artificial Sequence: Synthetic oligonucleotide
acagtcttcactactgtagaagaccttggctcc

SEQ ID NO: 217668 - DNA, 32 bp, Artificial Sequence
  Description of Artificial Sequence: Synthetic oligonucleotide
cagtcttcactactgtagaagaccttggctcc

SEQ ID NO: 217669 - DNA, 34 bp, Artificial Sequence
  Description of Artificial Sequence: Synthetic oligonucleotide
agtcttcactactgtagaagaccttggctccaag

SEQ ID NO: 217670 - DNA, 33 bp, Artificial Sequence
  Description of Artificial Sequence: Synthetic oligonucleotide
gtcttcactactgtagaagaccttggctccaag

SEQ ID NO: 217671 - DNA, 36 bp, Artificial Sequence
  Description of Artificial Sequence: Synthetic oligonucleotide
tcttcactactgtagaagaccttggctccaagatac

SEQ ID NO: 217672 - DNA, 35 bp, Artificial Sequence
  Description of Artificial Sequence: Synthetic oligonucleotide
cttcactactgtagaagaccttggctccaagatac

SEQ ID NO: 217673 - DNA, 36 bp, Artificial Sequence
  Description of Artificial Sequence: Synthetic oligonucleotide
ttcactactgtagaagaccttggctccaagatactc

SEQ ID NO: 217674 - DNA, 35 bp, Artificial Sequence
  Description of Artificial Sequence: Synthetic oligonucleotide
tcactactgtagaagaccttggctccaagatactc

SEQ ID NO: 217675 - DNA, 34 bp, Artificial Sequence
  Description of Artificial Sequence: Synthetic oligonucleotide
cactactgtagaagaccttggctccaagatactc

SEQ ID NO: 217676 - DNA, 34 bp, Artificial Sequence
  Description of Artificial Sequence: Synthetic oligonucleotide
actactgtagaagaccttggctccaagatactcc

SEQ ID NO: 217677 - DNA, 33 bp, Artificial Sequence
  Description of Artificial Sequence: Synthetic oligonucleotide
ctactgtagaagaccttggctccaagatactcc

SEQ ID NO: 217678 - DNA, 34 bp, Artificial Sequence
  Description of Artificial Sequence: Synthetic oligonucleotide
tactgtagaagaccttggctccaagatactcctc

SEQ ID NO: 217679 - DNA, 33 bp, Artificial Sequence
  Description of Artificial Sequence: Synthetic oligonucleotide
actgtagaagaccttggctccaagatactcctc

SEQ ID NO: 217680 - DNA, 32 bp, Artificial Sequence
  Description of Artificial Sequence: Synthetic oligonucleotide
ctgtagaagaccttggctccaagatactcctc

SEQ ID NO: 217681 - DNA, 33 bp, Artificial Sequence
  Description of Artificial Sequence: Synthetic oligonucleotide
tgtagaagaccttggctccaagatactcctcac

SEQ ID NO: 217682 - DNA, 24 bp, Artificial Sequence
  Description of Artificial Sequence: Synthetic oligonucleotide
gggggcgtggtgctgaaggaggat

SEQ ID NO: 217683 - DNA, 24 bp, Artificial Sequence
  Description of Artificial Sequence: Synthetic oligonucleotide
ggggcgtggtgctgaaggaggatg

SEQ ID NO: 217684 - DNA, 24 bp, Artificial Sequence
  Description of Artificial Sequence: Synthetic oligonucleotide
gggcgtggtgctgaaggaggatgc

SEQ ID NO: 217685 - DNA, 24 bp, Artificial Sequence
  Description of Artificial Sequence: Synthetic oligonucleotide
ggcgtggtgctgaaggaggatgcg

SEQ ID NO: 217686 - DNA, 25 bp, Artificial Sequence
  Description of Artificial Sequence: Synthetic oligonucleotide
gcgtggtgctgaaggaggatgcgct

SEQ ID NO: 217687 - DNA, 25 bp, Artificial Sequence
  Description of Artificial Sequence: Synthetic oligonucleotide
cgtggtgctgaaggaggatgcgctg

SEQ ID NO: 217688 - DNA, 25 bp, Artificial Sequence
  Description of Artificial Sequence: Synthetic oligonucleotide
gtggtgctgaaggaggatgcgctgc

SEQ ID NO: 217689 - DNA, 25 bp, Artificial Sequence
  Description of Artificial Sequence: Synthetic oligonucleotide
tggtgctgaaggaggatgcgctgcc

SEQ ID NO: 217690 - DNA, 24 bp, Artificial Sequence
  Description of Artificial Sequence: Synthetic oligonucleotide
ggtgctgaaggaggatgcgctgcc

SEQ ID NO: 217691 - DNA, 24 bp, Artificial Sequence
  Description of Artificial Sequence: Synthetic oligonucleotide
gtgctgaaggaggatgcgctgccc

SEQ ID NO: 217692 - DNA, 24 bp, Artificial Sequence
  Description of Artificial Sequence: Synthetic oligonucleotide
tgctgaaggaggatgcgctgcccg

SEQ ID NO: 217693 - DNA, 23 bp, Artificial Sequence
  Description of Artificial Sequence: Synthetic oligonucleotide
gctgaaggaggatgcgctgcccg

SEQ ID NO: 217694 - DNA, 23 bp, Artificial Sequence
  Description of Artificial Sequence: Synthetic oligonucleotide
ctgaaggaggatgcgctgcccgg

SEQ ID NO: 217695 - DNA, 23 bp, Artificial Sequence
  Description of Artificial Sequence: Synthetic oligonucleotide
tgaaggaggatgcgctgcccggc

SEQ ID NO: 217696 - DNA, 22 bp, Artificial Sequence
  Description of Artificial Sequence: Synthetic oligonucleotide
gaaggaggatgcgctgcccggc

SEQ ID NO: 217697 - DNA, 23 bp, Artificial Sequence
  Description of Artificial Sequence: Synthetic oligonucleotide
aaggaggatgcgctgcccggcca

SEQ ID NO: 217698 - DNA, 22 bp, Artificial Sequence
  Description of Artificial Sequence: Synthetic oligonucleotide
aggaggatgcgctgcccggcca

SEQ ID NO: 217699 - DNA, 21 bp, Artificial Sequence
  Description of Artificial Sequence: Synthetic oligonucleotide
ggaggatgcgctgcccggcca

SEQ ID NO: 217700 - DNA, 25 bp, Artificial Sequence
  Description of Artificial Sequence: Synthetic oligonucleotide
gaggatgcgctgcccggccagaaaa

SEQ ID NO: 217701 - DNA, 25 bp, Artificial Sequence
  Description of Artificial Sequence: Synthetic oligonucleotide
aggatgcgctgcccggccagaaaac

SEQ ID NO: 217702 - DNA, 24 bp, Artificial Sequence
  Description of Artificial Sequence: Synthetic oligonucleotide
ggatgcgctgcccggccagaaaac

SEQ ID NO: 217703 - DNA, 24 bp, Artificial Sequence
  Description of Artificial Sequence: Synthetic oligonucleotide
gatgcgctgcccggccagaaaacg

SEQ ID NO: 217704 - DNA, 25 bp, Artificial Sequence
  Description of Artificial Sequence: Synthetic oligonucleotide
atgcgctgcccggccagaaaacgga

SEQ ID NO: 217705 - DNA, 24 bp, Artificial Sequence
  Description of Artificial Sequence: Synthetic oligonucleotide
tgcgctgcccggccagaaaacgga

SEQ ID NO: 217706 - DNA, 29 bp, Artificial Sequence
  Description of Artificial Sequence: Synthetic oligonucleotide
gccagaaaacggagttcaaggtggactcg

SEQ ID NO: 217707 - DNA, 29 bp, Artificial Sequence
  Description of Artificial Sequence: Synthetic oligonucleotide
ccagaaaacggagttcaaggtggactcgg

SEQ ID NO: 217708 - DNA, 30 bp, Artificial Sequence
  Description of Artificial Sequence: Synthetic oligonucleotide
cagaaaacggagttcaaggtggactcggac

SEQ ID NO: 217709 - DNA, 30 bp, Artificial Sequence
  Description of Artificial Sequence: Synthetic oligonucleotide
agaaaacggagttcaaggtggactcggacg

SEQ ID NO: 217710 - DNA, 29 bp, Artificial Sequence
  Description of Artificial Sequence: Synthetic oligonucleotide
gaaaacggagttcaaggtggactcggacg

SEQ ID NO: 217711 - DNA, 30 bp, Artificial Sequence
  Description of Artificial Sequence: Synthetic oligonucleotide
aaaacggagttcaaggtggactcggacgac

SEQ ID NO: 217712 - DNA, 29 bp, Artificial Sequence
  Description of Artificial Sequence: Synthetic oligonucleotide
aaacggagttcaaggtggactcggacgac

SEQ ID NO: 217713 - DNA, 28 bp, Artificial Sequence
  Description of Artificial Sequence: Synthetic oligonucleotide
aacggagttcaaggtggactcggacgac

SEQ ID NO: 217714 - DNA, 27 bp, Artificial Sequence
  Description of Artificial Sequence: Synthetic oligonucleotide
acggagttcaaggtggactcggacgac

SEQ ID NO: 217715 - DNA, 26 bp, Artificial Sequence
  Description of Artificial Sequence: Synthetic oligonucleotide
cggagttcaaggtggactcggacgac

SEQ ID NO: 217716 - DNA, 27 bp, Artificial Sequence
  Description of Artificial Sequence: Synthetic oligonucleotide
ggagttcaaggtggactcggacgacca

SEQ ID NO: 217717 - DNA, 27 bp, Artificial Sequence
  Description of Artificial Sequence: Synthetic oligonucleotide
gagttcaaggtggactcggacgaccag

SEQ ID NO: 217718 - DNA, 28 bp, Artificial Sequence
  Description of Artificial Sequence: Synthetic oligonucleotide
agttcaaggtggactcggacgaccagtg

SEQ ID NO: 217719 - DNA, 27 bp, Artificial Sequence
  Description of Artificial Sequence: Synthetic oligonucleotide
gttcaaggtggactcggacgaccagtg

SEQ ID NO: 217720 - DNA, 27 bp, Artificial Sequence
  Description of Artificial Sequence: Synthetic oligonucleotide
ttcaaggtggactcggacgaccagtgg

SEQ ID NO: 217721 - DNA, 26 bp, Artificial Sequence
  Description of Artificial Sequence: Synthetic oligonucleotide
tcaaggtggactcggacgaccagtgg

SEQ ID NO: 217722 - DNA, 25 bp, Artificial Sequence
  Description of Artificial Sequence: Synthetic oligonucleotide
caaggtggactcggacgaccagtgg

SEQ ID NO: 217723 - DNA, 25 bp, Artificial Sequence
  Description of Artificial Sequence: Synthetic oligonucleotide
aaggtggactcggacgaccagtggg

SEQ ID NO: 217724 - DNA, 24 bp, Artificial Sequence
  Description of Artificial Sequence: Synthetic oligonucleotide
aggtggactcggacgaccagtggg

SEQ ID NO: 217725 - DNA, 23 bp, Artificial Sequence
  Description of Artificial Sequence: Synthetic oligonucleotide
ggtggactcggacgaccagtggg

SEQ ID NO: 217726 - DNA, 24 bp, Artificial Sequence
  Description of Artificial Sequence: Synthetic oligonucleotide
gtggactcggacgaccagtgggga

SEQ ID NO: 217727 - DNA, 25 bp, Artificial Sequence
  Description of Artificial Sequence: Synthetic oligonucleotide
tggactcggacgaccagtggggaga

SEQ ID NO: 217728 - DNA, 24 bp, Artificial Sequence
  Description of Artificial Sequence: Synthetic oligonucleotide
ggactcggacgaccagtggggaga

SEQ ID NO: 217729 - DNA, 26 bp, Artificial Sequence
  Description of Artificial Sequence: Synthetic oligonucleotide
gactcggacgaccagtggggagagta

SEQ ID NO: 217730 - DNA, 27 bp, Artificial Sequence
  Description of Artificial Sequence: Synthetic oligonucleotide
actcggacgaccagtggggagagtact

SEQ ID NO: 217731 - DNA, 26 bp, Artificial Sequence
  Description of Artificial Sequence: Synthetic oligonucleotide
ctcggacgaccagtggggagagtact

SEQ ID NO: 217732 - DNA, 26 bp, Artificial Sequence
  Description of Artificial Sequence: Synthetic oligonucleotide
tcggacgaccagtggggagagtactc

SEQ ID NO: 217733 - DNA, 25 bp, Artificial Sequence
  Description of Artificial Sequence: Synthetic oligonucleotide
cggacgaccagtggggagagtactc

SEQ ID NO: 217734 - DNA, 26 bp, Artificial Sequence
  Description of Artificial Sequence: Synthetic oligonucleotide
ggacgaccagtggggagagtactcct

SEQ ID NO: 217735 - DNA, 24 bp, Artificial Sequence
  Description of Artificial Sequence: Synthetic oligonucleotide
ggaagcccgaggacgtcctggatg

SEQ ID NO: 217736 - DNA, 26 bp, Artificial Sequence
  Description of Artificial Sequence: Synthetic oligonucleotide
gaagcccgaggacgtcctggatggaa

SEQ ID NO: 217737 - DNA, 27 bp, Artificial Sequence
  Description of Artificial Sequence: Synthetic oligonucleotide
aagcccgaggacgtcctggatggaaga

SEQ ID NO: 217738 - DNA, 26 bp, Artificial Sequence
  Description of Artificial Sequence: Synthetic oligonucleotide
agcccgaggacgtcctggatggaaga

SEQ ID NO: 217739 - DNA, 25 bp, Artificial Sequence
  Description of Artificial Sequence: Synthetic oligonucleotide
gcccgaggacgtcctggatggaaga

SEQ ID NO: 217740 - DNA, 25 bp, Artificial Sequence
  Description of Artificial Sequence: Synthetic oligonucleotide
cccgaggacgtcctggatggaagag

SEQ ID NO: 217741 - DNA, 26 bp, Artificial Sequence
  Description of Artificial Sequence: Synthetic oligonucleotide
ccgaggacgtcctggatggaagagca

SEQ ID NO: 217742 - DNA, 26 bp, Artificial Sequence
  Description of Artificial Sequence: Synthetic oligonucleotide
cgaggacgtcctggatggaagagcag

SEQ ID NO: 217743 - DNA, 26 bp, Artificial Sequence
  Description of Artificial Sequence: Synthetic oligonucleotide
gaggacgtcctggatggaagagcagc

SEQ ID NO: 217744 - DNA, 26 bp, Artificial Sequence
  Description of Artificial Sequence: Synthetic oligonucleotide
aggacgtcctggatggaagagcagcg

SEQ ID NO: 217745 - DNA, 25 bp, Artificial Sequence
  Description of Artificial Sequence: Synthetic oligonucleotide
ggacgtcctggatggaagagcagcg

SEQ ID NO: 217746 - DNA, 25 bp, Artificial Sequence
  Description of Artificial Sequence: Synthetic oligonucleotide
gacgtcctggatggaagagcagcgg

SEQ ID NO: 217747 - DNA, 25 bp, Artificial Sequence
  Description of Artificial Sequence: Synthetic oligonucleotide
acgtcctggatggaagagcagcggg

SEQ ID NO: 217748 - DNA, 24 bp, Artificial Sequence
  Description of Artificial Sequence: Synthetic oligonucleotide
cgtcctggatggaagagcagcggg

SEQ ID NO: 217749 - DNA, 25 bp, Artificial Sequence
  Description of Artificial Sequence: Synthetic oligonucleotide
gtcctggatggaagagcagcgggca

SEQ ID NO: 217750 - DNA, 25 bp, Artificial Sequence
  Description of Artificial Sequence: Synthetic oligonucleotide
tcctggatggaagagcagcgggcag

SEQ ID NO: 217751 - DNA, 24 bp, Artificial Sequence
  Description of Artificial Sequence: Synthetic oligonucleotide
cctggatggaagagcagcgggcag

SEQ ID NO: 217752 - DNA, 25 bp, Artificial Sequence
  Description of Artificial Sequence: Synthetic oligonucleotide
ctggatggaagagcagcgggcagca

SEQ ID NO: 217753 - DNA, 25 bp, Artificial Sequence
  Description of Artificial Sequence: Synthetic oligonucleotide
tggatggaagagcagcgggcagcac

SEQ ID NO: 217754 - DNA, 24 bp, Artificial Sequence
  Description of Artificial Sequence: Synthetic oligonucleotide
ggatggaagagcagcgggcagcac

SEQ ID NO: 217755 - DNA, 25 bp, Artificial Sequence
  Description of Artificial Sequence: Synthetic oligonucleotide
gatggaagagcagcgggcagcacca

SEQ ID NO: 217756 - DNA, 27 bp, Artificial Sequence
  Description of Artificial Sequence: Synthetic oligonucleotide
atggaagagcagcgggcagcaccagaa

SEQ ID NO: 217757 - DNA, 27 bp, Artificial Sequence
  Description of Artificial Sequence: Synthetic oligonucleotide
tggaagagcagcgggcagcaccagaat

SEQ ID NO: 217758 - DNA, 26 bp, Artificial Sequence
  Description of Artificial Sequence: Synthetic oligonucleotide
ggaagagcagcgggcagcaccagaat

SEQ ID NO: 217759 - DNA, 21 bp, Artificial Sequence
  Description of Artificial Sequence: Synthetic oligonucleotide
cgccggaagcccgaggacgtg

SEQ ID NO: 217760 - DNA, 21 bp, Artificial Sequence
  Description of Artificial Sequence: Synthetic oligonucleotide
gccggaagcccgaggacgtgg

SEQ ID NO: 217761 - DNA, 21 bp, Artificial Sequence
  Description of Artificial Sequence: Synthetic oligonucleotide
ccggaagcccgaggacgtggc

SEQ ID NO: 217762 - DNA, 21 bp, Artificial Sequence
  Description of Artificial Sequence: Synthetic oligonucleotide
cggaagcccgaggacgtggcc

SEQ ID NO: 217763 - DNA, 21 bp, Artificial Sequence
  Description of Artificial Sequence: Synthetic oligonucleotide
ggaagcccgaggacgtggccc

SEQ ID NO: 217764 - DNA, 22 bp, Artificial Sequence
  Description of Artificial Sequence: Synthetic oligonucleotide
gaagcccgaggacgtggcccga

SEQ ID NO: 217765 - DNA, 22 bp, Artificial Sequence
  Description of Artificial Sequence: Synthetic oligonucleotide
aagcccgaggacgtggcccgag

SEQ ID NO: 217766 - DNA, 33 bp, Artificial Sequence
  Description of Artificial Sequence: Synthetic oligonucleotide
tacacattgagaacctgaacatggaggccgatc

SEQ ID NO: 217767 - DNA, 32 bp, Artificial Sequence
  Description of Artificial Sequence: Synthetic oligonucleotide
acacattgagaacctgaacatggaggccgatc

SEQ ID NO: 217768 - DNA, 31 bp, Artificial Sequence
  Description of Artificial Sequence: Synthetic oligonucleotide
cacattgagaacctgaacatggaggccgatc

SEQ ID NO: 217769 - DNA, 31 bp, Artificial Sequence
  Description of Artificial Sequence: Synthetic oligonucleotide
acattgagaacctgaacatggaggccgatcc

SEQ ID NO: 217770 - DNA, 30 bp, Artificial Sequence
  Description of Artificial Sequence: Synthetic oligonucleotide
cattgagaacctgaacatggaggccgatcc

SEQ ID NO: 217771 - DNA, 30 bp, Artificial Sequence
  Description of Artificial Sequence: Synthetic oligonucleotide
attgagaacctgaacatggaggccgatccc

SEQ ID NO: 217772 - DNA, 29 bp, Artificial Sequence
  Description of Artificial Sequence: Synthetic oligonucleotide
ttgagaacctgaacatggaggccgatccc

SEQ ID NO: 217773 - DNA, 28 bp, Artificial Sequence
  Description of Artificial Sequence: Synthetic oligonucleotide
tgagaacctgaacatggaggccgatccc

SEQ ID NO: 217774 - DNA, 27 bp, Artificial Sequence
  Description of Artificial Sequence: Synthetic oligonucleotide
gagaacctgaacatggaggccgatccc

SEQ ID NO: 217775 - DNA, 27 bp, Artificial Sequence
  Description of Artificial Sequence: Synthetic oligonucleotide
agaacctgaacatggaggccgatcccg

SEQ ID NO: 217776 - DNA, 26 bp, Artificial Sequence
  Description of Artificial Sequence: Synthetic oligonucleotide
gaacctgaacatggaggccgatcccg

SEQ ID NO: 217777 - DNA, 26 bp, Artificial Sequence
  Description of Artificial Sequence: Synthetic oligonucleotide
aacctgaacatggaggccgatcccgg

SEQ ID NO: 217778 - DNA, 25 bp, Artificial Sequence
  Description of Artificial Sequence: Synthetic oligonucleotide
acctgaacatggaggccgatcccgg

SEQ ID NO: 217779 - DNA, 24 bp, Artificial Sequence
  Description of Artificial Sequence: Synthetic oligonucleotide
cctgaacatggaggccgatcccgg

SEQ ID NO: 217780 - DNA, 24 bp, Artificial Sequence
  Description of Artificial Sequence: Synthetic oligonucleotide
ctgaacatggaggccgatcccggc

SEQ ID NO: 217781 - DNA, 25 bp, Artificial Sequence
  Description of Artificial Sequence: Synthetic oligonucleotide
tgaacatggaggccgatcccggcca

SEQ ID NO: 217782 - DNA, 24 bp, Artificial Sequence
  Description of Artificial Sequence: Synthetic oligonucleotide
gaacatggaggccgatcccggcca

SEQ ID NO: 217783 - DNA, 26 bp, Artificial Sequence
  Description of Artificial Sequence: Synthetic oligonucleotide
aacatggaggccgatcccggccagta

SEQ ID NO: 217784 - DNA, 25 bp, Artificial Sequence
  Description of Artificial Sequence: Synthetic oligonucleotide
acatggaggccgatcccggccagta

SEQ ID NO: 217785 - DNA, 24 bp, Artificial Sequence
  Description of Artificial Sequence: Synthetic oligonucleotide
catggaggccgatcccggccagta

SEQ ID NO: 217786 - DNA, 24 bp, Artificial Sequence
  Description of Artificial Sequence: Synthetic oligonucleotide
atggaggccgatcccggccagtac

SEQ ID NO: 217787 - DNA, 23 bp, Artificial Sequence
  Description of Artificial Sequence: Synthetic oligonucleotide
tggaggccgatcccggccagtac

SEQ ID NO: 217788 - DNA, 22 bp, Artificial Sequence
  Description of Artificial Sequence: Synthetic oligonucleotide
ggaggccgatcccggccagtac

SEQ ID NO: 217789 - DNA, 22 bp, Artificial Sequence
  Description of Artificial Sequence: Synthetic oligonucleotide
gaggccgatcccggccagtacc

SEQ ID NO: 217790 - DNA, 22 bp, Artificial Sequence
  Description of Artificial Sequence: Synthetic oligonucleotide
aggccgatcccggccagtaccg

SEQ ID NO: 217791 - DNA, 21 bp, Artificial Sequence
  Description of Artificial Sequence: Synthetic oligonucleotide
ggccgatcccggccagtaccg

SEQ ID NO: 217792 - DNA, 22 bp, Artificial Sequence
  Description of Artificial Sequence: Synthetic oligonucleotide
gccgatcccggccagtaccggt

SEQ ID NO: 217793 - DNA, 22 bp, Artificial Sequence
  Description of Artificial Sequence: Synthetic oligonucleotide
ccgatcccggccagtaccggtg

SEQ ID NO: 217794 - DNA, 24 bp, Artificial Sequence
  Description of Artificial Sequence: Synthetic oligonucleotide
cgatcccggccagtaccggtgcaa

SEQ ID NO: 217795 - DNA, 24 bp, Artificial Sequence
  Description of Artificial Sequence: Synthetic oligonucleotide
gatcccggccagtaccggtgcaac

SEQ ID NO: 217796 - DNA, 24 bp, Artificial Sequence
  Description of Artificial Sequence: Synthetic oligonucleotide
atcccggccagtaccggtgcaacg

SEQ ID NO: 217797 - DNA, 23 bp, Artificial Sequence
  Description of Artificial Sequence: Synthetic oligonucleotide
tcccggccagtaccggtgcaacg

SEQ ID NO: 217798 - DNA, 21 bp, Artificial Sequence
  Description of Artificial Sequence: Synthetic oligonucleotide
cacggagcctccggggctgct

SEQ ID NO: 217799 - DNA, 21 bp, Artificial Sequence
  Description of Artificial Sequence: Synthetic oligonucleotide
acggagcctccggggctgctg

SEQ ID NO: 217800 - DNA, 20 bp, Artificial Sequence
  Description of Artificial Sequence: Synthetic oligonucleotide
cggagcctccggggctgctg

SEQ ID NO: 217801 - DNA, 20 bp, Artificial Sequence
  Description of Artificial Sequence: Synthetic oligonucleotide
ggagcctccggggctgctgg

SEQ ID NO: 217802 - DNA, 21 bp, Artificial Sequence
  Description of Artificial Sequence: Synthetic oligonucleotide
gagcctccggggctgctggca

SEQ ID NO: 217803 - DNA, 22 bp, Artificial Sequence
  Description of Artificial Sequence: Synthetic oligonucleotide
agcctccggggctgctggcaca

SEQ ID NO: 217804 - DNA, 21 bp, Artificial Sequence
  Description of Artificial Sequence: Synthetic oligonucleotide
gcctccggggctgctggcaca

SEQ ID NO: 217805 - DNA, 22 bp, Artificial Sequence
  Description of Artificial Sequence: Synthetic oligonucleotide
cctccggggctgctggcacagt

SEQ ID NO: 217806 - DNA, 24 bp, Artificial Sequence
  Description of Artificial Sequence: Synthetic oligonucleotide
ctccggggctgctggcacagtctt

SEQ ID NO: 217807 - DNA, 25 bp, Artificial Sequence
  Description of Artificial Sequence: Synthetic oligonucleotide
tccggggctgctggcacagtcttca

SEQ ID NO: 217808 - DNA, 24 bp, Artificial Sequence
  Description of Artificial Sequence: Synthetic oligonucleotide
ccggggctgctggcacagtcttca

SEQ ID NO: 217809 - DNA, 26 bp, Artificial Sequence
  Description of Artificial Sequence: Synthetic oligonucleotide
cggggctgctggcacagtcttcacta

SEQ ID NO: 217810 - DNA, 26 bp, Artificial Sequence
  Description of Artificial Sequence: Synthetic oligonucleotide
ggggctgctggcacagtcttcactac

SEQ ID NO: 217811 - DNA, 26 bp, Artificial Sequence
  Description of Artificial Sequence: Synthetic oligonucleotide
gggctgctggcacagtcttcactacc

SEQ ID NO: 217812 - DNA, 27 bp, Artificial Sequence
  Description of Artificial Sequence: Synthetic oligonucleotide
ggctgctggcacagtcttcactaccgt

SEQ ID NO: 217813 - DNA, 28 bp, Artificial Sequence
  Description of Artificial Sequence: Synthetic oligonucleotide
gctgctggcacagtcttcactaccgtag

SEQ ID NO: 217814 - DNA, 30 bp, Artificial Sequence
  Description of Artificial Sequence: Synthetic oligonucleotide
ctgctggcacagtcttcactaccgtagaag

SEQ ID NO: 217815 - DNA, 31 bp, Artificial Sequence
  Description of Artificial Sequence: Synthetic oligonucleotide
tgctggcacagtcttcactaccgtagaagac

SEQ ID NO: 217816 - DNA, 30 bp, Artificial Sequence
  Description of Artificial Sequence: Synthetic oligonucleotide
gctggcacagtcttcactaccgtagaagac

SEQ ID NO: 217817 - DNA, 30 bp, Artificial Sequence
  Description of Artificial Sequence: Synthetic oligonucleotide
ctggcacagtcttcactaccgtagaagacc

SEQ ID NO: 217818 - DNA, 32 bp, Artificial Sequence
  Description of Artificial Sequence: Synthetic oligonucleotide
tggcacagtcttcactaccgtagaagaccttg

SEQ ID NO: 217819 - DNA, 27 bp, Artificial Sequence
  Description of Artificial Sequence: Synthetic oligonucleotide
atggagagctggtggggacttccctgt

SEQ ID NO: 217820 - DNA, 26 bp, Artificial Sequence
  Description of Artificial Sequence: Synthetic oligonucleotide
tggagagctggtggggacttccctgt

SEQ ID NO: 217821 - DNA, 25 bp, Artificial Sequence
  Description of Artificial Sequence: Synthetic oligonucleotide
ggagagctggtggggacttccctgt

SEQ ID NO: 217822 - DNA, 27 bp, Artificial Sequence
  Description of Artificial Sequence: Synthetic oligonucleotide
gagagctggtggggacttccctgtctt

SEQ ID NO: 217823 - DNA, 27 bp, Artificial Sequence
  Description of Artificial Sequence: Synthetic oligonucleotide
agagctggtggggacttccctgtcttg

SEQ ID NO: 217824 - DNA, 26 bp, Artificial Sequence
  Description of Artificial Sequence: Synthetic oligonucleotide
gagctggtggggacttccctgtcttg

SEQ ID NO: 217825 - DNA, 26 bp, Artificial Sequence
  Description of Artificial Sequence: Synthetic oligonucleotide
agctggtggggacttccctgtcttgc

SEQ ID NO: 217826 - DNA, 25 bp, Artificial Sequence
  Description of Artificial Sequence: Synthetic oligonucleotide
gctggtggggacttccctgtcttgc

SEQ ID NO: 217827 - DNA, 27 bp, Artificial Sequence
  Description of Artificial Sequence: Synthetic oligonucleotide
ctggtggggacttccctgtcttgcgtt

SEQ ID NO: 217828 - DNA, 27 bp, Artificial Sequence
  Description of Artificial Sequence: Synthetic oligonucleotide
tggtggggacttccctgtcttgcgttc

SEQ ID NO: 217829 - DNA, 26 bp, Artificial Sequence
  Description of Artificial Sequence: Synthetic oligonucleotide
ggtggggacttccctgtcttgcgttc

SEQ ID NO: 217830 - DNA, 27 bp, Artificial Sequence
  Description of Artificial Sequence: Synthetic oligonucleotide
gtggggacttccctgtcttgcgttcct

SEQ ID NO: 217831 - DNA, 27 bp, Artificial Sequence
  Description of Artificial Sequence: Synthetic oligonucleotide
tggggacttccctgtcttgcgttcctg

SEQ ID NO: 217832 - DNA, 27 bp, Artificial Sequence
  Description of Artificial Sequence: Synthetic oligonucleotide
ggggacttccctgtcttgcgttcctgt

SEQ ID NO: 217833 - DNA, 27 bp, Artificial Sequence
  Description of Artificial Sequence: Synthetic oligonucleotide
gggacttccctgtcttgcgttcctgtg

SEQ ID NO: 217834 - DNA, 31 bp, Artificial Sequence
  Description of Artificial Sequence: Synthetic oligonucleotide
ggacttccctgtcttgcgttcctgtgttttc

SEQ ID NO: 217835 - DNA, 35 bp, Artificial Sequence
  Description of Artificial Sequence: Synthetic oligonucleotide
gacttccctgtcttgcgttcctgtgttttctaatg

SEQ ID NO: 217836 - DNA, 35 bp, Artificial Sequence
  Description of Artificial Sequence: Synthetic oligonucleotide
acttccctgtcttgcgttcctgtgttttctaatgc

SEQ ID NO: 217837 - DNA, 34 bp, Artificial Sequence
  Description of Artificial Sequence: Synthetic oligonucleotide
cttccctgtcttgcgttcctgtgttttctaatgc

SEQ ID NO: 217838 - DNA, 35 bp, Artificial Sequence
  Description of Artificial Sequence: Synthetic oligonucleotide
ttccctgtcttgcgttcctgtgttttctaatgcac

SEQ ID NO: 217839 - DNA, 34 bp, Artificial Sequence
  Description of Artificial Sequence: Synthetic oligonucleotide
tccctgtcttgcgttcctgtgttttctaatgcac

SEQ ID NO: 217840 - DNA, 33 bp, Artificial Sequence
  Description of Artificial Sequence: Synthetic oligonucleotide
ccctgtcttgcgttcctgtgttttctaatgcac

SEQ ID NO: 217841 - DNA, 33 bp, Artificial Sequence
  Description of Artificial Sequence: Synthetic oligonucleotide
cctgtcttgcgttcctgtgttttctaatgcacg

SEQ ID NO: 217842 - DNA, 33 bp, Artificial Sequence
  Description of Artificial Sequence: Synthetic oligonucleotide
ctgtcttgcgttcctgtgttttctaatgcacgc

SEQ ID NO: 217843 - DNA, 33 bp, Artificial Sequence
  Description of Artificial Sequence: Synthetic oligonucleotide
tgtcttgcgttcctgtgttttctaatgcacgcc

SEQ ID NO: 217844 - DNA, 32 bp, Artificial Sequence
  Description of Artificial Sequence: Synthetic oligonucleotide
gtcttgcgttcctgtgttttctaatgcacgcc

SEQ ID NO: 217845 - DNA, 32 bp, Artificial Sequence
  Description of Artificial Sequence: Synthetic oligonucleotide
tcttgcgttcctgtgttttctaatgcacgccc

SEQ ID NO: 217846 - DNA, 31 bp, Artificial Sequence
  Description of Artificial Sequence: Synthetic oligonucleotide
cttgcgttcctgtgttttctaatgcacgccc

SEQ ID NO: 217847 - DNA, 31 bp, Artificial Sequence
  Description of Artificial Sequence: Synthetic oligonucleotide
ttgcgttcctgtgttttctaatgcacgcccg

SEQ ID NO: 217848 - DNA, 30 bp, Artificial Sequence
  Description of Artificial Sequence: Synthetic oligonucleotide
tgcgttcctgtgttttctaatgcacgcccg

SEQ ID NO: 217849 - DNA, 29 bp, Artificial Sequence
  Description of Artificial Sequence: Synthetic oligonucleotide
gcgttcctgtgttttctaatgcacgcccg

SEQ ID NO: 217850 - DNA, 30 bp, Artificial Sequence
  Description of Artificial Sequence: Synthetic oligonucleotide
cgttcctgtgttttctaatgcacgcccgag

SEQ ID NO: 217851 - DNA, 30 bp, Artificial Sequence
  Description of Artificial Sequence: Synthetic oligonucleotide
gttcctgtgttttctaatgcacgcccgagg

SEQ ID NO: 217852 - DNA, 31 bp, Artificial Sequence
  Description of Artificial Sequence: Synthetic oligonucleotide
ttcctgtgttttctaatgcacgcccgaggtc

SEQ ID NO: 217853 - DNA, 30 bp, Artificial Sequence
  Description of Artificial Sequence: Synthetic oligonucleotide
tcctgtgttttctaatgcacgcccgaggtc

SEQ ID NO: 217854 - DNA, 29 bp, Artificial Sequence
  Description of Artificial Sequence: Synthetic oligonucleotide
cctgtgttttctaatgcacgcccgaggtc

SEQ ID NO: 217855 - DNA, 32 bp, Artificial Sequence
  Description of Artificial Sequence: Synthetic oligonucleotide
ctgtgttttctaatgcacgcccgaggtcaaag

SEQ ID NO: 217856 - DNA, 33 bp, Artificial Sequence
  Description of Artificial Sequence: Synthetic oligonucleotide
tgtgttttctaatgcacgcccgaggtcaaagag

SEQ ID NO: 217857 - DNA, 32 bp, Artificial Sequence
  Description of Artificial Sequence: Synthetic oligonucleotide
gtgttttctaatgcacgcccgaggtcaaagag

SEQ ID NO: 217858 - DNA, 33 bp, Artificial Sequence
  Description of Artificial Sequence: Synthetic oligonucleotide
tgttttctaatgcacgcccgaggtcaaagagac

SEQ ID NO: 217859 - DNA, 32 bp, Artificial Sequence
  Description of Artificial Sequence: Synthetic oligonucleotide
gttttctaatgcacgcccgaggtcaaagagac

SEQ ID NO: 217860 - DNA, 35 bp, Artificial Sequence
  Description of Artificial Sequence: Synthetic oligonucleotide
ttttctaatgcacgcccgaggtcaaagagactttg

SEQ ID NO: 217861 - DNA, 34 bp, Artificial Sequence
  Description of Artificial Sequence: Synthetic oligonucleotide
tttctaatgcacgcccgaggtcaaagagactttg

SEQ ID NO: 217862 - DNA, 33 bp, Artificial Sequence
  Description of Artificial Sequence: Synthetic oligonucleotide
ttctaatgcacgcccgaggtcaaagagactttg

SEQ ID NO: 217863 - DNA, 32 bp, Artificial Sequence
  Description of Artificial Sequence: Synthetic oligonucleotide
tctaatgcacgcccgaggtcaaagagactttg

SEQ ID NO: 217864 - DNA, 31 bp, Artificial Sequence
  Description of Artificial Sequence: Synthetic oligonucleotide
ctaatgcacgcccgaggtcaaagagactttg

SEQ ID NO: 217865 - DNA, 35 bp, Artificial Sequence
  Description of Artificial Sequence: Synthetic oligonucleotide
taatgcacgcccgaggtcaaagagactttgatttg

SEQ ID NO: 217866 - DNA, 34 bp, Artificial Sequence
  Description of Artificial Sequence: Synthetic oligonucleotide
aatgcacgcccgaggtcaaagagactttgatttg

SEQ ID NO: 217867 - DNA, 33 bp, Artificial Sequence
  Description of Artificial Sequence: Synthetic oligonucleotide
atgcacgcccgaggtcaaagagactttgatttg

SEQ ID NO: 217868 - DNA, 32 bp, Artificial Sequence
  Description of Artificial Sequence: Synthetic oligonucleotide
tgcacgcccgaggtcaaagagactttgatttg

SEQ ID NO: 217869 - DNA, 31 bp, Artificial Sequence
  Description of Artificial Sequence: Synthetic oligonucleotide
gcacgcccgaggtcaaagagactttgatttg

SEQ ID NO: 217870 - DNA, 31 bp, Artificial Sequence
  Description of Artificial Sequence: Synthetic oligonucleotide
cacgcccgaggtcaaagagactttgatttgg

SEQ ID NO: 217871 - DNA, 31 bp, Artificial Sequence
  Description of Artificial Sequence: Synthetic oligonucleotide
acgcccgaggtcaaagagactttgatttggc

SEQ ID NO: 217872 - DNA, 30 bp, Artificial Sequence
  Description of Artificial Sequence: Synthetic oligonucleotide
cgcccgaggtcaaagagactttgatttggc

SEQ ID NO: 217873 - DNA, 31 bp, Artificial Sequence
  Description of Artificial Sequence: Synthetic oligonucleotide
gcccgaggtcaaagagactttgatttggcag

SEQ ID NO: 217874 - DNA, 33 bp, Artificial Sequence
  Description of Artificial Sequence: Synthetic oligonucleotide
cccgaggtcaaagagactttgatttggcagatg

SEQ ID NO: 217875 - DNA, 33 bp, Artificial Sequence
  Description of Artificial Sequence: Synthetic oligonucleotide
ccgaggtcaaagagactttgatttggcagatgc

SEQ ID NO: 217876 - DNA, 33 bp, Artificial Sequence
  Description of Artificial Sequence: Synthetic oligonucleotide
cgaggtcaaagagactttgatttggcagatgcc

SEQ ID NO: 217877 - DNA, 33 bp, Artificial Sequence
  Description of Artificial Sequence: Synthetic oligonucleotide
gaggtcaaagagactttgatttggcagatgccc

SEQ ID NO: 217878 - DNA, 35 bp, Artificial Sequence
  Description of Artificial Sequence: Synthetic oligonucleotide
aggtcaaagagactttgatttggcagatgcccttg

SEQ ID NO: 217879 - DNA, 34 bp, Artificial Sequence
  Description of Artificial Sequence: Synthetic oligonucleotide
ggtcaaagagactttgatttggcagatgcccttg

SEQ ID NO: 217880 - DNA, 36 bp, Artificial Sequence
  Description of Artificial Sequence: Synthetic oligonucleotide
gtcaaagagactttgatttggcagatgcccttgatg

SEQ ID NO: 217881 - DNA, 37 bp, Artificial Sequence
  Description of Artificial Sequence: Synthetic oligonucleotide
tcaaagagactttgatttggcagatgcccttgatgac

SEQ ID NO: 217882 - DNA, 36 bp, Artificial Sequence
  Description of Artificial Sequence: Synthetic oligonucleotide
caaagagactttgatttggcagatgcccttgatgac

SEQ ID NO: 217883 - DNA, 36 bp, Artificial Sequence
  Description of Artificial Sequence: Synthetic oligonucleotide
aaagagactttgatttggcagatgcccttgatgacc

SEQ ID NO: 217884 - DNA, 35 bp, Artificial Sequence
  Description of Artificial Sequence: Synthetic oligonucleotide
aagagactttgatttggcagatgcccttgatgacc

SEQ ID NO: 217885 - DNA, 34 bp, Artificial Sequence
  Description of Artificial Sequence: Synthetic oligonucleotide
agagactttgatttggcagatgcccttgatgacc

SEQ ID NO: 217886 - DNA, 33 bp, Artificial Sequence
  Description of Artificial Sequence: Synthetic oligonucleotide
gagactttgatttggcagatgcccttgatgacc

SEQ ID NO: 217887 - DNA, 33 bp, Artificial Sequence
  Description of Artificial Sequence: Synthetic oligonucleotide
agactttgatttggcagatgcccttgatgaccc

SEQ ID NO: 217888 - DNA, 32 bp, Artificial Sequence
  Description of Artificial Sequence: Synthetic oligonucleotide
gactttgatttggcagatgcccttgatgaccc

SEQ ID NO: 217889 - DNA, 33 bp, Artificial Sequence
  Description of Artificial Sequence: Synthetic oligonucleotide
actttgatttggcagatgcccttgatgaccctg

SEQ ID NO: 217890 - DNA, 32 bp, Artificial Sequence
  Description of Artificial Sequence: Synthetic oligonucleotide
ctttgatttggcagatgcccttgatgaccctg

SEQ ID NO: 217891 - DNA, 34 bp, Artificial Sequence
  Description of Artificial Sequence: Synthetic oligonucleotide
tttgatttggcagatgcccttgatgaccctgaac

SEQ ID NO: 217892 - DNA, 33 bp, Artificial Sequence
  Description of Artificial Sequence: Synthetic oligonucleotide
ttgatttggcagatgcccttgatgaccctgaac

SEQ ID NO: 217893 - DNA, 32 bp, Artificial Sequence
  Description of Artificial Sequence: Synthetic oligonucleotide
tgatttggcagatgcccttgatgaccctgaac

SEQ ID NO: 217894 - DNA, 31 bp, Artificial Sequence
  Description of Artificial Sequence: Synthetic oligonucleotide
gatttggcagatgcccttgatgaccctgaac

SEQ ID NO: 217895 - DNA, 31 bp, Artificial Sequence
  Description of Artificial Sequence: Synthetic oligonucleotide
atttggcagatgcccttgatgaccctgaacc

SEQ ID NO: 217896 - DNA, 30 bp, Artificial Sequence
  Description of Artificial Sequence: Synthetic oligonucleotide
tttggcagatgcccttgatgaccctgaacc

SEQ ID NO: 217897 - DNA, 29 bp, Artificial Sequence
  Description of Artificial Sequence: Synthetic oligonucleotide
ttggcagatgcccttgatgaccctgaacc

SEQ ID NO: 217898 - DNA, 28 bp, Artificial Sequence
  Description of Artificial Sequence: Synthetic oligonucleotide
tggcagatgcccttgatgaccctgaacc

SEQ ID NO: 217899 - DNA, 27 bp, Artificial Sequence
  Description of Artificial Sequence: Synthetic oligonucleotide
ggcagatgcccttgatgaccctgaacc

SEQ ID NO: 217900 - DNA, 27 bp, Artificial Sequence
  Description of Artificial Sequence: Synthetic oligonucleotide
gcagatgcccttgatgaccctgaaccc

SEQ ID NO: 217901 - DNA, 28 bp, Artificial Sequence
  Description of Artificial Sequence: Synthetic oligonucleotide
cagatgcccttgatgaccctgaacccac

SEQ ID NO: 217902 - DNA, 28 bp, Artificial Sequence
  Description of Artificial Sequence: Synthetic oligonucleotide
agatgcccttgatgaccctgaacccacc

SEQ ID NO: 217903 - DNA, 27 bp, Artificial Sequence
  Description of Artificial Sequence: Synthetic oligonucleotide
gatgcccttgatgaccctgaacccacc

SEQ ID NO: 217904 - DNA, 29 bp, Artificial Sequence
  Description of Artificial Sequence: Synthetic oligonucleotide
atgcccttgatgaccctgaacccaccaag

SEQ ID NO: 217905 - DNA, 28 bp, Artificial Sequence
  Description of Artificial Sequence: Synthetic oligonucleotide
tgcccttgatgaccctgaacccaccaag

SEQ ID NO: 217906 - DNA, 27 bp, Artificial Sequence
  Description of Artificial Sequence: Synthetic oligonucleotide
gcccttgatgaccctgaacccaccaag

SEQ ID NO: 217907 - DNA, 29 bp, Artificial Sequence
  Description of Artificial Sequence: Synthetic oligonucleotide
cccttgatgaccctgaacccaccaagaag

SEQ ID NO: 217908 - DNA, 29 bp, Artificial Sequence
  Description of Artificial Sequence: Synthetic oligonucleotide
ccttgatgaccctgaacccaccaagaagc

SEQ ID NO: 217909 - DNA, 29 bp, Artificial Sequence
  Description of Artificial Sequence: Synthetic oligonucleotide
cttgatgaccctgaacccaccaagaagcc

SEQ ID NO: 217910 - DNA, 32 bp, Artificial Sequence
  Description of Artificial Sequence: Synthetic oligonucleotide
ttgatgaccctgaacccaccaagaagccaaac

SEQ ID NO: 217911 - DNA, 31 bp, Artificial Sequence
  Description of Artificial Sequence: Synthetic oligonucleotide
tgatgaccctgaacccaccaagaagccaaac

SEQ ID NO: 217912 - DNA, 30 bp, Artificial Sequence
  Description of Artificial Sequence: Synthetic oligonucleotide
gatgaccctgaacccaccaagaagccaaac

SEQ ID NO: 217913 - DNA, 31 bp, Artificial Sequence
  Description of Artificial Sequence: Synthetic oligonucleotide
atgaccctgaacccaccaagaagccaaactc

SEQ ID NO: 217914 - DNA, 30 bp, Artificial Sequence
  Description of Artificial Sequence: Synthetic oligonucleotide
tgaccctgaacccaccaagaagccaaactc

SEQ ID NO: 217915 - DNA, 29 bp, Artificial Sequence
  Description of Artificial Sequence: Synthetic oligonucleotide
gaccctgaacccaccaagaagccaaactc

SEQ ID NO: 217916 - DNA, 30 bp, Artificial Sequence
  Description of Artificial Sequence: Synthetic oligonucleotide
accctgaacccaccaagaagccaaactcag

SEQ ID NO: 217917 - DNA, 29 bp, Artificial Sequence
  Description of Artificial Sequence: Synthetic oligonucleotide
ccctgaacccaccaagaagccaaactcag

SEQ ID NO: 217918 - DNA, 33 bp, Artificial Sequence
  Description of Artificial Sequence: Synthetic oligonucleotide
cctgaacccaccaagaagccaaactcagatatc

SEQ ID NO: 217919 - DNA, 35 bp, Artificial Sequence
  Description of Artificial Sequence: Synthetic oligonucleotide
ctgaacccaccaagaagccaaactcagatatctac

SEQ ID NO: 217920 - DNA, 35 bp, Artificial Sequence
  Description of Artificial Sequence: Synthetic oligonucleotide
tgaacccaccaagaagccaaactcagatatctacc

SEQ ID NO: 217921 - DNA, 34 bp, Artificial Sequence
  Description of Artificial Sequence: Synthetic oligonucleotide
gaacccaccaagaagccaaactcagatatctacc

SEQ ID NO: 217922 - DNA, 34 bp, Artificial Sequence
  Description of Artificial Sequence: Synthetic oligonucleotide
aacccaccaagaagccaaactcagatatctaccc

SEQ ID NO: 217923 - DNA, 33 bp, Artificial Sequence
  Description of Artificial Sequence: Synthetic oligonucleotide
acccaccaagaagccaaactcagatatctaccc

SEQ ID NO: 217924 - DNA, 32 bp, Artificial Sequence
  Description of Artificial Sequence: Synthetic oligonucleotide
cccaccaagaagccaaactcagatatctaccc

SEQ ID NO: 217925 - DNA, 35 bp, Artificial Sequence
  Description of Artificial Sequence: Synthetic oligonucleotide
ccaccaagaagccaaactcagatatctacccaaag

SEQ ID NO: 217926 - DNA, 35 bp, Artificial Sequence
  Description of Artificial Sequence: Synthetic oligonucleotide
caccaagaagccaaactcagatatctacccaaagc

SEQ ID NO: 217927 - DNA, 35 bp, Artificial Sequence
  Description of Artificial Sequence: Synthetic oligonucleotide
accaagaagccaaactcagatatctacccaaagcc

SEQ ID NO: 217928 - DNA, 34 bp, Artificial Sequence
  Description of Artificial Sequence: Synthetic oligonucleotide
ccaagaagccaaactcagatatctacccaaagcc

SEQ ID NO: 217929 - DNA, 38 bp, Artificial Sequence
  Description of Artificial Sequence: Synthetic oligonucleotide
caagaagccaaactcagatatctacccaaagccaaaac

SEQ ID NO: 217930 - DNA, 38 bp, Artificial Sequence
  Description of Artificial Sequence: Synthetic oligonucleotide
aagaagccaaactcagatatctacccaaagccaaaacc

SEQ ID NO: 217931 - DNA, 37 bp, Artificial Sequence
  Description of Artificial Sequence: Synthetic oligonucleotide
agaagccaaactcagatatctacccaaagccaaaacc

SEQ ID NO: 217932 - DNA, 36 bp, Artificial Sequence
  Description of Artificial Sequence: Synthetic oligonucleotide
gaagccaaactcagatatctacccaaagccaaaacc

SEQ ID NO: 217933 - DNA, 37 bp, Artificial Sequence
  Description of Artificial Sequence: Synthetic oligonucleotide
aagccaaactcagatatctacccaaagccaaaaccac

SEQ ID NO: 217934 - DNA, 36 bp, Artificial Sequence
  Description of Artificial Sequence: Synthetic oligonucleotide
agccaaactcagatatctacccaaagccaaaaccac

SEQ ID NO: 217935 - DNA, 35 bp, Artificial Sequence
  Description of Artificial Sequence: Synthetic oligonucleotide
gccaaactcagatatctacccaaagccaaaaccac

SEQ ID NO: 217936 - DNA, 35 bp, Artificial Sequence
  Description of Artificial Sequence: Synthetic oligonucleotide
ccaaactcagatatctacccaaagccaaaaccacc

SEQ ID NO: 217937 - DNA, 38 bp, Artificial Sequence
  Description of Artificial Sequence: Synthetic oligonucleotide
caaactcagatatctacccaaagccaaaaccaccttac

SEQ ID NO: 217938 - DNA, 40 bp, Artificial Sequence
  Description of Artificial Sequence: Synthetic oligonucleotide
aaactcagatatctacccaaagccaaaaccaccttactac

SEQ ID NO: 217939 - DNA, 39 bp, Artificial Sequence
  Description of Artificial Sequence: Synthetic oligonucleotide
aactcagatatctacccaaagccaaaaccaccttactac

SEQ ID NO: 217940 - DNA, 38 bp, Artificial Sequence
  Description of Artificial Sequence: Synthetic oligonucleotide
actcagatatctacccaaagccaaaaccaccttactac

SEQ ID NO: 217941 - DNA, 37 bp, Artificial Sequence
  Description of Artificial Sequence: Synthetic oligonucleotide
ctcagatatctacccaaagccaaaaccaccttactac

SEQ ID NO: 217942 - DNA, 37 bp, Artificial Sequence
  Description of Artificial Sequence: Synthetic oligonucleotide
tcagatatctacccaaagccaaaaccaccttactacc

SEQ ID NO: 217943 - DNA, 36 bp, Artificial Sequence
  Description of Artificial Sequence: Synthetic oligonucleotide
cagatatctacccaaagccaaaaccaccttactacc

SEQ ID NO: 217944 - DNA, 36 bp, Artificial Sequence
  Description of Artificial Sequence: Synthetic oligonucleotide
agatatctacccaaagccaaaaccaccttactaccc

SEQ ID NO: 217945 - DNA, 35 bp, Artificial Sequence
  Description of Artificial Sequence: Synthetic oligonucleotide
gatatctacccaaagccaaaaccaccttactaccc

SEQ ID NO: 217946 - DNA, 36 bp, Artificial Sequence
  Description of Artificial Sequence: Synthetic oligonucleotide
atatctacccaaagccaaaaccaccttactacccac

SEQ ID NO: 217947 - DNA, 35 bp, Artificial Sequence
  Description of Artificial Sequence: Synthetic oligonucleotide
tatctacccaaagccaaaaccaccttactacccac

SEQ ID NO: 217948 - DNA, 34 bp, Artificial Sequence
  Description of Artificial Sequence: Synthetic oligonucleotide
atctacccaaagccaaaaccaccttactacccac

SEQ ID NO: 217949 - DNA, 33 bp, Artificial Sequence
  Description of Artificial Sequence: Synthetic oligonucleotide
tctacccaaagccaaaaccaccttactacccac

SEQ ID NO: 217950 - DNA, 32 bp, Artificial Sequence
  Description of Artificial Sequence: Synthetic oligonucleotide
ctacccaaagccaaaaccaccttactacccac

SEQ ID NO: 217951 - DNA, 33 bp, Artificial Sequence
  Description of Artificial Sequence: Synthetic oligonucleotide
tacccaaagccaaaaccaccttactacccacag

SEQ ID NO: 217952 - DNA, 32 bp, Artificial Sequence
  Description of Artificial Sequence: Synthetic oligonucleotide
acccaaagccaaaaccaccttactacccacag

SEQ ID NO: 217953 - DNA, 31 bp, Artificial Sequence
  Description of Artificial Sequence: Synthetic oligonucleotide
cccaaagccaaaaccaccttactacccacag

SEQ ID NO: 217954 - DNA, 31 bp, Artificial Sequence
  Description of Artificial Sequence: Synthetic oligonucleotide
ccaaagccaaaaccaccttactacccacagc

SEQ ID NO: 217955 - DNA, 31 bp, Artificial Sequence
  Description of Artificial Sequence: Synthetic oligonucleotide
caaagccaaaaccaccttactacccacagcc

SEQ ID NO: 217956 - DNA, 31 bp, Artificial Sequence
  Description of Artificial Sequence: Synthetic oligonucleotide
aaagccaaaaccaccttactacccacagccc

SEQ ID NO: 217957 - DNA, 30 bp, Artificial Sequence
  Description of Artificial Sequence: Synthetic oligonucleotide
aagccaaaaccaccttactacccacagccc

SEQ ID NO: 217958 - DNA, 29 bp, Artificial Sequence
  Description of Artificial Sequence: Synthetic oligonucleotide
agccaaaaccaccttactacccacagccc

SEQ ID NO: 217959 - DNA, 28 bp, Artificial Sequence
  Description of Artificial Sequence: Synthetic oligonucleotide
gccaaaaccaccttactacccacagccc

SEQ ID NO: 217960 - DNA, 28 bp, Artificial Sequence
  Description of Artificial Sequence: Synthetic oligonucleotide
ccaaaaccaccttactacccacagcccg

SEQ ID NO: 217961 - DNA, 29 bp, Artificial Sequence
  Description of Artificial Sequence: Synthetic oligonucleotide
caaaaccaccttactacccacagcccgag

SEQ ID NO: 217962 - DNA, 32 bp, Artificial Sequence
  Description of Artificial Sequence: Synthetic oligonucleotide
aaaaccaccttactacccacagcccgagaatc

SEQ ID NO: 217963 - DNA, 31 bp, Artificial Sequence
  Description of Artificial Sequence: Synthetic oligonucleotide
aaaccaccttactacccacagcccgagaatc

SEQ ID NO: 217964 - DNA, 30 bp, Artificial Sequence
  Description of Artificial Sequence: Synthetic oligonucleotide
aaccaccttactacccacagcccgagaatc

SEQ ID NO: 217965 - DNA, 29 bp, Artificial Sequence
  Description of Artificial Sequence: Synthetic oligonucleotide
accaccttactacccacagcccgagaatc

SEQ ID NO: 217966 - DNA, 28 bp, Artificial Sequence
  Description of Artificial Sequence: Synthetic oligonucleotide
ccaccttactacccacagcccgagaatc

SEQ ID NO: 217967 - DNA, 28 bp, Artificial Sequence
  Description of Artificial Sequence: Synthetic oligonucleotide
caccttactacccacagcccgagaatcc

SEQ ID NO: 217968 - DNA, 28 bp, Artificial Sequence
  Description of Artificial Sequence: Synthetic oligonucleotide
accttactacccacagcccgagaatccc

SEQ ID NO: 217969 - DNA, 27 bp, Artificial Sequence
  Description of Artificial Sequence: Synthetic oligonucleotide
ccttactacccacagcccgagaatccc

SEQ ID NO: 217970 - DNA, 27 bp, Artificial Sequence
  Description of Artificial Sequence: Synthetic oligonucleotide
cttactacccacagcccgagaatcccg

SEQ ID NO: 217971 - DNA, 28 bp, Artificial Sequence
  Description of Artificial Sequence: Synthetic oligonucleotide
ttactacccacagcccgagaatcccgac

SEQ ID NO: 217972 - DNA, 27 bp, Artificial Sequence
  Description of Artificial Sequence: Synthetic oligonucleotide
tactacccacagcccgagaatcccgac

SEQ ID NO: 217973 - DNA, 27 bp, Artificial Sequence
  Description of Artificial Sequence: Synthetic oligonucleotide
actacccacagcccgagaatcccgaca

SEQ ID NO: 217974 - DNA, 26 bp, Artificial Sequence
  Description of Artificial Sequence: Synthetic oligonucleotide
ctacccacagcccgagaatcccgaca

SEQ ID NO: 217975 - DNA, 26 bp, Artificial Sequence
  Description of Artificial Sequence: Synthetic oligonucleotide
tacccacagcccgagaatcccgacag

SEQ ID NO: 217976 - DNA, 25 bp, Artificial Sequence
  Description of Artificial Sequence: Synthetic oligonucleotide
acccacagcccgagaatcccgacag

SEQ ID NO: 217977 - DNA, 24 bp, Artificial Sequence
  Description of Artificial Sequence: Synthetic oligonucleotide
cccacagcccgagaatcccgacag

SEQ ID NO: 217978 - DNA, 24 bp, Artificial Sequence
  Description of Artificial Sequence: Synthetic oligonucleotide
ccacagcccgagaatcccgacagc

SEQ ID NO: 217979 - DNA, 24 bp, Artificial Sequence
  Description of Artificial Sequence: Synthetic oligonucleotide
cacagcccgagaatcccgacagcg

SEQ ID NO: 217980 - DNA, 25 bp, Artificial Sequence
  Description of Artificial Sequence: Synthetic oligonucleotide
acagcccgagaatcccgacagcggt

SEQ ID NO: 217981 - DNA, 24 bp, Artificial Sequence
  Description of Artificial Sequence: Synthetic oligonucleotide
cagcccgagaatcccgacagcggt

SEQ ID NO: 217982 - DNA, 24 bp, Artificial Sequence
  Description of Artificial Sequence: Synthetic oligonucleotide
agcccgagaatcccgacagcggtg

SEQ ID NO: 217983 - DNA, 23 bp, Artificial Sequence
  Description of Artificial Sequence: Synthetic oligonucleotide
gcccgagaatcccgacagcggtg

SEQ ID NO: 217984 - DNA, 27 bp, Artificial Sequence
  Description of Artificial Sequence: Synthetic oligonucleotide
cccgagaatcccgacagcggtggaaat

SEQ ID NO: 217985 - DNA, 29 bp, Artificial Sequence
  Description of Artificial Sequence: Synthetic oligonucleotide
ccgagaatcccgacagcggtggaaatatc

SEQ ID NO: 217986 - DNA, 31 bp, Artificial Sequence
  Description of Artificial Sequence: Synthetic oligonucleotide
cgagaatcccgacagcggtggaaatatctac

SEQ ID NO: 217987 - DNA, 31 bp, Artificial Sequence
  Description of Artificial Sequence: Synthetic oligonucleotide
gagaatcccgacagcggtggaaatatctacc

SEQ ID NO: 217988 - DNA, 31 bp, Artificial Sequence
  Description of Artificial Sequence: Synthetic oligonucleotide
agaatcccgacagcggtggaaatatctaccc

SEQ ID NO: 217989 - DNA, 30 bp, Artificial Sequence
  Description of Artificial Sequence: Synthetic oligonucleotide
gaatcccgacagcggtggaaatatctaccc

SEQ ID NO: 217990 - DNA, 32 bp, Artificial Sequence
  Description of Artificial Sequence: Synthetic oligonucleotide
aatcccgacagcggtggaaatatctacccaag

SEQ ID NO: 217991 - DNA, 31 bp, Artificial Sequence
  Description of Artificial Sequence: Synthetic oligonucleotide
atcccgacagcggtggaaatatctacccaag

SEQ ID NO: 217992 - DNA, 30 bp, Artificial Sequence
  Description of Artificial Sequence: Synthetic oligonucleotide
tcccgacagcggtggaaatatctacccaag

SEQ ID NO: 217993 - DNA, 29 bp, Artificial Sequence
  Description of Artificial Sequence: Synthetic oligonucleotide
cccgacagcggtggaaatatctacccaag

SEQ ID NO: 217994 - DNA, 29 bp, Artificial Sequence
  Description of Artificial Sequence: Synthetic oligonucleotide
ccgacagcggtggaaatatctacccaagg

SEQ ID NO: 217995 - DNA, 29 bp, Artificial Sequence
  Description of Artificial Sequence: Synthetic oligonucleotide
cgacagcggtggaaatatctacccaaggc

SEQ ID NO: 217996 - DNA, 29 bp, Artificial Sequence
  Description of Artificial Sequence: Synthetic oligonucleotide
gacagcggtggaaatatctacccaaggcc

SEQ ID NO: 217997 - DNA, 32 bp, Artificial Sequence
  Description of Artificial Sequence: Synthetic oligonucleotide
acagcggtggaaatatctacccaaggccaaag

SEQ ID NO: 217998 - DNA, 31 bp, Artificial Sequence
  Description of Artificial Sequence: Synthetic oligonucleotide
cagcggtggaaatatctacccaaggccaaag

SEQ ID NO: 217999 - DNA, 31 bp, Artificial Sequence
  Description of Artificial Sequence: Synthetic oligonucleotide
agcggtggaaatatctacccaaggccaaagc

SEQ ID NO: 218000 - DNA, 30 bp, Artificial Sequence
  Description of Artificial Sequence: Synthetic oligonucleotide
gcggtggaaatatctacccaaggccaaagc

SEQ ID NO: 218001 - DNA, 30 bp, Artificial Sequence
  Description of Artificial Sequence: Synthetic oligonucleotide
cggtggaaatatctacccaaggccaaagcc

SEQ ID NO: 218002 - DNA, 31 bp, Artificial Sequence
  Description of Artificial Sequence: Synthetic oligonucleotide
ggtggaaatatctacccaaggccaaagccac

SEQ ID NO: 218003 - DNA, 31 bp, Artificial Sequence
  Description of Artificial Sequence: Synthetic oligonucleotide
gtggaaatatctacccaaggccaaagccacg

SEQ ID NO: 218004 - DNA, 31 bp, Artificial Sequence
  Description of Artificial Sequence: Synthetic oligonucleotide
tggaaatatctacccaaggccaaagccacgc

SEQ ID NO: 218005 - DNA, 30 bp, Artificial Sequence
  Description of Artificial Sequence: Synthetic oligonucleotide
ggaaatatctacccaaggccaaagccacgc

SEQ ID NO: 218006 - DNA, 30 bp, Artificial Sequence
  Description of Artificial Sequence: Synthetic oligonucleotide
gaaatatctacccaaggccaaagccacgcc

SEQ ID NO: 218007 - DNA, 30 bp, Artificial Sequence
  Description of Artificial Sequence: Synthetic oligonucleotide
aaatatctacccaaggccaaagccacgccc

SEQ ID NO: 218008 - DNA, 29 bp, Artificial Sequence
  Description of Artificial Sequence: Synthetic oligonucleotide
aatatctacccaaggccaaagccacgccc

SEQ ID NO: 218009 - DNA, 28 bp, Artificial Sequence
  Description of Artificial Sequence: Synthetic oligonucleotide
atatctacccaaggccaaagccacgccc

SEQ ID NO: 218010 - DNA, 27 bp, Artificial Sequence
  Description of Artificial Sequence: Synthetic oligonucleotide
tatctacccaaggccaaagccacgccc

SEQ ID NO: 218011 - DNA, 27 bp, Artificial Sequence
  Description of Artificial Sequence: Synthetic oligonucleotide
atctacccaaggccaaagccacgccct

SEQ ID NO: 218012 - DNA, 26 bp, Artificial Sequence
  Description of Artificial Sequence: Synthetic oligonucleotide
tctacccaaggccaaagccacgccct

SEQ ID NO: 218013 - DNA, 25 bp, Artificial Sequence
  Description of Artificial Sequence: Synthetic oligonucleotide
ctacccaaggccaaagccacgccct

SEQ ID NO: 218014 - DNA, 27 bp, Artificial Sequence
  Description of Artificial Sequence: Synthetic oligonucleotide
tacccaaggccaaagccacgccctcaa

SEQ ID NO: 218015 - DNA, 26 bp, Artificial Sequence
  Description of Artificial Sequence: Synthetic oligonucleotide
acccaaggccaaagccacgccctcaa

SEQ ID NO: 218016 - DNA, 25 bp, Artificial Sequence
  Description of Artificial Sequence: Synthetic oligonucleotide
cccaaggccaaagccacgccctcaa

SEQ ID NO: 218017 - DNA, 25 bp, Artificial Sequence
  Description of Artificial Sequence: Synthetic oligonucleotide
ccaaggccaaagccacgccctcaac

SEQ ID NO: 218018 - DNA, 25 bp, Artificial Sequence
  Description of Artificial Sequence: Synthetic oligonucleotide
caaggccaaagccacgccctcaacc

SEQ ID NO: 218019 - DNA, 25 bp, Artificial Sequence
  Description of Artificial Sequence: Synthetic oligonucleotide
aaggccaaagccacgccctcaaccc

SEQ ID NO: 218020 - DNA, 24 bp, Artificial Sequence
  Description of Artificial Sequence: Synthetic oligonucleotide
aggccaaagccacgccctcaaccc

SEQ ID NO: 218021 - DNA, 23 bp, Artificial Sequence
  Description of Artificial Sequence: Synthetic oligonucleotide
ggccaaagccacgccctcaaccc

SEQ ID NO: 218022 - DNA, 24 bp, Artificial Sequence
  Description of Artificial Sequence: Synthetic oligonucleotide
gccaaagccacgccctcaacccca

SEQ ID NO: 218023 - DNA, 24 bp, Artificial Sequence
  Description of Artificial Sequence: Synthetic oligonucleotide
ccaaagccacgccctcaaccccag

SEQ ID NO: 218024 - DNA, 24 bp, Artificial Sequence
  Description of Artificial Sequence: Synthetic oligonucleotide
caaagccacgccctcaaccccagc

SEQ ID NO: 218025 - DNA, 25 bp, Artificial Sequence
  Description of Artificial Sequence: Synthetic oligonucleotide
aaagccacgccctcaaccccagcct

SEQ ID NO: 218026 - DNA, 24 bp, Artificial Sequence
  Description of Artificial Sequence: Synthetic oligonucleotide
aagccacgccctcaaccccagcct

SEQ ID NO: 218027 - DNA, 23 bp, Artificial Sequence
  Description of Artificial Sequence: Synthetic oligonucleotide
agccacgccctcaaccccagcct

SEQ ID NO: 218028 - DNA, 22 bp, Artificial Sequence
  Description of Artificial Sequence: Synthetic oligonucleotide
gccacgccctcaaccccagcct

SEQ ID NO: 218029 - DNA, 22 bp, Artificial Sequence
  Description of Artificial Sequence: Synthetic oligonucleotide
ccacgccctcaaccccagcctg

SEQ ID NO: 218030 - DNA, 22 bp, Artificial Sequence
  Description of Artificial Sequence: Synthetic oligonucleotide
cacgccctcaaccccagcctgg

SEQ ID NO: 218031 - DNA, 26 bp, Artificial Sequence
  Description of Artificial Sequence: Synthetic oligonucleotide
acgccctcaaccccagcctggcaatt

SEQ ID NO: 218032 - DNA, 25 bp, Artificial Sequence
  Description of Artificial Sequence: Synthetic oligonucleotide
cgccctcaaccccagcctggcaatt

SEQ ID NO: 218033 - DNA, 25 bp, Artificial Sequence
  Description of Artificial Sequence: Synthetic oligonucleotide
gccctcaaccccagcctggcaattc

SEQ ID NO: 218034 - DNA, 25 bp, Artificial Sequence
  Description of Artificial Sequence: Synthetic oligonucleotide
ccctcaaccccagcctggcaattcc

SEQ ID NO: 218035 - DNA, 25 bp, Artificial Sequence
  Description of Artificial Sequence: Synthetic oligonucleotide
cctcaaccccagcctggcaattccg

SEQ ID NO: 218036 - DNA, 25 bp, Artificial Sequence
  Description of Artificial Sequence: Synthetic oligonucleotide
ctcaaccccagcctggcaattccgg

SEQ ID NO: 218037 - DNA, 27 bp, Artificial Sequence
  Description of Artificial Sequence: Synthetic oligonucleotide
tcaaccccagcctggcaattccggcaa

SEQ ID NO: 218038 - DNA, 26 bp, Artificial Sequence
  Description of Artificial Sequence: Synthetic oligonucleotide
caaccccagcctggcaattccggcaa

SEQ ID NO: 218039 - DNA, 27 bp, Artificial Sequence
  Description of Artificial Sequence: Synthetic oligonucleotide
aaccccagcctggcaattccggcaaca

SEQ ID NO: 218040 - DNA, 26 bp, Artificial Sequence
  Description of Artificial Sequence: Synthetic oligonucleotide
accccagcctggcaattccggcaaca

SEQ ID NO: 218041 - DNA, 25 bp, Artificial Sequence
  Description of Artificial Sequence: Synthetic oligonucleotide
ccccagcctggcaattccggcaaca

SEQ ID NO: 218042 - DNA, 26 bp, Artificial Sequence
  Description of Artificial Sequence: Synthetic oligonucleotide
cccagcctggcaattccggcaacagt

SEQ ID NO: 218043 - DNA, 26 bp, Artificial Sequence
  Description of Artificial Sequence: Synthetic oligonucleotide
ccagcctggcaattccggcaacagtg

SEQ ID NO: 218044 - DNA, 27 bp, Artificial Sequence
  Description of Artificial Sequence: Synthetic oligonucleotide
cagcctggcaattccggcaacagtgga

SEQ ID NO: 218045 - DNA, 27 bp, Artificial Sequence
  Description of Artificial Sequence: Synthetic oligonucleotide
agcctggcaattccggcaacagtggag

SEQ ID NO: 218046 - DNA, 26 bp, Artificial Sequence
  Description of Artificial Sequence: Synthetic oligonucleotide
gcctggcaattccggcaacagtggag

SEQ ID NO: 218047 - DNA, 27 bp, Artificial Sequence
  Description of Artificial Sequence: Synthetic oligonucleotide
cctggcaattccggcaacagtggaggt

SEQ ID NO: 218048 - DNA, 29 bp, Artificial Sequence
  Description of Artificial Sequence: Synthetic oligonucleotide
ctggcaattccggcaacagtggaggttac

SEQ ID NO: 218049 - DNA, 31 bp, Artificial Sequence
  Description of Artificial Sequence: Synthetic oligonucleotide
tggcaattccggcaacagtggaggttacttc

SEQ ID NO: 218050 - DNA, 30 bp, Artificial Sequence
  Description of Artificial Sequence: Synthetic oligonucleotide
ggcaattccggcaacagtggaggttacttc

SEQ ID NO: 218051 - DNA, 33 bp, Artificial Sequence
  Description of Artificial Sequence: Synthetic oligonucleotide
gcaattccggcaacagtggaggttacttcaatg

SEQ ID NO: 218052 - DNA, 35 bp, Artificial Sequence
  Description of Artificial Sequence: Synthetic oligonucleotide
caattccggcaacagtggaggttacttcaatgatg

SEQ ID NO: 218053 - DNA, 36 bp, Artificial Sequence
  Description of Artificial Sequence: Synthetic oligonucleotide
aattccggcaacagtggaggttacttcaatgatgtg

SEQ ID NO: 218054 - DNA, 35 bp, Artificial Sequence
  Description of Artificial Sequence: Synthetic oligonucleotide
attccggcaacagtggaggttacttcaatgatgtg

SEQ ID NO: 218055 - DNA, 34 bp, Artificial Sequence
  Description of Artificial Sequence: Synthetic oligonucleotide
ttccggcaacagtggaggttacttcaatgatgtg

SEQ ID NO: 218056 - DNA, 33 bp, Artificial Sequence
  Description of Artificial Sequence: Synthetic oligonucleotide
tccggcaacagtggaggttacttcaatgatgtg

SEQ ID NO: 218057 - DNA, 32 bp, Artificial Sequence
  Description of Artificial Sequence: Synthetic oligonucleotide
ccggcaacagtggaggttacttcaatgatgtg

SEQ ID NO: 218058 - DNA, 32 bp, Artificial Sequence
  Description of Artificial Sequence: Synthetic oligonucleotide
cggcaacagtggaggttacttcaatgatgtgg

SEQ ID NO: 218059 - DNA, 33 bp, Artificial Sequence
  Description of Artificial Sequence: Synthetic oligonucleotide
ggcaacagtggaggttacttcaatgatgtggac

SEQ ID NO: 218060 - DNA, 33 bp, Artificial Sequence
  Description of Artificial Sequence: Synthetic oligonucleotide
gcaacagtggaggttacttcaatgatgtggacc

SEQ ID NO: 218061 - DNA, 33 bp, Artificial Sequence
  Description of Artificial Sequence: Synthetic oligonucleotide
caacagtggaggttacttcaatgatgtggaccg

SEQ ID NO: 218062 - DNA, 34 bp, Artificial Sequence
  Description of Artificial Sequence: Synthetic oligonucleotide
aacagtggaggttacttcaatgatgtggaccgtg

SEQ ID NO: 218063 - DNA, 33 bp, Artificial Sequence
  Description of Artificial Sequence: Synthetic oligonucleotide
acagtggaggttacttcaatgatgtggaccgtg

SEQ ID NO: 218064 - DNA, 32 bp, Artificial Sequence
  Description of Artificial Sequence: Synthetic oligonucleotide
cagtggaggttacttcaatgatgtggaccgtg

SEQ ID NO: 218065 - DNA, 34 bp, Artificial Sequence
  Description of Artificial Sequence: Synthetic oligonucleotide
agtggaggttacttcaatgatgtggaccgtgatg

SEQ ID NO: 218066 - DNA, 33 bp, Artificial Sequence
  Description of Artificial Sequence: Synthetic oligonucleotide
gtggaggttacttcaatgatgtggaccgtgatg

SEQ ID NO: 218067 - DNA, 34 bp, Artificial Sequence
  Description of Artificial Sequence: Synthetic oligonucleotide
tggaggttacttcaatgatgtggaccgtgatgac

SEQ ID NO: 218068 - DNA, 33 bp, Artificial Sequence
  Description of Artificial Sequence: Synthetic oligonucleotide
ggaggttacttcaatgatgtggaccgtgatgac

SEQ ID NO: 218069 - DNA, 33 bp, Artificial Sequence
  Description of Artificial Sequence: Synthetic oligonucleotide
gaggttacttcaatgatgtggaccgtgatgacg

SEQ ID NO: 218070 - DNA, 33 bp, Artificial Sequence
  Description of Artificial Sequence: Synthetic oligonucleotide
aggttacttcaatgatgtggaccgtgatgacgg

SEQ ID NO: 218071 - DNA, 32 bp, Artificial Sequence
  Description of Artificial Sequence: Synthetic oligonucleotide
ggttacttcaatgatgtggaccgtgatgacgg

SEQ ID NO: 218072 - DNA, 33 bp, Artificial Sequence
  Description of Artificial Sequence: Synthetic oligonucleotide
gttacttcaatgatgtggaccgtgatgacggac

SEQ ID NO: 218073 - DNA, 33 bp, Artificial Sequence
  Description of Artificial Sequence: Synthetic oligonucleotide
ttacttcaatgatgtggaccgtgatgacggacg

SEQ ID NO: 218074 - DNA, 32 bp, Artificial Sequence
  Description of Artificial Sequence: Synthetic oligonucleotide
tacttcaatgatgtggaccgtgatgacggacg

SEQ ID NO: 218075 - DNA, 31 bp, Artificial Sequence
  Description of Artificial Sequence: Synthetic oligonucleotide
acttcaatgatgtggaccgtgatgacggacg

SEQ ID NO: 218076 - DNA, 30 bp, Artificial Sequence
  Description of Artificial Sequence: Synthetic oligonucleotide
cttcaatgatgtggaccgtgatgacggacg

SEQ ID NO: 218077 - DNA, 30 bp, Artificial Sequence
  Description of Artificial Sequence: Synthetic oligonucleotide
ttcaatgatgtggaccgtgatgacggacgc

SEQ ID NO: 218078 - DNA, 29 bp, Artificial Sequence
  Description of Artificial Sequence: Synthetic oligonucleotide
tcaatgatgtggaccgtgatgacggacgc

SEQ ID NO: 218079 - DNA, 28 bp, Artificial Sequence
  Description of Artificial Sequence: Synthetic oligonucleotide
caatgatgtggaccgtgatgacggacgc

SEQ ID NO: 218080 - DNA, 30 bp, Artificial Sequence
  Description of Artificial Sequence: Synthetic oligonucleotide
aatgatgtggaccgtgatgacggacgctac

SEQ ID NO: 218081 - DNA, 29 bp, Artificial Sequence
  Description of Artificial Sequence: Synthetic oligonucleotide
atgatgtggaccgtgatgacggacgctac

SEQ ID NO: 218082 - DNA, 28 bp, Artificial Sequence
  Description of Artificial Sequence: Synthetic oligonucleotide
tgatgtggaccgtgatgacggacgctac

SEQ ID NO: 218083 - DNA, 27 bp, Artificial Sequence
  Description of Artificial Sequence: Synthetic oligonucleotide
gatgtggaccgtgatgacggacgctac

SEQ ID NO: 218084 - DNA, 27 bp, Artificial Sequence
  Description of Artificial Sequence: Synthetic oligonucleotide
atgtggaccgtgatgacggacgctacc

SEQ ID NO: 218085 - DNA, 26 bp, Artificial Sequence
  Description of Artificial Sequence: Synthetic oligonucleotide
tgtggaccgtgatgacggacgctacc

SEQ ID NO: 218086 - DNA, 25 bp, Artificial Sequence
  Description of Artificial Sequence: Synthetic oligonucleotide
gtggaccgtgatgacggacgctacc

SEQ ID NO: 218087 - DNA, 25 bp, Artificial Sequence
  Description of Artificial Sequence: Synthetic oligonucleotide
tggaccgtgatgacggacgctaccc

SEQ ID NO: 218088 - DNA, 24 bp, Artificial Sequence
  Description of Artificial Sequence: Synthetic oligonucleotide
ggaccgtgatgacggacgctaccc

SEQ ID NO: 218089 - DNA, 24 bp, Artificial Sequence
  Description of Artificial Sequence: Synthetic oligonucleotide
gaccgtgatgacggacgctacccg

SEQ ID NO: 218090 - DNA, 24 bp, Artificial Sequence
  Description of Artificial Sequence: Synthetic oligonucleotide
accgtgatgacggacgctacccgc

SEQ ID NO: 218091 - DNA, 23 bp, Artificial Sequence
  Description of Artificial Sequence: Synthetic oligonucleotide
ccgtgatgacggacgctacccgc

SEQ ID NO: 218092 - DNA, 23 bp, Artificial Sequence
  Description of Artificial Sequence: Synthetic oligonucleotide
cgtgatgacggacgctacccgcc

SEQ ID NO: 218093 - DNA, 24 bp, Artificial Sequence
  Description of Artificial Sequence: Synthetic oligonucleotide
gtgatgacggacgctacccgccca

SEQ ID NO: 218094 - DNA, 24 bp, Artificial Sequence
  Description of Artificial Sequence: Synthetic oligonucleotide
tgatgacggacgctacccgcccag

SEQ ID NO: 218095 - DNA, 23 bp, Artificial Sequence
  Description of Artificial Sequence: Synthetic oligonucleotide
gatgacggacgctacccgcccag

SEQ ID NO: 218096 - DNA, 23 bp, Artificial Sequence
  Description of Artificial Sequence: Synthetic oligonucleotide
atgacggacgctacccgcccagg

SEQ ID NO: 218097 - DNA, 22 bp, Artificial Sequence
  Description of Artificial Sequence: Synthetic oligonucleotide
tgacggacgctacccgcccagg

SEQ ID NO: 218098 - DNA, 21 bp, Artificial Sequence
  Description of Artificial Sequence: Synthetic oligonucleotide
gacggacgctacccgcccagg

SEQ ID NO: 218099 - DNA, 21 bp, Artificial Sequence
  Description of Artificial Sequence: Synthetic oligonucleotide
acggacgctacccgcccaggc

SEQ ID NO: 218100 - DNA, 20 bp, Artificial Sequence
  Description of Artificial Sequence: Synthetic oligonucleotide
cggacgctacccgcccaggc

SEQ ID NO: 218101 - DNA, 20 bp, Artificial Sequence
  Description of Artificial Sequence: Synthetic oligonucleotide
ggacgctacccgcccaggcc

SEQ ID NO: 218102 - DNA, 21 bp, Artificial Sequence
  Description of Artificial Sequence: Synthetic oligonucleotide
gacgctacccgcccaggccca

SEQ ID NO: 218103 - DNA, 21 bp, Artificial Sequence
  Description of Artificial Sequence: Synthetic oligonucleotide
acgctacccgcccaggcccag

SEQ ID NO: 218104 - DNA, 20 bp, Artificial Sequence
  Description of Artificial Sequence: Synthetic oligonucleotide
cgctacccgcccaggcccag

SEQ ID NO: 218105 - DNA, 20 bp, Artificial Sequence
  Description of Artificial Sequence: Synthetic oligonucleotide
gctacccgcccaggcccagg

SEQ ID NO: 218106 - DNA, 20 bp, Artificial Sequence
  Description of Artificial Sequence: Synthetic oligonucleotide
ctacccgcccaggcccaggc

SEQ ID NO: 218107 - DNA, 21 bp, Artificial Sequence
  Description of Artificial Sequence: Synthetic oligonucleotide
tacccgcccaggcccaggcca

SEQ ID NO: 218108 - DNA, 20 bp, Artificial Sequence
  Description of Artificial Sequence: Synthetic oligonucleotide
acccgcccaggcccaggcca

SEQ ID NO: 218109 - DNA, 20 bp, Artificial Sequence
  Description of Artificial Sequence: Synthetic oligonucleotide
cccgcccaggcccaggccat

SEQ ID NO: 218110 - DNA, 20 bp, Artificial Sequence
  Description of Artificial Sequence: Synthetic oligonucleotide
ccgcccaggcccaggccact

SEQ ID NO: 218111 - DNA, 20 bp, Artificial Sequence
  Description of Artificial Sequence: Synthetic oligonucleotide
cgcccaggcccaggccacgt

SEQ ID NO: 218112 - DNA, 20 bp, Artificial Sequence
  Description of Artificial Sequence: Synthetic oligonucleotide
gcccaggcccaggccacggt

SEQ ID NO: 218113 - DNA, 20 bp, Artificial Sequence
  Description of Artificial Sequence: Synthetic oligonucleotide
cccaggcccaggccacggct

SEQ ID NO: 218114 - DNA, 20 bp, Artificial Sequence
  Description of Artificial Sequence: Synthetic oligonucleotide
ccaggcccaggccacggcct

SEQ ID NO: 218115 - DNA, 20 bp, Artificial Sequence
  Description of Artificial Sequence: Synthetic oligonucleotide
caggcccaggccacggccgt

SEQ ID NO: 218116 - DNA, 20 bp, Artificial Sequence
  Description of Artificial Sequence: Synthetic oligonucleotide
aggcccaggccacggccgct

SEQ ID NO: 218117 - DNA, 20 bp, Artificial Sequence
  Description of Artificial Sequence: Synthetic oligonucleotide
ggcccaggccacggccgctt

SEQ ID NO: 218118 - DNA, 20 bp, Artificial Sequence
  Description of Artificial Sequence: Synthetic oligonucleotide
gcccaggccacggccgcctt

SEQ ID NO: 218119 - DNA, 20 bp, Artificial Sequence
  Description of Artificial Sequence: Synthetic oligonucleotide
cccaggccacggccgcctgt

SEQ ID NO: 218120 - DNA, 20 bp, Artificial Sequence
  Description of Artificial Sequence: Synthetic oligonucleotide
ccaggccacggccgcctgca

SEQ ID NO: 218121 - DNA, 20 bp, Artificial Sequence
  Description of Artificial Sequence: Synthetic oligonucleotide
caggccacggccgcctgcag

SEQ ID NO: 218122 - DNA, 21 bp, Artificial Sequence
  Description of Artificial Sequence: Synthetic oligonucleotide
aggccacggccgcctgcagga

SEQ ID NO: 218123 - DNA, 20 bp, Artificial Sequence
  Description of Artificial Sequence: Synthetic oligonucleotide
ggccacggccgcctgcagga

SEQ ID NO: 218124 - DNA, 20 bp, Artificial Sequence
  Description of Artificial Sequence: Synthetic oligonucleotide
gccacggccgcctgcaggag

SEQ ID NO: 218125 - DNA, 21 bp, Artificial Sequence
  Description of Artificial Sequence: Synthetic oligonucleotide
ccacggccgcctgcaggaggt

SEQ ID NO: 218126 - DNA, 21 bp, Artificial Sequence
  Description of Artificial Sequence: Synthetic oligonucleotide
cacggccgcctgcaggaggtg

SEQ ID NO: 218127 - DNA, 21 bp, Artificial Sequence
  Description of Artificial Sequence: Synthetic oligonucleotide
acggccgcctgcaggaggtgg

SEQ ID NO: 218128 - DNA, 20 bp, Artificial Sequence
  Description of Artificial Sequence: Synthetic oligonucleotide
cggccgcctgcaggaggtgg

SEQ ID NO: 218129 - DNA, 20 bp, Artificial Sequence
  Description of Artificial Sequence: Synthetic oligonucleotide
ggccgcctgcaggaggtggc

SEQ ID NO: 218130 - DNA, 20 bp, Artificial Sequence
  Description of Artificial Sequence: Synthetic oligonucleotide
gccgcctgcaggaggtggcg

SEQ ID NO: 218131 - DNA, 20 bp, Artificial Sequence
  Description of Artificial Sequence: Synthetic oligonucleotide
ccgcctgcaggaggtggcgg

SEQ ID NO: 218132 - DNA, 20 bp, Artificial Sequence
  Description of Artificial Sequence: Synthetic oligonucleotide
cgcctgcaggaggtggcggc

SEQ ID NO: 218133 - DNA, 20 bp, Artificial Sequence
  Description of Artificial Sequence: Synthetic oligonucleotide
gcctgcaggaggtggcggcg

SEQ ID NO: 218134 - DNA, 21 bp, Artificial Sequence
  Description of Artificial Sequence: Synthetic oligonucleotide
cctgcaggaggtggcggcggt

SEQ ID NO: 218135 - DNA, 21 bp, Artificial Sequence
  Description of Artificial Sequence: Synthetic oligonucleotide
ctgcaggaggtggcggcggtg

SEQ ID NO: 218136 - DNA, 21 bp, Artificial Sequence
  Description of Artificial Sequence: Synthetic oligonucleotide
tgcaggaggtggcggcggtgg

SEQ ID NO: 218137 - DNA, 20 bp, Artificial Sequence
  Description of Artificial Sequence: Synthetic oligonucleotide
gcaggaggtggcggcggtgg

SEQ ID NO: 218138 - DNA, 22 bp, Artificial Sequence
  Description of Artificial Sequence: Synthetic oligonucleotide
caggaggtggcggcggtggcta

SEQ ID NO: 218139 - DNA, 23 bp, Artificial Sequence
  Description of Artificial Sequence: Synthetic oligonucleotide
aggaggtggcggcggtggctact

SEQ ID NO: 218140 - DNA, 22 bp, Artificial Sequence
  Description of Artificial Sequence: Synthetic oligonucleotide
ggaggtggcggcggtggctact

SEQ ID NO: 218141 - DNA, 22 bp, Artificial Sequence
  Description of Artificial Sequence: Synthetic oligonucleotide
gaggtggcggcggtggctactc

SEQ ID NO: 218142 - DNA, 23 bp, Artificial Sequence
  Description of Artificial Sequence: Synthetic oligonucleotide
aggtggcggcggtggctactcca

SEQ ID NO: 218143 - DNA, 22 bp, Artificial Sequence
  Description of Artificial Sequence: Synthetic oligonucleotide
ggtggcggcggtggctactcca

SEQ ID NO: 218144 - DNA, 26 bp, Artificial Sequence
  Description of Artificial Sequence: Synthetic oligonucleotide
gtggcggcggtggctactccagttat

SEQ ID NO: 218145 - DNA, 26 bp, Artificial Sequence
  Description of Artificial Sequence: Synthetic oligonucleotide
tggcggcggtggctactccagttatg

SEQ ID NO: 218146 - DNA, 25 bp, Artificial Sequence
  Description of Artificial Sequence: Synthetic oligonucleotide
ggcggcggtggctactccagttatg

SEQ ID NO: 218147 - DNA, 25 bp, Artificial Sequence
  Description of Artificial Sequence: Synthetic oligonucleotide
gcggcggtggctactccagttatgg

SEQ ID NO: 218148 - DNA, 27 bp, Artificial Sequence
  Description of Artificial Sequence: Synthetic oligonucleotide
cggcggtggctactccagttatggcaa

SEQ ID NO: 218149 - DNA, 27 bp, Artificial Sequence
  Description of Artificial Sequence: Synthetic oligonucleotide
ggcggtggctactccagttatggcaac

SEQ ID NO: 218150 - DNA, 28 bp, Artificial Sequence
  Description of Artificial Sequence: Synthetic oligonucleotide
gcggtggctactccagttatggcaactc

SEQ ID NO: 218151 - DNA, 28 bp, Artificial Sequence
  Description of Artificial Sequence: Synthetic oligonucleotide
cggtggctactccagttatggcaactcc

SEQ ID NO: 218152 - DNA, 28 bp, Artificial Sequence
  Description of Artificial Sequence: Synthetic oligonucleotide
ggtggctactccagttatggcaactccg

SEQ ID NO: 218153 - DNA, 29 bp, Artificial Sequence
  Description of Artificial Sequence: Synthetic oligonucleotide
gtggctactccagttatggcaactccgac

SEQ ID NO: 218154 - DNA, 31 bp, Artificial Sequence
  Description of Artificial Sequence: Synthetic oligonucleotide
tggctactccagttatggcaactccgacaac

SEQ ID NO: 218155 - DNA, 30 bp, Artificial Sequence
  Description of Artificial Sequence: Synthetic oligonucleotide
ggctactccagttatggcaactccgacaac

SEQ ID NO: 218156 - DNA, 31 bp, Artificial Sequence
  Description of Artificial Sequence: Synthetic oligonucleotide
gctactccagttatggcaactccgacaacac

SEQ ID NO: 218157 - DNA, 31 bp, Artificial Sequence
  Description of Artificial Sequence: Synthetic oligonucleotide
ctactccagttatggcaactccgacaacacg

SEQ ID NO: 218158 - DNA, 31 bp, Artificial Sequence
  Description of Artificial Sequence: Synthetic oligonucleotide
tactccagttatggcaactccgacaacacgc

SEQ ID NO: 218159 - DNA, 30 bp, Artificial Sequence
  Description of Artificial Sequence: Synthetic oligonucleotide
actccagttatggcaactccgacaacacgc

SEQ ID NO: 218160 - DNA, 29 bp, Artificial Sequence
  Description of Artificial Sequence: Synthetic oligonucleotide
ctccagttatggcaactccgacaacacgc

SEQ ID NO: 218161 - DNA, 30 bp, Artificial Sequence
  Description of Artificial Sequence: Synthetic oligonucleotide
tccagttatggcaactccgacaacacgcac

SEQ ID NO: 218162 - DNA, 29 bp, Artificial Sequence
  Description of Artificial Sequence: Synthetic oligonucleotide
ccagttatggcaactccgacaacacgcac

SEQ ID NO: 218163 - DNA, 29 bp, Artificial Sequence
  Description of Artificial Sequence: Synthetic oligonucleotide
cagttatggcaactccgacaacacgcacg

SEQ ID NO: 218164 - DNA, 30 bp, Artificial Sequence
  Description of Artificial Sequence: Synthetic oligonucleotide
agttatggcaactccgacaacacgcacgac

SEQ ID NO: 218165 - DNA, 29 bp, Artificial Sequence
  Description of Artificial Sequence: Synthetic oligonucleotide
gttatggcaactccgacaacacgcacgac

SEQ ID NO: 218166 - DNA, 30 bp, Artificial Sequence
  Description of Artificial Sequence: Synthetic oligonucleotide
ttatggcaactccgacaacacgcacgacag

SEQ ID NO: 218167 - DNA, 29 bp, Artificial Sequence
  Description of Artificial Sequence: Synthetic oligonucleotide
tatggcaactccgacaacacgcacgacag

SEQ ID NO: 218168 - DNA, 28 bp, Artificial Sequence
  Description of Artificial Sequence: Synthetic oligonucleotide
atggcaactccgacaacacgcacgacag

SEQ ID NO: 218169 - DNA, 27 bp, Artificial Sequence
  Description of Artificial Sequence: Synthetic oligonucleotide
tggcaactccgacaacacgcacgacag

SEQ ID NO: 218170 - DNA, 26 bp, Artificial Sequence
  Description of Artificial Sequence: Synthetic oligonucleotide
ggcaactccgacaacacgcacgacag

SEQ ID NO: 218171 - DNA, 27 bp, Artificial Sequence
  Description of Artificial Sequence: Synthetic oligonucleotide
gcaactccgacaacacgcacgacaggt

SEQ ID NO: 218172 - DNA, 27 bp, Artificial Sequence
  Description of Artificial Sequence: Synthetic oligonucleotide
caactccgacaacacgcacgacaggtg

SEQ ID NO: 218173 - DNA, 27 bp, Artificial Sequence
  Description of Artificial Sequence: Synthetic oligonucleotide
aactccgacaacacgcacgacaggtgg

SEQ ID NO: 218174 - DNA, 27 bp, Artificial Sequence
  Description of Artificial Sequence: Synthetic oligonucleotide
actccgacaacacgcacgacaggtgga

SEQ ID NO: 218175 - DNA, 26 bp, Artificial Sequence
  Description of Artificial Sequence: Synthetic oligonucleotide
ctccgacaacacgcacgacaggtgga

SEQ ID NO: 218176 - DNA, 27 bp, Artificial Sequence
  Description of Artificial Sequence: Synthetic oligonucleotide
tccgacaacacgcacgacaggtggaga

SEQ ID NO: 218177 - DNA, 27 bp, Artificial Sequence
  Description of Artificial Sequence: Synthetic oligonucleotide
ccgacaacacgcacgacaggtggagat

SEQ ID NO: 218178 - DNA, 27 bp, Artificial Sequence
  Description of Artificial Sequence: Synthetic oligonucleotide
cgacaacacgcacgacaggtggagatc

SEQ ID NO: 218179 - DNA, 28 bp, Artificial Sequence
  Description of Artificial Sequence: Synthetic oligonucleotide
gacaacacgcacgacaggtggagatcac

SEQ ID NO: 218180 - DNA, 28 bp, Artificial Sequence
  Description of Artificial Sequence: Synthetic oligonucleotide
acaacacgcacgacaggtggagatcacc

SEQ ID NO: 218181 - DNA, 27 bp, Artificial Sequence
  Description of Artificial Sequence: Synthetic oligonucleotide
caacacgcacgacaggtggagatcacc

SEQ ID NO: 218182 - DNA, 30 bp, Artificial Sequence
  Description of Artificial Sequence: Synthetic oligonucleotide
aacacgcacgacaggtggagatcaccattc

SEQ ID NO: 218183 - DNA, 29 bp, Artificial Sequence
  Description of Artificial Sequence: Synthetic oligonucleotide
acacgcacgacaggtggagatcaccattc

SEQ ID NO: 218184 - DNA, 28 bp, Artificial Sequence
  Description of Artificial Sequence: Synthetic oligonucleotide
cacgcacgacaggtggagatcaccattc

SEQ ID NO: 218185 - DNA, 30 bp, Artificial Sequence
  Description of Artificial Sequence: Synthetic oligonucleotide
acgcacgacaggtggagatcaccattcaac

SEQ ID NO: 218186 - DNA, 29 bp, Artificial Sequence
  Description of Artificial Sequence: Synthetic oligonucleotide
cgcacgacaggtggagatcaccattcaac

SEQ ID NO: 218187 - DNA, 29 bp, Artificial Sequence
  Description of Artificial Sequence: Synthetic oligonucleotide
gcacgacaggtggagatcaccattcaacg

SEQ ID NO: 218188 - DNA, 32 bp, Artificial Sequence
  Description of Artificial Sequence: Synthetic oligonucleotide
cacgacaggtggagatcaccattcaacgtatg

SEQ ID NO: 218189 - DNA, 32 bp, Artificial Sequence
  Description of Artificial Sequence: Synthetic oligonucleotide
acgacaggtggagatcaccattcaacgtatgg

SEQ ID NO: 218190 - DNA, 31 bp, Artificial Sequence
  Description of Artificial Sequence: Synthetic oligonucleotide
cgacaggtggagatcaccattcaacgtatgg

SEQ ID NO: 218191 - DNA, 31 bp, Artificial Sequence
  Description of Artificial Sequence: Synthetic oligonucleotide
gacaggtggagatcaccattcaacgtatggc

SEQ ID NO: 218192 - DNA, 34 bp, Artificial Sequence
  Description of Artificial Sequence: Synthetic oligonucleotide
acaggtggagatcaccattcaacgtatggcaatc

SEQ ID NO: 218193 - DNA, 33 bp, Artificial Sequence
  Description of Artificial Sequence: Synthetic oligonucleotide
caggtggagatcaccattcaacgtatggcaatc

SEQ ID NO: 218194 - DNA, 33 bp, Artificial Sequence
  Description of Artificial Sequence: Synthetic oligonucleotide
aggtggagatcaccattcaacgtatggcaatcc

SEQ ID NO: 218195 - DNA, 32 bp, Artificial Sequence
  Description of Artificial Sequence: Synthetic oligonucleotide
ggtggagatcaccattcaacgtatggcaatcc

SEQ ID NO: 218196 - DNA, 33 bp, Artificial Sequence
  Description of Artificial Sequence: Synthetic oligonucleotide
gtggagatcaccattcaacgtatggcaatccag

SEQ ID NO: 218197 - DNA, 33 bp, Artificial Sequence
  Description of Artificial Sequence: Synthetic oligonucleotide
tggagatcaccattcaacgtatggcaatccagc

SEQ ID NO: 218198 - DNA, 32 bp, Artificial Sequence
  Description of Artificial Sequence: Synthetic oligonucleotide
ggagatcaccattcaacgtatggcaatccagc

SEQ ID NO: 218199 - DNA, 37 bp, Artificial Sequence
  Description of Artificial Sequence: Synthetic oligonucleotide
gagatcaccattcaacgtatggcaatccagcaatatg

SEQ ID NO: 218200 - DNA, 37 bp, Artificial Sequence
  Description of Artificial Sequence: Synthetic oligonucleotide
agatcaccattcaacgtatggcaatccagcaatatgg

SEQ ID NO: 218201 - DNA, 36 bp, Artificial Sequence
  Description of Artificial Sequence: Synthetic oligonucleotide
gatcaccattcaacgtatggcaatccagcaatatgg

SEQ ID NO: 218202 - DNA, 38 bp, Artificial Sequence
  Description of Artificial Sequence: Synthetic oligonucleotide
atcaccattcaacgtatggcaatccagcaatatggtag

SEQ ID NO: 218203 - DNA, 37 bp, Artificial Sequence
  Description of Artificial Sequence: Synthetic oligonucleotide
tcaccattcaacgtatggcaatccagcaatatggtag

SEQ ID NO: 218204 - DNA, 36 bp, Artificial Sequence
  Description of Artificial Sequence: Synthetic oligonucleotide
caccattcaacgtatggcaatccagcaatatggtag

SEQ ID NO: 218205 - DNA, 36 bp, Artificial Sequence
  Description of Artificial Sequence: Synthetic oligonucleotide
accattcaacgtatggcaatccagcaatatggtagc

SEQ ID NO: 218206 - DNA, 35 bp, Artificial Sequence
  Description of Artificial Sequence: Synthetic oligonucleotide
ccattcaacgtatggcaatccagcaatatggtagc

SEQ ID NO: 218207 - DNA, 41 bp, Artificial Sequence
  Description of Artificial Sequence: Synthetic oligonucleotide
cattcaacgtatggcaatccagcaatatggtagcaaaaatc

SEQ ID NO: 218208 - DNA, 41 bp, Artificial Sequence
  Description of Artificial Sequence: Synthetic oligonucleotide
attcaacgtatggcaatccagcaatatggtagcaaaaatcg

SEQ ID NO: 218209 - DNA, 40 bp, Artificial Sequence
  Description of Artificial Sequence: Synthetic oligonucleotide
ttcaacgtatggcaatccagcaatatggtagcaaaaatcg

SEQ ID NO: 218210 - DNA, 39 bp, Artificial Sequence
  Description of Artificial Sequence: Synthetic oligonucleotide
tcaacgtatggcaatccagcaatatggtagcaaaaatcg

SEQ ID NO: 218211 - DNA, 38 bp, Artificial Sequence
  Description of Artificial Sequence: Synthetic oligonucleotide
caacgtatggcaatccagcaatatggtagcaaaaatcg

SEQ ID NO: 218212 - DNA, 39 bp, Artificial Sequence
  Description of Artificial Sequence: Synthetic oligonucleotide
aacgtatggcaatccagcaatatggtagcaaaaatcgtg

SEQ ID NO: 218213 - DNA, 38 bp, Artificial Sequence
  Description of Artificial Sequence: Synthetic oligonucleotide
acgtatggcaatccagcaatatggtagcaaaaatcgtg

SEQ ID NO: 218214 - DNA, 37 bp, Artificial Sequence
  Description of Artificial Sequence: Synthetic oligonucleotide
cgtatggcaatccagcaatatggtagcaaaaatcgtg

SEQ ID NO: 218215 - DNA, 38 bp, Artificial Sequence
  Description of Artificial Sequence: Synthetic oligonucleotide
gtatggcaatccagcaatatggtagcaaaaatcgtgtc

SEQ ID NO: 218216 - DNA, 39 bp, Artificial Sequence
  Description of Artificial Sequence: Synthetic oligonucleotide
tatggcaatccagcaatatggtagcaaaaatcgtgtctc

SEQ ID NO: 218217 - DNA, 38 bp, Artificial Sequence
  Description of Artificial Sequence: Synthetic oligonucleotide
atggcaatccagcaatatggtagcaaaaatcgtgtctc

SEQ ID NO: 218218 - DNA, 37 bp, Artificial Sequence
  Description of Artificial Sequence: Synthetic oligonucleotide
tggcaatccagcaatatggtagcaaaaatcgtgtctc

SEQ ID NO: 218219 - DNA, 36 bp, Artificial Sequence
  Description of Artificial Sequence: Synthetic oligonucleotide
ggcaatccagcaatatggtagcaaaaatcgtgtctc

SEQ ID NO: 218220 - DNA, 36 bp, Artificial Sequence
  Description of Artificial Sequence: Synthetic oligonucleotide
gcaatccagcaatatggtagcaaaaatcgtgtctcc

SEQ ID NO: 218221 - DNA, 36 bp, Artificial Sequence
  Description of Artificial Sequence: Synthetic oligonucleotide
caatccagcaatatggtagcaaaaatcgtgtctccc

SEQ ID NO: 218222 - DNA, 38 bp, Artificial Sequence
  Description of Artificial Sequence: Synthetic oligonucleotide
aatccagcaatatggtagcaaaaatcgtgtctcccatc

SEQ ID NO: 218223 - DNA, 37 bp, Artificial Sequence
  Description of Artificial Sequence: Synthetic oligonucleotide
atccagcaatatggtagcaaaaatcgtgtctcccatc

SEQ ID NO: 218224 - DNA, 36 bp, Artificial Sequence
  Description of Artificial Sequence: Synthetic oligonucleotide
tccagcaatatggtagcaaaaatcgtgtctcccatc

SEQ ID NO: 218225 - DNA, 35 bp, Artificial Sequence
  Description of Artificial Sequence: Synthetic oligonucleotide
ccagcaatatggtagcaaaaatcgtgtctcccatc

SEQ ID NO: 218226 - DNA, 35 bp, Artificial Sequence
  Description of Artificial Sequence: Synthetic oligonucleotide
cagcaatatggtagcaaaaatcgtgtctcccatcg

SEQ ID NO: 218227 - DNA, 38 bp, Artificial Sequence
  Description of Artificial Sequence: Synthetic oligonucleotide
agcaatatggtagcaaaaatcgtgtctcccatcgtatc

SEQ ID NO: 218228 - DNA, 37 bp, Artificial Sequence
  Description of Artificial Sequence: Synthetic oligonucleotide
gcaatatggtagcaaaaatcgtgtctcccatcgtatc

SEQ ID NO: 218229 - DNA, 37 bp, Artificial Sequence
  Description of Artificial Sequence: Synthetic oligonucleotide
caatatggtagcaaaaatcgtgtctcccatcgtatcc

SEQ ID NO: 218230 - DNA, 37 bp, Artificial Sequence
  Description of Artificial Sequence: Synthetic oligonucleotide
aatatggtagcaaaaatcgtgtctcccatcgtatccg

SEQ ID NO: 218231 - DNA, 36 bp, Artificial Sequence
  Description of Artificial Sequence: Synthetic oligonucleotide
atatggtagcaaaaatcgtgtctcccatcgtatccg

SEQ ID NO: 218232 - DNA, 35 bp, Artificial Sequence
  Description of Artificial Sequence: Synthetic oligonucleotide
tatggtagcaaaaatcgtgtctcccatcgtatccg

SEQ ID NO: 218233 - DNA, 34 bp, Artificial Sequence
  Description of Artificial Sequence: Synthetic oligonucleotide
atggtagcaaaaatcgtgtctcccatcgtatccg

SEQ ID NO: 218234 - DNA, 33 bp, Artificial Sequence
  Description of Artificial Sequence: Synthetic oligonucleotide
tggtagcaaaaatcgtgtctcccatcgtatccg

SEQ ID NO: 218235 - DNA, 32 bp, Artificial Sequence
  Description of Artificial Sequence: Synthetic oligonucleotide
ggtagcaaaaatcgtgtctcccatcgtatccg

SEQ ID NO: 218236 - DNA, 33 bp, Artificial Sequence
  Description of Artificial Sequence: Synthetic oligonucleotide
gtagcaaaaatcgtgtctcccatcgtatccgtg

SEQ ID NO: 218237 - DNA, 33 bp, Artificial Sequence
  Description of Artificial Sequence: Synthetic oligonucleotide
tagcaaaaatcgtgtctcccatcgtatccgtgg

SEQ ID NO: 218238 - DNA, 32 bp, Artificial Sequence
  Description of Artificial Sequence: Synthetic oligonucleotide
agcaaaaatcgtgtctcccatcgtatccgtgg

SEQ ID NO: 218239 - DNA, 31 bp, Artificial Sequence
  Description of Artificial Sequence: Synthetic oligonucleotide
gcaaaaatcgtgtctcccatcgtatccgtgg

SEQ ID NO: 218240 - DNA, 32 bp, Artificial Sequence
  Description of Artificial Sequence: Synthetic oligonucleotide
caaaaatcgtgtctcccatcgtatccgtggtg

SEQ ID NO: 218241 - DNA, 32 bp, Artificial Sequence
  Description of Artificial Sequence: Synthetic oligonucleotide
aaaaatcgtgtctcccatcgtatccgtggtgg

SEQ ID NO: 218242 - DNA, 31 bp, Artificial Sequence
  Description of Artificial Sequence: Synthetic oligonucleotide
aaaatcgtgtctcccatcgtatccgtggtgg

SEQ ID NO: 218243 - DNA, 30 bp, Artificial Sequence
  Description of Artificial Sequence: Synthetic oligonucleotide
aaatcgtgtctcccatcgtatccgtggtgg

SEQ ID NO: 218244 - DNA, 29 bp, Artificial Sequence
  Description of Artificial Sequence: Synthetic oligonucleotide
aatcgtgtctcccatcgtatccgtggtgg

SEQ ID NO: 218245 - DNA, 28 bp, Artificial Sequence
  Description of Artificial Sequence: Synthetic oligonucleotide
atcgtgtctcccatcgtatccgtggtgg

SEQ ID NO: 218246 - DNA, 27 bp, Artificial Sequence
  Description of Artificial Sequence: Synthetic oligonucleotide
tcgtgtctcccatcgtatccgtggtgg

SEQ ID NO: 218247 - DNA, 27 bp, Artificial Sequence
  Description of Artificial Sequence: Synthetic oligonucleotide
cgtgtctcccatcgtatccgtggtggt

SEQ ID NO: 218248 - DNA, 27 bp, Artificial Sequence
  Description of Artificial Sequence: Synthetic oligonucleotide
gtgtctcccatcgtatccgtggtggtg

SEQ ID NO: 218249 - DNA, 27 bp, Artificial Sequence
  Description of Artificial Sequence: Synthetic oligonucleotide
tgtctcccatcgtatccgtggtggtgg

SEQ ID NO: 218250 - DNA, 27 bp, Artificial Sequence
  Description of Artificial Sequence: Synthetic oligonucleotide
gtctcccatcgtatccgtggtggtggt

SEQ ID NO: 218251 - DNA, 27 bp, Artificial Sequence
  Description of Artificial Sequence: Synthetic oligonucleotide
tctcccatcgtatccgtggtggtggtg

SEQ ID NO: 218252 - DNA, 27 bp, Artificial Sequence
  Description of Artificial Sequence: Synthetic oligonucleotide
ctcccatcgtatccgtggtggtggtga

SEQ ID NO: 218253 - DNA, 27 bp, Artificial Sequence
  Description of Artificial Sequence: Synthetic oligonucleotide
tcccatcgtatccgtggtggtggtgac

SEQ ID NO: 218254 - DNA, 27 bp, Artificial Sequence
  Description of Artificial Sequence: Synthetic oligonucleotide
cccatcgtatccgtggtggtggtgaca

SEQ ID NO: 218255 - DNA, 27 bp, Artificial Sequence
  Description of Artificial Sequence: Synthetic oligonucleotide
ccatcgtatccgtggtggtggtgacac

SEQ ID NO: 218256 - DNA, 28 bp, Artificial Sequence
  Description of Artificial Sequence: Synthetic oligonucleotide
catcgtatccgtggtggtggtgacactg

SEQ ID NO: 218257 - DNA, 28 bp, Artificial Sequence
  Description of Artificial Sequence: Synthetic oligonucleotide
atcgtatccgtggtggtggtgacactgc

SEQ ID NO: 218258 - DNA, 27 bp, Artificial Sequence
  Description of Artificial Sequence: Synthetic oligonucleotide
tcgtatccgtggtggtggtgacactgc

SEQ ID NO: 218259 - DNA, 27 bp, Artificial Sequence
  Description of Artificial Sequence: Synthetic oligonucleotide
cgtatccgtggtggtggtgacactgct

SEQ ID NO: 218260 - DNA, 27 bp, Artificial Sequence
  Description of Artificial Sequence: Synthetic oligonucleotide
gtatccgtggtggtggtgacactgctg

SEQ ID NO: 218261 - DNA, 27 bp, Artificial Sequence
  Description of Artificial Sequence: Synthetic oligonucleotide
tatccgtggtggtggtgacactgctgg

SEQ ID NO: 218262 - DNA, 26 bp, Artificial Sequence
  Description of Artificial Sequence: Synthetic oligonucleotide
atccgtggtggtggtgacactgctgg

SEQ ID NO: 218263 - DNA, 25 bp, Artificial Sequence
  Description of Artificial Sequence: Synthetic oligonucleotide
tccgtggtggtggtgacactgctgg

SEQ ID NO: 218264 - DNA, 24 bp, Artificial Sequence
  Description of Artificial Sequence: Synthetic oligonucleotide
ccgtggtggtggtgacactgctgg

SEQ ID NO: 218265 - DNA, 25 bp, Artificial Sequence
  Description of Artificial Sequence: Synthetic oligonucleotide
cgtggtggtggtgacactgctggga

SEQ ID NO: 218266 - DNA, 25 bp, Artificial Sequence
  Description of Artificial Sequence: Synthetic oligonucleotide
gtggtggtggtgacactgctgggag

SEQ ID NO: 218267 - DNA, 26 bp, Artificial Sequence
  Description of Artificial Sequence: Synthetic oligonucleotide
tggtggtggtgacactgctgggagca

SEQ ID NO: 218268 - DNA, 25 bp, Artificial Sequence
  Description of Artificial Sequence: Synthetic oligonucleotide
ggtggtggtgacactgctgggagca

SEQ ID NO: 218269 - DNA, 25 bp, Artificial Sequence
  Description of Artificial Sequence: Synthetic oligonucleotide
gtggtggtgacactgctgggagcag

SEQ ID NO: 218270 - DNA, 26 bp, Artificial Sequence
  Description of Artificial Sequence: Synthetic oligonucleotide
tggtggtgacactgctgggagcagca

SEQ ID NO: 218271 - DNA, 25 bp, Artificial Sequence
  Description of Artificial Sequence: Synthetic oligonucleotide
ggtggtgacactgctgggagcagca

SEQ ID NO: 218272 - DNA, 25 bp, Artificial Sequence
  Description of Artificial Sequence: Synthetic oligonucleotide
gtggtgacactgctgggagcagcag

SEQ ID NO: 218273 - DNA, 25 bp, Artificial Sequence
  Description of Artificial Sequence: Synthetic oligonucleotide
tggtgacactgctgggagcagcagc

SEQ ID NO: 218274 - DNA, 24 bp, Artificial Sequence
  Description of Artificial Sequence: Synthetic oligonucleotide
ggtgacactgctgggagcagcagc

SEQ ID NO: 218275 - DNA, 25 bp, Artificial Sequence
  Description of Artificial Sequence: Synthetic oligonucleotide
gtgacactgctgggagcagcagcca

SEQ ID NO: 218276 - DNA, 27 bp, Artificial Sequence
  Description of Artificial Sequence: Synthetic oligonucleotide
tgacactgctgggagcagcagccagtt

SEQ ID NO: 218277 - DNA, 27 bp, Artificial Sequence
  Description of Artificial Sequence: Synthetic oligonucleotide
gacactgctgggagcagcagccagtta

SEQ ID NO: 218278 - DNA, 30 bp, Artificial Sequence
  Description of Artificial Sequence: Synthetic oligonucleotide
acactgctgggagcagcagccagttatttc

SEQ ID NO: 218279 - DNA, 29 bp, Artificial Sequence
  Description of Artificial Sequence: Synthetic oligonucleotide
cactgctgggagcagcagccagttatttc

SEQ ID NO: 218280 - DNA, 32 bp, Artificial Sequence
  Description of Artificial Sequence: Synthetic oligonucleotide
actgctgggagcagcagccagttatttcaaac

SEQ ID NO: 218281 - DNA, 31 bp, Artificial Sequence
  Description of Artificial Sequence: Synthetic oligonucleotide
ctgctgggagcagcagccagttatttcaaac

SEQ ID NO: 218282 - DNA, 35 bp, Artificial Sequence
  Description of Artificial Sequence: Synthetic oligonucleotide
tgctgggagcagcagccagttatttcaaactaaac

SEQ ID NO: 218283 - DNA, 34 bp, Artificial Sequence
  Description of Artificial Sequence: Synthetic oligonucleotide
gctgggagcagcagccagttatttcaaactaaac

SEQ ID NO: 218284 - DNA, 38 bp, Artificial Sequence
  Description of Artificial Sequence: Synthetic oligonucleotide
ctgggagcagcagccagttatttcaaactaaacaatag

SEQ ID NO: 218285 - DNA, 38 bp, Artificial Sequence
  Description of Artificial Sequence: Synthetic oligonucleotide
tgggagcagcagccagttatttcaaactaaacaatagg

SEQ ID NO: 218286 - DNA, 37 bp, Artificial Sequence
  Description of Artificial Sequence: Synthetic oligonucleotide
gggagcagcagccagttatttcaaactaaacaatagg

SEQ ID NO: 218287 - DNA, 38 bp, Artificial Sequence
  Description of Artificial Sequence: Synthetic oligonucleotide
ggagcagcagccagttatttcaaactaaacaataggag

SEQ ID NO: 218288 - DNA, 43 bp, Artificial Sequence
  Description of Artificial Sequence: Synthetic oligonucleotide
gagcagcagccagttatttcaaactaaacaataggagaaattg

SEQ ID NO: 218289 - DNA, 46 bp, Artificial Sequence
  Description of Artificial Sequence: Synthetic oligonucleotide
agcagcagccagttatttcaaactaaacaataggagaaattgtttc

SEQ ID NO: 218290 - DNA, 45 bp, Artificial Sequence
  Description of Artificial Sequence: Synthetic oligonucleotide
gcagcagccagttatttcaaactaaacaataggagaaattgtttc

SEQ ID NO: 218291 - DNA, 46 bp, Artificial Sequence
  Description of Artificial Sequence: Synthetic oligonucleotide
cagcagccagttatttcaaactaaacaataggagaaattgtttcag

SEQ ID NO: 218292 - DNA, 46 bp, Artificial Sequence
  Description of Artificial Sequence: Synthetic oligonucleotide
agcagccagttatttcaaactaaacaataggagaaattgtttcagg

SEQ ID NO: 218293 - DNA, 45 bp, Artificial Sequence
  Description of Artificial Sequence: Synthetic oligonucleotide
gcagccagttatttcaaactaaacaataggagaaattgtttcagg

SEQ ID NO: 218294 - DNA, 46 bp, Artificial Sequence
  Description of Artificial Sequence: Synthetic oligonucleotide
cagccagttatttcaaactaaacaataggagaaattgtttcaggac

SEQ ID NO: 218295 - DNA, 46 bp, Artificial Sequence
  Description of Artificial Sequence: Synthetic oligonucleotide
agccagttatttcaaactaaacaataggagaaattgtttcaggacc

SEQ ID NO: 218296 - DNA, 45 bp, Artificial Sequence
  Description of Artificial Sequence: Synthetic oligonucleotide
gccagttatttcaaactaaacaataggagaaattgtttcaggacc

SEQ ID NO: 218297 - DNA, 45 bp, Artificial Sequence
  Description of Artificial Sequence: Synthetic oligonucleotide
ccagttatttcaaactaaacaataggagaaattgtttcaggaccc

SEQ ID NO: 218298 - DNA, 47 bp, Artificial Sequence
  Description of Artificial Sequence: Synthetic oligonucleotide
cagttatttcaaactaaacaataggagaaattgtttcaggacccatg

SEQ ID NO: 218299 - DNA, 49 bp, Artificial Sequence
  Description of Artificial Sequence: Synthetic oligonucleotide
agttatttcaaactaaacaataggagaaattgtttcaggacccatgaac

SEQ ID NO: 218300 - DNA, 48 bp, Artificial Sequence
  Description of Artificial Sequence: Synthetic oligonucleotide
gttatttcaaactaaacaataggagaaattgtttcaggacccatgaac

SEQ ID NO: 218301 - DNA, 48 bp, Artificial Sequence
  Description of Artificial Sequence: Synthetic oligonucleotide
ttatttcaaactaaacaataggagaaattgtttcaggacccatgaacc

SEQ ID NO: 218302 - DNA, 47 bp, Artificial Sequence
  Description of Artificial Sequence: Synthetic oligonucleotide
tatttcaaactaaacaataggagaaattgtttcaggacccatgaacc

SEQ ID NO: 218303 - DNA, 46 bp, Artificial Sequence
  Description of Artificial Sequence: Synthetic oligonucleotide
atttcaaactaaacaataggagaaattgtttcaggacccatgaacc

SEQ ID NO: 218304 - DNA, 45 bp, Artificial Sequence
  Description of Artificial Sequence: Synthetic oligonucleotide
tttcaaactaaacaataggagaaattgtttcaggacccatgaacc

SEQ ID NO: 218305 - DNA, 44 bp, Artificial Sequence
  Description of Artificial Sequence: Synthetic oligonucleotide
ttcaaactaaacaataggagaaattgtttcaggacccatgaacc

SEQ ID NO: 218306 - DNA, 43 bp, Artificial Sequence
  Description of Artificial Sequence: Synthetic oligonucleotide
tcaaactaaacaataggagaaattgtttcaggacccatgaacc

SEQ ID NO: 218307 - DNA, 42 bp, Artificial Sequence
  Description of Artificial Sequence: Synthetic oligonucleotide
caaactaaacaataggagaaattgtttcaggacccatgaacc

SEQ ID NO: 218308 - DNA, 43 bp, Artificial Sequence
  Description of Artificial Sequence: Synthetic oligonucleotide
aaactaaacaataggagaaattgtttcaggacccatgaaccag

SEQ ID NO: 218309 - DNA, 42 bp, Artificial Sequence
  Description of Artificial Sequence: Synthetic oligonucleotide
aactaaacaataggagaaattgtttcaggacccatgaaccag

SEQ ID NO: 218310 - DNA, 41 bp, Artificial Sequence
  Description of Artificial Sequence: Synthetic oligonucleotide
actaaacaataggagaaattgtttcaggacccatgaaccag

SEQ ID NO: 218311 - DNA, 40 bp, Artificial Sequence
  Description of Artificial Sequence: Synthetic oligonucleotide
ctaaacaataggagaaattgtttcaggacccatgaaccag

SEQ ID NO: 218312 - DNA, 45 bp, Artificial Sequence
  Description of Artificial Sequence: Synthetic oligonucleotide
taaacaataggagaaattgtttcaggacccatgaaccagaaaatg

SEQ ID NO: 218313 - DNA, 44 bp, Artificial Sequence
  Description of Artificial Sequence: Synthetic oligonucleotide
aaacaataggagaaattgtttcaggacccatgaaccagaaaatg

SEQ ID NO: 218314 - DNA, 43 bp, Artificial Sequence
  Description of Artificial Sequence: Synthetic oligonucleotide
aacaataggagaaattgtttcaggacccatgaaccagaaaatg

SEQ ID NO: 218315 - DNA, 42 bp, Artificial Sequence
  Description of Artificial Sequence: Synthetic oligonucleotide
acaataggagaaattgtttcaggacccatgaaccagaaaatg

SEQ ID NO: 218316 - DNA, 41 bp, Artificial Sequence
  Description of Artificial Sequence: Synthetic oligonucleotide
caataggagaaattgtttcaggacccatgaaccagaaaatg

SEQ ID NO: 218317 - DNA, 42 bp, Artificial Sequence
  Description of Artificial Sequence: Synthetic oligonucleotide
aataggagaaattgtttcaggacccatgaaccagaaaatgtc

SEQ ID NO: 218318 - DNA, 41 bp, Artificial Sequence
  Description of Artificial Sequence: Synthetic oligonucleotide
ataggagaaattgtttcaggacccatgaaccagaaaatgtc

SEQ ID NO: 218319 - DNA, 40 bp, Artificial Sequence
  Description of Artificial Sequence: Synthetic oligonucleotide
taggagaaattgtttcaggacccatgaaccagaaaatgtc

SEQ ID NO: 218320 - DNA, 39 bp, Artificial Sequence
  Description of Artificial Sequence: Synthetic oligonucleotide
aggagaaattgtttcaggacccatgaaccagaaaatgtc

SEQ ID NO: 218321 - DNA, 38 bp, Artificial Sequence
  Description of Artificial Sequence: Synthetic oligonucleotide
ggagaaattgtttcaggacccatgaaccagaaaatgtc

SEQ ID NO: 218322 - DNA, 39 bp, Artificial Sequence
  Description of Artificial Sequence: Synthetic oligonucleotide
gagaaattgtttcaggacccatgaaccagaaaatgtctg

SEQ ID NO: 218323 - DNA, 29 bp, Artificial Sequence
  Description of Artificial Sequence: Synthetic oligonucleotide
agttatggcaactccgacaacacgcacgg

SEQ ID NO: 218324 - DNA, 28 bp, Artificial Sequence
  Description of Artificial Sequence: Synthetic oligonucleotide
gttatggcaactccgacaacacgcacgg

SEQ ID NO: 218325 - DNA, 29 bp, Artificial Sequence
  Description of Artificial Sequence: Synthetic oligonucleotide
ttatggcaactccgacaacacgcacggtg

SEQ ID NO: 218326 - DNA, 28 bp, Artificial Sequence
  Description of Artificial Sequence: Synthetic oligonucleotide
tatggcaactccgacaacacgcacggtg

SEQ ID NO: 218327 - DNA, 27 bp, Artificial Sequence
  Description of Artificial Sequence: Synthetic oligonucleotide
atggcaactccgacaacacgcacggtg

SEQ ID NO: 218328 - DNA, 26 bp, Artificial Sequence
  Description of Artificial Sequence: Synthetic oligonucleotide
tggcaactccgacaacacgcacggtg

SEQ ID NO: 218329 - DNA, 25 bp, Artificial Sequence
  Description of Artificial Sequence: Synthetic oligonucleotide
ggcaactccgacaacacgcacggtg

SEQ ID NO: 218330 - DNA, 26 bp, Artificial Sequence
  Description of Artificial Sequence: Synthetic oligonucleotide
gcaactccgacaacacgcacggtgga

SEQ ID NO: 218331 - DNA, 27 bp, Artificial Sequence
  Description of Artificial Sequence: Synthetic oligonucleotide
caactccgacaacacgcacggtggaga

SEQ ID NO: 218332 - DNA, 28 bp, Artificial Sequence
  Description of Artificial Sequence: Synthetic oligonucleotide
aactccgacaacacgcacggtggagatc

SEQ ID NO: 218333 - DNA, 27 bp, Artificial Sequence
  Description of Artificial Sequence: Synthetic oligonucleotide
actccgacaacacgcacggtggagatc

SEQ ID NO: 218334 - DNA, 27 bp, Artificial Sequence
  Description of Artificial Sequence: Synthetic oligonucleotide
ctccgacaacacgcacggtggagatca

SEQ ID NO: 218335 - DNA, 27 bp, Artificial Sequence
  Description of Artificial Sequence: Synthetic oligonucleotide
tccgacaacacgcacggtggagatcac

SEQ ID NO: 218336 - DNA, 26 bp, Artificial Sequence
  Description of Artificial Sequence: Synthetic oligonucleotide
ccgacaacacgcacggtggagatcac

SEQ ID NO: 218337 - DNA, 27 bp, Artificial Sequence
  Description of Artificial Sequence: Synthetic oligonucleotide
cgacaacacgcacggtggagatcacca

SEQ ID NO: 218338 - DNA, 29 bp, Artificial Sequence
  Description of Artificial Sequence: Synthetic oligonucleotide
gacaacacgcacggtggagatcaccattc

SEQ ID NO: 218339 - DNA, 31 bp, Artificial Sequence
  Description of Artificial Sequence: Synthetic oligonucleotide
acaacacgcacggtggagatcaccattcaac

SEQ ID NO: 218340 - DNA, 30 bp, Artificial Sequence
  Description of Artificial Sequence: Synthetic oligonucleotide
caacacgcacggtggagatcaccattcaac

SEQ ID NO: 218341 - DNA, 30 bp, Artificial Sequence
  Description of Artificial Sequence: Synthetic oligonucleotide
aacacgcacggtggagatcaccattcaacg

SEQ ID NO: 218342 - DNA, 29 bp, Artificial Sequence
  Description of Artificial Sequence: Synthetic oligonucleotide
acacgcacggtggagatcaccattcaacg

SEQ ID NO: 218343 - DNA, 28 bp, Artificial Sequence
  Description of Artificial Sequence: Synthetic oligonucleotide
cacgcacggtggagatcaccattcaacg

SEQ ID NO: 218344 - DNA, 31 bp, Artificial Sequence
  Description of Artificial Sequence: Synthetic oligonucleotide
acgcacggtggagatcaccattcaacgtatg

SEQ ID NO: 218345 - DNA, 30 bp, Artificial Sequence
  Description of Artificial Sequence: Synthetic oligonucleotide
cgcacggtggagatcaccattcaacgtatg

SEQ ID NO: 218346 - DNA, 30 bp, Artificial Sequence
  Description of Artificial Sequence: Synthetic oligonucleotide
gcacggtggagatcaccattcaacgtatgg

SEQ ID NO: 218347 - DNA, 30 bp, Artificial Sequence
  Description of Artificial Sequence: Synthetic oligonucleotide
cacggtggagatcaccattcaacgtatggc

SEQ ID NO: 218348 - DNA, 33 bp, Artificial Sequence
  Description of Artificial Sequence: Synthetic oligonucleotide
acggtggagatcaccattcaacgtatggcaatc

SEQ ID NO: 218349 - DNA, 32 bp, Artificial Sequence
  Description of Artificial Sequence: Synthetic oligonucleotide
cggtggagatcaccattcaacgtatggcaatc

SEQ ID NO: 218350 - DNA, 29 bp, Artificial Sequence
  Description of Artificial Sequence: Synthetic oligonucleotide
cttactacccacagcccgagaatcccaac

SEQ ID NO: 218351 - DNA, 30 bp, Artificial Sequence
  Description of Artificial Sequence: Synthetic oligonucleotide
ttactacccacagcccgagaatcccaacag

SEQ ID NO: 218352 - DNA, 29 bp, Artificial Sequence
  Description of Artificial Sequence: Synthetic oligonucleotide
tactacccacagcccgagaatcccaacag

SEQ ID NO: 218353 - DNA, 28 bp, Artificial Sequence
  Description of Artificial Sequence: Synthetic oligonucleotide
actacccacagcccgagaatcccaacag

SEQ ID NO: 218354 - DNA, 27 bp, Artificial Sequence
  Description of Artificial Sequence: Synthetic oligonucleotide
ctacccacagcccgagaatcccaacag

SEQ ID NO: 218355 - DNA, 27 bp, Artificial Sequence
  Description of Artificial Sequence: Synthetic oligonucleotide
tacccacagcccgagaatcccaacagc

SEQ ID NO: 218356 - DNA, 26 bp, Artificial Sequence
  Description of Artificial Sequence: Synthetic oligonucleotide
acccacagcccgagaatcccaacagc

SEQ ID NO: 218357 - DNA, 25 bp, Artificial Sequence
  Description of Artificial Sequence: Synthetic oligonucleotide
cccacagcccgagaatcccaacagc

SEQ ID NO: 218358 - DNA, 25 bp, Artificial Sequence
  Description of Artificial Sequence: Synthetic oligonucleotide
ccacagcccgagaatcccaacagcg

SEQ ID NO: 218359 - DNA, 26 bp, Artificial Sequence
  Description of Artificial Sequence: Synthetic oligonucleotide
cacagcccgagaatcccaacagcggt

SEQ ID NO: 218360 - DNA, 26 bp, Artificial Sequence
  Description of Artificial Sequence: Synthetic oligonucleotide
acagcccgagaatcccaacagcggtg

SEQ ID NO: 218361 - DNA, 25 bp, Artificial Sequence
  Description of Artificial Sequence: Synthetic oligonucleotide
cagcccgagaatcccaacagcggtg

SEQ ID NO: 218362 - DNA, 27 bp, Artificial Sequence
  Description of Artificial Sequence: Synthetic oligonucleotide
agcccgagaatcccaacagcggtggaa

SEQ ID NO: 218363 - DNA, 27 bp, Artificial Sequence
  Description of Artificial Sequence: Synthetic oligonucleotide
gcccgagaatcccaacagcggtggaaa

SEQ ID NO: 218364 - DNA, 30 bp, Artificial Sequence
  Description of Artificial Sequence: Synthetic oligonucleotide
cccgagaatcccaacagcggtggaaatatc

SEQ ID NO: 218365 - DNA, 32 bp, Artificial Sequence
  Description of Artificial Sequence: Synthetic oligonucleotide
ccgagaatcccaacagcggtggaaatatctac

SEQ ID NO: 218366 - DNA, 32 bp, Artificial Sequence
  Description of Artificial Sequence: Synthetic oligonucleotide
cgagaatcccaacagcggtggaaatatctacc

SEQ ID NO: 218367 - DNA, 32 bp, Artificial Sequence
  Description of Artificial Sequence: Synthetic oligonucleotide
gagaatcccaacagcggtggaaatatctaccc

SEQ ID NO: 218368 - DNA, 34 bp, Artificial Sequence
  Description of Artificial Sequence: Synthetic oligonucleotide
agaatcccaacagcggtggaaatatctacccaag

SEQ ID NO: 218369 - DNA, 33 bp, Artificial Sequence
  Description of Artificial Sequence: Synthetic oligonucleotide
gaatcccaacagcggtggaaatatctacccaag

SEQ ID NO: 218370 - DNA, 33 bp, Artificial Sequence
  Description of Artificial Sequence: Synthetic oligonucleotide
aatcccaacagcggtggaaatatctacccaagg

SEQ ID NO: 218371 - DNA, 32 bp, Artificial Sequence
  Description of Artificial Sequence: Synthetic oligonucleotide
atcccaacagcggtggaaatatctacccaagg

SEQ ID NO: 218372 - DNA, 31 bp, Artificial Sequence
  Description of Artificial Sequence: Synthetic oligonucleotide
tcccaacagcggtggaaatatctacccaagg

SEQ ID NO: 218373 - DNA, 30 bp, Artificial Sequence
  Description of Artificial Sequence: Synthetic oligonucleotide
cccaacagcggtggaaatatctacccaagg

SEQ ID NO: 218374 - DNA, 30 bp, Artificial Sequence
  Description of Artificial Sequence: Synthetic oligonucleotide
ccaacagcggtggaaatatctacccaaggc

SEQ ID NO: 218375 - DNA, 30 bp, Artificial Sequence
  Description of Artificial Sequence: Synthetic oligonucleotide
caacagcggtggaaatatctacccaaggcc

SEQ ID NO: 218376 - DNA, 33 bp, Artificial Sequence
  Description of Artificial Sequence: Synthetic oligonucleotide
aacagcggtggaaatatctacccaaggccaaag

SEQ ID NO: 218377 - DNA, 35 bp, Artificial Sequence
  Description of Artificial Sequence: Synthetic oligonucleotide
atgggtgagttcaacgagaagaagacaacatgtgg

SEQ ID NO: 218378 - DNA, 34 bp, Artificial Sequence
  Description of Artificial Sequence: Synthetic oligonucleotide
tgggtgagttcaacgagaagaagacaacatgtgg

SEQ ID NO: 218379 - DNA, 33 bp, Artificial Sequence
  Description of Artificial Sequence: Synthetic oligonucleotide
gggtgagttcaacgagaagaagacaacatgtgg

SEQ ID NO: 218380 - DNA, 33 bp, Artificial Sequence
  Description of Artificial Sequence: Synthetic oligonucleotide
ggtgagttcaacgagaagaagacaacatgtggc

SEQ ID NO: 218381 - DNA, 34 bp, Artificial Sequence
  Description of Artificial Sequence: Synthetic oligonucleotide
gtgagttcaacgagaagaagacaacatgtggcac

SEQ ID NO: 218382 - DNA, 34 bp, Artificial Sequence
  Description of Artificial Sequence: Synthetic oligonucleotide
tgagttcaacgagaagaagacaacatgtggcacc

SEQ ID NO: 218383 - DNA, 33 bp, Artificial Sequence
  Description of Artificial Sequence: Synthetic oligonucleotide
gagttcaacgagaagaagacaacatgtggcacc

SEQ ID NO: 218384 - DNA, 33 bp, Artificial Sequence
  Description of Artificial Sequence: Synthetic oligonucleotide
agttcaacgagaagaagacaacatgtggcaccg

SEQ ID NO: 218385 - DNA, 32 bp, Artificial Sequence
  Description of Artificial Sequence: Synthetic oligonucleotide
gttcaacgagaagaagacaacatgtggcaccg

SEQ ID NO: 218386 - DNA, 35 bp, Artificial Sequence
  Description of Artificial Sequence: Synthetic oligonucleotide
ttcaacgagaagaagacaacatgtggcaccgtttg

SEQ ID NO: 218387 - DNA, 34 bp, Artificial Sequence
  Description of Artificial Sequence: Synthetic oligonucleotide
tcaacgagaagaagacaacatgtggcaccgtttg

SEQ ID NO: 218388 - DNA, 33 bp, Artificial Sequence
  Description of Artificial Sequence: Synthetic oligonucleotide
caacgagaagaagacaacatgtggcaccgtttg

SEQ ID NO: 218389 - DNA, 33 bp, Artificial Sequence
  Description of Artificial Sequence: Synthetic oligonucleotide
aacgagaagaagacaacatgtggcaccgtttgc

SEQ ID NO: 218390 - DNA, 32 bp, Artificial Sequence
  Description of Artificial Sequence: Synthetic oligonucleotide
acgagaagaagacaacatgtggcaccgtttgc

SEQ ID NO: 218391 - DNA, 31 bp, Artificial Sequence
  Description of Artificial Sequence: Synthetic oligonucleotide
cgagaagaagacaacatgtggcaccgtttgc

SEQ ID NO: 218392 - DNA, 31 bp, Artificial Sequence
  Description of Artificial Sequence: Synthetic oligonucleotide
gagaagaagacaacatgtggcaccgtttgcc

SEQ ID NO: 218393 - DNA, 32 bp, Artificial Sequence
  Description of Artificial Sequence: Synthetic oligonucleotide
agaagaagacaacatgtggcaccgtttgcctc

SEQ ID NO: 218394 - DNA, 31 bp, Artificial Sequence
  Description of Artificial Sequence: Synthetic oligonucleotide
gaagaagacaacatgtggcaccgtttgcctc

SEQ ID NO: 218395 - DNA, 33 bp, Artificial Sequence
  Description of Artificial Sequence: Synthetic oligonucleotide
aagaagacaacatgtggcaccgtttgcctcaag

SEQ ID NO: 218396 - DNA, 32 bp, Artificial Sequence
  Description of Artificial Sequence: Synthetic oligonucleotide
agaagacaacatgtggcaccgtttgcctcaag

SEQ ID NO: 218397 - DNA, 31 bp, Artificial Sequence
  Description of Artificial Sequence: Synthetic oligonucleotide
gaagacaacatgtggcaccgtttgcctcaag

SEQ ID NO: 218398 - DNA, 33 bp, Artificial Sequence
  Description of Artificial Sequence: Synthetic oligonucleotide
aagacaacatgtggcaccgtttgcctcaagtac

SEQ ID NO: 218399 - DNA, 32 bp, Artificial Sequence
  Description of Artificial Sequence: Synthetic oligonucleotide
agacaacatgtggcaccgtttgcctcaagtac

SEQ ID NO: 218400 - DNA, 31 bp, Artificial Sequence
  Description of Artificial Sequence: Synthetic oligonucleotide
gacaacatgtggcaccgtttgcctcaagtac

SEQ ID NO: 218401 - DNA, 31 bp, Artificial Sequence
  Description of Artificial Sequence: Synthetic oligonucleotide
acaacatgtggcaccgtttgcctcaagtacc

SEQ ID NO: 218402 - DNA, 30 bp, Artificial Sequence
  Description of Artificial Sequence: Synthetic oligonucleotide
caacatgtggcaccgtttgcctcaagtacc

SEQ ID NO: 218403 - DNA, 31 bp, Artificial Sequence
  Description of Artificial Sequence: Synthetic oligonucleotide
aacatgtggcaccgtttgcctcaagtacctg

SEQ ID NO: 218404 - DNA, 30 bp, Artificial Sequence
  Description of Artificial Sequence: Synthetic oligonucleotide
acatgtggcaccgtttgcctcaagtacctg

SEQ ID NO: 218405 - DNA, 29 bp, Artificial Sequence
  Description of Artificial Sequence: Synthetic oligonucleotide
catgtggcaccgtttgcctcaagtacctg

SEQ ID NO: 218406 - DNA, 29 bp, Artificial Sequence
  Description of Artificial Sequence: Synthetic oligonucleotide
atgtggcaccgtttgcctcaagtacctgc

SEQ ID NO: 218407 - DNA, 28 bp, Artificial Sequence
  Description of Artificial Sequence: Synthetic oligonucleotide
tgtggcaccgtttgcctcaagtacctgc

SEQ ID NO: 218408 - DNA, 27 bp, Artificial Sequence
  Description of Artificial Sequence: Synthetic oligonucleotide
gtggcaccgtttgcctcaagtacctgc

SEQ ID NO: 218409 - DNA, 28 bp, Artificial Sequence
  Description of Artificial Sequence: Synthetic oligonucleotide
tggcaccgtttgcctcaagtacctgctg

SEQ ID NO: 218410 - DNA, 27 bp, Artificial Sequence
  Description of Artificial Sequence: Synthetic oligonucleotide
ggcaccgtttgcctcaagtacctgctg

SEQ ID NO: 218411 - DNA, 31 bp, Artificial Sequence
  Description of Artificial Sequence: Synthetic oligonucleotide
gcaccgtttgcctcaagtacctgctgtttac

SEQ ID NO: 218412 - DNA, 31 bp, Artificial Sequence
  Description of Artificial Sequence: Synthetic oligonucleotide
caccgtttgcctcaagtacctgctgtttacc

SEQ ID NO: 218413 - DNA, 33 bp, Artificial Sequence
  Description of Artificial Sequence: Synthetic oligonucleotide
accgtttgcctcaagtacctgctgtttacctac

SEQ ID NO: 218414 - DNA, 32 bp, Artificial Sequence
  Description of Artificial Sequence: Synthetic oligonucleotide
ccgtttgcctcaagtacctgctgtttacctac

SEQ ID NO: 218415 - DNA, 36 bp, Artificial Sequence
  Description of Artificial Sequence: Synthetic oligonucleotide
cgtttgcctcaagtacctgctgtttacctacaattg

SEQ ID NO: 218416 - DNA, 36 bp, Artificial Sequence
  Description of Artificial Sequence: Synthetic oligonucleotide
gtttgcctcaagtacctgctgtttacctacaattgc

SEQ ID NO: 218417 - DNA, 37 bp, Artificial Sequence
  Description of Artificial Sequence: Synthetic oligonucleotide
tttgcctcaagtacctgctgtttacctacaattgctg

SEQ ID NO: 218418 - DNA, 36 bp, Artificial Sequence
  Description of Artificial Sequence: Synthetic oligonucleotide
ttgcctcaagtacctgctgtttacctacaattgctg

SEQ ID NO: 218419 - DNA, 35 bp, Artificial Sequence
  Description of Artificial Sequence: Synthetic oligonucleotide
tgcctcaagtacctgctgtttacctacaattgctg

SEQ ID NO: 218420 - DNA, 34 bp, Artificial Sequence
  Description of Artificial Sequence: Synthetic oligonucleotide
gcctcaagtacctgctgtttacctacaattgctg

SEQ ID NO: 218421 - DNA, 34 bp, Artificial Sequence
  Description of Artificial Sequence: Synthetic oligonucleotide
cctcaagtacctgctgtttacctacaattgctgc

SEQ ID NO: 218422 - DNA, 36 bp, Artificial Sequence
  Description of Artificial Sequence: Synthetic oligonucleotide
ctcaagtacctgctgtttacctacaattgctgcttc

SEQ ID NO: 218423 - DNA, 37 bp, Artificial Sequence
  Description of Artificial Sequence: Synthetic oligonucleotide
tcaagtacctgctgtttacctacaattgctgcttctg

SEQ ID NO: 218424 - DNA, 36 bp, Artificial Sequence
  Description of Artificial Sequence: Synthetic oligonucleotide
caagtacctgctgtttacctacaattgctgcttctg

SEQ ID NO: 218425 - DNA, 36 bp, Artificial Sequence
  Description of Artificial Sequence: Synthetic oligonucleotide
aagtacctgctgtttacctacaattgctgcttctgg

SEQ ID NO: 218426 - DNA, 35 bp, Artificial Sequence
  Description of Artificial Sequence: Synthetic oligonucleotide
agtacctgctgtttacctacaattgctgcttctgg

SEQ ID NO: 218427 - DNA, 34 bp, Artificial Sequence
  Description of Artificial Sequence: Synthetic oligonucleotide
gtacctgctgtttacctacaattgctgcttctgg

SEQ ID NO: 218428 - DNA, 34 bp, Artificial Sequence
  Description of Artificial Sequence: Synthetic oligonucleotide
tacctgctgtttacctacaattgctgcttctggc

SEQ ID NO: 218429 - DNA, 33 bp, Artificial Sequence
  Description of Artificial Sequence: Synthetic oligonucleotide
acctgctgtttacctacaattgctgcttctggc

SEQ ID NO: 218430 - DNA, 32 bp, Artificial Sequence
  Description of Artificial Sequence: Synthetic oligonucleotide
cctgctgtttacctacaattgctgcttctggc

SEQ ID NO: 218431 - DNA, 33 bp, Artificial Sequence
  Description of Artificial Sequence: Synthetic oligonucleotide
ctgctgtttacctacaattgctgcttctggctg

SEQ ID NO: 218432 - DNA, 33 bp, Artificial Sequence
  Description of Artificial Sequence: Synthetic oligonucleotide
tgctgtttacctacaattgctgcttctggctgg

SEQ ID NO: 218433 - DNA, 32 bp, Artificial Sequence
  Description of Artificial Sequence: Synthetic oligonucleotide
gctgtttacctacaattgctgcttctggctgg

SEQ ID NO: 218434 - DNA, 32 bp, Artificial Sequence
  Description of Artificial Sequence: Synthetic oligonucleotide
ctgtttacctacaattgctgcttctggctggc

SEQ ID NO: 218435 - DNA, 33 bp, Artificial Sequence
  Description of Artificial Sequence: Synthetic oligonucleotide
tgtttacctacaattgctgcttctggctggctg

SEQ ID NO: 218436 - DNA, 32 bp, Artificial Sequence
  Description of Artificial Sequence: Synthetic oligonucleotide
gtttacctacaattgctgcttctggctggctg

SEQ ID NO: 218437 - DNA, 32 bp, Artificial Sequence
  Description of Artificial Sequence: Synthetic oligonucleotide
tttacctacaattgctgcttctggctggctgg

SEQ ID NO: 218438 - DNA, 31 bp, Artificial Sequence
  Description of Artificial Sequence: Synthetic oligonucleotide
ttacctacaattgctgcttctggctggctgg

SEQ ID NO: 218439 - DNA, 30 bp, Artificial Sequence
  Description of Artificial Sequence: Synthetic oligonucleotide
tacctacaattgctgcttctggctggctgg

SEQ ID NO: 218440 - DNA, 29 bp, Artificial Sequence
  Description of Artificial Sequence: Synthetic oligonucleotide
acctacaattgctgcttctggctggctgg

SEQ ID NO: 218441 - DNA, 28 bp, Artificial Sequence
  Description of Artificial Sequence: Synthetic oligonucleotide
cctacaattgctgcttctggctggctgg

SEQ ID NO: 218442 - DNA, 28 bp, Artificial Sequence
  Description of Artificial Sequence: Synthetic oligonucleotide
ctacaattgctgcttctggctggctggc

SEQ ID NO: 218443 - DNA, 28 bp, Artificial Sequence
  Description of Artificial Sequence: Synthetic oligonucleotide
tacaattgctgcttctggctggctggcc

SEQ ID NO: 218444 - DNA, 27 bp, Artificial Sequence
  Description of Artificial Sequence: Synthetic oligonucleotide
acaattgctgcttctggctggctggcc

SEQ ID NO: 218445 - DNA, 27 bp, Artificial Sequence
  Description of Artificial Sequence: Synthetic oligonucleotide
caattgctgcttctggctggctggcct

SEQ ID NO: 218446 - DNA, 27 bp, Artificial Sequence
  Description of Artificial Sequence: Synthetic oligonucleotide
aattgctgcttctggctggctggcctg

SEQ ID NO: 218447 - DNA, 26 bp, Artificial Sequence
  Description of Artificial Sequence: Synthetic oligonucleotide
attgctgcttctggctggctggcctg

SEQ ID NO: 218448 - DNA, 25 bp, Artificial Sequence
  Description of Artificial Sequence: Synthetic oligonucleotide
ttgctgcttctggctggctggcctg

SEQ ID NO: 218449 - DNA, 24 bp, Artificial Sequence
  Description of Artificial Sequence: Synthetic oligonucleotide
tgctgcttctggctggctggcctg

SEQ ID NO: 218450 - DNA, 23 bp, Artificial Sequence
  Description of Artificial Sequence: Synthetic oligonucleotide
gctgcttctggctggctggcctg

SEQ ID NO: 218451 - DNA, 23 bp, Artificial Sequence
  Description of Artificial Sequence: Synthetic oligonucleotide
ctgcttctggctggctggcctgg

SEQ ID NO: 218452 - DNA, 24 bp, Artificial Sequence
  Description of Artificial Sequence: Synthetic oligonucleotide
tgcttctggctggctggcctggct

SEQ ID NO: 218453 - DNA, 23 bp, Artificial Sequence
  Description of Artificial Sequence: Synthetic oligonucleotide
gcttctggctggctggcctggct

SEQ ID NO: 218454 - DNA, 24 bp, Artificial Sequence
  Description of Artificial Sequence: Synthetic oligonucleotide
cttctggctggctggcctggctgt

SEQ ID NO: 218455 - DNA, 26 bp, Artificial Sequence
  Description of Artificial Sequence: Synthetic oligonucleotide
ttctggctggctggcctggctgtcat

SEQ ID NO: 218456 - DNA, 25 bp, Artificial Sequence
  Description of Artificial Sequence: Synthetic oligonucleotide
tctggctggctggcctggctgtcat

SEQ ID NO: 218457 - DNA, 24 bp, Artificial Sequence
  Description of Artificial Sequence: Synthetic oligonucleotide
ctggctggctggcctggctgtcat

SEQ ID NO: 218458 - DNA, 24 bp, Artificial Sequence
  Description of Artificial Sequence: Synthetic oligonucleotide
tggctggctggcctggctgtcatg

SEQ ID NO: 218459 - DNA, 23 bp, Artificial Sequence
  Description of Artificial Sequence: Synthetic oligonucleotide
ggctggctggcctggctgtcatg

SEQ ID NO: 218460 - DNA, 23 bp, Artificial Sequence
  Description of Artificial Sequence: Synthetic oligonucleotide
gctggctggcctggctgtcatgg

SEQ ID NO: 218461 - DNA, 24 bp, Artificial Sequence
  Description of Artificial Sequence: Synthetic oligonucleotide
ctggctggcctggctgtcatggca

SEQ ID NO: 218462 - DNA, 25 bp, Artificial Sequence
  Description of Artificial Sequence: Synthetic oligonucleotide
tggctggcctggctgtcatggcagt

SEQ ID NO: 218463 - DNA, 24 bp, Artificial Sequence
  Description of Artificial Sequence: Synthetic oligonucleotide
ggctggcctggctgtcatggcagt

SEQ ID NO: 218464 - DNA, 24 bp, Artificial Sequence
  Description of Artificial Sequence: Synthetic oligonucleotide
gctggcctggctgtcatggcagtg

SEQ ID NO: 218465 - DNA, 24 bp, Artificial Sequence
  Description of Artificial Sequence: Synthetic oligonucleotide
ctggcctggctgtcatggcagtgg

SEQ ID NO: 218466 - DNA, 24 bp, Artificial Sequence
  Description of Artificial Sequence: Synthetic oligonucleotide
tggcctggctgtcatggcagtggg

SEQ ID NO: 218467 - DNA, 23 bp, Artificial Sequence
  Description of Artificial Sequence: Synthetic oligonucleotide
ggcctggctgtcatggcagtggg

SEQ ID NO: 218468 - DNA, 25 bp, Artificial Sequence
  Description of Artificial Sequence: Synthetic oligonucleotide
gcctggctgtcatggcagtgggcat

SEQ ID NO: 218469 - DNA, 26 bp, Artificial Sequence
  Description of Artificial Sequence: Synthetic oligonucleotide
cctggctgtcatggcagtgggcatct

SEQ ID NO: 218470 - DNA, 26 bp, Artificial Sequence
  Description of Artificial Sequence: Synthetic oligonucleotide
ctggctgtcatggcagtgggcatctg

SEQ ID NO: 218471 - DNA, 27 bp, Artificial Sequence
  Description of Artificial Sequence: Synthetic oligonucleotide
tggctgtcatggcagtgggcatctgga

SEQ ID NO: 218472 - DNA, 26 bp, Artificial Sequence
  Description of Artificial Sequence: Synthetic oligonucleotide
ggctgtcatggcagtgggcatctgga

SEQ ID NO: 218473 - DNA, 26 bp, Artificial Sequence
  Description of Artificial Sequence: Synthetic oligonucleotide
gctgtcatggcagtgggcatctggac

SEQ ID NO: 218474 - DNA, 26 bp, Artificial Sequence
  Description of Artificial Sequence: Synthetic oligonucleotide
ctgtcatggcagtgggcatctggacg

SEQ ID NO: 218475 - DNA, 27 bp, Artificial Sequence
  Description of Artificial Sequence: Synthetic oligonucleotide
tgtcatggcagtgggcatctggacgct

SEQ ID NO: 218476 - DNA, 26 bp, Artificial Sequence
  Description of Artificial Sequence: Synthetic oligonucleotide
gtcatggcagtgggcatctggacgct

SEQ ID NO: 218477 - DNA, 26 bp, Artificial Sequence
  Description of Artificial Sequence: Synthetic oligonucleotide
tcatggcagtgggcatctggacgctg

SEQ ID NO: 218478 - DNA, 25 bp, Artificial Sequence
  Description of Artificial Sequence: Synthetic oligonucleotide
catggcagtgggcatctggacgctg

SEQ ID NO: 218479 - DNA, 25 bp, Artificial Sequence
  Description of Artificial Sequence: Synthetic oligonucleotide
atggcagtgggcatctggacgctgg

SEQ ID NO: 218480 - DNA, 24 bp, Artificial Sequence
  Description of Artificial Sequence: Synthetic oligonucleotide
tggcagtgggcatctggacgctgg

SEQ ID NO: 218481 - DNA, 23 bp, Artificial Sequence
  Description of Artificial Sequence: Synthetic oligonucleotide
ggcagtgggcatctggacgctgg

SEQ ID NO: 218482 - DNA, 23 bp, Artificial Sequence
  Description of Artificial Sequence: Synthetic oligonucleotide
gcagtgggcatctggacgctggc

SEQ ID NO: 218483 - DNA, 23 bp, Artificial Sequence
  Description of Artificial Sequence: Synthetic oligonucleotide
cagtgggcatctggacgctggcc

SEQ ID NO: 218484 - DNA, 24 bp, Artificial Sequence
  Description of Artificial Sequence: Synthetic oligonucleotide
agtgggcatctggacgctggccct

SEQ ID NO: 218485 - DNA, 23 bp, Artificial Sequence
  Description of Artificial Sequence: Synthetic oligonucleotide
gtgggcatctggacgctggccct

SEQ ID NO: 218486 - DNA, 25 bp, Artificial Sequence
  Description of Artificial Sequence: Synthetic oligonucleotide
tgggcatctggacgctggccctcaa

SEQ ID NO: 218487 - DNA, 24 bp, Artificial Sequence
  Description of Artificial Sequence: Synthetic oligonucleotide
gggcatctggacgctggccctcaa

SEQ ID NO: 218488 - DNA, 25 bp, Artificial Sequence
  Description of Artificial Sequence: Synthetic oligonucleotide
ggcatctggacgctggccctcaaga

SEQ ID NO: 218489 - DNA, 26 bp, Artificial Sequence
  Description of Artificial Sequence: Synthetic oligonucleotide
gcatctggacgctggccctcaagagt

SEQ ID NO: 218490 - DNA, 27 bp, Artificial Sequence
  Description of Artificial Sequence: Synthetic oligonucleotide
catctggacgctggccctcaagagtga

SEQ ID NO: 218491 - DNA, 27 bp, Artificial Sequence
  Description of Artificial Sequence: Synthetic oligonucleotide
atctggacgctggccctcaagagtgac

SEQ ID NO: 218492 - DNA, 27 bp, Artificial Sequence
  Description of Artificial Sequence: Synthetic oligonucleotide
tctggacgctggccctcaagagtgact

SEQ ID NO: 218493 - DNA, 27 bp, Artificial Sequence
  Description of Artificial Sequence: Synthetic oligonucleotide
ctggacgctggccctcaagagtgacta

SEQ ID NO: 218494 - DNA, 27 bp, Artificial Sequence
  Description of Artificial Sequence: Synthetic oligonucleotide
tggacgctggccctcaagagtgactac

SEQ ID NO: 218495 - DNA, 27 bp, Artificial Sequence
  Description of Artificial Sequence: Synthetic oligonucleotide
ggacgctggccctcaagagtgactaca

SEQ ID NO: 218496 - DNA, 28 bp, Artificial Sequence
  Description of Artificial Sequence: Synthetic oligonucleotide
gacgctggccctcaagagtgactacatc

SEQ ID NO: 218497 - DNA, 29 bp, Artificial Sequence
  Description of Artificial Sequence: Synthetic oligonucleotide
acgctggccctcaagagtgactacatcag

SEQ ID NO: 218498 - DNA, 28 bp, Artificial Sequence
  Description of Artificial Sequence: Synthetic oligonucleotide
cgctggccctcaagagtgactacatcag

SEQ ID NO: 218499 - DNA, 28 bp, Artificial Sequence
  Description of Artificial Sequence: Synthetic oligonucleotide
gctggccctcaagagtgactacatcagc

SEQ ID NO: 218500 - DNA, 28 bp, Artificial Sequence
  Description of Artificial Sequence: Synthetic oligonucleotide
ctggccctcaagagtgactacatcagcc

SEQ ID NO: 218501 - DNA, 29 bp, Artificial Sequence
  Description of Artificial Sequence: Synthetic oligonucleotide
tggccctcaagagtgactacatcagcctg

SEQ ID NO: 218502 - DNA, 28 bp, Artificial Sequence
  Description of Artificial Sequence: Synthetic oligonucleotide
ggccctcaagagtgactacatcagcctg

SEQ ID NO: 218503 - DNA, 28 bp, Artificial Sequence
  Description of Artificial Sequence: Synthetic oligonucleotide
gccctcaagagtgactacatcagcctgc

SEQ ID NO: 218504 - DNA, 29 bp, Artificial Sequence
  Description of Artificial Sequence: Synthetic oligonucleotide
ccctcaagagtgactacatcagcctgctg

SEQ ID NO: 218505 - DNA, 29 bp, Artificial Sequence
  Description of Artificial Sequence: Synthetic oligonucleotide
cctcaagagtgactacatcagcctgctgg

SEQ ID NO: 218506 - DNA, 29 bp, Artificial Sequence
  Description of Artificial Sequence: Synthetic oligonucleotide
ctcaagagtgactacatcagcctgctggc

SEQ ID NO: 218507 - DNA, 29 bp, Artificial Sequence
  Description of Artificial Sequence: Synthetic oligonucleotide
tcaagagtgactacatcagcctgctggcc

SEQ ID NO: 218508 - DNA, 28 bp, Artificial Sequence
  Description of Artificial Sequence: Synthetic oligonucleotide
caagagtgactacatcagcctgctggcc

SEQ ID NO: 218509 - DNA, 29 bp, Artificial Sequence
  Description of Artificial Sequence: Synthetic oligonucleotide
aagagtgactacatcagcctgctggcctc

SEQ ID NO: 218510 - DNA, 28 bp, Artificial Sequence
  Description of Artificial Sequence: Synthetic oligonucleotide
agagtgactacatcagcctgctggcctc

SEQ ID NO: 218511 - DNA, 27 bp, Artificial Sequence
  Description of Artificial Sequence: Synthetic oligonucleotide
gagtgactacatcagcctgctggcctc

SEQ ID NO: 218512 - DNA, 28 bp, Artificial Sequence
  Description of Artificial Sequence: Synthetic oligonucleotide
agtgactacatcagcctgctggcctcag

SEQ ID NO: 218513 - DNA, 27 bp, Artificial Sequence
  Description of Artificial Sequence: Synthetic oligonucleotide
gtgactacatcagcctgctggcctcag

SEQ ID NO: 218514 - DNA, 27 bp, Artificial Sequence
  Description of Artificial Sequence: Synthetic oligonucleotide
tgactacatcagcctgctggcctcagg

SEQ ID NO: 218515 - DNA, 26 bp, Artificial Sequence
  Description of Artificial Sequence: Synthetic oligonucleotide
gactacatcagcctgctggcctcagg

SEQ ID NO: 218516 - DNA, 27 bp, Artificial Sequence
  Description of Artificial Sequence: Synthetic oligonucleotide
actacatcagcctgctggcctcaggca

SEQ ID NO: 218517 - DNA, 26 bp, Artificial Sequence
  Description of Artificial Sequence: Synthetic oligonucleotide
ctacatcagcctgctggcctcaggca

SEQ ID NO: 218518 - DNA, 26 bp, Artificial Sequence
  Description of Artificial Sequence: Synthetic oligonucleotide
tacatcagcctgctggcctcaggcac

SEQ ID NO: 218519 - DNA, 25 bp, Artificial Sequence
  Description of Artificial Sequence: Synthetic oligonucleotide
acatcagcctgctggcctcaggcac

SEQ ID NO: 218520 - DNA, 24 bp, Artificial Sequence
  Description of Artificial Sequence: Synthetic oligonucleotide
catcagcctgctggcctcaggcac

SEQ ID NO: 218521 - DNA, 26 bp, Artificial Sequence
  Description of Artificial Sequence: Synthetic oligonucleotide
atcagcctgctggcctcaggcaccta

SEQ ID NO: 218522 - DNA, 25 bp, Artificial Sequence
  Description of Artificial Sequence: Synthetic oligonucleotide
tcagcctgctggcctcaggcaccta

SEQ ID NO: 218523 - DNA, 24 bp, Artificial Sequence
  Description of Artificial Sequence: Synthetic oligonucleotide
cagcctgctggcctcaggcaccta

SEQ ID NO: 218524 - DNA, 24 bp, Artificial Sequence
  Description of Artificial Sequence: Synthetic oligonucleotide
agcctgctggcctcaggcacctac

SEQ ID NO: 218525 - DNA, 23 bp, Artificial Sequence
  Description of Artificial Sequence: Synthetic oligonucleotide
gcctgctggcctcaggcacctac

SEQ ID NO: 218526 - DNA, 24 bp, Artificial Sequence
  Description of Artificial Sequence: Synthetic oligonucleotide
cctgctggcctcaggcacctacct

SEQ ID NO: 218527 - DNA, 24 bp, Artificial Sequence
  Description of Artificial Sequence: Synthetic oligonucleotide
ctgctggcctcaggcacctacctg

SEQ ID NO: 218528 - DNA, 24 bp, Artificial Sequence
  Description of Artificial Sequence: Synthetic oligonucleotide
tgctggcctcaggcacctacctgg

SEQ ID NO: 218529 - DNA, 23 bp, Artificial Sequence
  Description of Artificial Sequence: Synthetic oligonucleotide
gctggcctcaggcacctacctgg

SEQ ID NO: 218530 - DNA, 23 bp, Artificial Sequence
  Description of Artificial Sequence: Synthetic oligonucleotide
ctggcctcaggcacctacctggc

SEQ ID NO: 218531 - DNA, 24 bp, Artificial Sequence
  Description of Artificial Sequence: Synthetic oligonucleotide
tggcctcaggcacctacctggcca

SEQ ID NO: 218532 - DNA, 23 bp, Artificial Sequence
  Description of Artificial Sequence: Synthetic oligonucleotide
ggcctcaggcacctacctggcca

SEQ ID NO: 218533 - DNA, 24 bp, Artificial Sequence
  Description of Artificial Sequence: Synthetic oligonucleotide
gcctcaggcacctacctggccaca

SEQ ID NO: 218534 - DNA, 24 bp, Artificial Sequence
  Description of Artificial Sequence: Synthetic oligonucleotide
cctcaggcacctacctggccacag

SEQ ID NO: 218535 - DNA, 24 bp, Artificial Sequence
  Description of Artificial Sequence: Synthetic oligonucleotide
ctcaggcacctacctggccacagc

SEQ ID NO: 218536 - DNA, 26 bp, Artificial Sequence
  Description of Artificial Sequence: Synthetic oligonucleotide
tcaggcacctacctggccacagccta

SEQ ID NO: 218537 - DNA, 25 bp, Artificial Sequence
  Description of Artificial Sequence: Synthetic oligonucleotide
caggcacctacctggccacagccta

SEQ ID NO: 218538 - DNA, 27 bp, Artificial Sequence
  Description of Artificial Sequence: Synthetic oligonucleotide
aggcacctacctggccacagcctacat

SEQ ID NO: 218539 - DNA, 26 bp, Artificial Sequence
  Description of Artificial Sequence: Synthetic oligonucleotide
ggcacctacctggccacagcctacat

SEQ ID NO: 218540 - DNA, 26 bp, Artificial Sequence
  Description of Artificial Sequence: Synthetic oligonucleotide
gcacctacctggccacagcctacatc

SEQ ID NO: 218541 - DNA, 27 bp, Artificial Sequence
  Description of Artificial Sequence: Synthetic oligonucleotide
cacctacctggccacagcctacatcct

SEQ ID NO: 218542 - DNA, 27 bp, Artificial Sequence
  Description of Artificial Sequence: Synthetic oligonucleotide
acctacctggccacagcctacatcctg

SEQ ID NO: 218543 - DNA, 26 bp, Artificial Sequence
  Description of Artificial Sequence: Synthetic oligonucleotide
cctacctggccacagcctacatcctg

SEQ ID NO: 218544 - DNA, 27 bp, Artificial Sequence
  Description of Artificial Sequence: Synthetic oligonucleotide
ctacctggccacagcctacatcctggt

SEQ ID NO: 218545 - DNA, 27 bp, Artificial Sequence
  Description of Artificial Sequence: Synthetic oligonucleotide
tacctggccacagcctacatcctggtg

SEQ ID NO: 218546 - DNA, 26 bp, Artificial Sequence
  Description of Artificial Sequence: Synthetic oligonucleotide
acctggccacagcctacatcctggtg

SEQ ID NO: 218547 - DNA, 25 bp, Artificial Sequence
  Description of Artificial Sequence: Synthetic oligonucleotide
cctggccacagcctacatcctggtg

SEQ ID NO: 218548 - DNA, 26 bp, Artificial Sequence
  Description of Artificial Sequence: Synthetic oligonucleotide
ctggccacagcctacatcctggtggt

SEQ ID NO: 218549 - DNA, 26 bp, Artificial Sequence
  Description of Artificial Sequence: Synthetic oligonucleotide
tggccacagcctacatcctggtggtg

SEQ ID NO: 218550 - DNA, 25 bp, Artificial Sequence
  Description of Artificial Sequence: Synthetic oligonucleotide
ggccacagcctacatcctggtggtg

SEQ ID NO: 218551 - DNA, 25 bp, Artificial Sequence
  Description of Artificial Sequence: Synthetic oligonucleotide
gccacagcctacatcctggtggtgg

SEQ ID NO: 218552 - DNA, 25 bp, Artificial Sequence
  Description of Artificial Sequence: Synthetic oligonucleotide
ccacagcctacatcctggtggtggc

SEQ ID NO: 218553 - DNA, 25 bp, Artificial Sequence
  Description of Artificial Sequence: Synthetic oligonucleotide
cacagcctacatcctggtggtggcg

SEQ ID NO: 218554 - DNA, 25 bp, Artificial Sequence
  Description of Artificial Sequence: Synthetic oligonucleotide
acagcctacatcctggtggtggcgg

SEQ ID NO: 218555 - DNA, 24 bp, Artificial Sequence
  Description of Artificial Sequence: Synthetic oligonucleotide
cagcctacatcctggtggtggcgg

SEQ ID NO: 218556 - DNA, 24 bp, Artificial Sequence
  Description of Artificial Sequence: Synthetic oligonucleotide
agcctacatcctggtggtggcggg

SEQ ID NO: 218557 - DNA, 23 bp, Artificial Sequence
  Description of Artificial Sequence: Synthetic oligonucleotide
gcctacatcctggtggtggcggg

SEQ ID NO: 218558 - DNA, 24 bp, Artificial Sequence
  Description of Artificial Sequence: Synthetic oligonucleotide
cctacatcctggtggtggcgggca

SEQ ID NO: 218559 - DNA, 25 bp, Artificial Sequence
  Description of Artificial Sequence: Synthetic oligonucleotide
ctacatcctggtggtggcgggcact

SEQ ID NO: 218560 - DNA, 26 bp, Artificial Sequence
  Description of Artificial Sequence: Synthetic oligonucleotide
tacatcctggtggtggcgggcactgt

SEQ ID NO: 218561 - DNA, 25 bp, Artificial Sequence
  Description of Artificial Sequence: Synthetic oligonucleotide
acatcctggtggtggcgggcactgt

SEQ ID NO: 218562 - DNA, 24 bp, Artificial Sequence
  Description of Artificial Sequence: Synthetic oligonucleotide
catcctggtggtggcgggcactgt

SEQ ID NO: 218563 - DNA, 24 bp, Artificial Sequence
  Description of Artificial Sequence: Synthetic oligonucleotide
atcctggtggtggcgggcactgtc

SEQ ID NO: 218564 - DNA, 23 bp, Artificial Sequence
  Description of Artificial Sequence: Synthetic oligonucleotide
tcctggtggtggcgggcactgtc

SEQ ID NO: 218565 - DNA, 22 bp, Artificial Sequence
  Description of Artificial Sequence: Synthetic oligonucleotide
cctggtggtggcgggcactgtc

SEQ ID NO: 218566 - DNA, 23 bp, Artificial Sequence
  Description of Artificial Sequence: Synthetic oligonucleotide
ctggtggtggcgggcactgtcgt

SEQ ID NO: 218567 - DNA, 25 bp, Artificial Sequence
  Description of Artificial Sequence: Synthetic oligonucleotide
tggtggtggcgggcactgtcgtcat

SEQ ID NO: 218568 - DNA, 24 bp, Artificial Sequence
  Description of Artificial Sequence: Synthetic oligonucleotide
ggtggtggcgggcactgtcgtcat

SEQ ID NO: 218569 - DNA, 24 bp, Artificial Sequence
  Description of Artificial Sequence: Synthetic oligonucleotide
gtggtggcgggcactgtcgtcatg

SEQ ID NO: 218570 - DNA, 25 bp, Artificial Sequence
  Description of Artificial Sequence: Synthetic oligonucleotide
tggtggcgggcactgtcgtcatggt

SEQ ID NO: 218571 - DNA, 24 bp, Artificial Sequence
  Description of Artificial Sequence: Synthetic oligonucleotide
ggtggcgggcactgtcgtcatggt

SEQ ID NO: 218572 - DNA, 25 bp, Artificial Sequence
  Description of Artificial Sequence: Synthetic oligonucleotide
gtggcgggcactgtcgtcatggtga

SEQ ID NO: 218573 - DNA, 26 bp, Artificial Sequence
  Description of Artificial Sequence: Synthetic oligonucleotide
tggcgggcactgtcgtcatggtgact

SEQ ID NO: 218574 - DNA, 25 bp, Artificial Sequence
  Description of Artificial Sequence: Synthetic oligonucleotide
ggcgggcactgtcgtcatggtgact

SEQ ID NO: 218575 - DNA, 25 bp, Artificial Sequence
  Description of Artificial Sequence: Synthetic oligonucleotide
gcgggcactgtcgtcatggtgactg

SEQ ID NO: 218576 - DNA, 25 bp, Artificial Sequence
  Description of Artificial Sequence: Synthetic oligonucleotide
cgggcactgtcgtcatggtgactgg

SEQ ID NO: 218577 - DNA, 25 bp, Artificial Sequence
  Description of Artificial Sequence: Synthetic oligonucleotide
gggcactgtcgtcatggtgactggg

SEQ ID NO: 218578 - DNA, 26 bp, Artificial Sequence
  Description of Artificial Sequence: Synthetic oligonucleotide
ggcactgtcgtcatggtgactggggt

SEQ ID NO: 218579 - DNA, 27 bp, Artificial Sequence
  Description of Artificial Sequence: Synthetic oligonucleotide
gcactgtcgtcatggtgactggggtct

SEQ ID NO: 218580 - DNA, 28 bp, Artificial Sequence
  Description of Artificial Sequence: Synthetic oligonucleotide
cactgtcgtcatggtgactggggtcttg

SEQ ID NO: 218581 - DNA, 28 bp, Artificial Sequence
  Description of Artificial Sequence: Synthetic oligonucleotide
actgtcgtcatggtgactggggtcttgg

SEQ ID NO: 218582 - DNA, 27 bp, Artificial Sequence
  Description of Artificial Sequence: Synthetic oligonucleotide
ctgtcgtcatggtgactggggtcttgg

SEQ ID NO: 218583 - DNA, 27 bp, Artificial Sequence
  Description of Artificial Sequence: Synthetic oligonucleotide
tgtcgtcatggtgactggggtcttggg

SEQ ID NO: 218584 - DNA, 26 bp, Artificial Sequence
  Description of Artificial Sequence: Synthetic oligonucleotide
gtcgtcatggtgactggggtcttggg

SEQ ID NO: 218585 - DNA, 27 bp, Artificial Sequence
  Description of Artificial Sequence: Synthetic oligonucleotide
tcgtcatggtgactggggtcttgggct

SEQ ID NO: 218586 - DNA, 26 bp, Artificial Sequence
  Description of Artificial Sequence: Synthetic oligonucleotide
cgtcatggtgactggggtcttgggct

SEQ ID NO: 218587 - DNA, 26 bp, Artificial Sequence
  Description of Artificial Sequence: Synthetic oligonucleotide
gtcatggtgactggggtcttgggctg

SEQ ID NO: 218588 - DNA, 27 bp, Artificial Sequence
  Description of Artificial Sequence: Synthetic oligonucleotide
tcatggtgactggggtcttgggctgct

SEQ ID NO: 218589 - DNA, 26 bp, Artificial Sequence
  Description of Artificial Sequence: Synthetic oligonucleotide
catggtgactggggtcttgggctgct

SEQ ID NO: 218590 - DNA, 26 bp, Artificial Sequence
  Description of Artificial Sequence: Synthetic oligonucleotide
atggtgactggggtcttgggctgctg

SEQ ID NO: 218591 - DNA, 25 bp, Artificial Sequence
  Description of Artificial Sequence: Synthetic oligonucleotide
tggtgactggggtcttgggctgctg

SEQ ID NO: 218592 - DNA, 24 bp, Artificial Sequence
  Description of Artificial Sequence: Synthetic oligonucleotide
ggtgactggggtcttgggctgctg

SEQ ID NO: 218593 - DNA, 24 bp, Artificial Sequence
  Description of Artificial Sequence: Synthetic oligonucleotide
gtgactggggtcttgggctgctgc

SEQ ID NO: 218594 - DNA, 24 bp, Artificial Sequence
  Description of Artificial Sequence: Synthetic oligonucleotide
tgactggggtcttgggctgctgcg

SEQ ID NO: 218595 - DNA, 23 bp, Artificial Sequence
  Description of Artificial Sequence: Synthetic oligonucleotide
gactggggtcttgggctgctgcg

SEQ ID NO: 218596 - DNA, 23 bp, Artificial Sequence
  Description of Artificial Sequence: Synthetic oligonucleotide
actggggtcttgggctgctgcgc

SEQ ID NO: 218597 - DNA, 22 bp, Artificial Sequence
  Description of Artificial Sequence: Synthetic oligonucleotide
ctggggtcttgggctgctgcgc

SEQ ID NO: 218598 - DNA, 23 bp, Artificial Sequence
  Description of Artificial Sequence: Synthetic oligonucleotide
tggggtcttgggctgctgcgcca

SEQ ID NO: 218599 - DNA, 22 bp, Artificial Sequence
  Description of Artificial Sequence: Synthetic oligonucleotide
ggggtcttgggctgctgcgcca

SEQ ID NO: 218600 - DNA, 22 bp, Artificial Sequence
  Description of Artificial Sequence: Synthetic oligonucleotide
gggtcttgggctgctgcgccac

SEQ ID NO: 218601 - DNA, 24 bp, Artificial Sequence
  Description of Artificial Sequence: Synthetic oligonucleotide
ggtcttgggctgctgcgccacctt

SEQ ID NO: 218602 - DNA, 26 bp, Artificial Sequence
  Description of Artificial Sequence: Synthetic oligonucleotide
gtcttgggctgctgcgccaccttcaa

SEQ ID NO: 218603 - DNA, 26 bp, Artificial Sequence
  Description of Artificial Sequence: Synthetic oligonucleotide
tcttgggctgctgcgccaccttcaag

SEQ ID NO: 218604 - DNA, 25 bp, Artificial Sequence
  Description of Artificial Sequence: Synthetic oligonucleotide
cttgggctgctgcgccaccttcaag

SEQ ID NO: 218605 - DNA, 26 bp, Artificial Sequence
  Description of Artificial Sequence: Synthetic oligonucleotide
ttgggctgctgcgccaccttcaagga

SEQ ID NO: 218606 - DNA, 25 bp, Artificial Sequence
  Description of Artificial Sequence: Synthetic oligonucleotide
tgggctgctgcgccaccttcaagga

SEQ ID NO: 218607 - DNA, 24 bp, Artificial Sequence
  Description of Artificial Sequence: Synthetic oligonucleotide
gggctgctgcgccaccttcaagga

SEQ ID NO: 218608 - DNA, 24 bp, Artificial Sequence
  Description of Artificial Sequence: Synthetic oligonucleotide
ggctgctgcgccaccttcaaggag

SEQ ID NO: 218609 - DNA, 24 bp, Artificial Sequence
  Description of Artificial Sequence: Synthetic oligonucleotide
gctgctgcgccaccttcaaggagc

SEQ ID NO: 218610 - DNA, 25 bp, Artificial Sequence
  Description of Artificial Sequence: Synthetic oligonucleotide
ctgctgcgccaccttcaaggagcgt

SEQ ID NO: 218611 - DNA, 25 bp, Artificial Sequence
  Description of Artificial Sequence: Synthetic oligonucleotide
tgctgcgccaccttcaaggagcgtc

SEQ ID NO: 218612 - DNA, 24 bp, Artificial Sequence
  Description of Artificial Sequence: Synthetic oligonucleotide
gctgcgccaccttcaaggagcgtc

SEQ ID NO: 218613 - DNA, 24 bp, Artificial Sequence
  Description of Artificial Sequence: Synthetic oligonucleotide
ctgcgccaccttcaaggagcgtcg

SEQ ID NO: 218614 - DNA, 26 bp, Artificial Sequence
  Description of Artificial Sequence: Synthetic oligonucleotide
tgcgccaccttcaaggagcgtcggaa

SEQ ID NO: 218615 - DNA, 25 bp, Artificial Sequence
  Description of Artificial Sequence: Synthetic oligonucleotide
gcgccaccttcaaggagcgtcggaa

SEQ ID NO: 218616 - DNA, 25 bp, Artificial Sequence
  Description of Artificial Sequence: Synthetic oligonucleotide
cgccaccttcaaggagcgtcggaac

SEQ ID NO: 218617 - DNA, 26 bp, Artificial Sequence
  Description of Artificial Sequence: Synthetic oligonucleotide
gccaccttcaaggagcgtcggaacct

SEQ ID NO: 218618 - DNA, 26 bp, Artificial Sequence
  Description of Artificial Sequence: Synthetic oligonucleotide
ccaccttcaaggagcgtcggaacctg

SEQ ID NO: 218619 - DNA, 27 bp, Artificial Sequence
  Description of Artificial Sequence: Synthetic oligonucleotide
caccttcaaggagcgtcggaacctgct

SEQ ID NO: 218620 - DNA, 27 bp, Artificial Sequence
  Description of Artificial Sequence: Synthetic oligonucleotide
accttcaaggagcgtcggaacctgctg

SEQ ID NO: 218621 - DNA, 26 bp, Artificial Sequence
  Description of Artificial Sequence: Synthetic oligonucleotide
ccttcaaggagcgtcggaacctgctg

SEQ ID NO: 218622 - DNA, 26 bp, Artificial Sequence
  Description of Artificial Sequence: Synthetic oligonucleotide
cttcaaggagcgtcggaacctgctgc

SEQ ID NO: 218623 - DNA, 26 bp, Artificial Sequence
  Description of Artificial Sequence: Synthetic oligonucleotide
ttcaaggagcgtcggaacctgctgcg

SEQ ID NO: 218624 - DNA, 25 bp, Artificial Sequence
  Description of Artificial Sequence: Synthetic oligonucleotide
tcaaggagcgtcggaacctgctgcg

SEQ ID NO: 218625 - DNA, 24 bp, Artificial Sequence
  Description of Artificial Sequence: Synthetic oligonucleotide
caaggagcgtcggaacctgctgcg

SEQ ID NO: 218626 - DNA, 24 bp, Artificial Sequence
  Description of Artificial Sequence: Synthetic oligonucleotide
aaggagcgtcggaacctgctgcgc

SEQ ID NO: 218627 - DNA, 23 bp, Artificial Sequence
  Description of Artificial Sequence: Synthetic oligonucleotide
aggagcgtcggaacctgctgcgc

SEQ ID NO: 218628 - DNA, 22 bp, Artificial Sequence
  Description of Artificial Sequence: Synthetic oligonucleotide
ggagcgtcggaacctgctgcgc

SEQ ID NO: 218629 - DNA, 23 bp, Artificial Sequence
  Description of Artificial Sequence: Synthetic oligonucleotide
gagcgtcggaacctgctgcgcct

SEQ ID NO: 218630 - DNA, 25 bp, Artificial Sequence
  Description of Artificial Sequence: Synthetic oligonucleotide
agcgtcggaacctgctgcgcctgta

SEQ ID NO: 218631 - DNA, 24 bp, Artificial Sequence
  Description of Artificial Sequence: Synthetic oligonucleotide
gcgtcggaacctgctgcgcctgta

SEQ ID NO: 218632 - DNA, 26 bp, Artificial Sequence
  Description of Artificial Sequence: Synthetic oligonucleotide
cgtcggaacctgctgcgcctgtactt

SEQ ID NO: 218633 - DNA, 27 bp, Artificial Sequence
  Description of Artificial Sequence: Synthetic oligonucleotide
gtcggaacctgctgcgcctgtacttca

SEQ ID NO: 218634 - DNA, 28 bp, Artificial Sequence
  Description of Artificial Sequence: Synthetic oligonucleotide
tcggaacctgctgcgcctgtacttcatc

SEQ ID NO: 218635 - DNA, 27 bp, Artificial Sequence
  Description of Artificial Sequence: Synthetic oligonucleotide
cggaacctgctgcgcctgtacttcatc

SEQ ID NO: 218636 - DNA, 27 bp, Artificial Sequence
  Description of Artificial Sequence: Synthetic oligonucleotide
ggaacctgctgcgcctgtacttcatcc

SEQ ID NO: 218637 - DNA, 28 bp, Artificial Sequence
  Description of Artificial Sequence: Synthetic oligonucleotide
gaacctgctgcgcctgtacttcatcctg

SEQ ID NO: 218638 - DNA, 28 bp, Artificial Sequence
  Description of Artificial Sequence: Synthetic oligonucleotide
aacctgctgcgcctgtacttcatcctgc

SEQ ID NO: 218639 - DNA, 27 bp, Artificial Sequence
  Description of Artificial Sequence: Synthetic oligonucleotide
acctgctgcgcctgtacttcatcctgc

SEQ ID NO: 218640 - DNA, 27 bp, Artificial Sequence
  Description of Artificial Sequence: Synthetic oligonucleotide
cctgctgcgcctgtacttcatcctgct

SEQ ID NO: 218641 - DNA, 27 bp, Artificial Sequence
  Description of Artificial Sequence: Synthetic oligonucleotide
ctgctgcgcctgtacttcatcctgctc

SEQ ID NO: 218642 - DNA, 27 bp, Artificial Sequence
  Description of Artificial Sequence: Synthetic oligonucleotide
tgctgcgcctgtacttcatcctgctcc

SEQ ID NO: 218643 - DNA, 27 bp, Artificial Sequence
  Description of Artificial Sequence: Synthetic oligonucleotide
gctgcgcctgtacttcatcctgctcct

SEQ ID NO: 218644 - DNA, 27 bp, Artificial Sequence
  Description of Artificial Sequence: Synthetic oligonucleotide
ctgcgcctgtacttcatcctgctcctc

SEQ ID NO: 218645 - DNA, 29 bp, Artificial Sequence
  Description of Artificial Sequence: Synthetic oligonucleotide
tgcgcctgtacttcatcctgctcctcatc

SEQ ID NO: 218646 - DNA, 28 bp, Artificial Sequence
  Description of Artificial Sequence: Synthetic oligonucleotide
gcgcctgtacttcatcctgctcctcatc

SEQ ID NO: 218647 - DNA, 30 bp, Artificial Sequence
  Description of Artificial Sequence: Synthetic oligonucleotide
cgcctgtacttcatcctgctcctcatcatc

SEQ ID NO: 218648 - DNA, 33 bp, Artificial Sequence
  Description of Artificial Sequence: Synthetic oligonucleotide
gcctgtacttcatcctgctcctcatcatctttc

SEQ ID NO: 218649 - DNA, 34 bp, Artificial Sequence
  Description of Artificial Sequence: Synthetic oligonucleotide
cctgtacttcatcctgctcctcatcatctttctg

SEQ ID NO: 218650 - DNA, 34 bp, Artificial Sequence
  Description of Artificial Sequence: Synthetic oligonucleotide
ctgtacttcatcctgctcctcatcatctttctgc

SEQ ID NO: 218651 - DNA, 35 bp, Artificial Sequence
  Description of Artificial Sequence: Synthetic oligonucleotide
tgtacttcatcctgctcctcatcatctttctgctg

SEQ ID NO: 218652 - DNA, 34 bp, Artificial Sequence
  Description of Artificial Sequence: Synthetic oligonucleotide
gtacttcatcctgctcctcatcatctttctgctg

SEQ ID NO: 218653 - DNA, 34 bp, Artificial Sequence
  Description of Artificial Sequence: Synthetic oligonucleotide
tacttcatcctgctcctcatcatctttctgctgg

SEQ ID NO: 218654 - DNA, 33 bp, Artificial Sequence
  Description of Artificial Sequence: Synthetic oligonucleotide
acttcatcctgctcctcatcatctttctgctgg

SEQ ID NO: 218655 - DNA, 32 bp, Artificial Sequence
  Description of Artificial Sequence: Synthetic oligonucleotide
cttcatcctgctcctcatcatctttctgctgg

SEQ ID NO: 218656 - DNA, 33 bp, Artificial Sequence
  Description of Artificial Sequence: Synthetic oligonucleotide
ttcatcctgctcctcatcatctttctgctggag

SEQ ID NO: 218657 - DNA, 32 bp, Artificial Sequence
  Description of Artificial Sequence: Synthetic oligonucleotide
tcatcctgctcctcatcatctttctgctggag

SEQ ID NO: 218658 - DNA, 31 bp, Artificial Sequence
  Description of Artificial Sequence: Synthetic oligonucleotide
catcctgctcctcatcatctttctgctggag

SEQ ID NO: 218659 - DNA, 33 bp, Artificial Sequence
  Description of Artificial Sequence: Synthetic oligonucleotide
atcctgctcctcatcatctttctgctggagatc

SEQ ID NO: 218660 - DNA, 32 bp, Artificial Sequence
  Description of Artificial Sequence: Synthetic oligonucleotide
tcctgctcctcatcatctttctgctggagatc

SEQ ID NO: 218661 - DNA, 31 bp, Artificial Sequence
  Description of Artificial Sequence: Synthetic oligonucleotide
cctgctcctcatcatctttctgctggagatc

SEQ ID NO: 218662 - DNA, 33 bp, Artificial Sequence
  Description of Artificial Sequence: Synthetic oligonucleotide
ctgctcctcatcatctttctgctggagatcatc

SEQ ID NO: 218663 - DNA, 33 bp, Artificial Sequence
  Description of Artificial Sequence: Synthetic oligonucleotide
tgctcctcatcatctttctgctggagatcatcg

SEQ ID NO: 218664 - DNA, 32 bp, Artificial Sequence
  Description of Artificial Sequence: Synthetic oligonucleotide
gctcctcatcatctttctgctggagatcatcg

SEQ ID NO: 218665 - DNA, 32 bp, Artificial Sequence
  Description of Artificial Sequence: Synthetic oligonucleotide
ctcctcatcatctttctgctggagatcatcgc

SEQ ID NO: 218666 - DNA, 33 bp, Artificial Sequence
  Description of Artificial Sequence: Synthetic oligonucleotide
tcctcatcatctttctgctggagatcatcgctg

SEQ ID NO: 218667 - DNA, 32 bp, Artificial Sequence
  Description of Artificial Sequence: Synthetic oligonucleotide
cctcatcatctttctgctggagatcatcgctg

SEQ ID NO: 218668 - DNA, 32 bp, Artificial Sequence
  Description of Artificial Sequence: Synthetic oligonucleotide
ctcatcatctttctgctggagatcatcgctgg

SEQ ID NO: 218669 - DNA, 35 bp, Artificial Sequence
  Description of Artificial Sequence: Synthetic oligonucleotide
tcatcatctttctgctggagatcatcgctggtatc

SEQ ID NO: 218670 - DNA, 34 bp, Artificial Sequence
  Description of Artificial Sequence: Synthetic oligonucleotide
catcatctttctgctggagatcatcgctggtatc

SEQ ID NO: 218671 - DNA, 34 bp, Artificial Sequence
  Description of Artificial Sequence: Synthetic oligonucleotide
atcatctttctgctggagatcatcgctggtatcc

SEQ ID NO: 218672 - DNA, 33 bp, Artificial Sequence
  Description of Artificial Sequence: Synthetic oligonucleotide
tcatctttctgctggagatcatcgctggtatcc

SEQ ID NO: 218673 - DNA, 32 bp, Artificial Sequence
  Description of Artificial Sequence: Synthetic oligonucleotide
catctttctgctggagatcatcgctggtatcc

SEQ ID NO: 218674 - DNA, 33 bp, Artificial Sequence
  Description of Artificial Sequence: Synthetic oligonucleotide
atctttctgctggagatcatcgctggtatcctc

SEQ ID NO: 218675 - DNA, 32 bp, Artificial Sequence
  Description of Artificial Sequence: Synthetic oligonucleotide
tctttctgctggagatcatcgctggtatcctc

SEQ ID NO: 218676 - DNA, 31 bp, Artificial Sequence
  Description of Artificial Sequence: Synthetic oligonucleotide
ctttctgctggagatcatcgctggtatcctc

SEQ ID NO: 218677 - DNA, 31 bp, Artificial Sequence
  Description of Artificial Sequence: Synthetic oligonucleotide
tttctgctggagatcatcgctggtatcctcg

SEQ ID NO: 218678 - DNA, 30 bp, Artificial Sequence
  Description of Artificial Sequence: Synthetic oligonucleotide
ttctgctggagatcatcgctggtatcctcg

SEQ ID NO: 218679 - DNA, 29 bp, Artificial Sequence
  Description of Artificial Sequence: Synthetic oligonucleotide
tctgctggagatcatcgctggtatcctcg

SEQ ID NO: 218680 - DNA, 28 bp, Artificial Sequence
  Description of Artificial Sequence: Synthetic oligonucleotide
ctgctggagatcatcgctggtatcctcg

SEQ ID NO: 218681 - DNA, 28 bp, Artificial Sequence
  Description of Artificial Sequence: Synthetic oligonucleotide
tgctggagatcatcgctggtatcctcgc

SEQ ID NO: 218682 - DNA, 27 bp, Artificial Sequence
  Description of Artificial Sequence: Synthetic oligonucleotide
gctggagatcatcgctggtatcctcgc

SEQ ID NO: 218683 - DNA, 27 bp, Artificial Sequence
  Description of Artificial Sequence: Synthetic oligonucleotide
ctggagatcatcgctggtatcctcgcc

SEQ ID NO: 218684 - DNA, 29 bp, Artificial Sequence
  Description of Artificial Sequence: Synthetic oligonucleotide
tggagatcatcgctggtatcctcgcctac

SEQ ID NO: 218685 - DNA, 28 bp, Artificial Sequence
  Description of Artificial Sequence: Synthetic oligonucleotide
ggagatcatcgctggtatcctcgcctac

SEQ ID NO: 218686 - DNA, 28 bp, Artificial Sequence
  Description of Artificial Sequence: Synthetic oligonucleotide
gagatcatcgctggtatcctcgcctacg

SEQ ID NO: 218687 - DNA, 28 bp, Artificial Sequence
  Description of Artificial Sequence: Synthetic oligonucleotide
agatcatcgctggtatcctcgcctacgc

SEQ ID NO: 218688 - DNA, 27 bp, Artificial Sequence
  Description of Artificial Sequence: Synthetic oligonucleotide
gatcatcgctggtatcctcgcctacgc

SEQ ID NO: 218689 - DNA, 27 bp, Artificial Sequence
  Description of Artificial Sequence: Synthetic oligonucleotide
atcatcgctggtatcctcgcctacgcc

SEQ ID NO: 218690 - DNA, 27 bp, Artificial Sequence
  Description of Artificial Sequence: Synthetic oligonucleotide
tcatcgctggtatcctcgcctacgcct

SEQ ID NO: 218691 - DNA, 27 bp, Artificial Sequence
  Description of Artificial Sequence: Synthetic oligonucleotide
catcgctggtatcctcgcctacgccta

SEQ ID NO: 218692 - DNA, 27 bp, Artificial Sequence
  Description of Artificial Sequence: Synthetic oligonucleotide
atcgctggtatcctcgcctacgcctac

SEQ ID NO: 218693 - DNA, 27 bp, Artificial Sequence
  Description of Artificial Sequence: Synthetic oligonucleotide
tcgctggtatcctcgcctacgcctact

SEQ ID NO: 218694 - DNA, 27 bp, Artificial Sequence
  Description of Artificial Sequence: Synthetic oligonucleotide
cgctggtatcctcgcctacgcctacta

SEQ ID NO: 218695 - DNA, 27 bp, Artificial Sequence
  Description of Artificial Sequence: Synthetic oligonucleotide
gctggtatcctcgcctacgcctactac

SEQ ID NO: 218696 - DNA, 27 bp, Artificial Sequence
  Description of Artificial Sequence: Synthetic oligonucleotide
ctggtatcctcgcctacgcctactacc

SEQ ID NO: 218697 - DNA, 28 bp, Artificial Sequence
  Description of Artificial Sequence: Synthetic oligonucleotide
tggtatcctcgcctacgcctactaccag

SEQ ID NO: 218698 - DNA, 27 bp, Artificial Sequence
  Description of Artificial Sequence: Synthetic oligonucleotide
ggtatcctcgcctacgcctactaccag

SEQ ID NO: 218699 - DNA, 27 bp, Artificial Sequence
  Description of Artificial Sequence: Synthetic oligonucleotide
gtatcctcgcctacgcctactaccagc

SEQ ID NO: 218700 - DNA, 28 bp, Artificial Sequence
  Description of Artificial Sequence: Synthetic oligonucleotide
tatcctcgcctacgcctactaccagcag

SEQ ID NO: 218701 - DNA, 27 bp, Artificial Sequence
  Description of Artificial Sequence: Synthetic oligonucleotide
atcctcgcctacgcctactaccagcag

SEQ ID NO: 218702 - DNA, 26 bp, Artificial Sequence
  Description of Artificial Sequence: Synthetic oligonucleotide
tcctcgcctacgcctactaccagcag

SEQ ID NO: 218703 - DNA, 25 bp, Artificial Sequence
  Description of Artificial Sequence: Synthetic oligonucleotide
cctcgcctacgcctactaccagcag

SEQ ID NO: 218704 - DNA, 26 bp, Artificial Sequence
  Description of Artificial Sequence: Synthetic oligonucleotide
ctcgcctacgcctactaccagcagct

SEQ ID NO: 218705 - DNA, 27 bp, Artificial Sequence
  Description of Artificial Sequence: Synthetic oligonucleotide
tcgcctacgcctactaccagcagctga

SEQ ID NO: 218706 - DNA, 27 bp, Artificial Sequence
  Description of Artificial Sequence: Synthetic oligonucleotide
cgcctacgcctactaccagcagctgaa

SEQ ID NO: 218707 - DNA, 27 bp, Artificial Sequence
  Description of Artificial Sequence: Synthetic oligonucleotide
gcctacgcctactaccagcagctgaac

SEQ ID NO: 218708 - DNA, 28 bp, Artificial Sequence
  Description of Artificial Sequence: Synthetic oligonucleotide
cctacgcctactaccagcagctgaacac

SEQ ID NO: 218709 - DNA, 28 bp, Artificial Sequence
  Description of Artificial Sequence: Synthetic oligonucleotide
ctacgcctactaccagcagctgaacacg

SEQ ID NO: 218710 - DNA, 28 bp, Artificial Sequence
  Description of Artificial Sequence: Synthetic oligonucleotide
tacgcctactaccagcagctgaacacgg

SEQ ID NO: 218711 - DNA, 27 bp, Artificial Sequence
  Description of Artificial Sequence: Synthetic oligonucleotide
acgcctactaccagcagctgaacacgg

SEQ ID NO: 218712 - DNA, 27 bp, Artificial Sequence
  Description of Artificial Sequence: Synthetic oligonucleotide
cgcctactaccagcagctgaacacgga

SEQ ID NO: 218713 - DNA, 27 bp, Artificial Sequence
  Description of Artificial Sequence: Synthetic oligonucleotide
gcctactaccagcagctgaacacggag

SEQ ID NO: 218714 - DNA, 27 bp, Artificial Sequence
  Description of Artificial Sequence: Synthetic oligonucleotide
cctactaccagcagctgaacacggagc

SEQ ID NO: 218715 - DNA, 28 bp, Artificial Sequence
  Description of Artificial Sequence: Synthetic oligonucleotide
ctactaccagcagctgaacacggagctc

SEQ ID NO: 218716 - DNA, 30 bp, Artificial Sequence
  Description of Artificial Sequence: Synthetic oligonucleotide
tactaccagcagctgaacacggagctcaag

SEQ ID NO: 218717 - DNA, 29 bp, Artificial Sequence
  Description of Artificial Sequence: Synthetic oligonucleotide
actaccagcagctgaacacggagctcaag

SEQ ID NO: 218718 - DNA, 28 bp, Artificial Sequence
  Description of Artificial Sequence: Synthetic oligonucleotide
ctaccagcagctgaacacggagctcaag

SEQ ID NO: 218719 - DNA, 28 bp, Artificial Sequence
  Description of Artificial Sequence: Synthetic oligonucleotide
taccagcagctgaacacggagctcaagg

SEQ ID NO: 218720 - DNA, 27 bp, Artificial Sequence
  Description of Artificial Sequence: Synthetic oligonucleotide
accagcagctgaacacggagctcaagg

SEQ ID NO: 218721 - DNA, 27 bp, Artificial Sequence
  Description of Artificial Sequence: Synthetic oligonucleotide
ccagcagctgaacacggagctcaagga

SEQ ID NO: 218722 - DNA, 27 bp, Artificial Sequence
  Description of Artificial Sequence: Synthetic oligonucleotide
cagcagctgaacacggagctcaaggag

SEQ ID NO: 218723 - DNA, 29 bp, Artificial Sequence
  Description of Artificial Sequence: Synthetic oligonucleotide
agcagctgaacacggagctcaaggagaac

SEQ ID NO: 218724 - DNA, 28 bp, Artificial Sequence
  Description of Artificial Sequence: Synthetic oligonucleotide
gcagctgaacacggagctcaaggagaac

SEQ ID NO: 218725 - DNA, 28 bp, Artificial Sequence
  Description of Artificial Sequence: Synthetic oligonucleotide
cagctgaacacggagctcaaggagaacc

SEQ ID NO: 218726 - DNA, 29 bp, Artificial Sequence
  Description of Artificial Sequence: Synthetic oligonucleotide
agctgaacacggagctcaaggagaacctg

SEQ ID NO: 218727 - DNA, 28 bp, Artificial Sequence
  Description of Artificial Sequence: Synthetic oligonucleotide
gctgaacacggagctcaaggagaacctg

SEQ ID NO: 218728 - DNA, 30 bp, Artificial Sequence
  Description of Artificial Sequence: Synthetic oligonucleotide
ctgaacacggagctcaaggagaacctgaag

SEQ ID NO: 218729 - DNA, 30 bp, Artificial Sequence
  Description of Artificial Sequence: Synthetic oligonucleotide
tgaacacggagctcaaggagaacctgaagg

SEQ ID NO: 218730 - DNA, 29 bp, Artificial Sequence
  Description of Artificial Sequence: Synthetic oligonucleotide
gaacacggagctcaaggagaacctgaagg

SEQ ID NO: 218731 - DNA, 30 bp, Artificial Sequence
  Description of Artificial Sequence: Synthetic oligonucleotide
aacacggagctcaaggagaacctgaaggac

SEQ ID NO: 218732 - DNA, 29 bp, Artificial Sequence
  Description of Artificial Sequence: Synthetic oligonucleotide
acacggagctcaaggagaacctgaaggac

SEQ ID NO: 218733 - DNA, 28 bp, Artificial Sequence
  Description of Artificial Sequence: Synthetic oligonucleotide
cacggagctcaaggagaacctgaaggac

SEQ ID NO: 218734 - DNA, 29 bp, Artificial Sequence
  Description of Artificial Sequence: Synthetic oligonucleotide
acggagctcaaggagaacctgaaggacac

SEQ ID NO: 218735 - DNA, 28 bp, Artificial Sequence
  Description of Artificial Sequence: Synthetic oligonucleotide
cggagctcaaggagaacctgaaggacac

SEQ ID NO: 218736 - DNA, 28 bp, Artificial Sequence
  Description of Artificial Sequence: Synthetic oligonucleotide
ggagctcaaggagaacctgaaggacacc

SEQ ID NO: 218737 - DNA, 30 bp, Artificial Sequence
  Description of Artificial Sequence: Synthetic oligonucleotide
gagctcaaggagaacctgaaggacaccatg

SEQ ID NO: 218738 - DNA, 31 bp, Artificial Sequence
  Description of Artificial Sequence: Synthetic oligonucleotide
agctcaaggagaacctgaaggacaccatgac

SEQ ID NO: 218739 - DNA, 30 bp, Artificial Sequence
  Description of Artificial Sequence: Synthetic oligonucleotide
gctcaaggagaacctgaaggacaccatgac

SEQ ID NO: 218740 - DNA, 30 bp, Artificial Sequence
  Description of Artificial Sequence: Synthetic oligonucleotide
ctcaaggagaacctgaaggacaccatgacc

SEQ ID NO: 218741 - DNA, 32 bp, Artificial Sequence
  Description of Artificial Sequence: Synthetic oligonucleotide
tcaaggagaacctgaaggacaccatgaccaag

SEQ ID NO: 218742 - DNA, 31 bp, Artificial Sequence
  Description of Artificial Sequence: Synthetic oligonucleotide
caaggagaacctgaaggacaccatgaccaag

SEQ ID NO: 218743 - DNA, 31 bp, Artificial Sequence
  Description of Artificial Sequence: Synthetic oligonucleotide
aaggagaacctgaaggacaccatgaccaagc

SEQ ID NO: 218744 - DNA, 30 bp, Artificial Sequence
  Description of Artificial Sequence: Synthetic oligonucleotide
aggagaacctgaaggacaccatgaccaagc

SEQ ID NO: 218745 - DNA, 29 bp, Artificial Sequence
  Description of Artificial Sequence: Synthetic oligonucleotide
ggagaacctgaaggacaccatgaccaagc

SEQ ID NO: 218746 - DNA, 29 bp, Artificial Sequence
  Description of Artificial Sequence: Synthetic oligonucleotide
gagaacctgaaggacaccatgaccaagcg

SEQ ID NO: 218747 - DNA, 29 bp, Artificial Sequence
  Description of Artificial Sequence: Synthetic oligonucleotide
agaacctgaaggacaccatgaccaagcgc

SEQ ID NO: 218748 - DNA, 28 bp, Artificial Sequence
  Description of Artificial Sequence: Synthetic oligonucleotide
gaacctgaaggacaccatgaccaagcgc

SEQ ID NO: 218749 - DNA, 30 bp, Artificial Sequence
  Description of Artificial Sequence: Synthetic oligonucleotide
aacctgaaggacaccatgaccaagcgctac

SEQ ID NO: 218750 - DNA, 29 bp, Artificial Sequence
  Description of Artificial Sequence: Synthetic oligonucleotide
acctgaaggacaccatgaccaagcgctac

SEQ ID NO: 218751 - DNA, 28 bp, Artificial Sequence
  Description of Artificial Sequence: Synthetic oligonucleotide
cctgaaggacaccatgaccaagcgctac

SEQ ID NO: 218752 - DNA, 28 bp, Artificial Sequence
  Description of Artificial Sequence: Synthetic oligonucleotide
ctgaaggacaccatgaccaagcgctacc

SEQ ID NO: 218753 - DNA, 29 bp, Artificial Sequence
  Description of Artificial Sequence: Synthetic oligonucleotide
tgaaggacaccatgaccaagcgctaccac

SEQ ID NO: 218754 - DNA, 28 bp, Artificial Sequence
  Description of Artificial Sequence: Synthetic oligonucleotide
gaaggacaccatgaccaagcgctaccac

SEQ ID NO: 218755 - DNA, 28 bp, Artificial Sequence
  Description of Artificial Sequence: Synthetic oligonucleotide
aaggacaccatgaccaagcgctaccacc

SEQ ID NO: 218756 - DNA, 27 bp, Artificial Sequence
  Description of Artificial Sequence: Synthetic oligonucleotide
aggacaccatgaccaagcgctaccacc

SEQ ID NO: 218757 - DNA, 27 bp, Artificial Sequence
  Description of Artificial Sequence: Synthetic oligonucleotide
ggacaccatgaccaagcgctaccacca

SEQ ID NO: 218758 - DNA, 27 bp, Artificial Sequence
  Description of Artificial Sequence: Synthetic oligonucleotide
gacaccatgaccaagcgctaccaccag

SEQ ID NO: 218759 - DNA, 27 bp, Artificial Sequence
  Description of Artificial Sequence: Synthetic oligonucleotide
acaccatgaccaagcgctaccaccagc

SEQ ID NO: 218760 - DNA, 26 bp, Artificial Sequence
  Description of Artificial Sequence: Synthetic oligonucleotide
caccatgaccaagcgctaccaccagc

SEQ ID NO: 218761 - DNA, 26 bp, Artificial Sequence
  Description of Artificial Sequence: Synthetic oligonucleotide
accatgaccaagcgctaccaccagcc

SEQ ID NO: 218762 - DNA, 25 bp, Artificial Sequence
  Description of Artificial Sequence: Synthetic oligonucleotide
ccatgaccaagcgctaccaccagcc

SEQ ID NO: 218763 - DNA, 25 bp, Artificial Sequence
  Description of Artificial Sequence: Synthetic oligonucleotide
catgaccaagcgctaccaccagccg

SEQ ID NO: 218764 - DNA, 25 bp, Artificial Sequence
  Description of Artificial Sequence: Synthetic oligonucleotide
atgaccaagcgctaccaccagccgg

SEQ ID NO: 218765 - DNA, 24 bp, Artificial Sequence
  Description of Artificial Sequence: Synthetic oligonucleotide
tgaccaagcgctaccaccagccgg

SEQ ID NO: 218766 - DNA, 23 bp, Artificial Sequence
  Description of Artificial Sequence: Synthetic oligonucleotide
gaccaagcgctaccaccagccgg

SEQ ID NO: 218767 - DNA, 23 bp, Artificial Sequence
  Description of Artificial Sequence: Synthetic oligonucleotide
accaagcgctaccaccagccggg

SEQ ID NO: 218768 - DNA, 22 bp, Artificial Sequence
  Description of Artificial Sequence: Synthetic oligonucleotide
ccaagcgctaccaccagccggg

SEQ ID NO: 218769 - DNA, 22 bp, Artificial Sequence
  Description of Artificial Sequence: Synthetic oligonucleotide
caagcgctaccaccagccgggc

SEQ ID NO: 218770 - DNA, 24 bp, Artificial Sequence
  Description of Artificial Sequence: Synthetic oligonucleotide
aagcgctaccaccagccgggccat

SEQ ID NO: 218771 - DNA, 23 bp, Artificial Sequence
  Description of Artificial Sequence: Synthetic oligonucleotide
agcgctaccaccagccgggccat

SEQ ID NO: 218772 - DNA, 22 bp, Artificial Sequence
  Description of Artificial Sequence: Synthetic oligonucleotide
gcgctaccaccagccgggccat

SEQ ID NO: 218773 - DNA, 23 bp, Artificial Sequence
  Description of Artificial Sequence: Synthetic oligonucleotide
cgctaccaccagccgggccatga

SEQ ID NO: 218774 - DNA, 23 bp, Artificial Sequence
  Description of Artificial Sequence: Synthetic oligonucleotide
gctaccaccagccgggccatgag

SEQ ID NO: 218775 - DNA, 23 bp, Artificial Sequence
  Description of Artificial Sequence: Synthetic oligonucleotide
ctaccaccagccgggccatgagg

SEQ ID NO: 218776 - DNA, 24 bp, Artificial Sequence
  Description of Artificial Sequence: Synthetic oligonucleotide
taccaccagccgggccatgaggct

SEQ ID NO: 218777 - DNA, 23 bp, Artificial Sequence
  Description of Artificial Sequence: Synthetic oligonucleotide
accaccagccgggccatgaggct

SEQ ID NO: 218778 - DNA, 22 bp, Artificial Sequence
  Description of Artificial Sequence: Synthetic oligonucleotide
ccaccagccgggccatgaggct

SEQ ID NO: 218779 - DNA, 23 bp, Artificial Sequence
  Description of Artificial Sequence: Synthetic oligonucleotide
caccagccgggccatgaggctgt

SEQ ID NO: 218780 - DNA, 24 bp, Artificial Sequence
  Description of Artificial Sequence: Synthetic oligonucleotide
accagccgggccatgaggctgtga

SEQ ID NO: 218781 - DNA, 23 bp, Artificial Sequence
  Description of Artificial Sequence: Synthetic oligonucleotide
ccagccgggccatgaggctgtga

SEQ ID NO: 218782 - DNA, 23 bp, Artificial Sequence
  Description of Artificial Sequence: Synthetic oligonucleotide
cagccgggccatgaggctgtgac

SEQ ID NO: 218783 - DNA, 24 bp, Artificial Sequence
  Description of Artificial Sequence: Synthetic oligonucleotide
agccgggccatgaggctgtgacca

SEQ ID NO: 218784 - DNA, 23 bp, Artificial Sequence
  Description of Artificial Sequence: Synthetic oligonucleotide
gccgggccatgaggctgtgacca

SEQ ID NO: 218785 - DNA, 23 bp, Artificial Sequence
  Description of Artificial Sequence: Synthetic oligonucleotide
ccgggccatgaggctgtgaccag

SEQ ID NO: 218786 - DNA, 23 bp, Artificial Sequence
  Description of Artificial Sequence: Synthetic oligonucleotide
cgggccatgaggctgtgaccagc

SEQ ID NO: 218787 - DNA, 23 bp, Artificial Sequence
  Description of Artificial Sequence: Synthetic oligonucleotide
gggccatgaggctgtgaccagcg

SEQ ID NO: 218788 - DNA, 24 bp, Artificial Sequence
  Description of Artificial Sequence: Synthetic oligonucleotide
ggccatgaggctgtgaccagcgct

SEQ ID NO: 218789 - DNA, 25 bp, Artificial Sequence
  Description of Artificial Sequence: Synthetic oligonucleotide
gccatgaggctgtgaccagcgctgt

SEQ ID NO: 218790 - DNA, 25 bp, Artificial Sequence
  Description of Artificial Sequence: Synthetic oligonucleotide
ccatgaggctgtgaccagcgctgtg

SEQ ID NO: 218791 - DNA, 26 bp, Artificial Sequence
  Description of Artificial Sequence: Synthetic oligonucleotide
catgaggctgtgaccagcgctgtgga

SEQ ID NO: 218792 - DNA, 26 bp, Artificial Sequence
  Description of Artificial Sequence: Synthetic oligonucleotide
atgaggctgtgaccagcgctgtggac

SEQ ID NO: 218793 - DNA, 25 bp, Artificial Sequence
  Description of Artificial Sequence: Synthetic oligonucleotide
tgaggctgtgaccagcgctgtggac

SEQ ID NO: 218794 - DNA, 24 bp, Artificial Sequence
  Description of Artificial Sequence: Synthetic oligonucleotide
gaggctgtgaccagcgctgtggac

SEQ ID NO: 218795 - DNA, 25 bp, Artificial Sequence
  Description of Artificial Sequence: Synthetic oligonucleotide
aggctgtgaccagcgctgtggacca

SEQ ID NO: 218796 - DNA, 24 bp, Artificial Sequence
  Description of Artificial Sequence: Synthetic oligonucleotide
ggctgtgaccagcgctgtggacca

SEQ ID NO: 218797 - DNA, 24 bp, Artificial Sequence
  Description of Artificial Sequence: Synthetic oligonucleotide
gctgtgaccagcgctgtggaccag

SEQ ID NO: 218798 - DNA, 25 bp, Artificial Sequence
  Description of Artificial Sequence: Synthetic oligonucleotide
ctgtgaccagcgctgtggaccagct

SEQ ID NO: 218799 - DNA, 25 bp, Artificial Sequence
  Description of Artificial Sequence: Synthetic oligonucleotide
tgtgaccagcgctgtggaccagctg

SEQ ID NO: 218800 - DNA, 24 bp, Artificial Sequence
  Description of Artificial Sequence: Synthetic oligonucleotide
gtgaccagcgctgtggaccagctg

SEQ ID NO: 218801 - DNA, 25 bp, Artificial Sequence
  Description of Artificial Sequence: Synthetic oligonucleotide
tgaccagcgctgtggaccagctgca

SEQ ID NO: 218802 - DNA, 24 bp, Artificial Sequence
  Description of Artificial Sequence: Synthetic oligonucleotide
gaccagcgctgtggaccagctgca

SEQ ID NO: 218803 - DNA, 24 bp, Artificial Sequence
  Description of Artificial Sequence: Synthetic oligonucleotide
accagcgctgtggaccagctgcag

SEQ ID NO: 218804 - DNA, 23 bp, Artificial Sequence
  Description of Artificial Sequence: Synthetic oligonucleotide
ccagcgctgtggaccagctgcag

SEQ ID NO: 218805 - DNA, 24 bp, Artificial Sequence
  Description of Artificial Sequence: Synthetic oligonucleotide
cagcgctgtggaccagctgcagca

SEQ ID NO: 218806 - DNA, 24 bp, Artificial Sequence
  Description of Artificial Sequence: Synthetic oligonucleotide
agcgctgtggaccagctgcagcag

SEQ ID NO: 218807 - DNA, 23 bp, Artificial Sequence
  Description of Artificial Sequence: Synthetic oligonucleotide
gcgctgtggaccagctgcagcag

SEQ ID NO: 218808 - DNA, 24 bp, Artificial Sequence
  Description of Artificial Sequence: Synthetic oligonucleotide
cgctgtggaccagctgcagcagga

SEQ ID NO: 218809 - DNA, 26 bp, Artificial Sequence
  Description of Artificial Sequence: Synthetic oligonucleotide
gctgtggaccagctgcagcaggagtt

SEQ ID NO: 218810 - DNA, 26 bp, Artificial Sequence
  Description of Artificial Sequence: Synthetic oligonucleotide
ctgtggaccagctgcagcaggagttc

SEQ ID NO: 218811 - DNA, 27 bp, Artificial Sequence
  Description of Artificial Sequence: Synthetic oligonucleotide
tgtggaccagctgcagcaggagttcca

SEQ ID NO: 218812 - DNA, 26 bp, Artificial Sequence
  Description of Artificial Sequence: Synthetic oligonucleotide
gtggaccagctgcagcaggagttcca

SEQ ID NO: 218813 - DNA, 27 bp, Artificial Sequence
  Description of Artificial Sequence: Synthetic oligonucleotide
tggaccagctgcagcaggagttccact

SEQ ID NO: 218814 - DNA, 26 bp, Artificial Sequence
  Description of Artificial Sequence: Synthetic oligonucleotide
ggaccagctgcagcaggagttccact

SEQ ID NO: 218815 - DNA, 26 bp, Artificial Sequence
  Description of Artificial Sequence: Synthetic oligonucleotide
gaccagctgcagcaggagttccactg

SEQ ID NO: 218816 - DNA, 27 bp, Artificial Sequence
  Description of Artificial Sequence: Synthetic oligonucleotide
accagctgcagcaggagttccactgct

SEQ ID NO: 218817 - DNA, 26 bp, Artificial Sequence
  Description of Artificial Sequence: Synthetic oligonucleotide
ccagctgcagcaggagttccactgct

SEQ ID NO: 218818 - DNA, 27 bp, Artificial Sequence
  Description of Artificial Sequence: Synthetic oligonucleotide
cagctgcagcaggagttccactgctgt

SEQ ID NO: 218819 - DNA, 27 bp, Artificial Sequence
  Description of Artificial Sequence: Synthetic oligonucleotide
agctgcagcaggagttccactgctgtg

SEQ ID NO: 218820 - DNA, 26 bp, Artificial Sequence
  Description of Artificial Sequence: Synthetic oligonucleotide
gctgcagcaggagttccactgctgtg

SEQ ID NO: 218821 - DNA, 26 bp, Artificial Sequence
  Description of Artificial Sequence: Synthetic oligonucleotide
ctgcagcaggagttccactgctgtgg

SEQ ID NO: 218822 - DNA, 27 bp, Artificial Sequence
  Description of Artificial Sequence: Synthetic oligonucleotide
tgcagcaggagttccactgctgtggca

SEQ ID NO: 218823 - DNA, 26 bp, Artificial Sequence
  Description of Artificial Sequence: Synthetic oligonucleotide
gcagcaggagttccactgctgtggca

SEQ ID NO: 218824 - DNA, 26 bp, Artificial Sequence
  Description of Artificial Sequence: Synthetic oligonucleotide
cagcaggagttccactgctgtggcag

SEQ ID NO: 218825 - DNA, 27 bp, Artificial Sequence
  Description of Artificial Sequence: Synthetic oligonucleotide
agcaggagttccactgctgtggcagca

SEQ ID NO: 218826 - DNA, 27 bp, Artificial Sequence
  Description of Artificial Sequence: Synthetic oligonucleotide
gcaggagttccactgctgtggcagcaa

SEQ ID NO: 218827 - DNA, 27 bp, Artificial Sequence
  Description of Artificial Sequence: Synthetic oligonucleotide
caggagttccactgctgtggcagcaac

SEQ ID NO: 218828 - DNA, 29 bp, Artificial Sequence
  Description of Artificial Sequence: Synthetic oligonucleotide
aggagttccactgctgtggcagcaacaac

SEQ ID NO: 218829 - DNA, 28 bp, Artificial Sequence
  Description of Artificial Sequence: Synthetic oligonucleotide
ggagttccactgctgtggcagcaacaac

SEQ ID NO: 218830 - DNA, 29 bp, Artificial Sequence
  Description of Artificial Sequence: Synthetic oligonucleotide
gagttccactgctgtggcagcaacaactc

SEQ ID NO: 218831 - DNA, 30 bp, Artificial Sequence
  Description of Artificial Sequence: Synthetic oligonucleotide
agttccactgctgtggcagcaacaactcac

SEQ ID NO: 218832 - DNA, 29 bp, Artificial Sequence
  Description of Artificial Sequence: Synthetic oligonucleotide
gttccactgctgtggcagcaacaactcac

SEQ ID NO: 218833 - DNA, 30 bp, Artificial Sequence
  Description of Artificial Sequence: Synthetic oligonucleotide
ttccactgctgtggcagcaacaactcacag

SEQ ID NO: 218834 - DNA, 29 bp, Artificial Sequence
  Description of Artificial Sequence: Synthetic oligonucleotide
tccactgctgtggcagcaacaactcacag

SEQ ID NO: 218835 - DNA, 28 bp, Artificial Sequence
  Description of Artificial Sequence: Synthetic oligonucleotide
ccactgctgtggcagcaacaactcacag

SEQ ID NO: 218836 - DNA, 28 bp, Artificial Sequence
  Description of Artificial Sequence: Synthetic oligonucleotide
cactgctgtggcagcaacaactcacagg

SEQ ID NO: 218837 - DNA, 29 bp, Artificial Sequence
  Description of Artificial Sequence: Synthetic oligonucleotide
actgctgtggcagcaacaactcacaggac

SEQ ID NO: 218838 - DNA, 28 bp, Artificial Sequence
  Description of Artificial Sequence: Synthetic oligonucleotide
ctgctgtggcagcaacaactcacaggac

SEQ ID NO: 218839 - DNA, 29 bp, Artificial Sequence
  Description of Artificial Sequence: Synthetic oligonucleotide
tgctgtggcagcaacaactcacaggactg

SEQ ID NO: 218840 - DNA, 28 bp, Artificial Sequence
  Description of Artificial Sequence: Synthetic oligonucleotide
gctgtggcagcaacaactcacaggactg

SEQ ID NO: 218841 - DNA, 28 bp, Artificial Sequence
  Description of Artificial Sequence: Synthetic oligonucleotide
ctgtggcagcaacaactcacaggactgg

SEQ ID NO: 218842 - DNA, 28 bp, Artificial Sequence
  Description of Artificial Sequence: Synthetic oligonucleotide
tgtggcagcaacaactcacaggactggc

SEQ ID NO: 218843 - DNA, 27 bp, Artificial Sequence
  Description of Artificial Sequence: Synthetic oligonucleotide
gtggcagcaacaactcacaggactggc

SEQ ID NO: 218844 - DNA, 27 bp, Artificial Sequence
  Description of Artificial Sequence: Synthetic oligonucleotide
tggcagcaacaactcacaggactggcg

SEQ ID NO: 218845 - DNA, 27 bp, Artificial Sequence
  Description of Artificial Sequence: Synthetic oligonucleotide
ggcagcaacaactcacaggactggcga

SEQ ID NO: 218846 - DNA, 27 bp, Artificial Sequence
  Description of Artificial Sequence: Synthetic oligonucleotide
gcagcaacaactcacaggactggcgag

SEQ ID NO: 218847 - DNA, 28 bp, Artificial Sequence
  Description of Artificial Sequence: Synthetic oligonucleotide
cagcaacaactcacaggactggcgagac

SEQ ID NO: 218848 - DNA, 29 bp, Artificial Sequence
  Description of Artificial Sequence: Synthetic oligonucleotide
agcaacaactcacaggactggcgagacag

SEQ ID NO: 218849 - DNA, 28 bp, Artificial Sequence
  Description of Artificial Sequence: Synthetic oligonucleotide
gcaacaactcacaggactggcgagacag

SEQ ID NO: 218850 - DNA, 29 bp, Artificial Sequence
  Description of Artificial Sequence: Synthetic oligonucleotide
caacaactcacaggactggcgagacagtg

SEQ ID NO: 218851 - DNA, 30 bp, Artificial Sequence
  Description of Artificial Sequence: Synthetic oligonucleotide
aacaactcacaggactggcgagacagtgag

SEQ ID NO: 218852 - DNA, 29 bp, Artificial Sequence
  Description of Artificial Sequence: Synthetic oligonucleotide
acaactcacaggactggcgagacagtgag

SEQ ID NO: 218853 - DNA, 28 bp, Artificial Sequence
  Description of Artificial Sequence: Synthetic oligonucleotide
caactcacaggactggcgagacagtgag

SEQ ID NO: 218854 - DNA, 29 bp, Artificial Sequence
  Description of Artificial Sequence: Synthetic oligonucleotide
aactcacaggactggcgagacagtgagtg

SEQ ID NO: 218855 - DNA, 28 bp, Artificial Sequence
  Description of Artificial Sequence: Synthetic oligonucleotide
actcacaggactggcgagacagtgagtg

SEQ ID NO: 218856 - DNA, 27 bp, Artificial Sequence
  Description of Artificial Sequence: Synthetic oligonucleotide
ctcacaggactggcgagacagtgagtg

SEQ ID NO: 218857 - DNA, 27 bp, Artificial Sequence
  Description of Artificial Sequence: Synthetic oligonucleotide
tcacaggactggcgagacagtgagtgg

SEQ ID NO: 218858 - DNA, 27 bp, Artificial Sequence
  Description of Artificial Sequence: Synthetic oligonucleotide
cacaggactggcgagacagtgagtgga

SEQ ID NO: 218859 - DNA, 28 bp, Artificial Sequence
  Description of Artificial Sequence: Synthetic oligonucleotide
acaggactggcgagacagtgagtggatc

SEQ ID NO: 218860 - DNA, 27 bp, Artificial Sequence
  Description of Artificial Sequence: Synthetic oligonucleotide
caggactggcgagacagtgagtggatc

SEQ ID NO: 218861 - DNA, 27 bp, Artificial Sequence
  Description of Artificial Sequence: Synthetic oligonucleotide
aggactggcgagacagtgagtggatcc

SEQ ID NO: 218862 - DNA, 26 bp, Artificial Sequence
  Description of Artificial Sequence: Synthetic oligonucleotide
ggactggcgagacagtgagtggatcc

SEQ ID NO: 218863 - DNA, 26 bp, Artificial Sequence
  Description of Artificial Sequence: Synthetic oligonucleotide
gactggcgagacagtgagtggatccg

SEQ ID NO: 218864 - DNA, 27 bp, Artificial Sequence
  Description of Artificial Sequence: Synthetic oligonucleotide
actggcgagacagtgagtggatccgct

SEQ ID NO: 218865 - DNA, 26 bp, Artificial Sequence
  Description of Artificial Sequence: Synthetic oligonucleotide
ctggcgagacagtgagtggatccgct

SEQ ID NO: 218866 - DNA, 27 bp, Artificial Sequence
  Description of Artificial Sequence: Synthetic oligonucleotide
tggcgagacagtgagtggatccgctca

SEQ ID NO: 218867 - DNA, 26 bp, Artificial Sequence
  Description of Artificial Sequence: Synthetic oligonucleotide
ggcgagacagtgagtggatccgctca

SEQ ID NO: 218868 - DNA, 27 bp, Artificial Sequence
  Description of Artificial Sequence: Synthetic oligonucleotide
gcgagacagtgagtggatccgctcaca

SEQ ID NO: 218869 - DNA, 27 bp, Artificial Sequence
  Description of Artificial Sequence: Synthetic oligonucleotide
cgagacagtgagtggatccgctcacag

SEQ ID NO: 218870 - DNA, 27 bp, Artificial Sequence
  Description of Artificial Sequence: Synthetic oligonucleotide
gagacagtgagtggatccgctcacagg

SEQ ID NO: 218871 - DNA, 28 bp, Artificial Sequence
  Description of Artificial Sequence: Synthetic oligonucleotide
agacagtgagtggatccgctcacaggag

SEQ ID NO: 218872 - DNA, 27 bp, Artificial Sequence
  Description of Artificial Sequence: Synthetic oligonucleotide
gacagtgagtggatccgctcacaggag

SEQ ID NO: 218873 - DNA, 27 bp, Artificial Sequence
  Description of Artificial Sequence: Synthetic oligonucleotide
acagtgagtggatccgctcacaggagg

SEQ ID NO: 218874 - DNA, 26 bp, Artificial Sequence
  Description of Artificial Sequence: Synthetic oligonucleotide
cagtgagtggatccgctcacaggagg

SEQ ID NO: 218875 - DNA, 26 bp, Artificial Sequence
  Description of Artificial Sequence: Synthetic oligonucleotide
agtgagtggatccgctcacaggaggc

SEQ ID NO: 218876 - DNA, 25 bp, Artificial Sequence
  Description of Artificial Sequence: Synthetic oligonucleotide
gtgagtggatccgctcacaggaggc

SEQ ID NO: 218877 - DNA, 25 bp, Artificial Sequence
  Description of Artificial Sequence: Synthetic oligonucleotide
tgagtggatccgctcacaggaggcc

SEQ ID NO: 218878 - DNA, 24 bp, Artificial Sequence
  Description of Artificial Sequence: Synthetic oligonucleotide
gagtggatccgctcacaggaggcc

SEQ ID NO: 218879 - DNA, 24 bp, Artificial Sequence
  Description of Artificial Sequence: Synthetic oligonucleotide
agtggatccgctcacaggaggccg

SEQ ID NO: 218880 - DNA, 23 bp, Artificial Sequence
  Description of Artificial Sequence: Synthetic oligonucleotide
gtggatccgctcacaggaggccg

SEQ ID NO: 218881 - DNA, 24 bp, Artificial Sequence
  Description of Artificial Sequence: Synthetic oligonucleotide
tggatccgctcacaggaggccggt

SEQ ID NO: 218882 - DNA, 23 bp, Artificial Sequence
  Description of Artificial Sequence: Synthetic oligonucleotide
ggatccgctcacaggaggccggt

SEQ ID NO: 218883 - DNA, 23 bp, Artificial Sequence
  Description of Artificial Sequence: Synthetic oligonucleotide
gatccgctcacaggaggccggtg

SEQ ID NO: 218884 - DNA, 23 bp, Artificial Sequence
  Description of Artificial Sequence: Synthetic oligonucleotide
atccgctcacaggaggccggtgg

SEQ ID NO: 218885 - DNA, 22 bp, Artificial Sequence
  Description of Artificial Sequence: Synthetic oligonucleotide
tccgctcacaggaggccggtgg

SEQ ID NO: 218886 - DNA, 21 bp, Artificial Sequence
  Description of Artificial Sequence: Synthetic oligonucleotide
ccgctcacaggaggccggtgg

SEQ ID NO: 218887 - DNA, 21 bp, Artificial Sequence
  Description of Artificial Sequence: Synthetic oligonucleotide
cgctcacaggaggccggtggc

SEQ ID NO: 218888 - DNA, 21 bp, Artificial Sequence
  Description of Artificial Sequence: Synthetic oligonucleotide
gctcacaggaggccggtggcc

SEQ ID NO: 218889 - DNA, 22 bp, Artificial Sequence
  Description of Artificial Sequence: Synthetic oligonucleotide
ctcacaggaggccggtggccgt

SEQ ID NO: 218890 - DNA, 23 bp, Artificial Sequence
  Description of Artificial Sequence: Synthetic oligonucleotide
tcacaggaggccggtggccgtgt

SEQ ID NO: 218891 - DNA, 22 bp, Artificial Sequence
  Description of Artificial Sequence: Synthetic oligonucleotide
cacaggaggccggtggccgtgt

SEQ ID NO: 218892 - DNA, 22 bp, Artificial Sequence
  Description of Artificial Sequence: Synthetic oligonucleotide
acaggaggccggtggccgtgtg

SEQ ID NO: 218893 - DNA, 21 bp, Artificial Sequence
  Description of Artificial Sequence: Synthetic oligonucleotide
caggaggccggtggccgtgtg

SEQ ID NO: 218894 - DNA, 22 bp, Artificial Sequence
  Description of Artificial Sequence: Synthetic oligonucleotide
aggaggccggtggccgtgtggt

SEQ ID NO: 218895 - DNA, 21 bp, Artificial Sequence
  Description of Artificial Sequence: Synthetic oligonucleotide
ggaggccggtggccgtgtggt

SEQ ID NO: 218896 - DNA, 21 bp, Artificial Sequence
  Description of Artificial Sequence: Synthetic oligonucleotide
gaggccggtggccgtgtggtc

SEQ ID NO: 218897 - DNA, 21 bp, Artificial Sequence
  Description of Artificial Sequence: Synthetic oligonucleotide
aggccggtggccgtgtggtcc

SEQ ID NO: 218898 - DNA, 20 bp, Artificial Sequence
  Description of Artificial Sequence: Synthetic oligonucleotide
ggccggtggccgtgtggtcc

SEQ ID NO: 218899 - DNA, 21 bp, Artificial Sequence
  Description of Artificial Sequence: Synthetic oligonucleotide
gccggtggccgtgtggtccca

SEQ ID NO: 218900 - DNA, 22 bp, Artificial Sequence
  Description of Artificial Sequence: Synthetic oligonucleotide
ccggtggccgtgtggtcccaga

SEQ ID NO: 218901 - DNA, 23 bp, Artificial Sequence
  Description of Artificial Sequence: Synthetic oligonucleotide
cggtggccgtgtggtcccagaca

SEQ ID NO: 218902 - DNA, 23 bp, Artificial Sequence
  Description of Artificial Sequence: Synthetic oligonucleotide
ggtggccgtgtggtcccagacag

SEQ ID NO: 218903 - DNA, 24 bp, Artificial Sequence
  Description of Artificial Sequence: Synthetic oligonucleotide
gtggccgtgtggtcccagacagct

SEQ ID NO: 218904 - DNA, 24 bp, Artificial Sequence
  Description of Artificial Sequence: Synthetic oligonucleotide
tggccgtgtggtcccagacagctg

SEQ ID NO: 218905 - DNA, 23 bp, Artificial Sequence
  Description of Artificial Sequence: Synthetic oligonucleotide
ggccgtgtggtcccagacagctg

SEQ ID NO: 218906 - DNA, 24 bp, Artificial Sequence
  Description of Artificial Sequence: Synthetic oligonucleotide
gccgtgtggtcccagacagctgct

SEQ ID NO: 218907 - DNA, 24 bp, Artificial Sequence
  Description of Artificial Sequence: Synthetic oligonucleotide
ccgtgtggtcccagacagctgctg

SEQ ID NO: 218908 - DNA, 26 bp, Artificial Sequence
  Description of Artificial Sequence: Synthetic oligonucleotide
cgtgtggtcccagacagctgctgcaa

SEQ ID NO: 218909 - DNA, 27 bp, Artificial Sequence
  Description of Artificial Sequence: Synthetic oligonucleotide
gtgtggtcccagacagctgctgcaaga

SEQ ID NO: 218910 - DNA, 27 bp, Artificial Sequence
  Description of Artificial Sequence: Synthetic oligonucleotide
tgtggtcccagacagctgctgcaagac

SEQ ID NO: 218911 - DNA, 26 bp, Artificial Sequence
  Description of Artificial Sequence: Synthetic oligonucleotide
gtggtcccagacagctgctgcaagac

SEQ ID NO: 218912 - DNA, 26 bp, Artificial Sequence
  Description of Artificial Sequence: Synthetic oligonucleotide
tggtcccagacagctgctgcaagacg

SEQ ID NO: 218913 - DNA, 25 bp, Artificial Sequence
  Description of Artificial Sequence: Synthetic oligonucleotide
ggtcccagacagctgctgcaagacg

SEQ ID NO: 218914 - DNA, 26 bp, Artificial Sequence
  Description of Artificial Sequence: Synthetic oligonucleotide
gtcccagacagctgctgcaagacggt

SEQ ID NO: 218915 - DNA, 26 bp, Artificial Sequence
  Description of Artificial Sequence: Synthetic oligonucleotide
tcccagacagctgctgcaagacggtg

SEQ ID NO: 218916 - DNA, 25 bp, Artificial Sequence
  Description of Artificial Sequence: Synthetic oligonucleotide
cccagacagctgctgcaagacggtg

SEQ ID NO: 218917 - DNA, 26 bp, Artificial Sequence
  Description of Artificial Sequence: Synthetic oligonucleotide
ccagacagctgctgcaagacggtggt

SEQ ID NO: 218918 - DNA, 26 bp, Artificial Sequence
  Description of Artificial Sequence: Synthetic oligonucleotide
cagacagctgctgcaagacggtggtg

SEQ ID NO: 218919 - DNA, 26 bp, Artificial Sequence
  Description of Artificial Sequence: Synthetic oligonucleotide
agacagctgctgcaagacggtggtgg

SEQ ID NO: 218920 - DNA, 25 bp, Artificial Sequence
  Description of Artificial Sequence: Synthetic oligonucleotide
gacagctgctgcaagacggtggtgg

SEQ ID NO: 218921 - DNA, 26 bp, Artificial Sequence
  Description of Artificial Sequence: Synthetic oligonucleotide
acagctgctgcaagacggtggtggct

SEQ ID NO: 218922 - DNA, 25 bp, Artificial Sequence
  Description of Artificial Sequence: Synthetic oligonucleotide
cagctgctgcaagacggtggtggct

SEQ ID NO: 218923 - DNA, 27 bp, Artificial Sequence
  Description of Artificial Sequence: Synthetic oligonucleotide
agctgctgcaagacggtggtggctctt

SEQ ID NO: 218924 - DNA, 27 bp, Artificial Sequence
  Description of Artificial Sequence: Synthetic oligonucleotide
gctgctgcaagacggtggtggctcttt

SEQ ID NO: 218925 - DNA, 27 bp, Artificial Sequence
  Description of Artificial Sequence: Synthetic oligonucleotide
ctgctgcaagacggtggtggctctttg

SEQ ID NO: 218926 - DNA, 28 bp, Artificial Sequence
  Description of Artificial Sequence: Synthetic oligonucleotide
tgctgcaagacggtggtggctctttgtg

SEQ ID NO: 218927 - DNA, 27 bp, Artificial Sequence
  Description of Artificial Sequence: Synthetic oligonucleotide
gctgcaagacggtggtggctctttgtg

SEQ ID NO: 218928 - DNA, 27 bp, Artificial Sequence
  Description of Artificial Sequence: Synthetic oligonucleotide
ctgcaagacggtggtggctctttgtgg

SEQ ID NO: 218929 - DNA, 27 bp, Artificial Sequence
  Description of Artificial Sequence: Synthetic oligonucleotide
tgcaagacggtggtggctctttgtggg

SEQ ID NO: 218930 - DNA, 26 bp, Artificial Sequence
  Description of Artificial Sequence: Synthetic oligonucleotide
gcaagacggtggtggctctttgtggg

SEQ ID NO: 218931 - DNA, 27 bp, Artificial Sequence
  Description of Artificial Sequence: Synthetic oligonucleotide
caagacggtggtggctctttgtgggca

SEQ ID NO: 218932 - DNA, 27 bp, Artificial Sequence
  Description of Artificial Sequence: Synthetic oligonucleotide
aagacggtggtggctctttgtgggcag

SEQ ID NO: 218933 - DNA, 26 bp, Artificial Sequence
  Description of Artificial Sequence: Synthetic oligonucleotide
agacggtggtggctctttgtgggcag

SEQ ID NO: 218934 - DNA, 25 bp, Artificial Sequence
  Description of Artificial Sequence: Synthetic oligonucleotide
gacggtggtggctctttgtgggcag

SEQ ID NO: 218935 - DNA, 25 bp, Artificial Sequence
  Description of Artificial Sequence: Synthetic oligonucleotide
acggtggtggctctttgtgggcagc

SEQ ID NO: 218936 - DNA, 24 bp, Artificial Sequence
  Description of Artificial Sequence: Synthetic oligonucleotide
cggtggtggctctttgtgggcagc

SEQ ID NO: 218937 - DNA, 25 bp, Artificial Sequence
  Description of Artificial Sequence: Synthetic oligonucleotide
ggtggtggctctttgtgggcagcga

SEQ ID NO: 218938 - DNA, 26 bp, Artificial Sequence
  Description of Artificial Sequence: Synthetic oligonucleotide
gtggtggctctttgtgggcagcgaga

SEQ ID NO: 218939 - DNA, 26 bp, Artificial Sequence
  Description of Artificial Sequence: Synthetic oligonucleotide
tggtggctctttgtgggcagcgagac

SEQ ID NO: 218940 - DNA, 25 bp, Artificial Sequence
  Description of Artificial Sequence: Synthetic oligonucleotide
ggtggctctttgtgggcagcgagac

SEQ ID NO: 218941 - DNA, 27 bp, Artificial Sequence
  Description of Artificial Sequence: Synthetic oligonucleotide
gtggctctttgtgggcagcgagaccat

SEQ ID NO: 218942 - DNA, 27 bp, Artificial Sequence
  Description of Artificial Sequence: Synthetic oligonucleotide
tggctctttgtgggcagcgagaccatg

SEQ ID NO: 218943 - DNA, 26 bp, Artificial Sequence
  Description of Artificial Sequence: Synthetic oligonucleotide
ggctctttgtgggcagcgagaccatg

SEQ ID NO: 218944 - DNA, 26 bp, Artificial Sequence
  Description of Artificial Sequence: Synthetic oligonucleotide
gctctttgtgggcagcgagaccatgc

SEQ ID NO: 218945 - DNA, 27 bp, Artificial Sequence
  Description of Artificial Sequence: Synthetic oligonucleotide
ctctttgtgggcagcgagaccatgcct

SEQ ID NO: 218946 - DNA, 27 bp, Artificial Sequence
  Description of Artificial Sequence: Synthetic oligonucleotide
tctttgtgggcagcgagaccatgcctc

SEQ ID NO: 218947 - DNA, 26 bp, Artificial Sequence
  Description of Artificial Sequence: Synthetic oligonucleotide
ctttgtgggcagcgagaccatgcctc

SEQ ID NO: 218948 - DNA, 27 bp, Artificial Sequence
  Description of Artificial Sequence: Synthetic oligonucleotide
tttgtgggcagcgagaccatgcctcca

SEQ ID NO: 218949 - DNA, 27 bp, Artificial Sequence
  Description of Artificial Sequence: Synthetic oligonucleotide
ttgtgggcagcgagaccatgcctccaa

SEQ ID NO: 218950 - DNA, 26 bp, Artificial Sequence
  Description of Artificial Sequence: Synthetic oligonucleotide
tgtgggcagcgagaccatgcctccaa

SEQ ID NO: 218951 - DNA, 25 bp, Artificial Sequence
  Description of Artificial Sequence: Synthetic oligonucleotide
gtgggcagcgagaccatgcctccaa

SEQ ID NO: 218952 - DNA, 27 bp, Artificial Sequence
  Description of Artificial Sequence: Synthetic oligonucleotide
tgggcagcgagaccatgcctccaacat

SEQ ID NO: 218953 - DNA, 26 bp, Artificial Sequence
  Description of Artificial Sequence: Synthetic oligonucleotide
gggcagcgagaccatgcctccaacat

SEQ ID NO: 218954 - DNA, 27 bp, Artificial Sequence
  Description of Artificial Sequence: Synthetic oligonucleotide
ggcagcgagaccatgcctccaacatct

SEQ ID NO: 218955 - DNA, 28 bp, Artificial Sequence
  Description of Artificial Sequence: Synthetic oligonucleotide
gcagcgagaccatgcctccaacatctac

SEQ ID NO: 218956 - DNA, 30 bp, Artificial Sequence
  Description of Artificial Sequence: Synthetic oligonucleotide
cagcgagaccatgcctccaacatctacaag

SEQ ID NO: 218957 - DNA, 30 bp, Artificial Sequence
  Description of Artificial Sequence: Synthetic oligonucleotide
agcgagaccatgcctccaacatctacaagg

SEQ ID NO: 218958 - DNA, 29 bp, Artificial Sequence
  Description of Artificial Sequence: Synthetic oligonucleotide
gcgagaccatgcctccaacatctacaagg

SEQ ID NO: 218959 - DNA, 30 bp, Artificial Sequence
  Description of Artificial Sequence: Synthetic oligonucleotide
cgagaccatgcctccaacatctacaaggtg

SEQ ID NO: 218960 - DNA, 30 bp, Artificial Sequence
  Description of Artificial Sequence: Synthetic oligonucleotide
gagaccatgcctccaacatctacaaggtgg

SEQ ID NO: 218961 - DNA, 31 bp, Artificial Sequence
  Description of Artificial Sequence: Synthetic oligonucleotide
agaccatgcctccaacatctacaaggtggag

SEQ ID NO: 218962 - DNA, 30 bp, Artificial Sequence
  Description of Artificial Sequence: Synthetic oligonucleotide
gaccatgcctccaacatctacaaggtggag

SEQ ID NO: 218963 - DNA, 30 bp, Artificial Sequence
  Description of Artificial Sequence: Synthetic oligonucleotide
accatgcctccaacatctacaaggtggagg

SEQ ID NO: 218964 - DNA, 29 bp, Artificial Sequence
  Description of Artificial Sequence: Synthetic oligonucleotide
ccatgcctccaacatctacaaggtggagg

SEQ ID NO: 218965 - DNA, 29 bp, Artificial Sequence
  Description of Artificial Sequence: Synthetic oligonucleotide
catgcctccaacatctacaaggtggaggg

SEQ ID NO: 218966 - DNA, 29 bp, Artificial Sequence
  Description of Artificial Sequence: Synthetic oligonucleotide
atgcctccaacatctacaaggtggagggc

SEQ ID NO: 218967 - DNA, 28 bp, Artificial Sequence
  Description of Artificial Sequence: Synthetic oligonucleotide
tgcctccaacatctacaaggtggagggc

SEQ ID NO: 218968 - DNA, 27 bp, Artificial Sequence
  Description of Artificial Sequence: Synthetic oligonucleotide
gcctccaacatctacaaggtggagggc

SEQ ID NO: 218969 - DNA, 27 bp, Artificial Sequence
  Description of Artificial Sequence: Synthetic oligonucleotide
cctccaacatctacaaggtggagggcg

SEQ ID NO: 218970 - DNA, 27 bp, Artificial Sequence
  Description of Artificial Sequence: Synthetic oligonucleotide
ctccaacatctacaaggtggagggcgg

SEQ ID NO: 218971 - DNA, 27 bp, Artificial Sequence
  Description of Artificial Sequence: Synthetic oligonucleotide
tccaacatctacaaggtggagggcggc

SEQ ID NO: 218972 - DNA, 27 bp, Artificial Sequence
  Description of Artificial Sequence: Synthetic oligonucleotide
ccaacatctacaaggtggagggcggct

SEQ ID NO: 218973 - DNA, 27 bp, Artificial Sequence
  Description of Artificial Sequence: Synthetic oligonucleotide
caacatctacaaggtggagggcggctg

SEQ ID NO: 218974 - DNA, 27 bp, Artificial Sequence
  Description of Artificial Sequence: Synthetic oligonucleotide
aacatctacaaggtggagggcggctgc

SEQ ID NO: 218975 - DNA, 27 bp, Artificial Sequence
  Description of Artificial Sequence: Synthetic oligonucleotide
acatctacaaggtggagggcggctgca

SEQ ID NO: 218976 - DNA, 27 bp, Artificial Sequence
  Description of Artificial Sequence: Synthetic oligonucleotide
catctacaaggtggagggcggctgcat

SEQ ID NO: 218977 - DNA, 27 bp, Artificial Sequence
  Description of Artificial Sequence: Synthetic oligonucleotide
atctacaaggtggagggcggctgcatc

SEQ ID NO: 218978 - DNA, 27 bp, Artificial Sequence
  Description of Artificial Sequence: Synthetic oligonucleotide
tctacaaggtggagggcggctgcatca

SEQ ID NO: 218979 - DNA, 26 bp, Artificial Sequence
  Description of Artificial Sequence: Synthetic oligonucleotide
ctacaaggtggagggcggctgcatca

SEQ ID NO: 218980 - DNA, 26 bp, Artificial Sequence
  Description of Artificial Sequence: Synthetic oligonucleotide
tacaaggtggagggcggctgcatcac

SEQ ID NO: 218981 - DNA, 25 bp, Artificial Sequence
  Description of Artificial Sequence: Synthetic oligonucleotide
acaaggtggagggcggctgcatcac

SEQ ID NO: 218982 - DNA, 24 bp, Artificial Sequence
  Description of Artificial Sequence: Synthetic oligonucleotide
caaggtggagggcggctgcatcac

SEQ ID NO: 218983 - DNA, 26 bp, Artificial Sequence
  Description of Artificial Sequence: Synthetic oligonucleotide
aaggtggagggcggctgcatcaccaa

SEQ ID NO: 218984 - DNA, 25 bp, Artificial Sequence
  Description of Artificial Sequence: Synthetic oligonucleotide
aggtggagggcggctgcatcaccaa

SEQ ID NO: 218985 - DNA, 24 bp, Artificial Sequence
  Description of Artificial Sequence: Synthetic oligonucleotide
ggtggagggcggctgcatcaccaa

SEQ ID NO: 218986 - DNA, 26 bp, Artificial Sequence
  Description of Artificial Sequence: Synthetic oligonucleotide
gtggagggcggctgcatcaccaagtt

SEQ ID NO: 218987 - DNA, 26 bp, Artificial Sequence
  Description of Artificial Sequence: Synthetic oligonucleotide
tggagggcggctgcatcaccaagttg

SEQ ID NO: 218988 - DNA, 25 bp, Artificial Sequence
  Description of Artificial Sequence: Synthetic oligonucleotide
ggagggcggctgcatcaccaagttg

SEQ ID NO: 218989 - DNA, 26 bp, Artificial Sequence
  Description of Artificial Sequence: Synthetic oligonucleotide
gagggcggctgcatcaccaagttgga

SEQ ID NO: 218990 - DNA, 27 bp, Artificial Sequence
  Description of Artificial Sequence: Synthetic oligonucleotide
agggcggctgcatcaccaagttggaga

SEQ ID NO: 218991 - DNA, 26 bp, Artificial Sequence
  Description of Artificial Sequence: Synthetic oligonucleotide
gggcggctgcatcaccaagttggaga

SEQ ID NO: 218992 - DNA, 26 bp, Artificial Sequence
  Description of Artificial Sequence: Synthetic oligonucleotide
ggcggctgcatcaccaagttggagac

SEQ ID NO: 218993 - DNA, 27 bp, Artificial Sequence
  Description of Artificial Sequence: Synthetic oligonucleotide
gcggctgcatcaccaagttggagacct

SEQ ID NO: 218994 - DNA, 28 bp, Artificial Sequence
  Description of Artificial Sequence: Synthetic oligonucleotide
cggctgcatcaccaagttggagaccttc

SEQ ID NO: 218995 - DNA, 30 bp, Artificial Sequence
  Description of Artificial Sequence: Synthetic oligonucleotide
ggctgcatcaccaagttggagaccttcatc

SEQ ID NO: 218996 - DNA, 30 bp, Artificial Sequence
  Description of Artificial Sequence: Synthetic oligonucleotide
gctgcatcaccaagttggagaccttcatcc

SEQ ID NO: 218997 - DNA, 31 bp, Artificial Sequence
  Description of Artificial Sequence: Synthetic oligonucleotide
ctgcatcaccaagttggagaccttcatccag

SEQ ID NO: 218998 - DNA, 31 bp, Artificial Sequence
  Description of Artificial Sequence: Synthetic oligonucleotide
tgcatcaccaagttggagaccttcatccagg

SEQ ID NO: 218999 - DNA, 30 bp, Artificial Sequence
  Description of Artificial Sequence: Synthetic oligonucleotide
gcatcaccaagttggagaccttcatccagg

SEQ ID NO: 219000 - DNA, 31 bp, Artificial Sequence
  Description of Artificial Sequence: Synthetic oligonucleotide
catcaccaagttggagaccttcatccaggag

SEQ ID NO: 219001 - DNA, 31 bp, Artificial Sequence
  Description of Artificial Sequence: Synthetic oligonucleotide
atcaccaagttggagaccttcatccaggagc

SEQ ID NO: 219002 - DNA, 30 bp, Artificial Sequence
  Description of Artificial Sequence: Synthetic oligonucleotide
tcaccaagttggagaccttcatccaggagc

SEQ ID NO: 219003 - DNA, 29 bp, Artificial Sequence
  Description of Artificial Sequence: Synthetic oligonucleotide
caccaagttggagaccttcatccaggagc

SEQ ID NO: 219004 - DNA, 30 bp, Artificial Sequence
  Description of Artificial Sequence: Synthetic oligonucleotide
accaagttggagaccttcatccaggagcac

SEQ ID NO: 219005 - DNA, 29 bp, Artificial Sequence
  Description of Artificial Sequence: Synthetic oligonucleotide
ccaagttggagaccttcatccaggagcac

SEQ ID NO: 219006 - DNA, 29 bp, Artificial Sequence
  Description of Artificial Sequence: Synthetic oligonucleotide
caagttggagaccttcatccaggagcacc

SEQ ID NO: 219007 - DNA, 30 bp, Artificial Sequence
  Description of Artificial Sequence: Synthetic oligonucleotide
aagttggagaccttcatccaggagcacctg

SEQ ID NO: 219008 - DNA, 29 bp, Artificial Sequence
  Description of Artificial Sequence: Synthetic oligonucleotide
agttggagaccttcatccaggagcacctg

SEQ ID NO: 219009 - DNA, 28 bp, Artificial Sequence
  Description of Artificial Sequence: Synthetic oligonucleotide
gttggagaccttcatccaggagcacctg

SEQ ID NO: 219010 - DNA, 29 bp, Artificial Sequence
  Description of Artificial Sequence: Synthetic oligonucleotide
ttggagaccttcatccaggagcacctgag

SEQ ID NO: 219011 - DNA, 28 bp, Artificial Sequence
  Description of Artificial Sequence: Synthetic oligonucleotide
tggagaccttcatccaggagcacctgag

SEQ ID NO: 219012 - DNA, 27 bp, Artificial Sequence
  Description of Artificial Sequence: Synthetic oligonucleotide
ggagaccttcatccaggagcacctgag

SEQ ID NO: 219013 - DNA, 27 bp, Artificial Sequence
  Description of Artificial Sequence: Synthetic oligonucleotide
gagaccttcatccaggagcacctgagg

SEQ ID NO: 219014 - DNA, 27 bp, Artificial Sequence
  Description of Artificial Sequence: Synthetic oligonucleotide
agaccttcatccaggagcacctgaggg

SEQ ID NO: 219015 - DNA, 27 bp, Artificial Sequence
  Description of Artificial Sequence: Synthetic oligonucleotide
gaccttcatccaggagcacctgagggt

SEQ ID NO: 219016 - DNA, 27 bp, Artificial Sequence
  Description of Artificial Sequence: Synthetic oligonucleotide
accttcatccaggagcacctgagggtc

SEQ ID NO: 219017 - DNA, 27 bp, Artificial Sequence
  Description of Artificial Sequence: Synthetic oligonucleotide
ccttcatccaggagcacctgagggtca

SEQ ID NO: 219018 - DNA, 29 bp, Artificial Sequence
  Description of Artificial Sequence: Synthetic oligonucleotide
cttcatccaggagcacctgagggtcattg

SEQ ID NO: 219019 - DNA, 29 bp, Artificial Sequence
  Description of Artificial Sequence: Synthetic oligonucleotide
ttcatccaggagcacctgagggtcattgg

SEQ ID NO: 219020 - DNA, 28 bp, Artificial Sequence
  Description of Artificial Sequence: Synthetic oligonucleotide
tcatccaggagcacctgagggtcattgg

SEQ ID NO: 219021 - DNA, 27 bp, Artificial Sequence
  Description of Artificial Sequence: Synthetic oligonucleotide
catccaggagcacctgagggtcattgg

SEQ ID NO: 219022 - DNA, 27 bp, Artificial Sequence
  Description of Artificial Sequence: Synthetic oligonucleotide
atccaggagcacctgagggtcattggg

SEQ ID NO: 219023 - DNA, 26 bp, Artificial Sequence
  Description of Artificial Sequence: Synthetic oligonucleotide
tccaggagcacctgagggtcattggg

SEQ ID NO: 219024 - DNA, 25 bp, Artificial Sequence
  Description of Artificial Sequence: Synthetic oligonucleotide
ccaggagcacctgagggtcattggg

SEQ ID NO: 219025 - DNA, 25 bp, Artificial Sequence
  Description of Artificial Sequence: Synthetic oligonucleotide
caggagcacctgagggtcattgggg

SEQ ID NO: 219026 - DNA, 26 bp, Artificial Sequence
  Description of Artificial Sequence: Synthetic oligonucleotide
aggagcacctgagggtcattggggct

SEQ ID NO: 219027 - DNA, 25 bp, Artificial Sequence
  Description of Artificial Sequence: Synthetic oligonucleotide
ggagcacctgagggtcattggggct

SEQ ID NO: 219028 - DNA, 26 bp, Artificial Sequence
  Description of Artificial Sequence: Synthetic oligonucleotide
gagcacctgagggtcattggggctgt

SEQ ID NO: 219029 - DNA, 26 bp, Artificial Sequence
  Description of Artificial Sequence: Synthetic oligonucleotide
agcacctgagggtcattggggctgtg

SEQ ID NO: 219030 - DNA, 25 bp, Artificial Sequence
  Description of Artificial Sequence: Synthetic oligonucleotide
gcacctgagggtcattggggctgtg

SEQ ID NO: 219031 - DNA, 25 bp, Artificial Sequence
  Description of Artificial Sequence: Synthetic oligonucleotide
cacctgagggtcattggggctgtgg

SEQ ID NO: 219032 - DNA, 25 bp, Artificial Sequence
  Description of Artificial Sequence: Synthetic oligonucleotide
acctgagggtcattggggctgtggg

SEQ ID NO: 219033 - DNA, 24 bp, Artificial Sequence
  Description of Artificial Sequence: Synthetic oligonucleotide
cctgagggtcattggggctgtggg

SEQ ID NO: 219034 - DNA, 26 bp, Artificial Sequence
  Description of Artificial Sequence: Synthetic oligonucleotide
ctgagggtcattggggctgtggggat

SEQ ID NO: 219035 - DNA, 26 bp, Artificial Sequence
  Description of Artificial Sequence: Synthetic oligonucleotide
tgagggtcattggggctgtggggatc

SEQ ID NO: 219036 - DNA, 25 bp, Artificial Sequence
  Description of Artificial Sequence: Synthetic oligonucleotide
gagggtcattggggctgtggggatc

SEQ ID NO: 219037 - DNA, 25 bp, Artificial Sequence
  Description of Artificial Sequence: Synthetic oligonucleotide
agggtcattggggctgtggggatcg

SEQ ID NO: 219038 - DNA, 24 bp, Artificial Sequence
  Description of Artificial Sequence: Synthetic oligonucleotide
gggtcattggggctgtggggatcg

SEQ ID NO: 219039 - DNA, 24 bp, Artificial Sequence
  Description of Artificial Sequence: Synthetic oligonucleotide
ggtcattggggctgtggggatcgg

SEQ ID NO: 219040 - DNA, 27 bp, Artificial Sequence
  Description of Artificial Sequence: Synthetic oligonucleotide
gtcattggggctgtggggatcggcatt

SEQ ID NO: 219041 - DNA, 27 bp, Artificial Sequence
  Description of Artificial Sequence: Synthetic oligonucleotide
tcattggggctgtggggatcggcattg

SEQ ID NO: 219042 - DNA, 26 bp, Artificial Sequence
  Description of Artificial Sequence: Synthetic oligonucleotide
cattggggctgtggggatcggcattg

SEQ ID NO: 219043 - DNA, 26 bp, Artificial Sequence
  Description of Artificial Sequence: Synthetic oligonucleotide
attggggctgtggggatcggcattgc

SEQ ID NO: 219044 - DNA, 25 bp, Artificial Sequence
  Description of Artificial Sequence: Synthetic oligonucleotide
ttggggctgtggggatcggcattgc

SEQ ID NO: 219045 - DNA, 24 bp, Artificial Sequence
  Description of Artificial Sequence: Synthetic oligonucleotide
tggggctgtggggatcggcattgc

SEQ ID NO: 219046 - DNA, 23 bp, Artificial Sequence
  Description of Artificial Sequence: Synthetic oligonucleotide
ggggctgtggggatcggcattgc

SEQ ID NO: 219047 - DNA, 24 bp, Artificial Sequence
  Description of Artificial Sequence: Synthetic oligonucleotide
gggctgtggggatcggcattgcct

SEQ ID NO: 219048 - DNA, 25 bp, Artificial Sequence
  Description of Artificial Sequence: Synthetic oligonucleotide
ggctgtggggatcggcattgcctgt

SEQ ID NO: 219049 - DNA, 26 bp, Artificial Sequence
  Description of Artificial Sequence: Synthetic oligonucleotide
gctgtggggatcggcattgcctgtgt

SEQ ID NO: 219050 - DNA, 26 bp, Artificial Sequence
  Description of Artificial Sequence: Synthetic oligonucleotide
ctgtggggatcggcattgcctgtgtg

SEQ ID NO: 219051 - DNA, 27 bp, Artificial Sequence
  Description of Artificial Sequence: Synthetic oligonucleotide
tgtggggatcggcattgcctgtgtgca

SEQ ID NO: 219052 - DNA, 26 bp, Artificial Sequence
  Description of Artificial Sequence: Synthetic oligonucleotide
gtggggatcggcattgcctgtgtgca

SEQ ID NO: 219053 - DNA, 26 bp, Artificial Sequence
  Description of Artificial Sequence: Synthetic oligonucleotide
tggggatcggcattgcctgtgtgcag

SEQ ID NO: 219054 - DNA, 25 bp, Artificial Sequence
  Description of Artificial Sequence: Synthetic oligonucleotide
ggggatcggcattgcctgtgtgcag

SEQ ID NO: 219055 - DNA, 26 bp, Artificial Sequence
  Description of Artificial Sequence: Synthetic oligonucleotide
gggatcggcattgcctgtgtgcaggt

SEQ ID NO: 219056 - DNA, 27 bp, Artificial Sequence
  Description of Artificial Sequence: Synthetic oligonucleotide
ggatcggcattgcctgtgtgcaggtct

SEQ ID NO: 219057 - DNA, 29 bp, Artificial Sequence
  Description of Artificial Sequence: Synthetic oligonucleotide
gatcggcattgcctgtgtgcaggtctttg

SEQ ID NO: 219058 - DNA, 29 bp, Artificial Sequence
  Description of Artificial Sequence: Synthetic oligonucleotide
atcggcattgcctgtgtgcaggtctttgg

SEQ ID NO: 219059 - DNA, 28 bp, Artificial Sequence
  Description of Artificial Sequence: Synthetic oligonucleotide
tcggcattgcctgtgtgcaggtctttgg

SEQ ID NO: 219060 - DNA, 27 bp, Artificial Sequence
  Description of Artificial Sequence: Synthetic oligonucleotide
cggcattgcctgtgtgcaggtctttgg

SEQ ID NO: 219061 - DNA, 27 bp, Artificial Sequence
  Description of Artificial Sequence: Synthetic oligonucleotide
ggcattgcctgtgtgcaggtctttggc

SEQ ID NO: 219062 - DNA, 29 bp, Artificial Sequence
  Description of Artificial Sequence: Synthetic oligonucleotide
gcattgcctgtgtgcaggtctttggcatg

SEQ ID NO: 219063 - DNA, 31 bp, Artificial Sequence
  Description of Artificial Sequence: Synthetic oligonucleotide
cattgcctgtgtgcaggtctttggcatgatc

SEQ ID NO: 219064 - DNA, 33 bp, Artificial Sequence
  Description of Artificial Sequence: Synthetic oligonucleotide
attgcctgtgtgcaggtctttggcatgatcttc

SEQ ID NO: 219065 - DNA, 32 bp, Artificial Sequence
  Description of Artificial Sequence: Synthetic oligonucleotide
ttgcctgtgtgcaggtctttggcatgatcttc

SEQ ID NO: 219066 - DNA, 31 bp, Artificial Sequence
  Description of Artificial Sequence: Synthetic oligonucleotide
tgcctgtgtgcaggtctttggcatgatcttc

SEQ ID NO: 219067 - DNA, 30 bp, Artificial Sequence
  Description of Artificial Sequence: Synthetic oligonucleotide
gcctgtgtgcaggtctttggcatgatcttc

SEQ ID NO: 219068 - DNA, 31 bp, Artificial Sequence
  Description of Artificial Sequence: Synthetic oligonucleotide
cctgtgtgcaggtctttggcatgatcttcac

SEQ ID NO: 219069 - DNA, 31 bp, Artificial Sequence
  Description of Artificial Sequence: Synthetic oligonucleotide
ctgtgtgcaggtctttggcatgatcttcacg

SEQ ID NO: 219070 - DNA, 32 bp, Artificial Sequence
  Description of Artificial Sequence: Synthetic oligonucleotide
tgtgtgcaggtctttggcatgatcttcacgtg

SEQ ID NO: 219071 - DNA, 31 bp, Artificial Sequence
  Description of Artificial Sequence: Synthetic oligonucleotide
gtgtgcaggtctttggcatgatcttcacgtg

SEQ ID NO: 219072 - DNA, 31 bp, Artificial Sequence
  Description of Artificial Sequence: Synthetic oligonucleotide
tgtgcaggtctttggcatgatcttcacgtgc

SEQ ID NO: 219073 - DNA, 30 bp, Artificial Sequence
  Description of Artificial Sequence: Synthetic oligonucleotide
gtgcaggtctttggcatgatcttcacgtgc

SEQ ID NO: 219074 - DNA, 31 bp, Artificial Sequence
  Description of Artificial Sequence: Synthetic oligonucleotide
tgcaggtctttggcatgatcttcacgtgctg

SEQ ID NO: 219075 - DNA, 30 bp, Artificial Sequence
  Description of Artificial Sequence: Synthetic oligonucleotide
gcaggtctttggcatgatcttcacgtgctg

SEQ ID NO: 219076 - DNA, 30 bp, Artificial Sequence
  Description of Artificial Sequence: Synthetic oligonucleotide
caggtctttggcatgatcttcacgtgctgc

SEQ ID NO: 219077 - DNA, 30 bp, Artificial Sequence
  Description of Artificial Sequence: Synthetic oligonucleotide
aggtctttggcatgatcttcacgtgctgcc

SEQ ID NO: 219078 - DNA, 29 bp, Artificial Sequence
  Description of Artificial Sequence: Synthetic oligonucleotide
ggtctttggcatgatcttcacgtgctgcc

SEQ ID NO: 219079 - DNA, 30 bp, Artificial Sequence
  Description of Artificial Sequence: Synthetic oligonucleotide
gtctttggcatgatcttcacgtgctgcctg

SEQ ID NO: 219080 - DNA, 32 bp, Artificial Sequence
  Description of Artificial Sequence: Synthetic oligonucleotide
tctttggcatgatcttcacgtgctgcctgtac

SEQ ID NO: 219081 - DNA, 31 bp, Artificial Sequence
  Description of Artificial Sequence: Synthetic oligonucleotide
ctttggcatgatcttcacgtgctgcctgtac

SEQ ID NO: 219082 - DNA, 32 bp, Artificial Sequence
  Description of Artificial Sequence: Synthetic oligonucleotide
tttggcatgatcttcacgtgctgcctgtacag

SEQ ID NO: 219083 - DNA, 31 bp, Artificial Sequence
  Description of Artificial Sequence: Synthetic oligonucleotide
ttggcatgatcttcacgtgctgcctgtacag

SEQ ID NO: 219084 - DNA, 30 bp, Artificial Sequence
  Description of Artificial Sequence: Synthetic oligonucleotide
tggcatgatcttcacgtgctgcctgtacag

SEQ ID NO: 219085 - DNA, 29 bp, Artificial Sequence
  Description of Artificial Sequence: Synthetic oligonucleotide
ggcatgatcttcacgtgctgcctgtacag

SEQ ID NO: 219086 - DNA, 29 bp, Artificial Sequence
  Description of Artificial Sequence: Synthetic oligonucleotide
gcatgatcttcacgtgctgcctgtacagg

SEQ ID NO: 219087 - DNA, 30 bp, Artificial Sequence
  Description of Artificial Sequence: Synthetic oligonucleotide
catgatcttcacgtgctgcctgtacaggag

SEQ ID NO: 219088 - DNA, 31 bp, Artificial Sequence
  Description of Artificial Sequence: Synthetic oligonucleotide
atgatcttcacgtgctgcctgtacaggagtc

SEQ ID NO: 219089 - DNA, 30 bp, Artificial Sequence
  Description of Artificial Sequence: Synthetic oligonucleotide
tgatcttcacgtgctgcctgtacaggagtc

SEQ ID NO: 219090 - DNA, 29 bp, Artificial Sequence
  Description of Artificial Sequence: Synthetic oligonucleotide
gatcttcacgtgctgcctgtacaggagtc

SEQ ID NO: 219091 - DNA, 30 bp, Artificial Sequence
  Description of Artificial Sequence: Synthetic oligonucleotide
atcttcacgtgctgcctgtacaggagtctc

SEQ ID NO: 219092 - DNA, 29 bp, Artificial Sequence
  Description of Artificial Sequence: Synthetic oligonucleotide
tcttcacgtgctgcctgtacaggagtctc

SEQ ID NO: 219093 - DNA, 28 bp, Artificial Sequence
  Description of Artificial Sequence: Synthetic oligonucleotide
cttcacgtgctgcctgtacaggagtctc

SEQ ID NO: 219094 - DNA, 30 bp, Artificial Sequence
  Description of Artificial Sequence: Synthetic oligonucleotide
ttcacgtgctgcctgtacaggagtctcaag

SEQ ID NO: 219095 - DNA, 29 bp, Artificial Sequence
  Description of Artificial Sequence: Synthetic oligonucleotide
tcacgtgctgcctgtacaggagtctcaag

SEQ ID NO: 219096 - DNA, 28 bp, Artificial Sequence
  Description of Artificial Sequence: Synthetic oligonucleotide
cacgtgctgcctgtacaggagtctcaag

SEQ ID NO: 219097 - DNA, 28 bp, Artificial Sequence
  Description of Artificial Sequence: Synthetic oligonucleotide
acgtgctgcctgtacaggagtctcaagc

SEQ ID NO: 219098 - DNA, 27 bp, Artificial Sequence
  Description of Artificial Sequence: Synthetic oligonucleotide
cgtgctgcctgtacaggagtctcaagc

SEQ ID NO: 219099 - DNA, 28 bp, Artificial Sequence
  Description of Artificial Sequence: Synthetic oligonucleotide
gtgctgcctgtacaggagtctcaagctg

SEQ ID NO: 219100 - DNA, 28 bp, Artificial Sequence
  Description of Artificial Sequence: Synthetic oligonucleotide
tgctgcctgtacaggagtctcaagctgg

SEQ ID NO: 219101 - DNA, 27 bp, Artificial Sequence
  Description of Artificial Sequence: Synthetic oligonucleotide
gctgcctgtacaggagtctcaagctgg

SEQ ID NO: 219102 - DNA, 28 bp, Artificial Sequence
  Description of Artificial Sequence: Synthetic oligonucleotide
ctgcctgtacaggagtctcaagctggag

SEQ ID NO: 219103 - DNA, 28 bp, Artificial Sequence
  Description of Artificial Sequence: Synthetic oligonucleotide
tgcctgtacaggagtctcaagctggagc

SEQ ID NO: 219104 - DNA, 27 bp, Artificial Sequence
  Description of Artificial Sequence: Synthetic oligonucleotide
gcctgtacaggagtctcaagctggagc

SEQ ID NO: 219105 - DNA, 28 bp, Artificial Sequence
  Description of Artificial Sequence: Synthetic oligonucleotide
cctgtacaggagtctcaagctggagcac

SEQ ID NO: 219106 - DNA, 30 bp, Artificial Sequence
  Description of Artificial Sequence: Synthetic oligonucleotide
ctgtacaggagtctcaagctggagcactac

SEQ ID NO: 219107 - DNA, 31 bp, Artificial Sequence
  Description of Artificial Sequence: Synthetic oligonucleotide
tgtacaggagtctcaagctggagcactactg

SEQ ID NO: 219108 - DNA, 30 bp, Artificial Sequence
  Description of Artificial Sequence: Synthetic oligonucleotide
gtacaggagtctcaagctggagcactactg

SEQ ID NO: 219109 - DNA, 28 bp, Artificial Sequence
  Description of Artificial Sequence: Synthetic oligonucleotide
tgcaagacggtggtggctctttgtggac

SEQ ID NO: 219110 - DNA, 27 bp, Artificial Sequence
  Description of Artificial Sequence: Synthetic oligonucleotide
gcaagacggtggtggctctttgtggac

SEQ ID NO: 219111 - DNA, 28 bp, Artificial Sequence
  Description of Artificial Sequence: Synthetic oligonucleotide
caagacggtggtggctctttgtggacag

SEQ ID NO: 219112 - DNA, 28 bp, Artificial Sequence
  Description of Artificial Sequence: Synthetic oligonucleotide
aagacggtggtggctctttgtggacagc

SEQ ID NO: 219113 - DNA, 27 bp, Artificial Sequence
  Description of Artificial Sequence: Synthetic oligonucleotide
agacggtggtggctctttgtggacagc

SEQ ID NO: 219114 - DNA, 26 bp, Artificial Sequence
  Description of Artificial Sequence: Synthetic oligonucleotide
gacggtggtggctctttgtggacagc

SEQ ID NO: 219115 - DNA, 27 bp, Artificial Sequence
  Description of Artificial Sequence: Synthetic oligonucleotide
acggtggtggctctttgtggacagcga

SEQ ID NO: 219116 - DNA, 26 bp, Artificial Sequence
  Description of Artificial Sequence: Synthetic oligonucleotide
cggtggtggctctttgtggacagcga

SEQ ID NO: 219117 - DNA, 27 bp, Artificial Sequence
  Description of Artificial Sequence: Synthetic oligonucleotide
ggtggtggctctttgtggacagcgaga

SEQ ID NO: 219118 - DNA, 27 bp, Artificial Sequence
  Description of Artificial Sequence: Synthetic oligonucleotide
gtggtggctctttgtggacagcgagac

SEQ ID NO: 219119 - DNA, 27 bp, Artificial Sequence
  Description of Artificial Sequence: Synthetic oligonucleotide
tggtggctctttgtggacagcgagacc

SEQ ID NO: 219120 - DNA, 27 bp, Artificial Sequence
  Description of Artificial Sequence: Synthetic oligonucleotide
ggtggctctttgtggacagcgagacca

SEQ ID NO: 219121 - DNA, 28 bp, Artificial Sequence
  Description of Artificial Sequence: Synthetic oligonucleotide
gtggctctttgtggacagcgagaccatg

SEQ ID NO: 219122 - DNA, 28 bp, Artificial Sequence
  Description of Artificial Sequence: Synthetic oligonucleotide
tggctctttgtggacagcgagaccatgc

SEQ ID NO: 219123 - DNA, 27 bp, Artificial Sequence
  Description of Artificial Sequence: Synthetic oligonucleotide
ggctctttgtggacagcgagaccatgc

SEQ ID NO: 219124 - DNA, 27 bp, Artificial Sequence
  Description of Artificial Sequence: Synthetic oligonucleotide
gctctttgtggacagcgagaccatgcc

SEQ ID NO: 219125 - DNA, 28 bp, Artificial Sequence
  Description of Artificial Sequence: Synthetic oligonucleotide
ctctttgtggacagcgagaccatgcctc

SEQ ID NO: 219126 - DNA, 28 bp, Artificial Sequence
  Description of Artificial Sequence: Synthetic oligonucleotide
tctttgtggacagcgagaccatgcctcc

SEQ ID NO: 219127 - DNA, 27 bp, Artificial Sequence
  Description of Artificial Sequence: Synthetic oligonucleotide
ctttgtggacagcgagaccatgcctcc

SEQ ID NO: 219128 - DNA, 29 bp, Artificial Sequence
  Description of Artificial Sequence: Synthetic oligonucleotide
tttgtggacagcgagaccatgcctccaac

SEQ ID NO: 219129 - DNA, 28 bp, Artificial Sequence
  Description of Artificial Sequence: Synthetic oligonucleotide
ttgtggacagcgagaccatgcctccaac

SEQ ID NO: 219130 - DNA, 27 bp, Artificial Sequence
  Description of Artificial Sequence: Synthetic oligonucleotide
tgtggacagcgagaccatgcctccaac

SEQ ID NO: 219131 - DNA, 27 bp, Artificial Sequence
  Description of Artificial Sequence: Synthetic oligonucleotide
gtggacagcgagaccatgcctccaaca

SEQ ID NO: 219132 - DNA, 28 bp, Artificial Sequence
  Description of Artificial Sequence: Synthetic oligonucleotide
tggacagcgagaccatgcctccaacatc

SEQ ID NO: 219133 - DNA, 27 bp, Artificial Sequence
  Description of Artificial Sequence: Synthetic oligonucleotide
ggacagcgagaccatgcctccaacatc

SEQ ID NO: 219134 - DNA, 29 bp, Artificial Sequence
  Description of Artificial Sequence: Synthetic oligonucleotide
gacagcgagaccatgcctccaacatctac

SEQ ID NO: 219135 - DNA, 31 bp, Artificial Sequence
  Description of Artificial Sequence: Synthetic oligonucleotide
acagcgagaccatgcctccaacatctacaag

SEQ ID NO: 219136 - DNA, 31 bp, Artificial Sequence
  Description of Artificial Sequence: Synthetic oligonucleotide
tcaaggagaacctgaaggacaccatgaccag

SEQ ID NO: 219137 - DNA, 30 bp, Artificial Sequence
  Description of Artificial Sequence: Synthetic oligonucleotide
caaggagaacctgaaggacaccatgaccag

SEQ ID NO: 219138 - DNA, 30 bp, Artificial Sequence
  Description of Artificial Sequence: Synthetic oligonucleotide
aaggagaacctgaaggacaccatgaccagg

SEQ ID NO: 219139 - DNA, 29 bp, Artificial Sequence
  Description of Artificial Sequence: Synthetic oligonucleotide
aggagaacctgaaggacaccatgaccagg

SEQ ID NO: 219140 - DNA, 28 bp, Artificial Sequence
  Description of Artificial Sequence: Synthetic oligonucleotide
ggagaacctgaaggacaccatgaccagg

SEQ ID NO: 219141 - DNA, 28 bp, Artificial Sequence
  Description of Artificial Sequence: Synthetic oligonucleotide
gagaacctgaaggacaccatgaccaggc

SEQ ID NO: 219142 - DNA, 28 bp, Artificial Sequence
  Description of Artificial Sequence: Synthetic oligonucleotide
agaacctgaaggacaccatgaccaggcg

SEQ ID NO: 219143 - DNA, 27 bp, Artificial Sequence
  Description of Artificial Sequence: Synthetic oligonucleotide
gaacctgaaggacaccatgaccaggcg

SEQ ID NO: 219144 - DNA, 27 bp, Artificial Sequence
  Description of Artificial Sequence: Synthetic oligonucleotide
aacctgaaggacaccatgaccaggcgc

SEQ ID NO: 219145 - DNA, 27 bp, Artificial Sequence
  Description of Artificial Sequence: Synthetic oligonucleotide
acctgaaggacaccatgaccaggcgct

SEQ ID NO: 219146 - DNA, 27 bp, Artificial Sequence
  Description of Artificial Sequence: Synthetic oligonucleotide
cctgaaggacaccatgaccaggcgcta

SEQ ID NO: 219147 - DNA, 27 bp, Artificial Sequence
  Description of Artificial Sequence: Synthetic oligonucleotide
ctgaaggacaccatgaccaggcgctac

SEQ ID NO: 219148 - DNA, 27 bp, Artificial Sequence
  Description of Artificial Sequence: Synthetic oligonucleotide
tgaaggacaccatgaccaggcgctacc

SEQ ID NO: 219149 - DNA, 27 bp, Artificial Sequence
  Description of Artificial Sequence: Synthetic oligonucleotide
gaaggacaccatgaccaggcgctacca

SEQ ID NO: 219150 - DNA, 27 bp, Artificial Sequence
  Description of Artificial Sequence: Synthetic oligonucleotide
aaggacaccatgaccaggcgctaccac

SEQ ID NO: 219151 - DNA, 26 bp, Artificial Sequence
  Description of Artificial Sequence: Synthetic oligonucleotide
aggacaccatgaccaggcgctaccac

SEQ ID NO: 219152 - DNA, 25 bp, Artificial Sequence
  Description of Artificial Sequence: Synthetic oligonucleotide
ggacaccatgaccaggcgctaccac

SEQ ID NO: 219153 - DNA, 26 bp, Artificial Sequence
  Description of Artificial Sequence: Synthetic oligonucleotide
gacaccatgaccaggcgctaccacca

SEQ ID NO: 219154 - DNA, 27 bp, Artificial Sequence
  Description of Artificial Sequence: Synthetic oligonucleotide
acaccatgaccaggcgctaccaccagt

SEQ ID NO: 219155 - DNA, 26 bp, Artificial Sequence
  Description of Artificial Sequence: Synthetic oligonucleotide
caccatgaccaggcgctaccaccagt

SEQ ID NO: 219156 - DNA, 26 bp, Artificial Sequence
  Description of Artificial Sequence: Synthetic oligonucleotide
accatgaccaggcgctaccaccagtc

SEQ ID NO: 219157 - DNA, 25 bp, Artificial Sequence
  Description of Artificial Sequence: Synthetic oligonucleotide
ccatgaccaggcgctaccaccagtc

SEQ ID NO: 219158 - DNA, 25 bp, Artificial Sequence
  Description of Artificial Sequence: Synthetic oligonucleotide
catgaccaggcgctaccaccagtcg

SEQ ID NO: 219159 - DNA, 25 bp, Artificial Sequence
  Description of Artificial Sequence: Synthetic oligonucleotide
atgaccaggcgctaccaccagtcgg

SEQ ID NO: 219160 - DNA, 24 bp, Artificial Sequence
  Description of Artificial Sequence: Synthetic oligonucleotide
tgaccaggcgctaccaccagtcgg

SEQ ID NO: 219161 - DNA, 23 bp, Artificial Sequence
  Description of Artificial Sequence: Synthetic oligonucleotide
gaccaggcgctaccaccagtcgg

SEQ ID NO: 219162 - DNA, 23 bp, Artificial Sequence
  Description of Artificial Sequence: Synthetic oligonucleotide
accaggcgctaccaccagtcggg

SEQ ID NO: 219163 - DNA, 22 bp, Artificial Sequence
  Description of Artificial Sequence: Synthetic oligonucleotide
ccaggcgctaccaccagtcggg

SEQ ID NO: 219164 - DNA, 22 bp, Artificial Sequence
  Description of Artificial Sequence: Synthetic oligonucleotide
caggcgctaccaccagtcgggc

SEQ ID NO: 219165 - DNA, 24 bp, Artificial Sequence
  Description of Artificial Sequence: Synthetic oligonucleotide
aggcgctaccaccagtcgggccat

SEQ ID NO: 219166 - DNA, 23 bp, Artificial Sequence
  Description of Artificial Sequence: Synthetic oligonucleotide
ggcgctaccaccagtcgggccat

SEQ ID NO: 219167 - DNA, 24 bp, Artificial Sequence
  Description of Artificial Sequence: Synthetic oligonucleotide
gcgctaccaccagtcgggccatga

SEQ ID NO: 219168 - DNA, 24 bp, Artificial Sequence
  Description of Artificial Sequence: Synthetic oligonucleotide
cgctaccaccagtcgggccatgag

SEQ ID NO: 219169 - DNA, 24 bp, Artificial Sequence
  Description of Artificial Sequence: Synthetic oligonucleotide
gctaccaccagtcgggccatgagg

SEQ ID NO: 219170 - DNA, 25 bp, Artificial Sequence
  Description of Artificial Sequence: Synthetic oligonucleotide
ctaccaccagtcgggccatgaggct

SEQ ID NO: 219171 - DNA, 26 bp, Artificial Sequence
  Description of Artificial Sequence: Synthetic oligonucleotide
taccaccagtcgggccatgaggctgt

SEQ ID NO: 219172 - DNA, 25 bp, Artificial Sequence
  Description of Artificial Sequence: Synthetic oligonucleotide
accaccagtcgggccatgaggctgt

SEQ ID NO: 219173 - DNA, 24 bp, Artificial Sequence
  Description of Artificial Sequence: Synthetic oligonucleotide
ccaccagtcgggccatgaggctgt

SEQ ID NO: 219174 - DNA, 25 bp, Artificial Sequence
  Description of Artificial Sequence: Synthetic oligonucleotide
caccagtcgggccatgaggctgtga

SEQ ID NO: 219175 - DNA, 25 bp, Artificial Sequence
  Description of Artificial Sequence: Synthetic oligonucleotide
accagtcgggccatgaggctgtgac

SEQ ID NO: 219176 - DNA, 24 bp, Artificial Sequence
  Description of Artificial Sequence: Synthetic oligonucleotide
ccagtcgggccatgaggctgtgac

SEQ ID NO: 219177 - DNA, 25 bp, Artificial Sequence
  Description of Artificial Sequence: Synthetic oligonucleotide
cagtcgggccatgaggctgtgacca

SEQ ID NO: 219178 - DNA, 25 bp, Artificial Sequence
  Description of Artificial Sequence: Synthetic oligonucleotide
agtcgggccatgaggctgtgaccag

SEQ ID NO: 219179 - DNA, 24 bp, Artificial Sequence
  Description of Artificial Sequence: Synthetic oligonucleotide
gtcgggccatgaggctgtgaccag

SEQ ID NO: 219180 - DNA, 24 bp, Artificial Sequence
  Description of Artificial Sequence: Synthetic oligonucleotide
tcgggccatgaggctgtgaccagc

SEQ ID NO: 219181 - DNA, 27 bp, Artificial Sequence
  Description of Artificial Sequence: Synthetic oligonucleotide
gagaccttcatccaggagcacctgagc

SEQ ID NO: 219182 - DNA, 27 bp, Artificial Sequence
  Description of Artificial Sequence: Synthetic oligonucleotide
agaccttcatccaggagcacctgagcg

SEQ ID NO: 219183 - DNA, 27 bp, Artificial Sequence
  Description of Artificial Sequence: Synthetic oligonucleotide
gaccttcatccaggagcacctgagcgt

SEQ ID NO: 219184 - DNA, 27 bp, Artificial Sequence
  Description of Artificial Sequence: Synthetic oligonucleotide
accttcatccaggagcacctgagcgtc

SEQ ID NO: 219185 - DNA, 27 bp, Artificial Sequence
  Description of Artificial Sequence: Synthetic oligonucleotide
ccttcatccaggagcacctgagcgtca

SEQ ID NO: 219186 - DNA, 29 bp, Artificial Sequence
  Description of Artificial Sequence: Synthetic oligonucleotide
cttcatccaggagcacctgagcgtcattg

SEQ ID NO: 219187 - DNA, 29 bp, Artificial Sequence
  Description of Artificial Sequence: Synthetic oligonucleotide
ttcatccaggagcacctgagcgtcattgg

SEQ ID NO: 219188 - DNA, 28 bp, Artificial Sequence
  Description of Artificial Sequence: Synthetic oligonucleotide
tcatccaggagcacctgagcgtcattgg

SEQ ID NO: 219189 - DNA, 27 bp, Artificial Sequence
  Description of Artificial Sequence: Synthetic oligonucleotide
catccaggagcacctgagcgtcattgg

SEQ ID NO: 219190 - DNA, 27 bp, Artificial Sequence
  Description of Artificial Sequence: Synthetic oligonucleotide
atccaggagcacctgagcgtcattggg

SEQ ID NO: 219191 - DNA, 26 bp, Artificial Sequence
  Description of Artificial Sequence: Synthetic oligonucleotide
tccaggagcacctgagcgtcattggg

SEQ ID NO: 219192 - DNA, 25 bp, Artificial Sequence
  Description of Artificial Sequence: Synthetic oligonucleotide
ccaggagcacctgagcgtcattggg

SEQ ID NO: 219193 - DNA, 25 bp, Artificial Sequence
  Description of Artificial Sequence: Synthetic oligonucleotide
caggagcacctgagcgtcattgggg

SEQ ID NO: 219194 - DNA, 26 bp, Artificial Sequence
  Description of Artificial Sequence: Synthetic oligonucleotide
aggagcacctgagcgtcattggggct

SEQ ID NO: 219195 - DNA, 25 bp, Artificial Sequence
  Description of Artificial Sequence: Synthetic oligonucleotide
ggagcacctgagcgtcattggggct

SEQ ID NO: 219196 - DNA, 26 bp, Artificial Sequence
  Description of Artificial Sequence: Synthetic oligonucleotide
gagcacctgagcgtcattggggctgt

SEQ ID NO: 219197 - DNA, 26 bp, Artificial Sequence
  Description of Artificial Sequence: Synthetic oligonucleotide
agcacctgagcgtcattggggctgtg

SEQ ID NO: 219198 - DNA, 25 bp, Artificial Sequence
  Description of Artificial Sequence: Synthetic oligonucleotide
gcacctgagcgtcattggggctgtg

SEQ ID NO: 219199 - DNA, 25 bp, Artificial Sequence
  Description of Artificial Sequence: Synthetic oligonucleotide
cacctgagcgtcattggggctgtgg

SEQ ID NO: 219200 - DNA, 25 bp, Artificial Sequence
  Description of Artificial Sequence: Synthetic oligonucleotide
acctgagcgtcattggggctgtggg

SEQ ID NO: 219201 - DNA, 24 bp, Artificial Sequence
  Description of Artificial Sequence: Synthetic oligonucleotide
cctgagcgtcattggggctgtggg

SEQ ID NO: 219202 - DNA, 26 bp, Artificial Sequence
  Description of Artificial Sequence: Synthetic oligonucleotide
ctgagcgtcattggggctgtggggat

SEQ ID NO: 219203 - DNA, 26 bp, Artificial Sequence
  Description of Artificial Sequence: Synthetic oligonucleotide
tgagcgtcattggggctgtggggatc

SEQ ID NO: 219204 - DNA, 25 bp, Artificial Sequence
  Description of Artificial Sequence: Synthetic oligonucleotide
gagcgtcattggggctgtggggatc

SEQ ID NO: 219205 - DNA, 25 bp, Artificial Sequence
  Description of Artificial Sequence: Synthetic oligonucleotide
agcgtcattggggctgtggggatcg

SEQ ID NO: 219206 - DNA, 24 bp, Artificial Sequence
  Description of Artificial Sequence: Synthetic oligonucleotide
gcgtcattggggctgtggggatcg

SEQ ID NO: 219207 - DNA, 24 bp, Artificial Sequence
  Description of Artificial Sequence: Synthetic oligonucleotide
cgtcattggggctgtggggatcgg

SEQ ID NO: 219208 - DNA, 32 bp, Artificial Sequence
  Description of Artificial Sequence: Synthetic oligonucleotide
tgtacaggagtctcaagctggagcactactag

SEQ ID NO: 219209 - DNA, 26 bp, Artificial Sequence
  Description of Artificial Sequence: Synthetic oligonucleotide
cctatgccctgacactgaccaaggcg

SEQ ID NO: 219210 - DNA, 26 bp, Artificial Sequence
  Description of Artificial Sequence: Synthetic oligonucleotide
ctatgccctgacactgaccaaggcgc

SEQ ID NO: 219211 - DNA, 27 bp, Artificial Sequence
  Description of Artificial Sequence: Synthetic oligonucleotide
tatgccctgacactgaccaaggcgcct

SEQ ID NO: 219212 - DNA, 26 bp, Artificial Sequence
  Description of Artificial Sequence: Synthetic oligonucleotide
atgccctgacactgaccaaggcgcct

SEQ ID NO: 219213 - DNA, 25 bp, Artificial Sequence
  Description of Artificial Sequence: Synthetic oligonucleotide
tgccctgacactgaccaaggcgcct

SEQ ID NO: 219214 - DNA, 24 bp, Artificial Sequence
  Description of Artificial Sequence: Synthetic oligonucleotide
gccctgacactgaccaaggcgcct

SEQ ID NO: 219215 - DNA, 25 bp, Artificial Sequence
  Description of Artificial Sequence: Synthetic oligonucleotide
ccctgacactgaccaaggcgcctgt

SEQ ID NO: 219216 - DNA, 25 bp, Artificial Sequence
  Description of Artificial Sequence: Synthetic oligonucleotide
cctgacactgaccaaggcgcctgtg

SEQ ID NO: 219217 - DNA, 26 bp, Artificial Sequence
  Description of Artificial Sequence: Synthetic oligonucleotide
ctgacactgaccaaggcgcctgtgga

SEQ ID NO: 219218 - DNA, 26 bp, Artificial Sequence
  Description of Artificial Sequence: Synthetic oligonucleotide
tgacactgaccaaggcgcctgtggac

SEQ ID NO: 219219 - DNA, 25 bp, Artificial Sequence
  Description of Artificial Sequence: Synthetic oligonucleotide
gacactgaccaaggcgcctgtggac

SEQ ID NO: 219220 - DNA, 26 bp, Artificial Sequence
  Description of Artificial Sequence: Synthetic oligonucleotide
acactgaccaaggcgcctgtggacct

SEQ ID NO: 219221 - DNA, 25 bp, Artificial Sequence
  Description of Artificial Sequence: Synthetic oligonucleotide
cactgaccaaggcgcctgtggacct

SEQ ID NO: 219222 - DNA, 25 bp, Artificial Sequence
  Description of Artificial Sequence: Synthetic oligonucleotide
actgaccaaggcgcctgtggacctg

SEQ ID NO: 219223 - DNA, 24 bp, Artificial Sequence
  Description of Artificial Sequence: Synthetic oligonucleotide
ctgaccaaggcgcctgtggacctg

SEQ ID NO: 219224 - DNA, 25 bp, Artificial Sequence
  Description of Artificial Sequence: Synthetic oligonucleotide
tgaccaaggcgcctgtggacctgct

SEQ ID NO: 219225 - DNA, 24 bp, Artificial Sequence
  Description of Artificial Sequence: Synthetic oligonucleotide
gaccaaggcgcctgtggacctgct

SEQ ID NO: 219226 - DNA, 24 bp, Artificial Sequence
  Description of Artificial Sequence: Synthetic oligonucleotide
accaaggcgcctgtggacctgctc

SEQ ID NO: 219227 - DNA, 23 bp, Artificial Sequence
  Description of Artificial Sequence: Synthetic oligonucleotide
ccaaggcgcctgtggacctgctc

SEQ ID NO: 219228 - DNA, 23 bp, Artificial Sequence
  Description of Artificial Sequence: Synthetic oligonucleotide
caaggcgcctgtggacctgctcg

SEQ ID NO: 219229 - DNA, 24 bp, Artificial Sequence
  Description of Artificial Sequence: Synthetic oligonucleotide
aaggcgcctgtggacctgctcggt

SEQ ID NO: 219230 - DNA, 23 bp, Artificial Sequence
  Description of Artificial Sequence: Synthetic oligonucleotide
aggcgcctgtggacctgctcggt

SEQ ID NO: 219231 - DNA, 22 bp, Artificial Sequence
  Description of Artificial Sequence: Synthetic oligonucleotide
ggcgcctgtggacctgctcggt

SEQ ID NO: 219232 - DNA, 24 bp, Artificial Sequence
  Description of Artificial Sequence: Synthetic oligonucleotide
gcgcctgtggacctgctcggtgtt

SEQ ID NO: 219233 - DNA, 24 bp, Artificial Sequence
  Description of Artificial Sequence: Synthetic oligonucleotide
cgcctgtggacctgctcggtgttg

SEQ ID NO: 219234 - DNA, 24 bp, Artificial Sequence
  Description of Artificial Sequence: Synthetic oligonucleotide
gcctgtggacctgctcggtgttgc

SEQ ID NO: 219235 - DNA, 24 bp, Artificial Sequence
  Description of Artificial Sequence: Synthetic oligonucleotide
cctgtggacctgctcggtgttgcc

SEQ ID NO: 219236 - DNA, 25 bp, Artificial Sequence
  Description of Artificial Sequence: Synthetic oligonucleotide
ctgtggacctgctcggtgttgccca

SEQ ID NO: 219237 - DNA, 27 bp, Artificial Sequence
  Description of Artificial Sequence: Synthetic oligonucleotide
tgtggacctgctcggtgttgcccacaa

SEQ ID NO: 219238 - DNA, 26 bp, Artificial Sequence
  Description of Artificial Sequence: Synthetic oligonucleotide
gtggacctgctcggtgttgcccacaa

SEQ ID NO: 219239 - DNA, 27 bp, Artificial Sequence
  Description of Artificial Sequence: Synthetic oligonucleotide
tggacctgctcggtgttgcccacaaca

SEQ ID NO: 219240 - DNA, 27 bp, Artificial Sequence
  Description of Artificial Sequence: Synthetic oligonucleotide
ggacctgctcggtgttgcccacaacaa

SEQ ID NO: 219241 - DNA, 27 bp, Artificial Sequence
  Description of Artificial Sequence: Synthetic oligonucleotide
gacctgctcggtgttgcccacaacaac

SEQ ID NO: 219242 - DNA, 27 bp, Artificial Sequence
  Description of Artificial Sequence: Synthetic oligonucleotide
acctgctcggtgttgcccacaacaacc

SEQ ID NO: 219243 - DNA, 27 bp, Artificial Sequence
  Description of Artificial Sequence: Synthetic oligonucleotide
cctgctcggtgttgcccacaacaacct

SEQ ID NO: 219244 - DNA, 27 bp, Artificial Sequence
  Description of Artificial Sequence: Synthetic oligonucleotide
ctgctcggtgttgcccacaacaacctc

SEQ ID NO: 219245 - DNA, 29 bp, Artificial Sequence
  Description of Artificial Sequence: Synthetic oligonucleotide
tgctcggtgttgcccacaacaacctcatg

SEQ ID NO: 219246 - DNA, 28 bp, Artificial Sequence
  Description of Artificial Sequence: Synthetic oligonucleotide
gctcggtgttgcccacaacaacctcatg

SEQ ID NO: 219247 - DNA, 28 bp, Artificial Sequence
  Description of Artificial Sequence: Synthetic oligonucleotide
ctcggtgttgcccacaacaacctcatgg

SEQ ID NO: 219248 - DNA, 28 bp, Artificial Sequence
  Description of Artificial Sequence: Synthetic oligonucleotide
tcggtgttgcccacaacaacctcatggc

SEQ ID NO: 219249 - DNA, 27 bp, Artificial Sequence
  Description of Artificial Sequence: Synthetic oligonucleotide
cggtgttgcccacaacaacctcatggc

SEQ ID NO: 219250 - DNA, 28 bp, Artificial Sequence
  Description of Artificial Sequence: Synthetic oligonucleotide
gcaaagcagagatggcagaccaggcttc

SEQ ID NO: 219251 - DNA, 28 bp, Artificial Sequence
  Description of Artificial Sequence: Synthetic oligonucleotide
caaagcagagatggcagaccaggcttcg

SEQ ID NO: 219252 - DNA, 28 bp, Artificial Sequence
  Description of Artificial Sequence: Synthetic oligonucleotide
aaagcagagatggcagaccaggcttcgg

SEQ ID NO: 219253 - DNA, 27 bp, Artificial Sequence
  Description of Artificial Sequence: Synthetic oligonucleotide
aagcagagatggcagaccaggcttcgg

SEQ ID NO: 219254 - DNA, 26 bp, Artificial Sequence
  Description of Artificial Sequence: Synthetic oligonucleotide
agcagagatggcagaccaggcttcgg

SEQ ID NO: 219255 - DNA, 25 bp, Artificial Sequence
  Description of Artificial Sequence: Synthetic oligonucleotide
gcagagatggcagaccaggcttcgg

SEQ ID NO: 219256 - DNA, 25 bp, Artificial Sequence
  Description of Artificial Sequence: Synthetic oligonucleotide
cagagatggcagaccaggcttcggc

SEQ ID NO: 219257 - DNA, 26 bp, Artificial Sequence
  Description of Artificial Sequence: Synthetic oligonucleotide
agagatggcagaccaggcttcggcct

SEQ ID NO: 219258 - DNA, 25 bp, Artificial Sequence
  Description of Artificial Sequence: Synthetic oligonucleotide
gagatggcagaccaggcttcggcct

SEQ ID NO: 219259 - DNA, 25 bp, Artificial Sequence
  Description of Artificial Sequence: Synthetic oligonucleotide
agatggcagaccaggcttcggcctg

SEQ ID NO: 219260 - DNA, 24 bp, Artificial Sequence
  Description of Artificial Sequence: Synthetic oligonucleotide
gatggcagaccaggcttcggcctg

SEQ ID NO: 219261 - DNA, 24 bp, Artificial Sequence
  Description of Artificial Sequence: Synthetic oligonucleotide
atggcagaccaggcttcggcctgg

SEQ ID NO: 219262 - DNA, 23 bp, Artificial Sequence
  Description of Artificial Sequence: Synthetic oligonucleotide
tggcagaccaggcttcggcctgg

SEQ ID NO: 219263 - DNA, 22 bp, Artificial Sequence
  Description of Artificial Sequence: Synthetic oligonucleotide
ggcagaccaggcttcggcctgg

SEQ ID NO: 219264 - DNA, 23 bp, Artificial Sequence
  Description of Artificial Sequence: Synthetic oligonucleotide
gcagaccaggcttcggcctggct

SEQ ID NO: 219265 - DNA, 24 bp, Artificial Sequence
  Description of Artificial Sequence: Synthetic oligonucleotide
cagaccaggcttcggcctggctca

SEQ ID NO: 219266 - DNA, 24 bp, Artificial Sequence
  Description of Artificial Sequence: Synthetic oligonucleotide
agaccaggcttcggcctggctcac

SEQ ID NO: 219267 - DNA, 23 bp, Artificial Sequence
  Description of Artificial Sequence: Synthetic oligonucleotide
gaccaggcttcggcctggctcac

SEQ ID NO: 219268 - DNA, 23 bp, Artificial Sequence
  Description of Artificial Sequence: Synthetic oligonucleotide
accaggcttcggcctggctcacc

SEQ ID NO: 219269 - DNA, 22 bp, Artificial Sequence
  Description of Artificial Sequence: Synthetic oligonucleotide
ccaggcttcggcctggctcacc

SEQ ID NO: 219270 - DNA, 22 bp, Artificial Sequence
  Description of Artificial Sequence: Synthetic oligonucleotide
caggcttcggcctggctcaccc

SEQ ID NO: 219271 - DNA, 23 bp, Artificial Sequence
  Description of Artificial Sequence: Synthetic oligonucleotide
aggcttcggcctggctcacccgt

SEQ ID NO: 219272 - DNA, 22 bp, Artificial Sequence
  Description of Artificial Sequence: Synthetic oligonucleotide
ggcttcggcctggctcacccgt

SEQ ID NO: 219273 - DNA, 23 bp, Artificial Sequence
  Description of Artificial Sequence: Synthetic oligonucleotide
gcttcggcctggctcacccgtca

SEQ ID NO: 219274 - DNA, 23 bp, Artificial Sequence
  Description of Artificial Sequence: Synthetic oligonucleotide
cttcggcctggctcacccgtcag

SEQ ID NO: 219275 - DNA, 23 bp, Artificial Sequence
  Description of Artificial Sequence: Synthetic oligonucleotide
ttcggcctggctcacccgtcagg

SEQ ID NO: 219276 - DNA, 22 bp, Artificial Sequence
  Description of Artificial Sequence: Synthetic oligonucleotide
tcggcctggctcacccgtcagg

SEQ ID NO: 219277 - DNA, 21 bp, Artificial Sequence
  Description of Artificial Sequence: Synthetic oligonucleotide
ggcagcccgcgtgcagcagct

SEQ ID NO: 219278 - DNA, 21 bp, Artificial Sequence
  Description of Artificial Sequence: Synthetic oligonucleotide
gcagcccgcgtgcagcagctg

SEQ ID NO: 219279 - DNA, 22 bp, Artificial Sequence
  Description of Artificial Sequence: Synthetic oligonucleotide
cagcccgcgtgcagcagctgga

SEQ ID NO: 219280 - DNA, 23 bp, Artificial Sequence
  Description of Artificial Sequence: Synthetic oligonucleotide
agcccgcgtgcagcagctggact

SEQ ID NO: 219281 - DNA, 22 bp, Artificial Sequence
  Description of Artificial Sequence: Synthetic oligonucleotide
gcccgcgtgcagcagctggact

SEQ ID NO: 219282 - DNA, 22 bp, Artificial Sequence
  Description of Artificial Sequence: Synthetic oligonucleotide
cccgcgtgcagcagctggactg

SEQ ID NO: 219283 - DNA, 22 bp, Artificial Sequence
  Description of Artificial Sequence: Synthetic oligonucleotide
ccgcgtgcagcagctggactgc

SEQ ID NO: 219284 - DNA, 22 bp, Artificial Sequence
  Description of Artificial Sequence: Synthetic oligonucleotide
cgcgtgcagcagctggactgcc

SEQ ID NO: 219285 - DNA, 22 bp, Artificial Sequence
  Description of Artificial Sequence: Synthetic oligonucleotide
gcgtgcagcagctggactgccg

SEQ ID NO: 219286 - DNA, 22 bp, Artificial Sequence
  Description of Artificial Sequence: Synthetic oligonucleotide
cgtgcagcagctggactgccgg

SEQ ID NO: 219287 - DNA, 23 bp, Artificial Sequence
  Description of Artificial Sequence: Synthetic oligonucleotide
gtgcagcagctggactgccggga

SEQ ID NO: 219288 - DNA, 23 bp, Artificial Sequence
  Description of Artificial Sequence: Synthetic oligonucleotide
tgcagcagctggactgccgggag

SEQ ID NO: 219289 - DNA, 22 bp, Artificial Sequence
  Description of Artificial Sequence: Synthetic oligonucleotide
gcagcagctggactgccgggag

SEQ ID NO: 219290 - DNA, 22 bp, Artificial Sequence
  Description of Artificial Sequence: Synthetic oligonucleotide
cagcagctggactgccgggagc

SEQ ID NO: 219291 - DNA, 22 bp, Artificial Sequence
  Description of Artificial Sequence: Synthetic oligonucleotide
agcagctggactgccgggagcc

SEQ ID NO: 219292 - DNA, 21 bp, Artificial Sequence
  Description of Artificial Sequence: Synthetic oligonucleotide
gcagctggactgccgggagcc

SEQ ID NO: 219293 - DNA, 23 bp, Artificial Sequence
  Description of Artificial Sequence: Synthetic oligonucleotide
cagctggactgccgggagccctt

SEQ ID NO: 219294 - DNA, 23 bp, Artificial Sequence
  Description of Artificial Sequence: Synthetic oligonucleotide
agctggactgccgggagcccttc

SEQ ID NO: 219295 - DNA, 22 bp, Artificial Sequence
  Description of Artificial Sequence: Synthetic oligonucleotide
gctggactgccgggagcccttc

SEQ ID NO: 219296 - DNA, 23 bp, Artificial Sequence
  Description of Artificial Sequence: Synthetic oligonucleotide
ctggactgccgggagcccttcct

SEQ ID NO: 219297 - DNA, 24 bp, Artificial Sequence
  Description of Artificial Sequence: Synthetic oligonucleotide
tggactgccgggagcccttcctgt

SEQ ID NO: 219298 - DNA, 33 bp, Artificial Sequence
  Description of Artificial Sequence: Synthetic oligonucleotide
tgtccaaggttctgcagattgagaaggaaggag

SEQ ID NO: 219299 - DNA, 32 bp, Artificial Sequence
  Description of Artificial Sequence: Synthetic oligonucleotide
gtccaaggttctgcagattgagaaggaaggag

SEQ ID NO: 219300 - DNA, 32 bp, Artificial Sequence
  Description of Artificial Sequence: Synthetic oligonucleotide
tccaaggttctgcagattgagaaggaaggagc

SEQ ID NO: 219301 - DNA, 31 bp, Artificial Sequence
  Description of Artificial Sequence: Synthetic oligonucleotide
ccaaggttctgcagattgagaaggaaggagc

SEQ ID NO: 219302 - DNA, 31 bp, Artificial Sequence
  Description of Artificial Sequence: Synthetic oligonucleotide
caaggttctgcagattgagaaggaaggagcc

SEQ ID NO: 219303 - DNA, 33 bp, Artificial Sequence
  Description of Artificial Sequence: Synthetic oligonucleotide
aaggttctgcagattgagaaggaaggagccatc

SEQ ID NO: 219304 - DNA, 32 bp, Artificial Sequence
  Description of Artificial Sequence: Synthetic oligonucleotide
aggttctgcagattgagaaggaaggagccatc

SEQ ID NO: 219305 - DNA, 31 bp, Artificial Sequence
  Description of Artificial Sequence: Synthetic oligonucleotide
ggttctgcagattgagaaggaaggagccatc

SEQ ID NO: 219306 - DNA, 31 bp, Artificial Sequence
  Description of Artificial Sequence: Synthetic oligonucleotide
gttctgcagattgagaaggaaggagccatcc

SEQ ID NO: 219307 - DNA, 34 bp, Artificial Sequence
  Description of Artificial Sequence: Synthetic oligonucleotide
ttctgcagattgagaaggaaggagccatccatag

SEQ ID NO: 219308 - DNA, 33 bp, Artificial Sequence
  Description of Artificial Sequence: Synthetic oligonucleotide
tctgcagattgagaaggaaggagccatccatag

SEQ ID NO: 219309 - DNA, 32 bp, Artificial Sequence
  Description of Artificial Sequence: Synthetic oligonucleotide
ctgcagattgagaaggaaggagccatccatag

SEQ ID NO: 219310 - DNA, 33 bp, Artificial Sequence
  Description of Artificial Sequence: Synthetic oligonucleotide
tgcagattgagaaggaaggagccatccatagag

SEQ ID NO: 219311 - DNA, 32 bp, Artificial Sequence
  Description of Artificial Sequence: Synthetic oligonucleotide
gcagattgagaaggaaggagccatccatagag

SEQ ID NO: 219312 - DNA, 33 bp, Artificial Sequence
  Description of Artificial Sequence: Synthetic oligonucleotide
cagattgagaaggaaggagccatccatagagag

SEQ ID NO: 219313 - DNA, 33 bp, Artificial Sequence
  Description of Artificial Sequence: Synthetic oligonucleotide
agattgagaaggaaggagccatccatagagagg

SEQ ID NO: 219314 - DNA, 32 bp, Artificial Sequence
  Description of Artificial Sequence: Synthetic oligonucleotide
gattgagaaggaaggagccatccatagagagg

SEQ ID NO: 219315 - DNA, 33 bp, Artificial Sequence
  Description of Artificial Sequence: Synthetic oligonucleotide
attgagaaggaaggagccatccatagagaggag

SEQ ID NO: 219316 - DNA, 32 bp, Artificial Sequence
  Description of Artificial Sequence: Synthetic oligonucleotide
ttgagaaggaaggagccatccatagagaggag

SEQ ID NO: 219317 - DNA, 31 bp, Artificial Sequence
  Description of Artificial Sequence: Synthetic oligonucleotide
tgagaaggaaggagccatccatagagaggag

SEQ ID NO: 219318 - DNA, 30 bp, Artificial Sequence
  Description of Artificial Sequence: Synthetic oligonucleotide
gagaaggaaggagccatccatagagaggag

SEQ ID NO: 219319 - DNA, 30 bp, Artificial Sequence
  Description of Artificial Sequence: Synthetic oligonucleotide
agaaggaaggagccatccatagagaggagc

SEQ ID NO: 219320 - DNA, 29 bp, Artificial Sequence
  Description of Artificial Sequence: Synthetic oligonucleotide
gaaggaaggagccatccatagagaggagc

SEQ ID NO: 219321 - DNA, 30 bp, Artificial Sequence
  Description of Artificial Sequence: Synthetic oligonucleotide
aaggaaggagccatccatagagaggagctg

SEQ ID NO: 219322 - DNA, 29 bp, Artificial Sequence
  Description of Artificial Sequence: Synthetic oligonucleotide
aggaaggagccatccatagagaggagctg

SEQ ID NO: 219323 - DNA, 28 bp, Artificial Sequence
  Description of Artificial Sequence: Synthetic oligonucleotide
ggaaggagccatccatagagaggagctg

SEQ ID NO: 219324 - DNA, 28 bp, Artificial Sequence
  Description of Artificial Sequence: Synthetic oligonucleotide
gaaggagccatccatagagaggagctgg

SEQ ID NO: 219325 - DNA, 29 bp, Artificial Sequence
  Description of Artificial Sequence: Synthetic oligonucleotide
aaggagccatccatagagaggagctggtc

SEQ ID NO: 219326 - DNA, 28 bp, Artificial Sequence
  Description of Artificial Sequence: Synthetic oligonucleotide
aggagccatccatagagaggagctggtc

SEQ ID NO: 219327 - DNA, 27 bp, Artificial Sequence
  Description of Artificial Sequence: Synthetic oligonucleotide
ggagccatccatagagaggagctggtc

SEQ ID NO: 219328 - DNA, 30 bp, Artificial Sequence
  Description of Artificial Sequence: Synthetic oligonucleotide
gagccatccatagagaggagctggtctatg

SEQ ID NO: 219329 - DNA, 32 bp, Artificial Sequence
  Description of Artificial Sequence: Synthetic oligonucleotide
agccatccatagagaggagctggtctatgaac

SEQ ID NO: 219330 - DNA, 31 bp, Artificial Sequence
  Description of Artificial Sequence: Synthetic oligonucleotide
acgaggatggctacaggatgaagtttgcctc

SEQ ID NO: 219331 - DNA, 30 bp, Artificial Sequence
  Description of Artificial Sequence: Synthetic oligonucleotide
cgaggatggctacaggatgaagtttgcctc

SEQ ID NO: 219332 - DNA, 32 bp, Artificial Sequence
  Description of Artificial Sequence: Synthetic oligonucleotide
gaggatggctacaggatgaagtttgcctcatg

SEQ ID NO: 219333 - DNA, 33 bp, Artificial Sequence
  Description of Artificial Sequence: Synthetic oligonucleotide
aggatggctacaggatgaagtttgcctcatgag

SEQ ID NO: 219334 - DNA, 32 bp, Artificial Sequence
  Description of Artificial Sequence: Synthetic oligonucleotide
ggatggctacaggatgaagtttgcctcatgag

SEQ ID NO: 219335 - DNA, 32 bp, Artificial Sequence
  Description of Artificial Sequence: Synthetic oligonucleotide
gatggctacaggatgaagtttgcctcatgagc

SEQ ID NO: 219336 - DNA, 33 bp, Artificial Sequence
  Description of Artificial Sequence: Synthetic oligonucleotide
atggctacaggatgaagtttgcctcatgagctg

SEQ ID NO: 219337 - DNA, 32 bp, Artificial Sequence
  Description of Artificial Sequence: Synthetic oligonucleotide
tggctacaggatgaagtttgcctcatgagctg

SEQ ID NO: 219338 - DNA, 31 bp, Artificial Sequence
  Description of Artificial Sequence: Synthetic oligonucleotide
ggctacaggatgaagtttgcctcatgagctg

SEQ ID NO: 219339 - DNA, 33 bp, Artificial Sequence
  Description of Artificial Sequence: Synthetic oligonucleotide
gctacaggatgaagtttgcctcatgagctgttg

SEQ ID NO: 219340 - DNA, 34 bp, Artificial Sequence
  Description of Artificial Sequence: Synthetic oligonucleotide
ctacaggatgaagtttgcctcatgagctgttgtc

SEQ ID NO: 219341 - DNA, 34 bp, Artificial Sequence
  Description of Artificial Sequence: Synthetic oligonucleotide
tacaggatgaagtttgcctcatgagctgttgtcc

SEQ ID NO: 219342 - DNA, 33 bp, Artificial Sequence
  Description of Artificial Sequence: Synthetic oligonucleotide
acaggatgaagtttgcctcatgagctgttgtcc

SEQ ID NO: 219343 - DNA, 32 bp, Artificial Sequence
  Description of Artificial Sequence: Synthetic oligonucleotide
caggatgaagtttgcctcatgagctgttgtcc

SEQ ID NO: 219344 - DNA, 33 bp, Artificial Sequence
  Description of Artificial Sequence: Synthetic oligonucleotide
aggatgaagtttgcctcatgagctgttgtccag

SEQ ID NO: 219345 - DNA, 32 bp, Artificial Sequence
  Description of Artificial Sequence: Synthetic oligonucleotide
ggatgaagtttgcctcatgagctgttgtccag

SEQ ID NO: 219346 - DNA, 32 bp, Artificial Sequence
  Description of Artificial Sequence: Synthetic oligonucleotide
gatgaagtttgcctcatgagctgttgtccagc

SEQ ID NO: 219347 - DNA, 34 bp, Artificial Sequence
  Description of Artificial Sequence: Synthetic oligonucleotide
atgaagtttgcctcatgagctgttgtccagctac

SEQ ID NO: 219348 - DNA, 33 bp, Artificial Sequence
  Description of Artificial Sequence: Synthetic oligonucleotide
tgaagtttgcctcatgagctgttgtccagctac

SEQ ID NO: 219349 - DNA, 32 bp, Artificial Sequence
  Description of Artificial Sequence: Synthetic oligonucleotide
gaagtttgcctcatgagctgttgtccagctac

SEQ ID NO: 219350 - DNA, 33 bp, Artificial Sequence
  Description of Artificial Sequence: Synthetic oligonucleotide
aagtttgcctcatgagctgttgtccagctacac

SEQ ID NO: 219351 - DNA, 32 bp, Artificial Sequence
  Description of Artificial Sequence: Synthetic oligonucleotide
agtttgcctcatgagctgttgtccagctacac

SEQ ID NO: 219352 - DNA, 31 bp, Artificial Sequence
  Description of Artificial Sequence: Synthetic oligonucleotide
gtttgcctcatgagctgttgtccagctacac

SEQ ID NO: 219353 - DNA, 31 bp, Artificial Sequence
  Description of Artificial Sequence: Synthetic oligonucleotide
tttgcctcatgagctgttgtccagctacacc

SEQ ID NO: 219354 - DNA, 24 bp, Artificial Sequence
  Description of Artificial Sequence: Synthetic oligonucleotide
aaggtggggctgtctggcatggcc

SEQ ID NO: 219355 - DNA, 32 bp, Artificial Sequence
  Description of Artificial Sequence: Synthetic oligonucleotide
cctctacgttgctgcagccatcattgagtmtc

SEQ ID NO: 219356 - DNA, 32 bp, Artificial Sequence
  Description of Artificial Sequence: Synthetic oligonucleotide
ctctacgttgctgcagccatcattgagtmtcc

SEQ ID NO: 219357 - DNA, 33 bp, Artificial Sequence
  Description of Artificial Sequence: Synthetic oligonucleotide
tctacgttgctgcagccatcattgagtmtccag

SEQ ID NO: 219358 - DNA, 31 bp, Artificial Sequence
  Description of Artificial Sequence: Synthetic oligonucleotide
cctccttctactttgtggccttctactaccc

SEQ ID NO: 219359 - DNA, 32 bp, Artificial Sequence
  Description of Artificial Sequence: Synthetic oligonucleotide
ctccttctactttgtggccttctactaccctg

SEQ ID NO: 219360 - DNA, 32 bp, Artificial Sequence
  Description of Artificial Sequence: Synthetic oligonucleotide
tccttctactttgtggccttctactaccctgg

SEQ ID NO: 219361 - DNA, 31 bp, Artificial Sequence
  Description of Artificial Sequence: Synthetic oligonucleotide
ccttctactttgtggccttctactaccctgg

SEQ ID NO: 219362 - DNA, 32 bp, Artificial Sequence
  Description of Artificial Sequence: Synthetic oligonucleotide
cttctactttgtggccttctactaccctggag

SEQ ID NO: 219363 - DNA, 33 bp, Artificial Sequence
  Description of Artificial Sequence: Synthetic oligonucleotide
ttctactttgtggccttctactaccctggagac

SEQ ID NO: 219364 - DNA, 32 bp, Artificial Sequence
  Description of Artificial Sequence: Synthetic oligonucleotide
tctactttgtggccttctactaccctggagac

SEQ ID NO: 219365 - DNA, 31 bp, Artificial Sequence
  Description of Artificial Sequence: Synthetic oligonucleotide
ctactttgtggccttctactaccctggagac

SEQ ID NO: 219366 - DNA, 31 bp, Artificial Sequence
  Description of Artificial Sequence: Synthetic oligonucleotide
tactttgtggccttctactaccctggagacc

SEQ ID NO: 219367 - DNA, 30 bp, Artificial Sequence
  Description of Artificial Sequence: Synthetic oligonucleotide
actttgtggccttctactaccctggagacc

SEQ ID NO: 219368 - DNA, 29 bp, Artificial Sequence
  Description of Artificial Sequence: Synthetic oligonucleotide
ctttgtggccttctactaccctggagacc

SEQ ID NO: 219369 - DNA, 30 bp, Artificial Sequence
  Description of Artificial Sequence: Synthetic oligonucleotide
tttgtggccttctactaccctggagaccac

SEQ ID NO: 219370 - DNA, 29 bp, Artificial Sequence
  Description of Artificial Sequence: Synthetic oligonucleotide
ttgtggccttctactaccctggagaccac

SEQ ID NO: 219371 - DNA, 28 bp, Artificial Sequence
  Description of Artificial Sequence: Synthetic oligonucleotide
tgtggccttctactaccctggagaccac

SEQ ID NO: 219372 - DNA, 27 bp, Artificial Sequence
  Description of Artificial Sequence: Synthetic oligonucleotide
gtggccttctactaccctggagaccac

SEQ ID NO: 219373 - DNA, 27 bp, Artificial Sequence
  Description of Artificial Sequence: Synthetic oligonucleotide
tggccttctactaccctggagaccacc

SEQ ID NO: 219374 - DNA, 26 bp, Artificial Sequence
  Description of Artificial Sequence: Synthetic oligonucleotide
ggccttctactaccctggagaccacc

SEQ ID NO: 219375 - DNA, 27 bp, Artificial Sequence
  Description of Artificial Sequence: Synthetic oligonucleotide
gccttctactaccctggagaccaccca

SEQ ID NO: 219376 - DNA, 27 bp, Artificial Sequence
  Description of Artificial Sequence: Synthetic oligonucleotide
ccttctactaccctggagaccacccag

SEQ ID NO: 219377 - DNA, 28 bp, Artificial Sequence
  Description of Artificial Sequence: Synthetic oligonucleotide
cttctactaccctggagaccacccagtg

SEQ ID NO: 219378 - DNA, 28 bp, Artificial Sequence
  Description of Artificial Sequence: Synthetic oligonucleotide
ttctactaccctggagaccacccagtgg

SEQ ID NO: 219379 - DNA, 27 bp, Artificial Sequence
  Description of Artificial Sequence: Synthetic oligonucleotide
tctactaccctggagaccacccagtgg

SEQ ID NO: 219380 - DNA, 26 bp, Artificial Sequence
  Description of Artificial Sequence: Synthetic oligonucleotide
ctactaccctggagaccacccagtgg

SEQ ID NO: 219381 - DNA, 26 bp, Artificial Sequence
  Description of Artificial Sequence: Synthetic oligonucleotide
tactaccctggagaccacccagtggc

SEQ ID NO: 219382 - DNA, 25 bp, Artificial Sequence
  Description of Artificial Sequence: Synthetic oligonucleotide
actaccctggagaccacccagtggc

SEQ ID NO: 219383 - DNA, 24 bp, Artificial Sequence
  Description of Artificial Sequence: Synthetic oligonucleotide
ctaccctggagaccacccagtggc

SEQ ID NO: 219384 - DNA, 26 bp, Artificial Sequence
  Description of Artificial Sequence: Synthetic oligonucleotide
taccctggagaccacccagtggccaa

SEQ ID NO: 219385 - DNA, 25 bp, Artificial Sequence
  Description of Artificial Sequence: Synthetic oligonucleotide
accctggagaccacccagtggccaa

SEQ ID NO: 219386 - DNA, 24 bp, Artificial Sequence
  Description of Artificial Sequence: Synthetic oligonucleotide
ccctggagaccacccagtggccaa

SEQ ID NO: 219387 - DNA, 25 bp, Artificial Sequence
  Description of Artificial Sequence: Synthetic oligonucleotide
cctggagaccacccagtggccaact

SEQ ID NO: 219388 - DNA, 25 bp, Artificial Sequence
  Description of Artificial Sequence: Synthetic oligonucleotide
ctggagaccacccagtggccaactc

SEQ ID NO: 219389 - DNA, 29 bp, Artificial Sequence
  Description of Artificial Sequence: Synthetic oligonucleotide
ggcttccaggttaaggttctccgagaagg

SEQ ID NO: 219390 - DNA, 29 bp, Artificial Sequence
  Description of Artificial Sequence: Synthetic oligonucleotide
gcttccaggttaaggttctccgagaaggc

SEQ ID NO: 219391 - DNA, 30 bp, Artificial Sequence
  Description of Artificial Sequence: Synthetic oligonucleotide
cttccaggttaaggttctccgagaaggcag

SEQ ID NO: 219392 - DNA, 30 bp, Artificial Sequence
  Description of Artificial Sequence: Synthetic oligonucleotide
ttccaggttaaggttctccgagaaggcagc

SEQ ID NO: 219393 - DNA, 29 bp, Artificial Sequence
  Description of Artificial Sequence: Synthetic oligonucleotide
tccaggttaaggttctccgagaaggcagc

SEQ ID NO: 219394 - DNA, 28 bp, Artificial Sequence
  Description of Artificial Sequence: Synthetic oligonucleotide
ccaggttaaggttctccgagaaggcagc

SEQ ID NO: 219395 - DNA, 29 bp, Artificial Sequence
  Description of Artificial Sequence: Synthetic oligonucleotide
caggttaaggttctccgagaaggcagcag

SEQ ID NO: 219396 - DNA, 30 bp, Artificial Sequence
  Description of Artificial Sequence: Synthetic oligonucleotide
aggttaaggttctccgagaaggcagcagag

SEQ ID NO: 219397 - DNA, 29 bp, Artificial Sequence
  Description of Artificial Sequence: Synthetic oligonucleotide
ggttaaggttctccgagaaggcagcagag

SEQ ID NO: 219398 - DNA, 29 bp, Artificial Sequence
  Description of Artificial Sequence: Synthetic oligonucleotide
gttaaggttctccgagaaggcagcagagc

SEQ ID NO: 219399 - DNA, 30 bp, Artificial Sequence
  Description of Artificial Sequence: Synthetic oligonucleotide
ttaaggttctccgagaaggcagcagagctg

SEQ ID NO: 219400 - DNA, 29 bp, Artificial Sequence
  Description of Artificial Sequence: Synthetic oligonucleotide
taaggttctccgagaaggcagcagagctg

SEQ ID NO: 219401 - DNA, 28 bp, Artificial Sequence
  Description of Artificial Sequence: Synthetic oligonucleotide
aaggttctccgagaaggcagcagagctg

SEQ ID NO: 219402 - DNA, 27 bp, Artificial Sequence
  Description of Artificial Sequence: Synthetic oligonucleotide
aggttctccgagaaggcagcagagctg

SEQ ID NO: 219403 - DNA, 26 bp, Artificial Sequence
  Description of Artificial Sequence: Synthetic oligonucleotide
ggttctccgagaaggcagcagagctg

SEQ ID NO: 219404 - DNA, 27 bp, Artificial Sequence
  Description of Artificial Sequence: Synthetic oligonucleotide
gttctccgagaaggcagcagagctgct

SEQ ID NO: 219405 - DNA, 29 bp, Artificial Sequence
  Description of Artificial Sequence: Synthetic oligonucleotide
ttctccgagaaggcagcagagctgctttc

SEQ ID NO: 219406 - DNA, 28 bp, Artificial Sequence
  Description of Artificial Sequence: Synthetic oligonucleotide
tctccgagaaggcagcagagctgctttc

SEQ ID NO: 219407 - DNA, 27 bp, Artificial Sequence
  Description of Artificial Sequence: Synthetic oligonucleotide
ctccgagaaggcagcagagctgctttc

SEQ ID NO: 219408 - DNA, 27 bp, Artificial Sequence
  Description of Artificial Sequence: Synthetic oligonucleotide
tccgagaaggcagcagagctgctttcc

SEQ ID NO: 219409 - DNA, 26 bp, Artificial Sequence
  Description of Artificial Sequence: Synthetic oligonucleotide
ccgagaaggcagcagagctgctttcc

SEQ ID NO: 219410 - DNA, 26 bp, Artificial Sequence
  Description of Artificial Sequence: Synthetic oligonucleotide
cgagaaggcagcagagctgctttccg

SEQ ID NO: 219411 - DNA, 26 bp, Artificial Sequence
  Description of Artificial Sequence: Synthetic oligonucleotide
gagaaggcagcagagctgctttccgc

SEQ ID NO: 219412 - DNA, 27 bp, Artificial Sequence
  Description of Artificial Sequence: Synthetic oligonucleotide
agaaggcagcagagctgctttccgcct

SEQ ID NO: 219413 - DNA, 26 bp, Artificial Sequence
  Description of Artificial Sequence: Synthetic oligonucleotide
gaaggcagcagagctgctttccgcct

SEQ ID NO: 219414 - DNA, 27 bp, Artificial Sequence
  Description of Artificial Sequence: Synthetic oligonucleotide
aaggcagcagagctgctttccgcctct

SEQ ID NO: 219415 - DNA, 27 bp, Artificial Sequence
  Description of Artificial Sequence: Synthetic oligonucleotide
aggcagcagagctgctttccgcctctt

SEQ ID NO: 219416 - DNA, 27 bp, Artificial Sequence
  Description of Artificial Sequence: Synthetic oligonucleotide
ggcagcagagctgctttccgcctcttt

SEQ ID NO: 219417 - DNA, 27 bp, Artificial Sequence
  Description of Artificial Sequence: Synthetic oligonucleotide
gcagcagagctgctttccgcctctttg

SEQ ID NO: 219418 - DNA, 25 bp, Artificial Sequence
  Description of Artificial Sequence: Synthetic oligonucleotide
ggacacccccagtacctgctggagt

SEQ ID NO: 219419 - DNA, 25 bp, Artificial Sequence
  Description of Artificial Sequence: Synthetic oligonucleotide
gacacccccagtacctgctggagtc

SEQ ID NO: 219420 - DNA, 27 bp, Artificial Sequence
  Description of Artificial Sequence: Synthetic oligonucleotide
acacccccagtacctgctggagtcgaa

SEQ ID NO: 219421 - DNA, 27 bp, Artificial Sequence
  Description of Artificial Sequence: Synthetic oligonucleotide
cacccccagtacctgctggagtcgaat

SEQ ID NO: 219422 - DNA, 28 bp, Artificial Sequence
  Description of Artificial Sequence: Synthetic oligonucleotide
acccccagtacctgctggagtcgaatag

SEQ ID NO: 219423 - DNA, 27 bp, Artificial Sequence
  Description of Artificial Sequence: Synthetic oligonucleotide
cccccagtacctgctggagtcgaatag

SEQ ID NO: 219424 - DNA, 27 bp, Artificial Sequence
  Description of Artificial Sequence: Synthetic oligonucleotide
ccccagtacctgctggagtcgaatagc

SEQ ID NO: 219425 - DNA, 28 bp, Artificial Sequence
  Description of Artificial Sequence: Synthetic oligonucleotide
cccagtacctgctggagtcgaatagctg

SEQ ID NO: 219426 - DNA, 28 bp, Artificial Sequence
  Description of Artificial Sequence: Synthetic oligonucleotide
ccagtacctgctggagtcgaatagctgg

SEQ ID NO: 219427 - DNA, 30 bp, Artificial Sequence
  Description of Artificial Sequence: Synthetic oligonucleotide
cagtacctgctggagtcgaatagctggatc

SEQ ID NO: 219428 - DNA, 30 bp, Artificial Sequence
  Description of Artificial Sequence: Synthetic oligonucleotide
agtacctgctggagtcgaatagctggatcg

SEQ ID NO: 219429 - DNA, 29 bp, Artificial Sequence
  Description of Artificial Sequence: Synthetic oligonucleotide
gtacctgctggagtcgaatagctggatcg

SEQ ID NO: 219430 - DNA, 30 bp, Artificial Sequence
  Description of Artificial Sequence: Synthetic oligonucleotide
tacctgctggagtcgaatagctggatcgag

SEQ ID NO: 219431 - DNA, 29 bp, Artificial Sequence
  Description of Artificial Sequence: Synthetic oligonucleotide
acctgctggagtcgaatagctggatcgag

SEQ ID NO: 219432 - DNA, 28 bp, Artificial Sequence
  Description of Artificial Sequence: Synthetic oligonucleotide
cctgctggagtcgaatagctggatcgag

SEQ ID NO: 219433 - DNA, 28 bp, Artificial Sequence
  Description of Artificial Sequence: Synthetic oligonucleotide
ctgctggagtcgaatagctggatcgagg

SEQ ID NO: 219434 - DNA, 29 bp, Artificial Sequence
  Description of Artificial Sequence: Synthetic oligonucleotide
tgctggagtcgaatagctggatcgaggag

SEQ ID NO: 219435 - DNA, 28 bp, Artificial Sequence
  Description of Artificial Sequence: Synthetic oligonucleotide
gctggagtcgaatagctggatcgaggag

SEQ ID NO: 219436 - DNA, 30 bp, Artificial Sequence
  Description of Artificial Sequence: Synthetic oligonucleotide
ctggagtcgaatagctggatcgaggagatg

SEQ ID NO: 219437 - DNA, 30 bp, Artificial Sequence
  Description of Artificial Sequence: Synthetic oligonucleotide
tggagtcgaatagctggatcgaggagatgc

SEQ ID NO: 219438 - DNA, 29 bp, Artificial Sequence
  Description of Artificial Sequence: Synthetic oligonucleotide
ggagtcgaatagctggatcgaggagatgc

SEQ ID NO: 219439 - DNA, 29 bp, Artificial Sequence
  Description of Artificial Sequence: Synthetic oligonucleotide
gagtcgaatagctggatcgaggagatgcc

SEQ ID NO: 219440 - DNA, 29 bp, Artificial Sequence
  Description of Artificial Sequence: Synthetic oligonucleotide
agtcgaatagctggatcgaggagatgccc

SEQ ID NO: 219441 - DNA, 28 bp, Artificial Sequence
  Description of Artificial Sequence: Synthetic oligonucleotide
gtcgaatagctggatcgaggagatgccc

SEQ ID NO: 219442 - DNA, 25 bp, Artificial Sequence
  Description of Artificial Sequence: Synthetic oligonucleotide
tgtggtcctgggggtggggacagtt

SEQ ID NO: 219443 - DNA, 24 bp, Artificial Sequence
  Description of Artificial Sequence: Synthetic oligonucleotide
gtggtcctgggggtggggacagtt

SEQ ID NO: 219444 - DNA, 24 bp, Artificial Sequence
  Description of Artificial Sequence: Synthetic oligonucleotide
tggtcctgggggtggggacagttc

SEQ ID NO: 219445 - DNA, 23 bp, Artificial Sequence
  Description of Artificial Sequence: Synthetic oligonucleotide
ggtcctgggggtggggacagttc

SEQ ID NO: 219446 - DNA, 23 bp, Artificial Sequence
  Description of Artificial Sequence: Synthetic oligonucleotide
gtcctgggggtggggacagttcc

SEQ ID NO: 219447 - DNA, 25 bp, Artificial Sequence
  Description of Artificial Sequence: Synthetic oligonucleotide
tcctgggggtggggacagttccctt

SEQ ID NO: 219448 - DNA, 24 bp, Artificial Sequence
  Description of Artificial Sequence: Synthetic oligonucleotide
cctgggggtggggacagttccctt

SEQ ID NO: 219449 - DNA, 25 bp, Artificial Sequence
  Description of Artificial Sequence: Synthetic oligonucleotide
ctgggggtggggacagttcccttca

SEQ ID NO: 219450 - DNA, 25 bp, Artificial Sequence
  Description of Artificial Sequence: Synthetic oligonucleotide
tgggggtggggacagttcccttcag

SEQ ID NO: 219451 - DNA, 24 bp, Artificial Sequence
  Description of Artificial Sequence: Synthetic oligonucleotide
gggggtggggacagttcccttcag

SEQ ID NO: 219452 - DNA, 25 bp, Artificial Sequence
  Description of Artificial Sequence: Synthetic oligonucleotide
ggggtggggacagttcccttcaggt

SEQ ID NO: 219453 - DNA, 27 bp, Artificial Sequence
  Description of Artificial Sequence: Synthetic oligonucleotide
gggtggggacagttcccttcaggtgtt

SEQ ID NO: 219454 - DNA, 27 bp, Artificial Sequence
  Description of Artificial Sequence: Synthetic oligonucleotide
ggtggggacagttcccttcaggtgttc

SEQ ID NO: 219455 - DNA, 27 bp, Artificial Sequence
  Description of Artificial Sequence: Synthetic oligonucleotide
gtggggacagttcccttcaggtgttcc

SEQ ID NO: 219456 - DNA, 28 bp, Artificial Sequence
  Description of Artificial Sequence: Synthetic oligonucleotide
tggggacagttcccttcaggtgttccag

SEQ ID NO: 219457 - DNA, 27 bp, Artificial Sequence
  Description of Artificial Sequence: Synthetic oligonucleotide
ggggacagttcccttcaggtgttccag

SEQ ID NO: 219458 - DNA, 27 bp, Artificial Sequence
  Description of Artificial Sequence: Synthetic oligonucleotide
gggacagttcccttcaggtgttccagg

SEQ ID NO: 219459 - DNA, 27 bp, Artificial Sequence
  Description of Artificial Sequence: Synthetic oligonucleotide
ggacagttcccttcaggtgttccaggc

SEQ ID NO: 219460 - DNA, 28 bp, Artificial Sequence
  Description of Artificial Sequence: Synthetic oligonucleotide
gacagttcccttcaggtgttccaggcag

SEQ ID NO: 219461 - DNA, 28 bp, Artificial Sequence
  Description of Artificial Sequence: Synthetic oligonucleotide
acagttcccttcaggtgttccaggcagc

SEQ ID NO: 219462 - DNA, 27 bp, Artificial Sequence
  Description of Artificial Sequence: Synthetic oligonucleotide
cagttcccttcaggtgttccaggcagc

SEQ ID NO: 219463 - DNA, 27 bp, Artificial Sequence
  Description of Artificial Sequence: Synthetic oligonucleotide
agttcccttcaggtgttccaggcagcg

SEQ ID NO: 219464 - DNA, 26 bp, Artificial Sequence
  Description of Artificial Sequence: Synthetic oligonucleotide
gttcccttcaggtgttccaggcagcg

SEQ ID NO: 219465 - DNA, 26 bp, Artificial Sequence
  Description of Artificial Sequence: Synthetic oligonucleotide
ttcccttcaggtgttccaggcagcgg

SEQ ID NO: 219466 - DNA, 25 bp, Artificial Sequence
  Description of Artificial Sequence: Synthetic oligonucleotide
tcccttcaggtgttccaggcagcgg

SEQ ID NO: 219467 - DNA, 22 bp, Artificial Sequence
  Description of Artificial Sequence: Synthetic oligonucleotide
cgcgtgcagcagccggactgct

SEQ ID NO: 219468 - DNA, 22 bp, Artificial Sequence
  Description of Artificial Sequence: Synthetic oligonucleotide
gcgtgcagcagccggactgctg

SEQ ID NO: 219469 - DNA, 22 bp, Artificial Sequence
  Description of Artificial Sequence: Synthetic oligonucleotide
cgtgcagcagccggactgctgg

SEQ ID NO: 219470 - DNA, 23 bp, Artificial Sequence
  Description of Artificial Sequence: Synthetic oligonucleotide
gtgcagcagccggactgctggga

SEQ ID NO: 219471 - DNA, 23 bp, Artificial Sequence
  Description of Artificial Sequence: Synthetic oligonucleotide
tgcagcagccggactgctgggag

SEQ ID NO: 219472 - DNA, 22 bp, Artificial Sequence
  Description of Artificial Sequence: Synthetic oligonucleotide
gcagcagccggactgctgggag

SEQ ID NO: 219473 - DNA, 22 bp, Artificial Sequence
  Description of Artificial Sequence: Synthetic oligonucleotide
cagcagccggactgctgggagc

SEQ ID NO: 219474 - DNA, 22 bp, Artificial Sequence
  Description of Artificial Sequence: Synthetic oligonucleotide
agcagccggactgctgggagcc

SEQ ID NO: 219475 - DNA, 21 bp, Artificial Sequence
  Description of Artificial Sequence: Synthetic oligonucleotide
gcagccggactgctgggagcc

SEQ ID NO: 219476 - DNA, 23 bp, Artificial Sequence
  Description of Artificial Sequence: Synthetic oligonucleotide
cagccggactgctgggagccctt

SEQ ID NO: 219477 - DNA, 23 bp, Artificial Sequence
  Description of Artificial Sequence: Synthetic oligonucleotide
agccggactgctgggagcccttc

SEQ ID NO: 219478 - DNA, 22 bp, Artificial Sequence
  Description of Artificial Sequence: Synthetic oligonucleotide
gccggactgctgggagcccttc

SEQ ID NO: 219479 - DNA, 23 bp, Artificial Sequence
  Description of Artificial Sequence: Synthetic oligonucleotide
ccggactgctgggagcccttcct

SEQ ID NO: 219480 - DNA, 24 bp, Artificial Sequence
  Description of Artificial Sequence: Synthetic oligonucleotide
cggactgctgggagcccttcctgt

SEQ ID NO: 219481 - DNA, 24 bp, Artificial Sequence
  Description of Artificial Sequence: Synthetic oligonucleotide
ggactgctgggagcccttcctgtc

SEQ ID NO: 219482 - DNA, 25 bp, Artificial Sequence
  Description of Artificial Sequence: Synthetic oligonucleotide
gactgctgggagcccttcctgtcct

SEQ ID NO: 219483 - DNA, 25 bp, Artificial Sequence
  Description of Artificial Sequence: Synthetic oligonucleotide
actgctgggagcccttcctgtcctg

SEQ ID NO: 219484 - DNA, 24 bp, Artificial Sequence
  Description of Artificial Sequence: Synthetic oligonucleotide
ctgctgggagcccttcctgtcctg

SEQ ID NO: 219485 - DNA, 25 bp, Artificial Sequence
  Description of Artificial Sequence: Synthetic oligonucleotide
tgctgggagcccttcctgtcctgct

SEQ ID NO: 219486 - DNA, 24 bp, Artificial Sequence
  Description of Artificial Sequence: Synthetic oligonucleotide
gctgggagcccttcctgtcctgct

SEQ ID NO: 219487 - DNA, 24 bp, Artificial Sequence
  Description of Artificial Sequence: Synthetic oligonucleotide
ctgggagcccttcctgtcctgctg

SEQ ID NO: 219488 - DNA, 24 bp, Artificial Sequence
  Description of Artificial Sequence: Synthetic oligonucleotide
tgggagcccttcctgtcctgctgc

SEQ ID NO: 219489 - DNA, 37 bp, Artificial Sequence
  Description of Artificial Sequence: Synthetic oligonucleotide
tccatctcaaaggcaaactcatttttgggggagatag

SEQ ID NO: 219490 - DNA, 36 bp, Artificial Sequence
  Description of Artificial Sequence: Synthetic oligonucleotide
ccatctcaaaggcaaactcatttttgggggagatag

SEQ ID NO: 219491 - DNA, 36 bp, Artificial Sequence
  Description of Artificial Sequence: Synthetic oligonucleotide
catctcaaaggcaaactcatttttgggggagatagc

SEQ ID NO: 219492 - DNA, 38 bp, Artificial Sequence
  Description of Artificial Sequence: Synthetic oligonucleotide
atctcaaaggcaaactcatttttgggggagatagcaag

SEQ ID NO: 219493 - DNA, 37 bp, Artificial Sequence
  Description of Artificial Sequence: Synthetic oligonucleotide
tctcaaaggcaaactcatttttgggggagatagcaag

SEQ ID NO: 219494 - DNA, 36 bp, Artificial Sequence
  Description of Artificial Sequence: Synthetic oligonucleotide
ctcaaaggcaaactcatttttgggggagatagcaag

SEQ ID NO: 219495 - DNA, 37 bp, Artificial Sequence
  Description of Artificial Sequence: Synthetic oligonucleotide
tcaaaggcaaactcatttttgggggagatagcaagtg

SEQ ID NO: 219496 - DNA, 36 bp, Artificial Sequence
  Description of Artificial Sequence: Synthetic oligonucleotide
caaaggcaaactcatttttgggggagatagcaagtg

SEQ ID NO: 219497 - DNA, 36 bp, Artificial Sequence
  Description of Artificial Sequence: Synthetic oligonucleotide
aaaggcaaactcatttttgggggagatagcaagtgc

SEQ ID NO: 219498 - DNA, 35 bp, Artificial Sequence
  Description of Artificial Sequence: Synthetic oligonucleotide
aaggcaaactcatttttgggggagatagcaagtgc

SEQ ID NO: 219499 - DNA, 34 bp, Artificial Sequence
  Description of Artificial Sequence: Synthetic oligonucleotide
aggcaaactcatttttgggggagatagcaagtgc

SEQ ID NO: 219500 - DNA, 33 bp, Artificial Sequence
  Description of Artificial Sequence: Synthetic oligonucleotide
ggcaaactcatttttgggggagatagcaagtgc

SEQ ID NO: 219501 - DNA, 34 bp, Artificial Sequence
  Description of Artificial Sequence: Synthetic oligonucleotide
gcaaactcatttttgggggagatagcaagtgctg

SEQ ID NO: 219502 - DNA, 34 bp, Artificial Sequence
  Description of Artificial Sequence: Synthetic oligonucleotide
caaactcatttttgggggagatagcaagtgctgg

SEQ ID NO: 219503 - DNA, 34 bp, Artificial Sequence
  Description of Artificial Sequence: Synthetic oligonucleotide
aaactcatttttgggggagatagcaagtgctggg

SEQ ID NO: 219504 - DNA, 33 bp, Artificial Sequence
  Description of Artificial Sequence: Synthetic oligonucleotide
aactcatttttgggggagatagcaagtgctggg

SEQ ID NO: 219505 - DNA, 32 bp, Artificial Sequence
  Description of Artificial Sequence: Synthetic oligonucleotide
actcatttttgggggagatagcaagtgctggg

SEQ ID NO: 219506 - DNA, 31 bp, Artificial Sequence
  Description of Artificial Sequence: Synthetic oligonucleotide
ctcatttttgggggagatagcaagtgctggg

SEQ ID NO: 219507 - DNA, 31 bp, Artificial Sequence
  Description of Artificial Sequence: Synthetic oligonucleotide
tcatttttgggggagatagcaagtgctgggc

SEQ ID NO: 219508 - DNA, 30 bp, Artificial Sequence
  Description of Artificial Sequence: Synthetic oligonucleotide
catttttgggggagatagcaagtgctgggc

SEQ ID NO: 219509 - DNA, 31 bp, Artificial Sequence
  Description of Artificial Sequence: Synthetic oligonucleotide
atttttgggggagatagcaagtgctgggctc

SEQ ID NO: 219510 - DNA, 30 bp, Artificial Sequence
  Description of Artificial Sequence: Synthetic oligonucleotide
tttttgggggagatagcaagtgctgggctc

SEQ ID NO: 219511 - DNA, 29 bp, Artificial Sequence
  Description of Artificial Sequence: Synthetic oligonucleotide
ttttgggggagatagcaagtgctgggctc

SEQ ID NO: 219512 - DNA, 28 bp, Artificial Sequence
  Description of Artificial Sequence: Synthetic oligonucleotide
tttgggggagatagcaagtgctgggctc

SEQ ID NO: 219513 - DNA, 27 bp, Artificial Sequence
  Description of Artificial Sequence: Synthetic oligonucleotide
ttgggggagatagcaagtgctgggctc

SEQ ID NO: 219514 - DNA, 26 bp, Artificial Sequence
  Description of Artificial Sequence: Synthetic oligonucleotide
tgggggagatagcaagtgctgggctc

SEQ ID NO: 219515 - DNA, 25 bp, Artificial Sequence
  Description of Artificial Sequence: Synthetic oligonucleotide
gggggagatagcaagtgctgggctc

SEQ ID NO: 219516 - DNA, 26 bp, Artificial Sequence
  Description of Artificial Sequence: Synthetic oligonucleotide
ggggagatagcaagtgctgggctcct

SEQ ID NO: 219517 - DNA, 26 bp, Artificial Sequence
  Description of Artificial Sequence: Synthetic oligonucleotide
gggagatagcaagtgctgggctcctg

SEQ ID NO: 219518 - DNA, 26 bp, Artificial Sequence
  Description of Artificial Sequence: Synthetic oligonucleotide
ggagatagcaagtgctgggctcctgg

SEQ ID NO: 219519 - DNA, 27 bp, Artificial Sequence
  Description of Artificial Sequence: Synthetic oligonucleotide
gagatagcaagtgctgggctcctgggt

SEQ ID NO: 219520 - DNA, 27 bp, Artificial Sequence
  Description of Artificial Sequence: Synthetic oligonucleotide
agatagcaagtgctgggctcctgggtg

SEQ ID NO: 219521 - DNA, 26 bp, Artificial Sequence
  Description of Artificial Sequence: Synthetic oligonucleotide
gatagcaagtgctgggctcctgggtg

SEQ ID NO: 219522 - DNA, 26 bp, Artificial Sequence
  Description of Artificial Sequence: Synthetic oligonucleotide
atagcaagtgctgggctcctgggtgc

SEQ ID NO: 219523 - DNA, 25 bp, Artificial Sequence
  Description of Artificial Sequence: Synthetic oligonucleotide
tagcaagtgctgggctcctgggtgc

SEQ ID NO: 219524 - DNA, 30 bp, Artificial Sequence
  Description of Artificial Sequence: Synthetic oligonucleotide
tcactggttctcagagcaatgccgtgtcac

SEQ ID NO: 219525 - DNA, 29 bp, Artificial Sequence
  Description of Artificial Sequence: Synthetic oligonucleotide
cactggttctcagagcaatgccgtgtcac

SEQ ID NO: 219526 - DNA, 29 bp, Artificial Sequence
  Description of Artificial Sequence: Synthetic oligonucleotide
actggttctcagagcaatgccgtgtcacc

SEQ ID NO: 219527 - DNA, 28 bp, Artificial Sequence
  Description of Artificial Sequence: Synthetic oligonucleotide
ctggttctcagagcaatgccgtgtcacc

SEQ ID NO: 219528 - DNA, 28 bp, Artificial Sequence
  Description of Artificial Sequence: Synthetic oligonucleotide
tggttctcagagcaatgccgtgtcaccc

SEQ ID NO: 219529 - DNA, 27 bp, Artificial Sequence
  Description of Artificial Sequence: Synthetic oligonucleotide
ggttctcagagcaatgccgtgtcaccc

SEQ ID NO: 219530 - DNA, 28 bp, Artificial Sequence
  Description of Artificial Sequence: Synthetic oligonucleotide
gttctcagagcaatgccgtgtcacccac

SEQ ID NO: 219531 - DNA, 28 bp, Artificial Sequence
  Description of Artificial Sequence: Synthetic oligonucleotide
ttctcagagcaatgccgtgtcacccacc

SEQ ID NO: 219532 - DNA, 27 bp, Artificial Sequence
  Description of Artificial Sequence: Synthetic oligonucleotide
tctcagagcaatgccgtgtcacccacc

SEQ ID NO: 219533 - DNA, 26 bp, Artificial Sequence
  Description of Artificial Sequence: Synthetic oligonucleotide
ctcagagcaatgccgtgtcacccacc

SEQ ID NO: 219534 - DNA, 27 bp, Artificial Sequence
  Description of Artificial Sequence: Synthetic oligonucleotide
tcagagcaatgccgtgtcacccaccca

SEQ ID NO: 219535 - DNA, 26 bp, Artificial Sequence
  Description of Artificial Sequence: Synthetic oligonucleotide
cagagcaatgccgtgtcacccaccca

SEQ ID NO: 219536 - DNA, 26 bp, Artificial Sequence
  Description of Artificial Sequence: Synthetic oligonucleotide
agagcaatgccgtgtcacccacccag

SEQ ID NO: 219537 - DNA, 25 bp, Artificial Sequence
  Description of Artificial Sequence: Synthetic oligonucleotide
gagcaatgccgtgtcacccacccag

SEQ ID NO: 219538 - DNA, 25 bp, Artificial Sequence
  Description of Artificial Sequence: Synthetic oligonucleotide
agcaatgccgtgtcacccacccagg

SEQ ID NO: 219539 - DNA, 24 bp, Artificial Sequence
  Description of Artificial Sequence: Synthetic oligonucleotide
gcaatgccgtgtcacccacccagg

SEQ ID NO: 219540 - DNA, 25 bp, Artificial Sequence
  Description of Artificial Sequence: Synthetic oligonucleotide
caatgccgtgtcacccacccaggct

SEQ ID NO: 219541 - DNA, 25 bp, Artificial Sequence
  Description of Artificial Sequence: Synthetic oligonucleotide
aatgccgtgtcacccacccaggctc

SEQ ID NO: 219542 - DNA, 24 bp, Artificial Sequence
  Description of Artificial Sequence: Synthetic oligonucleotide
atgccgtgtcacccacccaggctc

SEQ ID NO: 219543 - DNA, 23 bp, Artificial Sequence
  Description of Artificial Sequence: Synthetic oligonucleotide
tgccgtgtcacccacccaggctc

SEQ ID NO: 219544 - DNA, 22 bp, Artificial Sequence
  Description of Artificial Sequence: Synthetic oligonucleotide
gccgtgtcacccacccaggctc

SEQ ID NO: 219545 - DNA, 23 bp, Artificial Sequence
  Description of Artificial Sequence: Synthetic oligonucleotide
ccgtgtcacccacccaggctcct

SEQ ID NO: 219546 - DNA, 23 bp, Artificial Sequence
  Description of Artificial Sequence: Synthetic oligonucleotide
cgtgtcacccacccaggctcctc

SEQ ID NO: 219547 - DNA, 23 bp, Artificial Sequence
  Description of Artificial Sequence: Synthetic oligonucleotide
gtgtcacccacccaggctcctcg

SEQ ID NO: 219548 - DNA, 25 bp, Artificial Sequence
  Description of Artificial Sequence: Synthetic oligonucleotide
tgtcacccacccaggctcctcgcaa

SEQ ID NO: 219549 - DNA, 24 bp, Artificial Sequence
  Description of Artificial Sequence: Synthetic oligonucleotide
gtcacccacccaggctcctcgcaa

SEQ ID NO: 219550 - DNA, 24 bp, Artificial Sequence
  Description of Artificial Sequence: Synthetic oligonucleotide
tcacccacccaggctcctcgcaac

SEQ ID NO: 219551 - DNA, 23 bp, Artificial Sequence
  Description of Artificial Sequence: Synthetic oligonucleotide
cacccacccaggctcctcgcaac

SEQ ID NO: 219552 - DNA, 23 bp, Artificial Sequence
  Description of Artificial Sequence: Synthetic oligonucleotide
acccacccaggctcctcgcaacc

SEQ ID NO: 219553 - DNA, 22 bp, Artificial Sequence
  Description of Artificial Sequence: Synthetic oligonucleotide
cccacccaggctcctcgcaacc

SEQ ID NO: 219554 - DNA, 24 bp, Artificial Sequence
  Description of Artificial Sequence: Synthetic oligonucleotide
ccacccaggctcctcgcaacccat

SEQ ID NO: 219555 - DNA, 24 bp, Artificial Sequence
  Description of Artificial Sequence: Synthetic oligonucleotide
cacccaggctcctcgcaacccatc

SEQ ID NO: 219556 - DNA, 24 bp, Artificial Sequence
  Description of Artificial Sequence: Synthetic oligonucleotide
acccaggctcctcgcaacccatcc

SEQ ID NO: 219557 - DNA, 23 bp, Artificial Sequence
  Description of Artificial Sequence: Synthetic oligonucleotide
cccaggctcctcgcaacccatcc

SEQ ID NO: 219558 - DNA, 24 bp, Artificial Sequence
  Description of Artificial Sequence: Synthetic oligonucleotide
ccaggctcctcgcaacccatccga

SEQ ID NO: 219559 - DNA, 24 bp, Artificial Sequence
  Description of Artificial Sequence: Synthetic oligonucleotide
caggctcctcgcaacccatccgac

SEQ ID NO: 219560 - DNA, 24 bp, Artificial Sequence
  Description of Artificial Sequence: Synthetic oligonucleotide
aggctcctcgcaacccatccgacc

SEQ ID NO: 219561 - DNA, 28 bp, Artificial Sequence
  Description of Artificial Sequence: Synthetic oligonucleotide
gaggccccgggtttctgtctattgagtg

SEQ ID NO: 219562 - DNA, 28 bp, Artificial Sequence
  Description of Artificial Sequence: Synthetic oligonucleotide
aggccccgggtttctgtctattgagtgg

SEQ ID NO: 219563 - DNA, 27 bp, Artificial Sequence
  Description of Artificial Sequence: Synthetic oligonucleotide
ggccccgggtttctgtctattgagtgg

SEQ ID NO: 219564 - DNA, 27 bp, Artificial Sequence
  Description of Artificial Sequence: Synthetic oligonucleotide
gccccgggtttctgtctattgagtggc

SEQ ID NO: 219565 - DNA, 27 bp, Artificial Sequence
  Description of Artificial Sequence: Synthetic oligonucleotide
ccccgggtttctgtctattgagtggcc

SEQ ID NO: 219566 - DNA, 27 bp, Artificial Sequence
  Description of Artificial Sequence: Synthetic oligonucleotide
cccgggtttctgtctattgagtggccg

SEQ ID NO: 219567 - DNA, 27 bp, Artificial Sequence
  Description of Artificial Sequence: Synthetic oligonucleotide
ccgggtttctgtctattgagtggccgg

SEQ ID NO: 219568 - DNA, 30 bp, Artificial Sequence
  Description of Artificial Sequence: Synthetic oligonucleotide
cgggtttctgtctattgagtggccggattc

SEQ ID NO: 219569 - DNA, 31 bp, Artificial Sequence
  Description of Artificial Sequence: Synthetic oligonucleotide
gggtttctgtctattgagtggccggattctc

SEQ ID NO: 219570 - DNA, 31 bp, Artificial Sequence
  Description of Artificial Sequence: Synthetic oligonucleotide
ggtttctgtctattgagtggccggattctcg

SEQ ID NO: 219571 - DNA, 32 bp, Artificial Sequence
  Description of Artificial Sequence: Synthetic oligonucleotide
gtttctgtctattgagtggccggattctcgac

SEQ ID NO: 219572 - DNA, 32 bp, Artificial Sequence
  Description of Artificial Sequence: Synthetic oligonucleotide
tttctgtctattgagtggccggattctcgacc

SEQ ID NO: 219573 - DNA, 31 bp, Artificial Sequence
  Description of Artificial Sequence: Synthetic oligonucleotide
ttctgtctattgagtggccggattctcgacc

SEQ ID NO: 219574 - DNA, 30 bp, Artificial Sequence
  Description of Artificial Sequence: Synthetic oligonucleotide
tctgtctattgagtggccggattctcgacc

SEQ ID NO: 219575 - DNA, 29 bp, Artificial Sequence
  Description of Artificial Sequence: Synthetic oligonucleotide
ctgtctattgagtggccggattctcgacc

SEQ ID NO: 219576 - DNA, 30 bp, Artificial Sequence
  Description of Artificial Sequence: Synthetic oligonucleotide
tgtctattgagtggccggattctcgacctc

SEQ ID NO: 219577 - DNA, 29 bp, Artificial Sequence
  Description of Artificial Sequence: Synthetic oligonucleotide
gtctattgagtggccggattctcgacctc

SEQ ID NO: 219578 - DNA, 29 bp, Artificial Sequence
  Description of Artificial Sequence: Synthetic oligonucleotide
tctattgagtggccggattctcgacctcc

SEQ ID NO: 219579 - DNA, 28 bp, Artificial Sequence
  Description of Artificial Sequence: Synthetic oligonucleotide
ctattgagtggccggattctcgacctcc

SEQ ID NO: 219580 - DNA, 29 bp, Artificial Sequence
  Description of Artificial Sequence: Synthetic oligonucleotide
tattgagtggccggattctcgacctcctc

SEQ ID NO: 219581 - DNA, 28 bp, Artificial Sequence
  Description of Artificial Sequence: Synthetic oligonucleotide
attgagtggccggattctcgacctcctc

SEQ ID NO: 219582 - DNA, 27 bp, Artificial Sequence
  Description of Artificial Sequence: Synthetic oligonucleotide
ttgagtggccggattctcgacctcctc

SEQ ID NO: 219583 - DNA, 26 bp, Artificial Sequence
  Description of Artificial Sequence: Synthetic oligonucleotide
tgagtggccggattctcgacctcctc

SEQ ID NO: 219584 - DNA, 25 bp, Artificial Sequence
  Description of Artificial Sequence: Synthetic oligonucleotide
gagtggccggattctcgacctcctc

SEQ ID NO: 219585 - DNA, 26 bp, Artificial Sequence
  Description of Artificial Sequence: Synthetic oligonucleotide
agtggccggattctcgacctcctcgt

SEQ ID NO: 219586 - DNA, 25 bp, Artificial Sequence
  Description of Artificial Sequence: Synthetic oligonucleotide
gtggccggattctcgacctcctcgt

SEQ ID NO: 219587 - DNA, 27 bp, Artificial Sequence
  Description of Artificial Sequence: Synthetic oligonucleotide
tggccggattctcgacctcctcgtgtt

SEQ ID NO: 219588 - DNA, 31 bp, Artificial Sequence
  Description of Artificial Sequence: Synthetic oligonucleotide
ccaagagaggttagatccgtctgtctgtctg

SEQ ID NO: 219589 - DNA, 31 bp, Artificial Sequence
  Description of Artificial Sequence: Synthetic oligonucleotide
caagagaggttagatccgtctgtctgtctgc

SEQ ID NO: 219590 - DNA, 33 bp, Artificial Sequence
  Description of Artificial Sequence: Synthetic oligonucleotide
aagagaggttagatccgtctgtctgtctgctac

SEQ ID NO: 219591 - DNA, 32 bp, Artificial Sequence
  Description of Artificial Sequence: Synthetic oligonucleotide
agagaggttagatccgtctgtctgtctgctac

SEQ ID NO: 219592 - DNA, 31 bp, Artificial Sequence
  Description of Artificial Sequence: Synthetic oligonucleotide
gagaggttagatccgtctgtctgtctgctac

SEQ ID NO: 219593 - DNA, 31 bp, Artificial Sequence
  Description of Artificial Sequence: Synthetic oligonucleotide
agaggttagatccgtctgtctgtctgctacc

SEQ ID NO: 219594 - DNA, 30 bp, Artificial Sequence
  Description of Artificial Sequence: Synthetic oligonucleotide
gaggttagatccgtctgtctgtctgctacc

SEQ ID NO: 219595 - DNA, 32 bp, Artificial Sequence
  Description of Artificial Sequence: Synthetic oligonucleotide
aggttagatccgtctgtctgtctgctaccttc

SEQ ID NO: 219596 - DNA, 31 bp, Artificial Sequence
  Description of Artificial Sequence: Synthetic oligonucleotide
ggttagatccgtctgtctgtctgctaccttc

SEQ ID NO: 219597 - DNA, 33 bp, Artificial Sequence
  Description of Artificial Sequence: Synthetic oligonucleotide
gttagatccgtctgtctgtctgctaccttcttc

SEQ ID NO: 219598 - DNA, 34 bp, Artificial Sequence
  Description of Artificial Sequence: Synthetic oligonucleotide
ttagatccgtctgtctgtctgctaccttcttcac

SEQ ID NO: 219599 - DNA, 33 bp, Artificial Sequence
  Description of Artificial Sequence: Synthetic oligonucleotide
tagatccgtctgtctgtctgctaccttcttcac

SEQ ID NO: 219600 - DNA, 32 bp, Artificial Sequence
  Description of Artificial Sequence: Synthetic oligonucleotide
agatccgtctgtctgtctgctaccttcttcac

SEQ ID NO: 219601 - DNA, 31 bp, Artificial Sequence
  Description of Artificial Sequence: Synthetic oligonucleotide
gatccgtctgtctgtctgctaccttcttcac

SEQ ID NO: 219602 - DNA, 31 bp, Artificial Sequence
  Description of Artificial Sequence: Synthetic oligonucleotide
atccgtctgtctgtctgctaccttcttcacc

SEQ ID NO: 219603 - DNA, 30 bp, Artificial Sequence
  Description of Artificial Sequence: Synthetic oligonucleotide
tccgtctgtctgtctgctaccttcttcacc

SEQ ID NO: 219604 - DNA, 29 bp, Artificial Sequence
  Description of Artificial Sequence: Synthetic oligonucleotide
ccgtctgtctgtctgctaccttcttcacc

SEQ ID NO: 219605 - DNA, 33 bp, Artificial Sequence
  Description of Artificial Sequence: Synthetic oligonucleotide
cgtctgtctgtctgctaccttcttcaccttatc

SEQ ID NO: 219606 - DNA, 34 bp, Artificial Sequence
  Description of Artificial Sequence: Synthetic oligonucleotide
gtctgtctgtctgctaccttcttcaccttatctc

SEQ ID NO: 219607 - DNA, 35 bp, Artificial Sequence
  Description of Artificial Sequence: Synthetic oligonucleotide
tctgtctgtctgctaccttcttcaccttatctctg

SEQ ID NO: 219608 - DNA, 34 bp, Artificial Sequence
  Description of Artificial Sequence: Synthetic oligonucleotide
ctgtctgtctgctaccttcttcaccttatctctg

SEQ ID NO: 219609 - DNA, 34 bp, Artificial Sequence
  Description of Artificial Sequence: Synthetic oligonucleotide
tgtctgtctgctaccttcttcaccttatctctgc

SEQ ID NO: 219610 - DNA, 33 bp, Artificial Sequence
  Description of Artificial Sequence: Synthetic oligonucleotide
gtctgtctgctaccttcttcaccttatctctgc

SEQ ID NO: 219611 - DNA, 34 bp, Artificial Sequence
  Description of Artificial Sequence: Synthetic oligonucleotide
tctgtctgctaccttcttcaccttatctctgcag

SEQ ID NO: 219612 - DNA, 33 bp, Artificial Sequence
  Description of Artificial Sequence: Synthetic oligonucleotide
ctgtctgctaccttcttcaccttatctctgcag

SEQ ID NO: 219613 - DNA, 35 bp, Artificial Sequence
  Description of Artificial Sequence: Synthetic oligonucleotide
tgtctgctaccttcttcaccttatctctgcagaag

SEQ ID NO: 219614 - DNA, 34 bp, Artificial Sequence
  Description of Artificial Sequence: Synthetic oligonucleotide
gtctgctaccttcttcaccttatctctgcagaag

SEQ ID NO: 219615 - DNA, 34 bp, Artificial Sequence
  Description of Artificial Sequence: Synthetic oligonucleotide
tctgctaccttcttcaccttatctctgcagaagc

SEQ ID NO: 219616 - DNA, 33 bp, Artificial Sequence
  Description of Artificial Sequence: Synthetic oligonucleotide
ctgctaccttcttcaccttatctctgcagaagc

SEQ ID NO: 219617 - DNA, 33 bp, Artificial Sequence
  Description of Artificial Sequence: Synthetic oligonucleotide
tgctaccttcttcaccttatctctgcagaagcc

SEQ ID NO: 219618 - DNA, 32 bp, Artificial Sequence
  Description of Artificial Sequence: Synthetic oligonucleotide
gctaccttcttcaccttatctctgcagaagcc

SEQ ID NO: 219619 - DNA, 32 bp, Artificial Sequence
  Description of Artificial Sequence: Synthetic oligonucleotide
ctaccttcttcaccttatctctgcagaagccc

SEQ ID NO: 219620 - DNA, 33 bp, Artificial Sequence
  Description of Artificial Sequence: Synthetic oligonucleotide
taccttcttcaccttatctctgcagaagcccag

SEQ ID NO: 219621 - DNA, 32 bp, Artificial Sequence
  Description of Artificial Sequence: Synthetic oligonucleotide
accttcttcaccttatctctgcagaagcccag

SEQ ID NO: 219622 - DNA, 31 bp, Artificial Sequence
  Description of Artificial Sequence: Synthetic oligonucleotide
ccttcttcaccttatctctgcagaagcccag

SEQ ID NO: 219623 - DNA, 29 bp, Artificial Sequence
  Description of Artificial Sequence: Synthetic oligonucleotide
gtgtcttctcctgggtctgttcctgaagc

SEQ ID NO: 219624 - DNA, 29 bp, Artificial Sequence
  Description of Artificial Sequence: Synthetic oligonucleotide
tgtcttctcctgggtctgttcctgaagcc

SEQ ID NO: 219625 - DNA, 28 bp, Artificial Sequence
  Description of Artificial Sequence: Synthetic oligonucleotide
gtcttctcctgggtctgttcctgaagcc

SEQ ID NO: 219626 - DNA, 28 bp, Artificial Sequence
  Description of Artificial Sequence: Synthetic oligonucleotide
tcttctcctgggtctgttcctgaagccc

SEQ ID NO: 219627 - DNA, 27 bp, Artificial Sequence
  Description of Artificial Sequence: Synthetic oligonucleotide
cttctcctgggtctgttcctgaagccc

SEQ ID NO: 219628 - DNA, 28 bp, Artificial Sequence
  Description of Artificial Sequence: Synthetic oligonucleotide
ttctcctgggtctgttcctgaagcccag

SEQ ID NO: 219629 - DNA, 27 bp, Artificial Sequence
  Description of Artificial Sequence: Synthetic oligonucleotide
tctcctgggtctgttcctgaagcccag

SEQ ID NO: 219630 - DNA, 26 bp, Artificial Sequence
  Description of Artificial Sequence: Synthetic oligonucleotide
ctcctgggtctgttcctgaagcccag

SEQ ID NO: 219631 - DNA, 27 bp, Artificial Sequence
  Description of Artificial Sequence: Synthetic oligonucleotide
tcctgggtctgttcctgaagcccagga

SEQ ID NO: 219632 - DNA, 26 bp, Artificial Sequence
  Description of Artificial Sequence: Synthetic oligonucleotide
cctgggtctgttcctgaagcccagga

SEQ ID NO: 219633 - DNA, 27 bp, Artificial Sequence
  Description of Artificial Sequence: Synthetic oligonucleotide
ctgggtctgttcctgaagcccaggaca

SEQ ID NO: 219634 - DNA, 29 bp, Artificial Sequence
  Description of Artificial Sequence: Synthetic oligonucleotide
tgggtctgttcctgaagcccaggacattc

SEQ ID NO: 219635 - DNA, 28 bp, Artificial Sequence
  Description of Artificial Sequence: Synthetic oligonucleotide
gggtctgttcctgaagcccaggacattc

SEQ ID NO: 219636 - DNA, 29 bp, Artificial Sequence
  Description of Artificial Sequence: Synthetic oligonucleotide
ggtctgttcctgaagcccaggacattcag

SEQ ID NO: 219637 - DNA, 29 bp, Artificial Sequence
  Description of Artificial Sequence: Synthetic oligonucleotide
gtctgttcctgaagcccaggacattcagc

SEQ ID NO: 219638 - DNA, 33 bp, Artificial Sequence
  Description of Artificial Sequence: Synthetic oligonucleotide
tctgttcctgaagcccaggacattcagcaaaac

SEQ ID NO: 219639 - DNA, 32 bp, Artificial Sequence
  Description of Artificial Sequence: Synthetic oligonucleotide
ctgttcctgaagcccaggacattcagcaaaac

SEQ ID NO: 219640 - DNA, 33 bp, Artificial Sequence
  Description of Artificial Sequence: Synthetic oligonucleotide
tgttcctgaagcccaggacattcagcaaaacac

SEQ ID NO: 219641 - DNA, 32 bp, Artificial Sequence
  Description of Artificial Sequence: Synthetic oligonucleotide
gttcctgaagcccaggacattcagcaaaacac

SEQ ID NO: 219642 - DNA, 33 bp, Artificial Sequence
  Description of Artificial Sequence: Synthetic oligonucleotide
ttcctgaagcccaggacattcagcaaaacacag

SEQ ID NO: 219643 - DNA, 32 bp, Artificial Sequence
  Description of Artificial Sequence: Synthetic oligonucleotide
tcctgaagcccaggacattcagcaaaacacag

SEQ ID NO: 219644 - DNA, 31 bp, Artificial Sequence
  Description of Artificial Sequence: Synthetic oligonucleotide
cctgaagcccaggacattcagcaaaacacag

SEQ ID NO: 219645 - DNA, 32 bp, Artificial Sequence
  Description of Artificial Sequence: Synthetic oligonucleotide
ctgaagcccaggacattcagcaaaacacagac

SEQ ID NO: 219646 - DNA, 32 bp, Artificial Sequence
  Description of Artificial Sequence: Synthetic oligonucleotide
tgaagcccaggacattcagcaaaacacagacg

SEQ ID NO: 219647 - DNA, 31 bp, Artificial Sequence
  Description of Artificial Sequence: Synthetic oligonucleotide
gaagcccaggacattcagcaaaacacagacg

SEQ ID NO: 219648 - DNA, 31 bp, Artificial Sequence
  Description of Artificial Sequence: Synthetic oligonucleotide
aagcccaggacattcagcaaaacacagacgg

SEQ ID NO: 219649 - DNA, 30 bp, Artificial Sequence
  Description of Artificial Sequence: Synthetic oligonucleotide
agcccaggacattcagcaaaacacagacgg

SEQ ID NO: 219650 - DNA, 29 bp, Artificial Sequence
  Description of Artificial Sequence: Synthetic oligonucleotide
gcccaggacattcagcaaaacacagacgg

SEQ ID NO: 219651 - DNA, 29 bp, Artificial Sequence
  Description of Artificial Sequence: Synthetic oligonucleotide
cccaggacattcagcaaaacacagacggg

SEQ ID NO: 219652 - DNA, 26 bp, Artificial Sequence
  Description of Artificial Sequence: Synthetic oligonucleotide
agctgccatcacggcctatgccctgt

SEQ ID NO: 219653 - DNA, 25 bp, Artificial Sequence
  Description of Artificial Sequence: Synthetic oligonucleotide
gctgccatcacggcctatgccctgt

SEQ ID NO: 219654 - DNA, 26 bp, Artificial Sequence
  Description of Artificial Sequence: Synthetic oligonucleotide
ctgccatcacggcctatgccctgtca

SEQ ID NO: 219655 - DNA, 27 bp, Artificial Sequence
  Description of Artificial Sequence: Synthetic oligonucleotide
tgccatcacggcctatgccctgtcact

SEQ ID NO: 219656 - DNA, 26 bp, Artificial Sequence
  Description of Artificial Sequence: Synthetic oligonucleotide
gccatcacggcctatgccctgtcact

SEQ ID NO: 219657 - DNA, 27 bp, Artificial Sequence
  Description of Artificial Sequence: Synthetic oligonucleotide
ccatcacggcctatgccctgtcactga

SEQ ID NO: 219658 - DNA, 27 bp, Artificial Sequence
  Description of Artificial Sequence: Synthetic oligonucleotide
catcacggcctatgccctgtcactgac

SEQ ID NO: 219659 - DNA, 27 bp, Artificial Sequence
  Description of Artificial Sequence: Synthetic oligonucleotide
atcacggcctatgccctgtcactgacc

SEQ ID NO: 219660 - DNA, 27 bp, Artificial Sequence
  Description of Artificial Sequence: Synthetic oligonucleotide
tcacggcctatgccctgtcactgacca

SEQ ID NO: 219661 - DNA, 27 bp, Artificial Sequence
  Description of Artificial Sequence: Synthetic oligonucleotide
cacggcctatgccctgtcactgaccaa

SEQ ID NO: 219662 - DNA, 27 bp, Artificial Sequence
  Description of Artificial Sequence: Synthetic oligonucleotide
acggcctatgccctgtcactgaccaag

SEQ ID NO: 219663 - DNA, 26 bp, Artificial Sequence
  Description of Artificial Sequence: Synthetic oligonucleotide
cggcctatgccctgtcactgaccaag

SEQ ID NO: 219664 - DNA, 26 bp, Artificial Sequence
  Description of Artificial Sequence: Synthetic oligonucleotide
ggcctatgccctgtcactgaccaagg

SEQ ID NO: 219665 - DNA, 26 bp, Artificial Sequence
  Description of Artificial Sequence: Synthetic oligonucleotide
gcctatgccctgtcactgaccaaggc

SEQ ID NO: 219666 - DNA, 26 bp, Artificial Sequence
  Description of Artificial Sequence: Synthetic oligonucleotide
cctatgccctgtcactgaccaaggcg

SEQ ID NO: 219667 - DNA, 26 bp, Artificial Sequence
  Description of Artificial Sequence: Synthetic oligonucleotide
ctatgccctgtcactgaccaaggcgc

SEQ ID NO: 219668 - DNA, 27 bp, Artificial Sequence
  Description of Artificial Sequence: Synthetic oligonucleotide
tatgccctgtcactgaccaaggcgcct

SEQ ID NO: 219669 - DNA, 26 bp, Artificial Sequence
  Description of Artificial Sequence: Synthetic oligonucleotide
atgccctgtcactgaccaaggcgcct

SEQ ID NO: 219670 - DNA, 25 bp, Artificial Sequence
  Description of Artificial Sequence: Synthetic oligonucleotide
tgccctgtcactgaccaaggcgcct

SEQ ID NO: 219671 - DNA, 24 bp, Artificial Sequence
  Description of Artificial Sequence: Synthetic oligonucleotide
gccctgtcactgaccaaggcgcct

SEQ ID NO: 219672 - DNA, 25 bp, Artificial Sequence
  Description of Artificial Sequence: Synthetic oligonucleotide
ccctgtcactgaccaaggcgcctgt

SEQ ID NO: 219673 - DNA, 25 bp, Artificial Sequence
  Description of Artificial Sequence: Synthetic oligonucleotide
cctgtcactgaccaaggcgcctgtg

SEQ ID NO: 219674 - DNA, 26 bp, Artificial Sequence
  Description of Artificial Sequence: Synthetic oligonucleotide
ctgtcactgaccaaggcgcctgtgga

SEQ ID NO: 219675 - DNA, 26 bp, Artificial Sequence
  Description of Artificial Sequence: Synthetic oligonucleotide
tgtcactgaccaaggcgcctgtggac

SEQ ID NO: 219676 - DNA, 25 bp, Artificial Sequence
  Description of Artificial Sequence: Synthetic oligonucleotide
gtcactgaccaaggcgcctgtggac

SEQ ID NO: 219677 - DNA, 26 bp, Artificial Sequence
  Description of Artificial Sequence: Synthetic oligonucleotide
tcactgaccaaggcgcctgtggacct

SEQ ID NO: 219678 - DNA, 35 bp, Artificial Sequence
  Description of Artificial Sequence: Synthetic oligonucleotide
agtacacgatggaagcaaacgaggactatgagtac

SEQ ID NO: 219679 - DNA, 34 bp, Artificial Sequence
  Description of Artificial Sequence: Synthetic oligonucleotide
gtacacgatggaagcaaacgaggactatgagtac

SEQ ID NO: 219680 - DNA, 34 bp, Artificial Sequence
  Description of Artificial Sequence: Synthetic oligonucleotide
tacacgatggaagcaaacgaggactatgagtacg

SEQ ID NO: 219681 - DNA, 33 bp, Artificial Sequence
  Description of Artificial Sequence: Synthetic oligonucleotide
acacgatggaagcaaacgaggactatgagtacg

SEQ ID NO: 219682 - DNA, 32 bp, Artificial Sequence
  Description of Artificial Sequence: Synthetic oligonucleotide
cacgatggaagcaaacgaggactatgagtacg

SEQ ID NO: 219683 - DNA, 34 bp, Artificial Sequence
  Description of Artificial Sequence: Synthetic oligonucleotide
acgatggaagcaaacgaggactatgagtacgatg

SEQ ID NO: 219684 - DNA, 33 bp, Artificial Sequence
  Description of Artificial Sequence: Synthetic oligonucleotide
cgatggaagcaaacgaggactatgagtacgatg

SEQ ID NO: 219685 - DNA, 34 bp, Artificial Sequence
  Description of Artificial Sequence: Synthetic oligonucleotide
gatggaagcaaacgaggactatgagtacgatgag

SEQ ID NO: 219686 - DNA, 34 bp, Artificial Sequence
  Description of Artificial Sequence: Synthetic oligonucleotide
atggaagcaaacgaggactatgagtacgatgagc

SEQ ID NO: 219687 - DNA, 33 bp, Artificial Sequence
  Description of Artificial Sequence: Synthetic oligonucleotide
tggaagcaaacgaggactatgagtacgatgagc

SEQ ID NO: 219688 - DNA, 32 bp, Artificial Sequence
  Description of Artificial Sequence: Synthetic oligonucleotide
ggaagcaaacgaggactatgagtacgatgagc

SEQ ID NO: 219689 - DNA, 34 bp, Artificial Sequence
  Description of Artificial Sequence: Synthetic oligonucleotide
gaagcaaacgaggactatgagtacgatgagcttc

SEQ ID NO: 219690 - DNA, 34 bp, Artificial Sequence
  Description of Artificial Sequence: Synthetic oligonucleotide
aagcaaacgaggactatgagtacgatgagcttcc

SEQ ID NO: 219691 - DNA, 33 bp, Artificial Sequence
  Description of Artificial Sequence: Synthetic oligonucleotide
agcaaacgaggactatgagtacgatgagcttcc

SEQ ID NO: 219692 - DNA, 32 bp, Artificial Sequence
  Description of Artificial Sequence: Synthetic oligonucleotide
gcaaacgaggactatgagtacgatgagcttcc

SEQ ID NO: 219693 - DNA, 33 bp, Artificial Sequence
  Description of Artificial Sequence: Synthetic oligonucleotide
caaacgaggactatgagtacgatgagcttccag

SEQ ID NO: 219694 - DNA, 33 bp, Artificial Sequence
  Description of Artificial Sequence: Synthetic oligonucleotide
aaacgaggactatgagtacgatgagcttccagc

SEQ ID NO: 219695 - DNA, 32 bp, Artificial Sequence
  Description of Artificial Sequence: Synthetic oligonucleotide
aacgaggactatgagtacgatgagcttccagc

SEQ ID NO: 219696 - DNA, 31 bp, Artificial Sequence
  Description of Artificial Sequence: Synthetic oligonucleotide
acgaggactatgagtacgatgagcttccagc

SEQ ID NO: 219697 - DNA, 30 bp, Artificial Sequence
  Description of Artificial Sequence: Synthetic oligonucleotide
cgaggactatgagtacgatgagcttccagc

SEQ ID NO: 219698 - DNA, 22 bp, Artificial Sequence
  Description of Artificial Sequence: Synthetic oligonucleotide
tccccacctcccgggagtgcct

SEQ ID NO: 219699 - DNA, 21 bp, Artificial Sequence
  Description of Artificial Sequence: Synthetic oligonucleotide
ccccacctcccgggagtgcct

SEQ ID NO: 219700 - DNA, 21 bp, Artificial Sequence
  Description of Artificial Sequence: Synthetic oligonucleotide
cccacctcccgggagtgcctg

SEQ ID NO: 219701 - DNA, 21 bp, Artificial Sequence
  Description of Artificial Sequence: Synthetic oligonucleotide
ccacctcccgggagtgcctgg

SEQ ID NO: 219702 - DNA, 21 bp, Artificial Sequence
  Description of Artificial Sequence: Synthetic oligonucleotide
cacctcccgggagtgcctggg

SEQ ID NO: 219703 - DNA, 24 bp, Artificial Sequence
  Description of Artificial Sequence: Synthetic oligonucleotide
acctcccgggagtgcctgggcttt

SEQ ID NO: 219704 - DNA, 23 bp, Artificial Sequence
  Description of Artificial Sequence: Synthetic oligonucleotide
cctcccgggagtgcctgggcttt

SEQ ID NO: 219705 - DNA, 24 bp, Artificial Sequence
  Description of Artificial Sequence: Synthetic oligonucleotide
ctcccgggagtgcctgggctttga

SEQ ID NO: 219706 - DNA, 24 bp, Artificial Sequence
  Description of Artificial Sequence: Synthetic oligonucleotide
tcccgggagtgcctgggctttgag

SEQ ID NO: 219707 - DNA, 23 bp, Artificial Sequence
  Description of Artificial Sequence: Synthetic oligonucleotide
cccgggagtgcctgggctttgag

SEQ ID NO: 219708 - DNA, 23 bp, Artificial Sequence
  Description of Artificial Sequence: Synthetic oligonucleotide
ccgggagtgcctgggctttgagg

SEQ ID NO: 219709 - DNA, 24 bp, Artificial Sequence
  Description of Artificial Sequence: Synthetic oligonucleotide
cgggagtgcctgggctttgaggct

SEQ ID NO: 219710 - DNA, 25 bp, Artificial Sequence
  Description of Artificial Sequence: Synthetic oligonucleotide
gggagtgcctgggctttgaggctgt

SEQ ID NO: 219711 - DNA, 25 bp, Artificial Sequence
  Description of Artificial Sequence: Synthetic oligonucleotide
ggagtgcctgggctttgaggctgtg

SEQ ID NO: 219712 - DNA, 26 bp, Artificial Sequence
  Description of Artificial Sequence: Synthetic oligonucleotide
gagtgcctgggctttgaggctgtgca

SEQ ID NO: 219713 - DNA, 26 bp, Artificial Sequence
  Description of Artificial Sequence: Synthetic oligonucleotide
agtgcctgggctttgaggctgtgcag

SEQ ID NO: 219714 - DNA, 25 bp, Artificial Sequence
  Description of Artificial Sequence: Synthetic oligonucleotide
gtgcctgggctttgaggctgtgcag

SEQ ID NO: 219715 - DNA, 27 bp, Artificial Sequence
  Description of Artificial Sequence: Synthetic oligonucleotide
tgcctgggctttgaggctgtgcaggaa

SEQ ID NO: 219716 - DNA, 26 bp, Artificial Sequence
  Description of Artificial Sequence: Synthetic oligonucleotide
gcctgggctttgaggctgtgcaggaa

SEQ ID NO: 219717 - DNA, 27 bp, Artificial Sequence
  Description of Artificial Sequence: Synthetic oligonucleotide
cctgggctttgaggctgtgcaggaagt

SEQ ID NO: 219718 - DNA, 27 bp, Artificial Sequence
  Description of Artificial Sequence: Synthetic oligonucleotide
ctgggctttgaggctgtgcaggaagtg

SEQ ID NO: 219719 - DNA, 23 bp, Artificial Sequence
  Description of Artificial Sequence: Synthetic oligonucleotide
gaccaccgaggccggaccttgga

SEQ ID NO: 219720 - DNA, 26 bp, Artificial Sequence
  Description of Artificial Sequence: Synthetic oligonucleotide
accaccgaggccggaccttggacata

SEQ ID NO: 219721 - DNA, 25 bp, Artificial Sequence
  Description of Artificial Sequence: Synthetic oligonucleotide
ccaccgaggccggaccttggacata

SEQ ID NO: 219722 - DNA, 25 bp, Artificial Sequence
  Description of Artificial Sequence: Synthetic oligonucleotide
caccgaggccggaccttggacatac

SEQ ID NO: 219723 - DNA, 26 bp, Artificial Sequence
  Description of Artificial Sequence: Synthetic oligonucleotide
accgaggccggaccttggacatacct

SEQ ID NO: 219724 - DNA, 25 bp, Artificial Sequence
  Description of Artificial Sequence: Synthetic oligonucleotide
ccgaggccggaccttggacatacct

SEQ ID NO: 219725 - DNA, 25 bp, Artificial Sequence
  Description of Artificial Sequence: Synthetic oligonucleotide
cgaggccggaccttggacatacctg

SEQ ID NO: 219726 - DNA, 25 bp, Artificial Sequence
  Description of Artificial Sequence: Synthetic oligonucleotide
gaggccggaccttggacatacctgg

SEQ ID NO: 219727 - DNA, 27 bp, Artificial Sequence
  Description of Artificial Sequence: Synthetic oligonucleotide
aggccggaccttggacatacctggcaa

SEQ ID NO: 219728 - DNA, 26 bp, Artificial Sequence
  Description of Artificial Sequence: Synthetic oligonucleotide
ggccggaccttggacatacctggcaa

SEQ ID NO: 219729 - DNA, 27 bp, Artificial Sequence
  Description of Artificial Sequence: Synthetic oligonucleotide
gccggaccttggacatacctggcaact

SEQ ID NO: 219730 - DNA, 27 bp, Artificial Sequence
  Description of Artificial Sequence: Synthetic oligonucleotide
ccggaccttggacatacctggcaactc

SEQ ID NO: 219731 - DNA, 28 bp, Artificial Sequence
  Description of Artificial Sequence: Synthetic oligonucleotide
cggaccttggacatacctggcaactctg

SEQ ID NO: 219732 - DNA, 30 bp, Artificial Sequence
  Description of Artificial Sequence: Synthetic oligonucleotide
ggaccttggacatacctggcaactctgatc

SEQ ID NO: 219733 - DNA, 30 bp, Artificial Sequence
  Description of Artificial Sequence: Synthetic oligonucleotide
gaccttggacatacctggcaactctgatcc

SEQ ID NO: 219734 - DNA, 30 bp, Artificial Sequence
  Description of Artificial Sequence: Synthetic oligonucleotide
accttggacatacctggcaactctgatccc

SEQ ID NO: 219735 - DNA, 29 bp, Artificial Sequence
  Description of Artificial Sequence: Synthetic oligonucleotide
ccttggacatacctggcaactctgatccc

SEQ ID NO: 219736 - DNA, 34 bp, Artificial Sequence
  Description of Artificial Sequence: Synthetic oligonucleotide
cttggacatacctggcaactctgatcccaatatg

SEQ ID NO: 219737 - DNA, 36 bp, Artificial Sequence
  Description of Artificial Sequence: Synthetic oligonucleotide
ttggacatacctggcaactctgatcccaatatgatc

SEQ ID NO: 219738 - DNA, 35 bp, Artificial Sequence
  Description of Artificial Sequence: Synthetic oligonucleotide
tggacatacctggcaactctgatcccaatatgatc

SEQ ID NO: 219739 - DNA, 34 bp, Artificial Sequence
  Description of Artificial Sequence: Synthetic oligonucleotide
ggacatacctggcaactctgatcccaatatgatc

SEQ ID NO: 219740 - DNA, 34 bp, Artificial Sequence
  Description of Artificial Sequence: Synthetic oligonucleotide
gacatacctggcaactctgatcccaatatgatcc

SEQ ID NO: 219741 - DNA, 34 bp, Artificial Sequence
  Description of Artificial Sequence: Synthetic oligonucleotide
acatacctggcaactctgatcccaatatgatccc

SEQ ID NO: 219742 - DNA, 33 bp, Artificial Sequence
  Description of Artificial Sequence: Synthetic oligonucleotide
catacctggcaactctgatcccaatatgatccc

SEQ ID NO: 219743 - DNA, 29 bp, Artificial Sequence
  Description of Artificial Sequence: Synthetic oligonucleotide
ctacgtcagggttacagcctcagatccac

SEQ ID NO: 219744 - DNA, 30 bp, Artificial Sequence
  Description of Artificial Sequence: Synthetic oligonucleotide
tacgtcagggttacagcctcagatccactg

SEQ ID NO: 219745 - DNA, 29 bp, Artificial Sequence
  Description of Artificial Sequence: Synthetic oligonucleotide
acgtcagggttacagcctcagatccactg

SEQ ID NO: 219746 - DNA, 28 bp, Artificial Sequence
  Description of Artificial Sequence: Synthetic oligonucleotide
cgtcagggttacagcctcagatccactg

SEQ ID NO: 219747 - DNA, 28 bp, Artificial Sequence
  Description of Artificial Sequence: Synthetic oligonucleotide
gtcagggttacagcctcagatccactgg

SEQ ID NO: 219748 - DNA, 29 bp, Artificial Sequence
  Description of Artificial Sequence: Synthetic oligonucleotide
tcagggttacagcctcagatccactggac

SEQ ID NO: 219749 - DNA, 28 bp, Artificial Sequence
  Description of Artificial Sequence: Synthetic oligonucleotide
cagggttacagcctcagatccactggac

SEQ ID NO: 219750 - DNA, 29 bp, Artificial Sequence
  Description of Artificial Sequence: Synthetic oligonucleotide
agggttacagcctcagatccactggacac

SEQ ID NO: 219751 - DNA, 28 bp, Artificial Sequence
  Description of Artificial Sequence: Synthetic oligonucleotide
gggttacagcctcagatccactggacac

SEQ ID NO: 219752 - DNA, 32 bp, Artificial Sequence
  Description of Artificial Sequence: Synthetic oligonucleotide
ggttacagcctcagatccactggacactttag

SEQ ID NO: 219753 - DNA, 32 bp, Artificial Sequence
  Description of Artificial Sequence: Synthetic oligonucleotide
gttacagcctcagatccactggacactttagg

SEQ ID NO: 219754 - DNA, 32 bp, Artificial Sequence
  Description of Artificial Sequence: Synthetic oligonucleotide
ttacagcctcagatccactggacactttaggc

SEQ ID NO: 219755 - DNA, 31 bp, Artificial Sequence
  Description of Artificial Sequence: Synthetic oligonucleotide
tacagcctcagatccactggacactttaggc

SEQ ID NO: 219756 - DNA, 30 bp, Artificial Sequence
  Description of Artificial Sequence: Synthetic oligonucleotide
acagcctcagatccactggacactttaggc

SEQ ID NO: 219757 - DNA, 29 bp, Artificial Sequence
  Description of Artificial Sequence: Synthetic oligonucleotide
cagcctcagatccactggacactttaggc

SEQ ID NO: 219758 - DNA, 30 bp, Artificial Sequence
  Description of Artificial Sequence: Synthetic oligonucleotide
agcctcagatccactggacactttaggctc

SEQ ID NO: 219759 - DNA, 29 bp, Artificial Sequence
  Description of Artificial Sequence: Synthetic oligonucleotide
gcctcagatccactggacactttaggctc

SEQ ID NO: 219760 - DNA, 30 bp, Artificial Sequence
  Description of Artificial Sequence: Synthetic oligonucleotide
cctcagatccactggacactttaggctctg

SEQ ID NO: 219761 - DNA, 31 bp, Artificial Sequence
  Description of Artificial Sequence: Synthetic oligonucleotide
ctcagatccactggacactttaggctctgag

SEQ ID NO: 219762 - DNA, 31 bp, Artificial Sequence
  Description of Artificial Sequence: Synthetic oligonucleotide
tcagatccactggacactttaggctctgagg

SEQ ID NO: 219763 - DNA, 30 bp, Artificial Sequence
  Description of Artificial Sequence: Synthetic oligonucleotide
cagatccactggacactttaggctctgagg

SEQ ID NO: 219764 - DNA, 30 bp, Artificial Sequence
  Description of Artificial Sequence: Synthetic oligonucleotide
agatccactggacactttaggctctgaggg

SEQ ID NO: 219765 - DNA, 29 bp, Artificial Sequence
  Description of Artificial Sequence: Synthetic oligonucleotide
gatccactggacactttaggctctgaggg

SEQ ID NO: 219766 - DNA, 29 bp, Artificial Sequence
  Description of Artificial Sequence: Synthetic oligonucleotide
atccactggacactttaggctctgagggg

SEQ ID NO: 219767 - DNA, 28 bp, Artificial Sequence
  Description of Artificial Sequence: Synthetic oligonucleotide
tccactggacactttaggctctgagggg

SEQ ID NO: 219768 - DNA, 27 bp, Artificial Sequence
  Description of Artificial Sequence: Synthetic oligonucleotide
ccactggacactttaggctctgagggg

SEQ ID NO: 219769 - DNA, 27 bp, Artificial Sequence
  Description of Artificial Sequence: Synthetic oligonucleotide
cactggacactttaggctctgaggggg

SEQ ID NO: 219770 - DNA, 27 bp, Artificial Sequence
  Description of Artificial Sequence: Synthetic oligonucleotide
actggacactttaggctctgagggggc

SEQ ID NO: 219771 - DNA, 26 bp, Artificial Sequence
  Description of Artificial Sequence: Synthetic oligonucleotide
ctggacactttaggctctgagggggc

SEQ ID NO: 219772 - DNA, 30 bp, Artificial Sequence
  Description of Artificial Sequence: Synthetic oligonucleotide
agactggagataacctgtactggggctctc

SEQ ID NO: 219773 - DNA, 29 bp, Artificial Sequence
  Description of Artificial Sequence: Synthetic oligonucleotide
gactggagataacctgtactggggctctc

SEQ ID NO: 219774 - DNA, 30 bp, Artificial Sequence
  Description of Artificial Sequence: Synthetic oligonucleotide
actggagataacctgtactggggctctcag

SEQ ID NO: 219775 - DNA, 29 bp, Artificial Sequence
  Description of Artificial Sequence: Synthetic oligonucleotide
ctggagataacctgtactggggctctcag

SEQ ID NO: 219776 - DNA, 30 bp, Artificial Sequence
  Description of Artificial Sequence: Synthetic oligonucleotide
tggagataacctgtactggggctctcagtc

SEQ ID NO: 219777 - DNA, 29 bp, Artificial Sequence
  Description of Artificial Sequence: Synthetic oligonucleotide
ggagataacctgtactggggctctcagtc

SEQ ID NO: 219778 - DNA, 30 bp, Artificial Sequence
  Description of Artificial Sequence: Synthetic oligonucleotide
gagataacctgtactggggctctcagtcac

SEQ ID NO: 219779 - DNA, 31 bp, Artificial Sequence
  Description of Artificial Sequence: Synthetic oligonucleotide
agataacctgtactggggctctcagtcactg

SEQ ID NO: 219780 - DNA, 30 bp, Artificial Sequence
  Description of Artificial Sequence: Synthetic oligonucleotide
gataacctgtactggggctctcagtcactg

SEQ ID NO: 219781 - DNA, 30 bp, Artificial Sequence
  Description of Artificial Sequence: Synthetic oligonucleotide
ataacctgtactggggctctcagtcactgg

SEQ ID NO: 219782 - DNA, 29 bp, Artificial Sequence
  Description of Artificial Sequence: Synthetic oligonucleotide
taacctgtactggggctctcagtcactgg

SEQ ID NO: 219783 - DNA, 28 bp, Artificial Sequence
  Description of Artificial Sequence: Synthetic oligonucleotide
aacctgtactggggctctcagtcactgg

SEQ ID NO: 219784 - DNA, 27 bp, Artificial Sequence
  Description of Artificial Sequence: Synthetic oligonucleotide
acctgtactggggctctcagtcactgg

SEQ ID NO: 219785 - DNA, 27 bp, Artificial Sequence
  Description of Artificial Sequence: Synthetic oligonucleotide
cctgtactggggctctcagtcactggt

SEQ ID NO: 219786 - DNA, 28 bp, Artificial Sequence
  Description of Artificial Sequence: Synthetic oligonucleotide
ctgtactggggctctcagtcactggttc

SEQ ID NO: 219787 - DNA, 29 bp, Artificial Sequence
  Description of Artificial Sequence: Synthetic oligonucleotide
tgtactggggctctcagtcactggttctc

SEQ ID NO: 219788 - DNA, 28 bp, Artificial Sequence
  Description of Artificial Sequence: Synthetic oligonucleotide
gtactggggctctcagtcactggttctc

SEQ ID NO: 219789 - DNA, 29 bp, Artificial Sequence
  Description of Artificial Sequence: Synthetic oligonucleotide
tactggggctctcagtcactggttctcag

SEQ ID NO: 219790 - DNA, 28 bp, Artificial Sequence
  Description of Artificial Sequence: Synthetic oligonucleotide
actggggctctcagtcactggttctcag

SEQ ID NO: 219791 - DNA, 27 bp, Artificial Sequence
  Description of Artificial Sequence: Synthetic oligonucleotide
ctggggctctcagtcactggttctcag

SEQ ID NO: 219792 - DNA, 28 bp, Artificial Sequence
  Description of Artificial Sequence: Synthetic oligonucleotide
tggggctctcagtcactggttctcagag

SEQ ID NO: 219793 - DNA, 27 bp, Artificial Sequence
  Description of Artificial Sequence: Synthetic oligonucleotide
ggggctctcagtcactggttctcagag

SEQ ID NO: 219794 - DNA, 27 bp, Artificial Sequence
  Description of Artificial Sequence: Synthetic oligonucleotide
gggctctcagtcactggttctcagagc

SEQ ID NO: 219795 - DNA, 30 bp, Artificial Sequence
  Description of Artificial Sequence: Synthetic oligonucleotide
ggctctcagtcactggttctcagagcaatg

SEQ ID NO: 219796 - DNA, 30 bp, Artificial Sequence
  Description of Artificial Sequence: Synthetic oligonucleotide
gctctcagtcactggttctcagagcaatgc

SEQ ID NO: 219797 - DNA, 30 bp, Artificial Sequence
  Description of Artificial Sequence: Synthetic oligonucleotide
ctctcagtcactggttctcagagcaatgcc

SEQ ID NO: 219798 - DNA, 30 bp, Artificial Sequence
  Description of Artificial Sequence: Synthetic oligonucleotide
tctcagtcactggttctcagagcaatgccg

SEQ ID NO: 219799 - DNA, 22 bp, Artificial Sequence
  Description of Artificial Sequence: Synthetic oligonucleotide
cggcctggaggaggagctgcag

SEQ ID NO: 219800 - DNA, 28 bp, Artificial Sequence
  Description of Artificial Sequence: Synthetic oligonucleotide
atgagctctaagtacccgcggtctgtcc

SEQ ID NO: 219801 - DNA, 27 bp, Artificial Sequence
  Description of Artificial Sequence: Synthetic oligonucleotide
tgagctctaagtacccgcggtctgtcc

SEQ ID NO: 219802 - DNA, 26 bp, Artificial Sequence
  Description of Artificial Sequence: Synthetic oligonucleotide
gagctctaagtacccgcggtctgtcc

SEQ ID NO: 219803 - DNA, 26 bp, Artificial Sequence
  Description of Artificial Sequence: Synthetic oligonucleotide
agctctaagtacccgcggtctgtccg

SEQ ID NO: 219804 - DNA, 25 bp, Artificial Sequence
  Description of Artificial Sequence: Synthetic oligonucleotide
gctctaagtacccgcggtctgtccg

SEQ ID NO: 219805 - DNA, 25 bp, Artificial Sequence
  Description of Artificial Sequence: Synthetic oligonucleotide
ctctaagtacccgcggtctgtccgg

SEQ ID NO: 219806 - DNA, 25 bp, Artificial Sequence
  Description of Artificial Sequence: Synthetic oligonucleotide
tctaagtacccgcggtctgtccggc

SEQ ID NO: 219807 - DNA, 24 bp, Artificial Sequence
  Description of Artificial Sequence: Synthetic oligonucleotide
ctaagtacccgcggtctgtccggc

SEQ ID NO: 219808 - DNA, 24 bp, Artificial Sequence
  Description of Artificial Sequence: Synthetic oligonucleotide
taagtacccgcggtctgtccggcg

SEQ ID NO: 219809 - DNA, 23 bp, Artificial Sequence
  Description of Artificial Sequence: Synthetic oligonucleotide
aagtacccgcggtctgtccggcg

SEQ ID NO: 219810 - DNA, 22 bp, Artificial Sequence
  Description of Artificial Sequence: Synthetic oligonucleotide
agtacccgcggtctgtccggcg

SEQ ID NO: 219811 - DNA, 21 bp, Artificial Sequence
  Description of Artificial Sequence: Synthetic oligonucleotide
gtacccgcggtctgtccggcg

SEQ ID NO: 219812 - DNA, 22 bp, Artificial Sequence
  Description of Artificial Sequence: Synthetic oligonucleotide
tacccgcggtctgtccggcgct

SEQ ID NO: 219813 - DNA, 21 bp, Artificial Sequence
  Description of Artificial Sequence: Synthetic oligonucleotide
acccgcggtctgtccggcgct

SEQ ID NO: 219814 - DNA, 20 bp, Artificial Sequence
  Description of Artificial Sequence: Synthetic oligonucleotide
cccgcggtctgtccggcgct

SEQ ID NO: 219815 - DNA, 20 bp, Artificial Sequence
  Description of Artificial Sequence: Synthetic oligonucleotide
ccgcggtctgtccggcgctg

SEQ ID NO: 219816 - DNA, 20 bp, Artificial Sequence
  Description of Artificial Sequence: Synthetic oligonucleotide
cgcggtctgtccggcgctgc

SEQ ID NO: 219817 - DNA, 21 bp, Artificial Sequence
  Description of Artificial Sequence: Synthetic oligonucleotide
gcggtctgtccggcgctgcct

SEQ ID NO: 219818 - DNA, 21 bp, Artificial Sequence
  Description of Artificial Sequence: Synthetic oligonucleotide
cggtctgtccggcgctgcctg

SEQ ID NO: 219819 - DNA, 21 bp, Artificial Sequence
  Description of Artificial Sequence: Synthetic oligonucleotide
ggtctgtccggcgctgcctgc

SEQ ID NO: 219820 - DNA, 21 bp, Artificial Sequence
  Description of Artificial Sequence: Synthetic oligonucleotide
gtctgtccggcgctgcctgcc

SEQ ID NO: 219821 - DNA, 21 bp, Artificial Sequence
  Description of Artificial Sequence: Synthetic oligonucleotide
tctgtccggcgctgcctgccc

SEQ ID NO: 219822 - DNA, 20 bp, Artificial Sequence
  Description of Artificial Sequence: Synthetic oligonucleotide
ctgtccggcgctgcctgccc

SEQ ID NO: 219823 - DNA, 21 bp, Artificial Sequence
  Description of Artificial Sequence: Synthetic oligonucleotide
tgtccggcgctgcctgcccct

SEQ ID NO: 219824 - DNA, 20 bp, Artificial Sequence
  Description of Artificial Sequence: Synthetic oligonucleotide
gtccggcgctgcctgcccct

SEQ ID NO: 219825 - DNA, 21 bp, Artificial Sequence
  Description of Artificial Sequence: Synthetic oligonucleotide
tccggcgctgcctgcccctct

SEQ ID NO: 219826 - DNA, 20 bp, Artificial Sequence
  Description of Artificial Sequence: Synthetic oligonucleotide
ccggcgctgcctgcccctct

SEQ ID NO: 219827 - DNA, 20 bp, Artificial Sequence
  Description of Artificial Sequence: Synthetic oligonucleotide
cggcgctgcctgcccctctg

SEQ ID NO: 219828 - DNA, 20 bp, Artificial Sequence
  Description of Artificial Sequence: Synthetic oligonucleotide
ggcgctgcctgcccctctgc

SEQ ID NO: 219829 - DNA, 20 bp, Artificial Sequence
  Description of Artificial Sequence: Synthetic oligonucleotide
gcgctgcctgcccctctgcg

SEQ ID NO: 219830 - DNA, 20 bp, Artificial Sequence
  Description of Artificial Sequence: Synthetic oligonucleotide
cgctgcctgcccctctgcgc

SEQ ID NO: 219831 - DNA, 20 bp, Artificial Sequence
  Description of Artificial Sequence: Synthetic oligonucleotide
gctgcctgcccctctgcgcc

SEQ ID NO: 219832 - DNA, 23 bp, Artificial Sequence
  Description of Artificial Sequence: Synthetic oligonucleotide
ctgcctgcccctctgcgccctaa

SEQ ID NO: 219833 - DNA, 24 bp, Artificial Sequence
  Description of Artificial Sequence: Synthetic oligonucleotide
tgcctgcccctctgcgccctaaca

SEQ ID NO: 219834 - DNA, 23 bp, Artificial Sequence
  Description of Artificial Sequence: Synthetic oligonucleotide
gcctgcccctctgcgccctaaca

SEQ ID NO: 219835 - DNA, 24 bp, Artificial Sequence
  Description of Artificial Sequence: Synthetic oligonucleotide
cctgcccctctgcgccctaacact

SEQ ID NO: 219836 - DNA, 24 bp, Artificial Sequence
  Description of Artificial Sequence: Synthetic oligonucleotide
ctgcccctctgcgccctaacactg

SEQ ID NO: 219837 - DNA, 26 bp, Artificial Sequence
  Description of Artificial Sequence: Synthetic oligonucleotide
tgcccctctgcgccctaacactggaa

SEQ ID NO: 219838 - DNA, 25 bp, Artificial Sequence
  Description of Artificial Sequence: Synthetic oligonucleotide
gcccctctgcgccctaacactggaa

SEQ ID NO: 219839 - DNA, 25 bp, Artificial Sequence
  Description of Artificial Sequence: Synthetic oligonucleotide
cccctctgcgccctaacactggaag

SEQ ID NO: 219840 - DNA, 26 bp, Artificial Sequence
  Description of Artificial Sequence: Synthetic oligonucleotide
ccctctgcgccctaacactggaagca

SEQ ID NO: 219841 - DNA, 26 bp, Artificial Sequence
  Description of Artificial Sequence: Synthetic oligonucleotide
cctctgcgccctaacactggaagcag

SEQ ID NO: 219842 - DNA, 27 bp, Artificial Sequence
  Description of Artificial Sequence: Synthetic oligonucleotide
ctctgcgccctaacactggaagcagct

SEQ ID NO: 219843 - DNA, 27 bp, Artificial Sequence
  Description of Artificial Sequence: Synthetic oligonucleotide
tctgcgccctaacactggaagcagctc

SEQ ID NO: 219844 - DNA, 27 bp, Artificial Sequence
  Description of Artificial Sequence: Synthetic oligonucleotide
ctgcgccctaacactggaagcagctct

SEQ ID NO: 219845 - DNA, 27 bp, Artificial Sequence
  Description of Artificial Sequence: Synthetic oligonucleotide
tgcgccctaacactggaagcagctctc

SEQ ID NO: 219846 - DNA, 27 bp, Artificial Sequence
  Description of Artificial Sequence: Synthetic oligonucleotide
gcgccctaacactggaagcagctctca

SEQ ID NO: 219847 - DNA, 29 bp, Artificial Sequence
  Description of Artificial Sequence: Synthetic oligonucleotide
cgccctaacactggaagcagctctcattc

SEQ ID NO: 219848 - DNA, 30 bp, Artificial Sequence
  Description of Artificial Sequence: Synthetic oligonucleotide
gccctaacactggaagcagctctcattctc

SEQ ID NO: 219849 - DNA, 30 bp, Artificial Sequence
  Description of Artificial Sequence: Synthetic oligonucleotide
ccctaacactggaagcagctctcattctcc

SEQ ID NO: 219850 - DNA, 31 bp, Artificial Sequence
  Description of Artificial Sequence: Synthetic oligonucleotide
cctaacactggaagcagctctcattctcctc

SEQ ID NO: 219851 - DNA, 33 bp, Artificial Sequence
  Description of Artificial Sequence: Synthetic oligonucleotide
ctaacactggaagcagctctcattctcctcttc

SEQ ID NO: 219852 - DNA, 43 bp, Artificial Sequence
  Description of Artificial Sequence: Synthetic oligonucleotide
taacactggaagcagctctcattctcctcttctatttttttac

SEQ ID NO: 219853 - DNA, 42 bp, Artificial Sequence
  Description of Artificial Sequence: Synthetic oligonucleotide
aacactggaagcagctctcattctcctcttctatttttttac

SEQ ID NO: 219854 - DNA, 41 bp, Artificial Sequence
  Description of Artificial Sequence: Synthetic oligonucleotide
acactggaagcagctctcattctcctcttctatttttttac

SEQ ID NO: 219855 - DNA, 40 bp, Artificial Sequence
  Description of Artificial Sequence: Synthetic oligonucleotide
cactggaagcagctctcattctcctcttctatttttttac

SEQ ID NO: 219856 - DNA, 40 bp, Artificial Sequence
  Description of Artificial Sequence: Synthetic oligonucleotide
actggaagcagctctcattctcctcttctatttttttacc

SEQ ID NO: 219857 - DNA, 39 bp, Artificial Sequence
  Description of Artificial Sequence: Synthetic oligonucleotide
ctggaagcagctctcattctcctcttctatttttttacc

SEQ ID NO: 219858 - DNA, 39 bp, Artificial Sequence
  Description of Artificial Sequence: Synthetic oligonucleotide
tggaagcagctctcattctcctcttctatttttttaccc

SEQ ID NO: 219859 - DNA, 38 bp, Artificial Sequence
  Description of Artificial Sequence: Synthetic oligonucleotide
ggaagcagctctcattctcctcttctatttttttaccc

SEQ ID NO: 219860 - DNA, 39 bp, Artificial Sequence
  Description of Artificial Sequence: Synthetic oligonucleotide
gaagcagctctcattctcctcttctatttttttacccac

SEQ ID NO: 219861 - DNA, 42 bp, Artificial Sequence
  Description of Artificial Sequence: Synthetic oligonucleotide
aagcagctctcattctcctcttctatttttttacccactatg

SEQ ID NO: 219862 - DNA, 41 bp, Artificial Sequence
  Description of Artificial Sequence: Synthetic oligonucleotide
agcagctctcattctcctcttctatttttttacccactatg

SEQ ID NO: 219863 - DNA, 40 bp, Artificial Sequence
  Description of Artificial Sequence: Synthetic oligonucleotide
gcagctctcattctcctcttctatttttttacccactatg

SEQ ID NO: 219864 - DNA, 41 bp, Artificial Sequence
  Description of Artificial Sequence: Synthetic oligonucleotide
cagctctcattctcctcttctatttttttacccactatgac

SEQ ID NO: 219865 - DNA, 41 bp, Artificial Sequence
  Description of Artificial Sequence: Synthetic oligonucleotide
agctctcattctcctcttctatttttttacccactatgacg

SEQ ID NO: 219866 - DNA, 40 bp, Artificial Sequence
  Description of Artificial Sequence: Synthetic oligonucleotide
gctctcattctcctcttctatttttttacccactatgacg

SEQ ID NO: 219867 - DNA, 40 bp, Artificial Sequence
  Description of Artificial Sequence: Synthetic oligonucleotide
ctctcattctcctcttctatttttttacccactatgacgc

SEQ ID NO: 219868 - DNA, 42 bp, Artificial Sequence
  Description of Artificial Sequence: Synthetic oligonucleotide
tctcattctcctcttctatttttttacccactatgacgcttc

SEQ ID NO: 219869 - DNA, 41 bp, Artificial Sequence
  Description of Artificial Sequence: Synthetic oligonucleotide
ctcattctcctcttctatttttttacccactatgacgcttc

SEQ ID NO: 219870 - DNA, 41 bp, Artificial Sequence
  Description of Artificial Sequence: Synthetic oligonucleotide
tcattctcctcttctatttttttacccactatgacgcttcc

SEQ ID NO: 219871 - DNA, 40 bp, Artificial Sequence
  Description of Artificial Sequence: Synthetic oligonucleotide
cattctcctcttctatttttttacccactatgacgcttcc

SEQ ID NO: 219872 - DNA, 43 bp, Artificial Sequence
  Description of Artificial Sequence: Synthetic oligonucleotide
attctcctcttctatttttttacccactatgacgcttccttag

SEQ ID NO: 219873 - DNA, 42 bp, Artificial Sequence
  Description of Artificial Sequence: Synthetic oligonucleotide
ttctcctcttctatttttttacccactatgacgcttccttag

SEQ ID NO: 219874 - DNA, 41 bp, Artificial Sequence
  Description of Artificial Sequence: Synthetic oligonucleotide
tctcctcttctatttttttacccactatgacgcttccttag

SEQ ID NO: 219875 - DNA, 40 bp, Artificial Sequence
  Description of Artificial Sequence: Synthetic oligonucleotide
ctcctcttctatttttttacccactatgacgcttccttag

SEQ ID NO: 219876 - DNA, 41 bp, Artificial Sequence
  Description of Artificial Sequence: Synthetic oligonucleotide
tcctcttctatttttttacccactatgacgcttccttagag

SEQ ID NO: 219877 - DNA, 40 bp, Artificial Sequence
  Description of Artificial Sequence: Synthetic oligonucleotide
cctcttctatttttttacccactatgacgcttccttagag

SEQ ID NO: 219878 - DNA, 40 bp, Artificial Sequence
  Description of Artificial Sequence: Synthetic oligonucleotide
ctcttctatttttttacccactatgacgcttccttagagg

SEQ ID NO: 219879 - DNA, 42 bp, Artificial Sequence
  Description of Artificial Sequence: Synthetic oligonucleotide
tcttctatttttttacccactatgacgcttccttagaggatc

SEQ ID NO: 219880 - DNA, 41 bp, Artificial Sequence
  Description of Artificial Sequence: Synthetic oligonucleotide
cttctatttttttacccactatgacgcttccttagaggatc

SEQ ID NO: 219881 - DNA, 45 bp, Artificial Sequence
  Description of Artificial Sequence: Synthetic oligonucleotide
ttctatttttttacccactatgacgcttccttagaggatcaaaag

SEQ ID NO: 219882 - DNA, 44 bp, Artificial Sequence
  Description of Artificial Sequence: Synthetic oligonucleotide
tctatttttttacccactatgacgcttccttagaggatcaaaag

SEQ ID NO: 219883 - DNA, 43 bp, Artificial Sequence
  Description of Artificial Sequence: Synthetic oligonucleotide
ctatttttttacccactatgacgcttccttagaggatcaaaag

SEQ ID NO: 219884 - DNA, 43 bp, Artificial Sequence
  Description of Artificial Sequence: Synthetic oligonucleotide
tatttttttacccactatgacgcttccttagaggatcaaaagg

SEQ ID NO: 219885 - DNA, 42 bp, Artificial Sequence
  Description of Artificial Sequence: Synthetic oligonucleotide
atttttttacccactatgacgcttccttagaggatcaaaagg

SEQ ID NO: 219886 - DNA, 41 bp, Artificial Sequence
  Description of Artificial Sequence: Synthetic oligonucleotide
tttttttacccactatgacgcttccttagaggatcaaaagg

SEQ ID NO: 219887 - DNA, 40 bp, Artificial Sequence
  Description of Artificial Sequence: Synthetic oligonucleotide
ttttttacccactatgacgcttccttagaggatcaaaagg

SEQ ID NO: 219888 - DNA, 39 bp, Artificial Sequence
  Description of Artificial Sequence: Synthetic oligonucleotide
tttttacccactatgacgcttccttagaggatcaaaagg

SEQ ID NO: 219889 - DNA, 38 bp, Artificial Sequence
  Description of Artificial Sequence: Synthetic oligonucleotide
ttttacccactatgacgcttccttagaggatcaaaagg

SEQ ID NO: 219890 - DNA, 37 bp, Artificial Sequence
  Description of Artificial Sequence: Synthetic oligonucleotide
tttacccactatgacgcttccttagaggatcaaaagg

SEQ ID NO: 219891 - DNA, 36 bp, Artificial Sequence
  Description of Artificial Sequence: Synthetic oligonucleotide
ttacccactatgacgcttccttagaggatcaaaagg

SEQ ID NO: 219892 - DNA, 35 bp, Artificial Sequence
  Description of Artificial Sequence: Synthetic oligonucleotide
tacccactatgacgcttccttagaggatcaaaagg

SEQ ID NO: 219893 - DNA, 34 bp, Artificial Sequence
  Description of Artificial Sequence: Synthetic oligonucleotide
acccactatgacgcttccttagaggatcaaaagg

SEQ ID NO: 219894 - DNA, 33 bp, Artificial Sequence
  Description of Artificial Sequence: Synthetic oligonucleotide
cccactatgacgcttccttagaggatcaaaagg

SEQ ID NO: 219895 - DNA, 33 bp, Artificial Sequence
  Description of Artificial Sequence: Synthetic oligonucleotide
ccactatgacgcttccttagaggatcaaaaggg

SEQ ID NO: 219896 - DNA, 33 bp, Artificial Sequence
  Description of Artificial Sequence: Synthetic oligonucleotide
cactatgacgcttccttagaggatcaaaagggg

SEQ ID NO: 219897 - DNA, 33 bp, Artificial Sequence
  Description of Artificial Sequence: Synthetic oligonucleotide
actatgacgcttccttagaggatcaaaaggggc

SEQ ID NO: 219898 - DNA, 32 bp, Artificial Sequence
  Description of Artificial Sequence: Synthetic oligonucleotide
ctatgacgcttccttagaggatcaaaaggggc

SEQ ID NO: 219899 - DNA, 33 bp, Artificial Sequence
  Description of Artificial Sequence: Synthetic oligonucleotide
tatgacgcttccttagaggatcaaaaggggctc

SEQ ID NO: 219900 - DNA, 32 bp, Artificial Sequence
  Description of Artificial Sequence: Synthetic oligonucleotide
atgacgcttccttagaggatcaaaaggggctc

SEQ ID NO: 219901 - DNA, 31 bp, Artificial Sequence
  Description of Artificial Sequence: Synthetic oligonucleotide
tgacgcttccttagaggatcaaaaggggctc

SEQ ID NO: 219902 - DNA, 30 bp, Artificial Sequence
  Description of Artificial Sequence: Synthetic oligonucleotide
gacgcttccttagaggatcaaaaggggctc

SEQ ID NO: 219903 - DNA, 30 bp, Artificial Sequence
  Description of Artificial Sequence: Synthetic oligonucleotide
acgcttccttagaggatcaaaaggggctcg

SEQ ID NO: 219904 - DNA, 29 bp, Artificial Sequence
  Description of Artificial Sequence: Synthetic oligonucleotide
cgcttccttagaggatcaaaaggggctcg

SEQ ID NO: 219905 - DNA, 30 bp, Artificial Sequence
  Description of Artificial Sequence: Synthetic oligonucleotide
gcttccttagaggatcaaaaggggctcgtg

SEQ ID NO: 219906 - DNA, 30 bp, Artificial Sequence
  Description of Artificial Sequence: Synthetic oligonucleotide
cttccttagaggatcaaaaggggctcgtgg

SEQ ID NO: 219907 - DNA, 30 bp, Artificial Sequence
  Description of Artificial Sequence: Synthetic oligonucleotide
ttccttagaggatcaaaaggggctcgtggc

SEQ ID NO: 219908 - DNA, 29 bp, Artificial Sequence
  Description of Artificial Sequence: Synthetic oligonucleotide
tccttagaggatcaaaaggggctcgtggc

SEQ ID NO: 219909 - DNA, 28 bp, Artificial Sequence
  Description of Artificial Sequence: Synthetic oligonucleotide
ccttagaggatcaaaaggggctcgtggc

SEQ ID NO: 219910 - DNA, 30 bp, Artificial Sequence
  Description of Artificial Sequence: Synthetic oligonucleotide
cttagaggatcaaaaggggctcgtggcatc

SEQ ID NO: 219911 - DNA, 30 bp, Artificial Sequence
  Description of Artificial Sequence: Synthetic oligonucleotide
ttagaggatcaaaaggggctcgtggcatcc

SEQ ID NO: 219912 - DNA, 29 bp, Artificial Sequence
  Description of Artificial Sequence: Synthetic oligonucleotide
tagaggatcaaaaggggctcgtggcatcc

SEQ ID NO: 219913 - DNA, 28 bp, Artificial Sequence
  Description of Artificial Sequence: Synthetic oligonucleotide
agaggatcaaaaggggctcgtggcatcc

SEQ ID NO: 219914 - DNA, 27 bp, Artificial Sequence
  Description of Artificial Sequence: Synthetic oligonucleotide
gaggatcaaaaggggctcgtggcatcc

SEQ ID NO: 219915 - DNA, 30 bp, Artificial Sequence
  Description of Artificial Sequence: Synthetic oligonucleotide
aggatcaaaaggggctcgtggcatcctatc

SEQ ID NO: 219916 - DNA, 29 bp, Artificial Sequence
  Description of Artificial Sequence: Synthetic oligonucleotide
ggatcaaaaggggctcgtggcatcctatc

SEQ ID NO: 219917 - DNA, 31 bp, Artificial Sequence
  Description of Artificial Sequence: Synthetic oligonucleotide
gatcaaaaggggctcgtggcatcctatcaag

SEQ ID NO: 219918 - DNA, 32 bp, Artificial Sequence
  Description of Artificial Sequence: Synthetic oligonucleotide
atcaaaaggggctcgtggcatcctatcaagtc

SEQ ID NO: 219919 - DNA, 31 bp, Artificial Sequence
  Description of Artificial Sequence: Synthetic oligonucleotide
tcaaaaggggctcgtggcatcctatcaagtc

SEQ ID NO: 219920 - DNA, 30 bp, Artificial Sequence
  Description of Artificial Sequence: Synthetic oligonucleotide
caaaaggggctcgtggcatcctatcaagtc

SEQ ID NO: 219921 - DNA, 30 bp, Artificial Sequence
  Description of Artificial Sequence: Synthetic oligonucleotide
aaaaggggctcgtggcatcctatcaagtcg

SEQ ID NO: 219922 - DNA, 29 bp, Artificial Sequence
  Description of Artificial Sequence: Synthetic oligonucleotide
aaaggggctcgtggcatcctatcaagtcg

SEQ ID NO: 219923 - DNA, 28 bp, Artificial Sequence
  Description of Artificial Sequence: Synthetic oligonucleotide
aaggggctcgtggcatcctatcaagtcg

SEQ ID NO: 219924 - DNA, 27 bp, Artificial Sequence
  Description of Artificial Sequence: Synthetic oligonucleotide
aggggctcgtggcatcctatcaagtcg

SEQ ID NO: 219925 - DNA, 26 bp, Artificial Sequence
  Description of Artificial Sequence: Synthetic oligonucleotide
ggggctcgtggcatcctatcaagtcg

SEQ ID NO: 219926 - DNA, 26 bp, Artificial Sequence
  Description of Artificial Sequence: Synthetic oligonucleotide
gggctcgtggcatcctatcaagtcgg

SEQ ID NO: 219927 - DNA, 26 bp, Artificial Sequence
  Description of Artificial Sequence: Synthetic oligonucleotide
ggctcgtggcatcctatcaagtcggc

SEQ ID NO: 219928 - DNA, 27 bp, Artificial Sequence
  Description of Artificial Sequence: Synthetic oligonucleotide
gctcgtggcatcctatcaagtcggcca

SEQ ID NO: 219929 - DNA, 28 bp, Artificial Sequence
  Description of Artificial Sequence: Synthetic oligonucleotide
ctcgtggcatcctatcaagtcggccaag

SEQ ID NO: 219930 - DNA, 30 bp, Artificial Sequence
  Description of Artificial Sequence: Synthetic oligonucleotide
tcgtggcatcctatcaagtcggccaagatc

SEQ ID NO: 219931 - DNA, 29 bp, Artificial Sequence
  Description of Artificial Sequence: Synthetic oligonucleotide
cgtggcatcctatcaagtcggccaagatc

SEQ ID NO: 219932 - DNA, 30 bp, Artificial Sequence
  Description of Artificial Sequence: Synthetic oligonucleotide
gtggcatcctatcaagtcggccaagatctg

SEQ ID NO: 219933 - DNA, 31 bp, Artificial Sequence
  Description of Artificial Sequence: Synthetic oligonucleotide
tggcatcctatcaagtcggccaagatctgac

SEQ ID NO: 219934 - DNA, 30 bp, Artificial Sequence
  Description of Artificial Sequence: Synthetic oligonucleotide
ggcatcctatcaagtcggccaagatctgac

SEQ ID NO: 219935 - DNA, 30 bp, Artificial Sequence
  Description of Artificial Sequence: Synthetic oligonucleotide
gcatcctatcaagtcggccaagatctgacc

SEQ ID NO: 219936 - DNA, 30 bp, Artificial Sequence
  Description of Artificial Sequence: Synthetic oligonucleotide
catcctatcaagtcggccaagatctgaccg

SEQ ID NO: 219937 - DNA, 31 bp, Artificial Sequence
  Description of Artificial Sequence: Synthetic oligonucleotide
atcctatcaagtcggccaagatctgaccgtg

SEQ ID NO: 219938 - DNA, 30 bp, Artificial Sequence
  Description of Artificial Sequence: Synthetic oligonucleotide
tcctatcaagtcggccaagatctgaccgtg

SEQ ID NO: 219939 - DNA, 29 bp, Artificial Sequence
  Description of Artificial Sequence: Synthetic oligonucleotide
cctatcaagtcggccaagatctgaccgtg

SEQ ID NO: 219940 - DNA, 31 bp, Artificial Sequence
  Description of Artificial Sequence: Synthetic oligonucleotide
ctatcaagtcggccaagatctgaccgtgatg

SEQ ID NO: 219941 - DNA, 31 bp, Artificial Sequence
  Description of Artificial Sequence: Synthetic oligonucleotide
tatcaagtcggccaagatctgaccgtgatgg

SEQ ID NO: 219942 - DNA, 30 bp, Artificial Sequence
  Description of Artificial Sequence: Synthetic oligonucleotide
atcaagtcggccaagatctgaccgtgatgg

SEQ ID NO: 219943 - DNA, 29 bp, Artificial Sequence
  Description of Artificial Sequence: Synthetic oligonucleotide
tcaagtcggccaagatctgaccgtgatgg

SEQ ID NO: 219944 - DNA, 28 bp, Artificial Sequence
  Description of Artificial Sequence: Synthetic oligonucleotide
caagtcggccaagatctgaccgtgatgg

SEQ ID NO: 219945 - DNA, 28 bp, Artificial Sequence
  Description of Artificial Sequence: Synthetic oligonucleotide
aagtcggccaagatctgaccgtgatggc

SEQ ID NO: 219946 - DNA, 27 bp, Artificial Sequence
  Description of Artificial Sequence: Synthetic oligonucleotide
agtcggccaagatctgaccgtgatggc

SEQ ID NO: 219947 - DNA, 26 bp, Artificial Sequence
  Description of Artificial Sequence: Synthetic oligonucleotide
gtcggccaagatctgaccgtgatggc

SEQ ID NO: 219948 - DNA, 26 bp, Artificial Sequence
  Description of Artificial Sequence: Synthetic oligonucleotide
tcggccaagatctgaccgtgatggcg

SEQ ID NO: 219949 - DNA, 25 bp, Artificial Sequence
  Description of Artificial Sequence: Synthetic oligonucleotide
cggccaagatctgaccgtgatggcg

SEQ ID NO: 219950 - DNA, 25 bp, Artificial Sequence
  Description of Artificial Sequence: Synthetic oligonucleotide
ggccaagatctgaccgtgatggcgg

SEQ ID NO: 219951 - DNA, 25 bp, Artificial Sequence
  Description of Artificial Sequence: Synthetic oligonucleotide
gccaagatctgaccgtgatggcggc

SEQ ID NO: 219952 - DNA, 25 bp, Artificial Sequence
  Description of Artificial Sequence: Synthetic oligonucleotide
ccaagatctgaccgtgatggcggcc

SEQ ID NO: 219953 - DNA, 27 bp, Artificial Sequence
  Description of Artificial Sequence: Synthetic oligonucleotide
caagatctgaccgtgatggcggccctt

SEQ ID NO: 219954 - DNA, 27 bp, Artificial Sequence
  Description of Artificial Sequence: Synthetic oligonucleotide
aagatctgaccgtgatggcggcccttg

SEQ ID NO: 219955 - DNA, 26 bp, Artificial Sequence
  Description of Artificial Sequence: Synthetic oligonucleotide
agatctgaccgtgatggcggcccttg

SEQ ID NO: 219956 - DNA, 25 bp, Artificial Sequence
  Description of Artificial Sequence: Synthetic oligonucleotide
gatctgaccgtgatggcggcccttg

SEQ ID NO: 219957 - DNA, 25 bp, Artificial Sequence
  Description of Artificial Sequence: Synthetic oligonucleotide
atctgaccgtgatggcggcccttgg

SEQ ID NO: 219958 - DNA, 24 bp, Artificial Sequence
  Description of Artificial Sequence: Synthetic oligonucleotide
tctgaccgtgatggcggcccttgg

SEQ ID NO: 219959 - DNA, 23 bp, Artificial Sequence
  Description of Artificial Sequence: Synthetic oligonucleotide
ctgaccgtgatggcggcccttgg

SEQ ID NO: 219960 - DNA, 25 bp, Artificial Sequence
  Description of Artificial Sequence: Synthetic oligonucleotide
tgaccgtgatggcggcccttggctt

SEQ ID NO: 219961 - DNA, 24 bp, Artificial Sequence
  Description of Artificial Sequence: Synthetic oligonucleotide
gaccgtgatggcggcccttggctt

SEQ ID NO: 219962 - DNA, 24 bp, Artificial Sequence
  Description of Artificial Sequence: Synthetic oligonucleotide
accgtgatggcggcccttggcttg

SEQ ID NO: 219963 - DNA, 23 bp, Artificial Sequence
  Description of Artificial Sequence: Synthetic oligonucleotide
ccgtgatggcggcccttggcttg

SEQ ID NO: 219964 - DNA, 23 bp, Artificial Sequence
  Description of Artificial Sequence: Synthetic oligonucleotide
cgtgatggcggcccttggcttgg

SEQ ID NO: 219965 - DNA, 23 bp, Artificial Sequence
  Description of Artificial Sequence: Synthetic oligonucleotide
gtgatggcggcccttggcttggg

SEQ ID NO: 219966 - DNA, 25 bp, Artificial Sequence
  Description of Artificial Sequence: Synthetic oligonucleotide
tgatggcggcccttggcttgggctt

SEQ ID NO: 219967 - DNA, 24 bp, Artificial Sequence
  Description of Artificial Sequence: Synthetic oligonucleotide
gatggcggcccttggcttgggctt

SEQ ID NO: 219968 - DNA, 24 bp, Artificial Sequence
  Description of Artificial Sequence: Synthetic oligonucleotide
atggcggcccttggcttgggcttc

SEQ ID NO: 219969 - DNA, 23 bp, Artificial Sequence
  Description of Artificial Sequence: Synthetic oligonucleotide
tggcggcccttggcttgggcttc

SEQ ID NO: 219970 - DNA, 22 bp, Artificial Sequence
  Description of Artificial Sequence: Synthetic oligonucleotide
ggcggcccttggcttgggcttc

SEQ ID NO: 219971 - DNA, 23 bp, Artificial Sequence
  Description of Artificial Sequence: Synthetic oligonucleotide
gcggcccttggcttgggcttcct

SEQ ID NO: 219972 - DNA, 24 bp, Artificial Sequence
  Description of Artificial Sequence: Synthetic oligonucleotide
cggcccttggcttgggcttcctca

SEQ ID NO: 219973 - DNA, 24 bp, Artificial Sequence
  Description of Artificial Sequence: Synthetic oligonucleotide
ggcccttggcttgggcttcctcac

SEQ ID NO: 219974 - DNA, 25 bp, Artificial Sequence
  Description of Artificial Sequence: Synthetic oligonucleotide
gcccttggcttgggcttcctcacct

SEQ ID NO: 219975 - DNA, 27 bp, Artificial Sequence
  Description of Artificial Sequence: Synthetic oligonucleotide
cccttggcttgggcttcctcacctcaa

SEQ ID NO: 219976 - DNA, 31 bp, Artificial Sequence
  Description of Artificial Sequence: Synthetic oligonucleotide
ccttggcttgggcttcctcacctcaaatttc

SEQ ID NO: 219977 - DNA, 31 bp, Artificial Sequence
  Description of Artificial Sequence: Synthetic oligonucleotide
cttggcttgggcttcctcacctcaaatttcc

SEQ ID NO: 219978 - DNA, 31 bp, Artificial Sequence
  Description of Artificial Sequence: Synthetic oligonucleotide
ttggcttgggcttcctcacctcaaatttccg

SEQ ID NO: 219979 - DNA, 30 bp, Artificial Sequence
  Description of Artificial Sequence: Synthetic oligonucleotide
tggcttgggcttcctcacctcaaatttccg

SEQ ID NO: 219980 - DNA, 29 bp, Artificial Sequence
  Description of Artificial Sequence: Synthetic oligonucleotide
ggcttgggcttcctcacctcaaatttccg

SEQ ID NO: 219981 - DNA, 29 bp, Artificial Sequence
  Description of Artificial Sequence: Synthetic oligonucleotide
gcttgggcttcctcacctcaaatttccgg

SEQ ID NO: 219982 - DNA, 30 bp, Artificial Sequence
  Description of Artificial Sequence: Synthetic oligonucleotide
cttgggcttcctcacctcaaatttccggag

SEQ ID NO: 219983 - DNA, 31 bp, Artificial Sequence
  Description of Artificial Sequence: Synthetic oligonucleotide
ttgggcttcctcacctcaaatttccggagac

SEQ ID NO: 219984 - DNA, 30 bp, Artificial Sequence
  Description of Artificial Sequence: Synthetic oligonucleotide
tgggcttcctcacctcaaatttccggagac

SEQ ID NO: 219985 - DNA, 29 bp, Artificial Sequence
  Description of Artificial Sequence: Synthetic oligonucleotide
gggcttcctcacctcaaatttccggagac

SEQ ID NO: 219986 - DNA, 30 bp, Artificial Sequence
  Description of Artificial Sequence: Synthetic oligonucleotide
ggcttcctcacctcaaatttccggagacac

SEQ ID NO: 219987 - DNA, 31 bp, Artificial Sequence
  Description of Artificial Sequence: Synthetic oligonucleotide
gcttcctcacctcaaatttccggagacacag

SEQ ID NO: 219988 - DNA, 31 bp, Artificial Sequence
  Description of Artificial Sequence: Synthetic oligonucleotide
cttcctcacctcaaatttccggagacacagc

SEQ ID NO: 219989 - DNA, 32 bp, Artificial Sequence
  Description of Artificial Sequence: Synthetic oligonucleotide
ttcctcacctcaaatttccggagacacagctg

SEQ ID NO: 219990 - DNA, 31 bp, Artificial Sequence
  Description of Artificial Sequence: Synthetic oligonucleotide
tcctcacctcaaatttccggagacacagctg

SEQ ID NO: 219991 - DNA, 30 bp, Artificial Sequence
  Description of Artificial Sequence: Synthetic oligonucleotide
cctcacctcaaatttccggagacacagctg

SEQ ID NO: 219992 - DNA, 30 bp, Artificial Sequence
  Description of Artificial Sequence: Synthetic oligonucleotide
ctcacctcaaatttccggagacacagctgg

SEQ ID NO: 219993 - DNA, 31 bp, Artificial Sequence
  Description of Artificial Sequence: Synthetic oligonucleotide
tcacctcaaatttccggagacacagctggag

SEQ ID NO: 219994 - DNA, 30 bp, Artificial Sequence
  Description of Artificial Sequence: Synthetic oligonucleotide
cacctcaaatttccggagacacagctggag

SEQ ID NO: 219995 - DNA, 30 bp, Artificial Sequence
  Description of Artificial Sequence: Synthetic oligonucleotide
acctcaaatttccggagacacagctggagc

SEQ ID NO: 219996 - DNA, 29 bp, Artificial Sequence
  Description of Artificial Sequence: Synthetic oligonucleotide
cctcaaatttccggagacacagctggagc

SEQ ID NO: 219997 - DNA, 30 bp, Artificial Sequence
  Description of Artificial Sequence: Synthetic oligonucleotide
ctcaaatttccggagacacagctggagcag

SEQ ID NO: 219998 - DNA, 31 bp, Artificial Sequence
  Description of Artificial Sequence: Synthetic oligonucleotide
tcaaatttccggagacacagctggagcagtg

SEQ ID NO: 219999 - DNA, 30 bp, Artificial Sequence
  Description of Artificial Sequence: Synthetic oligonucleotide
caaatttccggagacacagctggagcagtg

SEQ ID NO: 220000 - DNA, 31 bp, Artificial Sequence
  Description of Artificial Sequence: Synthetic oligonucleotide
aaatttccggagacacagctggagcagtgtg

SEQ ID NO: 220001 - DNA, 30 bp, Artificial Sequence
  Description of Artificial Sequence: Synthetic oligonucleotide
aatttccggagacacagctggagcagtgtg

SEQ ID NO: 220002 - DNA, 29 bp, Artificial Sequence
  Description of Artificial Sequence: Synthetic oligonucleotide
atttccggagacacagctggagcagtgtg

SEQ ID NO: 220003 - DNA, 28 bp, Artificial Sequence
  Description of Artificial Sequence: Synthetic oligonucleotide
tttccggagacacagctggagcagtgtg

SEQ ID NO: 220004 - DNA, 27 bp, Artificial Sequence
  Description of Artificial Sequence: Synthetic oligonucleotide
ttccggagacacagctggagcagtgtg

SEQ ID NO: 220005 - DNA, 26 bp, Artificial Sequence
  Description of Artificial Sequence: Synthetic oligonucleotide
tccggagacacagctggagcagtgtg

SEQ ID NO: 220006 - DNA, 25 bp, Artificial Sequence
  Description of Artificial Sequence: Synthetic oligonucleotide
ccggagacacagctggagcagtgtg

SEQ ID NO: 220007 - DNA, 25 bp, Artificial Sequence
  Description of Artificial Sequence: Synthetic oligonucleotide
cggagacacagctggagcagtgtgg

SEQ ID NO: 220008 - DNA, 25 bp, Artificial Sequence
  Description of Artificial Sequence: Synthetic oligonucleotide
ggagacacagctggagcagtgtggc

SEQ ID NO: 220009 - DNA, 27 bp, Artificial Sequence
  Description of Artificial Sequence: Synthetic oligonucleotide
gagacacagctggagcagtgtggcctt

SEQ ID NO: 220010 - DNA, 27 bp, Artificial Sequence
  Description of Artificial Sequence: Synthetic oligonucleotide
agacacagctggagcagtgtggccttc

SEQ ID NO: 220011 - DNA, 27 bp, Artificial Sequence
  Description of Artificial Sequence: Synthetic oligonucleotide
gacacagctggagcagtgtggccttca

SEQ ID NO: 220012 - DNA, 28 bp, Artificial Sequence
  Description of Artificial Sequence: Synthetic oligonucleotide
acacagctggagcagtgtggccttcaac

SEQ ID NO: 220013 - DNA, 27 bp, Artificial Sequence
  Description of Artificial Sequence: Synthetic oligonucleotide
cacagctggagcagtgtggccttcaac

SEQ ID NO: 220014 - DNA, 27 bp, Artificial Sequence
  Description of Artificial Sequence: Synthetic oligonucleotide
acagctggagcagtgtggccttcaacc

SEQ ID NO: 220015 - DNA, 27 bp, Artificial Sequence
  Description of Artificial Sequence: Synthetic oligonucleotide
cagctggagcagtgtggccttcaacct

SEQ ID NO: 220016 - DNA, 27 bp, Artificial Sequence
  Description of Artificial Sequence: Synthetic oligonucleotide
agctggagcagtgtggccttcaacctc

SEQ ID NO: 220017 - DNA, 27 bp, Artificial Sequence
  Description of Artificial Sequence: Synthetic oligonucleotide
gctggagcagtgtggccttcaacctct

SEQ ID NO: 220018 - DNA, 28 bp, Artificial Sequence
  Description of Artificial Sequence: Synthetic oligonucleotide
ctggagcagtgtggccttcaacctcttc

SEQ ID NO: 220019 - DNA, 30 bp, Artificial Sequence
  Description of Artificial Sequence: Synthetic oligonucleotide
tggagcagtgtggccttcaacctcttcatg

SEQ ID NO: 220020 - DNA, 29 bp, Artificial Sequence
  Description of Artificial Sequence: Synthetic oligonucleotide
ggagcagtgtggccttcaacctcttcatg

SEQ ID NO: 220021 - DNA, 29 bp, Artificial Sequence
  Description of Artificial Sequence: Synthetic oligonucleotide
gagcagtgtggccttcaacctcttcatgc

SEQ ID NO: 220022 - DNA, 30 bp, Artificial Sequence
  Description of Artificial Sequence: Synthetic oligonucleotide
agcagtgtggccttcaacctcttcatgctg

SEQ ID NO: 220023 - DNA, 29 bp, Artificial Sequence
  Description of Artificial Sequence: Synthetic oligonucleotide
gcagtgtggccttcaacctcttcatgctg

SEQ ID NO: 220024 - DNA, 29 bp, Artificial Sequence
  Description of Artificial Sequence: Synthetic oligonucleotide
cagtgtggccttcaacctcttcatgctgg

SEQ ID NO: 220025 - DNA, 29 bp, Artificial Sequence
  Description of Artificial Sequence: Synthetic oligonucleotide
agtgtggccttcaacctcttcatgctggc

SEQ ID NO: 220026 - DNA, 28 bp, Artificial Sequence
  Description of Artificial Sequence: Synthetic oligonucleotide
gtgtggccttcaacctcttcatgctggc

SEQ ID NO: 220027 - DNA, 28 bp, Artificial Sequence
  Description of Artificial Sequence: Synthetic oligonucleotide
tgtggccttcaacctcttcatgctggcg

SEQ ID NO: 220028 - DNA, 27 bp, Artificial Sequence
  Description of Artificial Sequence: Synthetic oligonucleotide
gtggccttcaacctcttcatgctggcg

SEQ ID NO: 220029 - DNA, 27 bp, Artificial Sequence
  Description of Artificial Sequence: Synthetic oligonucleotide
tggccttcaacctcttcatgctggcgc

SEQ ID NO: 220030 - DNA, 27 bp, Artificial Sequence
  Description of Artificial Sequence: Synthetic oligonucleotide
ggccttcaacctcttcatgctggcgct

SEQ ID NO: 220031 - DNA, 28 bp, Artificial Sequence
  Description of Artificial Sequence: Synthetic oligonucleotide
gccttcaacctcttcatgctggcgcttg

SEQ ID NO: 220032 - DNA, 28 bp, Artificial Sequence
  Description of Artificial Sequence: Synthetic oligonucleotide
ccttcaacctcttcatgctggcgcttgg

SEQ ID NO: 220033 - DNA, 29 bp, Artificial Sequence
  Description of Artificial Sequence: Synthetic oligonucleotide
cttcaacctcttcatgctggcgcttggtg

SEQ ID NO: 220034 - DNA, 30 bp, Artificial Sequence
  Description of Artificial Sequence: Synthetic oligonucleotide
ttcaacctcttcatgctggcgcttggtgtg

SEQ ID NO: 220035 - DNA, 29 bp, Artificial Sequence
  Description of Artificial Sequence: Synthetic oligonucleotide
tcaacctcttcatgctggcgcttggtgtg

SEQ ID NO: 220036 - DNA, 28 bp, Artificial Sequence
  Description of Artificial Sequence: Synthetic oligonucleotide
caacctcttcatgctggcgcttggtgtg

SEQ ID NO: 220037 - DNA, 28 bp, Artificial Sequence
  Description of Artificial Sequence: Synthetic oligonucleotide
aacctcttcatgctggcgcttggtgtgc

SEQ ID NO: 220038 - DNA, 27 bp, Artificial Sequence
  Description of Artificial Sequence: Synthetic oligonucleotide
acctcttcatgctggcgcttggtgtgc

SEQ ID NO: 220039 - DNA, 27 bp, Artificial Sequence
  Description of Artificial Sequence: Synthetic oligonucleotide
cctcttcatgctggcgcttggtgtgca

SEQ ID NO: 220040 - DNA, 27 bp, Artificial Sequence
  Description of Artificial Sequence: Synthetic oligonucleotide
ctcttcatgctggcgcttggtgtgcag

SEQ ID NO: 220041 - DNA, 28 bp, Artificial Sequence
  Description of Artificial Sequence: Synthetic oligonucleotide
tcttcatgctggcgcttggtgtgcagtg

SEQ ID NO: 220042 - DNA, 27 bp, Artificial Sequence
  Description of Artificial Sequence: Synthetic oligonucleotide
cttcatgctggcgcttggtgtgcagtg

SEQ ID NO: 220043 - DNA, 27 bp, Artificial Sequence
  Description of Artificial Sequence: Synthetic oligonucleotide
ttcatgctggcgcttggtgtgcagtgg

SEQ ID NO: 220044 - DNA, 26 bp, Artificial Sequence
  Description of Artificial Sequence: Synthetic oligonucleotide
tcatgctggcgcttggtgtgcagtgg

SEQ ID NO: 220045 - DNA, 25 bp, Artificial Sequence
  Description of Artificial Sequence: Synthetic oligonucleotide
catgctggcgcttggtgtgcagtgg

SEQ ID NO: 220046 - DNA, 25 bp, Artificial Sequence
  Description of Artificial Sequence: Synthetic oligonucleotide
atgctggcgcttggtgtgcagtggg

SEQ ID NO: 220047 - DNA, 24 bp, Artificial Sequence
  Description of Artificial Sequence: Synthetic oligonucleotide
tgctggcgcttggtgtgcagtggg

SEQ ID NO: 220048 - DNA, 23 bp, Artificial Sequence
  Description of Artificial Sequence: Synthetic oligonucleotide
gctggcgcttggtgtgcagtggg

SEQ ID NO: 220049 - DNA, 26 bp, Artificial Sequence
  Description of Artificial Sequence: Synthetic oligonucleotide
ctggcgcttggtgtgcagtgggcaat

SEQ ID NO: 220050 - DNA, 26 bp, Artificial Sequence
  Description of Artificial Sequence: Synthetic oligonucleotide
tggcgcttggtgtgcagtgggcaatc

SEQ ID NO: 220051 - DNA, 25 bp, Artificial Sequence
  Description of Artificial Sequence: Synthetic oligonucleotide
ggcgcttggtgtgcagtgggcaatc

SEQ ID NO: 220052 - DNA, 26 bp, Artificial Sequence
  Description of Artificial Sequence: Synthetic oligonucleotide
gcgcttggtgtgcagtgggcaatcct

SEQ ID NO: 220053 - DNA, 26 bp, Artificial Sequence
  Description of Artificial Sequence: Synthetic oligonucleotide
cgcttggtgtgcagtgggcaatcctg

SEQ ID NO: 220054 - DNA, 27 bp, Artificial Sequence
  Description of Artificial Sequence: Synthetic oligonucleotide
gcttggtgtgcagtgggcaatcctgct

SEQ ID NO: 220055 - DNA, 27 bp, Artificial Sequence
  Description of Artificial Sequence: Synthetic oligonucleotide
cttggtgtgcagtgggcaatcctgctg

SEQ ID NO: 220056 - DNA, 27 bp, Artificial Sequence
  Description of Artificial Sequence: Synthetic oligonucleotide
ttggtgtgcagtgggcaatcctgctgg

SEQ ID NO: 220057 - DNA, 27 bp, Artificial Sequence
  Description of Artificial Sequence: Synthetic oligonucleotide
tggtgtgcagtgggcaatcctgctgga

SEQ ID NO: 220058 - DNA, 26 bp, Artificial Sequence
  Description of Artificial Sequence: Synthetic oligonucleotide
ggtgtgcagtgggcaatcctgctgga

SEQ ID NO: 220059 - DNA, 26 bp, Artificial Sequence
  Description of Artificial Sequence: Synthetic oligonucleotide
gtgtgcagtgggcaatcctgctggac

SEQ ID NO: 220060 - DNA, 26 bp, Artificial Sequence
  Description of Artificial Sequence: Synthetic oligonucleotide
tgtgcagtgggcaatcctgctggacg

SEQ ID NO: 220061 - DNA, 25 bp, Artificial Sequence
  Description of Artificial Sequence: Synthetic oligonucleotide
gtgcagtgggcaatcctgctggacg

SEQ ID NO: 220062 - DNA, 25 bp, Artificial Sequence
  Description of Artificial Sequence: Synthetic oligonucleotide
tgcagtgggcaatcctgctggacgg

SEQ ID NO: 220063 - DNA, 24 bp, Artificial Sequence
  Description of Artificial Sequence: Synthetic oligonucleotide
gcagtgggcaatcctgctggacgg

SEQ ID NO: 220064 - DNA, 26 bp, Artificial Sequence
  Description of Artificial Sequence: Synthetic oligonucleotide
cagtgggcaatcctgctggacggctt

SEQ ID NO: 220065 - DNA, 26 bp, Artificial Sequence
  Description of Artificial Sequence: Synthetic oligonucleotide
agtgggcaatcctgctggacggcttc

SEQ ID NO: 220066 - DNA, 25 bp, Artificial Sequence
  Description of Artificial Sequence: Synthetic oligonucleotide
gtgggcaatcctgctggacggcttc

SEQ ID NO: 220067 - DNA, 26 bp, Artificial Sequence
  Description of Artificial Sequence: Synthetic oligonucleotide
tgggcaatcctgctggacggcttcct

SEQ ID NO: 220068 - DNA, 25 bp, Artificial Sequence
  Description of Artificial Sequence: Synthetic oligonucleotide
gggcaatcctgctggacggcttcct

SEQ ID NO: 220069 - DNA, 26 bp, Artificial Sequence
  Description of Artificial Sequence: Synthetic oligonucleotide
ggcaatcctgctggacggcttcctga

SEQ ID NO: 220070 - DNA, 26 bp, Artificial Sequence
  Description of Artificial Sequence: Synthetic oligonucleotide
gcaatcctgctggacggcttcctgag

SEQ ID NO: 220071 - DNA, 26 bp, Artificial Sequence
  Description of Artificial Sequence: Synthetic oligonucleotide
caatcctgctggacggcttcctgagc

SEQ ID NO: 220072 - DNA, 27 bp, Artificial Sequence
  Description of Artificial Sequence: Synthetic oligonucleotide
aatcctgctggacggcttcctgagcca

SEQ ID NO: 220073 - DNA, 26 bp, Artificial Sequence
  Description of Artificial Sequence: Synthetic oligonucleotide
atcctgctggacggcttcctgagcca

SEQ ID NO: 220074 - DNA, 25 bp, Artificial Sequence
  Description of Artificial Sequence: Synthetic oligonucleotide
tcctgctggacggcttcctgagcca

SEQ ID NO: 220075 - DNA, 24 bp, Artificial Sequence
  Description of Artificial Sequence: Synthetic oligonucleotide
cctgctggacggcttcctgagcca

SEQ ID NO: 220076 - DNA, 26 bp, Artificial Sequence
  Description of Artificial Sequence: Synthetic oligonucleotide
ctgctggacggcttcctgagccagtt

SEQ ID NO: 220077 - DNA, 26 bp, Artificial Sequence
  Description of Artificial Sequence: Synthetic oligonucleotide
tgctggacggcttcctgagccagttc

SEQ ID NO: 220078 - DNA, 25 bp, Artificial Sequence
  Description of Artificial Sequence: Synthetic oligonucleotide
gctggacggcttcctgagccagttc

SEQ ID NO: 220079 - DNA, 25 bp, Artificial Sequence
  Description of Artificial Sequence: Synthetic oligonucleotide
ctggacggcttcctgagccagttcc

SEQ ID NO: 220080 - DNA, 26 bp, Artificial Sequence
  Description of Artificial Sequence: Synthetic oligonucleotide
tggacggcttcctgagccagttccct

SEQ ID NO: 220081 - DNA, 25 bp, Artificial Sequence
  Description of Artificial Sequence: Synthetic oligonucleotide
ggacggcttcctgagccagttccct

SEQ ID NO: 220082 - DNA, 25 bp, Artificial Sequence
  Description of Artificial Sequence: Synthetic oligonucleotide
gacggcttcctgagccagttccctc

SEQ ID NO: 220083 - DNA, 26 bp, Artificial Sequence
  Description of Artificial Sequence: Synthetic oligonucleotide
acggcttcctgagccagttccctcct

SEQ ID NO: 220084 - DNA, 25 bp, Artificial Sequence
  Description of Artificial Sequence: Synthetic oligonucleotide
cggcttcctgagccagttccctcct

SEQ ID NO: 220085 - DNA, 25 bp, Artificial Sequence
  Description of Artificial Sequence: Synthetic oligonucleotide
ggcttcctgagccagttccctcctg

SEQ ID NO: 220086 - DNA, 25 bp, Artificial Sequence
  Description of Artificial Sequence: Synthetic oligonucleotide
gcttcctgagccagttccctcctgg

SEQ ID NO: 220087 - DNA, 27 bp, Artificial Sequence
  Description of Artificial Sequence: Synthetic oligonucleotide
cttcctgagccagttccctcctgggaa

SEQ ID NO: 220088 - DNA, 27 bp, Artificial Sequence
  Description of Artificial Sequence: Synthetic oligonucleotide
ttcctgagccagttccctcctgggaag

SEQ ID NO: 220089 - DNA, 26 bp, Artificial Sequence
  Description of Artificial Sequence: Synthetic oligonucleotide
tcctgagccagttccctcctgggaag

SEQ ID NO: 220090 - DNA, 25 bp, Artificial Sequence
  Description of Artificial Sequence: Synthetic oligonucleotide
cctgagccagttccctcctgggaag

SEQ ID NO: 220091 - DNA, 26 bp, Artificial Sequence
  Description of Artificial Sequence: Synthetic oligonucleotide
ctgagccagttccctcctgggaaggt

SEQ ID NO: 220092 - DNA, 26 bp, Artificial Sequence
  Description of Artificial Sequence: Synthetic oligonucleotide
tgagccagttccctcctgggaaggtg

SEQ ID NO: 220093 - DNA, 25 bp, Artificial Sequence
  Description of Artificial Sequence: Synthetic oligonucleotide
gagccagttccctcctgggaaggtg

SEQ ID NO: 220094 - DNA, 26 bp, Artificial Sequence
  Description of Artificial Sequence: Synthetic oligonucleotide
agccagttccctcctgggaaggtggt

SEQ ID NO: 220095 - DNA, 25 bp, Artificial Sequence
  Description of Artificial Sequence: Synthetic oligonucleotide
gccagttccctcctgggaaggtggt

SEQ ID NO: 220096 - DNA, 27 bp, Artificial Sequence
  Description of Artificial Sequence: Synthetic oligonucleotide
ccagttccctcctgggaaggtggtcat

SEQ ID NO: 220097 - DNA, 27 bp, Artificial Sequence
  Description of Artificial Sequence: Synthetic oligonucleotide
cagttccctcctgggaaggtggtcatc

SEQ ID NO: 220098 - DNA, 28 bp, Artificial Sequence
  Description of Artificial Sequence: Synthetic oligonucleotide
agttccctcctgggaaggtggtcatcac

SEQ ID NO: 220099 - DNA, 27 bp, Artificial Sequence
  Description of Artificial Sequence: Synthetic oligonucleotide
gttccctcctgggaaggtggtcatcac

SEQ ID NO: 220100 - DNA, 28 bp, Artificial Sequence
  Description of Artificial Sequence: Synthetic oligonucleotide
ttccctcctgggaaggtggtcatcacac

SEQ ID NO: 220101 - DNA, 27 bp, Artificial Sequence
  Description of Artificial Sequence: Synthetic oligonucleotide
tccctcctgggaaggtggtcatcacac

SEQ ID NO: 220102 - DNA, 27 bp, Artificial Sequence
  Description of Artificial Sequence: Synthetic oligonucleotide
ccctcctgggaaggtggtcatcacact

SEQ ID NO: 220103 - DNA, 27 bp, Artificial Sequence
  Description of Artificial Sequence: Synthetic oligonucleotide
cctcctgggaaggtggtcatcacactg

SEQ ID NO: 220104 - DNA, 29 bp, Artificial Sequence
  Description of Artificial Sequence: Synthetic oligonucleotide
ctcctgggaaggtggtcatcacactgttc

SEQ ID NO: 220105 - DNA, 30 bp, Artificial Sequence
  Description of Artificial Sequence: Synthetic oligonucleotide
tcctgggaaggtggtcatcacactgttcag

SEQ ID NO: 220106 - DNA, 29 bp, Artificial Sequence
  Description of Artificial Sequence: Synthetic oligonucleotide
cctgggaaggtggtcatcacactgttcag

SEQ ID NO: 220107 - DNA, 33 bp, Artificial Sequence
  Description of Artificial Sequence: Synthetic oligonucleotide
ctgggaaggtggtcatcacactgttcagtattc

SEQ ID NO: 220108 - DNA, 33 bp, Artificial Sequence
  Description of Artificial Sequence: Synthetic oligonucleotide
tgggaaggtggtcatcacactgttcagtattcg

SEQ ID NO: 220109 - DNA, 32 bp, Artificial Sequence
  Description of Artificial Sequence: Synthetic oligonucleotide
gggaaggtggtcatcacactgttcagtattcg

SEQ ID NO: 220110 - DNA, 32 bp, Artificial Sequence
  Description of Artificial Sequence: Synthetic oligonucleotide
ggaaggtggtcatcacactgttcagtattcgg

SEQ ID NO: 220111 - DNA, 32 bp, Artificial Sequence
  Description of Artificial Sequence: Synthetic oligonucleotide
gaaggtggtcatcacactgttcagtattcggc

SEQ ID NO: 220112 - DNA, 33 bp, Artificial Sequence
  Description of Artificial Sequence: Synthetic oligonucleotide
aaggtggtcatcacactgttcagtattcggctg

SEQ ID NO: 220113 - DNA, 32 bp, Artificial Sequence
  Description of Artificial Sequence: Synthetic oligonucleotide
aggtggtcatcacactgttcagtattcggctg

SEQ ID NO: 220114 - DNA, 31 bp, Artificial Sequence
  Description of Artificial Sequence: Synthetic oligonucleotide
ggtggtcatcacactgttcagtattcggctg

SEQ ID NO: 220115 - DNA, 31 bp, Artificial Sequence
  Description of Artificial Sequence: Synthetic oligonucleotide
gtggtcatcacactgttcagtattcggctgg

SEQ ID NO: 220116 - DNA, 31 bp, Artificial Sequence
  Description of Artificial Sequence: Synthetic oligonucleotide
tggtcatcacactgttcagtattcggctggc

SEQ ID NO: 220117 - DNA, 30 bp, Artificial Sequence
  Description of Artificial Sequence: Synthetic oligonucleotide
ggtcatcacactgttcagtattcggctggc

SEQ ID NO: 220118 - DNA, 30 bp, Artificial Sequence
  Description of Artificial Sequence: Synthetic oligonucleotide
gtcatcacactgttcagtattcggctggcc

SEQ ID NO: 220119 - DNA, 31 bp, Artificial Sequence
  Description of Artificial Sequence: Synthetic oligonucleotide
tcatcacactgttcagtattcggctggccac

SEQ ID NO: 220120 - DNA, 30 bp, Artificial Sequence
  Description of Artificial Sequence: Synthetic oligonucleotide
catcacactgttcagtattcggctggccac

SEQ ID NO: 220121 - DNA, 30 bp, Artificial Sequence
  Description of Artificial Sequence: Synthetic oligonucleotide
atcacactgttcagtattcggctggccacc

SEQ ID NO: 220122 - DNA, 29 bp, Artificial Sequence
  Description of Artificial Sequence: Synthetic oligonucleotide
tcacactgttcagtattcggctggccacc

SEQ ID NO: 220123 - DNA, 28 bp, Artificial Sequence
  Description of Artificial Sequence: Synthetic oligonucleotide
cacactgttcagtattcggctggccacc

SEQ ID NO: 220124 - DNA, 30 bp, Artificial Sequence
  Description of Artificial Sequence: Synthetic oligonucleotide
acactgttcagtattcggctggccaccatg

SEQ ID NO: 220125 - DNA, 29 bp, Artificial Sequence
  Description of Artificial Sequence: Synthetic oligonucleotide
cactgttcagtattcggctggccaccatg

SEQ ID NO: 220126 - DNA, 30 bp, Artificial Sequence
  Description of Artificial Sequence: Synthetic oligonucleotide
actgttcagtattcggctggccaccatgag

SEQ ID NO: 220127 - DNA, 29 bp, Artificial Sequence
  Description of Artificial Sequence: Synthetic oligonucleotide
ctgttcagtattcggctggccaccatgag

SEQ ID NO: 220128 - DNA, 30 bp, Artificial Sequence
  Description of Artificial Sequence: Synthetic oligonucleotide
tgttcagtattcggctggccaccatgagtg

SEQ ID NO: 220129 - DNA, 29 bp, Artificial Sequence
  Description of Artificial Sequence: Synthetic oligonucleotide
gttcagtattcggctggccaccatgagtg

SEQ ID NO: 220130 - DNA, 29 bp, Artificial Sequence
  Description of Artificial Sequence: Synthetic oligonucleotide
ttcagtattcggctggccaccatgagtgc

SEQ ID NO: 220131 - DNA, 28 bp, Artificial Sequence
  Description of Artificial Sequence: Synthetic oligonucleotide
tcagtattcggctggccaccatgagtgc

SEQ ID NO: 220132 - DNA, 27 bp, Artificial Sequence
  Description of Artificial Sequence: Synthetic oligonucleotide
cagtattcggctggccaccatgagtgc

SEQ ID NO: 220133 - DNA, 30 bp, Artificial Sequence
  Description of Artificial Sequence: Synthetic oligonucleotide
agtattcggctggccaccatgagtgctatg

SEQ ID NO: 220134 - DNA, 29 bp, Artificial Sequence
  Description of Artificial Sequence: Synthetic oligonucleotide
gtattcggctggccaccatgagtgctatg

SEQ ID NO: 220135 - DNA, 30 bp, Artificial Sequence
  Description of Artificial Sequence: Synthetic oligonucleotide
tattcggctggccaccatgagtgctatgtc

SEQ ID NO: 220136 - DNA, 29 bp, Artificial Sequence
  Description of Artificial Sequence: Synthetic oligonucleotide
attcggctggccaccatgagtgctatgtc

SEQ ID NO: 220137 - DNA, 28 bp, Artificial Sequence
  Description of Artificial Sequence: Synthetic oligonucleotide
ttcggctggccaccatgagtgctatgtc

SEQ ID NO: 220138 - DNA, 27 bp, Artificial Sequence
  Description of Artificial Sequence: Synthetic oligonucleotide
tcggctggccaccatgagtgctatgtc

SEQ ID NO: 220139 - DNA, 26 bp, Artificial Sequence
  Description of Artificial Sequence: Synthetic oligonucleotide
cggctggccaccatgagtgctatgtc

SEQ ID NO: 220140 - DNA, 26 bp, Artificial Sequence
  Description of Artificial Sequence: Synthetic oligonucleotide
ggctggccaccatgagtgctatgtcg

SEQ ID NO: 220141 - DNA, 27 bp, Artificial Sequence
  Description of Artificial Sequence: Synthetic oligonucleotide
gctggccaccatgagtgctatgtcggt

SEQ ID NO: 220142 - DNA, 27 bp, Artificial Sequence
  Description of Artificial Sequence: Synthetic oligonucleotide
ctggccaccatgagtgctatgtcggtg

SEQ ID NO: 220143 - DNA, 27 bp, Artificial Sequence
  Description of Artificial Sequence: Synthetic oligonucleotide
tggccaccatgagtgctatgtcggtgc

SEQ ID NO: 220144 - DNA, 27 bp, Artificial Sequence
  Description of Artificial Sequence: Synthetic oligonucleotide
ggccaccatgagtgctatgtcggtgct

SEQ ID NO: 220145 - DNA, 27 bp, Artificial Sequence
  Description of Artificial Sequence: Synthetic oligonucleotide
gccaccatgagtgctatgtcggtgctg

SEQ ID NO: 220146 - DNA, 29 bp, Artificial Sequence
  Description of Artificial Sequence: Synthetic oligonucleotide
ccaccatgagtgctatgtcggtgctgatc

SEQ ID NO: 220147 - DNA, 30 bp, Artificial Sequence
  Description of Artificial Sequence: Synthetic oligonucleotide
caccatgagtgctatgtcggtgctgatctc

SEQ ID NO: 220148 - DNA, 31 bp, Artificial Sequence
  Description of Artificial Sequence: Synthetic oligonucleotide
accatgagtgctatgtcggtgctgatctcag

SEQ ID NO: 220149 - DNA, 30 bp, Artificial Sequence
  Description of Artificial Sequence: Synthetic oligonucleotide
ccatgagtgctatgtcggtgctgatctcag

SEQ ID NO: 220150 - DNA, 30 bp, Artificial Sequence
  Description of Artificial Sequence: Synthetic oligonucleotide
catgagtgctatgtcggtgctgatctcagc

SEQ ID NO: 220151 - DNA, 30 bp, Artificial Sequence
  Description of Artificial Sequence: Synthetic oligonucleotide
atgagtgctatgtcggtgctgatctcagcg

SEQ ID NO: 220152 - DNA, 29 bp, Artificial Sequence
  Description of Artificial Sequence: Synthetic oligonucleotide
tgagtgctatgtcggtgctgatctcagcg

SEQ ID NO: 220153 - DNA, 28 bp, Artificial Sequence
  Description of Artificial Sequence: Synthetic oligonucleotide
gagtgctatgtcggtgctgatctcagcg

SEQ ID NO: 220154 - DNA, 28 bp, Artificial Sequence
  Description of Artificial Sequence: Synthetic oligonucleotide
agtgctatgtcggtgctgatctcagcgg

SEQ ID NO: 220155 - DNA, 27 bp, Artificial Sequence
  Description of Artificial Sequence: Synthetic oligonucleotide
gtgctatgtcggtgctgatctcagcgg

SEQ ID NO: 220156 - DNA, 27 bp, Artificial Sequence
  Description of Artificial Sequence: Synthetic oligonucleotide
tgctatgtcggtgctgatctcagcggg

SEQ ID NO: 220157 - DNA, 27 bp, Artificial Sequence
  Description of Artificial Sequence: Synthetic oligonucleotide
gctatgtcggtgctgatctcagcgggt

SEQ ID NO: 220158 - DNA, 27 bp, Artificial Sequence
  Description of Artificial Sequence: Synthetic oligonucleotide
ctatgtcggtgctgatctcagcgggtg

SEQ ID NO: 220159 - DNA, 27 bp, Artificial Sequence
  Description of Artificial Sequence: Synthetic oligonucleotide
tatgtcggtgctgatctcagcgggtgc

SEQ ID NO: 220160 - DNA, 27 bp, Artificial Sequence
  Description of Artificial Sequence: Synthetic oligonucleotide
atgtcggtgctgatctcagcgggtgct

SEQ ID NO: 220161 - DNA, 26 bp, Artificial Sequence
  Description of Artificial Sequence: Synthetic oligonucleotide
tgtcggtgctgatctcagcgggtgct

SEQ ID NO: 220162 - DNA, 25 bp, Artificial Sequence
  Description of Artificial Sequence: Synthetic oligonucleotide
gtcggtgctgatctcagcgggtgct

SEQ ID NO: 220163 - DNA, 26 bp, Artificial Sequence
  Description of Artificial Sequence: Synthetic oligonucleotide
tcggtgctgatctcagcgggtgctgt

SEQ ID NO: 220164 - DNA, 25 bp, Artificial Sequence
  Description of Artificial Sequence: Synthetic oligonucleotide
cggtgctgatctcagcgggtgctgt

SEQ ID NO: 220165 - DNA, 27 bp, Artificial Sequence
  Description of Artificial Sequence: Synthetic oligonucleotide
ggtgctgatctcagcgggtgctgtctt

SEQ ID NO: 220166 - DNA, 27 bp, Artificial Sequence
  Description of Artificial Sequence: Synthetic oligonucleotide
gtgctgatctcagcgggtgctgtcttg

SEQ ID NO: 220167 - DNA, 27 bp, Artificial Sequence
  Description of Artificial Sequence: Synthetic oligonucleotide
tgctgatctcagcgggtgctgtcttgg

SEQ ID NO: 220168 - DNA, 26 bp, Artificial Sequence
  Description of Artificial Sequence: Synthetic oligonucleotide
gctgatctcagcgggtgctgtcttgg

SEQ ID NO: 220169 - DNA, 26 bp, Artificial Sequence
  Description of Artificial Sequence: Synthetic oligonucleotide
ctgatctcagcgggtgctgtcttggg

SEQ ID NO: 220170 - DNA, 27 bp, Artificial Sequence
  Description of Artificial Sequence: Synthetic oligonucleotide
tgatctcagcgggtgctgtcttgggga

SEQ ID NO: 220171 - DNA, 27 bp, Artificial Sequence
  Description of Artificial Sequence: Synthetic oligonucleotide
gatctcagcgggtgctgtcttggggaa

SEQ ID NO: 220172 - DNA, 27 bp, Artificial Sequence
  Description of Artificial Sequence: Synthetic oligonucleotide
atctcagcgggtgctgtcttggggaag

SEQ ID NO: 220173 - DNA, 26 bp, Artificial Sequence
  Description of Artificial Sequence: Synthetic oligonucleotide
tctcagcgggtgctgtcttggggaag

SEQ ID NO: 220174 - DNA, 25 bp, Artificial Sequence
  Description of Artificial Sequence: Synthetic oligonucleotide
ctcagcgggtgctgtcttggggaag

SEQ ID NO: 220175 - DNA, 26 bp, Artificial Sequence
  Description of Artificial Sequence: Synthetic oligonucleotide
tcagcgggtgctgtcttggggaaggt

SEQ ID NO: 220176 - DNA, 25 bp, Artificial Sequence
  Description of Artificial Sequence: Synthetic oligonucleotide
cagcgggtgctgtcttggggaaggt

SEQ ID NO: 220177 - DNA, 27 bp, Artificial Sequence
  Description of Artificial Sequence: Synthetic oligonucleotide
agcgggtgctgtcttggggaaggtcaa

SEQ ID NO: 220178 - DNA, 26 bp, Artificial Sequence
  Description of Artificial Sequence: Synthetic oligonucleotide
gcgggtgctgtcttggggaaggtcaa

SEQ ID NO: 220179 - DNA, 27 bp, Artificial Sequence
  Description of Artificial Sequence: Synthetic oligonucleotide
cgggtgctgtcttggggaaggtcaact

SEQ ID NO: 220180 - DNA, 28 bp, Artificial Sequence
  Description of Artificial Sequence: Synthetic oligonucleotide
gggtgctgtcttggggaaggtcaacttg

SEQ ID NO: 220181 - DNA, 28 bp, Artificial Sequence
  Description of Artificial Sequence: Synthetic oligonucleotide
ggtgctgtcttggggaaggtcaacttgg

SEQ ID NO: 220182 - DNA, 28 bp, Artificial Sequence
  Description of Artificial Sequence: Synthetic oligonucleotide
gtgctgtcttggggaaggtcaacttggc

SEQ ID NO: 220183 - DNA, 28 bp, Artificial Sequence
  Description of Artificial Sequence: Synthetic oligonucleotide
tgctgtcttggggaaggtcaacttggcg

SEQ ID NO: 220184 - DNA, 27 bp, Artificial Sequence
  Description of Artificial Sequence: Synthetic oligonucleotide
gctgtcttggggaaggtcaacttggcg

SEQ ID NO: 220185 - DNA, 27 bp, Artificial Sequence
  Description of Artificial Sequence: Synthetic oligonucleotide
ctgtcttggggaaggtcaacttggcgc

SEQ ID NO: 220186 - DNA, 28 bp, Artificial Sequence
  Description of Artificial Sequence: Synthetic oligonucleotide
tgtcttggggaaggtcaacttggcgcag

SEQ ID NO: 220187 - DNA, 27 bp, Artificial Sequence
  Description of Artificial Sequence: Synthetic oligonucleotide
gtcttggggaaggtcaacttggcgcag

SEQ ID NO: 220188 - DNA, 29 bp, Artificial Sequence
  Description of Artificial Sequence: Synthetic oligonucleotide
tcttggggaaggtcaacttggcgcagttg

SEQ ID NO: 220189 - DNA, 28 bp, Artificial Sequence
  Description of Artificial Sequence: Synthetic oligonucleotide
cttggggaaggtcaacttggcgcagttg

SEQ ID NO: 220190 - DNA, 28 bp, Artificial Sequence
  Description of Artificial Sequence: Synthetic oligonucleotide
ttggggaaggtcaacttggcgcagttgg

SEQ ID NO: 220191 - DNA, 27 bp, Artificial Sequence
  Description of Artificial Sequence: Synthetic oligonucleotide
tggggaaggtcaacttggcgcagttgg

SEQ ID NO: 220192 - DNA, 27 bp, Artificial Sequence
  Description of Artificial Sequence: Synthetic oligonucleotide
ggggaaggtcaacttggcgcagttggt

SEQ ID NO: 220193 - DNA, 27 bp, Artificial Sequence
  Description of Artificial Sequence: Synthetic oligonucleotide
gggaaggtcaacttggcgcagttggtg

SEQ ID NO: 220194 - DNA, 27 bp, Artificial Sequence
  Description of Artificial Sequence: Synthetic oligonucleotide
ggaaggtcaacttggcgcagttggtgg

SEQ ID NO: 220195 - DNA, 28 bp, Artificial Sequence
  Description of Artificial Sequence: Synthetic oligonucleotide
gaaggtcaacttggcgcagttggtggtg

SEQ ID NO: 220196 - DNA, 30 bp, Artificial Sequence
  Description of Artificial Sequence: Synthetic oligonucleotide
aaggtcaacttggcgcagttggtggtgatg

SEQ ID NO: 220197 - DNA, 29 bp, Artificial Sequence
  Description of Artificial Sequence: Synthetic oligonucleotide
aggtcaacttggcgcagttggtggtgatg

SEQ ID NO: 220198 - DNA, 28 bp, Artificial Sequence
  Description of Artificial Sequence: Synthetic oligonucleotide
ggtcaacttggcgcagttggtggtgatg

SEQ ID NO: 220199 - DNA, 28 bp, Artificial Sequence
  Description of Artificial Sequence: Synthetic oligonucleotide
gtcaacttggcgcagttggtggtgatgg

SEQ ID NO: 220200 - DNA, 29 bp, Artificial Sequence
  Description of Artificial Sequence: Synthetic oligonucleotide
tcaacttggcgcagttggtggtgatggtg

SEQ ID NO: 220201 - DNA, 28 bp, Artificial Sequence
  Description of Artificial Sequence: Synthetic oligonucleotide
caacttggcgcagttggtggtgatggtg

SEQ ID NO: 220202 - DNA, 28 bp, Artificial Sequence
  Description of Artificial Sequence: Synthetic oligonucleotide
aacttggcgcagttggtggtgatggtgc

SEQ ID NO: 220203 - DNA, 27 bp, Artificial Sequence
  Description of Artificial Sequence: Synthetic oligonucleotide
acttggcgcagttggtggtgatggtgc

SEQ ID NO: 220204 - DNA, 27 bp, Artificial Sequence
  Description of Artificial Sequence: Synthetic oligonucleotide
cttggcgcagttggtggtgatggtgct

SEQ ID NO: 220205 - DNA, 27 bp, Artificial Sequence
  Description of Artificial Sequence: Synthetic oligonucleotide
ttggcgcagttggtggtgatggtgctg

SEQ ID NO: 220206 - DNA, 26 bp, Artificial Sequence
  Description of Artificial Sequence: Synthetic oligonucleotide
tggcgcagttggtggtgatggtgctg

SEQ ID NO: 220207 - DNA, 25 bp, Artificial Sequence
  Description of Artificial Sequence: Synthetic oligonucleotide
ggcgcagttggtggtgatggtgctg

SEQ ID NO: 220208 - DNA, 26 bp, Artificial Sequence
  Description of Artificial Sequence: Synthetic oligonucleotide
gcgcagttggtggtgatggtgctggt

SEQ ID NO: 220209 - DNA, 26 bp, Artificial Sequence
  Description of Artificial Sequence: Synthetic oligonucleotide
cgcagttggtggtgatggtgctggtg

SEQ ID NO: 220210 - DNA, 27 bp, Artificial Sequence
  Description of Artificial Sequence: Synthetic oligonucleotide
gcagttggtggtgatggtgctggtgga

SEQ ID NO: 220211 - DNA, 27 bp, Artificial Sequence
  Description of Artificial Sequence: Synthetic oligonucleotide
cagttggtggtgatggtgctggtggag

SEQ ID NO: 220212 - DNA, 27 bp, Artificial Sequence
  Description of Artificial Sequence: Synthetic oligonucleotide
agttggtggtgatggtgctggtggagg

SEQ ID NO: 220213 - DNA, 27 bp, Artificial Sequence
  Description of Artificial Sequence: Synthetic oligonucleotide
gttggtggtgatggtgctggtggaggt

SEQ ID NO: 220214 - DNA, 27 bp, Artificial Sequence
  Description of Artificial Sequence: Synthetic oligonucleotide
ttggtggtgatggtgctggtggaggtg

SEQ ID NO: 220215 - DNA, 27 bp, Artificial Sequence
  Description of Artificial Sequence: Synthetic oligonucleotide
tggtggtgatggtgctggtggaggtga

SEQ ID NO: 220216 - DNA, 26 bp, Artificial Sequence
  Description of Artificial Sequence: Synthetic oligonucleotide
ggtggtgatggtgctggtggaggtga

SEQ ID NO: 220217 - DNA, 27 bp, Artificial Sequence
  Description of Artificial Sequence: Synthetic oligonucleotide
gtggtgatggtgctggtggaggtgaca

SEQ ID NO: 220218 - DNA, 27 bp, Artificial Sequence
  Description of Artificial Sequence: Synthetic oligonucleotide
tggtgatggtgctggtggaggtgacag

SEQ ID NO: 220219 - DNA, 26 bp, Artificial Sequence
  Description of Artificial Sequence: Synthetic oligonucleotide
ggtgatggtgctggtggaggtgacag

SEQ ID NO: 220220 - DNA, 27 bp, Artificial Sequence
  Description of Artificial Sequence: Synthetic oligonucleotide
gtgatggtgctggtggaggtgacagct

SEQ ID NO: 220221 - DNA, 30 bp, Artificial Sequence
  Description of Artificial Sequence: Synthetic oligonucleotide
tgatggtgctggtggaggtgacagctttag

SEQ ID NO: 220222 - DNA, 29 bp, Artificial Sequence
  Description of Artificial Sequence: Synthetic oligonucleotide
gatggtgctggtggaggtgacagctttag

SEQ ID NO: 220223 - DNA, 29 bp, Artificial Sequence
  Description of Artificial Sequence: Synthetic oligonucleotide
atggtgctggtggaggtgacagctttagg

SEQ ID NO: 220224 - DNA, 28 bp, Artificial Sequence
  Description of Artificial Sequence: Synthetic oligonucleotide
tggtgctggtggaggtgacagctttagg

SEQ ID NO: 220225 - DNA, 27 bp, Artificial Sequence
  Description of Artificial Sequence: Synthetic oligonucleotide
ggtgctggtggaggtgacagctttagg

SEQ ID NO: 220226 - DNA, 27 bp, Artificial Sequence
  Description of Artificial Sequence: Synthetic oligonucleotide
gtgctggtggaggtgacagctttaggc

SEQ ID NO: 220227 - DNA, 28 bp, Artificial Sequence
  Description of Artificial Sequence: Synthetic oligonucleotide
tgctggtggaggtgacagctttaggcac

SEQ ID NO: 220228 - DNA, 27 bp, Artificial Sequence
  Description of Artificial Sequence: Synthetic oligonucleotide
gctggtggaggtgacagctttaggcac

SEQ ID NO: 220229 - DNA, 27 bp, Artificial Sequence
  Description of Artificial Sequence: Synthetic oligonucleotide
ctggtggaggtgacagctttaggcacc

SEQ ID NO: 220230 - DNA, 27 bp, Artificial Sequence
  Description of Artificial Sequence: Synthetic oligonucleotide
tggtggaggtgacagctttaggcaccc

SEQ ID NO: 220231 - DNA, 27 bp, Artificial Sequence
  Description of Artificial Sequence: Synthetic oligonucleotide
ggtggaggtgacagctttaggcaccct

SEQ ID NO: 220232 - DNA, 27 bp, Artificial Sequence
  Description of Artificial Sequence: Synthetic oligonucleotide
gtggaggtgacagctttaggcaccctg

SEQ ID NO: 220233 - DNA, 28 bp, Artificial Sequence
  Description of Artificial Sequence: Synthetic oligonucleotide
tggaggtgacagctttaggcaccctgag

SEQ ID NO: 220234 - DNA, 27 bp, Artificial Sequence
  Description of Artificial Sequence: Synthetic oligonucleotide
ggaggtgacagctttaggcaccctgag

SEQ ID NO: 220235 - DNA, 27 bp, Artificial Sequence
  Description of Artificial Sequence: Synthetic oligonucleotide
gaggtgacagctttaggcaccctgagg

SEQ ID NO: 220236 - DNA, 29 bp, Artificial Sequence
  Description of Artificial Sequence: Synthetic oligonucleotide
aggtgacagctttaggcaccctgaggatg

SEQ ID NO: 220237 - DNA, 28 bp, Artificial Sequence
  Description of Artificial Sequence: Synthetic oligonucleotide
ggtgacagctttaggcaccctgaggatg

SEQ ID NO: 220238 - DNA, 28 bp, Artificial Sequence
  Description of Artificial Sequence: Synthetic oligonucleotide
gtgacagctttaggcaccctgaggatgg

SEQ ID NO: 220239 - DNA, 29 bp, Artificial Sequence
  Description of Artificial Sequence: Synthetic oligonucleotide
tgacagctttaggcaccctgaggatggtc

SEQ ID NO: 220240 - DNA, 28 bp, Artificial Sequence
  Description of Artificial Sequence: Synthetic oligonucleotide
gacagctttaggcaccctgaggatggtc

SEQ ID NO: 220241 - DNA, 30 bp, Artificial Sequence
  Description of Artificial Sequence: Synthetic oligonucleotide
acagctttaggcaccctgaggatggtcatc

SEQ ID NO: 220242 - DNA, 29 bp, Artificial Sequence
  Description of Artificial Sequence: Synthetic oligonucleotide
cagctttaggcaccctgaggatggtcatc

SEQ ID NO: 220243 - DNA, 30 bp, Artificial Sequence
  Description of Artificial Sequence: Synthetic oligonucleotide
agctttaggcaccctgaggatggtcatcag

SEQ ID NO: 220244 - DNA, 29 bp, Artificial Sequence
  Description of Artificial Sequence: Synthetic oligonucleotide
gctttaggcaccctgaggatggtcatcag

SEQ ID NO: 220245 - DNA, 35 bp, Artificial Sequence
  Description of Artificial Sequence: Synthetic oligonucleotide
ctttaggcaccctgaggatggtcatcagtaatatc

SEQ ID NO: 220246 - DNA, 37 bp, Artificial Sequence
  Description of Artificial Sequence: Synthetic oligonucleotide
tttaggcaccctgaggatggtcatcagtaatatcttc

SEQ ID NO: 220247 - DNA, 36 bp, Artificial Sequence
  Description of Artificial Sequence: Synthetic oligonucleotide
ttaggcaccctgaggatggtcatcagtaatatcttc

SEQ ID NO: 220248 - DNA, 35 bp, Artificial Sequence
  Description of Artificial Sequence: Synthetic oligonucleotide
taggcaccctgaggatggtcatcagtaatatcttc

SEQ ID NO: 220249 - DNA, 34 bp, Artificial Sequence
  Description of Artificial Sequence: Synthetic oligonucleotide
aggcaccctgaggatggtcatcagtaatatcttc

SEQ ID NO: 220250 - DNA, 33 bp, Artificial Sequence
  Description of Artificial Sequence: Synthetic oligonucleotide
ggcaccctgaggatggtcatcagtaatatcttc

SEQ ID NO: 220251 - DNA, 35 bp, Artificial Sequence
  Description of Artificial Sequence: Synthetic oligonucleotide
gcaccctgaggatggtcatcagtaatatcttcaac

SEQ ID NO: 220252 - DNA, 36 bp, Artificial Sequence
  Description of Artificial Sequence: Synthetic oligonucleotide
caccctgaggatggtcatcagtaatatcttcaacac

SEQ ID NO: 220253 - DNA, 37 bp, Artificial Sequence
  Description of Artificial Sequence: Synthetic oligonucleotide
accctgaggatggtcatcagtaatatcttcaacacag

SEQ ID NO: 220254 - DNA, 36 bp, Artificial Sequence
  Description of Artificial Sequence: Synthetic oligonucleotide
ccctgaggatggtcatcagtaatatcttcaacacag

SEQ ID NO: 220255 - DNA, 37 bp, Artificial Sequence
  Description of Artificial Sequence: Synthetic oligonucleotide
cctgaggatggtcatcagtaatatcttcaacacagac

SEQ ID NO: 220256 - DNA, 39 bp, Artificial Sequence
  Description of Artificial Sequence: Synthetic oligonucleotide
ctgaggatggtcatcagtaatatcttcaacacagactac

SEQ ID NO: 220257 - DNA, 39 bp, Artificial Sequence
  Description of Artificial Sequence: Synthetic oligonucleotide
tgaggatggtcatcagtaatatcttcaacacagactacc

SEQ ID NO: 220258 - DNA, 38 bp, Artificial Sequence
  Description of Artificial Sequence: Synthetic oligonucleotide
gaggatggtcatcagtaatatcttcaacacagactacc

SEQ ID NO: 220259 - DNA, 39 bp, Artificial Sequence
  Description of Artificial Sequence: Synthetic oligonucleotide
aggatggtcatcagtaatatcttcaacacagactaccac

SEQ ID NO: 220260 - DNA, 38 bp, Artificial Sequence
  Description of Artificial Sequence: Synthetic oligonucleotide
ggatggtcatcagtaatatcttcaacacagactaccac

SEQ ID NO: 220261 - DNA, 40 bp, Artificial Sequence
  Description of Artificial Sequence: Synthetic oligonucleotide
gatggtcatcagtaatatcttcaacacagactaccacatg

SEQ ID NO: 220262 - DNA, 42 bp, Artificial Sequence
  Description of Artificial Sequence: Synthetic oligonucleotide
atggtcatcagtaatatcttcaacacagactaccacatgaac

SEQ ID NO: 220263 - DNA, 41 bp, Artificial Sequence
  Description of Artificial Sequence: Synthetic oligonucleotide
tggtcatcagtaatatcttcaacacagactaccacatgaac

SEQ ID NO: 220264 - DNA, 40 bp, Artificial Sequence
  Description of Artificial Sequence: Synthetic oligonucleotide
ggtcatcagtaatatcttcaacacagactaccacatgaac

SEQ ID NO: 220265 - DNA, 40 bp, Artificial Sequence
  Description of Artificial Sequence: Synthetic oligonucleotide
gtcatcagtaatatcttcaacacagactaccacatgaacc

SEQ ID NO: 220266 - DNA, 41 bp, Artificial Sequence
  Description of Artificial Sequence: Synthetic oligonucleotide
tcatcagtaatatcttcaacacagactaccacatgaacctg

SEQ ID NO: 220267 - DNA, 40 bp, Artificial Sequence
  Description of Artificial Sequence: Synthetic oligonucleotide
catcagtaatatcttcaacacagactaccacatgaacctg

SEQ ID NO: 220268 - DNA, 41 bp, Artificial Sequence
  Description of Artificial Sequence: Synthetic oligonucleotide
atcagtaatatcttcaacacagactaccacatgaacctgag

SEQ ID NO: 220269 - DNA, 40 bp, Artificial Sequence
  Description of Artificial Sequence: Synthetic oligonucleotide
tcagtaatatcttcaacacagactaccacatgaacctgag

SEQ ID NO: 220270 - DNA, 39 bp, Artificial Sequence
  Description of Artificial Sequence: Synthetic oligonucleotide
cagtaatatcttcaacacagactaccacatgaacctgag

SEQ ID NO: 220271 - DNA, 39 bp, Artificial Sequence
  Description of Artificial Sequence: Synthetic oligonucleotide
agtaatatcttcaacacagactaccacatgaacctgagg

SEQ ID NO: 220272 - DNA, 38 bp, Artificial Sequence
  Description of Artificial Sequence: Synthetic oligonucleotide
gtaatatcttcaacacagactaccacatgaacctgagg

SEQ ID NO: 220273 - DNA, 38 bp, Artificial Sequence
  Description of Artificial Sequence: Synthetic oligonucleotide
taatatcttcaacacagactaccacatgaacctgaggc

SEQ ID NO: 220274 - DNA, 37 bp, Artificial Sequence
  Description of Artificial Sequence: Synthetic oligonucleotide
aatatcttcaacacagactaccacatgaacctgaggc

SEQ ID NO: 220275 - DNA, 36 bp, Artificial Sequence
  Description of Artificial Sequence: Synthetic oligonucleotide
atatcttcaacacagactaccacatgaacctgaggc

SEQ ID NO: 220276 - DNA, 35 bp, Artificial Sequence
  Description of Artificial Sequence: Synthetic oligonucleotide
tatcttcaacacagactaccacatgaacctgaggc

SEQ ID NO: 220277 - DNA, 34 bp, Artificial Sequence
  Description of Artificial Sequence: Synthetic oligonucleotide
atcttcaacacagactaccacatgaacctgaggc

SEQ ID NO: 220278 - DNA, 33 bp, Artificial Sequence
  Description of Artificial Sequence: Synthetic oligonucleotide
tcttcaacacagactaccacatgaacctgaggc

SEQ ID NO: 220279 - DNA, 32 bp, Artificial Sequence
  Description of Artificial Sequence: Synthetic oligonucleotide
cttcaacacagactaccacatgaacctgaggc

SEQ ID NO: 220280 - DNA, 33 bp, Artificial Sequence
  Description of Artificial Sequence: Synthetic oligonucleotide
ttcaacacagactaccacatgaacctgaggcac

SEQ ID NO: 220281 - DNA, 32 bp, Artificial Sequence
  Description of Artificial Sequence: Synthetic oligonucleotide
tcaacacagactaccacatgaacctgaggcac

SEQ ID NO: 220282 - DNA, 31 bp, Artificial Sequence
  Description of Artificial Sequence: Synthetic oligonucleotide
caacacagactaccacatgaacctgaggcac

SEQ ID NO: 220283 - DNA, 33 bp, Artificial Sequence
  Description of Artificial Sequence: Synthetic oligonucleotide
aacacagactaccacatgaacctgaggcacttc

SEQ ID NO: 220284 - DNA, 32 bp, Artificial Sequence
  Description of Artificial Sequence: Synthetic oligonucleotide
acacagactaccacatgaacctgaggcacttc

SEQ ID NO: 220285 - DNA, 31 bp, Artificial Sequence
  Description of Artificial Sequence: Synthetic oligonucleotide
cacagactaccacatgaacctgaggcacttc

SEQ ID NO: 220286 - DNA, 33 bp, Artificial Sequence
  Description of Artificial Sequence: Synthetic oligonucleotide
acagactaccacatgaacctgaggcacttctac

SEQ ID NO: 220287 - DNA, 32 bp, Artificial Sequence
  Description of Artificial Sequence: Synthetic oligonucleotide
cagactaccacatgaacctgaggcacttctac

SEQ ID NO: 220288 - DNA, 32 bp, Artificial Sequence
  Description of Artificial Sequence: Synthetic oligonucleotide
agactaccacatgaacctgaggcacttctacg

SEQ ID NO: 220289 - DNA, 31 bp, Artificial Sequence
  Description of Artificial Sequence: Synthetic oligonucleotide
gactaccacatgaacctgaggcacttctacg

SEQ ID NO: 220290 - DNA, 32 bp, Artificial Sequence
  Description of Artificial Sequence: Synthetic oligonucleotide
actaccacatgaacctgaggcacttctacgtg

SEQ ID NO: 220291 - DNA, 31 bp, Artificial Sequence
  Description of Artificial Sequence: Synthetic oligonucleotide
ctaccacatgaacctgaggcacttctacgtg

SEQ ID NO: 220292 - DNA, 33 bp, Artificial Sequence
  Description of Artificial Sequence: Synthetic oligonucleotide
taccacatgaacctgaggcacttctacgtgttc

SEQ ID NO: 220293 - DNA, 32 bp, Artificial Sequence
  Description of Artificial Sequence: Synthetic oligonucleotide
accacatgaacctgaggcacttctacgtgttc

SEQ ID NO: 220294 - DNA, 31 bp, Artificial Sequence
  Description of Artificial Sequence: Synthetic oligonucleotide
ccacatgaacctgaggcacttctacgtgttc

SEQ ID NO: 220295 - DNA, 31 bp, Artificial Sequence
  Description of Artificial Sequence: Synthetic oligonucleotide
cacatgaacctgaggcacttctacgtgttcg

SEQ ID NO: 220296 - DNA, 31 bp, Artificial Sequence
  Description of Artificial Sequence: Synthetic oligonucleotide
acatgaacctgaggcacttctacgtgttcgc

SEQ ID NO: 220297 - DNA, 30 bp, Artificial Sequence
  Description of Artificial Sequence: Synthetic oligonucleotide
catgaacctgaggcacttctacgtgttcgc

SEQ ID NO: 220298 - DNA, 31 bp, Artificial Sequence
  Description of Artificial Sequence: Synthetic oligonucleotide
atgaacctgaggcacttctacgtgttcgcag

SEQ ID NO: 220299 - DNA, 30 bp, Artificial Sequence
  Description of Artificial Sequence: Synthetic oligonucleotide
tgaacctgaggcacttctacgtgttcgcag

SEQ ID NO: 220300 - DNA, 29 bp, Artificial Sequence
  Description of Artificial Sequence: Synthetic oligonucleotide
gaacctgaggcacttctacgtgttcgcag

SEQ ID NO: 220301 - DNA, 29 bp, Artificial Sequence
  Description of Artificial Sequence: Synthetic oligonucleotide
aacctgaggcacttctacgtgttcgcagc

SEQ ID NO: 220302 - DNA, 28 bp, Artificial Sequence
  Description of Artificial Sequence: Synthetic oligonucleotide
acctgaggcacttctacgtgttcgcagc

SEQ ID NO: 220303 - DNA, 27 bp, Artificial Sequence
  Description of Artificial Sequence: Synthetic oligonucleotide
cctgaggcacttctacgtgttcgcagc

SEQ ID NO: 220304 - DNA, 27 bp, Artificial Sequence
  Description of Artificial Sequence: Synthetic oligonucleotide
ctgaggcacttctacgtgttcgcagcc

SEQ ID NO: 220305 - DNA, 33 bp, Artificial Sequence
  Description of Artificial Sequence: Synthetic oligonucleotide
tgaggcacttctacgtgttcgcagcctattttg

SEQ ID NO: 220306 - DNA, 32 bp, Artificial Sequence
  Description of Artificial Sequence: Synthetic oligonucleotide
gaggcacttctacgtgttcgcagcctattttg

SEQ ID NO: 220307 - DNA, 32 bp, Artificial Sequence
  Description of Artificial Sequence: Synthetic oligonucleotide
aggcacttctacgtgttcgcagcctattttgg

SEQ ID NO: 220308 - DNA, 31 bp, Artificial Sequence
  Description of Artificial Sequence: Synthetic oligonucleotide
ggcacttctacgtgttcgcagcctattttgg

SEQ ID NO: 220309 - DNA, 31 bp, Artificial Sequence
  Description of Artificial Sequence: Synthetic oligonucleotide
gcacttctacgtgttcgcagcctattttggg

SEQ ID NO: 220310 - DNA, 31 bp, Artificial Sequence
  Description of Artificial Sequence: Synthetic oligonucleotide
cacttctacgtgttcgcagcctattttgggc

SEQ ID NO: 220311 - DNA, 32 bp, Artificial Sequence
  Description of Artificial Sequence: Synthetic oligonucleotide
acttctacgtgttcgcagcctattttgggctg

SEQ ID NO: 220312 - DNA, 31 bp, Artificial Sequence
  Description of Artificial Sequence: Synthetic oligonucleotide
cttctacgtgttcgcagcctattttgggctg

SEQ ID NO: 220313 - DNA, 32 bp, Artificial Sequence
  Description of Artificial Sequence: Synthetic oligonucleotide
ttctacgtgttcgcagcctattttgggctgac

SEQ ID NO: 220314 - DNA, 31 bp, Artificial Sequence
  Description of Artificial Sequence: Synthetic oligonucleotide
tctacgtgttcgcagcctattttgggctgac

SEQ ID NO: 220315 - DNA, 30 bp, Artificial Sequence
  Description of Artificial Sequence: Synthetic oligonucleotide
ctacgtgttcgcagcctattttgggctgac

SEQ ID NO: 220316 - DNA, 31 bp, Artificial Sequence
  Description of Artificial Sequence: Synthetic oligonucleotide
tacgtgttcgcagcctattttgggctgactg

SEQ ID NO: 220317 - DNA, 30 bp, Artificial Sequence
  Description of Artificial Sequence: Synthetic oligonucleotide
acgtgttcgcagcctattttgggctgactg

SEQ ID NO: 220318 - DNA, 29 bp, Artificial Sequence
  Description of Artificial Sequence: Synthetic oligonucleotide
cgtgttcgcagcctattttgggctgactg

SEQ ID NO: 220319 - DNA, 30 bp, Artificial Sequence
  Description of Artificial Sequence: Synthetic oligonucleotide
gtgttcgcagcctattttgggctgactgtg

SEQ ID NO: 220320 - DNA, 30 bp, Artificial Sequence
  Description of Artificial Sequence: Synthetic oligonucleotide
tgttcgcagcctattttgggctgactgtgg

SEQ ID NO: 220321 - DNA, 29 bp, Artificial Sequence
  Description of Artificial Sequence: Synthetic oligonucleotide
gttcgcagcctattttgggctgactgtgg

SEQ ID NO: 220322 - DNA, 29 bp, Artificial Sequence
  Description of Artificial Sequence: Synthetic oligonucleotide
ttcgcagcctattttgggctgactgtggc

SEQ ID NO: 220323 - DNA, 28 bp, Artificial Sequence
  Description of Artificial Sequence: Synthetic oligonucleotide
tcgcagcctattttgggctgactgtggc

SEQ ID NO: 220324 - DNA, 27 bp, Artificial Sequence
  Description of Artificial Sequence: Synthetic oligonucleotide
cgcagcctattttgggctgactgtggc

SEQ ID NO: 220325 - DNA, 27 bp, Artificial Sequence
  Description of Artificial Sequence: Synthetic oligonucleotide
gcagcctattttgggctgactgtggcc

SEQ ID NO: 220326 - DNA, 28 bp, Artificial Sequence
  Description of Artificial Sequence: Synthetic oligonucleotide
cagcctattttgggctgactgtggcctg

SEQ ID NO: 220327 - DNA, 28 bp, Artificial Sequence
  Description of Artificial Sequence: Synthetic oligonucleotide
agcctattttgggctgactgtggcctgg

SEQ ID NO: 220328 - DNA, 27 bp, Artificial Sequence
  Description of Artificial Sequence: Synthetic oligonucleotide
gcctattttgggctgactgtggcctgg

SEQ ID NO: 220329 - DNA, 28 bp, Artificial Sequence
  Description of Artificial Sequence: Synthetic oligonucleotide
cctattttgggctgactgtggcctggtg

SEQ ID NO: 220330 - DNA, 28 bp, Artificial Sequence
  Description of Artificial Sequence: Synthetic oligonucleotide
ctattttgggctgactgtggcctggtgc

SEQ ID NO: 220331 - DNA, 28 bp, Artificial Sequence
  Description of Artificial Sequence: Synthetic oligonucleotide
tattttgggctgactgtggcctggtgcc

SEQ ID NO: 220332 - DNA, 27 bp, Artificial Sequence
  Description of Artificial Sequence: Synthetic oligonucleotide
attttgggctgactgtggcctggtgcc

SEQ ID NO: 220333 - DNA, 27 bp, Artificial Sequence
  Description of Artificial Sequence: Synthetic oligonucleotide
ttttgggctgactgtggcctggtgcct

SEQ ID NO: 220334 - DNA, 26 bp, Artificial Sequence
  Description of Artificial Sequence: Synthetic oligonucleotide
tttgggctgactgtggcctggtgcct

SEQ ID NO: 220335 - DNA, 25 bp, Artificial Sequence
  Description of Artificial Sequence: Synthetic oligonucleotide
ttgggctgactgtggcctggtgcct

SEQ ID NO: 220336 - DNA, 24 bp, Artificial Sequence
  Description of Artificial Sequence: Synthetic oligonucleotide
tgggctgactgtggcctggtgcct

SEQ ID NO: 220337 - DNA, 23 bp, Artificial Sequence
  Description of Artificial Sequence: Synthetic oligonucleotide
gggctgactgtggcctggtgcct

SEQ ID NO: 220338 - DNA, 23 bp, Artificial Sequence
  Description of Artificial Sequence: Synthetic oligonucleotide
ggctgactgtggcctggtgcctg

SEQ ID NO: 220339 - DNA, 23 bp, Artificial Sequence
  Description of Artificial Sequence: Synthetic oligonucleotide
gctgactgtggcctggtgcctgc

SEQ ID NO: 220340 - DNA, 26 bp, Artificial Sequence
  Description of Artificial Sequence: Synthetic oligonucleotide
ctgactgtggcctggtgcctgccaaa

SEQ ID NO: 220341 - DNA, 26 bp, Artificial Sequence
  Description of Artificial Sequence: Synthetic oligonucleotide
tgactgtggcctggtgcctgccaaag

SEQ ID NO: 220342 - DNA, 25 bp, Artificial Sequence
  Description of Artificial Sequence: Synthetic oligonucleotide
gactgtggcctggtgcctgccaaag

SEQ ID NO: 220343 - DNA, 25 bp, Artificial Sequence
  Description of Artificial Sequence: Synthetic oligonucleotide
actgtggcctggtgcctgccaaagc

SEQ ID NO: 220344 - DNA, 24 bp, Artificial Sequence
  Description of Artificial Sequence: Synthetic oligonucleotide
ctgtggcctggtgcctgccaaagc

SEQ ID NO: 220345 - DNA, 25 bp, Artificial Sequence
  Description of Artificial Sequence: Synthetic oligonucleotide
tgtggcctggtgcctgccaaagcct

SEQ ID NO: 220346 - DNA, 24 bp, Artificial Sequence
  Description of Artificial Sequence: Synthetic oligonucleotide
gtggcctggtgcctgccaaagcct

SEQ ID NO: 220347 - DNA, 26 bp, Artificial Sequence
  Description of Artificial Sequence: Synthetic oligonucleotide
tggcctggtgcctgccaaagcctcta

SEQ ID NO: 220348 - DNA, 25 bp, Artificial Sequence
  Description of Artificial Sequence: Synthetic oligonucleotide
ggcctggtgcctgccaaagcctcta

SEQ ID NO: 220349 - DNA, 25 bp, Artificial Sequence
  Description of Artificial Sequence: Synthetic oligonucleotide
gcctggtgcctgccaaagcctctac

SEQ ID NO: 220350 - DNA, 25 bp, Artificial Sequence
  Description of Artificial Sequence: Synthetic oligonucleotide
cctggtgcctgccaaagcctctacc

SEQ ID NO: 220351 - DNA, 27 bp, Artificial Sequence
  Description of Artificial Sequence: Synthetic oligonucleotide
ctggtgcctgccaaagcctctacccaa

SEQ ID NO: 220352 - DNA, 27 bp, Artificial Sequence
  Description of Artificial Sequence: Synthetic oligonucleotide
tggtgcctgccaaagcctctacccaag

SEQ ID NO: 220353 - DNA, 26 bp, Artificial Sequence
  Description of Artificial Sequence: Synthetic oligonucleotide
ggtgcctgccaaagcctctacccaag

SEQ ID NO: 220354 - DNA, 26 bp, Artificial Sequence
  Description of Artificial Sequence: Synthetic oligonucleotide
gtgcctgccaaagcctctacccaagg

SEQ ID NO: 220355 - DNA, 27 bp, Artificial Sequence
  Description of Artificial Sequence: Synthetic oligonucleotide
tgcctgccaaagcctctacccaaggga

SEQ ID NO: 220356 - DNA, 27 bp, Artificial Sequence
  Description of Artificial Sequence: Synthetic oligonucleotide
gcctgccaaagcctctacccaagggaa

SEQ ID NO: 220357 - DNA, 27 bp, Artificial Sequence
  Description of Artificial Sequence: Synthetic oligonucleotide
cctgccaaagcctctacccaagggaac

SEQ ID NO: 220358 - DNA, 27 bp, Artificial Sequence
  Description of Artificial Sequence: Synthetic oligonucleotide
ctgccaaagcctctacccaagggaacg

SEQ ID NO: 220359 - DNA, 27 bp, Artificial Sequence
  Description of Artificial Sequence: Synthetic oligonucleotide
tgccaaagcctctacccaagggaacgg

SEQ ID NO: 220360 - DNA, 27 bp, Artificial Sequence
  Description of Artificial Sequence: Synthetic oligonucleotide
gccaaagcctctacccaagggaacgga

SEQ ID NO: 220361 - DNA, 27 bp, Artificial Sequence
  Description of Artificial Sequence: Synthetic oligonucleotide
ccaaagcctctacccaagggaacggag

SEQ ID NO: 220362 - DNA, 27 bp, Artificial Sequence
  Description of Artificial Sequence: Synthetic oligonucleotide
caaagcctctacccaagggaacggagg

SEQ ID NO: 220363 - DNA, 32 bp, Artificial Sequence
  Description of Artificial Sequence: Synthetic oligonucleotide
aaagcctctacccaagggaacggaggataatg

SEQ ID NO: 220364 - DNA, 31 bp, Artificial Sequence
  Description of Artificial Sequence: Synthetic oligonucleotide
aagcctctacccaagggaacggaggataatg

SEQ ID NO: 220365 - DNA, 30 bp, Artificial Sequence
  Description of Artificial Sequence: Synthetic oligonucleotide
agcctctacccaagggaacggaggataatg

SEQ ID NO: 220366 - DNA, 29 bp, Artificial Sequence
  Description of Artificial Sequence: Synthetic oligonucleotide
gcctctacccaagggaacggaggataatg

SEQ ID NO: 220367 - DNA, 31 bp, Artificial Sequence
  Description of Artificial Sequence: Synthetic oligonucleotide
cctctacccaagggaacggaggataatgatc

SEQ ID NO: 220368 - DNA, 32 bp, Artificial Sequence
  Description of Artificial Sequence: Synthetic oligonucleotide
ctctacccaagggaacggaggataatgatcag

SEQ ID NO: 220369 - DNA, 33 bp, Artificial Sequence
  Description of Artificial Sequence: Synthetic oligonucleotide
tctacccaagggaacggaggataatgatcagag

SEQ ID NO: 220370 - DNA, 32 bp, Artificial Sequence
  Description of Artificial Sequence: Synthetic oligonucleotide
ctacccaagggaacggaggataatgatcagag

SEQ ID NO: 220371 - DNA, 33 bp, Artificial Sequence
  Description of Artificial Sequence: Synthetic oligonucleotide
tacccaagggaacggaggataatgatcagagag

SEQ ID NO: 220372 - DNA, 32 bp, Artificial Sequence
  Description of Artificial Sequence: Synthetic oligonucleotide
acccaagggaacggaggataatgatcagagag

SEQ ID NO: 220373 - DNA, 31 bp, Artificial Sequence
  Description of Artificial Sequence: Synthetic oligonucleotide
cccaagggaacggaggataatgatcagagag

SEQ ID NO: 220374 - DNA, 31 bp, Artificial Sequence
  Description of Artificial Sequence: Synthetic oligonucleotide
ccaagggaacggaggataatgatcagagagc

SEQ ID NO: 220375 - DNA, 33 bp, Artificial Sequence
  Description of Artificial Sequence: Synthetic oligonucleotide
caagggaacggaggataatgatcagagagcaac

SEQ ID NO: 220376 - DNA, 33 bp, Artificial Sequence
  Description of Artificial Sequence: Synthetic oligonucleotide
aagggaacggaggataatgatcagagagcaacg

SEQ ID NO: 220377 - DNA, 32 bp, Artificial Sequence
  Description of Artificial Sequence: Synthetic oligonucleotide
agggaacggaggataatgatcagagagcaacg

SEQ ID NO: 220378 - DNA, 31 bp, Artificial Sequence
  Description of Artificial Sequence: Synthetic oligonucleotide
gggaacggaggataatgatcagagagcaacg

SEQ ID NO: 220379 - DNA, 34 bp, Artificial Sequence
  Description of Artificial Sequence: Synthetic oligonucleotide
ggaacggaggataatgatcagagagcaacgatac

SEQ ID NO: 220380 - DNA, 34 bp, Artificial Sequence
  Description of Artificial Sequence: Synthetic oligonucleotide
gaacggaggataatgatcagagagcaacgatacc

SEQ ID NO: 220381 - DNA, 34 bp, Artificial Sequence
  Description of Artificial Sequence: Synthetic oligonucleotide
aacggaggataatgatcagagagcaacgataccc

SEQ ID NO: 220382 - DNA, 33 bp, Artificial Sequence
  Description of Artificial Sequence: Synthetic oligonucleotide
acggaggataatgatcagagagcaacgataccc

SEQ ID NO: 220383 - DNA, 32 bp, Artificial Sequence
  Description of Artificial Sequence: Synthetic oligonucleotide
cggaggataatgatcagagagcaacgataccc

SEQ ID NO: 220384 - DNA, 33 bp, Artificial Sequence
  Description of Artificial Sequence: Synthetic oligonucleotide
ggaggataatgatcagagagcaacgatacccag

SEQ ID NO: 220385 - DNA, 36 bp, Artificial Sequence
  Description of Artificial Sequence: Synthetic oligonucleotide
gaggataatgatcagagagcaacgatacccagtttg

SEQ ID NO: 220386 - DNA, 37 bp, Artificial Sequence
  Description of Artificial Sequence: Synthetic oligonucleotide
aggataatgatcagagagcaacgatacccagtttgtc

SEQ ID NO: 220387 - DNA, 36 bp, Artificial Sequence
  Description of Artificial Sequence: Synthetic oligonucleotide
ggataatgatcagagagcaacgatacccagtttgtc

SEQ ID NO: 220388 - DNA, 37 bp, Artificial Sequence
  Description of Artificial Sequence: Synthetic oligonucleotide
gataatgatcagagagcaacgatacccagtttgtctg

SEQ ID NO: 220389 - DNA, 37 bp, Artificial Sequence
  Description of Artificial Sequence: Synthetic oligonucleotide
ataatgatcagagagcaacgatacccagtttgtctgc

SEQ ID NO: 220390 - DNA, 36 bp, Artificial Sequence
  Description of Artificial Sequence: Synthetic oligonucleotide
taatgatcagagagcaacgatacccagtttgtctgc

SEQ ID NO: 220391 - DNA, 35 bp, Artificial Sequence
  Description of Artificial Sequence: Synthetic oligonucleotide
aatgatcagagagcaacgatacccagtttgtctgc

SEQ ID NO: 220392 - DNA, 34 bp, Artificial Sequence
  Description of Artificial Sequence: Synthetic oligonucleotide
atgatcagagagcaacgatacccagtttgtctgc

SEQ ID NO: 220393 - DNA, 33 bp, Artificial Sequence
  Description of Artificial Sequence: Synthetic oligonucleotide
tgatcagagagcaacgatacccagtttgtctgc

SEQ ID NO: 220394 - DNA, 32 bp, Artificial Sequence
  Description of Artificial Sequence: Synthetic oligonucleotide
gatcagagagcaacgatacccagtttgtctgc

SEQ ID NO: 220395 - DNA, 32 bp, Artificial Sequence
  Description of Artificial Sequence: Synthetic oligonucleotide
atcagagagcaacgatacccagtttgtctgcc

SEQ ID NO: 220396 - DNA, 31 bp, Artificial Sequence
  Description of Artificial Sequence: Synthetic oligonucleotide
tcagagagcaacgatacccagtttgtctgcc

SEQ ID NO: 220397 - DNA, 30 bp, Artificial Sequence
  Description of Artificial Sequence: Synthetic oligonucleotide
cagagagcaacgatacccagtttgtctgcc

SEQ ID NO: 220398 - DNA, 32 bp, Artificial Sequence
  Description of Artificial Sequence: Synthetic oligonucleotide
agagagcaacgatacccagtttgtctgccatg

SEQ ID NO: 220399 - DNA, 31 bp, Artificial Sequence
  Description of Artificial Sequence: Synthetic oligonucleotide
gagagcaacgatacccagtttgtctgccatg

SEQ ID NO: 220400 - DNA, 31 bp, Artificial Sequence
  Description of Artificial Sequence: Synthetic oligonucleotide
agagcaacgatacccagtttgtctgccatgc

SEQ ID NO: 220401 - DNA, 30 bp, Artificial Sequence
  Description of Artificial Sequence: Synthetic oligonucleotide
gagcaacgatacccagtttgtctgccatgc

SEQ ID NO: 220402 - DNA, 31 bp, Artificial Sequence
  Description of Artificial Sequence: Synthetic oligonucleotide
agcaacgatacccagtttgtctgccatgctg

SEQ ID NO: 220403 - DNA, 30 bp, Artificial Sequence
  Description of Artificial Sequence: Synthetic oligonucleotide
gcaacgatacccagtttgtctgccatgctg

SEQ ID NO: 220404 - DNA, 30 bp, Artificial Sequence
  Description of Artificial Sequence: Synthetic oligonucleotide
caacgatacccagtttgtctgccatgctgg

SEQ ID NO: 220405 - DNA, 30 bp, Artificial Sequence
  Description of Artificial Sequence: Synthetic oligonucleotide
aacgatacccagtttgtctgccatgctggg

SEQ ID NO: 220406 - DNA, 29 bp, Artificial Sequence
  Description of Artificial Sequence: Synthetic oligonucleotide
acgatacccagtttgtctgccatgctggg

SEQ ID NO: 220407 - DNA, 28 bp, Artificial Sequence
  Description of Artificial Sequence: Synthetic oligonucleotide
cgatacccagtttgtctgccatgctggg

SEQ ID NO: 220408 - DNA, 28 bp, Artificial Sequence
  Description of Artificial Sequence: Synthetic oligonucleotide
gatacccagtttgtctgccatgctgggc

SEQ ID NO: 220409 - DNA, 28 bp, Artificial Sequence
  Description of Artificial Sequence: Synthetic oligonucleotide
atacccagtttgtctgccatgctgggcg

SEQ ID NO: 220410 - DNA, 27 bp, Artificial Sequence
  Description of Artificial Sequence: Synthetic oligonucleotide
tacccagtttgtctgccatgctgggcg

SEQ ID NO: 220411 - DNA, 26 bp, Artificial Sequence
  Description of Artificial Sequence: Synthetic oligonucleotide
acccagtttgtctgccatgctgggcg

SEQ ID NO: 220412 - DNA, 25 bp, Artificial Sequence
  Description of Artificial Sequence: Synthetic oligonucleotide
cccagtttgtctgccatgctgggcg

SEQ ID NO: 220413 - DNA, 25 bp, Artificial Sequence
  Description of Artificial Sequence: Synthetic oligonucleotide
ccagtttgtctgccatgctgggcgc

SEQ ID NO: 220414 - DNA, 25 bp, Artificial Sequence
  Description of Artificial Sequence: Synthetic oligonucleotide
cagtttgtctgccatgctgggcgcc

SEQ ID NO: 220415 - DNA, 26 bp, Artificial Sequence
  Description of Artificial Sequence: Synthetic oligonucleotide
agtttgtctgccatgctgggcgccct

SEQ ID NO: 220416 - DNA, 25 bp, Artificial Sequence
  Description of Artificial Sequence: Synthetic oligonucleotide
gtttgtctgccatgctgggcgccct

SEQ ID NO: 220417 - DNA, 27 bp, Artificial Sequence
  Description of Artificial Sequence: Synthetic oligonucleotide
tttgtctgccatgctgggcgccctctt

SEQ ID NO: 220418 - DNA, 26 bp, Artificial Sequence
  Description of Artificial Sequence: Synthetic oligonucleotide
ttgtctgccatgctgggcgccctctt

SEQ ID NO: 220419 - DNA, 25 bp, Artificial Sequence
  Description of Artificial Sequence: Synthetic oligonucleotide
tgtctgccatgctgggcgccctctt

SEQ ID NO: 220420 - DNA, 24 bp, Artificial Sequence
  Description of Artificial Sequence: Synthetic oligonucleotide
gtctgccatgctgggcgccctctt

SEQ ID NO: 220421 - DNA, 26 bp, Artificial Sequence
  Description of Artificial Sequence: Synthetic oligonucleotide
tctgccatgctgggcgccctcttctt

SEQ ID NO: 220422 - DNA, 25 bp, Artificial Sequence
  Description of Artificial Sequence: Synthetic oligonucleotide
ctgccatgctgggcgccctcttctt

SEQ ID NO: 220423 - DNA, 26 bp, Artificial Sequence
  Description of Artificial Sequence: Synthetic oligonucleotide
tgccatgctgggcgccctcttcttgt

SEQ ID NO: 220424 - DNA, 25 bp, Artificial Sequence
  Description of Artificial Sequence: Synthetic oligonucleotide
gccatgctgggcgccctcttcttgt

SEQ ID NO: 220425 - DNA, 25 bp, Artificial Sequence
  Description of Artificial Sequence: Synthetic oligonucleotide
ccatgctgggcgccctcttcttgtg

SEQ ID NO: 220426 - DNA, 27 bp, Artificial Sequence
  Description of Artificial Sequence: Synthetic oligonucleotide
catgctgggcgccctcttcttgtggat

SEQ ID NO: 220427 - DNA, 27 bp, Artificial Sequence
  Description of Artificial Sequence: Synthetic oligonucleotide
atgctgggcgccctcttcttgtggatg

SEQ ID NO: 220428 - DNA, 27 bp, Artificial Sequence
  Description of Artificial Sequence: Synthetic oligonucleotide
tgctgggcgccctcttcttgtggatgt

SEQ ID NO: 220429 - DNA, 27 bp, Artificial Sequence
  Description of Artificial Sequence: Synthetic oligonucleotide
gctgggcgccctcttcttgtggatgtt

SEQ ID NO: 220430 - DNA, 27 bp, Artificial Sequence
  Description of Artificial Sequence: Synthetic oligonucleotide
ctgggcgccctcttcttgtggatgttc

SEQ ID NO: 220431 - DNA, 28 bp, Artificial Sequence
  Description of Artificial Sequence: Synthetic oligonucleotide
tgggcgccctcttcttgtggatgttctg

SEQ ID NO: 220432 - DNA, 27 bp, Artificial Sequence
  Description of Artificial Sequence: Synthetic oligonucleotide
gggcgccctcttcttgtggatgttctg

SEQ ID NO: 220433 - DNA, 27 bp, Artificial Sequence
  Description of Artificial Sequence: Synthetic oligonucleotide
ggcgccctcttcttgtggatgttctgg

SEQ ID NO: 220434 - DNA, 27 bp, Artificial Sequence
  Description of Artificial Sequence: Synthetic oligonucleotide
gcgccctcttcttgtggatgttctggc

SEQ ID NO: 220435 - DNA, 27 bp, Artificial Sequence
  Description of Artificial Sequence: Synthetic oligonucleotide
cgccctcttcttgtggatgttctggcc

SEQ ID NO: 220436 - DNA, 29 bp, Artificial Sequence
  Description of Artificial Sequence: Synthetic oligonucleotide
gccctcttcttgtggatgttctggccaag

SEQ ID NO: 220437 - DNA, 30 bp, Artificial Sequence
  Description of Artificial Sequence: Synthetic oligonucleotide
ccctcttcttgtggatgttctggccaagtg

SEQ ID NO: 220438 - DNA, 31 bp, Artificial Sequence
  Description of Artificial Sequence: Synthetic oligonucleotide
cctcttcttgtggatgttctggccaagtgtc

SEQ ID NO: 220439 - DNA, 33 bp, Artificial Sequence
  Description of Artificial Sequence: Synthetic oligonucleotide
ctcttcttgtggatgttctggccaagtgtcaac

SEQ ID NO: 220440 - DNA, 34 bp, Artificial Sequence
  Description of Artificial Sequence: Synthetic oligonucleotide
tcttcttgtggatgttctggccaagtgtcaactc

SEQ ID NO: 220441 - DNA, 33 bp, Artificial Sequence
  Description of Artificial Sequence: Synthetic oligonucleotide
cttcttgtggatgttctggccaagtgtcaactc

SEQ ID NO: 220442 - DNA, 34 bp, Artificial Sequence
  Description of Artificial Sequence: Synthetic oligonucleotide
ttcttgtggatgttctggccaagtgtcaactctg

SEQ ID NO: 220443 - DNA, 33 bp, Artificial Sequence
  Description of Artificial Sequence: Synthetic oligonucleotide
tcttgtggatgttctggccaagtgtcaactctg

SEQ ID NO: 220444 - DNA, 32 bp, Artificial Sequence
  Description of Artificial Sequence: Synthetic oligonucleotide
cttgtggatgttctggccaagtgtcaactctg

SEQ ID NO: 220445 - DNA, 32 bp, Artificial Sequence
  Description of Artificial Sequence: Synthetic oligonucleotide
ttgtggatgttctggccaagtgtcaactctgc

SEQ ID NO: 220446 - DNA, 31 bp, Artificial Sequence
  Description of Artificial Sequence: Synthetic oligonucleotide
tgtggatgttctggccaagtgtcaactctgc

SEQ ID NO: 220447 - DNA, 30 bp, Artificial Sequence
  Description of Artificial Sequence: Synthetic oligonucleotide
gtggatgttctggccaagtgtcaactctgc

SEQ ID NO: 220448 - DNA, 31 bp, Artificial Sequence
  Description of Artificial Sequence: Synthetic oligonucleotide
tggatgttctggccaagtgtcaactctgctc

SEQ ID NO: 220449 - DNA, 30 bp, Artificial Sequence
  Description of Artificial Sequence: Synthetic oligonucleotide
ggatgttctggccaagtgtcaactctgctc

SEQ ID NO: 220450 - DNA, 31 bp, Artificial Sequence
  Description of Artificial Sequence: Synthetic oligonucleotide
gatgttctggccaagtgtcaactctgctctg

SEQ ID NO: 220451 - DNA, 31 bp, Artificial Sequence
  Description of Artificial Sequence: Synthetic oligonucleotide
atgttctggccaagtgtcaactctgctctgc

SEQ ID NO: 220452 - DNA, 30 bp, Artificial Sequence
  Description of Artificial Sequence: Synthetic oligonucleotide
tgttctggccaagtgtcaactctgctctgc

SEQ ID NO: 220453 - DNA, 29 bp, Artificial Sequence
  Description of Artificial Sequence: Synthetic oligonucleotide
gttctggccaagtgtcaactctgctctgc

SEQ ID NO: 220454 - DNA, 30 bp, Artificial Sequence
  Description of Artificial Sequence: Synthetic oligonucleotide
ttctggccaagtgtcaactctgctctgctg

SEQ ID NO: 220455 - DNA, 29 bp, Artificial Sequence
  Description of Artificial Sequence: Synthetic oligonucleotide
tctggccaagtgtcaactctgctctgctg

SEQ ID NO: 220456 - DNA, 28 bp, Artificial Sequence
  Description of Artificial Sequence: Synthetic oligonucleotide
ctggccaagtgtcaactctgctctgctg

SEQ ID NO: 220457 - DNA, 29 bp, Artificial Sequence
  Description of Artificial Sequence: Synthetic oligonucleotide
tggccaagtgtcaactctgctctgctgag

SEQ ID NO: 220458 - DNA, 28 bp, Artificial Sequence
  Description of Artificial Sequence: Synthetic oligonucleotide
ggccaagtgtcaactctgctctgctgag

SEQ ID NO: 220459 - DNA, 30 bp, Artificial Sequence
  Description of Artificial Sequence: Synthetic oligonucleotide
gccaagtgtcaactctgctctgctgagaag

SEQ ID NO: 220460 - DNA, 31 bp, Artificial Sequence
  Description of Artificial Sequence: Synthetic oligonucleotide
ccaagtgtcaactctgctctgctgagaagtc

SEQ ID NO: 220461 - DNA, 31 bp, Artificial Sequence
  Description of Artificial Sequence: Synthetic oligonucleotide
caagtgtcaactctgctctgctgagaagtcc

SEQ ID NO: 220462 - DNA, 34 bp, Artificial Sequence
  Description of Artificial Sequence: Synthetic oligonucleotide
aagtgtcaactctgctctgctgagaagtccaatc

SEQ ID NO: 220463 - DNA, 33 bp, Artificial Sequence
  Description of Artificial Sequence: Synthetic oligonucleotide
agtgtcaactctgctctgctgagaagtccaatc

SEQ ID NO: 220464 - DNA, 32 bp, Artificial Sequence
  Description of Artificial Sequence: Synthetic oligonucleotide
gtgtcaactctgctctgctgagaagtccaatc

SEQ ID NO: 220465 - DNA, 32 bp, Artificial Sequence
  Description of Artificial Sequence: Synthetic oligonucleotide
tgtcaactctgctctgctgagaagtccaatcc

SEQ ID NO: 220466 - DNA, 31 bp, Artificial Sequence
  Description of Artificial Sequence: Synthetic oligonucleotide
gtcaactctgctctgctgagaagtccaatcc

SEQ ID NO: 220467 - DNA, 34 bp, Artificial Sequence
  Description of Artificial Sequence: Synthetic oligonucleotide
tcaactctgctctgctgagaagtccaatccaaag

SEQ ID NO: 220468 - DNA, 33 bp, Artificial Sequence
  Description of Artificial Sequence: Synthetic oligonucleotide
caactctgctctgctgagaagtccaatccaaag

SEQ ID NO: 220469 - DNA, 33 bp, Artificial Sequence
  Description of Artificial Sequence: Synthetic oligonucleotide
aactctgctctgctgagaagtccaatccaaagg

SEQ ID NO: 220470 - DNA, 32 bp, Artificial Sequence
  Description of Artificial Sequence: Synthetic oligonucleotide
actctgctctgctgagaagtccaatccaaagg

SEQ ID NO: 220471 - DNA, 31 bp, Artificial Sequence
  Description of Artificial Sequence: Synthetic oligonucleotide
ctctgctctgctgagaagtccaatccaaagg

SEQ ID NO: 220472 - DNA, 33 bp, Artificial Sequence
  Description of Artificial Sequence: Synthetic oligonucleotide
tctgctctgctgagaagtccaatccaaaggaag

SEQ ID NO: 220473 - DNA, 32 bp, Artificial Sequence
  Description of Artificial Sequence: Synthetic oligonucleotide
ctgctctgctgagaagtccaatccaaaggaag

SEQ ID NO: 220474 - DNA, 35 bp, Artificial Sequence
  Description of Artificial Sequence: Synthetic oligonucleotide
tgctctgctgagaagtccaatccaaaggaagaatg

SEQ ID NO: 220475 - DNA, 34 bp, Artificial Sequence
  Description of Artificial Sequence: Synthetic oligonucleotide
gctctgctgagaagtccaatccaaaggaagaatg

SEQ ID NO: 220476 - DNA, 34 bp, Artificial Sequence
  Description of Artificial Sequence: Synthetic oligonucleotide
ctctgctgagaagtccaatccaaaggaagaatgc

SEQ ID NO: 220477 - DNA, 34 bp, Artificial Sequence
  Description of Artificial Sequence: Synthetic oligonucleotide
tctgctgagaagtccaatccaaaggaagaatgcc

SEQ ID NO: 220478 - DNA, 33 bp, Artificial Sequence
  Description of Artificial Sequence: Synthetic oligonucleotide
ctgctgagaagtccaatccaaaggaagaatgcc

SEQ ID NO: 220479 - DNA, 35 bp, Artificial Sequence
  Description of Artificial Sequence: Synthetic oligonucleotide
tgctgagaagtccaatccaaaggaagaatgccatg

SEQ ID NO: 220480 - DNA, 34 bp, Artificial Sequence
  Description of Artificial Sequence: Synthetic oligonucleotide
gctgagaagtccaatccaaaggaagaatgccatg

SEQ ID NO: 220481 - DNA, 36 bp, Artificial Sequence
  Description of Artificial Sequence: Synthetic oligonucleotide
ctgagaagtccaatccaaaggaagaatgccatgttc

SEQ ID NO: 220482 - DNA, 38 bp, Artificial Sequence
  Description of Artificial Sequence: Synthetic oligonucleotide
tgagaagtccaatccaaaggaagaatgccatgttcaac

SEQ ID NO: 220483 - DNA, 37 bp, Artificial Sequence
  Description of Artificial Sequence: Synthetic oligonucleotide
gagaagtccaatccaaaggaagaatgccatgttcaac

SEQ ID NO: 220484 - DNA, 38 bp, Artificial Sequence
  Description of Artificial Sequence: Synthetic oligonucleotide
agaagtccaatccaaaggaagaatgccatgttcaacac

SEQ ID NO: 220485 - DNA, 37 bp, Artificial Sequence
  Description of Artificial Sequence: Synthetic oligonucleotide
gaagtccaatccaaaggaagaatgccatgttcaacac

SEQ ID NO: 220486 - DNA, 37 bp, Artificial Sequence
  Description of Artificial Sequence: Synthetic oligonucleotide
aagtccaatccaaaggaagaatgccatgttcaacacc

SEQ ID NO: 220487 - DNA, 36 bp, Artificial Sequence
  Description of Artificial Sequence: Synthetic oligonucleotide
agtccaatccaaaggaagaatgccatgttcaacacc

SEQ ID NO: 220488 - DNA, 35 bp, Artificial Sequence
  Description of Artificial Sequence: Synthetic oligonucleotide
gtccaatccaaaggaagaatgccatgttcaacacc

SEQ ID NO: 220489 - DNA, 37 bp, Artificial Sequence
  Description of Artificial Sequence: Synthetic oligonucleotide
tccaatccaaaggaagaatgccatgttcaacacctac

SEQ ID NO: 220490 - DNA, 36 bp, Artificial Sequence
  Description of Artificial Sequence: Synthetic oligonucleotide
ccaatccaaaggaagaatgccatgttcaacacctac

SEQ ID NO: 220491 - DNA, 39 bp, Artificial Sequence
  Description of Artificial Sequence: Synthetic oligonucleotide
caatccaaaggaagaatgccatgttcaacacctactatg

SEQ ID NO: 220492 - DNA, 39 bp, Artificial Sequence
  Description of Artificial Sequence: Synthetic oligonucleotide
aatccaaaggaagaatgccatgttcaacacctactatgc

SEQ ID NO: 220493 - DNA, 38 bp, Artificial Sequence
  Description of Artificial Sequence: Synthetic oligonucleotide
atccaaaggaagaatgccatgttcaacacctactatgc

SEQ ID NO: 220494 - DNA, 37 bp, Artificial Sequence
  Description of Artificial Sequence: Synthetic oligonucleotide
tccaaaggaagaatgccatgttcaacacctactatgc

SEQ ID NO: 220495 - DNA, 36 bp, Artificial Sequence
  Description of Artificial Sequence: Synthetic oligonucleotide
ccaaaggaagaatgccatgttcaacacctactatgc

SEQ ID NO: 220496 - DNA, 37 bp, Artificial Sequence
  Description of Artificial Sequence: Synthetic oligonucleotide
caaaggaagaatgccatgttcaacacctactatgctc

SEQ ID NO: 220497 - DNA, 39 bp, Artificial Sequence
  Description of Artificial Sequence: Synthetic oligonucleotide
aaaggaagaatgccatgttcaacacctactatgctctag

SEQ ID NO: 220498 - DNA, 38 bp, Artificial Sequence
  Description of Artificial Sequence: Synthetic oligonucleotide
aaggaagaatgccatgttcaacacctactatgctctag

SEQ ID NO: 220499 - DNA, 37 bp, Artificial Sequence
  Description of Artificial Sequence: Synthetic oligonucleotide
aggaagaatgccatgttcaacacctactatgctctag

SEQ ID NO: 220500 - DNA, 36 bp, Artificial Sequence
  Description of Artificial Sequence: Synthetic oligonucleotide
ggaagaatgccatgttcaacacctactatgctctag

SEQ ID NO: 220501 - DNA, 36 bp, Artificial Sequence
  Description of Artificial Sequence: Synthetic oligonucleotide
gaagaatgccatgttcaacacctactatgctctagc

SEQ ID NO: 220502 - DNA, 37 bp, Artificial Sequence
  Description of Artificial Sequence: Synthetic oligonucleotide
aagaatgccatgttcaacacctactatgctctagcag

SEQ ID NO: 220503 - DNA, 36 bp, Artificial Sequence
  Description of Artificial Sequence: Synthetic oligonucleotide
agaatgccatgttcaacacctactatgctctagcag

SEQ ID NO: 220504 - DNA, 35 bp, Artificial Sequence
  Description of Artificial Sequence: Synthetic oligonucleotide
gaatgccatgttcaacacctactatgctctagcag

SEQ ID NO: 220505 - DNA, 36 bp, Artificial Sequence
  Description of Artificial Sequence: Synthetic oligonucleotide
aatgccatgttcaacacctactatgctctagcagtc

SEQ ID NO: 220506 - DNA, 35 bp, Artificial Sequence
  Description of Artificial Sequence: Synthetic oligonucleotide
atgccatgttcaacacctactatgctctagcagtc

SEQ ID NO: 220507 - DNA, 34 bp, Artificial Sequence
  Description of Artificial Sequence: Synthetic oligonucleotide
tgccatgttcaacacctactatgctctagcagtc

SEQ ID NO: 220508 - DNA, 33 bp, Artificial Sequence
  Description of Artificial Sequence: Synthetic oligonucleotide
gccatgttcaacacctactatgctctagcagtc

SEQ ID NO: 220509 - DNA, 34 bp, Artificial Sequence
  Description of Artificial Sequence: Synthetic oligonucleotide
ccatgttcaacacctactatgctctagcagtcag

SEQ ID NO: 220510 - DNA, 35 bp, Artificial Sequence
  Description of Artificial Sequence: Synthetic oligonucleotide
catgttcaacacctactatgctctagcagtcagtg

SEQ ID NO: 220511 - DNA, 36 bp, Artificial Sequence
  Description of Artificial Sequence: Synthetic oligonucleotide
atgttcaacacctactatgctctagcagtcagtgtg

SEQ ID NO: 220512 - DNA, 35 bp, Artificial Sequence
  Description of Artificial Sequence: Synthetic oligonucleotide
tgttcaacacctactatgctctagcagtcagtgtg

SEQ ID NO: 220513 - DNA, 34 bp, Artificial Sequence
  Description of Artificial Sequence: Synthetic oligonucleotide
gttcaacacctactatgctctagcagtcagtgtg

SEQ ID NO: 220514 - DNA, 34 bp, Artificial Sequence
  Description of Artificial Sequence: Synthetic oligonucleotide
ttcaacacctactatgctctagcagtcagtgtgg

SEQ ID NO: 220515 - DNA, 33 bp, Artificial Sequence
  Description of Artificial Sequence: Synthetic oligonucleotide
tcaacacctactatgctctagcagtcagtgtgg

SEQ ID NO: 220516 - DNA, 32 bp, Artificial Sequence
  Description of Artificial Sequence: Synthetic oligonucleotide
caacacctactatgctctagcagtcagtgtgg

SEQ ID NO: 220517 - DNA, 33 bp, Artificial Sequence
  Description of Artificial Sequence: Synthetic oligonucleotide
aacacctactatgctctagcagtcagtgtggtg

SEQ ID NO: 220518 - DNA, 32 bp, Artificial Sequence
  Description of Artificial Sequence: Synthetic oligonucleotide
acacctactatgctctagcagtcagtgtggtg

SEQ ID NO: 220519 - DNA, 31 bp, Artificial Sequence
  Description of Artificial Sequence: Synthetic oligonucleotide
cacctactatgctctagcagtcagtgtggtg

SEQ ID NO: 220520 - DNA, 32 bp, Artificial Sequence
  Description of Artificial Sequence: Synthetic oligonucleotide
acctactatgctctagcagtcagtgtggtgac

SEQ ID NO: 220521 - DNA, 31 bp, Artificial Sequence
  Description of Artificial Sequence: Synthetic oligonucleotide
cctactatgctctagcagtcagtgtggtgac

SEQ ID NO: 220522 - DNA, 32 bp, Artificial Sequence
  Description of Artificial Sequence: Synthetic oligonucleotide
ctactatgctctagcagtcagtgtggtgacag

SEQ ID NO: 220523 - DNA, 32 bp, Artificial Sequence
  Description of Artificial Sequence: Synthetic oligonucleotide
tactatgctctagcagtcagtgtggtgacagc

SEQ ID NO: 220524 - DNA, 31 bp, Artificial Sequence
  Description of Artificial Sequence: Synthetic oligonucleotide
actatgctctagcagtcagtgtggtgacagc

SEQ ID NO: 220525 - DNA, 30 bp, Artificial Sequence
  Description of Artificial Sequence: Synthetic oligonucleotide
ctatgctctagcagtcagtgtggtgacagc

SEQ ID NO: 220526 - DNA, 30 bp, Artificial Sequence
  Description of Artificial Sequence: Synthetic oligonucleotide
tatgctctagcagtcagtgtggtgacagcc

SEQ ID NO: 220527 - DNA, 29 bp, Artificial Sequence
  Description of Artificial Sequence: Synthetic oligonucleotide
atgctctagcagtcagtgtggtgacagcc

SEQ ID NO: 220528 - DNA, 28 bp, Artificial Sequence
  Description of Artificial Sequence: Synthetic oligonucleotide
tgctctagcagtcagtgtggtgacagcc

SEQ ID NO: 220529 - DNA, 27 bp, Artificial Sequence
  Description of Artificial Sequence: Synthetic oligonucleotide
gctctagcagtcagtgtggtgacagcc

SEQ ID NO: 220530 - DNA, 29 bp, Artificial Sequence
  Description of Artificial Sequence: Synthetic oligonucleotide
ctctagcagtcagtgtggtgacagccatc

SEQ ID NO: 220531 - DNA, 30 bp, Artificial Sequence
  Description of Artificial Sequence: Synthetic oligonucleotide
tctagcagtcagtgtggtgacagccatctc

SEQ ID NO: 220532 - DNA, 29 bp, Artificial Sequence
  Description of Artificial Sequence: Synthetic oligonucleotide
ctagcagtcagtgtggtgacagccatctc

SEQ ID NO: 220533 - DNA, 30 bp, Artificial Sequence
  Description of Artificial Sequence: Synthetic oligonucleotide
tagcagtcagtgtggtgacagccatctcag

SEQ ID NO: 220534 - DNA, 29 bp, Artificial Sequence
  Description of Artificial Sequence: Synthetic oligonucleotide
agcagtcagtgtggtgacagccatctcag

SEQ ID NO: 220535 - DNA, 28 bp, Artificial Sequence
  Description of Artificial Sequence: Synthetic oligonucleotide
gcagtcagtgtggtgacagccatctcag

SEQ ID NO: 220536 - DNA, 28 bp, Artificial Sequence
  Description of Artificial Sequence: Synthetic oligonucleotide
cagtcagtgtggtgacagccatctcagg

SEQ ID NO: 220537 - DNA, 28 bp, Artificial Sequence
  Description of Artificial Sequence: Synthetic oligonucleotide
agtcagtgtggtgacagccatctcaggg

SEQ ID NO: 220538 - DNA, 27 bp, Artificial Sequence
  Description of Artificial Sequence: Synthetic oligonucleotide
gtcagtgtggtgacagccatctcaggg

SEQ ID NO: 220539 - DNA, 28 bp, Artificial Sequence
  Description of Artificial Sequence: Synthetic oligonucleotide
tcagtgtggtgacagccatctcagggtc

SEQ ID NO: 220540 - DNA, 27 bp, Artificial Sequence
  Description of Artificial Sequence: Synthetic oligonucleotide
cagtgtggtgacagccatctcagggtc

SEQ ID NO: 220541 - DNA, 29 bp, Artificial Sequence
  Description of Artificial Sequence: Synthetic oligonucleotide
agtgtggtgacagccatctcagggtcatc

SEQ ID NO: 220542 - DNA, 28 bp, Artificial Sequence
  Description of Artificial Sequence: Synthetic oligonucleotide
gtgtggtgacagccatctcagggtcatc

SEQ ID NO: 220543 - DNA, 28 bp, Artificial Sequence
  Description of Artificial Sequence: Synthetic oligonucleotide
tgtggtgacagccatctcagggtcatcc

SEQ ID NO: 220544 - DNA, 27 bp, Artificial Sequence
  Description of Artificial Sequence: Synthetic oligonucleotide
gtggtgacagccatctcagggtcatcc

SEQ ID NO: 220545 - DNA, 29 bp, Artificial Sequence
  Description of Artificial Sequence: Synthetic oligonucleotide
tggtgacagccatctcagggtcatccttg

SEQ ID NO: 220546 - DNA, 28 bp, Artificial Sequence
  Description of Artificial Sequence: Synthetic oligonucleotide
ggtgacagccatctcagggtcatccttg

SEQ ID NO: 220547 - DNA, 28 bp, Artificial Sequence
  Description of Artificial Sequence: Synthetic oligonucleotide
gtgacagccatctcagggtcatccttgg

SEQ ID NO: 220548 - DNA, 28 bp, Artificial Sequence
  Description of Artificial Sequence: Synthetic oligonucleotide
tgacagccatctcagggtcatccttggc

SEQ ID NO: 220549 - DNA, 27 bp, Artificial Sequence
  Description of Artificial Sequence: Synthetic oligonucleotide
gacagccatctcagggtcatccttggc

SEQ ID NO: 220550 - DNA, 28 bp, Artificial Sequence
  Description of Artificial Sequence: Synthetic oligonucleotide
acagccatctcagggtcatccttggctc

SEQ ID NO: 220551 - DNA, 27 bp, Artificial Sequence
  Description of Artificial Sequence: Synthetic oligonucleotide
cagccatctcagggtcatccttggctc

SEQ ID NO: 220552 - DNA, 28 bp, Artificial Sequence
  Description of Artificial Sequence: Synthetic oligonucleotide
agccatctcagggtcatccttggctcac

SEQ ID NO: 220553 - DNA, 27 bp, Artificial Sequence
  Description of Artificial Sequence: Synthetic oligonucleotide
gccatctcagggtcatccttggctcac

SEQ ID NO: 220554 - DNA, 27 bp, Artificial Sequence
  Description of Artificial Sequence: Synthetic oligonucleotide
ccatctcagggtcatccttggctcacc

SEQ ID NO: 220555 - DNA, 27 bp, Artificial Sequence
  Description of Artificial Sequence: Synthetic oligonucleotide
catctcagggtcatccttggctcaccc

SEQ ID NO: 220556 - DNA, 27 bp, Artificial Sequence
  Description of Artificial Sequence: Synthetic oligonucleotide
atctcagggtcatccttggctcacccc

SEQ ID NO: 220557 - DNA, 26 bp, Artificial Sequence
  Description of Artificial Sequence: Synthetic oligonucleotide
tctcagggtcatccttggctcacccc

SEQ ID NO: 220558 - DNA, 25 bp, Artificial Sequence
  Description of Artificial Sequence: Synthetic oligonucleotide
ctcagggtcatccttggctcacccc

SEQ ID NO: 220559 - DNA, 27 bp, Artificial Sequence
  Description of Artificial Sequence: Synthetic oligonucleotide
tcagggtcatccttggctcacccccaa

SEQ ID NO: 220560 - DNA, 27 bp, Artificial Sequence
  Description of Artificial Sequence: Synthetic oligonucleotide
cagggtcatccttggctcacccccaaa

SEQ ID NO: 220561 - DNA, 27 bp, Artificial Sequence
  Description of Artificial Sequence: Synthetic oligonucleotide
agggtcatccttggctcacccccaaag

SEQ ID NO: 220562 - DNA, 26 bp, Artificial Sequence
  Description of Artificial Sequence: Synthetic oligonucleotide
gggtcatccttggctcacccccaaag

SEQ ID NO: 220563 - DNA, 27 bp, Artificial Sequence
  Description of Artificial Sequence: Synthetic oligonucleotide
ggtcatccttggctcacccccaaagga

SEQ ID NO: 220564 - DNA, 28 bp, Artificial Sequence
  Description of Artificial Sequence: Synthetic oligonucleotide
gtcatccttggctcacccccaaaggaag

SEQ ID NO: 220565 - DNA, 30 bp, Artificial Sequence
  Description of Artificial Sequence: Synthetic oligonucleotide
tcatccttggctcacccccaaaggaagatc

SEQ ID NO: 220566 - DNA, 29 bp, Artificial Sequence
  Description of Artificial Sequence: Synthetic oligonucleotide
catccttggctcacccccaaaggaagatc

SEQ ID NO: 220567 - DNA, 30 bp, Artificial Sequence
  Description of Artificial Sequence: Synthetic oligonucleotide
atccttggctcacccccaaaggaagatcag

SEQ ID NO: 220568 - DNA, 29 bp, Artificial Sequence
  Description of Artificial Sequence: Synthetic oligonucleotide
tccttggctcacccccaaaggaagatcag

SEQ ID NO: 220569 - DNA, 28 bp, Artificial Sequence
  Description of Artificial Sequence: Synthetic oligonucleotide
ccttggctcacccccaaaggaagatcag

SEQ ID NO: 220570 - DNA, 28 bp, Artificial Sequence
  Description of Artificial Sequence: Synthetic oligonucleotide
cttggctcacccccaaaggaagatcagc

SEQ ID NO: 220571 - DNA, 30 bp, Artificial Sequence
  Description of Artificial Sequence: Synthetic oligonucleotide
ttggctcacccccaaaggaagatcagcatg

SEQ ID NO: 220572 - DNA, 29 bp, Artificial Sequence
  Description of Artificial Sequence: Synthetic oligonucleotide
tggctcacccccaaaggaagatcagcatg

SEQ ID NO: 220573 - DNA, 28 bp, Artificial Sequence
  Description of Artificial Sequence: Synthetic oligonucleotide
ggctcacccccaaaggaagatcagcatg

SEQ ID NO: 220574 - DNA, 29 bp, Artificial Sequence
  Description of Artificial Sequence: Synthetic oligonucleotide
gctcacccccaaaggaagatcagcatgac

SEQ ID NO: 220575 - DNA, 33 bp, Artificial Sequence
  Description of Artificial Sequence: Synthetic oligonucleotide
ctcacccccaaaggaagatcagcatgacttatg

SEQ ID NO: 220576 - DNA, 34 bp, Artificial Sequence
  Description of Artificial Sequence: Synthetic oligonucleotide
tcacccccaaaggaagatcagcatgacttatgtg

SEQ ID NO: 220577 - DNA, 33 bp, Artificial Sequence
  Description of Artificial Sequence: Synthetic oligonucleotide
cacccccaaaggaagatcagcatgacttatgtg

SEQ ID NO: 220578 - DNA, 33 bp, Artificial Sequence
  Description of Artificial Sequence: Synthetic oligonucleotide
acccccaaaggaagatcagcatgacttatgtgc

SEQ ID NO: 220579 - DNA, 32 bp, Artificial Sequence
  Description of Artificial Sequence: Synthetic oligonucleotide
cccccaaaggaagatcagcatgacttatgtgc

SEQ ID NO: 220580 - DNA, 33 bp, Artificial Sequence
  Description of Artificial Sequence: Synthetic oligonucleotide
ccccaaaggaagatcagcatgacttatgtgcac

SEQ ID NO: 220581 - DNA, 34 bp, Artificial Sequence
  Description of Artificial Sequence: Synthetic oligonucleotide
cccaaaggaagatcagcatgacttatgtgcacag

SEQ ID NO: 220582 - DNA, 35 bp, Artificial Sequence
  Description of Artificial Sequence: Synthetic oligonucleotide
ccaaaggaagatcagcatgacttatgtgcacagtg

SEQ ID NO: 220583 - DNA, 35 bp, Artificial Sequence
  Description of Artificial Sequence: Synthetic oligonucleotide
caaaggaagatcagcatgacttatgtgcacagtgc

SEQ ID NO: 220584 - DNA, 35 bp, Artificial Sequence
  Description of Artificial Sequence: Synthetic oligonucleotide
aaaggaagatcagcatgacttatgtgcacagtgcg

SEQ ID NO: 220585 - DNA, 34 bp, Artificial Sequence
  Description of Artificial Sequence: Synthetic oligonucleotide
aaggaagatcagcatgacttatgtgcacagtgcg

SEQ ID NO: 220586 - DNA, 33 bp, Artificial Sequence
  Description of Artificial Sequence: Synthetic oligonucleotide
aggaagatcagcatgacttatgtgcacagtgcg

SEQ ID NO: 220587 - DNA, 32 bp, Artificial Sequence
  Description of Artificial Sequence: Synthetic oligonucleotide
ggaagatcagcatgacttatgtgcacagtgcg

SEQ ID NO: 220588 - DNA, 32 bp, Artificial Sequence
  Description of Artificial Sequence: Synthetic oligonucleotide
gaagatcagcatgacttatgtgcacagtgcgg

SEQ ID NO: 220589 - DNA, 33 bp, Artificial Sequence
  Description of Artificial Sequence: Synthetic oligonucleotide
aagatcagcatgacttatgtgcacagtgcggtg

SEQ ID NO: 220590 - DNA, 32 bp, Artificial Sequence
  Description of Artificial Sequence: Synthetic oligonucleotide
agatcagcatgacttatgtgcacagtgcggtg

SEQ ID NO: 220591 - DNA, 31 bp, Artificial Sequence
  Description of Artificial Sequence: Synthetic oligonucleotide
gatcagcatgacttatgtgcacagtgcggtg

SEQ ID NO: 220592 - DNA, 33 bp, Artificial Sequence
  Description of Artificial Sequence: Synthetic oligonucleotide
atcagcatgacttatgtgcacagtgcggtgttg

SEQ ID NO: 220593 - DNA, 32 bp, Artificial Sequence
  Description of Artificial Sequence: Synthetic oligonucleotide
tcagcatgacttatgtgcacagtgcggtgttg

SEQ ID NO: 220594 - DNA, 31 bp, Artificial Sequence
  Description of Artificial Sequence: Synthetic oligonucleotide
cagcatgacttatgtgcacagtgcggtgttg

SEQ ID NO: 220595 - DNA, 31 bp, Artificial Sequence
  Description of Artificial Sequence: Synthetic oligonucleotide
agcatgacttatgtgcacagtgcggtgttgg

SEQ ID NO: 220596 - DNA, 30 bp, Artificial Sequence
  Description of Artificial Sequence: Synthetic oligonucleotide
gcatgacttatgtgcacagtgcggtgttgg

SEQ ID NO: 220597 - DNA, 30 bp, Artificial Sequence
  Description of Artificial Sequence: Synthetic oligonucleotide
catgacttatgtgcacagtgcggtgttggc

SEQ ID NO: 220598 - DNA, 31 bp, Artificial Sequence
  Description of Artificial Sequence: Synthetic oligonucleotide
atgacttatgtgcacagtgcggtgttggcag

SEQ ID NO: 220599 - DNA, 30 bp, Artificial Sequence
  Description of Artificial Sequence: Synthetic oligonucleotide
tgacttatgtgcacagtgcggtgttggcag

SEQ ID NO: 220600 - DNA, 29 bp, Artificial Sequence
  Description of Artificial Sequence: Synthetic oligonucleotide
gacttatgtgcacagtgcggtgttggcag

SEQ ID NO: 220601 - DNA, 29 bp, Artificial Sequence
  Description of Artificial Sequence: Synthetic oligonucleotide
acttatgtgcacagtgcggtgttggcagg

SEQ ID NO: 220602 - DNA, 28 bp, Artificial Sequence
  Description of Artificial Sequence: Synthetic oligonucleotide
cttatgtgcacagtgcggtgttggcagg

SEQ ID NO: 220603 - DNA, 29 bp, Artificial Sequence
  Description of Artificial Sequence: Synthetic oligonucleotide
ttatgtgcacagtgcggtgttggcaggag

SEQ ID NO: 220604 - DNA, 28 bp, Artificial Sequence
  Description of Artificial Sequence: Synthetic oligonucleotide
tatgtgcacagtgcggtgttggcaggag

SEQ ID NO: 220605 - DNA, 27 bp, Artificial Sequence
  Description of Artificial Sequence: Synthetic oligonucleotide
atgtgcacagtgcggtgttggcaggag

SEQ ID NO: 220606 - DNA, 26 bp, Artificial Sequence
  Description of Artificial Sequence: Synthetic oligonucleotide
tgtgcacagtgcggtgttggcaggag

SEQ ID NO: 220607 - DNA, 25 bp, Artificial Sequence
  Description of Artificial Sequence: Synthetic oligonucleotide
gtgcacagtgcggtgttggcaggag

SEQ ID NO: 220608 - DNA, 25 bp, Artificial Sequence
  Description of Artificial Sequence: Synthetic oligonucleotide
tgcacagtgcggtgttggcaggagg

SEQ ID NO: 220609 - DNA, 24 bp, Artificial Sequence
  Description of Artificial Sequence: Synthetic oligonucleotide
gcacagtgcggtgttggcaggagg

SEQ ID NO: 220610 - DNA, 24 bp, Artificial Sequence
  Description of Artificial Sequence: Synthetic oligonucleotide
cacagtgcggtgttggcaggaggc

SEQ ID NO: 220611 - DNA, 25 bp, Artificial Sequence
  Description of Artificial Sequence: Synthetic oligonucleotide
acagtgcggtgttggcaggaggcgt

SEQ ID NO: 220612 - DNA, 24 bp, Artificial Sequence
  Description of Artificial Sequence: Synthetic oligonucleotide
cagtgcggtgttggcaggaggcgt

SEQ ID NO: 220613 - DNA, 24 bp, Artificial Sequence
  Description of Artificial Sequence: Synthetic oligonucleotide
agtgcggtgttggcaggaggcgtg

SEQ ID NO: 220614 - DNA, 23 bp, Artificial Sequence
  Description of Artificial Sequence: Synthetic oligonucleotide
gtgcggtgttggcaggaggcgtg

SEQ ID NO: 220615 - DNA, 23 bp, Artificial Sequence
  Description of Artificial Sequence: Synthetic oligonucleotide
tgcggtgttggcaggaggcgtgg

SEQ ID NO: 220616 - DNA, 22 bp, Artificial Sequence
  Description of Artificial Sequence: Synthetic oligonucleotide
gcggtgttggcaggaggcgtgg

SEQ ID NO: 220617 - DNA, 23 bp, Artificial Sequence
  Description of Artificial Sequence: Synthetic oligonucleotide
cggtgttggcaggaggcgtggct

SEQ ID NO: 220618 - DNA, 24 bp, Artificial Sequence
  Description of Artificial Sequence: Synthetic oligonucleotide
ggtgttggcaggaggcgtggctgt

SEQ ID NO: 220619 - DNA, 24 bp, Artificial Sequence
  Description of Artificial Sequence: Synthetic oligonucleotide
gtgttggcaggaggcgtggctgtg

SEQ ID NO: 220620 - DNA, 24 bp, Artificial Sequence
  Description of Artificial Sequence: Synthetic oligonucleotide
tgttggcaggaggcgtggctgtgg

SEQ ID NO: 220621 - DNA, 23 bp, Artificial Sequence
  Description of Artificial Sequence: Synthetic oligonucleotide
gttggcaggaggcgtggctgtgg

SEQ ID NO: 220622 - DNA, 25 bp, Artificial Sequence
  Description of Artificial Sequence: Synthetic oligonucleotide
ttggcaggaggcgtggctgtgggta

SEQ ID NO: 220623 - DNA, 24 bp, Artificial Sequence
  Description of Artificial Sequence: Synthetic oligonucleotide
tggcaggaggcgtggctgtgggta

SEQ ID NO: 220624 - DNA, 23 bp, Artificial Sequence
  Description of Artificial Sequence: Synthetic oligonucleotide
ggcaggaggcgtggctgtgggta

SEQ ID NO: 220625 - DNA, 23 bp, Artificial Sequence
  Description of Artificial Sequence: Synthetic oligonucleotide
gcaggaggcgtggctgtgggtac

SEQ ID NO: 220626 - DNA, 24 bp, Artificial Sequence
  Description of Artificial Sequence: Synthetic oligonucleotide
caggaggcgtggctgtgggtacct

SEQ ID NO: 220627 - DNA, 24 bp, Artificial Sequence
  Description of Artificial Sequence: Synthetic oligonucleotide
aggaggcgtggctgtgggtacctc

SEQ ID NO: 220628 - DNA, 23 bp, Artificial Sequence
  Description of Artificial Sequence: Synthetic oligonucleotide
ggaggcgtggctgtgggtacctc

SEQ ID NO: 220629 - DNA, 24 bp, Artificial Sequence
  Description of Artificial Sequence: Synthetic oligonucleotide
gaggcgtggctgtgggtacctcgt

SEQ ID NO: 220630 - DNA, 25 bp, Artificial Sequence
  Description of Artificial Sequence: Synthetic oligonucleotide
aggcgtggctgtgggtacctcgtgt

SEQ ID NO: 220631 - DNA, 24 bp, Artificial Sequence
  Description of Artificial Sequence: Synthetic oligonucleotide
ggcgtggctgtgggtacctcgtgt

SEQ ID NO: 220632 - DNA, 25 bp, Artificial Sequence
  Description of Artificial Sequence: Synthetic oligonucleotide
gcgtggctgtgggtacctcgtgtca

SEQ ID NO: 220633 - DNA, 25 bp, Artificial Sequence
  Description of Artificial Sequence: Synthetic oligonucleotide
cgtggctgtgggtacctcgtgtcac

SEQ ID NO: 220634 - DNA, 26 bp, Artificial Sequence
  Description of Artificial Sequence: Synthetic oligonucleotide
gtggctgtgggtacctcgtgtcacct

SEQ ID NO: 220635 - DNA, 27 bp, Artificial Sequence
  Description of Artificial Sequence: Synthetic oligonucleotide
tggctgtgggtacctcgtgtcacctga

SEQ ID NO: 220636 - DNA, 27 bp, Artificial Sequence
  Description of Artificial Sequence: Synthetic oligonucleotide
ggctgtgggtacctcgtgtcacctgat

SEQ ID NO: 220637 - DNA, 27 bp, Artificial Sequence
  Description of Artificial Sequence: Synthetic oligonucleotide
gctgtgggtacctcgtgtcacctgatc

SEQ ID NO: 220638 - DNA, 27 bp, Artificial Sequence
  Description of Artificial Sequence: Synthetic oligonucleotide
ctgtgggtacctcgtgtcacctgatcc

SEQ ID NO: 220639 - DNA, 27 bp, Artificial Sequence
  Description of Artificial Sequence: Synthetic oligonucleotide
tgtgggtacctcgtgtcacctgatccc

SEQ ID NO: 220640 - DNA, 27 bp, Artificial Sequence
  Description of Artificial Sequence: Synthetic oligonucleotide
gtgggtacctcgtgtcacctgatccct

SEQ ID NO: 220641 - DNA, 28 bp, Artificial Sequence
  Description of Artificial Sequence: Synthetic oligonucleotide
tgggtacctcgtgtcacctgatcccttc

SEQ ID NO: 220642 - DNA, 27 bp, Artificial Sequence
  Description of Artificial Sequence: Synthetic oligonucleotide
gggtacctcgtgtcacctgatcccttc

SEQ ID NO: 220643 - DNA, 28 bp, Artificial Sequence
  Description of Artificial Sequence: Synthetic oligonucleotide
ggtacctcgtgtcacctgatcccttctc

SEQ ID NO: 220644 - DNA, 28 bp, Artificial Sequence
  Description of Artificial Sequence: Synthetic oligonucleotide
gtacctcgtgtcacctgatcccttctcc

SEQ ID NO: 220645 - DNA, 28 bp, Artificial Sequence
  Description of Artificial Sequence: Synthetic oligonucleotide
tacctcgtgtcacctgatcccttctccg

SEQ ID NO: 220646 - DNA, 27 bp, Artificial Sequence
  Description of Artificial Sequence: Synthetic oligonucleotide
acctcgtgtcacctgatcccttctccg

SEQ ID NO: 220647 - DNA, 27 bp, Artificial Sequence
  Description of Artificial Sequence: Synthetic oligonucleotide
cctcgtgtcacctgatcccttctccgt

SEQ ID NO: 220648 - DNA, 27 bp, Artificial Sequence
  Description of Artificial Sequence: Synthetic oligonucleotide
ctcgtgtcacctgatcccttctccgtg

SEQ ID NO: 220649 - DNA, 27 bp, Artificial Sequence
  Description of Artificial Sequence: Synthetic oligonucleotide
tcgtgtcacctgatcccttctccgtgg

SEQ ID NO: 220650 - DNA, 26 bp, Artificial Sequence
  Description of Artificial Sequence: Synthetic oligonucleotide
cgtgtcacctgatcccttctccgtgg

SEQ ID NO: 220651 - DNA, 27 bp, Artificial Sequence
  Description of Artificial Sequence: Synthetic oligonucleotide
gtgtcacctgatcccttctccgtggct

SEQ ID NO: 220652 - DNA, 28 bp, Artificial Sequence
  Description of Artificial Sequence: Synthetic oligonucleotide
tgtcacctgatcccttctccgtggcttg

SEQ ID NO: 220653 - DNA, 27 bp, Artificial Sequence
  Description of Artificial Sequence: Synthetic oligonucleotide
gtcacctgatcccttctccgtggcttg

SEQ ID NO: 220654 - DNA, 27 bp, Artificial Sequence
  Description of Artificial Sequence: Synthetic oligonucleotide
tcacctgatcccttctccgtggcttgc

SEQ ID NO: 220655 - DNA, 26 bp, Artificial Sequence
  Description of Artificial Sequence: Synthetic oligonucleotide
cacctgatcccttctccgtggcttgc

SEQ ID NO: 220656 - DNA, 27 bp, Artificial Sequence
  Description of Artificial Sequence: Synthetic oligonucleotide
acctgatcccttctccgtggcttgcca

SEQ ID NO: 220657 - DNA, 27 bp, Artificial Sequence
  Description of Artificial Sequence: Synthetic oligonucleotide
cctgatcccttctccgtggcttgccat

SEQ ID NO: 220658 - DNA, 27 bp, Artificial Sequence
  Description of Artificial Sequence: Synthetic oligonucleotide
ctgatcccttctccgtggcttgccatg

SEQ ID NO: 220659 - DNA, 27 bp, Artificial Sequence
  Description of Artificial Sequence: Synthetic oligonucleotide
tgatcccttctccgtggcttgccatgg

SEQ ID NO: 220660 - DNA, 27 bp, Artificial Sequence
  Description of Artificial Sequence: Synthetic oligonucleotide
gatcccttctccgtggcttgccatggt

SEQ ID NO: 220661 - DNA, 27 bp, Artificial Sequence
  Description of Artificial Sequence: Synthetic oligonucleotide
atcccttctccgtggcttgccatggtg

SEQ ID NO: 220662 - DNA, 26 bp, Artificial Sequence
  Description of Artificial Sequence: Synthetic oligonucleotide
tcccttctccgtggcttgccatggtg

SEQ ID NO: 220663 - DNA, 25 bp, Artificial Sequence
  Description of Artificial Sequence: Synthetic oligonucleotide
cccttctccgtggcttgccatggtg

SEQ ID NO: 220664 - DNA, 26 bp, Artificial Sequence
  Description of Artificial Sequence: Synthetic oligonucleotide
ccttctccgtggcttgccatggtgct

SEQ ID NO: 220665 - DNA, 26 bp, Artificial Sequence
  Description of Artificial Sequence: Synthetic oligonucleotide
cttctccgtggcttgccatggtgctg

SEQ ID NO: 220666 - DNA, 26 bp, Artificial Sequence
  Description of Artificial Sequence: Synthetic oligonucleotide
ttctccgtggcttgccatggtgctgg

SEQ ID NO: 220667 - DNA, 25 bp, Artificial Sequence
  Description of Artificial Sequence: Synthetic oligonucleotide
tctccgtggcttgccatggtgctgg

SEQ ID NO: 220668 - DNA, 24 bp, Artificial Sequence
  Description of Artificial Sequence: Synthetic oligonucleotide
ctccgtggcttgccatggtgctgg

SEQ ID NO: 220669 - DNA, 25 bp, Artificial Sequence
  Description of Artificial Sequence: Synthetic oligonucleotide
tccgtggcttgccatggtgctgggt

SEQ ID NO: 220670 - DNA, 24 bp, Artificial Sequence
  Description of Artificial Sequence: Synthetic oligonucleotide
ccgtggcttgccatggtgctgggt

SEQ ID NO: 220671 - DNA, 26 bp, Artificial Sequence
  Description of Artificial Sequence: Synthetic oligonucleotide
cgtggcttgccatggtgctgggtctt

SEQ ID NO: 220672 - DNA, 27 bp, Artificial Sequence
  Description of Artificial Sequence: Synthetic oligonucleotide
gtggcttgccatggtgctgggtcttgt

SEQ ID NO: 220673 - DNA, 27 bp, Artificial Sequence
  Description of Artificial Sequence: Synthetic oligonucleotide
tggcttgccatggtgctgggtcttgtg

SEQ ID NO: 220674 - DNA, 26 bp, Artificial Sequence
  Description of Artificial Sequence: Synthetic oligonucleotide
ggcttgccatggtgctgggtcttgtg

SEQ ID NO: 220675 - DNA, 26 bp, Artificial Sequence
  Description of Artificial Sequence: Synthetic oligonucleotide
gcttgccatggtgctgggtcttgtgg

SEQ ID NO: 220676 - DNA, 27 bp, Artificial Sequence
  Description of Artificial Sequence: Synthetic oligonucleotide
cttgccatggtgctgggtcttgtggct

SEQ ID NO: 220677 - DNA, 27 bp, Artificial Sequence
  Description of Artificial Sequence: Synthetic oligonucleotide
ttgccatggtgctgggtcttgtggctg

SEQ ID NO: 220678 - DNA, 26 bp, Artificial Sequence
  Description of Artificial Sequence: Synthetic oligonucleotide
tgccatggtgctgggtcttgtggctg

SEQ ID NO: 220679 - DNA, 25 bp, Artificial Sequence
  Description of Artificial Sequence: Synthetic oligonucleotide
gccatggtgctgggtcttgtggctg

SEQ ID NO: 220680 - DNA, 25 bp, Artificial Sequence
  Description of Artificial Sequence: Synthetic oligonucleotide
ccatggtgctgggtcttgtggctgg

SEQ ID NO: 220681 - DNA, 25 bp, Artificial Sequence
  Description of Artificial Sequence: Synthetic oligonucleotide
catggtgctgggtcttgtggctggg

SEQ ID NO: 220682 - DNA, 26 bp, Artificial Sequence
  Description of Artificial Sequence: Synthetic oligonucleotide
atggtgctgggtcttgtggctgggct

SEQ ID NO: 220683 - DNA, 25 bp, Artificial Sequence
  Description of Artificial Sequence: Synthetic oligonucleotide
tggtgctgggtcttgtggctgggct

SEQ ID NO: 220684 - DNA, 24 bp, Artificial Sequence
  Description of Artificial Sequence: Synthetic oligonucleotide
ggtgctgggtcttgtggctgggct

SEQ ID NO: 220685 - DNA, 26 bp, Artificial Sequence
  Description of Artificial Sequence: Synthetic oligonucleotide
gtgctgggtcttgtggctgggctgat

SEQ ID NO: 220686 - DNA, 27 bp, Artificial Sequence
  Description of Artificial Sequence: Synthetic oligonucleotide
tgctgggtcttgtggctgggctgatct

SEQ ID NO: 220687 - DNA, 26 bp, Artificial Sequence
  Description of Artificial Sequence: Synthetic oligonucleotide
gctgggtcttgtggctgggctgatct

SEQ ID NO: 220688 - DNA, 26 bp, Artificial Sequence
  Description of Artificial Sequence: Synthetic oligonucleotide
ctgggtcttgtggctgggctgatctc

SEQ ID NO: 220689 - DNA, 27 bp, Artificial Sequence
  Description of Artificial Sequence: Synthetic oligonucleotide
tgggtcttgtggctgggctgatctcca

SEQ ID NO: 220690 - DNA, 27 bp, Artificial Sequence
  Description of Artificial Sequence: Synthetic oligonucleotide
gggtcttgtggctgggctgatctccat

SEQ ID NO: 220691 - DNA, 27 bp, Artificial Sequence
  Description of Artificial Sequence: Synthetic oligonucleotide
ggtcttgtggctgggctgatctccatc

SEQ ID NO: 220692 - DNA, 27 bp, Artificial Sequence
  Description of Artificial Sequence: Synthetic oligonucleotide
gtcttgtggctgggctgatctccatcg

SEQ ID NO: 220693 - DNA, 27 bp, Artificial Sequence
  Description of Artificial Sequence: Synthetic oligonucleotide
tcttgtggctgggctgatctccatcgg

SEQ ID NO: 220694 - DNA, 26 bp, Artificial Sequence
  Description of Artificial Sequence: Synthetic oligonucleotide
cttgtggctgggctgatctccatcgg

SEQ ID NO: 220695 - DNA, 26 bp, Artificial Sequence
  Description of Artificial Sequence: Synthetic oligonucleotide
ttgtggctgggctgatctccatcggg

SEQ ID NO: 220696 - DNA, 25 bp, Artificial Sequence
  Description of Artificial Sequence: Synthetic oligonucleotide
tgtggctgggctgatctccatcggg

SEQ ID NO: 220697 - DNA, 24 bp, Artificial Sequence
  Description of Artificial Sequence: Synthetic oligonucleotide
gtggctgggctgatctccatcggg

SEQ ID NO: 220698 - DNA, 24 bp, Artificial Sequence
  Description of Artificial Sequence: Synthetic oligonucleotide
tggctgggctgatctccatcgggg

SEQ ID NO: 220699 - DNA, 23 bp, Artificial Sequence
  Description of Artificial Sequence: Synthetic oligonucleotide
ggctgggctgatctccatcgggg

SEQ ID NO: 220700 - DNA, 24 bp, Artificial Sequence
  Description of Artificial Sequence: Synthetic oligonucleotide
gctgggctgatctccatcggggga

SEQ ID NO: 220701 - DNA, 24 bp, Artificial Sequence
  Description of Artificial Sequence: Synthetic oligonucleotide
ctgggctgatctccatcgggggag

SEQ ID NO: 220702 - DNA, 24 bp, Artificial Sequence
  Description of Artificial Sequence: Synthetic oligonucleotide
tgggctgatctccatcgggggagc

SEQ ID NO: 220703 - DNA, 23 bp, Artificial Sequence
  Description of Artificial Sequence: Synthetic oligonucleotide
gggctgatctccatcgggggagc

SEQ ID NO: 220704 - DNA, 25 bp, Artificial Sequence
  Description of Artificial Sequence: Synthetic oligonucleotide
ggctgatctccatcgggggagccaa

SEQ ID NO: 220705 - DNA, 26 bp, Artificial Sequence
  Description of Artificial Sequence: Synthetic oligonucleotide
gctgatctccatcgggggagccaagt

SEQ ID NO: 220706 - DNA, 26 bp, Artificial Sequence
  Description of Artificial Sequence: Synthetic oligonucleotide
ctgatctccatcgggggagccaagtg

SEQ ID NO: 220707 - DNA, 26 bp, Artificial Sequence
  Description of Artificial Sequence: Synthetic oligonucleotide
tgatctccatcgggggagccaagtgc

SEQ ID NO: 220708 - DNA, 25 bp, Artificial Sequence
  Description of Artificial Sequence: Synthetic oligonucleotide
gatctccatcgggggagccaagtgc

SEQ ID NO: 220709 - DNA, 26 bp, Artificial Sequence
  Description of Artificial Sequence: Synthetic oligonucleotide
atctccatcgggggagccaagtgcct

SEQ ID NO: 220710 - DNA, 25 bp, Artificial Sequence
  Description of Artificial Sequence: Synthetic oligonucleotide
tctccatcgggggagccaagtgcct

SEQ ID NO: 220711 - DNA, 24 bp, Artificial Sequence
  Description of Artificial Sequence: Synthetic oligonucleotide
ctccatcgggggagccaagtgcct

SEQ ID NO: 220712 - DNA, 24 bp, Artificial Sequence
  Description of Artificial Sequence: Synthetic oligonucleotide
tccatcgggggagccaagtgcctg

SEQ ID NO: 220713 - DNA, 23 bp, Artificial Sequence
  Description of Artificial Sequence: Synthetic oligonucleotide
ccatcgggggagccaagtgcctg

SEQ ID NO: 220714 - DNA, 23 bp, Artificial Sequence
  Description of Artificial Sequence: Synthetic oligonucleotide
catcgggggagccaagtgcctgc

SEQ ID NO: 220715 - DNA, 23 bp, Artificial Sequence
  Description of Artificial Sequence: Synthetic oligonucleotide
atcgggggagccaagtgcctgcc

SEQ ID NO: 220716 - DNA, 22 bp, Artificial Sequence
  Description of Artificial Sequence: Synthetic oligonucleotide
tcgggggagccaagtgcctgcc

SEQ ID NO: 220717 - DNA, 21 bp, Artificial Sequence
  Description of Artificial Sequence: Synthetic oligonucleotide
cgggggagccaagtgcctgcc

SEQ ID NO: 220718 - DNA, 21 bp, Artificial Sequence
  Description of Artificial Sequence: Synthetic oligonucleotide
gggggagccaagtgcctgccg

SEQ ID NO: 220719 - DNA, 22 bp, Artificial Sequence
  Description of Artificial Sequence: Synthetic oligonucleotide
ggggagccaagtgcctgccggt

SEQ ID NO: 220720 - DNA, 23 bp, Artificial Sequence
  Description of Artificial Sequence: Synthetic oligonucleotide
gggagccaagtgcctgccggtgt

SEQ ID NO: 220721 - DNA, 25 bp, Artificial Sequence
  Description of Artificial Sequence: Synthetic oligonucleotide
ggagccaagtgcctgccggtgtgtt

SEQ ID NO: 220722 - DNA, 27 bp, Artificial Sequence
  Description of Artificial Sequence: Synthetic oligonucleotide
gagccaagtgcctgccggtgtgttgta

SEQ ID NO: 220723 - DNA, 28 bp, Artificial Sequence
  Description of Artificial Sequence: Synthetic oligonucleotide
agccaagtgcctgccggtgtgttgtaac

SEQ ID NO: 220724 - DNA, 27 bp, Artificial Sequence
  Description of Artificial Sequence: Synthetic oligonucleotide
gccaagtgcctgccggtgtgttgtaac

SEQ ID NO: 220725 - DNA, 27 bp, Artificial Sequence
  Description of Artificial Sequence: Synthetic oligonucleotide
ccaagtgcctgccggtgtgttgtaacc

SEQ ID NO: 220726 - DNA, 27 bp, Artificial Sequence
  Description of Artificial Sequence: Synthetic oligonucleotide
caagtgcctgccggtgtgttgtaaccg

SEQ ID NO: 220727 - DNA, 28 bp, Artificial Sequence
  Description of Artificial Sequence: Synthetic oligonucleotide
aagtgcctgccggtgtgttgtaaccgag

SEQ ID NO: 220728 - DNA, 27 bp, Artificial Sequence
  Description of Artificial Sequence: Synthetic oligonucleotide
agtgcctgccggtgtgttgtaaccgag

SEQ ID NO: 220729 - DNA, 27 bp, Artificial Sequence
  Description of Artificial Sequence: Synthetic oligonucleotide
gtgcctgccggtgtgttgtaaccgagt

SEQ ID NO: 220730 - DNA, 27 bp, Artificial Sequence
  Description of Artificial Sequence: Synthetic oligonucleotide
tgcctgccggtgtgttgtaaccgagtg

SEQ ID NO: 220731 - DNA, 26 bp, Artificial Sequence
  Description of Artificial Sequence: Synthetic oligonucleotide
gcctgccggtgtgttgtaaccgagtg

SEQ ID NO: 220732 - DNA, 27 bp, Artificial Sequence
  Description of Artificial Sequence: Synthetic oligonucleotide
cctgccggtgtgttgtaaccgagtgct

SEQ ID NO: 220733 - DNA, 27 bp, Artificial Sequence
  Description of Artificial Sequence: Synthetic oligonucleotide
ctgccggtgtgttgtaaccgagtgctg

SEQ ID NO: 220734 - DNA, 27 bp, Artificial Sequence
  Description of Artificial Sequence: Synthetic oligonucleotide
tgccggtgtgttgtaaccgagtgctgg

SEQ ID NO: 220735 - DNA, 26 bp, Artificial Sequence
  Description of Artificial Sequence: Synthetic oligonucleotide
gccggtgtgttgtaaccgagtgctgg

SEQ ID NO: 220736 - DNA, 26 bp, Artificial Sequence
  Description of Artificial Sequence: Synthetic oligonucleotide
ccggtgtgttgtaaccgagtgctggg

SEQ ID NO: 220737 - DNA, 27 bp, Artificial Sequence
  Description of Artificial Sequence: Synthetic oligonucleotide
cggtgtgttgtaaccgagtgctgggga

SEQ ID NO: 220738 - DNA, 29 bp, Artificial Sequence
  Description of Artificial Sequence: Synthetic oligonucleotide
ggtgtgttgtaaccgagtgctggggattc

SEQ ID NO: 220739 - DNA, 30 bp, Artificial Sequence
  Description of Artificial Sequence: Synthetic oligonucleotide
gtgtgttgtaaccgagtgctggggattcac

SEQ ID NO: 220740 - DNA, 30 bp, Artificial Sequence
  Description of Artificial Sequence: Synthetic oligonucleotide
tgtgttgtaaccgagtgctggggattcacc

SEQ ID NO: 220741 - DNA, 29 bp, Artificial Sequence
  Description of Artificial Sequence: Synthetic oligonucleotide
gtgttgtaaccgagtgctggggattcacc

SEQ ID NO: 220742 - DNA, 30 bp, Artificial Sequence
  Description of Artificial Sequence: Synthetic oligonucleotide
tgttgtaaccgagtgctggggattcaccac

SEQ ID NO: 220743 - DNA, 29 bp, Artificial Sequence
  Description of Artificial Sequence: Synthetic oligonucleotide
gttgtaaccgagtgctggggattcaccac

SEQ ID NO: 220744 - DNA, 31 bp, Artificial Sequence
  Description of Artificial Sequence: Synthetic oligonucleotide
ttgtaaccgagtgctggggattcaccacatc

SEQ ID NO: 220745 - DNA, 30 bp, Artificial Sequence
  Description of Artificial Sequence: Synthetic oligonucleotide
tgtaaccgagtgctggggattcaccacatc

SEQ ID NO: 220746 - DNA, 29 bp, Artificial Sequence
  Description of Artificial Sequence: Synthetic oligonucleotide
gtaaccgagtgctggggattcaccacatc

SEQ ID NO: 220747 - DNA, 30 bp, Artificial Sequence
  Description of Artificial Sequence: Synthetic oligonucleotide
taaccgagtgctggggattcaccacatctc

SEQ ID NO: 220748 - DNA, 29 bp, Artificial Sequence
  Description of Artificial Sequence: Synthetic oligonucleotide
aaccgagtgctggggattcaccacatctc

SEQ ID NO: 220749 - DNA, 28 bp, Artificial Sequence
  Description of Artificial Sequence: Synthetic oligonucleotide
accgagtgctggggattcaccacatctc

SEQ ID NO: 220750 - DNA, 27 bp, Artificial Sequence
  Description of Artificial Sequence: Synthetic oligonucleotide
ccgagtgctggggattcaccacatctc

SEQ ID NO: 220751 - DNA, 27 bp, Artificial Sequence
  Description of Artificial Sequence: Synthetic oligonucleotide
cgagtgctggggattcaccacatctcc

SEQ ID NO: 220752 - DNA, 27 bp, Artificial Sequence
  Description of Artificial Sequence: Synthetic oligonucleotide
gagtgctggggattcaccacatctccg

SEQ ID NO: 220753 - DNA, 28 bp, Artificial Sequence
  Description of Artificial Sequence: Synthetic oligonucleotide
agtgctggggattcaccacatctccgtc

SEQ ID NO: 220754 - DNA, 27 bp, Artificial Sequence
  Description of Artificial Sequence: Synthetic oligonucleotide
gtgctggggattcaccacatctccgtc

SEQ ID NO: 220755 - DNA, 29 bp, Artificial Sequence
  Description of Artificial Sequence: Synthetic oligonucleotide
tgctggggattcaccacatctccgtcatg

SEQ ID NO: 220756 - DNA, 28 bp, Artificial Sequence
  Description of Artificial Sequence: Synthetic oligonucleotide
gctggggattcaccacatctccgtcatg

SEQ ID NO: 220757 - DNA, 28 bp, Artificial Sequence
  Description of Artificial Sequence: Synthetic oligonucleotide
ctggggattcaccacatctccgtcatgc

SEQ ID NO: 220758 - DNA, 29 bp, Artificial Sequence
  Description of Artificial Sequence: Synthetic oligonucleotide
tggggattcaccacatctccgtcatgcac

SEQ ID NO: 220759 - DNA, 28 bp, Artificial Sequence
  Description of Artificial Sequence: Synthetic oligonucleotide
ggggattcaccacatctccgtcatgcac

SEQ ID NO: 220760 - DNA, 29 bp, Artificial Sequence
  Description of Artificial Sequence: Synthetic oligonucleotide
gggattcaccacatctccgtcatgcactc

SEQ ID NO: 220761 - DNA, 29 bp, Artificial Sequence
  Description of Artificial Sequence: Synthetic oligonucleotide
ggattcaccacatctccgtcatgcactcc

SEQ ID NO: 220762 - DNA, 31 bp, Artificial Sequence
  Description of Artificial Sequence: Synthetic oligonucleotide
gattcaccacatctccgtcatgcactccatc

SEQ ID NO: 220763 - DNA, 33 bp, Artificial Sequence
  Description of Artificial Sequence: Synthetic oligonucleotide
attcaccacatctccgtcatgcactccatcttc

SEQ ID NO: 220764 - DNA, 32 bp, Artificial Sequence
  Description of Artificial Sequence: Synthetic oligonucleotide
ttcaccacatctccgtcatgcactccatcttc

SEQ ID NO: 220765 - DNA, 31 bp, Artificial Sequence
  Description of Artificial Sequence: Synthetic oligonucleotide
tcaccacatctccgtcatgcactccatcttc

SEQ ID NO: 220766 - DNA, 30 bp, Artificial Sequence
  Description of Artificial Sequence: Synthetic oligonucleotide
caccacatctccgtcatgcactccatcttc

SEQ ID NO: 220767 - DNA, 31 bp, Artificial Sequence
  Description of Artificial Sequence: Synthetic oligonucleotide
accacatctccgtcatgcactccatcttcag

SEQ ID NO: 220768 - DNA, 30 bp, Artificial Sequence
  Description of Artificial Sequence: Synthetic oligonucleotide
ccacatctccgtcatgcactccatcttcag

SEQ ID NO: 220769 - DNA, 30 bp, Artificial Sequence
  Description of Artificial Sequence: Synthetic oligonucleotide
cacatctccgtcatgcactccatcttcagc

SEQ ID NO: 220770 - DNA, 32 bp, Artificial Sequence
  Description of Artificial Sequence: Synthetic oligonucleotide
acatctccgtcatgcactccatcttcagcttg

SEQ ID NO: 220771 - DNA, 31 bp, Artificial Sequence
  Description of Artificial Sequence: Synthetic oligonucleotide
catctccgtcatgcactccatcttcagcttg

SEQ ID NO: 220772 - DNA, 31 bp, Artificial Sequence
  Description of Artificial Sequence: Synthetic oligonucleotide
atctccgtcatgcactccatcttcagcttgc

SEQ ID NO: 220773 - DNA, 30 bp, Artificial Sequence
  Description of Artificial Sequence: Synthetic oligonucleotide
tctccgtcatgcactccatcttcagcttgc

SEQ ID NO: 220774 - DNA, 29 bp, Artificial Sequence
  Description of Artificial Sequence: Synthetic oligonucleotide
ctccgtcatgcactccatcttcagcttgc

SEQ ID NO: 220775 - DNA, 30 bp, Artificial Sequence
  Description of Artificial Sequence: Synthetic oligonucleotide
tccgtcatgcactccatcttcagcttgctg

SEQ ID NO: 220776 - DNA, 29 bp, Artificial Sequence
  Description of Artificial Sequence: Synthetic oligonucleotide
ccgtcatgcactccatcttcagcttgctg

SEQ ID NO: 220777 - DNA, 29 bp, Artificial Sequence
  Description of Artificial Sequence: Synthetic oligonucleotide
cgtcatgcactccatcttcagcttgctgg

SEQ ID NO: 220778 - DNA, 29 bp, Artificial Sequence
  Description of Artificial Sequence: Synthetic oligonucleotide
gtcatgcactccatcttcagcttgctggg

SEQ ID NO: 220779 - DNA, 30 bp, Artificial Sequence
  Description of Artificial Sequence: Synthetic oligonucleotide
tcatgcactccatcttcagcttgctgggtc

SEQ ID NO: 220780 - DNA, 29 bp, Artificial Sequence
  Description of Artificial Sequence: Synthetic oligonucleotide
catgcactccatcttcagcttgctgggtc

SEQ ID NO: 220781 - DNA, 30 bp, Artificial Sequence
  Description of Artificial Sequence: Synthetic oligonucleotide
atgcactccatcttcagcttgctgggtctg

SEQ ID NO: 220782 - DNA, 29 bp, Artificial Sequence
  Description of Artificial Sequence: Synthetic oligonucleotide
tgcactccatcttcagcttgctgggtctg

SEQ ID NO: 220783 - DNA, 28 bp, Artificial Sequence
  Description of Artificial Sequence: Synthetic oligonucleotide
gcactccatcttcagcttgctgggtctg

SEQ ID NO: 220784 - DNA, 28 bp, Artificial Sequence
  Description of Artificial Sequence: Synthetic oligonucleotide
cactccatcttcagcttgctgggtctgc

SEQ ID NO: 220785 - DNA, 30 bp, Artificial Sequence
  Description of Artificial Sequence: Synthetic oligonucleotide
actccatcttcagcttgctgggtctgcttg

SEQ ID NO: 220786 - DNA, 29 bp, Artificial Sequence
  Description of Artificial Sequence: Synthetic oligonucleotide
ctccatcttcagcttgctgggtctgcttg

SEQ ID NO: 220787 - DNA, 29 bp, Artificial Sequence
  Description of Artificial Sequence: Synthetic oligonucleotide
tccatcttcagcttgctgggtctgcttgg

SEQ ID NO: 220788 - DNA, 28 bp, Artificial Sequence
  Description of Artificial Sequence: Synthetic oligonucleotide
ccatcttcagcttgctgggtctgcttgg

SEQ ID NO: 220789 - DNA, 29 bp, Artificial Sequence
  Description of Artificial Sequence: Synthetic oligonucleotide
catcttcagcttgctgggtctgcttggag

SEQ ID NO: 220790 - DNA, 30 bp, Artificial Sequence
  Description of Artificial Sequence: Synthetic oligonucleotide
atcttcagcttgctgggtctgcttggagag

SEQ ID NO: 220791 - DNA, 29 bp, Artificial Sequence
  Description of Artificial Sequence: Synthetic oligonucleotide
tcttcagcttgctgggtctgcttggagag

SEQ ID NO: 220792 - DNA, 28 bp, Artificial Sequence
  Description of Artificial Sequence: Synthetic oligonucleotide
cttcagcttgctgggtctgcttggagag

SEQ ID NO: 220793 - DNA, 30 bp, Artificial Sequence
  Description of Artificial Sequence: Synthetic oligonucleotide
ttcagcttgctgggtctgcttggagagatc

SEQ ID NO: 220794 - DNA, 29 bp, Artificial Sequence
  Description of Artificial Sequence: Synthetic oligonucleotide
tcagcttgctgggtctgcttggagagatc

SEQ ID NO: 220795 - DNA, 28 bp, Artificial Sequence
  Description of Artificial Sequence: Synthetic oligonucleotide
cagcttgctgggtctgcttggagagatc

SEQ ID NO: 220796 - DNA, 29 bp, Artificial Sequence
  Description of Artificial Sequence: Synthetic oligonucleotide
agcttgctgggtctgcttggagagatcac

SEQ ID NO: 220797 - DNA, 28 bp, Artificial Sequence
  Description of Artificial Sequence: Synthetic oligonucleotide
gcttgctgggtctgcttggagagatcac

SEQ ID NO: 220798 - DNA, 28 bp, Artificial Sequence
  Description of Artificial Sequence: Synthetic oligonucleotide
cttgctgggtctgcttggagagatcacc

SEQ ID NO: 220799 - DNA, 30 bp, Artificial Sequence
  Description of Artificial Sequence: Synthetic oligonucleotide
ttgctgggtctgcttggagagatcacctac

SEQ ID NO: 220800 - DNA, 29 bp, Artificial Sequence
  Description of Artificial Sequence: Synthetic oligonucleotide
tgctgggtctgcttggagagatcacctac

SEQ ID NO: 220801 - DNA, 28 bp, Artificial Sequence
  Description of Artificial Sequence: Synthetic oligonucleotide
gctgggtctgcttggagagatcacctac

SEQ ID NO: 220802 - DNA, 31 bp, Artificial Sequence
  Description of Artificial Sequence: Synthetic oligonucleotide
ctgggtctgcttggagagatcacctacattg

SEQ ID NO: 220803 - DNA, 32 bp, Artificial Sequence
  Description of Artificial Sequence: Synthetic oligonucleotide
tgggtctgcttggagagatcacctacattgtg

SEQ ID NO: 220804 - DNA, 31 bp, Artificial Sequence
  Description of Artificial Sequence: Synthetic oligonucleotide
gggtctgcttggagagatcacctacattgtg

SEQ ID NO: 220805 - DNA, 31 bp, Artificial Sequence
  Description of Artificial Sequence: Synthetic oligonucleotide
ggtctgcttggagagatcacctacattgtgc

SEQ ID NO: 220806 - DNA, 32 bp, Artificial Sequence
  Description of Artificial Sequence: Synthetic oligonucleotide
gtctgcttggagagatcacctacattgtgctg

SEQ ID NO: 220807 - DNA, 32 bp, Artificial Sequence
  Description of Artificial Sequence: Synthetic oligonucleotide
tctgcttggagagatcacctacattgtgctgc

SEQ ID NO: 220808 - DNA, 31 bp, Artificial Sequence
  Description of Artificial Sequence: Synthetic oligonucleotide
ctgcttggagagatcacctacattgtgctgc

SEQ ID NO: 220809 - DNA, 32 bp, Artificial Sequence
  Description of Artificial Sequence: Synthetic oligonucleotide
tgcttggagagatcacctacattgtgctgctg

SEQ ID NO: 220810 - DNA, 31 bp, Artificial Sequence
  Description of Artificial Sequence: Synthetic oligonucleotide
gcttggagagatcacctacattgtgctgctg

SEQ ID NO: 220811 - DNA, 31 bp, Artificial Sequence
  Description of Artificial Sequence: Synthetic oligonucleotide
cttggagagatcacctacattgtgctgctgg

SEQ ID NO: 220812 - DNA, 32 bp, Artificial Sequence
  Description of Artificial Sequence: Synthetic oligonucleotide
ttggagagatcacctacattgtgctgctggtg

SEQ ID NO: 220813 - DNA, 31 bp, Artificial Sequence
  Description of Artificial Sequence: Synthetic oligonucleotide
tggagagatcacctacattgtgctgctggtg

SEQ ID NO: 220814 - DNA, 30 bp, Artificial Sequence
  Description of Artificial Sequence: Synthetic oligonucleotide
ggagagatcacctacattgtgctgctggtg

SEQ ID NO: 220815 - DNA, 30 bp, Artificial Sequence
  Description of Artificial Sequence: Synthetic oligonucleotide
gagagatcacctacattgtgctgctggtgc

SEQ ID NO: 220816 - DNA, 32 bp, Artificial Sequence
  Description of Artificial Sequence: Synthetic oligonucleotide
agagatcacctacattgtgctgctggtgcttc

SEQ ID NO: 220817 - DNA, 31 bp, Artificial Sequence
  Description of Artificial Sequence: Synthetic oligonucleotide
gagatcacctacattgtgctgctggtgcttc

SEQ ID NO: 220818 - DNA, 34 bp, Artificial Sequence
  Description of Artificial Sequence: Synthetic oligonucleotide
agatcacctacattgtgctgctggtgcttcatac

SEQ ID NO: 220819 - DNA, 33 bp, Artificial Sequence
  Description of Artificial Sequence: Synthetic oligonucleotide
gatcacctacattgtgctgctggtgcttcatac

SEQ ID NO: 220820 - DNA, 34 bp, Artificial Sequence
  Description of Artificial Sequence: Synthetic oligonucleotide
atcacctacattgtgctgctggtgcttcatactg

SEQ ID NO: 220821 - DNA, 33 bp, Artificial Sequence
  Description of Artificial Sequence: Synthetic oligonucleotide
tcacctacattgtgctgctggtgcttcatactg

SEQ ID NO: 220822 - DNA, 32 bp, Artificial Sequence
  Description of Artificial Sequence: Synthetic oligonucleotide
cacctacattgtgctgctggtgcttcatactg

SEQ ID NO: 220823 - DNA, 33 bp, Artificial Sequence
  Description of Artificial Sequence: Synthetic oligonucleotide
acctacattgtgctgctggtgcttcatactgtc

SEQ ID NO: 220824 - DNA, 32 bp, Artificial Sequence
  Description of Artificial Sequence: Synthetic oligonucleotide
cctacattgtgctgctggtgcttcatactgtc

SEQ ID NO: 220825 - DNA, 33 bp, Artificial Sequence
  Description of Artificial Sequence: Synthetic oligonucleotide
ctacattgtgctgctggtgcttcatactgtctg

SEQ ID NO: 220826 - DNA, 33 bp, Artificial Sequence
  Description of Artificial Sequence: Synthetic oligonucleotide
tacattgtgctgctggtgcttcatactgtctgg

SEQ ID NO: 220827 - DNA, 32 bp, Artificial Sequence
  Description of Artificial Sequence: Synthetic oligonucleotide
acattgtgctgctggtgcttcatactgtctgg

SEQ ID NO: 220828 - DNA, 31 bp, Artificial Sequence
  Description of Artificial Sequence: Synthetic oligonucleotide
cattgtgctgctggtgcttcatactgtctgg

SEQ ID NO: 220829 - DNA, 33 bp, Artificial Sequence
  Description of Artificial Sequence: Synthetic oligonucleotide
attgtgctgctggtgcttcatactgtctggaac

SEQ ID NO: 220830 - DNA, 32 bp, Artificial Sequence
  Description of Artificial Sequence: Synthetic oligonucleotide
ttgtgctgctggtgcttcatactgtctggaac

SEQ ID NO: 220831 - DNA, 31 bp, Artificial Sequence
  Description of Artificial Sequence: Synthetic oligonucleotide
tgtgctgctggtgcttcatactgtctggaac

SEQ ID NO: 220832 - DNA, 30 bp, Artificial Sequence
  Description of Artificial Sequence: Synthetic oligonucleotide
gtgctgctggtgcttcatactgtctggaac

SEQ ID NO: 220833 - DNA, 30 bp, Artificial Sequence
  Description of Artificial Sequence: Synthetic oligonucleotide
tgctgctggtgcttcatactgtctggaacg

SEQ ID NO: 220834 - DNA, 29 bp, Artificial Sequence
  Description of Artificial Sequence: Synthetic oligonucleotide
gctgctggtgcttcatactgtctggaacg

SEQ ID NO: 220835 - DNA, 29 bp, Artificial Sequence
  Description of Artificial Sequence: Synthetic oligonucleotide
ctgctggtgcttcatactgtctggaacgg

SEQ ID NO: 220836 - DNA, 29 bp, Artificial Sequence
  Description of Artificial Sequence: Synthetic oligonucleotide
tgctggtgcttcatactgtctggaacggc

SEQ ID NO: 220837 - DNA, 28 bp, Artificial Sequence
  Description of Artificial Sequence: Synthetic oligonucleotide
gctggtgcttcatactgtctggaacggc

SEQ ID NO: 220838 - DNA, 31 bp, Artificial Sequence
  Description of Artificial Sequence: Synthetic oligonucleotide
ctggtgcttcatactgtctggaacggcaatg

SEQ ID NO: 220839 - DNA, 31 bp, Artificial Sequence
  Description of Artificial Sequence: Synthetic oligonucleotide
tggtgcttcatactgtctggaacggcaatgg

SEQ ID NO: 220840 - DNA, 30 bp, Artificial Sequence
  Description of Artificial Sequence: Synthetic oligonucleotide
ggtgcttcatactgtctggaacggcaatgg

SEQ ID NO: 220841 - DNA, 30 bp, Artificial Sequence
  Description of Artificial Sequence: Synthetic oligonucleotide
gtgcttcatactgtctggaacggcaatggc

SEQ ID NO: 220842 - DNA, 32 bp, Artificial Sequence
  Description of Artificial Sequence: Synthetic oligonucleotide
tgcttcatactgtctggaacggcaatggcatg

SEQ ID NO: 220843 - DNA, 31 bp, Artificial Sequence
  Description of Artificial Sequence: Synthetic oligonucleotide
gcttcatactgtctggaacggcaatggcatg

SEQ ID NO: 220844 - DNA, 34 bp, Artificial Sequence
  Description of Artificial Sequence: Synthetic oligonucleotide
cttcatactgtctggaacggcaatggcatgattg

SEQ ID NO: 220845 - DNA, 34 bp, Artificial Sequence
  Description of Artificial Sequence: Synthetic oligonucleotide
ttcatactgtctggaacggcaatggcatgattgg

SEQ ID NO: 220846 - DNA, 33 bp, Artificial Sequence
  Description of Artificial Sequence: Synthetic oligonucleotide
tcatactgtctggaacggcaatggcatgattgg

SEQ ID NO: 220847 - DNA, 32 bp, Artificial Sequence
  Description of Artificial Sequence: Synthetic oligonucleotide
catactgtctggaacggcaatggcatgattgg

SEQ ID NO: 220848 - DNA, 32 bp, Artificial Sequence
  Description of Artificial Sequence: Synthetic oligonucleotide
atactgtctggaacggcaatggcatgattggc

SEQ ID NO: 220849 - DNA, 31 bp, Artificial Sequence
  Description of Artificial Sequence: Synthetic oligonucleotide
tactgtctggaacggcaatggcatgattggc

SEQ ID NO: 220850 - DNA, 30 bp, Artificial Sequence
  Description of Artificial Sequence: Synthetic oligonucleotide
actgtctggaacggcaatggcatgattggc

SEQ ID NO: 220851 - DNA, 29 bp, Artificial Sequence
  Description of Artificial Sequence: Synthetic oligonucleotide
ctgtctggaacggcaatggcatgattggc

SEQ ID NO: 220852 - DNA, 31 bp, Artificial Sequence
  Description of Artificial Sequence: Synthetic oligonucleotide
tgtctggaacggcaatggcatgattggcttc

SEQ ID NO: 220853 - DNA, 30 bp, Artificial Sequence
  Description of Artificial Sequence: Synthetic oligonucleotide
gtctggaacggcaatggcatgattggcttc

SEQ ID NO: 220854 - DNA, 30 bp, Artificial Sequence
  Description of Artificial Sequence: Synthetic oligonucleotide
tctggaacggcaatggcatgattggcttcc

SEQ ID NO: 220855 - DNA, 29 bp, Artificial Sequence
  Description of Artificial Sequence: Synthetic oligonucleotide
ctggaacggcaatggcatgattggcttcc

SEQ ID NO: 220856 - DNA, 30 bp, Artificial Sequence
  Description of Artificial Sequence: Synthetic oligonucleotide
tggaacggcaatggcatgattggcttccag

SEQ ID NO: 220857 - DNA, 29 bp, Artificial Sequence
  Description of Artificial Sequence: Synthetic oligonucleotide
ggaacggcaatggcatgattggcttccag

SEQ ID NO: 220858 - DNA, 29 bp, Artificial Sequence
  Description of Artificial Sequence: Synthetic oligonucleotide
gaacggcaatggcatgattggcttccagg

SEQ ID NO: 220859 - DNA, 30 bp, Artificial Sequence
  Description of Artificial Sequence: Synthetic oligonucleotide
aacggcaatggcatgattggcttccaggtc

SEQ ID NO: 220860 - DNA, 29 bp, Artificial Sequence
  Description of Artificial Sequence: Synthetic oligonucleotide
acggcaatggcatgattggcttccaggtc

SEQ ID NO: 220861 - DNA, 28 bp, Artificial Sequence
  Description of Artificial Sequence: Synthetic oligonucleotide
cggcaatggcatgattggcttccaggtc

SEQ ID NO: 220862 - DNA, 28 bp, Artificial Sequence
  Description of Artificial Sequence: Synthetic oligonucleotide
ggcaatggcatgattggcttccaggtcc

SEQ ID NO: 220863 - DNA, 29 bp, Artificial Sequence
  Description of Artificial Sequence: Synthetic oligonucleotide
gcaatggcatgattggcttccaggtcctc

SEQ ID NO: 220864 - DNA, 29 bp, Artificial Sequence
  Description of Artificial Sequence: Synthetic oligonucleotide
caatggcatgattggcttccaggtcctcc

SEQ ID NO: 220865 - DNA, 30 bp, Artificial Sequence
  Description of Artificial Sequence: Synthetic oligonucleotide
aatggcatgattggcttccaggtcctcctc

SEQ ID NO: 220866 - DNA, 29 bp, Artificial Sequence
  Description of Artificial Sequence: Synthetic oligonucleotide
atggcatgattggcttccaggtcctcctc

SEQ ID NO: 220867 - DNA, 28 bp, Artificial Sequence
  Description of Artificial Sequence: Synthetic oligonucleotide
tggcatgattggcttccaggtcctcctc

SEQ ID NO: 220868 - DNA, 27 bp, Artificial Sequence
  Description of Artificial Sequence: Synthetic oligonucleotide
ggcatgattggcttccaggtcctcctc

SEQ ID NO: 220869 - DNA, 28 bp, Artificial Sequence
  Description of Artificial Sequence: Synthetic oligonucleotide
gcatgattggcttccaggtcctcctcag

SEQ ID NO: 220870 - DNA, 28 bp, Artificial Sequence
  Description of Artificial Sequence: Synthetic oligonucleotide
catgattggcttccaggtcctcctcagc

SEQ ID NO: 220871 - DNA, 31 bp, Artificial Sequence
  Description of Artificial Sequence: Synthetic oligonucleotide
atgattggcttccaggtcctcctcagcattg

SEQ ID NO: 220872 - DNA, 30 bp, Artificial Sequence
  Description of Artificial Sequence: Synthetic oligonucleotide
tgattggcttccaggtcctcctcagcattg

SEQ ID NO: 220873 - DNA, 29 bp, Artificial Sequence
  Description of Artificial Sequence: Synthetic oligonucleotide
gattggcttccaggtcctcctcagcattg

SEQ ID NO: 220874 - DNA, 29 bp, Artificial Sequence
  Description of Artificial Sequence: Synthetic oligonucleotide
attggcttccaggtcctcctcagcattgg

SEQ ID NO: 220875 - DNA, 28 bp, Artificial Sequence
  Description of Artificial Sequence: Synthetic oligonucleotide
ttggcttccaggtcctcctcagcattgg

SEQ ID NO: 220876 - DNA, 27 bp, Artificial Sequence
  Description of Artificial Sequence: Synthetic oligonucleotide
tggcttccaggtcctcctcagcattgg

SEQ ID NO: 220877 - DNA, 26 bp, Artificial Sequence
  Description of Artificial Sequence: Synthetic oligonucleotide
ggcttccaggtcctcctcagcattgg

SEQ ID NO: 220878 - DNA, 26 bp, Artificial Sequence
  Description of Artificial Sequence: Synthetic oligonucleotide
gcttccaggtcctcctcagcattggg

SEQ ID NO: 220879 - DNA, 27 bp, Artificial Sequence
  Description of Artificial Sequence: Synthetic oligonucleotide
cttccaggtcctcctcagcattgggga

SEQ ID NO: 220880 - DNA, 28 bp, Artificial Sequence
  Description of Artificial Sequence: Synthetic oligonucleotide
ttccaggtcctcctcagcattggggaac

SEQ ID NO: 220881 - DNA, 27 bp, Artificial Sequence
  Description of Artificial Sequence: Synthetic oligonucleotide
tccaggtcctcctcagcattggggaac

SEQ ID NO: 220882 - DNA, 27 bp, Artificial Sequence
  Description of Artificial Sequence: Synthetic oligonucleotide
ccaggtcctcctcagcattggggaact

SEQ ID NO: 220883 - DNA, 27 bp, Artificial Sequence
  Description of Artificial Sequence: Synthetic oligonucleotide
caggtcctcctcagcattggggaactc

SEQ ID NO: 220884 - DNA, 28 bp, Artificial Sequence
  Description of Artificial Sequence: Synthetic oligonucleotide
aggtcctcctcagcattggggaactcag

SEQ ID NO: 220885 - DNA, 27 bp, Artificial Sequence
  Description of Artificial Sequence: Synthetic oligonucleotide
ggtcctcctcagcattggggaactcag

SEQ ID NO: 220886 - DNA, 27 bp, Artificial Sequence
  Description of Artificial Sequence: Synthetic oligonucleotide
gtcctcctcagcattggggaactcagc

SEQ ID NO: 220887 - DNA, 29 bp, Artificial Sequence
  Description of Artificial Sequence: Synthetic oligonucleotide
tcctcctcagcattggggaactcagcttg

SEQ ID NO: 220888 - DNA, 28 bp, Artificial Sequence
  Description of Artificial Sequence: Synthetic oligonucleotide
cctcctcagcattggggaactcagcttg

SEQ ID NO: 220889 - DNA, 28 bp, Artificial Sequence
  Description of Artificial Sequence: Synthetic oligonucleotide
ctcctcagcattggggaactcagcttgg

SEQ ID NO: 220890 - DNA, 28 bp, Artificial Sequence
  Description of Artificial Sequence: Synthetic oligonucleotide
tcctcagcattggggaactcagcttggc

SEQ ID NO: 220891 - DNA, 27 bp, Artificial Sequence
  Description of Artificial Sequence: Synthetic oligonucleotide
cctcagcattggggaactcagcttggc

SEQ ID NO: 220892 - DNA, 27 bp, Artificial Sequence
  Description of Artificial Sequence: Synthetic oligonucleotide
ctcagcattggggaactcagcttggcc

SEQ ID NO: 220893 - DNA, 29 bp, Artificial Sequence
  Description of Artificial Sequence: Synthetic oligonucleotide
tcagcattggggaactcagcttggccatc

SEQ ID NO: 220894 - DNA, 28 bp, Artificial Sequence
  Description of Artificial Sequence: Synthetic oligonucleotide
cagcattggggaactcagcttggccatc

SEQ ID NO: 220895 - DNA, 28 bp, Artificial Sequence
  Description of Artificial Sequence: Synthetic oligonucleotide
agcattggggaactcagcttggccatcg

SEQ ID NO: 220896 - DNA, 27 bp, Artificial Sequence
  Description of Artificial Sequence: Synthetic oligonucleotide
gcattggggaactcagcttggccatcg

SEQ ID NO: 220897 - DNA, 28 bp, Artificial Sequence
  Description of Artificial Sequence: Synthetic oligonucleotide
cattggggaactcagcttggccatcgtg

SEQ ID NO: 220898 - DNA, 31 bp, Artificial Sequence
  Description of Artificial Sequence: Synthetic oligonucleotide
attggggaactcagcttggccatcgtgatag

SEQ ID NO: 220899 - DNA, 30 bp, Artificial Sequence
  Description of Artificial Sequence: Synthetic oligonucleotide
ttggggaactcagcttggccatcgtgatag

SEQ ID NO: 220900 - DNA, 29 bp, Artificial Sequence
  Description of Artificial Sequence: Synthetic oligonucleotide
tggggaactcagcttggccatcgtgatag

SEQ ID NO: 220901 - DNA, 28 bp, Artificial Sequence
  Description of Artificial Sequence: Synthetic oligonucleotide
ggggaactcagcttggccatcgtgatag

SEQ ID NO: 220902 - DNA, 28 bp, Artificial Sequence
  Description of Artificial Sequence: Synthetic oligonucleotide
gggaactcagcttggccatcgtgatagc

SEQ ID NO: 220903 - DNA, 29 bp, Artificial Sequence
  Description of Artificial Sequence: Synthetic oligonucleotide
ggaactcagcttggccatcgtgatagctc

SEQ ID NO: 220904 - DNA, 30 bp, Artificial Sequence
  Description of Artificial Sequence: Synthetic oligonucleotide
gaactcagcttggccatcgtgatagctctc

SEQ ID NO: 220905 - DNA, 31 bp, Artificial Sequence
  Description of Artificial Sequence: Synthetic oligonucleotide
aactcagcttggccatcgtgatagctctcac

SEQ ID NO: 220906 - DNA, 30 bp, Artificial Sequence
  Description of Artificial Sequence: Synthetic oligonucleotide
actcagcttggccatcgtgatagctctcac

SEQ ID NO: 220907 - DNA, 29 bp, Artificial Sequence
  Description of Artificial Sequence: Synthetic oligonucleotide
ctcagcttggccatcgtgatagctctcac

SEQ ID NO: 220908 - DNA, 29 bp, Artificial Sequence
  Description of Artificial Sequence: Synthetic oligonucleotide
tcagcttggccatcgtgatagctctcacg

SEQ ID NO: 220909 - DNA, 28 bp, Artificial Sequence
  Description of Artificial Sequence: Synthetic oligonucleotide
cagcttggccatcgtgatagctctcacg

SEQ ID NO: 220910 - DNA, 29 bp, Artificial Sequence
  Description of Artificial Sequence: Synthetic oligonucleotide
agcttggccatcgtgatagctctcacgtc

SEQ ID NO: 220911 - DNA, 28 bp, Artificial Sequence
  Description of Artificial Sequence: Synthetic oligonucleotide
gcttggccatcgtgatagctctcacgtc

SEQ ID NO: 220912 - DNA, 29 bp, Artificial Sequence
  Description of Artificial Sequence: Synthetic oligonucleotide
cttggccatcgtgatagctctcacgtctg

SEQ ID NO: 220913 - DNA, 29 bp, Artificial Sequence
  Description of Artificial Sequence: Synthetic oligonucleotide
ttggccatcgtgatagctctcacgtctgg

SEQ ID NO: 220914 - DNA, 28 bp, Artificial Sequence
  Description of Artificial Sequence: Synthetic oligonucleotide
tggccatcgtgatagctctcacgtctgg

SEQ ID NO: 220915 - DNA, 27 bp, Artificial Sequence
  Description of Artificial Sequence: Synthetic oligonucleotide
ggccatcgtgatagctctcacgtctgg

SEQ ID NO: 220916 - DNA, 28 bp, Artificial Sequence
  Description of Artificial Sequence: Synthetic oligonucleotide
gccatcgtgatagctctcacgtctggtc

SEQ ID NO: 220917 - DNA, 29 bp, Artificial Sequence
  Description of Artificial Sequence: Synthetic oligonucleotide
ccatcgtgatagctctcacgtctggtctc

SEQ ID NO: 220918 - DNA, 29 bp, Artificial Sequence
  Description of Artificial Sequence: Synthetic oligonucleotide
catcgtgatagctctcacgtctggtctcc

SEQ ID NO: 220919 - DNA, 30 bp, Artificial Sequence
  Description of Artificial Sequence: Synthetic oligonucleotide
atcgtgatagctctcacgtctggtctcctg

SEQ ID NO: 220920 - DNA, 29 bp, Artificial Sequence
  Description of Artificial Sequence: Synthetic oligonucleotide
tcgtgatagctctcacgtctggtctcctg

SEQ ID NO: 220921 - DNA, 28 bp, Artificial Sequence
  Description of Artificial Sequence: Synthetic oligonucleotide
cgtgatagctctcacgtctggtctcctg

SEQ ID NO: 220922 - DNA, 29 bp, Artificial Sequence
  Description of Artificial Sequence: Synthetic oligonucleotide
gtgatagctctcacgtctggtctcctgac

SEQ ID NO: 220923 - DNA, 30 bp, Artificial Sequence
  Description of Artificial Sequence: Synthetic oligonucleotide
tgatagctctcacgtctggtctcctgacag

SEQ ID NO: 220924 - DNA, 29 bp, Artificial Sequence
  Description of Artificial Sequence: Synthetic oligonucleotide
gatagctctcacgtctggtctcctgacag

SEQ ID NO: 220925 - DNA, 29 bp, Artificial Sequence
  Description of Artificial Sequence: Synthetic oligonucleotide
atagctctcacgtctggtctcctgacagg

SEQ ID NO: 220926 - DNA, 28 bp, Artificial Sequence
  Description of Artificial Sequence: Synthetic oligonucleotide
tagctctcacgtctggtctcctgacagg

SEQ ID NO: 220927 - DNA, 27 bp, Artificial Sequence
  Description of Artificial Sequence: Synthetic oligonucleotide
agctctcacgtctggtctcctgacagg

SEQ ID NO: 220928 - DNA, 27 bp, Artificial Sequence
  Description of Artificial Sequence: Synthetic oligonucleotide
gctctcacgtctggtctcctgacaggt

SEQ ID NO: 220929 - DNA, 29 bp, Artificial Sequence
  Description of Artificial Sequence: Synthetic oligonucleotide
ctctcacgtctggtctcctgacaggtttg

SEQ ID NO: 220930 - DNA, 29 bp, Artificial Sequence
  Description of Artificial Sequence: Synthetic oligonucleotide
tctcacgtctggtctcctgacaggtttgc

SEQ ID NO: 220931 - DNA, 28 bp, Artificial Sequence
  Description of Artificial Sequence: Synthetic oligonucleotide
ctcacgtctggtctcctgacaggtttgc

SEQ ID NO: 220932 - DNA, 29 bp, Artificial Sequence
  Description of Artificial Sequence: Synthetic oligonucleotide
tcacgtctggtctcctgacaggtttgctc

SEQ ID NO: 220933 - DNA, 28 bp, Artificial Sequence
  Description of Artificial Sequence: Synthetic oligonucleotide
cacgtctggtctcctgacaggtttgctc

SEQ ID NO: 220934 - DNA, 28 bp, Artificial Sequence
  Description of Artificial Sequence: Synthetic oligonucleotide
acgtctggtctcctgacaggtttgctcc

SEQ ID NO: 220935 - DNA, 27 bp, Artificial Sequence
  Description of Artificial Sequence: Synthetic oligonucleotide
cgtctggtctcctgacaggtttgctcc

SEQ ID NO: 220936 - DNA, 32 bp, Artificial Sequence
  Description of Artificial Sequence: Synthetic oligonucleotide
gtctggtctcctgacaggtttgctcctaaatc

SEQ ID NO: 220937 - DNA, 33 bp, Artificial Sequence
  Description of Artificial Sequence: Synthetic oligonucleotide
tctggtctcctgacaggtttgctcctaaatctc

SEQ ID NO: 220938 - DNA, 32 bp, Artificial Sequence
  Description of Artificial Sequence: Synthetic oligonucleotide
ctggtctcctgacaggtttgctcctaaatctc

SEQ ID NO: 220939 - DNA, 39 bp, Artificial Sequence
  Description of Artificial Sequence: Synthetic oligonucleotide
tggtctcctgacaggtttgctcctaaatctcaaaatatg

SEQ ID NO: 220940 - DNA, 38 bp, Artificial Sequence
  Description of Artificial Sequence: Synthetic oligonucleotide
ggtctcctgacaggtttgctcctaaatctcaaaatatg

SEQ ID NO: 220941 - DNA, 38 bp, Artificial Sequence
  Description of Artificial Sequence: Synthetic oligonucleotide
gtctcctgacaggtttgctcctaaatctcaaaatatgg

SEQ ID NO: 220942 - DNA, 41 bp, Artificial Sequence
  Description of Artificial Sequence: Synthetic oligonucleotide
tctcctgacaggtttgctcctaaatctcaaaatatggaaag

SEQ ID NO: 220943 - DNA, 40 bp, Artificial Sequence
  Description of Artificial Sequence: Synthetic oligonucleotide
ctcctgacaggtttgctcctaaatctcaaaatatggaaag

SEQ ID NO: 220944 - DNA, 40 bp, Artificial Sequence
  Description of Artificial Sequence: Synthetic oligonucleotide
tcctgacaggtttgctcctaaatctcaaaatatggaaagc

SEQ ID NO: 220945 - DNA, 39 bp, Artificial Sequence
  Description of Artificial Sequence: Synthetic oligonucleotide
cctgacaggtttgctcctaaatctcaaaatatggaaagc

SEQ ID NO: 220946 - DNA, 40 bp, Artificial Sequence
  Description of Artificial Sequence: Synthetic oligonucleotide
ctgacaggtttgctcctaaatctcaaaatatggaaagcac

SEQ ID NO: 220947 - DNA, 40 bp, Artificial Sequence
  Description of Artificial Sequence: Synthetic oligonucleotide
tgacaggtttgctcctaaatctcaaaatatggaaagcacc

SEQ ID NO: 220948 - DNA, 39 bp, Artificial Sequence
  Description of Artificial Sequence: Synthetic oligonucleotide
gacaggtttgctcctaaatctcaaaatatggaaagcacc

SEQ ID NO: 220949 - DNA, 40 bp, Artificial Sequence
  Description of Artificial Sequence: Synthetic oligonucleotide
acaggtttgctcctaaatctcaaaatatggaaagcacctc

SEQ ID NO: 220950 - DNA, 39 bp, Artificial Sequence
  Description of Artificial Sequence: Synthetic oligonucleotide
caggtttgctcctaaatctcaaaatatggaaagcacctc

SEQ ID NO: 220951 - DNA, 41 bp, Artificial Sequence
  Description of Artificial Sequence: Synthetic oligonucleotide
aggtttgctcctaaatctcaaaatatggaaagcacctcatg

SEQ ID NO: 220952 - DNA, 40 bp, Artificial Sequence
  Description of Artificial Sequence: Synthetic oligonucleotide
ggtttgctcctaaatctcaaaatatggaaagcacctcatg

SEQ ID NO: 220953 - DNA, 41 bp, Artificial Sequence
  Description of Artificial Sequence: Synthetic oligonucleotide
gtttgctcctaaatctcaaaatatggaaagcacctcatgtg

SEQ ID NO: 220954 - DNA, 41 bp, Artificial Sequence
  Description of Artificial Sequence: Synthetic oligonucleotide
tttgctcctaaatctcaaaatatggaaagcacctcatgtgg

SEQ ID NO: 220955 - DNA, 40 bp, Artificial Sequence
  Description of Artificial Sequence: Synthetic oligonucleotide
ttgctcctaaatctcaaaatatggaaagcacctcatgtgg

SEQ ID NO: 220956 - DNA, 39 bp, Artificial Sequence
  Description of Artificial Sequence: Synthetic oligonucleotide
tgctcctaaatctcaaaatatggaaagcacctcatgtgg

SEQ ID NO: 220957 - DNA, 38 bp, Artificial Sequence
  Description of Artificial Sequence: Synthetic oligonucleotide
gctcctaaatctcaaaatatggaaagcacctcatgtgg

SEQ ID NO: 220958 - DNA, 38 bp, Artificial Sequence
  Description of Artificial Sequence: Synthetic oligonucleotide
ctcctaaatctcaaaatatggaaagcacctcatgtggc

SEQ ID NO: 220959 - DNA, 48 bp, Artificial Sequence
  Description of Artificial Sequence: Synthetic oligonucleotide
tcctaaatctcaaaatatggaaagcacctcatgtggctaaatattttg

SEQ ID NO: 220960 - DNA, 47 bp, Artificial Sequence
  Description of Artificial Sequence: Synthetic oligonucleotide
cctaaatctcaaaatatggaaagcacctcatgtggctaaatattttg

SEQ ID NO: 220961 - DNA, 49 bp, Artificial Sequence
  Description of Artificial Sequence: Synthetic oligonucleotide
ctaaatctcaaaatatggaaagcacctcatgtggctaaatattttgatg

SEQ ID NO: 220962 - DNA, 50 bp, Artificial Sequence
  Description of Artificial Sequence: Synthetic oligonucleotide
taaatctcaaaatatggaaagcacctcatgtggctaaatattttgatgac

SEQ ID NO: 220963 - DNA, 49 bp, Artificial Sequence
  Description of Artificial Sequence: Synthetic oligonucleotide
aaatctcaaaatatggaaagcacctcatgtggctaaatattttgatgac

SEQ ID NO: 220964 - DNA, 48 bp, Artificial Sequence
  Description of Artificial Sequence: Synthetic oligonucleotide
aatctcaaaatatggaaagcacctcatgtggctaaatattttgatgac

SEQ ID NO: 220965 - DNA, 47 bp, Artificial Sequence
  Description of Artificial Sequence: Synthetic oligonucleotide
atctcaaaatatggaaagcacctcatgtggctaaatattttgatgac

SEQ ID NO: 220966 - DNA, 46 bp, Artificial Sequence
  Description of Artificial Sequence: Synthetic oligonucleotide
tctcaaaatatggaaagcacctcatgtggctaaatattttgatgac

SEQ ID NO: 220967 - DNA, 45 bp, Artificial Sequence
  Description of Artificial Sequence: Synthetic oligonucleotide
ctcaaaatatggaaagcacctcatgtggctaaatattttgatgac

SEQ ID NO: 220968 - DNA, 45 bp, Artificial Sequence
  Description of Artificial Sequence: Synthetic oligonucleotide
tcaaaatatggaaagcacctcatgtggctaaatattttgatgacc

SEQ ID NO: 220969 - DNA, 44 bp, Artificial Sequence
  Description of Artificial Sequence: Synthetic oligonucleotide
caaaatatggaaagcacctcatgtggctaaatattttgatgacc

SEQ ID NO: 220970 - DNA, 46 bp, Artificial Sequence
  Description of Artificial Sequence: Synthetic oligonucleotide
aaaatatggaaagcacctcatgtggctaaatattttgatgaccaag

SEQ ID NO: 220971 - DNA, 45 bp, Artificial Sequence
  Description of Artificial Sequence: Synthetic oligonucleotide
aaatatggaaagcacctcatgtggctaaatattttgatgaccaag

SEQ ID NO: 220972 - DNA, 44 bp, Artificial Sequence
  Description of Artificial Sequence: Synthetic oligonucleotide
aatatggaaagcacctcatgtggctaaatattttgatgaccaag

SEQ ID NO: 220973 - DNA, 43 bp, Artificial Sequence
  Description of Artificial Sequence: Synthetic oligonucleotide
atatggaaagcacctcatgtggctaaatattttgatgaccaag

SEQ ID NO: 220974 - DNA, 42 bp, Artificial Sequence
  Description of Artificial Sequence: Synthetic oligonucleotide
tatggaaagcacctcatgtggctaaatattttgatgaccaag

SEQ ID NO: 220975 - DNA, 41 bp, Artificial Sequence
  Description of Artificial Sequence: Synthetic oligonucleotide
atggaaagcacctcatgtggctaaatattttgatgaccaag

SEQ ID NO: 220976 - DNA, 40 bp, Artificial Sequence
  Description of Artificial Sequence: Synthetic oligonucleotide
tggaaagcacctcatgtggctaaatattttgatgaccaag

SEQ ID NO: 220977 - DNA, 39 bp, Artificial Sequence
  Description of Artificial Sequence: Synthetic oligonucleotide
ggaaagcacctcatgtggctaaatattttgatgaccaag

SEQ ID NO: 220978 - DNA, 43 bp, Artificial Sequence
  Description of Artificial Sequence: Synthetic oligonucleotide
gaaagcacctcatgtggctaaatattttgatgaccaagttttc

SEQ ID NO: 220979 - DNA, 44 bp, Artificial Sequence
  Description of Artificial Sequence: Synthetic oligonucleotide
aaagcacctcatgtggctaaatattttgatgaccaagttttctg

SEQ ID NO: 220980 - DNA, 43 bp, Artificial Sequence
  Description of Artificial Sequence: Synthetic oligonucleotide
aagcacctcatgtggctaaatattttgatgaccaagttttctg

SEQ ID NO: 220981 - DNA, 42 bp, Artificial Sequence
  Description of Artificial Sequence: Synthetic oligonucleotide
agcacctcatgtggctaaatattttgatgaccaagttttctg

SEQ ID NO: 220982 - DNA, 41 bp, Artificial Sequence
  Description of Artificial Sequence: Synthetic oligonucleotide
gcacctcatgtggctaaatattttgatgaccaagttttctg

SEQ ID NO: 220983 - DNA, 41 bp, Artificial Sequence
  Description of Artificial Sequence: Synthetic oligonucleotide
cacctcatgtggctaaatattttgatgaccaagttttctgg

SEQ ID NO: 220984 - DNA, 43 bp, Artificial Sequence
  Description of Artificial Sequence: Synthetic oligonucleotide
acctcatgtggctaaatattttgatgaccaagttttctggaag

SEQ ID NO: 220985 - DNA, 42 bp, Artificial Sequence
  Description of Artificial Sequence: Synthetic oligonucleotide
cctcatgtggctaaatattttgatgaccaagttttctggaag

SEQ ID NO: 220986 - DNA, 45 bp, Artificial Sequence
  Description of Artificial Sequence: Synthetic oligonucleotide
ctcatgtggctaaatattttgatgaccaagttttctggaagtttc

SEQ ID NO: 220987 - DNA, 45 bp, Artificial Sequence
  Description of Artificial Sequence: Synthetic oligonucleotide
tcatgtggctaaatattttgatgaccaagttttctggaagtttcc

SEQ ID NO: 220988 - DNA, 44 bp, Artificial Sequence
  Description of Artificial Sequence: Synthetic oligonucleotide
catgtggctaaatattttgatgaccaagttttctggaagtttcc

SEQ ID NO: 220989 - DNA, 45 bp, Artificial Sequence
  Description of Artificial Sequence: Synthetic oligonucleotide
atgtggctaaatattttgatgaccaagttttctggaagtttcctc

SEQ ID NO: 220990 - DNA, 44 bp, Artificial Sequence
  Description of Artificial Sequence: Synthetic oligonucleotide
tgtggctaaatattttgatgaccaagttttctggaagtttcctc

SEQ ID NO: 220991 - DNA, 43 bp, Artificial Sequence
  Description of Artificial Sequence: Synthetic oligonucleotide
gtggctaaatattttgatgaccaagttttctggaagtttcctc

SEQ ID NO: 220992 - DNA, 47 bp, Artificial Sequence
  Description of Artificial Sequence: Synthetic oligonucleotide
tggctaaatattttgatgaccaagttttctggaagtttcctcatttg

SEQ ID NO: 220993 - DNA, 46 bp, Artificial Sequence
  Description of Artificial Sequence: Synthetic oligonucleotide
ggctaaatattttgatgaccaagttttctggaagtttcctcatttg

SEQ ID NO: 220994 - DNA, 46 bp, Artificial Sequence
  Description of Artificial Sequence: Synthetic oligonucleotide
gctaaatattttgatgaccaagttttctggaagtttcctcatttgg

SEQ ID NO: 220995 - DNA, 46 bp, Artificial Sequence
  Description of Artificial Sequence: Synthetic oligonucleotide
ctaaatattttgatgaccaagttttctggaagtttcctcatttggc

SEQ ID NO: 220996 - DNA, 47 bp, Artificial Sequence
  Description of Artificial Sequence: Synthetic oligonucleotide
taaatattttgatgaccaagttttctggaagtttcctcatttggctg

SEQ ID NO: 220997 - DNA, 46 bp, Artificial Sequence
  Description of Artificial Sequence: Synthetic oligonucleotide
aaatattttgatgaccaagttttctggaagtttcctcatttggctg

SEQ ID NO: 220998 - DNA, 45 bp, Artificial Sequence
  Description of Artificial Sequence: Synthetic oligonucleotide
aatattttgatgaccaagttttctggaagtttcctcatttggctg

SEQ ID NO: 220999 - DNA, 44 bp, Artificial Sequence
  Description of Artificial Sequence: Synthetic oligonucleotide
atattttgatgaccaagttttctggaagtttcctcatttggctg

SEQ ID NO: 221000 - DNA, 43 bp, Artificial Sequence
  Description of Artificial Sequence: Synthetic oligonucleotide
tattttgatgaccaagttttctggaagtttcctcatttggctg

SEQ ID NO: 221001 - DNA, 42 bp, Artificial Sequence
  Description of Artificial Sequence: Synthetic oligonucleotide
attttgatgaccaagttttctggaagtttcctcatttggctg

SEQ ID NO: 221002 - DNA, 41 bp, Artificial Sequence
  Description of Artificial Sequence: Synthetic oligonucleotide
ttttgatgaccaagttttctggaagtttcctcatttggctg

SEQ ID NO: 221003 - DNA, 40 bp, Artificial Sequence
  Description of Artificial Sequence: Synthetic oligonucleotide
tttgatgaccaagttttctggaagtttcctcatttggctg

SEQ ID NO: 221004 - DNA, 39 bp, Artificial Sequence
  Description of Artificial Sequence: Synthetic oligonucleotide
ttgatgaccaagttttctggaagtttcctcatttggctg

SEQ ID NO: 221005 - DNA, 38 bp, Artificial Sequence
  Description of Artificial Sequence: Synthetic oligonucleotide
tgatgaccaagttttctggaagtttcctcatttggctg

SEQ ID NO: 221006 - DNA, 37 bp, Artificial Sequence
  Description of Artificial Sequence: Synthetic oligonucleotide
gatgaccaagttttctggaagtttcctcatttggctg

SEQ ID NO: 221007 - DNA, 39 bp, Artificial Sequence
  Description of Artificial Sequence: Synthetic oligonucleotide
atgaccaagttttctggaagtttcctcatttggctgttg

SEQ ID NO: 221008 - DNA, 38 bp, Artificial Sequence
  Description of Artificial Sequence: Synthetic oligonucleotide
tgaccaagttttctggaagtttcctcatttggctgttg

SEQ ID NO: 221009 - DNA, 37 bp, Artificial Sequence
  Description of Artificial Sequence: Synthetic oligonucleotide
gaccaagttttctggaagtttcctcatttggctgttg

SEQ ID NO: 221010 - DNA, 37 bp, Artificial Sequence
  Description of Artificial Sequence: Synthetic oligonucleotide
accaagttttctggaagtttcctcatttggctgttgg

SEQ ID NO: 221011 - DNA, 36 bp, Artificial Sequence
  Description of Artificial Sequence: Synthetic oligonucleotide
ccaagttttctggaagtttcctcatttggctgttgg

SEQ ID NO: 221012 - DNA, 20 bp, Artificial Sequence
  Description of Artificial Sequence: Synthetic oligonucleotide
ggcgctgcctgcccctctgg

SEQ ID NO: 221013 - DNA, 20 bp, Artificial Sequence
  Description of Artificial Sequence: Synthetic oligonucleotide
gcgctgcctgcccctctggg

SEQ ID NO: 221014 - DNA, 20 bp, Artificial Sequence
  Description of Artificial Sequence: Synthetic oligonucleotide
cgctgcctgcccctctgggc

SEQ ID NO: 221015 - DNA, 20 bp, Artificial Sequence
  Description of Artificial Sequence: Synthetic oligonucleotide
gctgcctgcccctctgggcc

SEQ ID NO: 221016 - DNA, 23 bp, Artificial Sequence
  Description of Artificial Sequence: Synthetic oligonucleotide
ctgcctgcccctctgggccctaa

SEQ ID NO: 221017 - DNA, 24 bp, Artificial Sequence
  Description of Artificial Sequence: Synthetic oligonucleotide
tgcctgcccctctgggccctaaca

SEQ ID NO: 221018 - DNA, 23 bp, Artificial Sequence
  Description of Artificial Sequence: Synthetic oligonucleotide
gcctgcccctctgggccctaaca

SEQ ID NO: 221019 - DNA, 24 bp, Artificial Sequence
  Description of Artificial Sequence: Synthetic oligonucleotide
cctgcccctctgggccctaacact

SEQ ID NO: 221020 - DNA, 24 bp, Artificial Sequence
  Description of Artificial Sequence: Synthetic oligonucleotide
ctgcccctctgggccctaacactg

SEQ ID NO: 221021 - DNA, 26 bp, Artificial Sequence
  Description of Artificial Sequence: Synthetic oligonucleotide
tgcccctctgggccctaacactggaa

SEQ ID NO: 221022 - DNA, 25 bp, Artificial Sequence
  Description of Artificial Sequence: Synthetic oligonucleotide
gcccctctgggccctaacactggaa

SEQ ID NO: 221023 - DNA, 25 bp, Artificial Sequence
  Description of Artificial Sequence: Synthetic oligonucleotide
cccctctgggccctaacactggaag

SEQ ID NO: 221024 - DNA, 26 bp, Artificial Sequence
  Description of Artificial Sequence: Synthetic oligonucleotide
ccctctgggccctaacactggaagca

SEQ ID NO: 221025 - DNA, 26 bp, Artificial Sequence
  Description of Artificial Sequence: Synthetic oligonucleotide
cctctgggccctaacactggaagcag

SEQ ID NO: 221026 - DNA, 27 bp, Artificial Sequence
  Description of Artificial Sequence: Synthetic oligonucleotide
ctctgggccctaacactggaagcagct

SEQ ID NO: 221027 - DNA, 27 bp, Artificial Sequence
  Description of Artificial Sequence: Synthetic oligonucleotide
tctgggccctaacactggaagcagctc

SEQ ID NO: 221028 - DNA, 27 bp, Artificial Sequence
  Description of Artificial Sequence: Synthetic oligonucleotide
ctgggccctaacactggaagcagctct

SEQ ID NO: 221029 - DNA, 27 bp, Artificial Sequence
  Description of Artificial Sequence: Synthetic oligonucleotide
tgggccctaacactggaagcagctctc

SEQ ID NO: 221030 - DNA, 27 bp, Artificial Sequence
  Description of Artificial Sequence: Synthetic oligonucleotide
gggccctaacactggaagcagctctca

SEQ ID NO: 221031 - DNA, 29 bp, Artificial Sequence
  Description of Artificial Sequence: Synthetic oligonucleotide
ggccctaacactggaagcagctctcattc

SEQ ID NO: 221032 - DNA, 33 bp, Artificial Sequence
  Description of Artificial Sequence: Synthetic oligonucleotide
atcaaaaggggctcgtggcatcctatcaagttg

SEQ ID NO: 221033 - DNA, 32 bp, Artificial Sequence
  Description of Artificial Sequence: Synthetic oligonucleotide
tcaaaaggggctcgtggcatcctatcaagttg

SEQ ID NO: 221034 - DNA, 31 bp, Artificial Sequence
  Description of Artificial Sequence: Synthetic oligonucleotide
caaaaggggctcgtggcatcctatcaagttg

SEQ ID NO: 221035 - DNA, 31 bp, Artificial Sequence
  Description of Artificial Sequence: Synthetic oligonucleotide
aaaaggggctcgtggcatcctatcaagttgg

SEQ ID NO: 221036 - DNA, 30 bp, Artificial Sequence
  Description of Artificial Sequence: Synthetic oligonucleotide
aaaggggctcgtggcatcctatcaagttgg

SEQ ID NO: 221037 - DNA, 29 bp, Artificial Sequence
  Description of Artificial Sequence: Synthetic oligonucleotide
aaggggctcgtggcatcctatcaagttgg

SEQ ID NO: 221038 - DNA, 28 bp, Artificial Sequence
  Description of Artificial Sequence: Synthetic oligonucleotide
aggggctcgtggcatcctatcaagttgg

SEQ ID NO: 221039 - DNA, 27 bp, Artificial Sequence
  Description of Artificial Sequence: Synthetic oligonucleotide
ggggctcgtggcatcctatcaagttgg

SEQ ID NO: 221040 - DNA, 27 bp, Artificial Sequence
  Description of Artificial Sequence: Synthetic oligonucleotide
gggctcgtggcatcctatcaagttggc

SEQ ID NO: 221041 - DNA, 27 bp, Artificial Sequence
  Description of Artificial Sequence: Synthetic oligonucleotide
ggctcgtggcatcctatcaagttggcc

SEQ ID NO: 221042 - DNA, 29 bp, Artificial Sequence
  Description of Artificial Sequence: Synthetic oligonucleotide
gctcgtggcatcctatcaagttggccaag

SEQ ID NO: 221043 - DNA, 31 bp, Artificial Sequence
  Description of Artificial Sequence: Synthetic oligonucleotide
ctcgtggcatcctatcaagttggccaagatc

SEQ ID NO: 221044 - DNA, 32 bp, Artificial Sequence
  Description of Artificial Sequence: Synthetic oligonucleotide
tcgtggcatcctatcaagttggccaagatctg

SEQ ID NO: 221045 - DNA, 31 bp, Artificial Sequence
  Description of Artificial Sequence: Synthetic oligonucleotide
cgtggcatcctatcaagttggccaagatctg

SEQ ID NO: 221046 - DNA, 32 bp, Artificial Sequence
  Description of Artificial Sequence: Synthetic oligonucleotide
gtggcatcctatcaagttggccaagatctgac

SEQ ID NO: 221047 - DNA, 32 bp, Artificial Sequence
  Description of Artificial Sequence: Synthetic oligonucleotide
tggcatcctatcaagttggccaagatctgacc

SEQ ID NO: 221048 - DNA, 31 bp, Artificial Sequence
  Description of Artificial Sequence: Synthetic oligonucleotide
ggcatcctatcaagttggccaagatctgacc

SEQ ID NO: 221049 - DNA, 31 bp, Artificial Sequence
  Description of Artificial Sequence: Synthetic oligonucleotide
gcatcctatcaagttggccaagatctgaccg

SEQ ID NO: 221050 - DNA, 32 bp, Artificial Sequence
  Description of Artificial Sequence: Synthetic oligonucleotide
catcctatcaagttggccaagatctgaccgtg

SEQ ID NO: 221051 - DNA, 34 bp, Artificial Sequence
  Description of Artificial Sequence: Synthetic oligonucleotide
atcctatcaagttggccaagatctgaccgtgatg

SEQ ID NO: 221052 - DNA, 33 bp, Artificial Sequence
  Description of Artificial Sequence: Synthetic oligonucleotide
tcctatcaagttggccaagatctgaccgtgatg

SEQ ID NO: 221053 - DNA, 32 bp, Artificial Sequence
  Description of Artificial Sequence: Synthetic oligonucleotide
cctatcaagttggccaagatctgaccgtgatg

SEQ ID NO: 221054 - DNA, 32 bp, Artificial Sequence
  Description of Artificial Sequence: Synthetic oligonucleotide
ctatcaagttggccaagatctgaccgtgatgg

SEQ ID NO: 221055 - DNA, 32 bp, Artificial Sequence
  Description of Artificial Sequence: Synthetic oligonucleotide
tatcaagttggccaagatctgaccgtgatggc

SEQ ID NO: 221056 - DNA, 31 bp, Artificial Sequence
  Description of Artificial Sequence: Synthetic oligonucleotide
atcaagttggccaagatctgaccgtgatggc

SEQ ID NO: 221057 - DNA, 30 bp, Artificial Sequence
  Description of Artificial Sequence: Synthetic oligonucleotide
tcaagttggccaagatctgaccgtgatggc

SEQ ID NO: 221058 - DNA, 29 bp, Artificial Sequence
  Description of Artificial Sequence: Synthetic oligonucleotide
caagttggccaagatctgaccgtgatggc

SEQ ID NO: 221059 - DNA, 29 bp, Artificial Sequence
  Description of Artificial Sequence: Synthetic oligonucleotide
aagttggccaagatctgaccgtgatggcg

SEQ ID NO: 221060 - DNA, 28 bp, Artificial Sequence
  Description of Artificial Sequence: Synthetic oligonucleotide
agttggccaagatctgaccgtgatggcg

SEQ ID NO: 221061 - DNA, 27 bp, Artificial Sequence
  Description of Artificial Sequence: Synthetic oligonucleotide
gttggccaagatctgaccgtgatggcg

SEQ ID NO: 221062 - DNA, 27 bp, Artificial Sequence
  Description of Artificial Sequence: Synthetic oligonucleotide
ttggccaagatctgaccgtgatggcgg

SEQ ID NO: 221063 - DNA, 26 bp, Artificial Sequence
  Description of Artificial Sequence: Synthetic oligonucleotide
tggccaagatctgaccgtgatggcgg

SEQ ID NO: 221064 - DNA, 27 bp, Artificial Sequence
  Description of Artificial Sequence: Synthetic oligonucleotide
ccaagatctgaccgtgatggcggccat

SEQ ID NO: 221065 - DNA, 28 bp, Artificial Sequence
  Description of Artificial Sequence: Synthetic oligonucleotide
caagatctgaccgtgatggcggccattg

SEQ ID NO: 221066 - DNA, 28 bp, Artificial Sequence
  Description of Artificial Sequence: Synthetic oligonucleotide
aagatctgaccgtgatggcggccattgg

SEQ ID NO: 221067 - DNA, 27 bp, Artificial Sequence
  Description of Artificial Sequence: Synthetic oligonucleotide
agatctgaccgtgatggcggccattgg

SEQ ID NO: 221068 - DNA, 26 bp, Artificial Sequence
  Description of Artificial Sequence: Synthetic oligonucleotide
gatctgaccgtgatggcggccattgg

SEQ ID NO: 221069 - DNA, 27 bp, Artificial Sequence
  Description of Artificial Sequence: Synthetic oligonucleotide
atctgaccgtgatggcggccattggct

SEQ ID NO: 221070 - DNA, 27 bp, Artificial Sequence
  Description of Artificial Sequence: Synthetic oligonucleotide
tctgaccgtgatggcggccattggctt

SEQ ID NO: 221071 - DNA, 26 bp, Artificial Sequence
  Description of Artificial Sequence: Synthetic oligonucleotide
ctgaccgtgatggcggccattggctt

SEQ ID NO: 221072 - DNA, 26 bp, Artificial Sequence
  Description of Artificial Sequence: Synthetic oligonucleotide
tgaccgtgatggcggccattggcttg

SEQ ID NO: 221073 - DNA, 25 bp, Artificial Sequence
  Description of Artificial Sequence: Synthetic oligonucleotide
gaccgtgatggcggccattggcttg

SEQ ID NO: 221074 - DNA, 25 bp, Artificial Sequence
  Description of Artificial Sequence: Synthetic oligonucleotide
accgtgatggcggccattggcttgg

SEQ ID NO: 221075 - DNA, 24 bp, Artificial Sequence
  Description of Artificial Sequence: Synthetic oligonucleotide
ccgtgatggcggccattggcttgg

SEQ ID NO: 221076 - DNA, 24 bp, Artificial Sequence
  Description of Artificial Sequence: Synthetic oligonucleotide
cgtgatggcggccattggcttggg

SEQ ID NO: 221077 - DNA, 26 bp, Artificial Sequence
  Description of Artificial Sequence: Synthetic oligonucleotide
gtgatggcggccattggcttgggctt

SEQ ID NO: 221078 - DNA, 26 bp, Artificial Sequence
  Description of Artificial Sequence: Synthetic oligonucleotide
tgatggcggccattggcttgggcttc

SEQ ID NO: 221079 - DNA, 25 bp, Artificial Sequence
  Description of Artificial Sequence: Synthetic oligonucleotide
gatggcggccattggcttgggcttc

SEQ ID NO: 221080 - DNA, 26 bp, Artificial Sequence
  Description of Artificial Sequence: Synthetic oligonucleotide
atggcggccattggcttgggcttcct

SEQ ID NO: 221081 - DNA, 25 bp, Artificial Sequence
  Description of Artificial Sequence: Synthetic oligonucleotide
tggcggccattggcttgggcttcct

SEQ ID NO: 221082 - DNA, 24 bp, Artificial Sequence
  Description of Artificial Sequence: Synthetic oligonucleotide
ggcggccattggcttgggcttcct

SEQ ID NO: 221083 - DNA, 25 bp, Artificial Sequence
  Description of Artificial Sequence: Synthetic oligonucleotide
gcggccattggcttgggcttcctca

SEQ ID NO: 221084 - DNA, 25 bp, Artificial Sequence
  Description of Artificial Sequence: Synthetic oligonucleotide
cggccattggcttgggcttcctcac

SEQ ID NO: 221085 - DNA, 26 bp, Artificial Sequence
  Description of Artificial Sequence: Synthetic oligonucleotide
ggccattggcttgggcttcctcacct

SEQ ID NO: 221086 - DNA, 26 bp, Artificial Sequence
  Description of Artificial Sequence: Synthetic oligonucleotide
gccattggcttgggcttcctcacctc

SEQ ID NO: 221087 - DNA, 27 bp, Artificial Sequence
  Description of Artificial Sequence: Synthetic oligonucleotide
ccattggcttgggcttcctcacctcga

SEQ ID NO: 221088 - DNA, 27 bp, Artificial Sequence
  Description of Artificial Sequence: Synthetic oligonucleotide
cattggcttgggcttcctcacctcgag

SEQ ID NO: 221089 - DNA, 30 bp, Artificial Sequence
  Description of Artificial Sequence: Synthetic oligonucleotide
attggcttgggcttcctcacctcgagtttc

SEQ ID NO: 221090 - DNA, 29 bp, Artificial Sequence
  Description of Artificial Sequence: Synthetic oligonucleotide
ttggcttgggcttcctcacctcgagtttc

SEQ ID NO: 221091 - DNA, 28 bp, Artificial Sequence
  Description of Artificial Sequence: Synthetic oligonucleotide
tggcttgggcttcctcacctcgagtttc

SEQ ID NO: 221092 - DNA, 27 bp, Artificial Sequence
  Description of Artificial Sequence: Synthetic oligonucleotide
ggcttgggcttcctcacctcgagtttc

SEQ ID NO: 221093 - DNA, 27 bp, Artificial Sequence
  Description of Artificial Sequence: Synthetic oligonucleotide
gcttgggcttcctcacctcgagtttcc

SEQ ID NO: 221094 - DNA, 27 bp, Artificial Sequence
  Description of Artificial Sequence: Synthetic oligonucleotide
cttgggcttcctcacctcgagtttccg

SEQ ID NO: 221095 - DNA, 27 bp, Artificial Sequence
  Description of Artificial Sequence: Synthetic oligonucleotide
ttgggcttcctcacctcgagtttccgg

SEQ ID NO: 221096 - DNA, 27 bp, Artificial Sequence
  Description of Artificial Sequence: Synthetic oligonucleotide
tgggcttcctcacctcgagtttccgga

SEQ ID NO: 221097 - DNA, 26 bp, Artificial Sequence
  Description of Artificial Sequence: Synthetic oligonucleotide
gggcttcctcacctcgagtttccgga

SEQ ID NO: 221098 - DNA, 27 bp, Artificial Sequence
  Description of Artificial Sequence: Synthetic oligonucleotide
ggcttcctcacctcgagtttccggaga

SEQ ID NO: 221099 - DNA, 27 bp, Artificial Sequence
  Description of Artificial Sequence: Synthetic oligonucleotide
gcttcctcacctcgagtttccggagac

SEQ ID NO: 221100 - DNA, 28 bp, Artificial Sequence
  Description of Artificial Sequence: Synthetic oligonucleotide
cttcctcacctcgagtttccggagacac

SEQ ID NO: 221101 - DNA, 29 bp, Artificial Sequence
  Description of Artificial Sequence: Synthetic oligonucleotide
ttcctcacctcgagtttccggagacacag

SEQ ID NO: 221102 - DNA, 28 bp, Artificial Sequence
  Description of Artificial Sequence: Synthetic oligonucleotide
tcctcacctcgagtttccggagacacag

SEQ ID NO: 221103 - DNA, 27 bp, Artificial Sequence
  Description of Artificial Sequence: Synthetic oligonucleotide
cctcacctcgagtttccggagacacag

SEQ ID NO: 221104 - DNA, 27 bp, Artificial Sequence
  Description of Artificial Sequence: Synthetic oligonucleotide
ctcacctcgagtttccggagacacagc

SEQ ID NO: 221105 - DNA, 28 bp, Artificial Sequence
  Description of Artificial Sequence: Synthetic oligonucleotide
tcacctcgagtttccggagacacagctg

SEQ ID NO: 221106 - DNA, 27 bp, Artificial Sequence
  Description of Artificial Sequence: Synthetic oligonucleotide
cacctcgagtttccggagacacagctg

SEQ ID NO: 221107 - DNA, 27 bp, Artificial Sequence
  Description of Artificial Sequence: Synthetic oligonucleotide
acctcgagtttccggagacacagctgg

SEQ ID NO: 221108 - DNA, 27 bp, Artificial Sequence
  Description of Artificial Sequence: Synthetic oligonucleotide
cctcgagtttccggagacacagctgga

SEQ ID NO: 221109 - DNA, 27 bp, Artificial Sequence
  Description of Artificial Sequence: Synthetic oligonucleotide
ctcgagtttccggagacacagctggag

SEQ ID NO: 221110 - DNA, 27 bp, Artificial Sequence
  Description of Artificial Sequence: Synthetic oligonucleotide
tcgagtttccggagacacagctggagc

SEQ ID NO: 221111 - DNA, 27 bp, Artificial Sequence
  Description of Artificial Sequence: Synthetic oligonucleotide
cgagtttccggagacacagctggagca

SEQ ID NO: 221112 - DNA, 27 bp, Artificial Sequence
  Description of Artificial Sequence: Synthetic oligonucleotide
gagtttccggagacacagctggagcag

SEQ ID NO: 221113 - DNA, 28 bp, Artificial Sequence
  Description of Artificial Sequence: Synthetic oligonucleotide
agtttccggagacacagctggagcagtg

SEQ ID NO: 221114 - DNA, 27 bp, Artificial Sequence
  Description of Artificial Sequence: Synthetic oligonucleotide
gtttccggagacacagctggagcagtg

SEQ ID NO: 221115 - DNA, 27 bp, Artificial Sequence
  Description of Artificial Sequence: Synthetic oligonucleotide
tggacggcttcctgagccagttccctt

SEQ ID NO: 221116 - DNA, 26 bp, Artificial Sequence
  Description of Artificial Sequence: Synthetic oligonucleotide
ggacggcttcctgagccagttccctt

SEQ ID NO: 221117 - DNA, 27 bp, Artificial Sequence
  Description of Artificial Sequence: Synthetic oligonucleotide
gacggcttcctgagccagttcccttct

SEQ ID NO: 221118 - DNA, 27 bp, Artificial Sequence
  Description of Artificial Sequence: Synthetic oligonucleotide
acggcttcctgagccagttcccttctg

SEQ ID NO: 221119 - DNA, 26 bp, Artificial Sequence
  Description of Artificial Sequence: Synthetic oligonucleotide
cggcttcctgagccagttcccttctg

SEQ ID NO: 221120 - DNA, 26 bp, Artificial Sequence
  Description of Artificial Sequence: Synthetic oligonucleotide
ggcttcctgagccagttcccttctgg

SEQ ID NO: 221121 - DNA, 27 bp, Artificial Sequence
  Description of Artificial Sequence: Synthetic oligonucleotide
gcttcctgagccagttcccttctggga

SEQ ID NO: 221122 - DNA, 28 bp, Artificial Sequence
  Description of Artificial Sequence: Synthetic oligonucleotide
cttcctgagccagttcccttctgggaag

SEQ ID NO: 221123 - DNA, 28 bp, Artificial Sequence
  Description of Artificial Sequence: Synthetic oligonucleotide
ttcctgagccagttcccttctgggaagg

SEQ ID NO: 221124 - DNA, 27 bp, Artificial Sequence
  Description of Artificial Sequence: Synthetic oligonucleotide
tcctgagccagttcccttctgggaagg

SEQ ID NO: 221125 - DNA, 27 bp, Artificial Sequence
  Description of Artificial Sequence: Synthetic oligonucleotide
cctgagccagttcccttctgggaaggt

SEQ ID NO: 221126 - DNA, 27 bp, Artificial Sequence
  Description of Artificial Sequence: Synthetic oligonucleotide
ctgagccagttcccttctgggaaggtg

SEQ ID NO: 221127 - DNA, 27 bp, Artificial Sequence
  Description of Artificial Sequence: Synthetic oligonucleotide
tgagccagttcccttctgggaaggtgg

SEQ ID NO: 221128 - DNA, 27 bp, Artificial Sequence
  Description of Artificial Sequence: Synthetic oligonucleotide
gagccagttcccttctgggaaggtggt

SEQ ID NO: 221129 - DNA, 27 bp, Artificial Sequence
  Description of Artificial Sequence: Synthetic oligonucleotide
agccagttcccttctgggaaggtggtc

SEQ ID NO: 221130 - DNA, 27 bp, Artificial Sequence
  Description of Artificial Sequence: Synthetic oligonucleotide
gccagttcccttctgggaaggtggtca

SEQ ID NO: 221131 - DNA, 28 bp, Artificial Sequence
  Description of Artificial Sequence: Synthetic oligonucleotide
ccagttcccttctgggaaggtggtcatc

SEQ ID NO: 221132 - DNA, 29 bp, Artificial Sequence
  Description of Artificial Sequence: Synthetic oligonucleotide
cagttcccttctgggaaggtggtcatcac

SEQ ID NO: 221133 - DNA, 30 bp, Artificial Sequence
  Description of Artificial Sequence: Synthetic oligonucleotide
agttcccttctgggaaggtggtcatcacac

SEQ ID NO: 221134 - DNA, 29 bp, Artificial Sequence
  Description of Artificial Sequence: Synthetic oligonucleotide
gttcccttctgggaaggtggtcatcacac

SEQ ID NO: 221135 - DNA, 30 bp, Artificial Sequence
  Description of Artificial Sequence: Synthetic oligonucleotide
ttcccttctgggaaggtggtcatcacactg

SEQ ID NO: 221136 - DNA, 29 bp, Artificial Sequence
  Description of Artificial Sequence: Synthetic oligonucleotide
tcccttctgggaaggtggtcatcacactg

SEQ ID NO: 221137 - DNA, 28 bp, Artificial Sequence
  Description of Artificial Sequence: Synthetic oligonucleotide
cccttctgggaaggtggtcatcacactg

SEQ ID NO: 221138 - DNA, 30 bp, Artificial Sequence
  Description of Artificial Sequence: Synthetic oligonucleotide
ccttctgggaaggtggtcatcacactgttc

SEQ ID NO: 221139 - DNA, 31 bp, Artificial Sequence
  Description of Artificial Sequence: Synthetic oligonucleotide
cttctgggaaggtggtcatcacactgttcag

SEQ ID NO: 221140 - DNA, 35 bp, Artificial Sequence
  Description of Artificial Sequence: Synthetic oligonucleotide
ttctgggaaggtggtcatcacactgttcagtattc

SEQ ID NO: 221141 - DNA, 34 bp, Artificial Sequence
  Description of Artificial Sequence: Synthetic oligonucleotide
tctgggaaggtggtcatcacactgttcagtattc

SEQ ID NO: 221142 - DNA, 30 bp, Artificial Sequence
  Description of Artificial Sequence: Synthetic oligonucleotide
agtattcggctggccaccatgagtgctttg

SEQ ID NO: 221143 - DNA, 29 bp, Artificial Sequence
  Description of Artificial Sequence: Synthetic oligonucleotide
gtattcggctggccaccatgagtgctttg

SEQ ID NO: 221144 - DNA, 30 bp, Artificial Sequence
  Description of Artificial Sequence: Synthetic oligonucleotide
tattcggctggccaccatgagtgctttgtc

SEQ ID NO: 221145 - DNA, 29 bp, Artificial Sequence
  Description of Artificial Sequence: Synthetic oligonucleotide
attcggctggccaccatgagtgctttgtc

SEQ ID NO: 221146 - DNA, 28 bp, Artificial Sequence
  Description of Artificial Sequence: Synthetic oligonucleotide
ttcggctggccaccatgagtgctttgtc

SEQ ID NO: 221147 - DNA, 27 bp, Artificial Sequence
  Description of Artificial Sequence: Synthetic oligonucleotide
tcggctggccaccatgagtgctttgtc

SEQ ID NO: 221148 - DNA, 26 bp, Artificial Sequence
  Description of Artificial Sequence: Synthetic oligonucleotide
cggctggccaccatgagtgctttgtc

SEQ ID NO: 221149 - DNA, 26 bp, Artificial Sequence
  Description of Artificial Sequence: Synthetic oligonucleotide
ggctggccaccatgagtgctttgtcg

SEQ ID NO: 221150 - DNA, 27 bp, Artificial Sequence
  Description of Artificial Sequence: Synthetic oligonucleotide
gctggccaccatgagtgctttgtcggt

SEQ ID NO: 221151 - DNA, 27 bp, Artificial Sequence
  Description of Artificial Sequence: Synthetic oligonucleotide
ctggccaccatgagtgctttgtcggtg

SEQ ID NO: 221152 - DNA, 27 bp, Artificial Sequence
  Description of Artificial Sequence: Synthetic oligonucleotide
tggccaccatgagtgctttgtcggtgc

SEQ ID NO: 221153 - DNA, 27 bp, Artificial Sequence
  Description of Artificial Sequence: Synthetic oligonucleotide
ggccaccatgagtgctttgtcggtgct

SEQ ID NO: 221154 - DNA, 27 bp, Artificial Sequence
  Description of Artificial Sequence: Synthetic oligonucleotide
gccaccatgagtgctttgtcggtgctg

SEQ ID NO: 221155 - DNA, 29 bp, Artificial Sequence
  Description of Artificial Sequence: Synthetic oligonucleotide
ccaccatgagtgctttgtcggtgctgatc

SEQ ID NO: 221156 - DNA, 30 bp, Artificial Sequence
  Description of Artificial Sequence: Synthetic oligonucleotide
caccatgagtgctttgtcggtgctgatctc

SEQ ID NO: 221157 - DNA, 31 bp, Artificial Sequence
  Description of Artificial Sequence: Synthetic oligonucleotide
accatgagtgctttgtcggtgctgatctcag

SEQ ID NO: 221158 - DNA, 30 bp, Artificial Sequence
  Description of Artificial Sequence: Synthetic oligonucleotide
ccatgagtgctttgtcggtgctgatctcag

SEQ ID NO: 221159 - DNA, 31 bp, Artificial Sequence
  Description of Artificial Sequence: Synthetic oligonucleotide
catgagtgctttgtcggtgctgatctcagtg

SEQ ID NO: 221160 - DNA, 31 bp, Artificial Sequence
  Description of Artificial Sequence: Synthetic oligonucleotide
atgagtgctttgtcggtgctgatctcagtgg

SEQ ID NO: 221161 - DNA, 30 bp, Artificial Sequence
  Description of Artificial Sequence: Synthetic oligonucleotide
tgagtgctttgtcggtgctgatctcagtgg

SEQ ID NO: 221162 - DNA, 29 bp, Artificial Sequence
  Description of Artificial Sequence: Synthetic oligonucleotide
gagtgctttgtcggtgctgatctcagtgg

SEQ ID NO: 221163 - DNA, 31 bp, Artificial Sequence
  Description of Artificial Sequence: Synthetic oligonucleotide
agtgctttgtcggtgctgatctcagtggatg

SEQ ID NO: 221164 - DNA, 30 bp, Artificial Sequence
  Description of Artificial Sequence: Synthetic oligonucleotide
gtgctttgtcggtgctgatctcagtggatg

SEQ ID NO: 221165 - DNA, 30 bp, Artificial Sequence
  Description of Artificial Sequence: Synthetic oligonucleotide
tgctttgtcggtgctgatctcagtggatgc

SEQ ID NO: 221166 - DNA, 29 bp, Artificial Sequence
  Description of Artificial Sequence: Synthetic oligonucleotide
gctttgtcggtgctgatctcagtggatgc

SEQ ID NO: 221167 - DNA, 30 bp, Artificial Sequence
  Description of Artificial Sequence: Synthetic oligonucleotide
ctttgtcggtgctgatctcagtggatgctg

SEQ ID NO: 221168 - DNA, 31 bp, Artificial Sequence
  Description of Artificial Sequence: Synthetic oligonucleotide
tttgtcggtgctgatctcagtggatgctgtc

SEQ ID NO: 221169 - DNA, 30 bp, Artificial Sequence
  Description of Artificial Sequence: Synthetic oligonucleotide
ttgtcggtgctgatctcagtggatgctgtc

SEQ ID NO: 221170 - DNA, 29 bp, Artificial Sequence
  Description of Artificial Sequence: Synthetic oligonucleotide
tgtcggtgctgatctcagtggatgctgtc

SEQ ID NO: 221171 - DNA, 28 bp, Artificial Sequence
  Description of Artificial Sequence: Synthetic oligonucleotide
gtcggtgctgatctcagtggatgctgtc

SEQ ID NO: 221172 - DNA, 30 bp, Artificial Sequence
  Description of Artificial Sequence: Synthetic oligonucleotide
tcggtgctgatctcagtggatgctgtcttg

SEQ ID NO: 221173 - DNA, 29 bp, Artificial Sequence
  Description of Artificial Sequence: Synthetic oligonucleotide
cggtgctgatctcagtggatgctgtcttg

SEQ ID NO: 221174 - DNA, 29 bp, Artificial Sequence
  Description of Artificial Sequence: Synthetic oligonucleotide
ggtgctgatctcagtggatgctgtcttgg

SEQ ID NO: 221175 - DNA, 29 bp, Artificial Sequence
  Description of Artificial Sequence: Synthetic oligonucleotide
gtgctgatctcagtggatgctgtcttggg

SEQ ID NO: 221176 - DNA, 29 bp, Artificial Sequence
  Description of Artificial Sequence: Synthetic oligonucleotide
tgctgatctcagtggatgctgtcttgggg

SEQ ID NO: 221177 - DNA, 28 bp, Artificial Sequence
  Description of Artificial Sequence: Synthetic oligonucleotide
gctgatctcagtggatgctgtcttgggg

SEQ ID NO: 221178 - DNA, 30 bp, Artificial Sequence
  Description of Artificial Sequence: Synthetic oligonucleotide
ctgatctcagtggatgctgtcttggggaag

SEQ ID NO: 221179 - DNA, 30 bp, Artificial Sequence
  Description of Artificial Sequence: Synthetic oligonucleotide
tgatctcagtggatgctgtcttggggaagg

SEQ ID NO: 221180 - DNA, 29 bp, Artificial Sequence
  Description of Artificial Sequence: Synthetic oligonucleotide
gatctcagtggatgctgtcttggggaagg

SEQ ID NO: 221181 - DNA, 30 bp, Artificial Sequence
  Description of Artificial Sequence: Synthetic oligonucleotide
atctcagtggatgctgtcttggggaaggtc

SEQ ID NO: 221182 - DNA, 29 bp, Artificial Sequence
  Description of Artificial Sequence: Synthetic oligonucleotide
tctcagtggatgctgtcttggggaaggtc

SEQ ID NO: 221183 - DNA, 28 bp, Artificial Sequence
  Description of Artificial Sequence: Synthetic oligonucleotide
ctcagtggatgctgtcttggggaaggtc

SEQ ID NO: 221184 - DNA, 30 bp, Artificial Sequence
  Description of Artificial Sequence: Synthetic oligonucleotide
tcagtggatgctgtcttggggaaggtcaac

SEQ ID NO: 221185 - DNA, 29 bp, Artificial Sequence
  Description of Artificial Sequence: Synthetic oligonucleotide
cagtggatgctgtcttggggaaggtcaac

SEQ ID NO: 221186 - DNA, 31 bp, Artificial Sequence
  Description of Artificial Sequence: Synthetic oligonucleotide
agtggatgctgtcttggggaaggtcaacttg

SEQ ID NO: 221187 - DNA, 30 bp, Artificial Sequence
  Description of Artificial Sequence: Synthetic oligonucleotide
gtggatgctgtcttggggaaggtcaacttg

SEQ ID NO: 221188 - DNA, 30 bp, Artificial Sequence
  Description of Artificial Sequence: Synthetic oligonucleotide
tggatgctgtcttggggaaggtcaacttgg

SEQ ID NO: 221189 - DNA, 29 bp, Artificial Sequence
  Description of Artificial Sequence: Synthetic oligonucleotide
ggatgctgtcttggggaaggtcaacttgg

SEQ ID NO: 221190 - DNA, 29 bp, Artificial Sequence
  Description of Artificial Sequence: Synthetic oligonucleotide
gatgctgtcttggggaaggtcaacttggc

SEQ ID NO: 221191 - DNA, 29 bp, Artificial Sequence
  Description of Artificial Sequence: Synthetic oligonucleotide
atgctgtcttggggaaggtcaacttggcg

SEQ ID NO: 221192 - DNA, 29 bp, Artificial Sequence
  Description of Artificial Sequence: Synthetic oligonucleotide
tgctggtggaggtgacagctttaggcaac

SEQ ID NO: 221193 - DNA, 28 bp, Artificial Sequence
  Description of Artificial Sequence: Synthetic oligonucleotide
gctggtggaggtgacagctttaggcaac

SEQ ID NO: 221194 - DNA, 28 bp, Artificial Sequence
  Description of Artificial Sequence: Synthetic oligonucleotide
ctggtggaggtgacagctttaggcaacc

SEQ ID NO: 221195 - DNA, 29 bp, Artificial Sequence
  Description of Artificial Sequence: Synthetic oligonucleotide
tggtggaggtgacagctttaggcaacctg

SEQ ID NO: 221196 - DNA, 28 bp, Artificial Sequence
  Description of Artificial Sequence: Synthetic oligonucleotide
ggtggaggtgacagctttaggcaacctg

SEQ ID NO: 221197 - DNA, 29 bp, Artificial Sequence
  Description of Artificial Sequence: Synthetic oligonucleotide
gtggaggtgacagctttaggcaacctgag

SEQ ID NO: 221198 - DNA, 29 bp, Artificial Sequence
  Description of Artificial Sequence: Synthetic oligonucleotide
tggaggtgacagctttaggcaacctgagg

SEQ ID NO: 221199 - DNA, 28 bp, Artificial Sequence
  Description of Artificial Sequence: Synthetic oligonucleotide
ggaggtgacagctttaggcaacctgagg

SEQ ID NO: 221200 - DNA, 30 bp, Artificial Sequence
  Description of Artificial Sequence: Synthetic oligonucleotide
gaggtgacagctttaggcaacctgaggatg

SEQ ID NO: 221201 - DNA, 30 bp, Artificial Sequence
  Description of Artificial Sequence: Synthetic oligonucleotide
aggtgacagctttaggcaacctgaggatgg

SEQ ID NO: 221202 - DNA, 29 bp, Artificial Sequence
  Description of Artificial Sequence: Synthetic oligonucleotide
ggtgacagctttaggcaacctgaggatgg

SEQ ID NO: 221203 - DNA, 30 bp, Artificial Sequence
  Description of Artificial Sequence: Synthetic oligonucleotide
gtgacagctttaggcaacctgaggatggtc

SEQ ID NO: 221204 - DNA, 32 bp, Artificial Sequence
  Description of Artificial Sequence: Synthetic oligonucleotide
tgacagctttaggcaacctgaggatggtcatc

SEQ ID NO: 221205 - DNA, 31 bp, Artificial Sequence
  Description of Artificial Sequence: Synthetic oligonucleotide
gacagctttaggcaacctgaggatggtcatc

SEQ ID NO: 221206 - DNA, 32 bp, Artificial Sequence
  Description of Artificial Sequence: Synthetic oligonucleotide
acagctttaggcaacctgaggatggtcatcag

SEQ ID NO: 221207 - DNA, 31 bp, Artificial Sequence
  Description of Artificial Sequence: Synthetic oligonucleotide
cagctttaggcaacctgaggatggtcatcag

SEQ ID NO: 221208 - DNA, 37 bp, Artificial Sequence
  Description of Artificial Sequence: Synthetic oligonucleotide
agctttaggcaacctgaggatggtcatcagtaatatc

SEQ ID NO: 221209 - DNA, 36 bp, Artificial Sequence
  Description of Artificial Sequence: Synthetic oligonucleotide
gctttaggcaacctgaggatggtcatcagtaatatc

SEQ ID NO: 221210 - DNA, 38 bp, Artificial Sequence
  Description of Artificial Sequence: Synthetic oligonucleotide
ctttaggcaacctgaggatggtcatcagtaatatcttc

SEQ ID NO: 221211 - DNA, 40 bp, Artificial Sequence
  Description of Artificial Sequence: Synthetic oligonucleotide
tttaggcaacctgaggatggtcatcagtaatatcttcaac

SEQ ID NO: 221212 - DNA, 39 bp, Artificial Sequence
  Description of Artificial Sequence: Synthetic oligonucleotide
ttaggcaacctgaggatggtcatcagtaatatcttcaac

SEQ ID NO: 221213 - DNA, 38 bp, Artificial Sequence
  Description of Artificial Sequence: Synthetic oligonucleotide
taggcaacctgaggatggtcatcagtaatatcttcaac

SEQ ID NO: 221214 - DNA, 37 bp, Artificial Sequence
  Description of Artificial Sequence: Synthetic oligonucleotide
aggcaacctgaggatggtcatcagtaatatcttcaac

SEQ ID NO: 221215 - DNA, 36 bp, Artificial Sequence
  Description of Artificial Sequence: Synthetic oligonucleotide
ggcaacctgaggatggtcatcagtaatatcttcaac

SEQ ID NO: 221216 - DNA, 37 bp, Artificial Sequence
  Description of Artificial Sequence: Synthetic oligonucleotide
gcaacctgaggatggtcatcagtaatatcttcaacac

SEQ ID NO: 221217 - DNA, 38 bp, Artificial Sequence
  Description of Artificial Sequence: Synthetic oligonucleotide
caacctgaggatggtcatcagtaatatcttcaacacag

SEQ ID NO: 221218 - DNA, 39 bp, Artificial Sequence
  Description of Artificial Sequence: Synthetic oligonucleotide
aacctgaggatggtcatcagtaatatcttcaacacagac

SEQ ID NO: 221219 - DNA, 38 bp, Artificial Sequence
  Description of Artificial Sequence: Synthetic oligonucleotide
acctgaggatggtcatcagtaatatcttcaacacagac

SEQ ID NO: 221220 - DNA, 34 bp, Artificial Sequence
  Description of Artificial Sequence: Synthetic oligonucleotide
ttcttgtggatgttctggccaagtgtcaactctc

SEQ ID NO: 221221 - DNA, 33 bp, Artificial Sequence
  Description of Artificial Sequence: Synthetic oligonucleotide
tcttgtggatgttctggccaagtgtcaactctc

SEQ ID NO: 221222 - DNA, 32 bp, Artificial Sequence
  Description of Artificial Sequence: Synthetic oligonucleotide
cttgtggatgttctggccaagtgtcaactctc

SEQ ID NO: 221223 - DNA, 32 bp, Artificial Sequence
  Description of Artificial Sequence: Synthetic oligonucleotide
ttgtggatgttctggccaagtgtcaactctcc

SEQ ID NO: 221224 - DNA, 31 bp, Artificial Sequence
  Description of Artificial Sequence: Synthetic oligonucleotide
tgtggatgttctggccaagtgtcaactctcc

SEQ ID NO: 221225 - DNA, 30 bp, Artificial Sequence
  Description of Artificial Sequence: Synthetic oligonucleotide
gtggatgttctggccaagtgtcaactctcc

SEQ ID NO: 221226 - DNA, 31 bp, Artificial Sequence
  Description of Artificial Sequence: Synthetic oligonucleotide
tggatgttctggccaagtgtcaactctcctc

SEQ ID NO: 221227 - DNA, 30 bp, Artificial Sequence
  Description of Artificial Sequence: Synthetic oligonucleotide
ggatgttctggccaagtgtcaactctcctc

SEQ ID NO: 221228 - DNA, 31 bp, Artificial Sequence
  Description of Artificial Sequence: Synthetic oligonucleotide
gatgttctggccaagtgtcaactctcctctg

SEQ ID NO: 221229 - DNA, 31 bp, Artificial Sequence
  Description of Artificial Sequence: Synthetic oligonucleotide
atgttctggccaagtgtcaactctcctctgc

SEQ ID NO: 221230 - DNA, 30 bp, Artificial Sequence
  Description of Artificial Sequence: Synthetic oligonucleotide
tgttctggccaagtgtcaactctcctctgc

SEQ ID NO: 221231 - DNA, 29 bp, Artificial Sequence
  Description of Artificial Sequence: Synthetic oligonucleotide
gttctggccaagtgtcaactctcctctgc

SEQ ID NO: 221232 - DNA, 30 bp, Artificial Sequence
  Description of Artificial Sequence: Synthetic oligonucleotide
ttctggccaagtgtcaactctcctctgctg

SEQ ID NO: 221233 - DNA, 29 bp, Artificial Sequence
  Description of Artificial Sequence: Synthetic oligonucleotide
tctggccaagtgtcaactctcctctgctg

SEQ ID NO: 221234 - DNA, 28 bp, Artificial Sequence
  Description of Artificial Sequence: Synthetic oligonucleotide
ctggccaagtgtcaactctcctctgctg

SEQ ID NO: 221235 - DNA, 29 bp, Artificial Sequence
  Description of Artificial Sequence: Synthetic oligonucleotide
tggccaagtgtcaactctcctctgctgag

SEQ ID NO: 221236 - DNA, 28 bp, Artificial Sequence
  Description of Artificial Sequence: Synthetic oligonucleotide
ggccaagtgtcaactctcctctgctgag

SEQ ID NO: 221237 - DNA, 30 bp, Artificial Sequence
  Description of Artificial Sequence: Synthetic oligonucleotide
gccaagtgtcaactctcctctgctgagaag

SEQ ID NO: 221238 - DNA, 31 bp, Artificial Sequence
  Description of Artificial Sequence: Synthetic oligonucleotide
ccaagtgtcaactctcctctgctgagaagtc

SEQ ID NO: 221239 - DNA, 31 bp, Artificial Sequence
  Description of Artificial Sequence: Synthetic oligonucleotide
caagtgtcaactctcctctgctgagaagtcc

SEQ ID NO: 221240 - DNA, 34 bp, Artificial Sequence
  Description of Artificial Sequence: Synthetic oligonucleotide
aagtgtcaactctcctctgctgagaagtccaatc

SEQ ID NO: 221241 - DNA, 33 bp, Artificial Sequence
  Description of Artificial Sequence: Synthetic oligonucleotide
agtgtcaactctcctctgctgagaagtccaatc

SEQ ID NO: 221242 - DNA, 32 bp, Artificial Sequence
  Description of Artificial Sequence: Synthetic oligonucleotide
gtgtcaactctcctctgctgagaagtccaatc

SEQ ID NO: 221243 - DNA, 32 bp, Artificial Sequence
  Description of Artificial Sequence: Synthetic oligonucleotide
tgtcaactctcctctgctgagaagtccaatcc

SEQ ID NO: 221244 - DNA, 31 bp, Artificial Sequence
  Description of Artificial Sequence: Synthetic oligonucleotide
gtcaactctcctctgctgagaagtccaatcc

SEQ ID NO: 221245 - DNA, 34 bp, Artificial Sequence
  Description of Artificial Sequence: Synthetic oligonucleotide
tcaactctcctctgctgagaagtccaatccaaag

SEQ ID NO: 221246 - DNA, 33 bp, Artificial Sequence
  Description of Artificial Sequence: Synthetic oligonucleotide
caactctcctctgctgagaagtccaatccaaag

SEQ ID NO: 221247 - DNA, 33 bp, Artificial Sequence
  Description of Artificial Sequence: Synthetic oligonucleotide
aactctcctctgctgagaagtccaatccaaagg

SEQ ID NO: 221248 - DNA, 32 bp, Artificial Sequence
  Description of Artificial Sequence: Synthetic oligonucleotide
actctcctctgctgagaagtccaatccaaagg

SEQ ID NO: 221249 - DNA, 31 bp, Artificial Sequence
  Description of Artificial Sequence: Synthetic oligonucleotide
ctctcctctgctgagaagtccaatccaaagg

SEQ ID NO: 221250 - DNA, 33 bp, Artificial Sequence
  Description of Artificial Sequence: Synthetic oligonucleotide
tctcctctgctgagaagtccaatccaaaggaag

SEQ ID NO: 221251 - DNA, 32 bp, Artificial Sequence
  Description of Artificial Sequence: Synthetic oligonucleotide
ctcctctgctgagaagtccaatccaaaggaag

SEQ ID NO: 221252 - DNA, 35 bp, Artificial Sequence
  Description of Artificial Sequence: Synthetic oligonucleotide
tcctctgctgagaagtccaatccaaaggaagaatg

SEQ ID NO: 221253 - DNA, 34 bp, Artificial Sequence
  Description of Artificial Sequence: Synthetic oligonucleotide
cctctgctgagaagtccaatccaaaggaagaatg

SEQ ID NO: 221254 - DNA, 24 bp, Artificial Sequence
  Description of Artificial Sequence: Synthetic oligonucleotide
ggggagccaagtgcctgccggatt

SEQ ID NO: 221255 - DNA, 24 bp, Artificial Sequence
  Description of Artificial Sequence: Synthetic oligonucleotide
gggagccaagtgcctgccggattg

SEQ ID NO: 221256 - DNA, 24 bp, Artificial Sequence
  Description of Artificial Sequence: Synthetic oligonucleotide
ggagccaagtgcctgccggattgg

SEQ ID NO: 221257 - DNA, 26 bp, Artificial Sequence
  Description of Artificial Sequence: Synthetic oligonucleotide
gagccaagtgcctgccggattggctt

SEQ ID NO: 221258 - DNA, 26 bp, Artificial Sequence
  Description of Artificial Sequence: Synthetic oligonucleotide
agccaagtgcctgccggattggcttc

SEQ ID NO: 221259 - DNA, 25 bp, Artificial Sequence
  Description of Artificial Sequence: Synthetic oligonucleotide
gccaagtgcctgccggattggcttc

SEQ ID NO: 221260 - DNA, 26 bp, Artificial Sequence
  Description of Artificial Sequence: Synthetic oligonucleotide
ccaagtgcctgccggattggcttcca

SEQ ID NO: 221261 - DNA, 26 bp, Artificial Sequence
  Description of Artificial Sequence: Synthetic oligonucleotide
caagtgcctgccggattggcttccag

SEQ ID NO: 221262 - DNA, 27 bp, Artificial Sequence
  Description of Artificial Sequence: Synthetic oligonucleotide
aagtgcctgccggattggcttccaggt

SEQ ID NO: 221263 - DNA, 26 bp, Artificial Sequence
  Description of Artificial Sequence: Synthetic oligonucleotide
agtgcctgccggattggcttccaggt

SEQ ID NO: 221264 - DNA, 25 bp, Artificial Sequence
  Description of Artificial Sequence: Synthetic oligonucleotide
gtgcctgccggattggcttccaggt

SEQ ID NO: 221265 - DNA, 25 bp, Artificial Sequence
  Description of Artificial Sequence: Synthetic oligonucleotide
tgcctgccggattggcttccaggtc

SEQ ID NO: 221266 - DNA, 24 bp, Artificial Sequence
  Description of Artificial Sequence: Synthetic oligonucleotide
gcctgccggattggcttccaggtc

SEQ ID NO: 221267 - DNA, 25 bp, Artificial Sequence
  Description of Artificial Sequence: Synthetic oligonucleotide
cctgccggattggcttccaggtcct

SEQ ID NO: 221268 - DNA, 25 bp, Artificial Sequence
  Description of Artificial Sequence: Synthetic oligonucleotide
ctgccggattggcttccaggtcctc

SEQ ID NO: 221269 - DNA, 26 bp, Artificial Sequence
  Description of Artificial Sequence: Synthetic oligonucleotide
tgccggattggcttccaggtcctcct

SEQ ID NO: 221270 - DNA, 25 bp, Artificial Sequence
  Description of Artificial Sequence: Synthetic oligonucleotide
gccggattggcttccaggtcctcct

SEQ ID NO: 221271 - DNA, 26 bp, Artificial Sequence
  Description of Artificial Sequence: Synthetic oligonucleotide
ccggattggcttccaggtcctcctca

SEQ ID NO: 221272 - DNA, 26 bp, Artificial Sequence
  Description of Artificial Sequence: Synthetic oligonucleotide
cggattggcttccaggtcctcctcag

SEQ ID NO: 221273 - DNA, 27 bp, Artificial Sequence
  Description of Artificial Sequence: Synthetic oligonucleotide
ggattggcttccaggtcctcctcagca

SEQ ID NO: 221274 - DNA, 36 bp, Artificial Sequence
  Description of Artificial Sequence: Synthetic oligonucleotide
gcaacctgaggatggtcatcagtaatatcttcaacg

SEQ ID NO: 221275 - DNA, 37 bp, Artificial Sequence
  Description of Artificial Sequence: Synthetic oligonucleotide
caacctgaggatggtcatcagtaatatcttcaacgtg

SEQ ID NO: 221276 - DNA, 38 bp, Artificial Sequence
  Description of Artificial Sequence: Synthetic oligonucleotide
aacctgaggatggtcatcagtaatatcttcaacgtgtg

SEQ ID NO: 221277 - DNA, 37 bp, Artificial Sequence
  Description of Artificial Sequence: Synthetic oligonucleotide
acctgaggatggtcatcagtaatatcttcaacgtgtg

SEQ ID NO: 221278 - DNA, 36 bp, Artificial Sequence
  Description of Artificial Sequence: Synthetic oligonucleotide
cctgaggatggtcatcagtaatatcttcaacgtgtg

SEQ ID NO: 221279 - DNA, 38 bp, Artificial Sequence
  Description of Artificial Sequence: Synthetic oligonucleotide
ctgaggatggtcatcagtaatatcttcaacgtgtgttg

SEQ ID NO: 221280 - DNA, 41 bp, Artificial Sequence
  Description of Artificial Sequence: Synthetic oligonucleotide
tgaggatggtcatcagtaatatcttcaacgtgtgttgtaac

SEQ ID NO: 221281 - DNA, 40 bp, Artificial Sequence
  Description of Artificial Sequence: Synthetic oligonucleotide
gaggatggtcatcagtaatatcttcaacgtgtgttgtaac

SEQ ID NO: 221282 - DNA, 40 bp, Artificial Sequence
  Description of Artificial Sequence: Synthetic oligonucleotide
aggatggtcatcagtaatatcttcaacgtgtgttgtaacc

SEQ ID NO: 221283 - DNA, 39 bp, Artificial Sequence
  Description of Artificial Sequence: Synthetic oligonucleotide
ggatggtcatcagtaatatcttcaacgtgtgttgtaacc

SEQ ID NO: 221284 - DNA, 39 bp, Artificial Sequence
  Description of Artificial Sequence: Synthetic oligonucleotide
gatggtcatcagtaatatcttcaacgtgtgttgtaaccg

SEQ ID NO: 221285 - DNA, 40 bp, Artificial Sequence
  Description of Artificial Sequence: Synthetic oligonucleotide
atggtcatcagtaatatcttcaacgtgtgttgtaaccgag

SEQ ID NO: 221286 - DNA, 39 bp, Artificial Sequence
  Description of Artificial Sequence: Synthetic oligonucleotide
tggtcatcagtaatatcttcaacgtgtgttgtaaccgag

SEQ ID NO: 221287 - DNA, 38 bp, Artificial Sequence
  Description of Artificial Sequence: Synthetic oligonucleotide
ggtcatcagtaatatcttcaacgtgtgttgtaaccgag

SEQ ID NO: 221288 - DNA, 39 bp, Artificial Sequence
  Description of Artificial Sequence: Synthetic oligonucleotide
gtcatcagtaatatcttcaacgtgtgttgtaaccgagtg

SEQ ID NO: 221289 - DNA, 39 bp, Artificial Sequence
  Description of Artificial Sequence: Synthetic oligonucleotide
tcatcagtaatatcttcaacgtgtgttgtaaccgagtgc

SEQ ID NO: 221290 - DNA, 38 bp, Artificial Sequence
  Description of Artificial Sequence: Synthetic oligonucleotide
catcagtaatatcttcaacgtgtgttgtaaccgagtgc

SEQ ID NO: 221291 - DNA, 39 bp, Artificial Sequence
  Description of Artificial Sequence: Synthetic oligonucleotide
atcagtaatatcttcaacgtgtgttgtaaccgagtgctg

SEQ ID NO: 221292 - DNA, 38 bp, Artificial Sequence
  Description of Artificial Sequence: Synthetic oligonucleotide
tcagtaatatcttcaacgtgtgttgtaaccgagtgctg

SEQ ID NO: 221293 - DNA, 37 bp, Artificial Sequence
  Description of Artificial Sequence: Synthetic oligonucleotide
cagtaatatcttcaacgtgtgttgtaaccgagtgctg

SEQ ID NO: 221294 - DNA, 37 bp, Artificial Sequence
  Description of Artificial Sequence: Synthetic oligonucleotide
agtaatatcttcaacgtgtgttgtaaccgagtgctgg

SEQ ID NO: 221295 - DNA, 36 bp, Artificial Sequence
  Description of Artificial Sequence: Synthetic oligonucleotide
gtaatatcttcaacgtgtgttgtaaccgagtgctgg

SEQ ID NO: 221296 - DNA, 36 bp, Artificial Sequence
  Description of Artificial Sequence: Synthetic oligonucleotide
taatatcttcaacgtgtgttgtaaccgagtgctggg

SEQ ID NO: 221297 - DNA, 35 bp, Artificial Sequence
  Description of Artificial Sequence: Synthetic oligonucleotide
aatatcttcaacgtgtgttgtaaccgagtgctggg

SEQ ID NO: 221298 - DNA, 34 bp, Artificial Sequence
  Description of Artificial Sequence: Synthetic oligonucleotide
atatcttcaacgtgtgttgtaaccgagtgctggg

SEQ ID NO: 221299 - DNA, 33 bp, Artificial Sequence
  Description of Artificial Sequence: Synthetic oligonucleotide
tatcttcaacgtgtgttgtaaccgagtgctggg

SEQ ID NO: 221300 - DNA, 32 bp, Artificial Sequence
  Description of Artificial Sequence: Synthetic oligonucleotide
atcttcaacgtgtgttgtaaccgagtgctggg

SEQ ID NO: 221301 - DNA, 31 bp, Artificial Sequence
  Description of Artificial Sequence: Synthetic oligonucleotide
tcttcaacgtgtgttgtaaccgagtgctggg

SEQ ID NO: 221302 - DNA, 30 bp, Artificial Sequence
  Description of Artificial Sequence: Synthetic oligonucleotide
cttcaacgtgtgttgtaaccgagtgctggg

SEQ ID NO: 221303 - DNA, 30 bp, Artificial Sequence
  Description of Artificial Sequence: Synthetic oligonucleotide
ttcaacgtgtgttgtaaccgagtgctgggg

SEQ ID NO: 221304 - DNA, 29 bp, Artificial Sequence
  Description of Artificial Sequence: Synthetic oligonucleotide
tcaacgtgtgttgtaaccgagtgctgggg

SEQ ID NO: 221305 - DNA, 28 bp, Artificial Sequence
  Description of Artificial Sequence: Synthetic oligonucleotide
caacgtgtgttgtaaccgagtgctgggg

SEQ ID NO: 221306 - DNA, 31 bp, Artificial Sequence
  Description of Artificial Sequence: Synthetic oligonucleotide
aacgtgtgttgtaaccgagtgctggggattc

SEQ ID NO: 221307 - DNA, 30 bp, Artificial Sequence
  Description of Artificial Sequence: Synthetic oligonucleotide
acgtgtgttgtaaccgagtgctggggattc

SEQ ID NO: 221308 - DNA, 29 bp, Artificial Sequence
  Description of Artificial Sequence: Synthetic oligonucleotide
cgtgtgttgtaaccgagtgctggggattc

SEQ ID NO: 221309 - DNA, 41 bp, Artificial Sequence
  Description of Artificial Sequence: Synthetic oligonucleotide
caacctgaggatggtcatcagtaatatcttcaacacttatg

SEQ ID NO: 221310 - DNA, 42 bp, Artificial Sequence
  Description of Artificial Sequence: Synthetic oligonucleotide
aacctgaggatggtcatcagtaatatcttcaacacttatgtg

SEQ ID NO: 221311 - DNA, 41 bp, Artificial Sequence
  Description of Artificial Sequence: Synthetic oligonucleotide
acctgaggatggtcatcagtaatatcttcaacacttatgtg

SEQ ID NO: 221312 - DNA, 40 bp, Artificial Sequence
  Description of Artificial Sequence: Synthetic oligonucleotide
cctgaggatggtcatcagtaatatcttcaacacttatgtg

SEQ ID NO: 221313 - DNA, 40 bp, Artificial Sequence
  Description of Artificial Sequence: Synthetic oligonucleotide
ctgaggatggtcatcagtaatatcttcaacacttatgtgc

SEQ ID NO: 221314 - DNA, 41 bp, Artificial Sequence
  Description of Artificial Sequence: Synthetic oligonucleotide
tgaggatggtcatcagtaatatcttcaacacttatgtgcac

SEQ ID NO: 221315 - DNA, 40 bp, Artificial Sequence
  Description of Artificial Sequence: Synthetic oligonucleotide
gaggatggtcatcagtaatatcttcaacacttatgtgcac

SEQ ID NO: 221316 - DNA, 41 bp, Artificial Sequence
  Description of Artificial Sequence: Synthetic oligonucleotide
aggatggtcatcagtaatatcttcaacacttatgtgcacag

SEQ ID NO: 221317 - DNA, 40 bp, Artificial Sequence
  Description of Artificial Sequence: Synthetic oligonucleotide
ggatggtcatcagtaatatcttcaacacttatgtgcacag

SEQ ID NO: 221318 - DNA, 41 bp, Artificial Sequence
  Description of Artificial Sequence: Synthetic oligonucleotide
gatggtcatcagtaatatcttcaacacttatgtgcacagtg

SEQ ID NO: 221319 - DNA, 41 bp, Artificial Sequence
  Description of Artificial Sequence: Synthetic oligonucleotide
atggtcatcagtaatatcttcaacacttatgtgcacagtgc

SEQ ID NO: 221320 - DNA, 40 bp, Artificial Sequence
  Description of Artificial Sequence: Synthetic oligonucleotide
tggtcatcagtaatatcttcaacacttatgtgcacagtgc

SEQ ID NO: 221321 - DNA, 39 bp, Artificial Sequence
  Description of Artificial Sequence: Synthetic oligonucleotide
ggtcatcagtaatatcttcaacacttatgtgcacagtgc

SEQ ID NO: 221322 - DNA, 39 bp, Artificial Sequence
  Description of Artificial Sequence: Synthetic oligonucleotide
gtcatcagtaatatcttcaacacttatgtgcacagtgcg

SEQ ID NO: 221323 - DNA, 39 bp, Artificial Sequence
  Description of Artificial Sequence: Synthetic oligonucleotide
tcatcagtaatatcttcaacacttatgtgcacagtgcgg

SEQ ID NO: 221324 - DNA, 38 bp, Artificial Sequence
  Description of Artificial Sequence: Synthetic oligonucleotide
catcagtaatatcttcaacacttatgtgcacagtgcgg

SEQ ID NO: 221325 - DNA, 39 bp, Artificial Sequence
  Description of Artificial Sequence: Synthetic oligonucleotide
atcagtaatatcttcaacacttatgtgcacagtgcggtg

SEQ ID NO: 221326 - DNA, 38 bp, Artificial Sequence
  Description of Artificial Sequence: Synthetic oligonucleotide
tcagtaatatcttcaacacttatgtgcacagtgcggtg

SEQ ID NO: 221327 - DNA, 37 bp, Artificial Sequence
  Description of Artificial Sequence: Synthetic oligonucleotide
cagtaatatcttcaacacttatgtgcacagtgcggtg

SEQ ID NO: 221328 - DNA, 39 bp, Artificial Sequence
  Description of Artificial Sequence: Synthetic oligonucleotide
agtaatatcttcaacacttatgtgcacagtgcggtgttg

SEQ ID NO: 221329 - DNA, 38 bp, Artificial Sequence
  Description of Artificial Sequence: Synthetic oligonucleotide
gtaatatcttcaacacttatgtgcacagtgcggtgttg

SEQ ID NO: 221330 - DNA, 38 bp, Artificial Sequence
  Description of Artificial Sequence: Synthetic oligonucleotide
taatatcttcaacacttatgtgcacagtgcggtgttgg

SEQ ID NO: 221331 - DNA, 37 bp, Artificial Sequence
  Description of Artificial Sequence: Synthetic oligonucleotide
aatatcttcaacacttatgtgcacagtgcggtgttgg

SEQ ID NO: 221332 - DNA, 36 bp, Artificial Sequence
  Description of Artificial Sequence: Synthetic oligonucleotide
atatcttcaacacttatgtgcacagtgcggtgttgg

SEQ ID NO: 221333 - DNA, 35 bp, Artificial Sequence
  Description of Artificial Sequence: Synthetic oligonucleotide
tatcttcaacacttatgtgcacagtgcggtgttgg

SEQ ID NO: 221334 - DNA, 34 bp, Artificial Sequence
  Description of Artificial Sequence: Synthetic oligonucleotide
atcttcaacacttatgtgcacagtgcggtgttgg

SEQ ID NO: 221335 - DNA, 33 bp, Artificial Sequence
  Description of Artificial Sequence: Synthetic oligonucleotide
tcttcaacacttatgtgcacagtgcggtgttgg

SEQ ID NO: 221336 - DNA, 32 bp, Artificial Sequence
  Description of Artificial Sequence: Synthetic oligonucleotide
cttcaacacttatgtgcacagtgcggtgttgg

SEQ ID NO: 221337 - DNA, 32 bp, Artificial Sequence
  Description of Artificial Sequence: Synthetic oligonucleotide
ttcaacacttatgtgcacagtgcggtgttggc

SEQ ID NO: 221338 - DNA, 31 bp, Artificial Sequence
  Description of Artificial Sequence: Synthetic oligonucleotide
tcaacacttatgtgcacagtgcggtgttggc

SEQ ID NO: 221339 - DNA, 30 bp, Artificial Sequence
  Description of Artificial Sequence: Synthetic oligonucleotide
caacacttatgtgcacagtgcggtgttggc

SEQ ID NO: 221340 - DNA, 31 bp, Artificial Sequence
  Description of Artificial Sequence: Synthetic oligonucleotide
aacacttatgtgcacagtgcggtgttggcag

SEQ ID NO: 221341 - DNA, 30 bp, Artificial Sequence
  Description of Artificial Sequence: Synthetic oligonucleotide
acacttatgtgcacagtgcggtgttggcag

SEQ ID NO: 221342 - DNA, 29 bp, Artificial Sequence
  Description of Artificial Sequence: Synthetic oligonucleotide
cacttatgtgcacagtgcggtgttggcag

SEQ ID NO: 221343 - DNA, 34 bp, Artificial Sequence
  Description of Artificial Sequence: Synthetic oligonucleotide
ttcatactgtctggaacggcaatggcatgattgc

SEQ ID NO: 221344 - DNA, 33 bp, Artificial Sequence
  Description of Artificial Sequence: Synthetic oligonucleotide
tcatactgtctggaacggcaatggcatgattgc

SEQ ID NO: 221345 - DNA, 32 bp, Artificial Sequence
  Description of Artificial Sequence: Synthetic oligonucleotide
catactgtctggaacggcaatggcatgattgc

SEQ ID NO: 221346 - DNA, 33 bp, Artificial Sequence
  Description of Artificial Sequence: Synthetic oligonucleotide
atactgtctggaacggcaatggcatgattgctc

SEQ ID NO: 221347 - DNA, 32 bp, Artificial Sequence
  Description of Artificial Sequence: Synthetic oligonucleotide
tactgtctggaacggcaatggcatgattgctc

SEQ ID NO: 221348 - DNA, 31 bp, Artificial Sequence
  Description of Artificial Sequence: Synthetic oligonucleotide
actgtctggaacggcaatggcatgattgctc

SEQ ID NO: 221349 - DNA, 30 bp, Artificial Sequence
  Description of Artificial Sequence: Synthetic oligonucleotide
ctgtctggaacggcaatggcatgattgctc

SEQ ID NO: 221350 - DNA, 30 bp, Artificial Sequence
  Description of Artificial Sequence: Synthetic oligonucleotide
tgtctggaacggcaatggcatgattgctcc

SEQ ID NO: 221351 - DNA, 29 bp, Artificial Sequence
  Description of Artificial Sequence: Synthetic oligonucleotide
gtctggaacggcaatggcatgattgctcc

SEQ ID NO: 221352 - DNA, 34 bp, Artificial Sequence
  Description of Artificial Sequence: Synthetic oligonucleotide
tctggaacggcaatggcatgattgctcctaaatc

SEQ ID NO: 221353 - DNA, 33 bp, Artificial Sequence
  Description of Artificial Sequence: Synthetic oligonucleotide
ctggaacggcaatggcatgattgctcctaaatc

SEQ ID NO: 221354 - DNA, 34 bp, Artificial Sequence
  Description of Artificial Sequence: Synthetic oligonucleotide
tggaacggcaatggcatgattgctcctaaatctc

SEQ ID NO: 221355 - DNA, 33 bp, Artificial Sequence
  Description of Artificial Sequence: Synthetic oligonucleotide
ggaacggcaatggcatgattgctcctaaatctc

SEQ ID NO: 221356 - DNA, 40 bp, Artificial Sequence
  Description of Artificial Sequence: Synthetic oligonucleotide
gaacggcaatggcatgattgctcctaaatctcaaaatatg

SEQ ID NO: 221357 - DNA, 40 bp, Artificial Sequence
  Description of Artificial Sequence: Synthetic oligonucleotide
aacggcaatggcatgattgctcctaaatctcaaaatatgg

SEQ ID NO: 221358 - DNA, 39 bp, Artificial Sequence
  Description of Artificial Sequence: Synthetic oligonucleotide
acggcaatggcatgattgctcctaaatctcaaaatatgg

SEQ ID NO: 221359 - DNA, 38 bp, Artificial Sequence
  Description of Artificial Sequence: Synthetic oligonucleotide
cggcaatggcatgattgctcctaaatctcaaaatatgg

SEQ ID NO: 221360 - DNA, 41 bp, Artificial Sequence
  Description of Artificial Sequence: Synthetic oligonucleotide
ggcaatggcatgattgctcctaaatctcaaaatatggaaag

SEQ ID NO: 221361 - DNA, 41 bp, Artificial Sequence
  Description of Artificial Sequence: Synthetic oligonucleotide
gcaatggcatgattgctcctaaatctcaaaatatggaaagc

SEQ ID NO: 221362 - DNA, 42 bp, Artificial Sequence
  Description of Artificial Sequence: Synthetic oligonucleotide
caatggcatgattgctcctaaatctcaaaatatggaaagcac

SEQ ID NO: 221363 - DNA, 42 bp, Artificial Sequence
  Description of Artificial Sequence: Synthetic oligonucleotide
aatggcatgattgctcctaaatctcaaaatatggaaagcacc

SEQ ID NO: 221364 - DNA, 41 bp, Artificial Sequence
  Description of Artificial Sequence: Synthetic oligonucleotide
atggcatgattgctcctaaatctcaaaatatggaaagcacc

SEQ ID NO: 221365 - DNA, 40 bp, Artificial Sequence
  Description of Artificial Sequence: Synthetic oligonucleotide
tggcatgattgctcctaaatctcaaaatatggaaagcacc

SEQ ID NO: 221366 - DNA, 39 bp, Artificial Sequence
  Description of Artificial Sequence: Synthetic oligonucleotide
ggcatgattgctcctaaatctcaaaatatggaaagcacc

SEQ ID NO: 221367 - DNA, 40 bp, Artificial Sequence
  Description of Artificial Sequence: Synthetic oligonucleotide
gcatgattgctcctaaatctcaaaatatggaaagcacctc

SEQ ID NO: 221368 - DNA, 42 bp, Artificial Sequence
  Description of Artificial Sequence: Synthetic oligonucleotide
catgattgctcctaaatctcaaaatatggaaagcacctcatg

SEQ ID NO: 221369 - DNA, 43 bp, Artificial Sequence
  Description of Artificial Sequence: Synthetic oligonucleotide
atgattgctcctaaatctcaaaatatggaaagcacctcatgtg

SEQ ID NO: 221370 - DNA, 42 bp, Artificial Sequence
  Description of Artificial Sequence: Synthetic oligonucleotide
tgattgctcctaaatctcaaaatatggaaagcacctcatgtg

SEQ ID NO: 221371 - DNA, 41 bp, Artificial Sequence
  Description of Artificial Sequence: Synthetic oligonucleotide
gattgctcctaaatctcaaaatatggaaagcacctcatgtg

SEQ ID NO: 221372 - DNA, 41 bp, Artificial Sequence
  Description of Artificial Sequence: Synthetic oligonucleotide
attgctcctaaatctcaaaatatggaaagcacctcatgtgg

SEQ ID NO: 221373 - DNA, 28 bp, Artificial Sequence
  Description of Artificial Sequence: Synthetic oligonucleotide
ggtgtgttgtaaccgagtgctggggatc

SEQ ID NO: 221374 - DNA, 28 bp, Artificial Sequence
  Description of Artificial Sequence: Synthetic oligonucleotide
gtgtgttgtaaccgagtgctggggatcc

SEQ ID NO: 221375 - DNA, 28 bp, Artificial Sequence
  Description of Artificial Sequence: Synthetic oligonucleotide
tgtgttgtaaccgagtgctggggatccc

SEQ ID NO: 221376 - DNA, 27 bp, Artificial Sequence
  Description of Artificial Sequence: Synthetic oligonucleotide
gtgttgtaaccgagtgctggggatccc

SEQ ID NO: 221377 - DNA, 28 bp, Artificial Sequence
  Description of Artificial Sequence: Synthetic oligonucleotide
tgttgtaaccgagtgctggggatcccac

SEQ ID NO: 221378 - DNA, 27 bp, Artificial Sequence
  Description of Artificial Sequence: Synthetic oligonucleotide
gttgtaaccgagtgctggggatcccac

SEQ ID NO: 221379 - DNA, 29 bp, Artificial Sequence
  Description of Artificial Sequence: Synthetic oligonucleotide
ttgtaaccgagtgctggggatcccacatc

SEQ ID NO: 221380 - DNA, 28 bp, Artificial Sequence
  Description of Artificial Sequence: Synthetic oligonucleotide
tgtaaccgagtgctggggatcccacatc

SEQ ID NO: 221381 - DNA, 27 bp, Artificial Sequence
  Description of Artificial Sequence: Synthetic oligonucleotide
gtaaccgagtgctggggatcccacatc

SEQ ID NO: 221382 - DNA, 28 bp, Artificial Sequence
  Description of Artificial Sequence: Synthetic oligonucleotide
taaccgagtgctggggatcccacatctc

SEQ ID NO: 221383 - DNA, 27 bp, Artificial Sequence
  Description of Artificial Sequence: Synthetic oligonucleotide
aaccgagtgctggggatcccacatctc

SEQ ID NO: 221384 - DNA, 26 bp, Artificial Sequence
  Description of Artificial Sequence: Synthetic oligonucleotide
accgagtgctggggatcccacatctc

SEQ ID NO: 221385 - DNA, 25 bp, Artificial Sequence
  Description of Artificial Sequence: Synthetic oligonucleotide
ccgagtgctggggatcccacatctc

SEQ ID NO: 221386 - DNA, 25 bp, Artificial Sequence
  Description of Artificial Sequence: Synthetic oligonucleotide
cgagtgctggggatcccacatctcc

SEQ ID NO: 221387 - DNA, 26 bp, Artificial Sequence
  Description of Artificial Sequence: Synthetic oligonucleotide
gagtgctggggatcccacatctccgt

SEQ ID NO: 221388 - DNA, 27 bp, Artificial Sequence
  Description of Artificial Sequence: Synthetic oligonucleotide
agtgctggggatcccacatctccgtca

SEQ ID NO: 221389 - DNA, 27 bp, Artificial Sequence
  Description of Artificial Sequence: Synthetic oligonucleotide
gtgctggggatcccacatctccgtcat

SEQ ID NO: 221390 - DNA, 27 bp, Artificial Sequence
  Description of Artificial Sequence: Synthetic oligonucleotide
tgctggggatcccacatctccgtcatg

SEQ ID NO: 221391 - DNA, 26 bp, Artificial Sequence
  Description of Artificial Sequence: Synthetic oligonucleotide
gctggggatcccacatctccgtcatg

SEQ ID NO: 221392 - DNA, 27 bp, Artificial Sequence
  Description of Artificial Sequence: Synthetic oligonucleotide
ctggggatcccacatctccgtcatgca

SEQ ID NO: 221393 - DNA, 27 bp, Artificial Sequence
  Description of Artificial Sequence: Synthetic oligonucleotide
tggggatcccacatctccgtcatgcac

SEQ ID NO: 221394 - DNA, 27 bp, Artificial Sequence
  Description of Artificial Sequence: Synthetic oligonucleotide
ggggatcccacatctccgtcatgcact

SEQ ID NO: 221395 - DNA, 27 bp, Artificial Sequence
  Description of Artificial Sequence: Synthetic oligonucleotide
gggatcccacatctccgtcatgcactc

SEQ ID NO: 221396 - DNA, 27 bp, Artificial Sequence
  Description of Artificial Sequence: Synthetic oligonucleotide
ggatcccacatctccgtcatgcactcc

SEQ ID NO: 221397 - DNA, 29 bp, Artificial Sequence
  Description of Artificial Sequence: Synthetic oligonucleotide
gatcccacatctccgtcatgcactccatc

SEQ ID NO: 221398 - DNA, 31 bp, Artificial Sequence
  Description of Artificial Sequence: Synthetic oligonucleotide
atcccacatctccgtcatgcactccatcttc

SEQ ID NO: 221399 - DNA, 30 bp, Artificial Sequence
  Description of Artificial Sequence: Synthetic oligonucleotide
tcccacatctccgtcatgcactccatcttc

SEQ ID NO: 221400 - DNA, 29 bp, Artificial Sequence
  Description of Artificial Sequence: Synthetic oligonucleotide
cccacatctccgtcatgcactccatcttc

SEQ ID NO: 221401 - DNA, 32 bp, Artificial Sequence
  Description of Artificial Sequence: Synthetic oligonucleotide
tgtcaactctcctctgctgagaagtccaatcg

SEQ ID NO: 221402 - DNA, 31 bp, Artificial Sequence
  Description of Artificial Sequence: Synthetic oligonucleotide
gtcaactctcctctgctgagaagtccaatcg

SEQ ID NO: 221403 - DNA, 34 bp, Artificial Sequence
  Description of Artificial Sequence: Synthetic oligonucleotide
tcaactctcctctgctgagaagtccaatcgaaag

SEQ ID NO: 221404 - DNA, 33 bp, Artificial Sequence
  Description of Artificial Sequence: Synthetic oligonucleotide
caactctcctctgctgagaagtccaatcgaaag

SEQ ID NO: 221405 - DNA, 33 bp, Artificial Sequence
  Description of Artificial Sequence: Synthetic oligonucleotide
aactctcctctgctgagaagtccaatcgaaagg

SEQ ID NO: 221406 - DNA, 32 bp, Artificial Sequence
  Description of Artificial Sequence: Synthetic oligonucleotide
actctcctctgctgagaagtccaatcgaaagg

SEQ ID NO: 221407 - DNA, 31 bp, Artificial Sequence
  Description of Artificial Sequence: Synthetic oligonucleotide
ctctcctctgctgagaagtccaatcgaaagg

SEQ ID NO: 221408 - DNA, 33 bp, Artificial Sequence
  Description of Artificial Sequence: Synthetic oligonucleotide
tctcctctgctgagaagtccaatcgaaaggaag

SEQ ID NO: 221409 - DNA, 32 bp, Artificial Sequence
  Description of Artificial Sequence: Synthetic oligonucleotide
ctcctctgctgagaagtccaatcgaaaggaag

SEQ ID NO: 221410 - DNA, 35 bp, Artificial Sequence
  Description of Artificial Sequence: Synthetic oligonucleotide
tcctctgctgagaagtccaatcgaaaggaagaatg

SEQ ID NO: 221411 - DNA, 34 bp, Artificial Sequence
  Description of Artificial Sequence: Synthetic oligonucleotide
cctctgctgagaagtccaatcgaaaggaagaatg

SEQ ID NO: 221412 - DNA, 34 bp, Artificial Sequence
  Description of Artificial Sequence: Synthetic oligonucleotide
ctctgctgagaagtccaatcgaaaggaagaatgc

SEQ ID NO: 221413 - DNA, 34 bp, Artificial Sequence
  Description of Artificial Sequence: Synthetic oligonucleotide
tctgctgagaagtccaatcgaaaggaagaatgcc

SEQ ID NO: 221414 - DNA, 33 bp, Artificial Sequence
  Description of Artificial Sequence: Synthetic oligonucleotide
ctgctgagaagtccaatcgaaaggaagaatgcc

SEQ ID NO: 221415 - DNA, 33 bp, Artificial Sequence
  Description of Artificial Sequence: Synthetic oligonucleotide
tgctgagaagtccaatcgaaaggaagaatgccg

SEQ ID NO: 221416 - DNA, 32 bp, Artificial Sequence
  Description of Artificial Sequence: Synthetic oligonucleotide
gctgagaagtccaatcgaaaggaagaatgccg

SEQ ID NO: 221417 - DNA, 33 bp, Artificial Sequence
  Description of Artificial Sequence: Synthetic oligonucleotide
ctgagaagtccaatcgaaaggaagaatgccgtg

SEQ ID NO: 221418 - DNA, 35 bp, Artificial Sequence
  Description of Artificial Sequence: Synthetic oligonucleotide
tgagaagtccaatcgaaaggaagaatgccgtgttc

SEQ ID NO: 221419 - DNA, 34 bp, Artificial Sequence
  Description of Artificial Sequence: Synthetic oligonucleotide
gagaagtccaatcgaaaggaagaatgccgtgttc

SEQ ID NO: 221420 - DNA, 36 bp, Artificial Sequence
  Description of Artificial Sequence: Synthetic oligonucleotide
agaagtccaatcgaaaggaagaatgccgtgttcaac

SEQ ID NO: 221421 - DNA, 35 bp, Artificial Sequence
  Description of Artificial Sequence: Synthetic oligonucleotide
gaagtccaatcgaaaggaagaatgccgtgttcaac

SEQ ID NO: 221422 - DNA, 36 bp, Artificial Sequence
  Description of Artificial Sequence: Synthetic oligonucleotide
aagtccaatcgaaaggaagaatgccgtgttcaacac

SEQ ID NO: 221423 - DNA, 35 bp, Artificial Sequence
  Description of Artificial Sequence: Synthetic oligonucleotide
agtccaatcgaaaggaagaatgccgtgttcaacac

SEQ ID NO: 221424 - DNA, 34 bp, Artificial Sequence
  Description of Artificial Sequence: Synthetic oligonucleotide
gtccaatcgaaaggaagaatgccgtgttcaacac

SEQ ID NO: 221425 - DNA, 34 bp, Artificial Sequence
  Description of Artificial Sequence: Synthetic oligonucleotide
tccaatcgaaaggaagaatgccgtgttcaacacc

SEQ ID NO: 221426 - DNA, 33 bp, Artificial Sequence
  Description of Artificial Sequence: Synthetic oligonucleotide
ccaatcgaaaggaagaatgccgtgttcaacacc

SEQ ID NO: 221427 - DNA, 35 bp, Artificial Sequence
  Description of Artificial Sequence: Synthetic oligonucleotide
caatcgaaaggaagaatgccgtgttcaacacctac

SEQ ID NO: 221428 - DNA, 38 bp, Artificial Sequence
  Description of Artificial Sequence: Synthetic oligonucleotide
aatcgaaaggaagaatgccgtgttcaacacctactatg

SEQ ID NO: 221429 - DNA, 37 bp, Artificial Sequence
  Description of Artificial Sequence: Synthetic oligonucleotide
atcgaaaggaagaatgccgtgttcaacacctactatg

SEQ ID NO: 221430 - DNA, 36 bp, Artificial Sequence
  Description of Artificial Sequence: Synthetic oligonucleotide
tcgaaaggaagaatgccgtgttcaacacctactatg

SEQ ID NO: 221431 - DNA, 35 bp, Artificial Sequence
  Description of Artificial Sequence: Synthetic oligonucleotide
cgaaaggaagaatgccgtgttcaacacctactatg

SEQ ID NO: 221432 - DNA, 35 bp, Artificial Sequence
  Description of Artificial Sequence: Synthetic oligonucleotide
gaaaggaagaatgccgtgttcaacacctactatgc

SEQ ID NO: 221433 - DNA, 36 bp, Artificial Sequence
  Description of Artificial Sequence: Synthetic oligonucleotide
aaaggaagaatgccgtgttcaacacctactatgctc

SEQ ID NO: 221434 - DNA, 35 bp, Artificial Sequence
  Description of Artificial Sequence: Synthetic oligonucleotide
aaggaagaatgccgtgttcaacacctactatgctc

SEQ ID NO: 221435 - DNA, 34 bp, Artificial Sequence
  Description of Artificial Sequence: Synthetic oligonucleotide
aggaagaatgccgtgttcaacacctactatgctc

SEQ ID NO: 221436 - DNA, 33 bp, Artificial Sequence
  Description of Artificial Sequence: Synthetic oligonucleotide
ggaagaatgccgtgttcaacacctactatgctc

SEQ ID NO: 221437 - DNA, 35 bp, Artificial Sequence
  Description of Artificial Sequence: Synthetic oligonucleotide
gaagaatgccgtgttcaacacctactatgctctag

SEQ ID NO: 221438 - DNA, 35 bp, Artificial Sequence
  Description of Artificial Sequence: Synthetic oligonucleotide
aagaatgccgtgttcaacacctactatgctctagc

SEQ ID NO: 221439 - DNA, 34 bp, Artificial Sequence
  Description of Artificial Sequence: Synthetic oligonucleotide
agaatgccgtgttcaacacctactatgctctagc

SEQ ID NO: 221440 - DNA, 33 bp, Artificial Sequence
  Description of Artificial Sequence: Synthetic oligonucleotide
gaatgccgtgttcaacacctactatgctctagc

SEQ ID NO: 221441 - DNA, 34 bp, Artificial Sequence
  Description of Artificial Sequence: Synthetic oligonucleotide
aatgccgtgttcaacacctactatgctctagcag

SEQ ID NO: 221442 - DNA, 33 bp, Artificial Sequence
  Description of Artificial Sequence: Synthetic oligonucleotide
atgccgtgttcaacacctactatgctctagcag

SEQ ID NO: 221443 - DNA, 32 bp, Artificial Sequence
  Description of Artificial Sequence: Synthetic oligonucleotide
tgccgtgttcaacacctactatgctctagcag

SEQ ID NO: 221444 - DNA, 31 bp, Artificial Sequence
  Description of Artificial Sequence: Synthetic oligonucleotide
gccgtgttcaacacctactatgctctagcag

SEQ ID NO: 221445 - DNA, 32 bp, Artificial Sequence
  Description of Artificial Sequence: Synthetic oligonucleotide
ccgtgttcaacacctactatgctctagcagtc

SEQ ID NO: 221446 - DNA, 33 bp, Artificial Sequence
  Description of Artificial Sequence: Synthetic oligonucleotide
cgtgttcaacacctactatgctctagcagtcag

SEQ ID NO: 221447 - DNA, 34 bp, Artificial Sequence
  Description of Artificial Sequence: Synthetic oligonucleotide
gtgttcaacacctactatgctctagcagtcagtg

SEQ ID NO: 221448 - DNA, 28 bp, Artificial Sequence
  Description of Artificial Sequence: Synthetic oligonucleotide
tggaggtgacagctttaggcaccctgac

SEQ ID NO: 221449 - DNA, 27 bp, Artificial Sequence
  Description of Artificial Sequence: Synthetic oligonucleotide
ggaggtgacagctttaggcaccctgac

SEQ ID NO: 221450 - DNA, 27 bp, Artificial Sequence
  Description of Artificial Sequence: Synthetic oligonucleotide
gaggtgacagctttaggcaccctgacg

SEQ ID NO: 221451 - DNA, 29 bp, Artificial Sequence
  Description of Artificial Sequence: Synthetic oligonucleotide
aggtgacagctttaggcaccctgacgatg

SEQ ID NO: 221452 - DNA, 28 bp, Artificial Sequence
  Description of Artificial Sequence: Synthetic oligonucleotide
ggtgacagctttaggcaccctgacgatg

SEQ ID NO: 221453 - DNA, 28 bp, Artificial Sequence
  Description of Artificial Sequence: Synthetic oligonucleotide
gtgacagctttaggcaccctgacgatgg

SEQ ID NO: 221454 - DNA, 29 bp, Artificial Sequence
  Description of Artificial Sequence: Synthetic oligonucleotide
tgacagctttaggcaccctgacgatggtc

SEQ ID NO: 221455 - DNA, 28 bp, Artificial Sequence
  Description of Artificial Sequence: Synthetic oligonucleotide
gacagctttaggcaccctgacgatggtc

SEQ ID NO: 221456 - DNA, 30 bp, Artificial Sequence
  Description of Artificial Sequence: Synthetic oligonucleotide
acagctttaggcaccctgacgatggtcatc

SEQ ID NO: 221457 - DNA, 29 bp, Artificial Sequence
  Description of Artificial Sequence: Synthetic oligonucleotide
cagctttaggcaccctgacgatggtcatc

SEQ ID NO: 221458 - DNA, 30 bp, Artificial Sequence
  Description of Artificial Sequence: Synthetic oligonucleotide
agctttaggcaccctgacgatggtcatcag

SEQ ID NO: 221459 - DNA, 29 bp, Artificial Sequence
  Description of Artificial Sequence: Synthetic oligonucleotide
gctttaggcaccctgacgatggtcatcag

SEQ ID NO: 221460 - DNA, 35 bp, Artificial Sequence
  Description of Artificial Sequence: Synthetic oligonucleotide
ctttaggcaccctgacgatggtcatcagtaatatc

SEQ ID NO: 221461 - DNA, 37 bp, Artificial Sequence
  Description of Artificial Sequence: Synthetic oligonucleotide
tttaggcaccctgacgatggtcatcagtaatatcttc

SEQ ID NO: 221462 - DNA, 36 bp, Artificial Sequence
  Description of Artificial Sequence: Synthetic oligonucleotide
ttaggcaccctgacgatggtcatcagtaatatcttc

SEQ ID NO: 221463 - DNA, 35 bp, Artificial Sequence
  Description of Artificial Sequence: Synthetic oligonucleotide
taggcaccctgacgatggtcatcagtaatatcttc

SEQ ID NO: 221464 - DNA, 34 bp, Artificial Sequence
  Description of Artificial Sequence: Synthetic oligonucleotide
aggcaccctgacgatggtcatcagtaatatcttc

SEQ ID NO: 221465 - DNA, 33 bp, Artificial Sequence
  Description of Artificial Sequence: Synthetic oligonucleotide
ggcaccctgacgatggtcatcagtaatatcttc

SEQ ID NO: 221466 - DNA, 35 bp, Artificial Sequence
  Description of Artificial Sequence: Synthetic oligonucleotide
gcaccctgacgatggtcatcagtaatatcttcaac

SEQ ID NO: 221467 - DNA, 36 bp, Artificial Sequence
  Description of Artificial Sequence: Synthetic oligonucleotide
caccctgacgatggtcatcagtaatatcttcaacac

SEQ ID NO: 221468 - DNA, 37 bp, Artificial Sequence
  Description of Artificial Sequence: Synthetic oligonucleotide
accctgacgatggtcatcagtaatatcttcaacacag

SEQ ID NO: 221469 - DNA, 36 bp, Artificial Sequence
  Description of Artificial Sequence: Synthetic oligonucleotide
ccctgacgatggtcatcagtaatatcttcaacacag

SEQ ID NO: 221470 - DNA, 37 bp, Artificial Sequence
  Description of Artificial Sequence: Synthetic oligonucleotide
cctgacgatggtcatcagtaatatcttcaacacagac

SEQ ID NO: 221471 - DNA, 39 bp, Artificial Sequence
  Description of Artificial Sequence: Synthetic oligonucleotide
ctgacgatggtcatcagtaatatcttcaacacagactac

SEQ ID NO: 221472 - DNA, 39 bp, Artificial Sequence
  Description of Artificial Sequence: Synthetic oligonucleotide
tgacgatggtcatcagtaatatcttcaacacagactacc

SEQ ID NO: 221473 - DNA, 38 bp, Artificial Sequence
  Description of Artificial Sequence: Synthetic oligonucleotide
gacgatggtcatcagtaatatcttcaacacagactacc

SEQ ID NO: 221474 - DNA, 39 bp, Artificial Sequence
  Description of Artificial Sequence: Synthetic oligonucleotide
acgatggtcatcagtaatatcttcaacacagactaccac

SEQ ID NO: 221475 - DNA, 38 bp, Artificial Sequence
  Description of Artificial Sequence: Synthetic oligonucleotide
cgatggtcatcagtaatatcttcaacacagactaccac

SEQ ID NO: 221476 - DNA, 28 bp, Artificial Sequence
  Description of Artificial Sequence: Synthetic oligonucleotide
tcaacttggcgcagttggtggtgatggc

SEQ ID NO: 221477 - DNA, 27 bp, Artificial Sequence
  Description of Artificial Sequence: Synthetic oligonucleotide
caacttggcgcagttggtggtgatggc

SEQ ID NO: 221478 - DNA, 27 bp, Artificial Sequence
  Description of Artificial Sequence: Synthetic oligonucleotide
aacttggcgcagttggtggtgatggcg

SEQ ID NO: 221479 - DNA, 26 bp, Artificial Sequence
  Description of Artificial Sequence: Synthetic oligonucleotide
acttggcgcagttggtggtgatggcg

SEQ ID NO: 221480 - DNA, 25 bp, Artificial Sequence
  Description of Artificial Sequence: Synthetic oligonucleotide
cttggcgcagttggtggtgatggcg

SEQ ID NO: 221481 - DNA, 26 bp, Artificial Sequence
  Description of Artificial Sequence: Synthetic oligonucleotide
ttggcgcagttggtggtgatggcgct

SEQ ID NO: 221482 - DNA, 25 bp, Artificial Sequence
  Description of Artificial Sequence: Synthetic oligonucleotide
tggcgcagttggtggtgatggcgct

SEQ ID NO: 221483 - DNA, 24 bp, Artificial Sequence
  Description of Artificial Sequence: Synthetic oligonucleotide
ggcgcagttggtggtgatggcgct

SEQ ID NO: 221484 - DNA, 24 bp, Artificial Sequence
  Description of Artificial Sequence: Synthetic oligonucleotide
gcgcagttggtggtgatggcgctg

SEQ ID NO: 221485 - DNA, 25 bp, Artificial Sequence
  Description of Artificial Sequence: Synthetic oligonucleotide
cgcagttggtggtgatggcgctggt

SEQ ID NO: 221486 - DNA, 25 bp, Artificial Sequence
  Description of Artificial Sequence: Synthetic oligonucleotide
gcagttggtggtgatggcgctggtg

SEQ ID NO: 221487 - DNA, 26 bp, Artificial Sequence
  Description of Artificial Sequence: Synthetic oligonucleotide
cagttggtggtgatggcgctggtgga

SEQ ID NO: 221488 - DNA, 26 bp, Artificial Sequence
  Description of Artificial Sequence: Synthetic oligonucleotide
agttggtggtgatggcgctggtggag

SEQ ID NO: 221489 - DNA, 25 bp, Artificial Sequence
  Description of Artificial Sequence: Synthetic oligonucleotide
gttggtggtgatggcgctggtggag

SEQ ID NO: 221490 - DNA, 26 bp, Artificial Sequence
  Description of Artificial Sequence: Synthetic oligonucleotide
ttggtggtgatggcgctggtggaggt

SEQ ID NO: 221491 - DNA, 25 bp, Artificial Sequence
  Description of Artificial Sequence: Synthetic oligonucleotide
tggtggtgatggcgctggtggaggt

SEQ ID NO: 221492 - DNA, 24 bp, Artificial Sequence
  Description of Artificial Sequence: Synthetic oligonucleotide
ggtggtgatggcgctggtggaggt

SEQ ID NO: 221493 - DNA, 25 bp, Artificial Sequence
  Description of Artificial Sequence: Synthetic oligonucleotide
gtggtgatggcgctggtggaggtca

SEQ ID NO: 221494 - DNA, 26 bp, Artificial Sequence
  Description of Artificial Sequence: Synthetic oligonucleotide
tggtgatggcgctggtggaggtcaca

SEQ ID NO: 221495 - DNA, 25 bp, Artificial Sequence
  Description of Artificial Sequence: Synthetic oligonucleotide
ggtgatggcgctggtggaggtcaca

SEQ ID NO: 221496 - DNA, 25 bp, Artificial Sequence
  Description of Artificial Sequence: Synthetic oligonucleotide
gtgatggcgctggtggaggtcacag

SEQ ID NO: 221497 - DNA, 27 bp, Artificial Sequence
  Description of Artificial Sequence: Synthetic oligonucleotide
tgatggcgctggtggaggtcacagctt

SEQ ID NO: 221498 - DNA, 27 bp, Artificial Sequence
  Description of Artificial Sequence: Synthetic oligonucleotide
gatggcgctggtggaggtcacagcttt

SEQ ID NO: 221499 - DNA, 28 bp, Artificial Sequence
  Description of Artificial Sequence: Synthetic oligonucleotide
atggcgctggtggaggtcacagctttag

SEQ ID NO: 221500 - DNA, 27 bp, Artificial Sequence
  Description of Artificial Sequence: Synthetic oligonucleotide
tggcgctggtggaggtcacagctttag

SEQ ID NO: 221501 - DNA, 26 bp, Artificial Sequence
  Description of Artificial Sequence: Synthetic oligonucleotide
ggcgctggtggaggtcacagctttag

SEQ ID NO: 221502 - DNA, 26 bp, Artificial Sequence
  Description of Artificial Sequence: Synthetic oligonucleotide
gcgctggtggaggtcacagctttagg

SEQ ID NO: 221503 - DNA, 27 bp, Artificial Sequence
  Description of Artificial Sequence: Synthetic oligonucleotide
cgctggtggaggtcacagctttaggca

SEQ ID NO: 221504 - DNA, 27 bp, Artificial Sequence
  Description of Artificial Sequence: Synthetic oligonucleotide
gctggtggaggtcacagctttaggcac

SEQ ID NO: 221505 - DNA, 27 bp, Artificial Sequence
  Description of Artificial Sequence: Synthetic oligonucleotide
ctggtggaggtcacagctttaggcacc

SEQ ID NO: 221506 - DNA, 27 bp, Artificial Sequence
  Description of Artificial Sequence: Synthetic oligonucleotide
tggtggaggtcacagctttaggcaccc

SEQ ID NO: 221507 - DNA, 27 bp, Artificial Sequence
  Description of Artificial Sequence: Synthetic oligonucleotide
ggtggaggtcacagctttaggcaccct

SEQ ID NO: 221508 - DNA, 27 bp, Artificial Sequence
  Description of Artificial Sequence: Synthetic oligonucleotide
gtggaggtcacagctttaggcaccctg

SEQ ID NO: 221509 - DNA, 28 bp, Artificial Sequence
  Description of Artificial Sequence: Synthetic oligonucleotide
tggaggtcacagctttaggcaccctgag

SEQ ID NO: 221510 - DNA, 27 bp, Artificial Sequence
  Description of Artificial Sequence: Synthetic oligonucleotide
ggaggtcacagctttaggcaccctgag

SEQ ID NO: 221511 - DNA, 27 bp, Artificial Sequence
  Description of Artificial Sequence: Synthetic oligonucleotide
gaggtcacagctttaggcaccctgagg

SEQ ID NO: 221512 - DNA, 29 bp, Artificial Sequence
  Description of Artificial Sequence: Synthetic oligonucleotide
aggtcacagctttaggcaccctgaggatg

SEQ ID NO: 221513 - DNA, 28 bp, Artificial Sequence
  Description of Artificial Sequence: Synthetic oligonucleotide
ggtcacagctttaggcaccctgaggatg

SEQ ID NO: 221514 - DNA, 28 bp, Artificial Sequence
  Description of Artificial Sequence: Synthetic oligonucleotide
gtcacagctttaggcaccctgaggatgg

SEQ ID NO: 221515 - DNA, 29 bp, Artificial Sequence
  Description of Artificial Sequence: Synthetic oligonucleotide
tcacagctttaggcaccctgaggatggtc

SEQ ID NO: 221516 - DNA, 28 bp, Artificial Sequence
  Description of Artificial Sequence: Synthetic oligonucleotide
cacagctttaggcaccctgaggatggtc

SEQ ID NO: 221517 - DNA, 26 bp, Artificial Sequence
  Description of Artificial Sequence: Synthetic oligonucleotide
cagggtcatccttggctcacccccaa

SEQ ID NO: 221518 - DNA, 26 bp, Artificial Sequence
  Description of Artificial Sequence: Synthetic oligonucleotide
agggtcatccttggctcacccccaag

SEQ ID NO: 221519 - DNA, 25 bp, Artificial Sequence
  Description of Artificial Sequence: Synthetic oligonucleotide
gggtcatccttggctcacccccaag

SEQ ID NO: 221520 - DNA, 25 bp, Artificial Sequence
  Description of Artificial Sequence: Synthetic oligonucleotide
ggtcatccttggctcacccccaagg

SEQ ID NO: 221521 - DNA, 27 bp, Artificial Sequence
  Description of Artificial Sequence: Synthetic oligonucleotide
gtcatccttggctcacccccaagggaa

SEQ ID NO: 221522 - DNA, 27 bp, Artificial Sequence
  Description of Artificial Sequence: Synthetic oligonucleotide
tcatccttggctcacccccaagggaag

SEQ ID NO: 221523 - DNA, 27 bp, Artificial Sequence
  Description of Artificial Sequence: Synthetic oligonucleotide
catccttggctcacccccaagggaaga

SEQ ID NO: 221524 - DNA, 28 bp, Artificial Sequence
  Description of Artificial Sequence: Synthetic oligonucleotide
atccttggctcacccccaagggaagatc

SEQ ID NO: 221525 - DNA, 27 bp, Artificial Sequence
  Description of Artificial Sequence: Synthetic oligonucleotide
tccttggctcacccccaagggaagatc

SEQ ID NO: 221526 - DNA, 27 bp, Artificial Sequence
  Description of Artificial Sequence: Synthetic oligonucleotide
ccttggctcacccccaagggaagatca

SEQ ID NO: 221527 - DNA, 27 bp, Artificial Sequence
  Description of Artificial Sequence: Synthetic oligonucleotide
cttggctcacccccaagggaagatcag

SEQ ID NO: 221528 - DNA, 27 bp, Artificial Sequence
  Description of Artificial Sequence: Synthetic oligonucleotide
ttggctcacccccaagggaagatcagc

SEQ ID NO: 221529 - DNA, 27 bp, Artificial Sequence
  Description of Artificial Sequence: Synthetic oligonucleotide
tggctcacccccaagggaagatcagca

SEQ ID NO: 221530 - DNA, 27 bp, Artificial Sequence
  Description of Artificial Sequence: Synthetic oligonucleotide
ggctcacccccaagggaagatcagcat

SEQ ID NO: 221531 - DNA, 27 bp, Artificial Sequence
  Description of Artificial Sequence: Synthetic oligonucleotide
gctcacccccaagggaagatcagcatg

SEQ ID NO: 221532 - DNA, 28 bp, Artificial Sequence
  Description of Artificial Sequence: Synthetic oligonucleotide
ctcacccccaagggaagatcagcatgac

SEQ ID NO: 221533 - DNA, 32 bp, Artificial Sequence
  Description of Artificial Sequence: Synthetic oligonucleotide
tcacccccaagggaagatcagcatgacttatg

SEQ ID NO: 221534 - DNA, 31 bp, Artificial Sequence
  Description of Artificial Sequence: Synthetic oligonucleotide
cacccccaagggaagatcagcatgacttatg

SEQ ID NO: 221535 - DNA, 32 bp, Artificial Sequence
  Description of Artificial Sequence: Synthetic oligonucleotide
acccccaagggaagatcagcatgacttatgtg

SEQ ID NO: 221536 - DNA, 31 bp, Artificial Sequence
  Description of Artificial Sequence: Synthetic oligonucleotide
cccccaagggaagatcagcatgacttatgtg

SEQ ID NO: 221537 - DNA, 31 bp, Artificial Sequence
  Description of Artificial Sequence: Synthetic oligonucleotide
ccccaagggaagatcagcatgacttatgtgc

SEQ ID NO: 221538 - DNA, 32 bp, Artificial Sequence
  Description of Artificial Sequence: Synthetic oligonucleotide
cccaagggaagatcagcatgacttatgtgcac

SEQ ID NO: 221539 - DNA, 33 bp, Artificial Sequence
  Description of Artificial Sequence: Synthetic oligonucleotide
ccaagggaagatcagcatgacttatgtgcacag

SEQ ID NO: 221540 - DNA, 34 bp, Artificial Sequence
  Description of Artificial Sequence: Synthetic oligonucleotide
caagggaagatcagcatgacttatgtgcacagtg

SEQ ID NO: 221541 - DNA, 34 bp, Artificial Sequence
  Description of Artificial Sequence: Synthetic oligonucleotide
aagggaagatcagcatgacttatgtgcacagtgc

SEQ ID NO: 221542 - DNA, 33 bp, Artificial Sequence
  Description of Artificial Sequence: Synthetic oligonucleotide
agggaagatcagcatgacttatgtgcacagtgc

SEQ ID NO: 221543 - DNA, 32 bp, Artificial Sequence
  Description of Artificial Sequence: Synthetic oligonucleotide
gggaagatcagcatgacttatgtgcacagtgc

SEQ ID NO: 221544 - DNA, 27 bp, Artificial Sequence
  Description of Artificial Sequence: Synthetic oligonucleotide
gtcggccaagatctgaccgtgatggca

SEQ ID NO: 221545 - DNA, 27 bp, Artificial Sequence
  Description of Artificial Sequence: Synthetic oligonucleotide
tcggccaagatctgaccgtgatggcag

SEQ ID NO: 221546 - DNA, 26 bp, Artificial Sequence
  Description of Artificial Sequence: Synthetic oligonucleotide
cggccaagatctgaccgtgatggcag

SEQ ID NO: 221547 - DNA, 26 bp, Artificial Sequence
  Description of Artificial Sequence: Synthetic oligonucleotide
ggccaagatctgaccgtgatggcagc

SEQ ID NO: 221548 - DNA, 26 bp, Artificial Sequence
  Description of Artificial Sequence: Synthetic oligonucleotide
gccaagatctgaccgtgatggcagcc

SEQ ID NO: 221549 - DNA, 27 bp, Artificial Sequence
  Description of Artificial Sequence: Synthetic oligonucleotide
ccaagatctgaccgtgatggcagccct

SEQ ID NO: 221550 - DNA, 28 bp, Artificial Sequence
  Description of Artificial Sequence: Synthetic oligonucleotide
caagatctgaccgtgatggcagcccttg

SEQ ID NO: 221551 - DNA, 28 bp, Artificial Sequence
  Description of Artificial Sequence: Synthetic oligonucleotide
aagatctgaccgtgatggcagcccttgg

SEQ ID NO: 221552 - DNA, 27 bp, Artificial Sequence
  Description of Artificial Sequence: Synthetic oligonucleotide
agatctgaccgtgatggcagcccttgg

SEQ ID NO: 221553 - DNA, 26 bp, Artificial Sequence
  Description of Artificial Sequence: Synthetic oligonucleotide
gatctgaccgtgatggcagcccttgg

SEQ ID NO: 221554 - DNA, 27 bp, Artificial Sequence
  Description of Artificial Sequence: Synthetic oligonucleotide
atctgaccgtgatggcagcccttggct

SEQ ID NO: 221555 - DNA, 27 bp, Artificial Sequence
  Description of Artificial Sequence: Synthetic oligonucleotide
tctgaccgtgatggcagcccttggctt

SEQ ID NO: 221556 - DNA, 26 bp, Artificial Sequence
  Description of Artificial Sequence: Synthetic oligonucleotide
ctgaccgtgatggcagcccttggctt

SEQ ID NO: 221557 - DNA, 26 bp, Artificial Sequence
  Description of Artificial Sequence: Synthetic oligonucleotide
tgaccgtgatggcagcccttggcttg

SEQ ID NO: 221558 - DNA, 25 bp, Artificial Sequence
  Description of Artificial Sequence: Synthetic oligonucleotide
gaccgtgatggcagcccttggcttg

SEQ ID NO: 221559 - DNA, 25 bp, Artificial Sequence
  Description of Artificial Sequence: Synthetic oligonucleotide
accgtgatggcagcccttggcttgg

SEQ ID NO: 221560 - DNA, 24 bp, Artificial Sequence
  Description of Artificial Sequence: Synthetic oligonucleotide
ccgtgatggcagcccttggcttgg

SEQ ID NO: 221561 - DNA, 24 bp, Artificial Sequence
  Description of Artificial Sequence: Synthetic oligonucleotide
cgtgatggcagcccttggcttggg

SEQ ID NO: 221562 - DNA, 26 bp, Artificial Sequence
  Description of Artificial Sequence: Synthetic oligonucleotide
gtgatggcagcccttggcttgggctt

SEQ ID NO: 221563 - DNA, 26 bp, Artificial Sequence
  Description of Artificial Sequence: Synthetic oligonucleotide
tgatggcagcccttggcttgggcttc

SEQ ID NO: 221564 - DNA, 25 bp, Artificial Sequence
  Description of Artificial Sequence: Synthetic oligonucleotide
gatggcagcccttggcttgggcttc

SEQ ID NO: 221565 - DNA, 26 bp, Artificial Sequence
  Description of Artificial Sequence: Synthetic oligonucleotide
atggcagcccttggcttgggcttcct

SEQ ID NO: 221566 - DNA, 25 bp, Artificial Sequence
  Description of Artificial Sequence: Synthetic oligonucleotide
tggcagcccttggcttgggcttcct

SEQ ID NO: 221567 - DNA, 24 bp, Artificial Sequence
  Description of Artificial Sequence: Synthetic oligonucleotide
ggcagcccttggcttgggcttcct

SEQ ID NO: 221568 - DNA, 25 bp, Artificial Sequence
  Description of Artificial Sequence: Synthetic oligonucleotide
gcagcccttggcttgggcttcctca

SEQ ID NO: 221569 - DNA, 25 bp, Artificial Sequence
  Description of Artificial Sequence: Synthetic oligonucleotide
cagcccttggcttgggcttcctcac

SEQ ID NO: 221570 - DNA, 26 bp, Artificial Sequence
  Description of Artificial Sequence: Synthetic oligonucleotide
agcccttggcttgggcttcctcacct

SEQ ID NO: 221571 - DNA, 40 bp, Artificial Sequence
  Description of Artificial Sequence: Synthetic oligonucleotide
accctgaggatggtcatcagtaatatcttcaacacttatg

SEQ ID NO: 221572 - DNA, 39 bp, Artificial Sequence
  Description of Artificial Sequence: Synthetic oligonucleotide
ccctgaggatggtcatcagtaatatcttcaacacttatg

SEQ ID NO: 221573 - DNA, 34 bp, Artificial Sequence
  Description of Artificial Sequence: Synthetic oligonucleotide
cttcatactgtctggaacggcaatggcatgtttg

SEQ ID NO: 221574 - DNA, 34 bp, Artificial Sequence
  Description of Artificial Sequence: Synthetic oligonucleotide
ttcatactgtctggaacggcaatggcatgtttgc

SEQ ID NO: 221575 - DNA, 33 bp, Artificial Sequence
  Description of Artificial Sequence: Synthetic oligonucleotide
tcatactgtctggaacggcaatggcatgtttgc

SEQ ID NO: 221576 - DNA, 32 bp, Artificial Sequence
  Description of Artificial Sequence: Synthetic oligonucleotide
catactgtctggaacggcaatggcatgtttgc

SEQ ID NO: 221577 - DNA, 33 bp, Artificial Sequence
  Description of Artificial Sequence: Synthetic oligonucleotide
atactgtctggaacggcaatggcatgtttgctc

SEQ ID NO: 221578 - DNA, 32 bp, Artificial Sequence
  Description of Artificial Sequence: Synthetic oligonucleotide
tactgtctggaacggcaatggcatgtttgctc

SEQ ID NO: 221579 - DNA, 31 bp, Artificial Sequence
  Description of Artificial Sequence: Synthetic oligonucleotide
actgtctggaacggcaatggcatgtttgctc

SEQ ID NO: 221580 - DNA, 30 bp, Artificial Sequence
  Description of Artificial Sequence: Synthetic oligonucleotide
ctgtctggaacggcaatggcatgtttgctc

SEQ ID NO: 221581 - DNA, 30 bp, Artificial Sequence
  Description of Artificial Sequence: Synthetic oligonucleotide
tgtctggaacggcaatggcatgtttgctcc

SEQ ID NO: 221582 - DNA, 29 bp, Artificial Sequence
  Description of Artificial Sequence: Synthetic oligonucleotide
gtctggaacggcaatggcatgtttgctcc

SEQ ID NO: 221583 - DNA, 34 bp, Artificial Sequence
  Description of Artificial Sequence: Synthetic oligonucleotide
tctggaacggcaatggcatgtttgctcctaaatc

SEQ ID NO: 221584 - DNA, 33 bp, Artificial Sequence
  Description of Artificial Sequence: Synthetic oligonucleotide
ctggaacggcaatggcatgtttgctcctaaatc

SEQ ID NO: 221585 - DNA, 34 bp, Artificial Sequence
  Description of Artificial Sequence: Synthetic oligonucleotide
tggaacggcaatggcatgtttgctcctaaatctc

SEQ ID NO: 221586 - DNA, 33 bp, Artificial Sequence
  Description of Artificial Sequence: Synthetic oligonucleotide
ggaacggcaatggcatgtttgctcctaaatctc

SEQ ID NO: 221587 - DNA, 40 bp, Artificial Sequence
  Description of Artificial Sequence: Synthetic oligonucleotide
gaacggcaatggcatgtttgctcctaaatctcaaaatatg

SEQ ID NO: 221588 - DNA, 40 bp, Artificial Sequence
  Description of Artificial Sequence: Synthetic oligonucleotide
aacggcaatggcatgtttgctcctaaatctcaaaatatgg

SEQ ID NO: 221589 - DNA, 39 bp, Artificial Sequence
  Description of Artificial Sequence: Synthetic oligonucleotide
acggcaatggcatgtttgctcctaaatctcaaaatatgg

SEQ ID NO: 221590 - DNA, 38 bp, Artificial Sequence
  Description of Artificial Sequence: Synthetic oligonucleotide
cggcaatggcatgtttgctcctaaatctcaaaatatgg

SEQ ID NO: 221591 - DNA, 41 bp, Artificial Sequence
  Description of Artificial Sequence: Synthetic oligonucleotide
ggcaatggcatgtttgctcctaaatctcaaaatatggaaag

SEQ ID NO: 221592 - DNA, 41 bp, Artificial Sequence
  Description of Artificial Sequence: Synthetic oligonucleotide
gcaatggcatgtttgctcctaaatctcaaaatatggaaagc

SEQ ID NO: 221593 - DNA, 42 bp, Artificial Sequence
  Description of Artificial Sequence: Synthetic oligonucleotide
caatggcatgtttgctcctaaatctcaaaatatggaaagcac

SEQ ID NO: 221594 - DNA, 42 bp, Artificial Sequence
  Description of Artificial Sequence: Synthetic oligonucleotide
aatggcatgtttgctcctaaatctcaaaatatggaaagcacc

SEQ ID NO: 221595 - DNA, 41 bp, Artificial Sequence
  Description of Artificial Sequence: Synthetic oligonucleotide
atggcatgtttgctcctaaatctcaaaatatggaaagcacc

SEQ ID NO: 221596 - DNA, 40 bp, Artificial Sequence
  Description of Artificial Sequence: Synthetic oligonucleotide
tggcatgtttgctcctaaatctcaaaatatggaaagcacc

SEQ ID NO: 221597 - DNA, 39 bp, Artificial Sequence
  Description of Artificial Sequence: Synthetic oligonucleotide
ggcatgtttgctcctaaatctcaaaatatggaaagcacc

SEQ ID NO: 221598 - DNA, 40 bp, Artificial Sequence
  Description of Artificial Sequence: Synthetic oligonucleotide
gcatgtttgctcctaaatctcaaaatatggaaagcacctc

SEQ ID NO: 221599 - DNA, 42 bp, Artificial Sequence
  Description of Artificial Sequence: Synthetic oligonucleotide
catgtttgctcctaaatctcaaaatatggaaagcacctcatg

SEQ ID NO: 221600 - DNA, 43 bp, Artificial Sequence
  Description of Artificial Sequence: Synthetic oligonucleotide
atgtttgctcctaaatctcaaaatatggaaagcacctcatgtg

SEQ ID NO: 221601 - DNA, 42 bp, Artificial Sequence
  Description of Artificial Sequence: Synthetic oligonucleotide
tgtttgctcctaaatctcaaaatatggaaagcacctcatgtg

SEQ ID NO: 221602 - DNA, 35 bp, Artificial Sequence
  Description of Artificial Sequence: Synthetic oligonucleotide
caccctgaggatggtcatcagtaatatcttcaacg

SEQ ID NO: 221603 - DNA, 36 bp, Artificial Sequence
  Description of Artificial Sequence: Synthetic oligonucleotide
accctgaggatggtcatcagtaatatcttcaacgtg

SEQ ID NO: 221604 - DNA, 35 bp, Artificial Sequence
  Description of Artificial Sequence: Synthetic oligonucleotide
ccctgaggatggtcatcagtaatatcttcaacgtg

SEQ ID NO: 221605 - DNA, 33 bp, Artificial Sequence
  Description of Artificial Sequence: Synthetic oligonucleotide
tgctgagaagtccaatccaaaggaagaatgccg

SEQ ID NO: 221606 - DNA, 32 bp, Artificial Sequence
  Description of Artificial Sequence: Synthetic oligonucleotide
gctgagaagtccaatccaaaggaagaatgccg

SEQ ID NO: 221607 - DNA, 33 bp, Artificial Sequence
  Description of Artificial Sequence: Synthetic oligonucleotide
ctgagaagtccaatccaaaggaagaatgccgtg

SEQ ID NO: 221608 - DNA, 35 bp, Artificial Sequence
  Description of Artificial Sequence: Synthetic oligonucleotide
tgagaagtccaatccaaaggaagaatgccgtgttc

SEQ ID NO: 221609 - DNA, 34 bp, Artificial Sequence
  Description of Artificial Sequence: Synthetic oligonucleotide
gagaagtccaatccaaaggaagaatgccgtgttc

SEQ ID NO: 221610 - DNA, 36 bp, Artificial Sequence
  Description of Artificial Sequence: Synthetic oligonucleotide
agaagtccaatccaaaggaagaatgccgtgttcaac

SEQ ID NO: 221611 - DNA, 35 bp, Artificial Sequence
  Description of Artificial Sequence: Synthetic oligonucleotide
gaagtccaatccaaaggaagaatgccgtgttcaac

SEQ ID NO: 221612 - DNA, 36 bp, Artificial Sequence
  Description of Artificial Sequence: Synthetic oligonucleotide
aagtccaatccaaaggaagaatgccgtgttcaacac

SEQ ID NO: 221613 - DNA, 35 bp, Artificial Sequence
  Description of Artificial Sequence: Synthetic oligonucleotide
agtccaatccaaaggaagaatgccgtgttcaacac

SEQ ID NO: 221614 - DNA, 34 bp, Artificial Sequence
  Description of Artificial Sequence: Synthetic oligonucleotide
gtccaatccaaaggaagaatgccgtgttcaacac

SEQ ID NO: 221615 - DNA, 34 bp, Artificial Sequence
  Description of Artificial Sequence: Synthetic oligonucleotide
tccaatccaaaggaagaatgccgtgttcaacacc

SEQ ID NO: 221616 - DNA, 33 bp, Artificial Sequence
  Description of Artificial Sequence: Synthetic oligonucleotide
ccaatccaaaggaagaatgccgtgttcaacacc

SEQ ID NO: 221617 - DNA, 35 bp, Artificial Sequence
  Description of Artificial Sequence: Synthetic oligonucleotide
caatccaaaggaagaatgccgtgttcaacacctac

SEQ ID NO: 221618 - DNA, 38 bp, Artificial Sequence
  Description of Artificial Sequence: Synthetic oligonucleotide
aatccaaaggaagaatgccgtgttcaacacctactatg

SEQ ID NO: 221619 - DNA, 37 bp, Artificial Sequence
  Description of Artificial Sequence: Synthetic oligonucleotide
atccaaaggaagaatgccgtgttcaacacctactatg

SEQ ID NO: 221620 - DNA, 36 bp, Artificial Sequence
  Description of Artificial Sequence: Synthetic oligonucleotide
tccaaaggaagaatgccgtgttcaacacctactatg

SEQ ID NO: 221621 - DNA, 35 bp, Artificial Sequence
  Description of Artificial Sequence: Synthetic oligonucleotide
ccaaaggaagaatgccgtgttcaacacctactatg

SEQ ID NO: 221622 - DNA, 35 bp, Artificial Sequence
  Description of Artificial Sequence: Synthetic oligonucleotide
caaaggaagaatgccgtgttcaacacctactatgc

SEQ ID NO: 221623 - DNA, 27 bp, Artificial Sequence
  Description of Artificial Sequence: Synthetic oligonucleotide
ggctcacccccaagggaagatcagcaa

SEQ ID NO: 221624 - DNA, 27 bp, Artificial Sequence
  Description of Artificial Sequence: Synthetic oligonucleotide
gctcacccccaagggaagatcagcaag

SEQ ID NO: 221625 - DNA, 28 bp, Artificial Sequence
  Description of Artificial Sequence: Synthetic oligonucleotide
ctcacccccaagggaagatcagcaagac

SEQ ID NO: 221626 - DNA, 32 bp, Artificial Sequence
  Description of Artificial Sequence: Synthetic oligonucleotide
tcacccccaagggaagatcagcaagacttatg

SEQ ID NO: 221627 - DNA, 31 bp, Artificial Sequence
  Description of Artificial Sequence: Synthetic oligonucleotide
cacccccaagggaagatcagcaagacttatg

SEQ ID NO: 221628 - DNA, 32 bp, Artificial Sequence
  Description of Artificial Sequence: Synthetic oligonucleotide
acccccaagggaagatcagcaagacttatgtg

SEQ ID NO: 221629 - DNA, 31 bp, Artificial Sequence
  Description of Artificial Sequence: Synthetic oligonucleotide
cccccaagggaagatcagcaagacttatgtg

SEQ ID NO: 221630 - DNA, 31 bp, Artificial Sequence
  Description of Artificial Sequence: Synthetic oligonucleotide
ccccaagggaagatcagcaagacttatgtgc

SEQ ID NO: 221631 - DNA, 32 bp, Artificial Sequence
  Description of Artificial Sequence: Synthetic oligonucleotide
cccaagggaagatcagcaagacttatgtgcac

SEQ ID NO: 221632 - DNA, 33 bp, Artificial Sequence
  Description of Artificial Sequence: Synthetic oligonucleotide
ccaagggaagatcagcaagacttatgtgcacag

SEQ ID NO: 221633 - DNA, 34 bp, Artificial Sequence
  Description of Artificial Sequence: Synthetic oligonucleotide
caagggaagatcagcaagacttatgtgcacagtg

SEQ ID NO: 221634 - DNA, 34 bp, Artificial Sequence
  Description of Artificial Sequence: Synthetic oligonucleotide
aagggaagatcagcaagacttatgtgcacagtgc

SEQ ID NO: 221635 - DNA, 33 bp, Artificial Sequence
  Description of Artificial Sequence: Synthetic oligonucleotide
agggaagatcagcaagacttatgtgcacagtgc

SEQ ID NO: 221636 - DNA, 32 bp, Artificial Sequence
  Description of Artificial Sequence: Synthetic oligonucleotide
gggaagatcagcaagacttatgtgcacagtgc

SEQ ID NO: 221637 - DNA, 32 bp, Artificial Sequence
  Description of Artificial Sequence: Synthetic oligonucleotide
ggaagatcagcaagacttatgtgcacagtgcg

SEQ ID NO: 221638 - DNA, 32 bp, Artificial Sequence
  Description of Artificial Sequence: Synthetic oligonucleotide
gaagatcagcaagacttatgtgcacagtgcgg

SEQ ID NO: 221639 - DNA, 33 bp, Artificial Sequence
  Description of Artificial Sequence: Synthetic oligonucleotide
aagatcagcaagacttatgtgcacagtgcggtg

SEQ ID NO: 221640 - DNA, 32 bp, Artificial Sequence
  Description of Artificial Sequence: Synthetic oligonucleotide
agatcagcaagacttatgtgcacagtgcggtg

SEQ ID NO: 221641 - DNA, 31 bp, Artificial Sequence
  Description of Artificial Sequence: Synthetic oligonucleotide
gatcagcaagacttatgtgcacagtgcggtg

SEQ ID NO: 221642 - DNA, 33 bp, Artificial Sequence
  Description of Artificial Sequence: Synthetic oligonucleotide
atcagcaagacttatgtgcacagtgcggtgttg

SEQ ID NO: 221643 - DNA, 32 bp, Artificial Sequence
  Description of Artificial Sequence: Synthetic oligonucleotide
tcagcaagacttatgtgcacagtgcggtgttg

SEQ ID NO: 221644 - DNA, 31 bp, Artificial Sequence
  Description of Artificial Sequence: Synthetic oligonucleotide
cagcaagacttatgtgcacagtgcggtgttg

SEQ ID NO: 221645 - DNA, 31 bp, Artificial Sequence
  Description of Artificial Sequence: Synthetic oligonucleotide
agcaagacttatgtgcacagtgcggtgttgg

SEQ ID NO: 221646 - DNA, 30 bp, Artificial Sequence
  Description of Artificial Sequence: Synthetic oligonucleotide
gcaagacttatgtgcacagtgcggtgttgg

SEQ ID NO: 221647 - DNA, 30 bp, Artificial Sequence
  Description of Artificial Sequence: Synthetic oligonucleotide
caagacttatgtgcacagtgcggtgttggc

SEQ ID NO: 221648 - DNA, 31 bp, Artificial Sequence
  Description of Artificial Sequence: Synthetic oligonucleotide
aagacttatgtgcacagtgcggtgttggcag

SEQ ID NO: 221649 - DNA, 30 bp, Artificial Sequence
  Description of Artificial Sequence: Synthetic oligonucleotide
agacttatgtgcacagtgcggtgttggcag

SEQ ID NO: 221650 - DNA, 36 bp, Artificial Sequence
  Description of Artificial Sequence: Synthetic oligonucleotide
caaaggaagatcagcatgacttatgtgcacagtgtg

SEQ ID NO: 221651 - DNA, 36 bp, Artificial Sequence
  Description of Artificial Sequence: Synthetic oligonucleotide
aaaggaagatcagcatgacttatgtgcacagtgtgg

SEQ ID NO: 221652 - DNA, 35 bp, Artificial Sequence
  Description of Artificial Sequence: Synthetic oligonucleotide
aaggaagatcagcatgacttatgtgcacagtgtgg

SEQ ID NO: 221653 - DNA, 34 bp, Artificial Sequence
  Description of Artificial Sequence: Synthetic oligonucleotide
aggaagatcagcatgacttatgtgcacagtgtgg

SEQ ID NO: 221654 - DNA, 33 bp, Artificial Sequence
  Description of Artificial Sequence: Synthetic oligonucleotide
ggaagatcagcatgacttatgtgcacagtgtgg

SEQ ID NO: 221655 - DNA, 34 bp, Artificial Sequence
  Description of Artificial Sequence: Synthetic oligonucleotide
gaagatcagcatgacttatgtgcacagtgtggtg

SEQ ID NO: 221656 - DNA, 36 bp, Artificial Sequence
  Description of Artificial Sequence: Synthetic oligonucleotide
aagatcagcatgacttatgtgcacagtgtggtgttg

SEQ ID NO: 221657 - DNA, 35 bp, Artificial Sequence
  Description of Artificial Sequence: Synthetic oligonucleotide
agatcagcatgacttatgtgcacagtgtggtgttg

SEQ ID NO: 221658 - DNA, 34 bp, Artificial Sequence
  Description of Artificial Sequence: Synthetic oligonucleotide
gatcagcatgacttatgtgcacagtgtggtgttg

SEQ ID NO: 221659 - DNA, 34 bp, Artificial Sequence
  Description of Artificial Sequence: Synthetic oligonucleotide
atcagcatgacttatgtgcacagtgtggtgttgg

SEQ ID NO: 221660 - DNA, 33 bp, Artificial Sequence
  Description of Artificial Sequence: Synthetic oligonucleotide
tcagcatgacttatgtgcacagtgtggtgttgg

SEQ ID NO: 221661 - DNA, 32 bp, Artificial Sequence
  Description of Artificial Sequence: Synthetic oligonucleotide
cagcatgacttatgtgcacagtgtggtgttgg

SEQ ID NO: 221662 - DNA, 32 bp, Artificial Sequence
  Description of Artificial Sequence: Synthetic oligonucleotide
agcatgacttatgtgcacagtgtggtgttggc

SEQ ID NO: 221663 - DNA, 31 bp, Artificial Sequence
  Description of Artificial Sequence: Synthetic oligonucleotide
gcatgacttatgtgcacagtgtggtgttggc

SEQ ID NO: 221664 - DNA, 32 bp, Artificial Sequence
  Description of Artificial Sequence: Synthetic oligonucleotide
catgacttatgtgcacagtgtggtgttggcag

SEQ ID NO: 221665 - DNA, 32 bp, Artificial Sequence
  Description of Artificial Sequence: Synthetic oligonucleotide
atgacttatgtgcacagtgtggtgttggcagg

SEQ ID NO: 221666 - DNA, 31 bp, Artificial Sequence
  Description of Artificial Sequence: Synthetic oligonucleotide
tgacttatgtgcacagtgtggtgttggcagg

SEQ ID NO: 221667 - DNA, 30 bp, Artificial Sequence
  Description of Artificial Sequence: Synthetic oligonucleotide
gacttatgtgcacagtgtggtgttggcagg

SEQ ID NO: 221668 - DNA, 31 bp, Artificial Sequence
  Description of Artificial Sequence: Synthetic oligonucleotide
acttatgtgcacagtgtggtgttggcaggag

SEQ ID NO: 221669 - DNA, 30 bp, Artificial Sequence
  Description of Artificial Sequence: Synthetic oligonucleotide
cttatgtgcacagtgtggtgttggcaggag

SEQ ID NO: 221670 - DNA, 30 bp, Artificial Sequence
  Description of Artificial Sequence: Synthetic oligonucleotide
ttatgtgcacagtgtggtgttggcaggagg

SEQ ID NO: 221671 - DNA, 29 bp, Artificial Sequence
  Description of Artificial Sequence: Synthetic oligonucleotide
tatgtgcacagtgtggtgttggcaggagg

SEQ ID NO: 221672 - DNA, 28 bp, Artificial Sequence
  Description of Artificial Sequence: Synthetic oligonucleotide
atgtgcacagtgtggtgttggcaggagg

SEQ ID NO: 221673 - DNA, 27 bp, Artificial Sequence
  Description of Artificial Sequence: Synthetic oligonucleotide
tgtgcacagtgtggtgttggcaggagg

SEQ ID NO: 221674 - DNA, 26 bp, Artificial Sequence
  Description of Artificial Sequence: Synthetic oligonucleotide
gtgcacagtgtggtgttggcaggagg

SEQ ID NO: 221675 - DNA, 26 bp, Artificial Sequence
  Description of Artificial Sequence: Synthetic oligonucleotide
tgcacagtgtggtgttggcaggaggc

SEQ ID NO: 221676 - DNA, 25 bp, Artificial Sequence
  Description of Artificial Sequence: Synthetic oligonucleotide
gcacagtgtggtgttggcaggaggc

SEQ ID NO: 221677 - DNA, 26 bp, Artificial Sequence
  Description of Artificial Sequence: Synthetic oligonucleotide
cacagtgtggtgttggcaggaggcgt

SEQ ID NO: 221678 - DNA, 26 bp, Artificial Sequence
  Description of Artificial Sequence: Synthetic oligonucleotide
acagtgtggtgttggcaggaggcgtg

SEQ ID NO: 221679 - DNA, 25 bp, Artificial Sequence
  Description of Artificial Sequence: Synthetic oligonucleotide
cagtgtggtgttggcaggaggcgtg

SEQ ID NO: 221680 - DNA, 25 bp, Artificial Sequence
  Description of Artificial Sequence: Synthetic oligonucleotide
agtgtggtgttggcaggaggcgtgg

SEQ ID NO: 221681 - DNA, 24 bp, Artificial Sequence
  Description of Artificial Sequence: Synthetic oligonucleotide
gtgtggtgttggcaggaggcgtgg

SEQ ID NO: 221682 - DNA, 25 bp, Artificial Sequence
  Description of Artificial Sequence: Synthetic oligonucleotide
tgtggtgttggcaggaggcgtggct

SEQ ID NO: 221683 - DNA, 24 bp, Artificial Sequence
  Description of Artificial Sequence: Synthetic oligonucleotide
gtggtgttggcaggaggcgtggct

SEQ ID NO: 221684 - DNA, 25 bp, Artificial Sequence
  Description of Artificial Sequence: Synthetic oligonucleotide
tggtgttggcaggaggcgtggctgt

SEQ ID NO: 221685 - DNA, 29 bp, Artificial Sequence
  Description of Artificial Sequence: Synthetic oligonucleotide
ggaactcagcttggccatcgtgatagctg

SEQ ID NO: 221686 - DNA, 30 bp, Artificial Sequence
  Description of Artificial Sequence: Synthetic oligonucleotide
gaactcagcttggccatcgtgatagctgtc

SEQ ID NO: 221687 - DNA, 31 bp, Artificial Sequence
  Description of Artificial Sequence: Synthetic oligonucleotide
aactcagcttggccatcgtgatagctgtcac

SEQ ID NO: 221688 - DNA, 30 bp, Artificial Sequence
  Description of Artificial Sequence: Synthetic oligonucleotide
actcagcttggccatcgtgatagctgtcac

SEQ ID NO: 221689 - DNA, 29 bp, Artificial Sequence
  Description of Artificial Sequence: Synthetic oligonucleotide
ctcagcttggccatcgtgatagctgtcac

SEQ ID NO: 221690 - DNA, 29 bp, Artificial Sequence
  Description of Artificial Sequence: Synthetic oligonucleotide
tcagcttggccatcgtgatagctgtcacg

SEQ ID NO: 221691 - DNA, 28 bp, Artificial Sequence
  Description of Artificial Sequence: Synthetic oligonucleotide
cagcttggccatcgtgatagctgtcacg

SEQ ID NO: 221692 - DNA, 29 bp, Artificial Sequence
  Description of Artificial Sequence: Synthetic oligonucleotide
agcttggccatcgtgatagctgtcacgtc

SEQ ID NO: 221693 - DNA, 28 bp, Artificial Sequence
  Description of Artificial Sequence: Synthetic oligonucleotide
gcttggccatcgtgatagctgtcacgtc

SEQ ID NO: 221694 - DNA, 29 bp, Artificial Sequence
  Description of Artificial Sequence: Synthetic oligonucleotide
cttggccatcgtgatagctgtcacgtctg

SEQ ID NO: 221695 - DNA, 29 bp, Artificial Sequence
  Description of Artificial Sequence: Synthetic oligonucleotide
ttggccatcgtgatagctgtcacgtctgg

SEQ ID NO: 221696 - DNA, 28 bp, Artificial Sequence
  Description of Artificial Sequence: Synthetic oligonucleotide
tggccatcgtgatagctgtcacgtctgg

SEQ ID NO: 221697 - DNA, 27 bp, Artificial Sequence
  Description of Artificial Sequence: Synthetic oligonucleotide
ggccatcgtgatagctgtcacgtctgg

SEQ ID NO: 221698 - DNA, 28 bp, Artificial Sequence
  Description of Artificial Sequence: Synthetic oligonucleotide
gccatcgtgatagctgtcacgtctggtc

SEQ ID NO: 221699 - DNA, 29 bp, Artificial Sequence
  Description of Artificial Sequence: Synthetic oligonucleotide
ccatcgtgatagctgtcacgtctggtctc

SEQ ID NO: 221700 - DNA, 29 bp, Artificial Sequence
  Description of Artificial Sequence: Synthetic oligonucleotide
catcgtgatagctgtcacgtctggtctcc

SEQ ID NO: 221701 - DNA, 30 bp, Artificial Sequence
  Description of Artificial Sequence: Synthetic oligonucleotide
atcgtgatagctgtcacgtctggtctcctg

SEQ ID NO: 221702 - DNA, 29 bp, Artificial Sequence
  Description of Artificial Sequence: Synthetic oligonucleotide
tcgtgatagctgtcacgtctggtctcctg

SEQ ID NO: 221703 - DNA, 28 bp, Artificial Sequence
  Description of Artificial Sequence: Synthetic oligonucleotide
cgtgatagctgtcacgtctggtctcctg

SEQ ID NO: 221704 - DNA, 29 bp, Artificial Sequence
  Description of Artificial Sequence: Synthetic oligonucleotide
gtgatagctgtcacgtctggtctcctgac

SEQ ID NO: 221705 - DNA, 30 bp, Artificial Sequence
  Description of Artificial Sequence: Synthetic oligonucleotide
tgatagctgtcacgtctggtctcctgacag

SEQ ID NO: 221706 - DNA, 29 bp, Artificial Sequence
  Description of Artificial Sequence: Synthetic oligonucleotide
gatagctgtcacgtctggtctcctgacag

SEQ ID NO: 221707 - DNA, 29 bp, Artificial Sequence
  Description of Artificial Sequence: Synthetic oligonucleotide
atagctgtcacgtctggtctcctgacagg

SEQ ID NO: 221708 - DNA, 28 bp, Artificial Sequence
  Description of Artificial Sequence: Synthetic oligonucleotide
tagctgtcacgtctggtctcctgacagg

SEQ ID NO: 221709 - DNA, 27 bp, Artificial Sequence
  Description of Artificial Sequence: Synthetic oligonucleotide
agctgtcacgtctggtctcctgacagg

SEQ ID NO: 221710 - DNA, 27 bp, Artificial Sequence
  Description of Artificial Sequence: Synthetic oligonucleotide
gctgtcacgtctggtctcctgacaggt

SEQ ID NO: 221711 - DNA, 29 bp, Artificial Sequence
  Description of Artificial Sequence: Synthetic oligonucleotide
ctgtcacgtctggtctcctgacaggtttg

SEQ ID NO: 221712 - DNA, 29 bp, Artificial Sequence
  Description of Artificial Sequence: Synthetic oligonucleotide
tgtcacgtctggtctcctgacaggtttgc

SEQ ID NO: 221713 - DNA, 28 bp, Artificial Sequence
  Description of Artificial Sequence: Synthetic oligonucleotide
gtcacgtctggtctcctgacaggtttgc

SEQ ID NO: 221714 - DNA, 34 bp, Artificial Sequence
  Description of Artificial Sequence: Synthetic oligonucleotide
ctgggaaggtggtcatcacactgttcagtatttg

SEQ ID NO: 221715 - DNA, 34 bp, Artificial Sequence
  Description of Artificial Sequence: Synthetic oligonucleotide
tgggaaggtggtcatcacactgttcagtatttgg

SEQ ID NO: 221716 - DNA, 33 bp, Artificial Sequence
  Description of Artificial Sequence: Synthetic oligonucleotide
gggaaggtggtcatcacactgttcagtatttgg

SEQ ID NO: 221717 - DNA, 33 bp, Artificial Sequence
  Description of Artificial Sequence: Synthetic oligonucleotide
ggaaggtggtcatcacactgttcagtatttggc

SEQ ID NO: 221718 - DNA, 34 bp, Artificial Sequence
  Description of Artificial Sequence: Synthetic oligonucleotide
gaaggtggtcatcacactgttcagtatttggctg

SEQ ID NO: 221719 - DNA, 34 bp, Artificial Sequence
  Description of Artificial Sequence: Synthetic oligonucleotide
aaggtggtcatcacactgttcagtatttggctgg

SEQ ID NO: 221720 - DNA, 33 bp, Artificial Sequence
  Description of Artificial Sequence: Synthetic oligonucleotide
aggtggtcatcacactgttcagtatttggctgg

SEQ ID NO: 221721 - DNA, 32 bp, Artificial Sequence
  Description of Artificial Sequence: Synthetic oligonucleotide
ggtggtcatcacactgttcagtatttggctgg

SEQ ID NO: 221722 - DNA, 32 bp, Artificial Sequence
  Description of Artificial Sequence: Synthetic oligonucleotide
gtggtcatcacactgttcagtatttggctggc

SEQ ID NO: 221723 - DNA, 32 bp, Artificial Sequence
  Description of Artificial Sequence: Synthetic oligonucleotide
tggtcatcacactgttcagtatttggctggcc

SEQ ID NO: 221724 - DNA, 31 bp, Artificial Sequence
  Description of Artificial Sequence: Synthetic oligonucleotide
ggtcatcacactgttcagtatttggctggcc

SEQ ID NO: 221725 - DNA, 32 bp, Artificial Sequence
  Description of Artificial Sequence: Synthetic oligonucleotide
gtcatcacactgttcagtatttggctggccac

SEQ ID NO: 221726 - DNA, 32 bp, Artificial Sequence
  Description of Artificial Sequence: Synthetic oligonucleotide
tcatcacactgttcagtatttggctggccacc

SEQ ID NO: 221727 - DNA, 31 bp, Artificial Sequence
  Description of Artificial Sequence: Synthetic oligonucleotide
catcacactgttcagtatttggctggccacc

SEQ ID NO: 221728 - DNA, 33 bp, Artificial Sequence
  Description of Artificial Sequence: Synthetic oligonucleotide
atcacactgttcagtatttggctggccaccatg

SEQ ID NO: 221729 - DNA, 32 bp, Artificial Sequence
  Description of Artificial Sequence: Synthetic oligonucleotide
tcacactgttcagtatttggctggccaccatg

SEQ ID NO: 221730 - DNA, 31 bp, Artificial Sequence
  Description of Artificial Sequence: Synthetic oligonucleotide
cacactgttcagtatttggctggccaccatg

SEQ ID NO: 221731 - DNA, 32 bp, Artificial Sequence
  Description of Artificial Sequence: Synthetic oligonucleotide
acactgttcagtatttggctggccaccatgag

SEQ ID NO: 221732 - DNA, 31 bp, Artificial Sequence
  Description of Artificial Sequence: Synthetic oligonucleotide
cactgttcagtatttggctggccaccatgag

SEQ ID NO: 221733 - DNA, 32 bp, Artificial Sequence
  Description of Artificial Sequence: Synthetic oligonucleotide
actgttcagtatttggctggccaccatgagtg

SEQ ID NO: 221734 - DNA, 31 bp, Artificial Sequence
  Description of Artificial Sequence: Synthetic oligonucleotide
ctgttcagtatttggctggccaccatgagtg

SEQ ID NO: 221735 - DNA, 31 bp, Artificial Sequence
  Description of Artificial Sequence: Synthetic oligonucleotide
tgttcagtatttggctggccaccatgagtgc

SEQ ID NO: 221736 - DNA, 30 bp, Artificial Sequence
  Description of Artificial Sequence: Synthetic oligonucleotide
gttcagtatttggctggccaccatgagtgc

SEQ ID NO: 221737 - DNA, 33 bp, Artificial Sequence
  Description of Artificial Sequence: Synthetic oligonucleotide
ttcagtatttggctggccaccatgagtgctatg

SEQ ID NO: 221738 - DNA, 32 bp, Artificial Sequence
  Description of Artificial Sequence: Synthetic oligonucleotide
tcagtatttggctggccaccatgagtgctatg

SEQ ID NO: 221739 - DNA, 31 bp, Artificial Sequence
  Description of Artificial Sequence: Synthetic oligonucleotide
cagtatttggctggccaccatgagtgctatg

SEQ ID NO: 221740 - DNA, 32 bp, Artificial Sequence
  Description of Artificial Sequence: Synthetic oligonucleotide
agtatttggctggccaccatgagtgctatgtc

SEQ ID NO: 221741 - DNA, 31 bp, Artificial Sequence
  Description of Artificial Sequence: Synthetic oligonucleotide
gtatttggctggccaccatgagtgctatgtc

SEQ ID NO: 221742 - DNA, 31 bp, Artificial Sequence
  Description of Artificial Sequence: Synthetic oligonucleotide
tatttggctggccaccatgagtgctatgtcg

SEQ ID NO: 221743 - DNA, 30 bp, Artificial Sequence
  Description of Artificial Sequence: Synthetic oligonucleotide
atttggctggccaccatgagtgctatgtcg

SEQ ID NO: 221744 - DNA, 29 bp, Artificial Sequence
  Description of Artificial Sequence: Synthetic oligonucleotide
tttggctggccaccatgagtgctatgtcg

SEQ ID NO: 221745 - DNA, 28 bp, Artificial Sequence
  Description of Artificial Sequence: Synthetic oligonucleotide
ttggctggccaccatgagtgctatgtcg

SEQ ID NO: 221746 - DNA, 27 bp, Artificial Sequence
  Description of Artificial Sequence: Synthetic oligonucleotide
tggctggccaccatgagtgctatgtcg

SEQ ID NO: 221747 - DNA, 37 bp, Artificial Sequence
  Description of Artificial Sequence: Synthetic oligonucleotide
caaaggaagaatgccatgttcaacacctactatgctg

SEQ ID NO: 221748 - DNA, 39 bp, Artificial Sequence
  Description of Artificial Sequence: Synthetic oligonucleotide
aaaggaagaatgccatgttcaacacctactatgctgtag

SEQ ID NO: 221749 - DNA, 38 bp, Artificial Sequence
  Description of Artificial Sequence: Synthetic oligonucleotide
aaggaagaatgccatgttcaacacctactatgctgtag

SEQ ID NO: 221750 - DNA, 37 bp, Artificial Sequence
  Description of Artificial Sequence: Synthetic oligonucleotide
aggaagaatgccatgttcaacacctactatgctgtag

SEQ ID NO: 221751 - DNA, 36 bp, Artificial Sequence
  Description of Artificial Sequence: Synthetic oligonucleotide
ggaagaatgccatgttcaacacctactatgctgtag

SEQ ID NO: 221752 - DNA, 36 bp, Artificial Sequence
  Description of Artificial Sequence: Synthetic oligonucleotide
gaagaatgccatgttcaacacctactatgctgtagc

SEQ ID NO: 221753 - DNA, 37 bp, Artificial Sequence
  Description of Artificial Sequence: Synthetic oligonucleotide
aagaatgccatgttcaacacctactatgctgtagcag

SEQ ID NO: 221754 - DNA, 36 bp, Artificial Sequence
  Description of Artificial Sequence: Synthetic oligonucleotide
agaatgccatgttcaacacctactatgctgtagcag

SEQ ID NO: 221755 - DNA, 35 bp, Artificial Sequence
  Description of Artificial Sequence: Synthetic oligonucleotide
gaatgccatgttcaacacctactatgctgtagcag

SEQ ID NO: 221756 - DNA, 36 bp, Artificial Sequence
  Description of Artificial Sequence: Synthetic oligonucleotide
aatgccatgttcaacacctactatgctgtagcagtc

SEQ ID NO: 221757 - DNA, 35 bp, Artificial Sequence
  Description of Artificial Sequence: Synthetic oligonucleotide
atgccatgttcaacacctactatgctgtagcagtc

SEQ ID NO: 221758 - DNA, 34 bp, Artificial Sequence
  Description of Artificial Sequence: Synthetic oligonucleotide
tgccatgttcaacacctactatgctgtagcagtc

SEQ ID NO: 221759 - DNA, 33 bp, Artificial Sequence
  Description of Artificial Sequence: Synthetic oligonucleotide
gccatgttcaacacctactatgctgtagcagtc

SEQ ID NO: 221760 - DNA, 34 bp, Artificial Sequence
  Description of Artificial Sequence: Synthetic oligonucleotide
ccatgttcaacacctactatgctgtagcagtcag

SEQ ID NO: 221761 - DNA, 35 bp, Artificial Sequence
  Description of Artificial Sequence: Synthetic oligonucleotide
catgttcaacacctactatgctgtagcagtcagtg

SEQ ID NO: 221762 - DNA, 36 bp, Artificial Sequence
  Description of Artificial Sequence: Synthetic oligonucleotide
atgttcaacacctactatgctgtagcagtcagtgtg

SEQ ID NO: 221763 - DNA, 35 bp, Artificial Sequence
  Description of Artificial Sequence: Synthetic oligonucleotide
tgttcaacacctactatgctgtagcagtcagtgtg

SEQ ID NO: 221764 - DNA, 34 bp, Artificial Sequence
  Description of Artificial Sequence: Synthetic oligonucleotide
gttcaacacctactatgctgtagcagtcagtgtg

SEQ ID NO: 221765 - DNA, 34 bp, Artificial Sequence
  Description of Artificial Sequence: Synthetic oligonucleotide
ttcaacacctactatgctgtagcagtcagtgtgg

SEQ ID NO: 221766 - DNA, 33 bp, Artificial Sequence
  Description of Artificial Sequence: Synthetic oligonucleotide
tcaacacctactatgctgtagcagtcagtgtgg

SEQ ID NO: 221767 - DNA, 32 bp, Artificial Sequence
  Description of Artificial Sequence: Synthetic oligonucleotide
caacacctactatgctgtagcagtcagtgtgg

SEQ ID NO: 221768 - DNA, 33 bp, Artificial Sequence
  Description of Artificial Sequence: Synthetic oligonucleotide
aacacctactatgctgtagcagtcagtgtggtg

SEQ ID NO: 221769 - DNA, 32 bp, Artificial Sequence
  Description of Artificial Sequence: Synthetic oligonucleotide
acacctactatgctgtagcagtcagtgtggtg

SEQ ID NO: 221770 - DNA, 31 bp, Artificial Sequence
  Description of Artificial Sequence: Synthetic oligonucleotide
cacctactatgctgtagcagtcagtgtggtg

SEQ ID NO: 221771 - DNA, 32 bp, Artificial Sequence
  Description of Artificial Sequence: Synthetic oligonucleotide
acctactatgctgtagcagtcagtgtggtgac

SEQ ID NO: 221772 - DNA, 31 bp, Artificial Sequence
  Description of Artificial Sequence: Synthetic oligonucleotide
cctactatgctgtagcagtcagtgtggtgac

SEQ ID NO: 221773 - DNA, 32 bp, Artificial Sequence
  Description of Artificial Sequence: Synthetic oligonucleotide
ctactatgctgtagcagtcagtgtggtgacag

SEQ ID NO: 221774 - DNA, 32 bp, Artificial Sequence
  Description of Artificial Sequence: Synthetic oligonucleotide
tactatgctgtagcagtcagtgtggtgacagc

SEQ ID NO: 221775 - DNA, 31 bp, Artificial Sequence
  Description of Artificial Sequence: Synthetic oligonucleotide
actatgctgtagcagtcagtgtggtgacagc

SEQ ID NO: 221776 - DNA, 30 bp, Artificial Sequence
  Description of Artificial Sequence: Synthetic oligonucleotide
ctatgctgtagcagtcagtgtggtgacagc

SEQ ID NO: 221777 - DNA, 30 bp, Artificial Sequence
  Description of Artificial Sequence: Synthetic oligonucleotide
tatgctgtagcagtcagtgtggtgacagcc

SEQ ID NO: 221778 - DNA, 29 bp, Artificial Sequence
  Description of Artificial Sequence: Synthetic oligonucleotide
atgctgtagcagtcagtgtggtgacagcc

SEQ ID NO: 221779 - DNA, 28 bp, Artificial Sequence
  Description of Artificial Sequence: Synthetic oligonucleotide
tgctgtagcagtcagtgtggtgacagcc

SEQ ID NO: 221780 - DNA, 27 bp, Artificial Sequence
  Description of Artificial Sequence: Synthetic oligonucleotide
gctgtagcagtcagtgtggtgacagcc

SEQ ID NO: 221781 - DNA, 29 bp, Artificial Sequence
  Description of Artificial Sequence: Synthetic oligonucleotide
ctgtagcagtcagtgtggtgacagccatc

SEQ ID NO: 221782 - DNA, 30 bp, Artificial Sequence
  Description of Artificial Sequence: Synthetic oligonucleotide
tgtagcagtcagtgtggtgacagccatctc

SEQ ID NO: 221783 - DNA, 29 bp, Artificial Sequence
  Description of Artificial Sequence: Synthetic oligonucleotide
gtagcagtcagtgtggtgacagccatctc

SEQ ID NO: 221784 - DNA, 36 bp, Artificial Sequence
  Description of Artificial Sequence: Synthetic oligonucleotide
ttcaacacctactatgctgtagcagtcagtgtgatg

SEQ ID NO: 221785 - DNA, 35 bp, Artificial Sequence
  Description of Artificial Sequence: Synthetic oligonucleotide
tcaacacctactatgctgtagcagtcagtgtgatg

SEQ ID NO: 221786 - DNA, 34 bp, Artificial Sequence
  Description of Artificial Sequence: Synthetic oligonucleotide
caacacctactatgctgtagcagtcagtgtgatg

SEQ ID NO: 221787 - DNA, 35 bp, Artificial Sequence
  Description of Artificial Sequence: Synthetic oligonucleotide
aacacctactatgctgtagcagtcagtgtgatgac

SEQ ID NO: 221788 - DNA, 34 bp, Artificial Sequence
  Description of Artificial Sequence: Synthetic oligonucleotide
acacctactatgctgtagcagtcagtgtgatgac

SEQ ID NO: 221789 - DNA, 33 bp, Artificial Sequence
  Description of Artificial Sequence: Synthetic oligonucleotide
cacctactatgctgtagcagtcagtgtgatgac

SEQ ID NO: 221790 - DNA, 34 bp, Artificial Sequence
  Description of Artificial Sequence: Synthetic oligonucleotide
acctactatgctgtagcagtcagtgtgatgacag

SEQ ID NO: 221791 - DNA, 33 bp, Artificial Sequence
  Description of Artificial Sequence: Synthetic oligonucleotide
cctactatgctgtagcagtcagtgtgatgacag

SEQ ID NO: 221792 - DNA, 33 bp, Artificial Sequence
  Description of Artificial Sequence: Synthetic oligonucleotide
ctactatgctgtagcagtcagtgtgatgacagc

SEQ ID NO: 221793 - DNA, 33 bp, Artificial Sequence
  Description of Artificial Sequence: Synthetic oligonucleotide
tactatgctgtagcagtcagtgtgatgacagcc

SEQ ID NO: 221794 - DNA, 32 bp, Artificial Sequence
  Description of Artificial Sequence: Synthetic oligonucleotide
actatgctgtagcagtcagtgtgatgacagcc

SEQ ID NO: 221795 - DNA, 31 bp, Artificial Sequence
  Description of Artificial Sequence: Synthetic oligonucleotide
ctatgctgtagcagtcagtgtgatgacagcc

SEQ ID NO: 221796 - DNA, 33 bp, Artificial Sequence
  Description of Artificial Sequence: Synthetic oligonucleotide
tatgctgtagcagtcagtgtgatgacagccatc

SEQ ID NO: 221797 - DNA, 32 bp, Artificial Sequence
  Description of Artificial Sequence: Synthetic oligonucleotide
atgctgtagcagtcagtgtgatgacagccatc

SEQ ID NO: 221798 - DNA, 31 bp, Artificial Sequence
  Description of Artificial Sequence: Synthetic oligonucleotide
tgctgtagcagtcagtgtgatgacagccatc

SEQ ID NO: 221799 - DNA, 30 bp, Artificial Sequence
  Description of Artificial Sequence: Synthetic oligonucleotide
gctgtagcagtcagtgtgatgacagccatc

SEQ ID NO: 221800 - DNA, 31 bp, Artificial Sequence
  Description of Artificial Sequence: Synthetic oligonucleotide
ctgtagcagtcagtgtgatgacagccatctc

SEQ ID NO: 221801 - DNA, 32 bp, Artificial Sequence
  Description of Artificial Sequence: Synthetic oligonucleotide
tgtagcagtcagtgtgatgacagccatctcag

SEQ ID NO: 221802 - DNA, 31 bp, Artificial Sequence
  Description of Artificial Sequence: Synthetic oligonucleotide
gtagcagtcagtgtgatgacagccatctcag

SEQ ID NO: 221803 - DNA, 31 bp, Artificial Sequence
  Description of Artificial Sequence: Synthetic oligonucleotide
tagcagtcagtgtgatgacagccatctcagg

SEQ ID NO: 221804 - DNA, 30 bp, Artificial Sequence
  Description of Artificial Sequence: Synthetic oligonucleotide
agcagtcagtgtgatgacagccatctcagg

SEQ ID NO: 221805 - DNA, 29 bp, Artificial Sequence
  Description of Artificial Sequence: Synthetic oligonucleotide
gcagtcagtgtgatgacagccatctcagg

SEQ ID NO: 221806 - DNA, 29 bp, Artificial Sequence
  Description of Artificial Sequence: Synthetic oligonucleotide
cagtcagtgtgatgacagccatctcaggg

SEQ ID NO: 221807 - DNA, 30 bp, Artificial Sequence
  Description of Artificial Sequence: Synthetic oligonucleotide
agtcagtgtgatgacagccatctcagggtc

SEQ ID NO: 221808 - DNA, 29 bp, Artificial Sequence
  Description of Artificial Sequence: Synthetic oligonucleotide
gtcagtgtgatgacagccatctcagggtc

SEQ ID NO: 221809 - DNA, 31 bp, Artificial Sequence
  Description of Artificial Sequence: Synthetic oligonucleotide
tcagtgtgatgacagccatctcagggtcatc

SEQ ID NO: 221810 - DNA, 30 bp, Artificial Sequence
  Description of Artificial Sequence: Synthetic oligonucleotide
cagtgtgatgacagccatctcagggtcatc

SEQ ID NO: 221811 - DNA, 30 bp, Artificial Sequence
  Description of Artificial Sequence: Synthetic oligonucleotide
agtgtgatgacagccatctcagggtcatcc

SEQ ID NO: 221812 - DNA, 29 bp, Artificial Sequence
  Description of Artificial Sequence: Synthetic oligonucleotide
gtgtgatgacagccatctcagggtcatcc

SEQ ID NO: 221813 - DNA, 31 bp, Artificial Sequence
  Description of Artificial Sequence: Synthetic oligonucleotide
tgtgatgacagccatctcagggtcatccttg

SEQ ID NO: 221814 - DNA, 30 bp, Artificial Sequence
  Description of Artificial Sequence: Synthetic oligonucleotide
gtgatgacagccatctcagggtcatccttg

SEQ ID NO: 221815 - DNA, 30 bp, Artificial Sequence
  Description of Artificial Sequence: Synthetic oligonucleotide
tgatgacagccatctcagggtcatccttgg

SEQ ID NO: 221816 - DNA, 29 bp, Artificial Sequence
  Description of Artificial Sequence: Synthetic oligonucleotide
gatgacagccatctcagggtcatccttgg

SEQ ID NO: 221817 - DNA, 29 bp, Artificial Sequence
  Description of Artificial Sequence: Synthetic oligonucleotide
atgacagccatctcagggtcatccttggc

SEQ ID NO: 221818 - DNA, 28 bp, Artificial Sequence
  Description of Artificial Sequence: Synthetic oligonucleotide
tcgtggcatcctatcaagtcggccaagg

SEQ ID NO: 221819 - DNA, 27 bp, Artificial Sequence
  Description of Artificial Sequence: Synthetic oligonucleotide
cgtggcatcctatcaagtcggccaagg

SEQ ID NO: 221820 - DNA, 28 bp, Artificial Sequence
  Description of Artificial Sequence: Synthetic oligonucleotide
gtggcatcctatcaagtcggccaaggtc

SEQ ID NO: 221821 - DNA, 29 bp, Artificial Sequence
  Description of Artificial Sequence: Synthetic oligonucleotide
tggcatcctatcaagtcggccaaggtctg

SEQ ID NO: 221822 - DNA, 28 bp, Artificial Sequence
  Description of Artificial Sequence: Synthetic oligonucleotide
ggcatcctatcaagtcggccaaggtctg

SEQ ID NO: 221823 - DNA, 29 bp, Artificial Sequence
  Description of Artificial Sequence: Synthetic oligonucleotide
gcatcctatcaagtcggccaaggtctgac

SEQ ID NO: 221824 - DNA, 29 bp, Artificial Sequence
  Description of Artificial Sequence: Synthetic oligonucleotide
catcctatcaagtcggccaaggtctgacc

SEQ ID NO: 221825 - DNA, 29 bp, Artificial Sequence
  Description of Artificial Sequence: Synthetic oligonucleotide
atcctatcaagtcggccaaggtctgaccg

SEQ ID NO: 221826 - DNA, 28 bp, Artificial Sequence
  Description of Artificial Sequence: Synthetic oligonucleotide
tcctatcaagtcggccaaggtctgaccg

SEQ ID NO: 221827 - DNA, 27 bp, Artificial Sequence
  Description of Artificial Sequence: Synthetic oligonucleotide
cctatcaagtcggccaaggtctgaccg

SEQ ID NO: 221828 - DNA, 28 bp, Artificial Sequence
  Description of Artificial Sequence: Synthetic oligonucleotide
ctatcaagtcggccaaggtctgaccgtg

SEQ ID NO: 221829 - DNA, 30 bp, Artificial Sequence
  Description of Artificial Sequence: Synthetic oligonucleotide
tatcaagtcggccaaggtctgaccgtgatg

SEQ ID NO: 221830 - DNA, 29 bp, Artificial Sequence
  Description of Artificial Sequence: Synthetic oligonucleotide
atcaagtcggccaaggtctgaccgtgatg

SEQ ID NO: 221831 - DNA, 28 bp, Artificial Sequence
  Description of Artificial Sequence: Synthetic oligonucleotide
tcaagtcggccaaggtctgaccgtgatg

SEQ ID NO: 221832 - DNA, 27 bp, Artificial Sequence
  Description of Artificial Sequence: Synthetic oligonucleotide
caagtcggccaaggtctgaccgtgatg

SEQ ID NO: 221833 - DNA, 27 bp, Artificial Sequence
  Description of Artificial Sequence: Synthetic oligonucleotide
aagtcggccaaggtctgaccgtgatgg

SEQ ID NO: 221834 - DNA, 26 bp, Artificial Sequence
  Description of Artificial Sequence: Synthetic oligonucleotide
agtcggccaaggtctgaccgtgatgg

SEQ ID NO: 221835 - DNA, 25 bp, Artificial Sequence
  Description of Artificial Sequence: Synthetic oligonucleotide
gtcggccaaggtctgaccgtgatgg

SEQ ID NO: 221836 - DNA, 25 bp, Artificial Sequence
  Description of Artificial Sequence: Synthetic oligonucleotide
tcggccaaggtctgaccgtgatggc

SEQ ID NO: 221837 - DNA, 24 bp, Artificial Sequence
  Description of Artificial Sequence: Synthetic oligonucleotide
cggccaaggtctgaccgtgatggc

SEQ ID NO: 221838 - DNA, 24 bp, Artificial Sequence
  Description of Artificial Sequence: Synthetic oligonucleotide
ggccaaggtctgaccgtgatggcg

SEQ ID NO: 221839 - DNA, 24 bp, Artificial Sequence
  Description of Artificial Sequence: Synthetic oligonucleotide
gccaaggtctgaccgtgatggcgg

SEQ ID NO: 221840 - DNA, 24 bp, Artificial Sequence
  Description of Artificial Sequence: Synthetic oligonucleotide
ccaaggtctgaccgtgatggcggc

SEQ ID NO: 221841 - DNA, 24 bp, Artificial Sequence
  Description of Artificial Sequence: Synthetic oligonucleotide
caaggtctgaccgtgatggcggcc

SEQ ID NO: 221842 - DNA, 27 bp, Artificial Sequence
  Description of Artificial Sequence: Synthetic oligonucleotide
aaggtctgaccgtgatggcggcccttt

SEQ ID NO: 221843 - DNA, 26 bp, Artificial Sequence
  Description of Artificial Sequence: Synthetic oligonucleotide
aggtctgaccgtgatggcggcccttt

SEQ ID NO: 221844 - DNA, 25 bp, Artificial Sequence
  Description of Artificial Sequence: Synthetic oligonucleotide
ggtctgaccgtgatggcggcccttt

SEQ ID NO: 221845 - DNA, 25 bp, Artificial Sequence
  Description of Artificial Sequence: Synthetic oligonucleotide
gtctgaccgtgatggcggccctttg

SEQ ID NO: 221846 - DNA, 27 bp, Artificial Sequence
  Description of Artificial Sequence: Synthetic oligonucleotide
tctgaccgtgatggcggccctttgctt

SEQ ID NO: 221847 - DNA, 26 bp, Artificial Sequence
  Description of Artificial Sequence: Synthetic oligonucleotide
ctgaccgtgatggcggccctttgctt

SEQ ID NO: 221848 - DNA, 26 bp, Artificial Sequence
  Description of Artificial Sequence: Synthetic oligonucleotide
tgaccgtgatggcggccctttgcttg

SEQ ID NO: 221849 - DNA, 25 bp, Artificial Sequence
  Description of Artificial Sequence: Synthetic oligonucleotide
gaccgtgatggcggccctttgcttg

SEQ ID NO: 221850 - DNA, 25 bp, Artificial Sequence
  Description of Artificial Sequence: Synthetic oligonucleotide
accgtgatggcggccctttgcttgg

SEQ ID NO: 221851 - DNA, 24 bp, Artificial Sequence
  Description of Artificial Sequence: Synthetic oligonucleotide
ccgtgatggcggccctttgcttgg

SEQ ID NO: 221852 - DNA, 24 bp, Artificial Sequence
  Description of Artificial Sequence: Synthetic oligonucleotide
cgtgatggcggccctttgcttggg

SEQ ID NO: 221853 - DNA, 26 bp, Artificial Sequence
  Description of Artificial Sequence: Synthetic oligonucleotide
gtgatggcggccctttgcttgggctt

SEQ ID NO: 221854 - DNA, 26 bp, Artificial Sequence
  Description of Artificial Sequence: Synthetic oligonucleotide
tgatggcggccctttgcttgggcttc

SEQ ID NO: 221855 - DNA, 25 bp, Artificial Sequence
  Description of Artificial Sequence: Synthetic oligonucleotide
gatggcggccctttgcttgggcttc

SEQ ID NO: 221856 - DNA, 26 bp, Artificial Sequence
  Description of Artificial Sequence: Synthetic oligonucleotide
atggcggccctttgcttgggcttcct

SEQ ID NO: 221857 - DNA, 25 bp, Artificial Sequence
  Description of Artificial Sequence: Synthetic oligonucleotide
tggcggccctttgcttgggcttcct

SEQ ID NO: 221858 - DNA, 24 bp, Artificial Sequence
  Description of Artificial Sequence: Synthetic oligonucleotide
ggcggccctttgcttgggcttcct

SEQ ID NO: 221859 - DNA, 25 bp, Artificial Sequence
  Description of Artificial Sequence: Synthetic oligonucleotide
gcggccctttgcttgggcttcctca

SEQ ID NO: 221860 - DNA, 25 bp, Artificial Sequence
  Description of Artificial Sequence: Synthetic oligonucleotide
cggccctttgcttgggcttcctcac

SEQ ID NO: 221861 - DNA, 26 bp, Artificial Sequence
  Description of Artificial Sequence: Synthetic oligonucleotide
ggccctttgcttgggcttcctcacct

SEQ ID NO: 221862 - DNA, 27 bp, Artificial Sequence
  Description of Artificial Sequence: Synthetic oligonucleotide
gccctttgcttgggcttcctcacctca

SEQ ID NO: 221863 - DNA, 32 bp, Artificial Sequence
  Description of Artificial Sequence: Synthetic oligonucleotide
ccctttgcttgggcttcctcacctcaaatttc

SEQ ID NO: 221864 - DNA, 32 bp, Artificial Sequence
  Description of Artificial Sequence: Synthetic oligonucleotide
cctttgcttgggcttcctcacctcaaatttcc

SEQ ID NO: 221865 - DNA, 32 bp, Artificial Sequence
  Description of Artificial Sequence: Synthetic oligonucleotide
ctttgcttgggcttcctcacctcaaatttccg

SEQ ID NO: 221866 - DNA, 32 bp, Artificial Sequence
  Description of Artificial Sequence: Synthetic oligonucleotide
tttgcttgggcttcctcacctcaaatttccgg

SEQ ID NO: 221867 - DNA, 31 bp, Artificial Sequence
  Description of Artificial Sequence: Synthetic oligonucleotide
ttgcttgggcttcctcacctcaaatttccgg

SEQ ID NO: 221868 - DNA, 30 bp, Artificial Sequence
  Description of Artificial Sequence: Synthetic oligonucleotide
tgcttgggcttcctcacctcaaatttccgg

SEQ ID NO: 221869 - DNA, 32 bp, Artificial Sequence
  Description of Artificial Sequence: Synthetic oligonucleotide
tgtcaactctgctctgctgagaagtccaatcg

SEQ ID NO: 221870 - DNA, 31 bp, Artificial Sequence
  Description of Artificial Sequence: Synthetic oligonucleotide
gtcaactctgctctgctgagaagtccaatcg

SEQ ID NO: 221871 - DNA, 34 bp, Artificial Sequence
  Description of Artificial Sequence: Synthetic oligonucleotide
tcaactctgctctgctgagaagtccaatcgaaag

SEQ ID NO: 221872 - DNA, 33 bp, Artificial Sequence
  Description of Artificial Sequence: Synthetic oligonucleotide
caactctgctctgctgagaagtccaatcgaaag

SEQ ID NO: 221873 - DNA, 33 bp, Artificial Sequence
  Description of Artificial Sequence: Synthetic oligonucleotide
aactctgctctgctgagaagtccaatcgaaagg

SEQ ID NO: 221874 - DNA, 32 bp, Artificial Sequence
  Description of Artificial Sequence: Synthetic oligonucleotide
actctgctctgctgagaagtccaatcgaaagg

SEQ ID NO: 221875 - DNA, 31 bp, Artificial Sequence
  Description of Artificial Sequence: Synthetic oligonucleotide
ctctgctctgctgagaagtccaatcgaaagg

SEQ ID NO: 221876 - DNA, 33 bp, Artificial Sequence
  Description of Artificial Sequence: Synthetic oligonucleotide
tctgctctgctgagaagtccaatcgaaaggaag

SEQ ID NO: 221877 - DNA, 32 bp, Artificial Sequence
  Description of Artificial Sequence: Synthetic oligonucleotide
ctgctctgctgagaagtccaatcgaaaggaag

SEQ ID NO: 221878 - DNA, 35 bp, Artificial Sequence
  Description of Artificial Sequence: Synthetic oligonucleotide
tgctctgctgagaagtccaatcgaaaggaagaatg

SEQ ID NO: 221879 - DNA, 34 bp, Artificial Sequence
  Description of Artificial Sequence: Synthetic oligonucleotide
gctctgctgagaagtccaatcgaaaggaagaatg

SEQ ID NO: 221880 - DNA, 35 bp, Artificial Sequence
  Description of Artificial Sequence: Synthetic oligonucleotide
tgctgagaagtccaatcgaaaggaagaatgccatg

SEQ ID NO: 221881 - DNA, 34 bp, Artificial Sequence
  Description of Artificial Sequence: Synthetic oligonucleotide
gctgagaagtccaatcgaaaggaagaatgccatg

SEQ ID NO: 221882 - DNA, 36 bp, Artificial Sequence
  Description of Artificial Sequence: Synthetic oligonucleotide
ctgagaagtccaatcgaaaggaagaatgccatgttc

SEQ ID NO: 221883 - DNA, 38 bp, Artificial Sequence
  Description of Artificial Sequence: Synthetic oligonucleotide
tgagaagtccaatcgaaaggaagaatgccatgttcaac

SEQ ID NO: 221884 - DNA, 37 bp, Artificial Sequence
  Description of Artificial Sequence: Synthetic oligonucleotide
gagaagtccaatcgaaaggaagaatgccatgttcaac

SEQ ID NO: 221885 - DNA, 38 bp, Artificial Sequence
  Description of Artificial Sequence: Synthetic oligonucleotide
agaagtccaatcgaaaggaagaatgccatgttcaacac

SEQ ID NO: 221886 - DNA, 37 bp, Artificial Sequence
  Description of Artificial Sequence: Synthetic oligonucleotide
gaagtccaatcgaaaggaagaatgccatgttcaacac

SEQ ID NO: 221887 - DNA, 37 bp, Artificial Sequence
  Description of Artificial Sequence: Synthetic oligonucleotide
aagtccaatcgaaaggaagaatgccatgttcaacacc

SEQ ID NO: 221888 - DNA, 36 bp, Artificial Sequence
  Description of Artificial Sequence: Synthetic oligonucleotide
agtccaatcgaaaggaagaatgccatgttcaacacc

SEQ ID NO: 221889 - DNA, 35 bp, Artificial Sequence
  Description of Artificial Sequence: Synthetic oligonucleotide
gtccaatcgaaaggaagaatgccatgttcaacacc

SEQ ID NO: 221890 - DNA, 37 bp, Artificial Sequence
  Description of Artificial Sequence: Synthetic oligonucleotide
tccaatcgaaaggaagaatgccatgttcaacacctac

SEQ ID NO: 221891 - DNA, 36 bp, Artificial Sequence
  Description of Artificial Sequence: Synthetic oligonucleotide
ccaatcgaaaggaagaatgccatgttcaacacctac

SEQ ID NO: 221892 - DNA, 39 bp, Artificial Sequence
  Description of Artificial Sequence: Synthetic oligonucleotide
caatcgaaaggaagaatgccatgttcaacacctactatg

SEQ ID NO: 221893 - DNA, 39 bp, Artificial Sequence
  Description of Artificial Sequence: Synthetic oligonucleotide
aatcgaaaggaagaatgccatgttcaacacctactatgc

SEQ ID NO: 221894 - DNA, 38 bp, Artificial Sequence
  Description of Artificial Sequence: Synthetic oligonucleotide
atcgaaaggaagaatgccatgttcaacacctactatgc

SEQ ID NO: 221895 - DNA, 37 bp, Artificial Sequence
  Description of Artificial Sequence: Synthetic oligonucleotide
tcgaaaggaagaatgccatgttcaacacctactatgc

SEQ ID NO: 221896 - DNA, 36 bp, Artificial Sequence
  Description of Artificial Sequence: Synthetic oligonucleotide
cgaaaggaagaatgccatgttcaacacctactatgc

SEQ ID NO: 221897 - DNA, 37 bp, Artificial Sequence
  Description of Artificial Sequence: Synthetic oligonucleotide
gaaaggaagaatgccatgttcaacacctactatgctc

SEQ ID NO: 221898 - DNA, 27 bp, Artificial Sequence
  Description of Artificial Sequence: Synthetic oligonucleotide
cttgtggctgggctgatctccatcgga

SEQ ID NO: 221899 - DNA, 27 bp, Artificial Sequence
  Description of Artificial Sequence: Synthetic oligonucleotide
ttgtggctgggctgatctccatcggag

SEQ ID NO: 221900 - DNA, 26 bp, Artificial Sequence
  Description of Artificial Sequence: Synthetic oligonucleotide
tgtggctgggctgatctccatcggag

SEQ ID NO: 221901 - DNA, 25 bp, Artificial Sequence
  Description of Artificial Sequence: Synthetic oligonucleotide
gtggctgggctgatctccatcggag

SEQ ID NO: 221902 - DNA, 26 bp, Artificial Sequence
  Description of Artificial Sequence: Synthetic oligonucleotide
tggctgggctgatctccatcggagga

SEQ ID NO: 221903 - DNA, 25 bp, Artificial Sequence
  Description of Artificial Sequence: Synthetic oligonucleotide
ggctgggctgatctccatcggagga

SEQ ID NO: 221904 - DNA, 25 bp, Artificial Sequence
  Description of Artificial Sequence: Synthetic oligonucleotide
gctgggctgatctccatcggaggag

SEQ ID NO: 221905 - DNA, 25 bp, Artificial Sequence
  Description of Artificial Sequence: Synthetic oligonucleotide
ctgggctgatctccatcggaggagc

SEQ ID NO: 221906 - DNA, 27 bp, Artificial Sequence
  Description of Artificial Sequence: Synthetic oligonucleotide
tgggctgatctccatcggaggagccaa

SEQ ID NO: 221907 - DNA, 26 bp, Artificial Sequence
  Description of Artificial Sequence: Synthetic oligonucleotide
gggctgatctccatcggaggagccaa

SEQ ID NO: 221908 - DNA, 27 bp, Artificial Sequence
  Description of Artificial Sequence: Synthetic oligonucleotide
ggctgatctccatcggaggagccaagt

SEQ ID NO: 221909 - DNA, 27 bp, Artificial Sequence
  Description of Artificial Sequence: Synthetic oligonucleotide
gctgatctccatcggaggagccaagtg

SEQ ID NO: 221910 - DNA, 27 bp, Artificial Sequence
  Description of Artificial Sequence: Synthetic oligonucleotide
ctgatctccatcggaggagccaagtgc

SEQ ID NO: 221911 - DNA, 27 bp, Artificial Sequence
  Description of Artificial Sequence: Synthetic oligonucleotide
tgatctccatcggaggagccaagtgcc

SEQ ID NO: 221912 - DNA, 27 bp, Artificial Sequence
  Description of Artificial Sequence: Synthetic oligonucleotide
gatctccatcggaggagccaagtgcct

SEQ ID NO: 221913 - DNA, 27 bp, Artificial Sequence
  Description of Artificial Sequence: Synthetic oligonucleotide
atctccatcggaggagccaagtgcctg

SEQ ID NO: 221914 - DNA, 26 bp, Artificial Sequence
  Description of Artificial Sequence: Synthetic oligonucleotide
tctccatcggaggagccaagtgcctg

SEQ ID NO: 221915 - DNA, 25 bp, Artificial Sequence
  Description of Artificial Sequence: Synthetic oligonucleotide
ctccatcggaggagccaagtgcctg

SEQ ID NO: 221916 - DNA, 25 bp, Artificial Sequence
  Description of Artificial Sequence: Synthetic oligonucleotide
tccatcggaggagccaagtgcctgc

SEQ ID NO: 221917 - DNA, 24 bp, Artificial Sequence
  Description of Artificial Sequence: Synthetic oligonucleotide
ccatcggaggagccaagtgcctgc

SEQ ID NO: 221918 - DNA, 24 bp, Artificial Sequence
  Description of Artificial Sequence: Synthetic oligonucleotide
catcggaggagccaagtgcctgcc

SEQ ID NO: 221919 - DNA, 24 bp, Artificial Sequence
  Description of Artificial Sequence: Synthetic oligonucleotide
atcggaggagccaagtgcctgccg

SEQ ID NO: 221920 - DNA, 23 bp, Artificial Sequence
  Description of Artificial Sequence: Synthetic oligonucleotide
tcggaggagccaagtgcctgccg

SEQ ID NO: 221921 - DNA, 22 bp, Artificial Sequence
  Description of Artificial Sequence: Synthetic oligonucleotide
cggaggagccaagtgcctgccg

SEQ ID NO: 221922 - DNA, 23 bp, Artificial Sequence
  Description of Artificial Sequence: Synthetic oligonucleotide
ggaggagccaagtgcctgccggt

SEQ ID NO: 221923 - DNA, 24 bp, Artificial Sequence
  Description of Artificial Sequence: Synthetic oligonucleotide
gaggagccaagtgcctgccggtgt

SEQ ID NO: 221924 - DNA, 26 bp, Artificial Sequence
  Description of Artificial Sequence: Synthetic oligonucleotide
aggagccaagtgcctgccggtgtgtt

SEQ ID NO: 221925 - DNA, 26 bp, Artificial Sequence
  Description of Artificial Sequence: Synthetic oligonucleotide
tgggtcttgtggctgggctgatctcc

SEQ ID NO: 221926 - DNA, 25 bp, Artificial Sequence
  Description of Artificial Sequence: Synthetic oligonucleotide
gggtcttgtggctgggctgatctcc

SEQ ID NO: 221927 - DNA, 26 bp, Artificial Sequence
  Description of Artificial Sequence: Synthetic oligonucleotide
ggtcttgtggctgggctgatctccgt

SEQ ID NO: 221928 - DNA, 26 bp, Artificial Sequence
  Description of Artificial Sequence: Synthetic oligonucleotide
gtcttgtggctgggctgatctccgtc

SEQ ID NO: 221929 - DNA, 26 bp, Artificial Sequence
  Description of Artificial Sequence: Synthetic oligonucleotide
tcttgtggctgggctgatctccgtcg

SEQ ID NO: 221930 - DNA, 25 bp, Artificial Sequence
  Description of Artificial Sequence: Synthetic oligonucleotide
cttgtggctgggctgatctccgtcg

SEQ ID NO: 221931 - DNA, 25 bp, Artificial Sequence
  Description of Artificial Sequence: Synthetic oligonucleotide
ttgtggctgggctgatctccgtcgg

SEQ ID NO: 221932 - DNA, 24 bp, Artificial Sequence
  Description of Artificial Sequence: Synthetic oligonucleotide
tgtggctgggctgatctccgtcgg

SEQ ID NO: 221933 - DNA, 23 bp, Artificial Sequence
  Description of Artificial Sequence: Synthetic oligonucleotide
gtggctgggctgatctccgtcgg

SEQ ID NO: 221934 - DNA, 23 bp, Artificial Sequence
  Description of Artificial Sequence: Synthetic oligonucleotide
tggctgggctgatctccgtcggg

SEQ ID NO: 221935 - DNA, 22 bp, Artificial Sequence
  Description of Artificial Sequence: Synthetic oligonucleotide
ggctgggctgatctccgtcggg

SEQ ID NO: 221936 - DNA, 22 bp, Artificial Sequence
  Description of Artificial Sequence: Synthetic oligonucleotide
gctgggctgatctccgtcgggg

SEQ ID NO: 221937 - DNA, 23 bp, Artificial Sequence
  Description of Artificial Sequence: Synthetic oligonucleotide
ctgggctgatctccgtcggggga

SEQ ID NO: 221938 - DNA, 23 bp, Artificial Sequence
  Description of Artificial Sequence: Synthetic oligonucleotide
tgggctgatctccgtcgggggag

SEQ ID NO: 221939 - DNA, 22 bp, Artificial Sequence
  Description of Artificial Sequence: Synthetic oligonucleotide
gggctgatctccgtcgggggag

SEQ ID NO: 221940 - DNA, 22 bp, Artificial Sequence
  Description of Artificial Sequence: Synthetic oligonucleotide
ggctgatctccgtcgggggagc

SEQ ID NO: 221941 - DNA, 24 bp, Artificial Sequence
  Description of Artificial Sequence: Synthetic oligonucleotide
gctgatctccgtcgggggagccaa

SEQ ID NO: 221942 - DNA, 25 bp, Artificial Sequence
  Description of Artificial Sequence: Synthetic oligonucleotide
ctgatctccgtcgggggagccaagt

SEQ ID NO: 221943 - DNA, 25 bp, Artificial Sequence
  Description of Artificial Sequence: Synthetic oligonucleotide
tgatctccgtcgggggagccaagtg

SEQ ID NO: 221944 - DNA, 24 bp, Artificial Sequence
  Description of Artificial Sequence: Synthetic oligonucleotide
gatctccgtcgggggagccaagtg

SEQ ID NO: 221945 - DNA, 24 bp, Artificial Sequence
  Description of Artificial Sequence: Synthetic oligonucleotide
atctccgtcgggggagccaagtgc

SEQ ID NO: 221946 - DNA, 23 bp, Artificial Sequence
  Description of Artificial Sequence: Synthetic oligonucleotide
tctccgtcgggggagccaagtgc

SEQ ID NO: 221947 - DNA, 22 bp, Artificial Sequence
  Description of Artificial Sequence: Synthetic oligonucleotide
ctccgtcgggggagccaagtgc

SEQ ID NO: 221948 - DNA, 23 bp, Artificial Sequence
  Description of Artificial Sequence: Synthetic oligonucleotide
tccgtcgggggagccaagtgcct

SEQ ID NO: 221949 - DNA, 22 bp, Artificial Sequence
  Description of Artificial Sequence: Synthetic oligonucleotide
ccgtcgggggagccaagtgcct

SEQ ID NO: 221950 - DNA, 22 bp, Artificial Sequence
  Description of Artificial Sequence: Synthetic oligonucleotide
cgtcgggggagccaagtgcctg

SEQ ID NO: 221951 - DNA, 22 bp, Artificial Sequence
  Description of Artificial Sequence: Synthetic oligonucleotide
gtcgggggagccaagtgcctgc

SEQ ID NO: 221952 - DNA, 29 bp, Artificial Sequence
  Description of Artificial Sequence: Synthetic oligonucleotide
ataagctctaagtacccgcggtctgtccg

SEQ ID NO: 221953 - DNA, 28 bp, Artificial Sequence
  Description of Artificial Sequence: Synthetic oligonucleotide
taagctctaagtacccgcggtctgtccg

SEQ ID NO: 221954 - DNA, 27 bp, Artificial Sequence
  Description of Artificial Sequence: Synthetic oligonucleotide
aagctctaagtacccgcggtctgtccg

SEQ ID NO: 221955 - DNA, 29 bp, Artificial Sequence
  Description of Artificial Sequence: Synthetic oligonucleotide
agcagtgtggccttcaacctcttcatgcc

SEQ ID NO: 221956 - DNA, 28 bp, Artificial Sequence
  Description of Artificial Sequence: Synthetic oligonucleotide
gcagtgtggccttcaacctcttcatgcc

SEQ ID NO: 221957 - DNA, 28 bp, Artificial Sequence
  Description of Artificial Sequence: Synthetic oligonucleotide
cagtgtggccttcaacctcttcatgccg

SEQ ID NO: 221958 - DNA, 28 bp, Artificial Sequence
  Description of Artificial Sequence: Synthetic oligonucleotide
agtgtggccttcaacctcttcatgccgg

SEQ ID NO: 221959 - DNA, 27 bp, Artificial Sequence
  Description of Artificial Sequence: Synthetic oligonucleotide
gtgtggccttcaacctcttcatgccgg

SEQ ID NO: 221960 - DNA, 27 bp, Artificial Sequence
  Description of Artificial Sequence: Synthetic oligonucleotide
tgtggccttcaacctcttcatgccggc

SEQ ID NO: 221961 - DNA, 26 bp, Artificial Sequence
  Description of Artificial Sequence: Synthetic oligonucleotide
gtggccttcaacctcttcatgccggc

SEQ ID NO: 221962 - DNA, 26 bp, Artificial Sequence
  Description of Artificial Sequence: Synthetic oligonucleotide
tggccttcaacctcttcatgccggcg

SEQ ID NO: 221963 - DNA, 25 bp, Artificial Sequence
  Description of Artificial Sequence: Synthetic oligonucleotide
ggccttcaacctcttcatgccggcg

SEQ ID NO: 221964 - DNA, 27 bp, Artificial Sequence
  Description of Artificial Sequence: Synthetic oligonucleotide
gccttcaacctcttcatgccggcgctt

SEQ ID NO: 221965 - DNA, 27 bp, Artificial Sequence
  Description of Artificial Sequence: Synthetic oligonucleotide
ccttcaacctcttcatgccggcgcttg

SEQ ID NO: 221966 - DNA, 27 bp, Artificial Sequence
  Description of Artificial Sequence: Synthetic oligonucleotide
cttcaacctcttcatgccggcgcttgg

SEQ ID NO: 221967 - DNA, 28 bp, Artificial Sequence
  Description of Artificial Sequence: Synthetic oligonucleotide
ttcaacctcttcatgccggcgcttggtg

SEQ ID NO: 221968 - DNA, 27 bp, Artificial Sequence
  Description of Artificial Sequence: Synthetic oligonucleotide
tcaacctcttcatgccggcgcttggtg

SEQ ID NO: 221969 - DNA, 27 bp, Artificial Sequence
  Description of Artificial Sequence: Synthetic oligonucleotide
caacctcttcatgccggcgcttggtgt

SEQ ID NO: 221970 - DNA, 27 bp, Artificial Sequence
  Description of Artificial Sequence: Synthetic oligonucleotide
aacctcttcatgccggcgcttggtgtg

SEQ ID NO: 221971 - DNA, 26 bp, Artificial Sequence
  Description of Artificial Sequence: Synthetic oligonucleotide
acctcttcatgccggcgcttggtgtg

SEQ ID NO: 221972 - DNA, 25 bp, Artificial Sequence
  Description of Artificial Sequence: Synthetic oligonucleotide
cctcttcatgccggcgcttggtgtg

SEQ ID NO: 221973 - DNA, 26 bp, Artificial Sequence
  Description of Artificial Sequence: Synthetic oligonucleotide
ctcttcatgccggcgcttggtgtgca

SEQ ID NO: 221974 - DNA, 27 bp, Artificial Sequence
  Description of Artificial Sequence: Synthetic oligonucleotide
tcttcatgccggcgcttggtgtgcagt

SEQ ID NO: 221975 - DNA, 26 bp, Artificial Sequence
  Description of Artificial Sequence: Synthetic oligonucleotide
cttcatgccggcgcttggtgtgcagt

SEQ ID NO: 221976 - DNA, 26 bp, Artificial Sequence
  Description of Artificial Sequence: Synthetic oligonucleotide
ttcatgccggcgcttggtgtgcagtg

SEQ ID NO: 221977 - DNA, 25 bp, Artificial Sequence
  Description of Artificial Sequence: Synthetic oligonucleotide
tcatgccggcgcttggtgtgcagtg

SEQ ID NO: 221978 - DNA, 24 bp, Artificial Sequence
  Description of Artificial Sequence: Synthetic oligonucleotide
catgccggcgcttggtgtgcagtg

SEQ ID NO: 221979 - DNA, 24 bp, Artificial Sequence
  Description of Artificial Sequence: Synthetic oligonucleotide
atgccggcgcttggtgtgcagtgg

SEQ ID NO: 221980 - DNA, 23 bp, Artificial Sequence
  Description of Artificial Sequence: Synthetic oligonucleotide
tgccggcgcttggtgtgcagtgg

SEQ ID NO: 221981 - DNA, 22 bp, Artificial Sequence
  Description of Artificial Sequence: Synthetic oligonucleotide
gccggcgcttggtgtgcagtgg

SEQ ID NO: 221982 - DNA, 22 bp, Artificial Sequence
  Description of Artificial Sequence: Synthetic oligonucleotide
ccggcgcttggtgtgcagtggg

SEQ ID NO: 221983 - DNA, 25 bp, Artificial Sequence
  Description of Artificial Sequence: Synthetic oligonucleotide
cggcgcttggtgtgcagtgggcaat

SEQ ID NO: 221984 - DNA, 31 bp, Artificial Sequence
  Description of Artificial Sequence: Synthetic oligonucleotide
tatttggctggccaccatgagtgctttgtcg

SEQ ID NO: 221985 - DNA, 30 bp, Artificial Sequence
  Description of Artificial Sequence: Synthetic oligonucleotide
atttggctggccaccatgagtgctttgtcg

SEQ ID NO: 221986 - DNA, 29 bp, Artificial Sequence
  Description of Artificial Sequence: Synthetic oligonucleotide
tttggctggccaccatgagtgctttgtcg

SEQ ID NO: 221987 - DNA, 28 bp, Artificial Sequence
  Description of Artificial Sequence: Synthetic oligonucleotide
ttggctggccaccatgagtgctttgtcg

SEQ ID NO: 221988 - DNA, 27 bp, Artificial Sequence
  Description of Artificial Sequence: Synthetic oligonucleotide
tggctggccaccatgagtgctttgtcg

SEQ ID NO: 221989 - DNA, 31 bp, Artificial Sequence
  Description of Artificial Sequence: Synthetic oligonucleotide
tattcagctggccaccatgagtgctttgtcg

SEQ ID NO: 221990 - DNA, 30 bp, Artificial Sequence
  Description of Artificial Sequence: Synthetic oligonucleotide
attcagctggccaccatgagtgctttgtcg

SEQ ID NO: 221991 - DNA, 29 bp, Artificial Sequence
  Description of Artificial Sequence: Synthetic oligonucleotide
ttcagctggccaccatgagtgctttgtcg

SEQ ID NO: 221992 - DNA, 28 bp, Artificial Sequence
  Description of Artificial Sequence: Synthetic oligonucleotide
tcagctggccaccatgagtgctttgtcg

SEQ ID NO: 221993 - DNA, 27 bp, Artificial Sequence
  Description of Artificial Sequence: Synthetic oligonucleotide
cagctggccaccatgagtgctttgtcg

SEQ ID NO: 221994 - DNA, 27 bp, Artificial Sequence
  Description of Artificial Sequence: Synthetic oligonucleotide
agctggccaccatgagtgctttgtcgg

SEQ ID NO: 221995 - DNA, 31 bp, Artificial Sequence
  Description of Artificial Sequence: Synthetic oligonucleotide
tattcagctggccaccatgagtgctatgtcg

SEQ ID NO: 221996 - DNA, 30 bp, Artificial Sequence
  Description of Artificial Sequence: Synthetic oligonucleotide
attcagctggccaccatgagtgctatgtcg

SEQ ID NO: 221997 - DNA, 29 bp, Artificial Sequence
  Description of Artificial Sequence: Synthetic oligonucleotide
ttcagctggccaccatgagtgctatgtcg

SEQ ID NO: 221998 - DNA, 28 bp, Artificial Sequence
  Description of Artificial Sequence: Synthetic oligonucleotide
tcagctggccaccatgagtgctatgtcg

SEQ ID NO: 221999 - DNA, 27 bp, Artificial Sequence
  Description of Artificial Sequence: Synthetic oligonucleotide
cagctggccaccatgagtgctatgtcg

SEQ ID NO: 222000 - DNA, 27 bp, Artificial Sequence
  Description of Artificial Sequence: Synthetic oligonucleotide
agctggccaccatgagtgctatgtcgg

SEQ ID NO: 222001 - DNA, 23 bp, Artificial Sequence
  Description of Artificial Sequence: Synthetic oligonucleotide
ctgcctgcccctctgggccgtaa

SEQ ID NO: 222002 - DNA, 24 bp, Artificial Sequence
  Description of Artificial Sequence: Synthetic oligonucleotide
tgcctgcccctctgggccgtaaca

SEQ ID NO: 222003 - DNA, 23 bp, Artificial Sequence
  Description of Artificial Sequence: Synthetic oligonucleotide
gcctgcccctctgggccgtaaca

SEQ ID NO: 222004 - DNA, 24 bp, Artificial Sequence
  Description of Artificial Sequence: Synthetic oligonucleotide
cctgcccctctgggccgtaacact

SEQ ID NO: 222005 - DNA, 24 bp, Artificial Sequence
  Description of Artificial Sequence: Synthetic oligonucleotide
ctgcccctctgggccgtaacactg

SEQ ID NO: 222006 - DNA, 26 bp, Artificial Sequence
  Description of Artificial Sequence: Synthetic oligonucleotide
tgcccctctgggccgtaacactggaa

SEQ ID NO: 222007 - DNA, 25 bp, Artificial Sequence
  Description of Artificial Sequence: Synthetic oligonucleotide
gcccctctgggccgtaacactggaa

SEQ ID NO: 222008 - DNA, 25 bp, Artificial Sequence
  Description of Artificial Sequence: Synthetic oligonucleotide
cccctctgggccgtaacactggaag

SEQ ID NO: 222009 - DNA, 26 bp, Artificial Sequence
  Description of Artificial Sequence: Synthetic oligonucleotide
ccctctgggccgtaacactggaagca

SEQ ID NO: 222010 - DNA, 26 bp, Artificial Sequence
  Description of Artificial Sequence: Synthetic oligonucleotide
cctctgggccgtaacactggaagcag

SEQ ID NO: 222011 - DNA, 27 bp, Artificial Sequence
  Description of Artificial Sequence: Synthetic oligonucleotide
ctctgggccgtaacactggaagcagct

SEQ ID NO: 222012 - DNA, 27 bp, Artificial Sequence
  Description of Artificial Sequence: Synthetic oligonucleotide
tctgggccgtaacactggaagcagctc

SEQ ID NO: 222013 - DNA, 27 bp, Artificial Sequence
  Description of Artificial Sequence: Synthetic oligonucleotide
ctgggccgtaacactggaagcagctct

SEQ ID NO: 222014 - DNA, 27 bp, Artificial Sequence
  Description of Artificial Sequence: Synthetic oligonucleotide
tgggccgtaacactggaagcagctctc

SEQ ID NO: 222015 - DNA, 27 bp, Artificial Sequence
  Description of Artificial Sequence: Synthetic oligonucleotide
gggccgtaacactggaagcagctctca

SEQ ID NO: 222016 - DNA, 29 bp, Artificial Sequence
  Description of Artificial Sequence: Synthetic oligonucleotide
ggccgtaacactggaagcagctctcattc

SEQ ID NO: 222017 - DNA, 30 bp, Artificial Sequence
  Description of Artificial Sequence: Synthetic oligonucleotide
gccgtaacactggaagcagctctcattctc

SEQ ID NO: 222018 - DNA, 30 bp, Artificial Sequence
  Description of Artificial Sequence: Synthetic oligonucleotide
ccgtaacactggaagcagctctcattctcc

SEQ ID NO: 222019 - DNA, 31 bp, Artificial Sequence
  Description of Artificial Sequence: Synthetic oligonucleotide
cgtaacactggaagcagctctcattctcctc

SEQ ID NO: 222020 - DNA, 33 bp, Artificial Sequence
  Description of Artificial Sequence: Synthetic oligonucleotide
gtaacactggaagcagctctcattctcctcttc

SEQ ID NO: 222021 - DNA, 42 bp, Artificial Sequence
  Description of Artificial Sequence: Synthetic oligonucleotide
gtcatcagtaatatcttcaacacagactaccacatgaacatg

SEQ ID NO: 222022 - DNA, 44 bp, Artificial Sequence
  Description of Artificial Sequence: Synthetic oligonucleotide
tcatcagtaatatcttcaacacagactaccacatgaacatgatg

SEQ ID NO: 222023 - DNA, 43 bp, Artificial Sequence
  Description of Artificial Sequence: Synthetic oligonucleotide
catcagtaatatcttcaacacagactaccacatgaacatgatg

SEQ ID NO: 222024 - DNA, 43 bp, Artificial Sequence
  Description of Artificial Sequence: Synthetic oligonucleotide
atcagtaatatcttcaacacagactaccacatgaacatgatgc

SEQ ID NO: 222025 - DNA, 42 bp, Artificial Sequence
  Description of Artificial Sequence: Synthetic oligonucleotide
tcagtaatatcttcaacacagactaccacatgaacatgatgc

SEQ ID NO: 222026 - DNA, 41 bp, Artificial Sequence
  Description of Artificial Sequence: Synthetic oligonucleotide
cagtaatatcttcaacacagactaccacatgaacatgatgc

SEQ ID NO: 222027 - DNA, 42 bp, Artificial Sequence
  Description of Artificial Sequence: Synthetic oligonucleotide
agtaatatcttcaacacagactaccacatgaacatgatgcac

SEQ ID NO: 222028 - DNA, 41 bp, Artificial Sequence
  Description of Artificial Sequence: Synthetic oligonucleotide
gtaatatcttcaacacagactaccacatgaacatgatgcac

SEQ ID NO: 222029 - DNA, 43 bp, Artificial Sequence
  Description of Artificial Sequence: Synthetic oligonucleotide
taatatcttcaacacagactaccacatgaacatgatgcacatc

SEQ ID NO: 222030 - DNA, 42 bp, Artificial Sequence
  Description of Artificial Sequence: Synthetic oligonucleotide
aatatcttcaacacagactaccacatgaacatgatgcacatc

SEQ ID NO: 222031 - DNA, 41 bp, Artificial Sequence
  Description of Artificial Sequence: Synthetic oligonucleotide
atatcttcaacacagactaccacatgaacatgatgcacatc

SEQ ID NO: 222032 - DNA, 40 bp, Artificial Sequence
  Description of Artificial Sequence: Synthetic oligonucleotide
tatcttcaacacagactaccacatgaacatgatgcacatc

SEQ ID NO: 222033 - DNA, 39 bp, Artificial Sequence
  Description of Artificial Sequence: Synthetic oligonucleotide
atcttcaacacagactaccacatgaacatgatgcacatc

SEQ ID NO: 222034 - DNA, 38 bp, Artificial Sequence
  Description of Artificial Sequence: Synthetic oligonucleotide
tcttcaacacagactaccacatgaacatgatgcacatc

SEQ ID NO: 222035 - DNA, 37 bp, Artificial Sequence
  Description of Artificial Sequence: Synthetic oligonucleotide
cttcaacacagactaccacatgaacatgatgcacatc

SEQ ID NO: 222036 - DNA, 39 bp, Artificial Sequence
  Description of Artificial Sequence: Synthetic oligonucleotide
ttcaacacagactaccacatgaacatgatgcacatctac

SEQ ID NO: 222037 - DNA, 38 bp, Artificial Sequence
  Description of Artificial Sequence: Synthetic oligonucleotide
tcaacacagactaccacatgaacatgatgcacatctac

SEQ ID NO: 222038 - DNA, 37 bp, Artificial Sequence
  Description of Artificial Sequence: Synthetic oligonucleotide
caacacagactaccacatgaacatgatgcacatctac

SEQ ID NO: 222039 - DNA, 37 bp, Artificial Sequence
  Description of Artificial Sequence: Synthetic oligonucleotide
aacacagactaccacatgaacatgatgcacatctacg

SEQ ID NO: 222040 - DNA, 36 bp, Artificial Sequence
  Description of Artificial Sequence: Synthetic oligonucleotide
acacagactaccacatgaacatgatgcacatctacg

SEQ ID NO: 222041 - DNA, 35 bp, Artificial Sequence
  Description of Artificial Sequence: Synthetic oligonucleotide
cacagactaccacatgaacatgatgcacatctacg

SEQ ID NO: 222042 - DNA, 36 bp, Artificial Sequence
  Description of Artificial Sequence: Synthetic oligonucleotide
acagactaccacatgaacatgatgcacatctacgtg

SEQ ID NO: 222043 - DNA, 35 bp, Artificial Sequence
  Description of Artificial Sequence: Synthetic oligonucleotide
cagactaccacatgaacatgatgcacatctacgtg

SEQ ID NO: 222044 - DNA, 37 bp, Artificial Sequence
  Description of Artificial Sequence: Synthetic oligonucleotide
agactaccacatgaacatgatgcacatctacgtgttc

SEQ ID NO: 222045 - DNA, 36 bp, Artificial Sequence
  Description of Artificial Sequence: Synthetic oligonucleotide
gactaccacatgaacatgatgcacatctacgtgttc

SEQ ID NO: 222046 - DNA, 36 bp, Artificial Sequence
  Description of Artificial Sequence: Synthetic oligonucleotide
actaccacatgaacatgatgcacatctacgtgttcg

SEQ ID NO: 222047 - DNA, 35 bp, Artificial Sequence
  Description of Artificial Sequence: Synthetic oligonucleotide
ctaccacatgaacatgatgcacatctacgtgttcg

SEQ ID NO: 222048 - DNA, 35 bp, Artificial Sequence
  Description of Artificial Sequence: Synthetic oligonucleotide
taccacatgaacatgatgcacatctacgtgttcgc

SEQ ID NO: 222049 - DNA, 34 bp, Artificial Sequence
  Description of Artificial Sequence: Synthetic oligonucleotide
accacatgaacatgatgcacatctacgtgttcgc

SEQ ID NO: 222050 - DNA, 33 bp, Artificial Sequence
  Description of Artificial Sequence: Synthetic oligonucleotide
ccacatgaacatgatgcacatctacgtgttcgc

SEQ ID NO: 222051 - DNA, 34 bp, Artificial Sequence
  Description of Artificial Sequence: Synthetic oligonucleotide
cacatgaacatgatgcacatctacgtgttcgcag

SEQ ID NO: 222052 - DNA, 34 bp, Artificial Sequence
  Description of Artificial Sequence: Synthetic oligonucleotide
acatgaacatgatgcacatctacgtgttcgcagc

SEQ ID NO: 222053 - DNA, 33 bp, Artificial Sequence
  Description of Artificial Sequence: Synthetic oligonucleotide
catgaacatgatgcacatctacgtgttcgcagc

SEQ ID NO: 222054 - DNA, 33 bp, Artificial Sequence
  Description of Artificial Sequence: Synthetic oligonucleotide
atgaacatgatgcacatctacgtgttcgcagcc

SEQ ID NO: 222055 - DNA, 32 bp, Artificial Sequence
  Description of Artificial Sequence: Synthetic oligonucleotide
tgaacatgatgcacatctacgtgttcgcagcc

SEQ ID NO: 222056 - DNA, 31 bp, Artificial Sequence
  Description of Artificial Sequence: Synthetic oligonucleotide
gaacatgatgcacatctacgtgttcgcagcc

SEQ ID NO: 222057 - DNA, 37 bp, Artificial Sequence
  Description of Artificial Sequence: Synthetic oligonucleotide
aacatgatgcacatctacgtgttcgcagcctattttg

SEQ ID NO: 222058 - DNA, 36 bp, Artificial Sequence
  Description of Artificial Sequence: Synthetic oligonucleotide
acatgatgcacatctacgtgttcgcagcctattttg

SEQ ID NO: 222059 - DNA, 35 bp, Artificial Sequence
  Description of Artificial Sequence: Synthetic oligonucleotide
catgatgcacatctacgtgttcgcagcctattttg

SEQ ID NO: 222060 - DNA, 35 bp, Artificial Sequence
  Description of Artificial Sequence: Synthetic oligonucleotide
atgatgcacatctacgtgttcgcagcctattttgg

SEQ ID NO: 222061 - DNA, 34 bp, Artificial Sequence
  Description of Artificial Sequence: Synthetic oligonucleotide
tgatgcacatctacgtgttcgcagcctattttgg

SEQ ID NO: 222062 - DNA, 33 bp, Artificial Sequence
  Description of Artificial Sequence: Synthetic oligonucleotide
gatgcacatctacgtgttcgcagcctattttgg

SEQ ID NO: 222063 - DNA, 33 bp, Artificial Sequence
  Description of Artificial Sequence: Synthetic oligonucleotide
atgcacatctacgtgttcgcagcctattttggg

SEQ ID NO: 222064 - DNA, 32 bp, Artificial Sequence
  Description of Artificial Sequence: Synthetic oligonucleotide
tgcacatctacgtgttcgcagcctattttggg

SEQ ID NO: 222065 - DNA, 31 bp, Artificial Sequence
  Description of Artificial Sequence: Synthetic oligonucleotide
gcacatctacgtgttcgcagcctattttggg

SEQ ID NO: 222066 - DNA, 31 bp, Artificial Sequence
  Description of Artificial Sequence: Synthetic oligonucleotide
cacatctacgtgttcgcagcctattttgggc

SEQ ID NO: 222067 - DNA, 32 bp, Artificial Sequence
  Description of Artificial Sequence: Synthetic oligonucleotide
acatctacgtgttcgcagcctattttgggctg

SEQ ID NO: 222068 - DNA, 31 bp, Artificial Sequence
  Description of Artificial Sequence: Synthetic oligonucleotide
catctacgtgttcgcagcctattttgggctg

SEQ ID NO: 222069 - DNA, 32 bp, Artificial Sequence
  Description of Artificial Sequence: Synthetic oligonucleotide
atctacgtgttcgcagcctattttgggctgtc

SEQ ID NO: 222070 - DNA, 31 bp, Artificial Sequence
  Description of Artificial Sequence: Synthetic oligonucleotide
tctacgtgttcgcagcctattttgggctgtc

SEQ ID NO: 222071 - DNA, 30 bp, Artificial Sequence
  Description of Artificial Sequence: Synthetic oligonucleotide
ctacgtgttcgcagcctattttgggctgtc

SEQ ID NO: 222072 - DNA, 31 bp, Artificial Sequence
  Description of Artificial Sequence: Synthetic oligonucleotide
tacgtgttcgcagcctattttgggctgtctg

SEQ ID NO: 222073 - DNA, 30 bp, Artificial Sequence
  Description of Artificial Sequence: Synthetic oligonucleotide
acgtgttcgcagcctattttgggctgtctg

SEQ ID NO: 222074 - DNA, 29 bp, Artificial Sequence
  Description of Artificial Sequence: Synthetic oligonucleotide
cgtgttcgcagcctattttgggctgtctg

SEQ ID NO: 222075 - DNA, 30 bp, Artificial Sequence
  Description of Artificial Sequence: Synthetic oligonucleotide
gtgttcgcagcctattttgggctgtctgtg

SEQ ID NO: 222076 - DNA, 30 bp, Artificial Sequence
  Description of Artificial Sequence: Synthetic oligonucleotide
tgttcgcagcctattttgggctgtctgtgg

SEQ ID NO: 222077 - DNA, 29 bp, Artificial Sequence
  Description of Artificial Sequence: Synthetic oligonucleotide
gttcgcagcctattttgggctgtctgtgg

SEQ ID NO: 222078 - DNA, 29 bp, Artificial Sequence
  Description of Artificial Sequence: Synthetic oligonucleotide
ttcgcagcctattttgggctgtctgtggc

SEQ ID NO: 222079 - DNA, 28 bp, Artificial Sequence
  Description of Artificial Sequence: Synthetic oligonucleotide
tcgcagcctattttgggctgtctgtggc

SEQ ID NO: 222080 - DNA, 27 bp, Artificial Sequence
  Description of Artificial Sequence: Synthetic oligonucleotide
cgcagcctattttgggctgtctgtggc

SEQ ID NO: 222081 - DNA, 27 bp, Artificial Sequence
  Description of Artificial Sequence: Synthetic oligonucleotide
gcagcctattttgggctgtctgtggcc

SEQ ID NO: 222082 - DNA, 28 bp, Artificial Sequence
  Description of Artificial Sequence: Synthetic oligonucleotide
cagcctattttgggctgtctgtggcctg

SEQ ID NO: 222083 - DNA, 28 bp, Artificial Sequence
  Description of Artificial Sequence: Synthetic oligonucleotide
agcctattttgggctgtctgtggcctgg

SEQ ID NO: 222084 - DNA, 27 bp, Artificial Sequence
  Description of Artificial Sequence: Synthetic oligonucleotide
gcctattttgggctgtctgtggcctgg

SEQ ID NO: 222085 - DNA, 28 bp, Artificial Sequence
  Description of Artificial Sequence: Synthetic oligonucleotide
cctattttgggctgtctgtggcctggtg

SEQ ID NO: 222086 - DNA, 28 bp, Artificial Sequence
  Description of Artificial Sequence: Synthetic oligonucleotide
ctattttgggctgtctgtggcctggtgc

SEQ ID NO: 222087 - DNA, 28 bp, Artificial Sequence
  Description of Artificial Sequence: Synthetic oligonucleotide
tattttgggctgtctgtggcctggtgcc

SEQ ID NO: 222088 - DNA, 27 bp, Artificial Sequence
  Description of Artificial Sequence: Synthetic oligonucleotide
attttgggctgtctgtggcctggtgcc

SEQ ID NO: 222089 - DNA, 27 bp, Artificial Sequence
  Description of Artificial Sequence: Synthetic oligonucleotide
ttttgggctgtctgtggcctggtgcct

SEQ ID NO: 222090 - DNA, 26 bp, Artificial Sequence
  Description of Artificial Sequence: Synthetic oligonucleotide
tttgggctgtctgtggcctggtgcct

SEQ ID NO: 222091 - DNA, 25 bp, Artificial Sequence
  Description of Artificial Sequence: Synthetic oligonucleotide
ttgggctgtctgtggcctggtgcct

SEQ ID NO: 222092 - DNA, 24 bp, Artificial Sequence
  Description of Artificial Sequence: Synthetic oligonucleotide
tgggctgtctgtggcctggtgcct

SEQ ID NO: 222093 - DNA, 23 bp, Artificial Sequence
  Description of Artificial Sequence: Synthetic oligonucleotide
gggctgtctgtggcctggtgcct

SEQ ID NO: 222094 - DNA, 23 bp, Artificial Sequence
  Description of Artificial Sequence: Synthetic oligonucleotide
ggctgtctgtggcctggtgcctg

SEQ ID NO: 222095 - DNA, 23 bp, Artificial Sequence
  Description of Artificial Sequence: Synthetic oligonucleotide
gctgtctgtggcctggtgcctgc

SEQ ID NO: 222096 - DNA, 26 bp, Artificial Sequence
  Description of Artificial Sequence: Synthetic oligonucleotide
ctgtctgtggcctggtgcctgccaaa

SEQ ID NO: 222097 - DNA, 26 bp, Artificial Sequence
  Description of Artificial Sequence: Synthetic oligonucleotide
tgtctgtggcctggtgcctgccaaag

SEQ ID NO: 222098 - DNA, 25 bp, Artificial Sequence
  Description of Artificial Sequence: Synthetic oligonucleotide
gtctgtggcctggtgcctgccaaag

SEQ ID NO: 222099 - DNA, 25 bp, Artificial Sequence
  Description of Artificial Sequence: Synthetic oligonucleotide
tctgtggcctggtgcctgccaaagc

SEQ ID NO: 222100 - DNA, 25 bp, Artificial Sequence
  Description of Artificial Sequence: Synthetic oligonucleotide
ctggtgcctgccaaagcctctaccc

SEQ ID NO: 222101 - DNA, 26 bp, Artificial Sequence
  Description of Artificial Sequence: Synthetic oligonucleotide
tggtgcctgccaaagcctctacccga

SEQ ID NO: 222102 - DNA, 25 bp, Artificial Sequence
  Description of Artificial Sequence: Synthetic oligonucleotide
ggtgcctgccaaagcctctacccga

SEQ ID NO: 222103 - DNA, 25 bp, Artificial Sequence
  Description of Artificial Sequence: Synthetic oligonucleotide
gtgcctgccaaagcctctacccgag

SEQ ID NO: 222104 - DNA, 25 bp, Artificial Sequence
  Description of Artificial Sequence: Synthetic oligonucleotide
tgcctgccaaagcctctacccgagg

SEQ ID NO: 222105 - DNA, 24 bp, Artificial Sequence
  Description of Artificial Sequence: Synthetic oligonucleotide
gcctgccaaagcctctacccgagg

SEQ ID NO: 222106 - DNA, 26 bp, Artificial Sequence
  Description of Artificial Sequence: Synthetic oligonucleotide
cctgccaaagcctctacccgagggaa

SEQ ID NO: 222107 - DNA, 26 bp, Artificial Sequence
  Description of Artificial Sequence: Synthetic oligonucleotide
ctgccaaagcctctacccgagggaac

SEQ ID NO: 222108 - DNA, 26 bp, Artificial Sequence
  Description of Artificial Sequence: Synthetic oligonucleotide
tgccaaagcctctacccgagggaacg

SEQ ID NO: 222109 - DNA, 25 bp, Artificial Sequence
  Description of Artificial Sequence: Synthetic oligonucleotide
gccaaagcctctacccgagggaacg

SEQ ID NO: 222110 - DNA, 26 bp, Artificial Sequence
  Description of Artificial Sequence: Synthetic oligonucleotide
ccaaagcctctacccgagggaacgga

SEQ ID NO: 222111 - DNA, 26 bp, Artificial Sequence
  Description of Artificial Sequence: Synthetic oligonucleotide
caaagcctctacccgagggaacggag

SEQ ID NO: 222112 - DNA, 27 bp, Artificial Sequence
  Description of Artificial Sequence: Synthetic oligonucleotide
aaagcctctacccgagggaacggagga

SEQ ID NO: 222113 - DNA, 27 bp, Artificial Sequence
  Description of Artificial Sequence: Synthetic oligonucleotide
aagcctctacccgagggaacggaggat

SEQ ID NO: 222114 - DNA, 27 bp, Artificial Sequence
  Description of Artificial Sequence: Synthetic oligonucleotide
agcctctacccgagggaacggaggata

SEQ ID NO: 222115 - DNA, 27 bp, Artificial Sequence
  Description of Artificial Sequence: Synthetic oligonucleotide
gcctctacccgagggaacggaggataa

SEQ ID NO: 222116 - DNA, 28 bp, Artificial Sequence
  Description of Artificial Sequence: Synthetic oligonucleotide
cctctacccgagggaacggaggataaag

SEQ ID NO: 222117 - DNA, 30 bp, Artificial Sequence
  Description of Artificial Sequence: Synthetic oligonucleotide
ctctacccgagggaacggaggataaagatc

SEQ ID NO: 222118 - DNA, 31 bp, Artificial Sequence
  Description of Artificial Sequence: Synthetic oligonucleotide
tctacccgagggaacggaggataaagatcag

SEQ ID NO: 222119 - DNA, 30 bp, Artificial Sequence
  Description of Artificial Sequence: Synthetic oligonucleotide
ctacccgagggaacggaggataaagatcag

SEQ ID NO: 222120 - DNA, 31 bp, Artificial Sequence
  Description of Artificial Sequence: Synthetic oligonucleotide
tacccgagggaacggaggataaagatcagac

SEQ ID NO: 222121 - DNA, 30 bp, Artificial Sequence
  Description of Artificial Sequence: Synthetic oligonucleotide
acccgagggaacggaggataaagatcagac

SEQ ID NO: 222122 - DNA, 29 bp, Artificial Sequence
  Description of Artificial Sequence: Synthetic oligonucleotide
cccgagggaacggaggataaagatcagac

SEQ ID NO: 222123 - DNA, 30 bp, Artificial Sequence
  Description of Artificial Sequence: Synthetic oligonucleotide
ccgagggaacggaggataaagatcagacag

SEQ ID NO: 222124 - DNA, 30 bp, Artificial Sequence
  Description of Artificial Sequence: Synthetic oligonucleotide
cgagggaacggaggataaagatcagacagc

SEQ ID NO: 222125 - DNA, 32 bp, Artificial Sequence
  Description of Artificial Sequence: Synthetic oligonucleotide
gagggaacggaggataaagatcagacagcaac

SEQ ID NO: 222126 - DNA, 32 bp, Artificial Sequence
  Description of Artificial Sequence: Synthetic oligonucleotide
agggaacggaggataaagatcagacagcaacg

SEQ ID NO: 222127 - DNA, 31 bp, Artificial Sequence
  Description of Artificial Sequence: Synthetic oligonucleotide
gggaacggaggataaagatcagacagcaacg

SEQ ID NO: 222128 - DNA, 34 bp, Artificial Sequence
  Description of Artificial Sequence: Synthetic oligonucleotide
ggaacggaggataaagatcagacagcaacgatac

SEQ ID NO: 222129 - DNA, 34 bp, Artificial Sequence
  Description of Artificial Sequence: Synthetic oligonucleotide
gaacggaggataaagatcagacagcaacgatacc

SEQ ID NO: 222130 - DNA, 34 bp, Artificial Sequence
  Description of Artificial Sequence: Synthetic oligonucleotide
aacggaggataaagatcagacagcaacgataccc

SEQ ID NO: 222131 - DNA, 33 bp, Artificial Sequence
  Description of Artificial Sequence: Synthetic oligonucleotide
acggaggataaagatcagacagcaacgataccc

SEQ ID NO: 222132 - DNA, 32 bp, Artificial Sequence
  Description of Artificial Sequence: Synthetic oligonucleotide
cggaggataaagatcagacagcaacgataccc

SEQ ID NO: 222133 - DNA, 33 bp, Artificial Sequence
  Description of Artificial Sequence: Synthetic oligonucleotide
ggaggataaagatcagacagcaacgatacccag

SEQ ID NO: 222134 - DNA, 36 bp, Artificial Sequence
  Description of Artificial Sequence: Synthetic oligonucleotide
gaggataaagatcagacagcaacgatacccagtttg

SEQ ID NO: 222135 - DNA, 37 bp, Artificial Sequence
  Description of Artificial Sequence: Synthetic oligonucleotide
aggataaagatcagacagcaacgatacccagtttgtc

SEQ ID NO: 222136 - DNA, 36 bp, Artificial Sequence
  Description of Artificial Sequence: Synthetic oligonucleotide
ggataaagatcagacagcaacgatacccagtttgtc

SEQ ID NO: 222137 - DNA, 37 bp, Artificial Sequence
  Description of Artificial Sequence: Synthetic oligonucleotide
gataaagatcagacagcaacgatacccagtttgtctg

SEQ ID NO: 222138 - DNA, 37 bp, Artificial Sequence
  Description of Artificial Sequence: Synthetic oligonucleotide
ataaagatcagacagcaacgatacccagtttgtctgc

SEQ ID NO: 222139 - DNA, 36 bp, Artificial Sequence
  Description of Artificial Sequence: Synthetic oligonucleotide
taaagatcagacagcaacgatacccagtttgtctgc

SEQ ID NO: 222140 - DNA, 35 bp, Artificial Sequence
  Description of Artificial Sequence: Synthetic oligonucleotide
aaagatcagacagcaacgatacccagtttgtctgc

SEQ ID NO: 222141 - DNA, 34 bp, Artificial Sequence
  Description of Artificial Sequence: Synthetic oligonucleotide
aagatcagacagcaacgatacccagtttgtctgc

SEQ ID NO: 222142 - DNA, 33 bp, Artificial Sequence
  Description of Artificial Sequence: Synthetic oligonucleotide
agatcagacagcaacgatacccagtttgtctgc

SEQ ID NO: 222143 - DNA, 32 bp, Artificial Sequence
  Description of Artificial Sequence: Synthetic oligonucleotide
gatcagacagcaacgatacccagtttgtctgc

SEQ ID NO: 222144 - DNA, 32 bp, Artificial Sequence
  Description of Artificial Sequence: Synthetic oligonucleotide
atcagacagcaacgatacccagtttgtctgcc

SEQ ID NO: 222145 - DNA, 31 bp, Artificial Sequence
  Description of Artificial Sequence: Synthetic oligonucleotide
tcagacagcaacgatacccagtttgtctgcc

SEQ ID NO: 222146 - DNA, 30 bp, Artificial Sequence
  Description of Artificial Sequence: Synthetic oligonucleotide
cagacagcaacgatacccagtttgtctgcc

SEQ ID NO: 222147 - DNA, 32 bp, Artificial Sequence
  Description of Artificial Sequence: Synthetic oligonucleotide
agacagcaacgatacccagtttgtctgccatg

SEQ ID NO: 222148 - DNA, 31 bp, Artificial Sequence
  Description of Artificial Sequence: Synthetic oligonucleotide
gacagcaacgatacccagtttgtctgccatg

SEQ ID NO: 222149 - DNA, 31 bp, Artificial Sequence
  Description of Artificial Sequence: Synthetic oligonucleotide
acagcaacgatacccagtttgtctgccatgc

SEQ ID NO: 222150 - DNA, 30 bp, Artificial Sequence
  Description of Artificial Sequence: Synthetic oligonucleotide
cagcaacgatacccagtttgtctgccatgc

SEQ ID NO: 222151 - DNA, 32 bp, Artificial Sequence
  Description of Artificial Sequence: Synthetic oligonucleotide
ccctcttcttgtggatgttctggccaagtttc

SEQ ID NO: 222152 - DNA, 34 bp, Artificial Sequence
  Description of Artificial Sequence: Synthetic oligonucleotide
cctcttcttgtggatgttctggccaagtttcaac

SEQ ID NO: 222153 - DNA, 35 bp, Artificial Sequence
  Description of Artificial Sequence: Synthetic oligonucleotide
ctcttcttgtggatgttctggccaagtttcaactc

SEQ ID NO: 222154 - DNA, 36 bp, Artificial Sequence
  Description of Artificial Sequence: Synthetic oligonucleotide
tcttcttgtggatgttctggccaagtttcaactctg

SEQ ID NO: 222155 - DNA, 35 bp, Artificial Sequence
  Description of Artificial Sequence: Synthetic oligonucleotide
cttcttgtggatgttctggccaagtttcaactctg

SEQ ID NO: 222156 - DNA, 35 bp, Artificial Sequence
  Description of Artificial Sequence: Synthetic oligonucleotide
ttcttgtggatgttctggccaagtttcaactctgc

SEQ ID NO: 222157 - DNA, 34 bp, Artificial Sequence
  Description of Artificial Sequence: Synthetic oligonucleotide
tcttgtggatgttctggccaagtttcaactctgc

SEQ ID NO: 222158 - DNA, 33 bp, Artificial Sequence
  Description of Artificial Sequence: Synthetic oligonucleotide
cttgtggatgttctggccaagtttcaactctgc

SEQ ID NO: 222159 - DNA, 34 bp, Artificial Sequence
  Description of Artificial Sequence: Synthetic oligonucleotide
ttgtggatgttctggccaagtttcaactctgctc

SEQ ID NO: 222160 - DNA, 33 bp, Artificial Sequence
  Description of Artificial Sequence: Synthetic oligonucleotide
tgtggatgttctggccaagtttcaactctgctc

SEQ ID NO: 222161 - DNA, 32 bp, Artificial Sequence
  Description of Artificial Sequence: Synthetic oligonucleotide
gtggatgttctggccaagtttcaactctgctc

SEQ ID NO: 222162 - DNA, 33 bp, Artificial Sequence
  Description of Artificial Sequence: Synthetic oligonucleotide
tggatgttctggccaagtttcaactctgctctg

SEQ ID NO: 222163 - DNA, 32 bp, Artificial Sequence
  Description of Artificial Sequence: Synthetic oligonucleotide
ggatgttctggccaagtttcaactctgctctg

SEQ ID NO: 222164 - DNA, 32 bp, Artificial Sequence
  Description of Artificial Sequence: Synthetic oligonucleotide
gatgttctggccaagtttcaactctgctctgc

SEQ ID NO: 222165 - DNA, 33 bp, Artificial Sequence
  Description of Artificial Sequence: Synthetic oligonucleotide
atgttctggccaagtttcaactctgctctgctg

SEQ ID NO: 222166 - DNA, 32 bp, Artificial Sequence
  Description of Artificial Sequence: Synthetic oligonucleotide
tgttctggccaagtttcaactctgctctgctg

SEQ ID NO: 222167 - DNA, 31 bp, Artificial Sequence
  Description of Artificial Sequence: Synthetic oligonucleotide
gttctggccaagtttcaactctgctctgctg

SEQ ID NO: 222168 - DNA, 32 bp, Artificial Sequence
  Description of Artificial Sequence: Synthetic oligonucleotide
ttctggccaagtttcaactctgctctgctgag

SEQ ID NO: 222169 - DNA, 31 bp, Artificial Sequence
  Description of Artificial Sequence: Synthetic oligonucleotide
tctggccaagtttcaactctgctctgctgag

SEQ ID NO: 222170 - DNA, 30 bp, Artificial Sequence
  Description of Artificial Sequence: Synthetic oligonucleotide
ctggccaagtttcaactctgctctgctgag

SEQ ID NO: 222171 - DNA, 32 bp, Artificial Sequence
  Description of Artificial Sequence: Synthetic oligonucleotide
tggccaagtttcaactctgctctgctgagaag

SEQ ID NO: 222172 - DNA, 31 bp, Artificial Sequence
  Description of Artificial Sequence: Synthetic oligonucleotide
ggccaagtttcaactctgctctgctgagaag

SEQ ID NO: 222173 - DNA, 32 bp, Artificial Sequence
  Description of Artificial Sequence: Synthetic oligonucleotide
gccaagtttcaactctgctctgctgagaagtc

SEQ ID NO: 222174 - DNA, 32 bp, Artificial Sequence
  Description of Artificial Sequence: Synthetic oligonucleotide
ccaagtttcaactctgctctgctgagaagtcc

SEQ ID NO: 222175 - DNA, 35 bp, Artificial Sequence
  Description of Artificial Sequence: Synthetic oligonucleotide
caagtttcaactctgctctgctgagaagtccaatc

SEQ ID NO: 222176 - DNA, 35 bp, Artificial Sequence
  Description of Artificial Sequence: Synthetic oligonucleotide
aagtttcaactctgctctgctgagaagtccaatcg

SEQ ID NO: 222177 - DNA, 34 bp, Artificial Sequence
  Description of Artificial Sequence: Synthetic oligonucleotide
agtttcaactctgctctgctgagaagtccaatcg

SEQ ID NO: 222178 - DNA, 33 bp, Artificial Sequence
  Description of Artificial Sequence: Synthetic oligonucleotide
gtttcaactctgctctgctgagaagtccaatcg

SEQ ID NO: 222179 - DNA, 36 bp, Artificial Sequence
  Description of Artificial Sequence: Synthetic oligonucleotide
tttcaactctgctctgctgagaagtccaatcgaaag

SEQ ID NO: 222180 - DNA, 35 bp, Artificial Sequence
  Description of Artificial Sequence: Synthetic oligonucleotide
ttcaactctgctctgctgagaagtccaatcgaaag

SEQ ID NO: 222181 - DNA, 36 bp, Artificial Sequence
  Description of Artificial Sequence: Synthetic oligonucleotide
aaaggaagaatgccgtgttcaacacctactatgctg

SEQ ID NO: 222182 - DNA, 35 bp, Artificial Sequence
  Description of Artificial Sequence: Synthetic oligonucleotide
aaggaagaatgccgtgttcaacacctactatgctg

SEQ ID NO: 222183 - DNA, 34 bp, Artificial Sequence
  Description of Artificial Sequence: Synthetic oligonucleotide
aggaagaatgccgtgttcaacacctactatgctg

SEQ ID NO: 222184 - DNA, 33 bp, Artificial Sequence
  Description of Artificial Sequence: Synthetic oligonucleotide
ggaagaatgccgtgttcaacacctactatgctg

SEQ ID NO: 222185 - DNA, 35 bp, Artificial Sequence
  Description of Artificial Sequence: Synthetic oligonucleotide
gaagaatgccgtgttcaacacctactatgctgtag

SEQ ID NO: 222186 - DNA, 35 bp, Artificial Sequence
  Description of Artificial Sequence: Synthetic oligonucleotide
aagaatgccgtgttcaacacctactatgctgtagc

SEQ ID NO: 222187 - DNA, 34 bp, Artificial Sequence
  Description of Artificial Sequence: Synthetic oligonucleotide
agaatgccgtgttcaacacctactatgctgtagc

SEQ ID NO: 222188 - DNA, 33 bp, Artificial Sequence
  Description of Artificial Sequence: Synthetic oligonucleotide
gaatgccgtgttcaacacctactatgctgtagc

SEQ ID NO: 222189 - DNA, 34 bp, Artificial Sequence
  Description of Artificial Sequence: Synthetic oligonucleotide
aatgccgtgttcaacacctactatgctgtagcag

SEQ ID NO: 222190 - DNA, 33 bp, Artificial Sequence
  Description of Artificial Sequence: Synthetic oligonucleotide
atgccgtgttcaacacctactatgctgtagcag

SEQ ID NO: 222191 - DNA, 32 bp, Artificial Sequence
  Description of Artificial Sequence: Synthetic oligonucleotide
tgccgtgttcaacacctactatgctgtagcag

SEQ ID NO: 222192 - DNA, 31 bp, Artificial Sequence
  Description of Artificial Sequence: Synthetic oligonucleotide
gccgtgttcaacacctactatgctgtagcag

SEQ ID NO: 222193 - DNA, 32 bp, Artificial Sequence
  Description of Artificial Sequence: Synthetic oligonucleotide
ccgtgttcaacacctactatgctgtagcagtc

SEQ ID NO: 222194 - DNA, 33 bp, Artificial Sequence
  Description of Artificial Sequence: Synthetic oligonucleotide
cgtgttcaacacctactatgctgtagcagtcag

SEQ ID NO: 222195 - DNA, 33 bp, Artificial Sequence
  Description of Artificial Sequence: Synthetic oligonucleotide
gtgttcaacacctactatgctgtagcagtcagc

SEQ ID NO: 222196 - DNA, 33 bp, Artificial Sequence
  Description of Artificial Sequence: Synthetic oligonucleotide
tgttcaacacctactatgctgtagcagtcagcg

SEQ ID NO: 222197 - DNA, 32 bp, Artificial Sequence
  Description of Artificial Sequence: Synthetic oligonucleotide
gttcaacacctactatgctgtagcagtcagcg

SEQ ID NO: 222198 - DNA, 33 bp, Artificial Sequence
  Description of Artificial Sequence: Synthetic oligonucleotide
ttcaacacctactatgctgtagcagtcagcgtg

SEQ ID NO: 222199 - DNA, 32 bp, Artificial Sequence
  Description of Artificial Sequence: Synthetic oligonucleotide
tcaacacctactatgctgtagcagtcagcgtg

SEQ ID NO: 222200 - DNA, 31 bp, Artificial Sequence
  Description of Artificial Sequence: Synthetic oligonucleotide
caacacctactatgctgtagcagtcagcgtg

SEQ ID NO: 222201 - DNA, 31 bp, Artificial Sequence
  Description of Artificial Sequence: Synthetic oligonucleotide
aacacctactatgctgtagcagtcagcgtgg

SEQ ID NO: 222202 - DNA, 30 bp, Artificial Sequence
  Description of Artificial Sequence: Synthetic oligonucleotide
acacctactatgctgtagcagtcagcgtgg

SEQ ID NO: 222203 - DNA, 29 bp, Artificial Sequence
  Description of Artificial Sequence: Synthetic oligonucleotide
cacctactatgctgtagcagtcagcgtgg

SEQ ID NO: 222204 - DNA, 30 bp, Artificial Sequence
  Description of Artificial Sequence: Synthetic oligonucleotide
acctactatgctgtagcagtcagcgtggtg

SEQ ID NO: 222205 - DNA, 29 bp, Artificial Sequence
  Description of Artificial Sequence: Synthetic oligonucleotide
cctactatgctgtagcagtcagcgtggtg

SEQ ID NO: 222206 - DNA, 30 bp, Artificial Sequence
  Description of Artificial Sequence: Synthetic oligonucleotide
ctactatgctgtagcagtcagcgtggtgac

SEQ ID NO: 222207 - DNA, 31 bp, Artificial Sequence
  Description of Artificial Sequence: Synthetic oligonucleotide
tactatgctgtagcagtcagcgtggtgacag

SEQ ID NO: 222208 - DNA, 30 bp, Artificial Sequence
  Description of Artificial Sequence: Synthetic oligonucleotide
actatgctgtagcagtcagcgtggtgacag

SEQ ID NO: 222209 - DNA, 29 bp, Artificial Sequence
  Description of Artificial Sequence: Synthetic oligonucleotide
ctatgctgtagcagtcagcgtggtgacag

SEQ ID NO: 222210 - DNA, 29 bp, Artificial Sequence
  Description of Artificial Sequence: Synthetic oligonucleotide
tatgctgtagcagtcagcgtggtgacagc

SEQ ID NO: 222211 - DNA, 28 bp, Artificial Sequence
  Description of Artificial Sequence: Synthetic oligonucleotide
atgctgtagcagtcagcgtggtgacagc

SEQ ID NO: 222212 - DNA, 27 bp, Artificial Sequence
  Description of Artificial Sequence: Synthetic oligonucleotide
tgctgtagcagtcagcgtggtgacagc

SEQ ID NO: 222213 - DNA, 26 bp, Artificial Sequence
  Description of Artificial Sequence: Synthetic oligonucleotide
gctgtagcagtcagcgtggtgacagc

SEQ ID NO: 222214 - DNA, 27 bp, Artificial Sequence
  Description of Artificial Sequence: Synthetic oligonucleotide
ctgtagcagtcagcgtggtgacagcca

SEQ ID NO: 222215 - DNA, 28 bp, Artificial Sequence
  Description of Artificial Sequence: Synthetic oligonucleotide
tgtagcagtcagcgtggtgacagccatc

SEQ ID NO: 222216 - DNA, 27 bp, Artificial Sequence
  Description of Artificial Sequence: Synthetic oligonucleotide
gtagcagtcagcgtggtgacagccatc

SEQ ID NO: 222217 - DNA, 28 bp, Artificial Sequence
  Description of Artificial Sequence: Synthetic oligonucleotide
tagcagtcagcgtggtgacagccatctc

SEQ ID NO: 222218 - DNA, 27 bp, Artificial Sequence
  Description of Artificial Sequence: Synthetic oligonucleotide
agcagtcagcgtggtgacagccatctc

SEQ ID NO: 222219 - DNA, 27 bp, Artificial Sequence
  Description of Artificial Sequence: Synthetic oligonucleotide
gcagtcagcgtggtgacagccatctca

SEQ ID NO: 222220 - DNA, 27 bp, Artificial Sequence
  Description of Artificial Sequence: Synthetic oligonucleotide
cagtcagcgtggtgacagccatctcag

SEQ ID NO: 222221 - DNA, 27 bp, Artificial Sequence
  Description of Artificial Sequence: Synthetic oligonucleotide
agtcagcgtggtgacagccatctcagg

SEQ ID NO: 222222 - DNA, 26 bp, Artificial Sequence
  Description of Artificial Sequence: Synthetic oligonucleotide
gtcagcgtggtgacagccatctcagg

SEQ ID NO: 222223 - DNA, 27 bp, Artificial Sequence
  Description of Artificial Sequence: Synthetic oligonucleotide
tcagcgtggtgacagccatctcagggt

SEQ ID NO: 222224 - DNA, 26 bp, Artificial Sequence
  Description of Artificial Sequence: Synthetic oligonucleotide
cagcgtggtgacagccatctcagggt

SEQ ID NO: 222225 - DNA, 27 bp, Artificial Sequence
  Description of Artificial Sequence: Synthetic oligonucleotide
agcgtggtgacagccatctcagggtca

SEQ ID NO: 222226 - DNA, 27 bp, Artificial Sequence
  Description of Artificial Sequence: Synthetic oligonucleotide
gcgtggtgacagccatctcagggtcat

SEQ ID NO: 222227 - DNA, 27 bp, Artificial Sequence
  Description of Artificial Sequence: Synthetic oligonucleotide
cgtggtgacagccatctcagggtcatc

SEQ ID NO: 222228 - DNA, 31 bp, Artificial Sequence
  Description of Artificial Sequence: Synthetic oligonucleotide
acccccaagggaagatcagcaagacttatgg

SEQ ID NO: 222229 - DNA, 30 bp, Artificial Sequence
  Description of Artificial Sequence: Synthetic oligonucleotide
cccccaagggaagatcagcaagacttatgg

SEQ ID NO: 222230 - DNA, 30 bp, Artificial Sequence
  Description of Artificial Sequence: Synthetic oligonucleotide
ccccaagggaagatcagcaagacttatggg

SEQ ID NO: 222231 - DNA, 30 bp, Artificial Sequence
  Description of Artificial Sequence: Synthetic oligonucleotide
cccaagggaagatcagcaagacttatgggc

SEQ ID NO: 222232 - DNA, 31 bp, Artificial Sequence
  Description of Artificial Sequence: Synthetic oligonucleotide
ccaagggaagatcagcaagacttatgggcac

SEQ ID NO: 222233 - DNA, 32 bp, Artificial Sequence
  Description of Artificial Sequence: Synthetic oligonucleotide
caagggaagatcagcaagacttatgggcacag

SEQ ID NO: 222234 - DNA, 33 bp, Artificial Sequence
  Description of Artificial Sequence: Synthetic oligonucleotide
aagggaagatcagcaagacttatgggcacagtg

SEQ ID NO: 222235 - DNA, 32 bp, Artificial Sequence
  Description of Artificial Sequence: Synthetic oligonucleotide
agggaagatcagcaagacttatgggcacagtg

SEQ ID NO: 222236 - DNA, 31 bp, Artificial Sequence
  Description of Artificial Sequence: Synthetic oligonucleotide
gggaagatcagcaagacttatgggcacagtg

SEQ ID NO: 222237 - DNA, 31 bp, Artificial Sequence
  Description of Artificial Sequence: Synthetic oligonucleotide
ggaagatcagcaagacttatgggcacagtgc

SEQ ID NO: 222238 - DNA, 31 bp, Artificial Sequence
  Description of Artificial Sequence: Synthetic oligonucleotide
gaagatcagcaagacttatgggcacagtgcg

SEQ ID NO: 222239 - DNA, 31 bp, Artificial Sequence
  Description of Artificial Sequence: Synthetic oligonucleotide
aagatcagcaagacttatgggcacagtgcgg

SEQ ID NO: 222240 - DNA, 30 bp, Artificial Sequence
  Description of Artificial Sequence: Synthetic oligonucleotide
agatcagcaagacttatgggcacagtgcgg

SEQ ID NO: 222241 - DNA, 29 bp, Artificial Sequence
  Description of Artificial Sequence: Synthetic oligonucleotide
gatcagcaagacttatgggcacagtgcgg

SEQ ID NO: 222242 - DNA, 30 bp, Artificial Sequence
  Description of Artificial Sequence: Synthetic oligonucleotide
atcagcaagacttatgggcacagtgcggtg

SEQ ID NO: 222243 - DNA, 29 bp, Artificial Sequence
  Description of Artificial Sequence: Synthetic oligonucleotide
tcagcaagacttatgggcacagtgcggtg

SEQ ID NO: 222244 - DNA, 28 bp, Artificial Sequence
  Description of Artificial Sequence: Synthetic oligonucleotide
cagcaagacttatgggcacagtgcggtg

SEQ ID NO: 222245 - DNA, 30 bp, Artificial Sequence
  Description of Artificial Sequence: Synthetic oligonucleotide
agcaagacttatgggcacagtgcggtgttg

SEQ ID NO: 222246 - DNA, 29 bp, Artificial Sequence
  Description of Artificial Sequence: Synthetic oligonucleotide
gcaagacttatgggcacagtgcggtgttg

SEQ ID NO: 222247 - DNA, 29 bp, Artificial Sequence
  Description of Artificial Sequence: Synthetic oligonucleotide
caagacttatgggcacagtgcggtgttgg

SEQ ID NO: 222248 - DNA, 29 bp, Artificial Sequence
  Description of Artificial Sequence: Synthetic oligonucleotide
aagacttatgggcacagtgcggtgttggc

SEQ ID NO: 222249 - DNA, 28 bp, Artificial Sequence
  Description of Artificial Sequence: Synthetic oligonucleotide
agacttatgggcacagtgcggtgttggc

SEQ ID NO: 222250 - DNA, 27 bp, Artificial Sequence
  Description of Artificial Sequence: Synthetic oligonucleotide
gacttatgggcacagtgcggtgttggc

SEQ ID NO: 222251 - DNA, 28 bp, Artificial Sequence
  Description of Artificial Sequence: Synthetic oligonucleotide
acttatgggcacagtgcggtgttggcag

SEQ ID NO: 222252 - DNA, 27 bp, Artificial Sequence
  Description of Artificial Sequence: Synthetic oligonucleotide
cttatgggcacagtgcggtgttggcag

SEQ ID NO: 222253 - DNA, 27 bp, Artificial Sequence
  Description of Artificial Sequence: Synthetic oligonucleotide
ttatgggcacagtgcggtgttggcagg

SEQ ID NO: 222254 - DNA, 27 bp, Artificial Sequence
  Description of Artificial Sequence: Synthetic oligonucleotide
tatgggcacagtgcggtgttggcagga

SEQ ID NO: 222255 - DNA, 26 bp, Artificial Sequence
  Description of Artificial Sequence: Synthetic oligonucleotide
atgggcacagtgcggtgttggcagga

SEQ ID NO: 222256 - DNA, 25 bp, Artificial Sequence
  Description of Artificial Sequence: Synthetic oligonucleotide
tgggcacagtgcggtgttggcagga

SEQ ID NO: 222257 - DNA, 24 bp, Artificial Sequence
  Description of Artificial Sequence: Synthetic oligonucleotide
gggcacagtgcggtgttggcagga

SEQ ID NO: 222258 - DNA, 24 bp, Artificial Sequence
  Description of Artificial Sequence: Synthetic oligonucleotide
ggcacagtgcggtgttggcaggag

SEQ ID NO: 222259 - DNA, 26 bp, Artificial Sequence
  Description of Artificial Sequence: Synthetic oligonucleotide
ctgatctccgtcgggggagccaagta

SEQ ID NO: 222260 - DNA, 26 bp, Artificial Sequence
  Description of Artificial Sequence: Synthetic oligonucleotide
tgatctccgtcgggggagccaagtac

SEQ ID NO: 222261 - DNA, 25 bp, Artificial Sequence
  Description of Artificial Sequence: Synthetic oligonucleotide
gatctccgtcgggggagccaagtac

SEQ ID NO: 222262 - DNA, 26 bp, Artificial Sequence
  Description of Artificial Sequence: Synthetic oligonucleotide
atctccgtcgggggagccaagtacct

SEQ ID NO: 222263 - DNA, 25 bp, Artificial Sequence
  Description of Artificial Sequence: Synthetic oligonucleotide
tctccgtcgggggagccaagtacct

SEQ ID NO: 222264 - DNA, 24 bp, Artificial Sequence
  Description of Artificial Sequence: Synthetic oligonucleotide
ctccgtcgggggagccaagtacct

SEQ ID NO: 222265 - DNA, 24 bp, Artificial Sequence
  Description of Artificial Sequence: Synthetic oligonucleotide
tccgtcgggggagccaagtacctg

SEQ ID NO: 222266 - DNA, 23 bp, Artificial Sequence
  Description of Artificial Sequence: Synthetic oligonucleotide
ccgtcgggggagccaagtacctg

SEQ ID NO: 222267 - DNA, 23 bp, Artificial Sequence
  Description of Artificial Sequence: Synthetic oligonucleotide
cgtcgggggagccaagtacctgc

SEQ ID NO: 222268 - DNA, 23 bp, Artificial Sequence
  Description of Artificial Sequence: Synthetic oligonucleotide
gtcgggggagccaagtacctgcc

SEQ ID NO: 222269 - DNA, 23 bp, Artificial Sequence
  Description of Artificial Sequence: Synthetic oligonucleotide
tcgggggagccaagtacctgccg

SEQ ID NO: 222270 - DNA, 22 bp, Artificial Sequence
  Description of Artificial Sequence: Synthetic oligonucleotide
cgggggagccaagtacctgccg

SEQ ID NO: 222271 - DNA, 22 bp, Artificial Sequence
  Description of Artificial Sequence: Synthetic oligonucleotide
gggggagccaagtacctgccgg

SEQ ID NO: 222272 - DNA, 22 bp, Artificial Sequence
  Description of Artificial Sequence: Synthetic oligonucleotide
ggggagccaagtacctgccggg

SEQ ID NO: 222273 - DNA, 23 bp, Artificial Sequence
  Description of Artificial Sequence: Synthetic oligonucleotide
gggagccaagtacctgccggggt

SEQ ID NO: 222274 - DNA, 25 bp, Artificial Sequence
  Description of Artificial Sequence: Synthetic oligonucleotide
ggagccaagtacctgccggggtgtt

SEQ ID NO: 222275 - DNA, 27 bp, Artificial Sequence
  Description of Artificial Sequence: Synthetic oligonucleotide
gagccaagtacctgccggggtgttgta

SEQ ID NO: 222276 - DNA, 28 bp, Artificial Sequence
  Description of Artificial Sequence: Synthetic oligonucleotide
agccaagtacctgccggggtgttgtaac

SEQ ID NO: 222277 - DNA, 27 bp, Artificial Sequence
  Description of Artificial Sequence: Synthetic oligonucleotide
gccaagtacctgccggggtgttgtaac

SEQ ID NO: 222278 - DNA, 27 bp, Artificial Sequence
  Description of Artificial Sequence: Synthetic oligonucleotide
ccaagtacctgccggggtgttgtaacc

SEQ ID NO: 222279 - DNA, 27 bp, Artificial Sequence
  Description of Artificial Sequence: Synthetic oligonucleotide
caagtacctgccggggtgttgtaaccg

SEQ ID NO: 222280 - DNA, 28 bp, Artificial Sequence
  Description of Artificial Sequence: Synthetic oligonucleotide
aagtacctgccggggtgttgtaaccgag

SEQ ID NO: 222281 - DNA, 27 bp, Artificial Sequence
  Description of Artificial Sequence: Synthetic oligonucleotide
agtacctgccggggtgttgtaaccgag

SEQ ID NO: 222282 - DNA, 27 bp, Artificial Sequence
  Description of Artificial Sequence: Synthetic oligonucleotide
gtacctgccggggtgttgtaaccgagt

SEQ ID NO: 222283 - DNA, 27 bp, Artificial Sequence
  Description of Artificial Sequence: Synthetic oligonucleotide
tacctgccggggtgttgtaaccgagtg

SEQ ID NO: 222284 - DNA, 26 bp, Artificial Sequence
  Description of Artificial Sequence: Synthetic oligonucleotide
acctgccggggtgttgtaaccgagtg

SEQ ID NO: 222285 - DNA, 25 bp, Artificial Sequence
  Description of Artificial Sequence: Synthetic oligonucleotide
cctgccggggtgttgtaaccgagtg

SEQ ID NO: 222286 - DNA, 26 bp, Artificial Sequence
  Description of Artificial Sequence: Synthetic oligonucleotide
ctgccggggtgttgtaaccgagtgct

SEQ ID NO: 222287 - DNA, 26 bp, Artificial Sequence
  Description of Artificial Sequence: Synthetic oligonucleotide
tgccggggtgttgtaaccgagtgctg

SEQ ID NO: 222288 - DNA, 25 bp, Artificial Sequence
  Description of Artificial Sequence: Synthetic oligonucleotide
gccggggtgttgtaaccgagtgctg

SEQ ID NO: 222289 - DNA, 25 bp, Artificial Sequence
  Description of Artificial Sequence: Synthetic oligonucleotide
ccggggtgttgtaaccgagtgctgg

SEQ ID NO: 222290 - DNA, 25 bp, Artificial Sequence
  Description of Artificial Sequence: Synthetic oligonucleotide
cggggtgttgtaaccgagtgctggg

SEQ ID NO: 222291 - DNA, 27 bp, Artificial Sequence
  Description of Artificial Sequence: Synthetic oligonucleotide
ggggtgttgtaaccgagtgctggggat

SEQ ID NO: 222292 - DNA, 28 bp, Artificial Sequence
  Description of Artificial Sequence: Synthetic oligonucleotide
gggtgttgtaaccgagtgctggggattc

SEQ ID NO: 222293 - DNA, 28 bp, Artificial Sequence
  Description of Artificial Sequence: Synthetic oligonucleotide
ggtgttgtaaccgagtgctggggattcc

SEQ ID NO: 222294 - DNA, 28 bp, Artificial Sequence
  Description of Artificial Sequence: Synthetic oligonucleotide
gtgttgtaaccgagtgctggggattccc

SEQ ID NO: 222295 - DNA, 28 bp, Artificial Sequence
  Description of Artificial Sequence: Synthetic oligonucleotide
tgttgtaaccgagtgctggggattcccc

SEQ ID NO: 222296 - DNA, 27 bp, Artificial Sequence
  Description of Artificial Sequence: Synthetic oligonucleotide
gttgtaaccgagtgctggggattcccc

SEQ ID NO: 222297 - DNA, 28 bp, Artificial Sequence
  Description of Artificial Sequence: Synthetic oligonucleotide
ttgtaaccgagtgctggggattccccac

SEQ ID NO: 222298 - DNA, 27 bp, Artificial Sequence
  Description of Artificial Sequence: Synthetic oligonucleotide
tgtaaccgagtgctggggattccccac

SEQ ID NO: 222299 - DNA, 27 bp, Artificial Sequence
  Description of Artificial Sequence: Synthetic oligonucleotide
gtaaccgagtgctggggattccccaca

SEQ ID NO: 222300 - DNA, 27 bp, Artificial Sequence
  Description of Artificial Sequence: Synthetic oligonucleotide
taaccgagtgctggggattccccacag

SEQ ID NO: 222301 - DNA, 26 bp, Artificial Sequence
  Description of Artificial Sequence: Synthetic oligonucleotide
aaccgagtgctggggattccccacag

SEQ ID NO: 222302 - DNA, 25 bp, Artificial Sequence
  Description of Artificial Sequence: Synthetic oligonucleotide
accgagtgctggggattccccacag

SEQ ID NO: 222303 - DNA, 24 bp, Artificial Sequence
  Description of Artificial Sequence: Synthetic oligonucleotide
ccgagtgctggggattccccacag

SEQ ID NO: 222304 - DNA, 25 bp, Artificial Sequence
  Description of Artificial Sequence: Synthetic oligonucleotide
cgagtgctggggattccccacagct

SEQ ID NO: 222305 - DNA, 25 bp, Artificial Sequence
  Description of Artificial Sequence: Synthetic oligonucleotide
gagtgctggggattccccacagctc

SEQ ID NO: 222306 - DNA, 27 bp, Artificial Sequence
  Description of Artificial Sequence: Synthetic oligonucleotide
agtgctggggattccccacagctccat

SEQ ID NO: 222307 - DNA, 26 bp, Artificial Sequence
  Description of Artificial Sequence: Synthetic oligonucleotide
gtgctggggattccccacagctccat

SEQ ID NO: 222308 - DNA, 27 bp, Artificial Sequence
  Description of Artificial Sequence: Synthetic oligonucleotide
tgctggggattccccacagctccatca

SEQ ID NO: 222309 - DNA, 27 bp, Artificial Sequence
  Description of Artificial Sequence: Synthetic oligonucleotide
gctggggattccccacagctccatcat

SEQ ID NO: 222310 - DNA, 27 bp, Artificial Sequence
  Description of Artificial Sequence: Synthetic oligonucleotide
ctggggattccccacagctccatcatg

SEQ ID NO: 222311 - DNA, 27 bp, Artificial Sequence
  Description of Artificial Sequence: Synthetic oligonucleotide
tggggattccccacagctccatcatgg

SEQ ID NO: 222312 - DNA, 26 bp, Artificial Sequence
  Description of Artificial Sequence: Synthetic oligonucleotide
ggggattccccacagctccatcatgg

SEQ ID NO: 222313 - DNA, 26 bp, Artificial Sequence
  Description of Artificial Sequence: Synthetic oligonucleotide
gggattccccacagctccatcatggg

SEQ ID NO: 222314 - DNA, 27 bp, Artificial Sequence
  Description of Artificial Sequence: Synthetic oligonucleotide
ggattccccacagctccatcatgggct

SEQ ID NO: 222315 - DNA, 28 bp, Artificial Sequence
  Description of Artificial Sequence: Synthetic oligonucleotide
gattccccacagctccatcatgggctac

SEQ ID NO: 222316 - DNA, 30 bp, Artificial Sequence
  Description of Artificial Sequence: Synthetic oligonucleotide
attccccacagctccatcatgggctacaac

SEQ ID NO: 222317 - DNA, 29 bp, Artificial Sequence
  Description of Artificial Sequence: Synthetic oligonucleotide
ttccccacagctccatcatgggctacaac

SEQ ID NO: 222318 - DNA, 28 bp, Artificial Sequence
  Description of Artificial Sequence: Synthetic oligonucleotide
tccccacagctccatcatgggctacaac

SEQ ID NO: 222319 - DNA, 27 bp, Artificial Sequence
  Description of Artificial Sequence: Synthetic oligonucleotide
ccccacagctccatcatgggctacaac

SEQ ID NO: 222320 - DNA, 29 bp, Artificial Sequence
  Description of Artificial Sequence: Synthetic oligonucleotide
cccacagctccatcatgggctacaacttc

SEQ ID NO: 222321 - DNA, 30 bp, Artificial Sequence
  Description of Artificial Sequence: Synthetic oligonucleotide
ccacagctccatcatgggctacaacttcag

SEQ ID NO: 222322 - DNA, 30 bp, Artificial Sequence
  Description of Artificial Sequence: Synthetic oligonucleotide
cacagctccatcatgggctacaacttcagc

SEQ ID NO: 222323 - DNA, 32 bp, Artificial Sequence
  Description of Artificial Sequence: Synthetic oligonucleotide
acagctccatcatgggctacaacttcagcttg

SEQ ID NO: 222324 - DNA, 31 bp, Artificial Sequence
  Description of Artificial Sequence: Synthetic oligonucleotide
cagctccatcatgggctacaacttcagcttg

SEQ ID NO: 222325 - DNA, 31 bp, Artificial Sequence
  Description of Artificial Sequence: Synthetic oligonucleotide
agctccatcatgggctacaacttcagcttgc

SEQ ID NO: 222326 - DNA, 30 bp, Artificial Sequence
  Description of Artificial Sequence: Synthetic oligonucleotide
gctccatcatgggctacaacttcagcttgc

SEQ ID NO: 222327 - DNA, 31 bp, Artificial Sequence
  Description of Artificial Sequence: Synthetic oligonucleotide
ctccatcatgggctacaacttcagcttgctg

SEQ ID NO: 222328 - DNA, 31 bp, Artificial Sequence
  Description of Artificial Sequence: Synthetic oligonucleotide
tccatcatgggctacaacttcagcttgctgg

SEQ ID NO: 222329 - DNA, 30 bp, Artificial Sequence
  Description of Artificial Sequence: Synthetic oligonucleotide
ccatcatgggctacaacttcagcttgctgg

SEQ ID NO: 222330 - DNA, 30 bp, Artificial Sequence
  Description of Artificial Sequence: Synthetic oligonucleotide
catcatgggctacaacttcagcttgctggg

SEQ ID NO: 222331 - DNA, 31 bp, Artificial Sequence
  Description of Artificial Sequence: Synthetic oligonucleotide
atcatgggctacaacttcagcttgctgggtc

SEQ ID NO: 222332 - DNA, 30 bp, Artificial Sequence
  Description of Artificial Sequence: Synthetic oligonucleotide
tcatgggctacaacttcagcttgctgggtc

SEQ ID NO: 222333 - DNA, 29 bp, Artificial Sequence
  Description of Artificial Sequence: Synthetic oligonucleotide
catgggctacaacttcagcttgctgggtc

SEQ ID NO: 222334 - DNA, 30 bp, Artificial Sequence
  Description of Artificial Sequence: Synthetic oligonucleotide
atgggctacaacttcagcttgctgggtctg

SEQ ID NO: 222335 - DNA, 29 bp, Artificial Sequence
  Description of Artificial Sequence: Synthetic oligonucleotide
tgggctacaacttcagcttgctgggtctg

SEQ ID NO: 222336 - DNA, 28 bp, Artificial Sequence
  Description of Artificial Sequence: Synthetic oligonucleotide
gggctacaacttcagcttgctgggtctg

SEQ ID NO: 222337 - DNA, 28 bp, Artificial Sequence
  Description of Artificial Sequence: Synthetic oligonucleotide
ggctacaacttcagcttgctgggtctgc

SEQ ID NO: 222338 - DNA, 30 bp, Artificial Sequence
  Description of Artificial Sequence: Synthetic oligonucleotide
gctacaacttcagcttgctgggtctgcttg

SEQ ID NO: 222339 - DNA, 30 bp, Artificial Sequence
  Description of Artificial Sequence: Synthetic oligonucleotide
ctacaacttcagcttgctgggtctgcttgg

SEQ ID NO: 222340 - DNA, 31 bp, Artificial Sequence
  Description of Artificial Sequence: Synthetic oligonucleotide
tacaacttcagcttgctgggtctgcttggag

SEQ ID NO: 222341 - DNA, 30 bp, Artificial Sequence
  Description of Artificial Sequence: Synthetic oligonucleotide
acaacttcagcttgctgggtctgcttggag

SEQ ID NO: 222342 - DNA, 29 bp, Artificial Sequence
  Description of Artificial Sequence: Synthetic oligonucleotide
caacttcagcttgctgggtctgcttggag

SEQ ID NO: 222343 - DNA, 30 bp, Artificial Sequence
  Description of Artificial Sequence: Synthetic oligonucleotide
aacttcagcttgctgggtctgcttggagag

SEQ ID NO: 222344 - DNA, 29 bp, Artificial Sequence
  Description of Artificial Sequence: Synthetic oligonucleotide
acttcagcttgctgggtctgcttggagag

SEQ ID NO: 222345 - DNA, 30 bp, Artificial Sequence
  Description of Artificial Sequence: Synthetic oligonucleotide
agcttgctgggtctgcttggagagatcatc

SEQ ID NO: 222346 - DNA, 29 bp, Artificial Sequence
  Description of Artificial Sequence: Synthetic oligonucleotide
gcttgctgggtctgcttggagagatcatc

SEQ ID NO: 222347 - DNA, 31 bp, Artificial Sequence
  Description of Artificial Sequence: Synthetic oligonucleotide
cttgctgggtctgcttggagagatcatctac

SEQ ID NO: 222348 - DNA, 34 bp, Artificial Sequence
  Description of Artificial Sequence: Synthetic oligonucleotide
ttgctgggtctgcttggagagatcatctacattg

SEQ ID NO: 222349 - DNA, 33 bp, Artificial Sequence
  Description of Artificial Sequence: Synthetic oligonucleotide
tgctgggtctgcttggagagatcatctacattg

SEQ ID NO: 222350 - DNA, 32 bp, Artificial Sequence
  Description of Artificial Sequence: Synthetic oligonucleotide
gctgggtctgcttggagagatcatctacattg

SEQ ID NO: 222351 - DNA, 33 bp, Artificial Sequence
  Description of Artificial Sequence: Synthetic oligonucleotide
ctgggtctgcttggagagatcatctacattgtg

SEQ ID NO: 222352 - DNA, 35 bp, Artificial Sequence
  Description of Artificial Sequence: Synthetic oligonucleotide
tgggtctgcttggagagatcatctacattgtgttg

SEQ ID NO: 222353 - DNA, 34 bp, Artificial Sequence
  Description of Artificial Sequence: Synthetic oligonucleotide
gggtctgcttggagagatcatctacattgtgttg

SEQ ID NO: 222354 - DNA, 34 bp, Artificial Sequence
  Description of Artificial Sequence: Synthetic oligonucleotide
ggtctgcttggagagatcatctacattgtgttgc

SEQ ID NO: 222355 - DNA, 35 bp, Artificial Sequence
  Description of Artificial Sequence: Synthetic oligonucleotide
gtctgcttggagagatcatctacattgtgttgctg

SEQ ID NO: 222356 - DNA, 35 bp, Artificial Sequence
  Description of Artificial Sequence: Synthetic oligonucleotide
tctgcttggagagatcatctacattgtgttgctgg

SEQ ID NO: 222357 - DNA, 34 bp, Artificial Sequence
  Description of Artificial Sequence: Synthetic oligonucleotide
ctgcttggagagatcatctacattgtgttgctgg

SEQ ID NO: 222358 - DNA, 35 bp, Artificial Sequence
  Description of Artificial Sequence: Synthetic oligonucleotide
tgcttggagagatcatctacattgtgttgctggtg

SEQ ID NO: 222359 - DNA, 34 bp, Artificial Sequence
  Description of Artificial Sequence: Synthetic oligonucleotide
gcttggagagatcatctacattgtgttgctggtg

SEQ ID NO: 222360 - DNA, 34 bp, Artificial Sequence
  Description of Artificial Sequence: Synthetic oligonucleotide
cttggagagatcatctacattgtgttgctggtgc

SEQ ID NO: 222361 - DNA, 36 bp, Artificial Sequence
  Description of Artificial Sequence: Synthetic oligonucleotide
ttggagagatcatctacattgtgttgctggtgcttg

SEQ ID NO: 222362 - DNA, 35 bp, Artificial Sequence
  Description of Artificial Sequence: Synthetic oligonucleotide
tggagagatcatctacattgtgttgctggtgcttg

SEQ ID NO: 222363 - DNA, 34 bp, Artificial Sequence
  Description of Artificial Sequence: Synthetic oligonucleotide
ggagagatcatctacattgtgttgctggtgcttg

SEQ ID NO: 222364 - DNA, 37 bp, Artificial Sequence
  Description of Artificial Sequence: Synthetic oligonucleotide
gagagatcatctacattgtgttgctggtgcttgatac

SEQ ID NO: 222365 - DNA, 37 bp, Artificial Sequence
  Description of Artificial Sequence: Synthetic oligonucleotide
agagatcatctacattgtgttgctggtgcttgatacc

SEQ ID NO: 222366 - DNA, 36 bp, Artificial Sequence
  Description of Artificial Sequence: Synthetic oligonucleotide
gagatcatctacattgtgttgctggtgcttgatacc

SEQ ID NO: 222367 - DNA, 36 bp, Artificial Sequence
  Description of Artificial Sequence: Synthetic oligonucleotide
agatcatctacattgtgttgctggtgcttgataccg

SEQ ID NO: 222368 - DNA, 35 bp, Artificial Sequence
  Description of Artificial Sequence: Synthetic oligonucleotide
gatcatctacattgtgttgctggtgcttgataccg

SEQ ID NO: 222369 - DNA, 36 bp, Artificial Sequence
  Description of Artificial Sequence: Synthetic oligonucleotide
atcatctacattgtgttgctggtgcttgataccgtc

SEQ ID NO: 222370 - DNA, 35 bp, Artificial Sequence
  Description of Artificial Sequence: Synthetic oligonucleotide
tcatctacattgtgttgctggtgcttgataccgtc

SEQ ID NO: 222371 - DNA, 34 bp, Artificial Sequence
  Description of Artificial Sequence: Synthetic oligonucleotide
catctacattgtgttgctggtgcttgataccgtc

SEQ ID NO: 222372 - DNA, 34 bp, Artificial Sequence
  Description of Artificial Sequence: Synthetic oligonucleotide
atctacattgtgttgctggtgcttgataccgtcg

SEQ ID NO: 222373 - DNA, 33 bp, Artificial Sequence
  Description of Artificial Sequence: Synthetic oligonucleotide
tctacattgtgttgctggtgcttgataccgtcg

SEQ ID NO: 222374 - DNA, 32 bp, Artificial Sequence
  Description of Artificial Sequence: Synthetic oligonucleotide
ctacattgtgttgctggtgcttgataccgtcg

SEQ ID NO: 222375 - DNA, 32 bp, Artificial Sequence
  Description of Artificial Sequence: Synthetic oligonucleotide
tacattgtgttgctggtgcttgataccgtcgg

SEQ ID NO: 222376 - DNA, 31 bp, Artificial Sequence
  Description of Artificial Sequence: Synthetic oligonucleotide
acattgtgttgctggtgcttgataccgtcgg

SEQ ID NO: 222377 - DNA, 30 bp, Artificial Sequence
  Description of Artificial Sequence: Synthetic oligonucleotide
cattgtgttgctggtgcttgataccgtcgg

SEQ ID NO: 222378 - DNA, 31 bp, Artificial Sequence
  Description of Artificial Sequence: Synthetic oligonucleotide
attgtgttgctggtgcttgataccgtcggag

SEQ ID NO: 222379 - DNA, 30 bp, Artificial Sequence
  Description of Artificial Sequence: Synthetic oligonucleotide
ttgtgttgctggtgcttgataccgtcggag

SEQ ID NO: 222380 - DNA, 29 bp, Artificial Sequence
  Description of Artificial Sequence: Synthetic oligonucleotide
tgtgttgctggtgcttgataccgtcggag

SEQ ID NO: 222381 - DNA, 28 bp, Artificial Sequence
  Description of Artificial Sequence: Synthetic oligonucleotide
gtgttgctggtgcttgataccgtcggag

SEQ ID NO: 222382 - DNA, 28 bp, Artificial Sequence
  Description of Artificial Sequence: Synthetic oligonucleotide
tgttgctggtgcttgataccgtcggagc

SEQ ID NO: 222383 - DNA, 27 bp, Artificial Sequence
  Description of Artificial Sequence: Synthetic oligonucleotide
gttgctggtgcttgataccgtcggagc

SEQ ID NO: 222384 - DNA, 27 bp, Artificial Sequence
  Description of Artificial Sequence: Synthetic oligonucleotide
ttgctggtgcttgataccgtcggagcc

SEQ ID NO: 222385 - DNA, 26 bp, Artificial Sequence
  Description of Artificial Sequence: Synthetic oligonucleotide
tgctggtgcttgataccgtcggagcc

SEQ ID NO: 222386 - DNA, 25 bp, Artificial Sequence
  Description of Artificial Sequence: Synthetic oligonucleotide
gctggtgcttgataccgtcggagcc

SEQ ID NO: 222387 - DNA, 25 bp, Artificial Sequence
  Description of Artificial Sequence: Synthetic oligonucleotide
ctggtgcttgataccgtcggagccg

SEQ ID NO: 222388 - DNA, 25 bp, Artificial Sequence
  Description of Artificial Sequence: Synthetic oligonucleotide
tggtgcttgataccgtcggagccgg

SEQ ID NO: 222389 - DNA, 24 bp, Artificial Sequence
  Description of Artificial Sequence: Synthetic oligonucleotide
ggtgcttgataccgtcggagccgg

SEQ ID NO: 222390 - DNA, 27 bp, Artificial Sequence
  Description of Artificial Sequence: Synthetic oligonucleotide
gtgcttgataccgtcggagccggcaat

SEQ ID NO: 222391 - DNA, 27 bp, Artificial Sequence
  Description of Artificial Sequence: Synthetic oligonucleotide
tgcttgataccgtcggagccggcaatg

SEQ ID NO: 222392 - DNA, 26 bp, Artificial Sequence
  Description of Artificial Sequence: Synthetic oligonucleotide
gcttgataccgtcggagccggcaatg

SEQ ID NO: 222393 - DNA, 26 bp, Artificial Sequence
  Description of Artificial Sequence: Synthetic oligonucleotide
cttgataccgtcggagccggcaatgg

SEQ ID NO: 222394 - DNA, 27 bp, Artificial Sequence
  Description of Artificial Sequence: Synthetic oligonucleotide
ttgataccgtcggagccggcaatggca

SEQ ID NO: 222395 - DNA, 27 bp, Artificial Sequence
  Description of Artificial Sequence: Synthetic oligonucleotide
tgataccgtcggagccggcaatggcat

SEQ ID NO: 222396 - DNA, 26 bp, Artificial Sequence
  Description of Artificial Sequence: Synthetic oligonucleotide
gataccgtcggagccggcaatggcat

SEQ ID NO: 222397 - DNA, 27 bp, Artificial Sequence
  Description of Artificial Sequence: Synthetic oligonucleotide
ataccgtcggagccggcaatggcatga

SEQ ID NO: 222398 - DNA, 27 bp, Artificial Sequence
  Description of Artificial Sequence: Synthetic oligonucleotide
taccgtcggagccggcaatggcatgat

SEQ ID NO: 222399 - DNA, 27 bp, Artificial Sequence
  Description of Artificial Sequence: Synthetic oligonucleotide
accgtcggagccggcaatggcatgatt

SEQ ID NO: 222400 - DNA, 26 bp, Artificial Sequence
  Description of Artificial Sequence: Synthetic oligonucleotide
ccgtcggagccggcaatggcatgatt

SEQ ID NO: 222401 - DNA, 26 bp, Artificial Sequence
  Description of Artificial Sequence: Synthetic oligonucleotide
cgtcggagccggcaatggcatgattg

SEQ ID NO: 222402 - DNA, 26 bp, Artificial Sequence
  Description of Artificial Sequence: Synthetic oligonucleotide
gtcggagccggcaatggcatgattgg

SEQ ID NO: 222403 - DNA, 27 bp, Artificial Sequence
  Description of Artificial Sequence: Synthetic oligonucleotide
tcggagccggcaatggcatgattggct

SEQ ID NO: 222404 - DNA, 27 bp, Artificial Sequence
  Description of Artificial Sequence: Synthetic oligonucleotide
cggagccggcaatggcatgattggctt

SEQ ID NO: 222405 - DNA, 27 bp, Artificial Sequence
  Description of Artificial Sequence: Synthetic oligonucleotide
ggagccggcaatggcatgattggcttc

SEQ ID NO: 222406 - DNA, 27 bp, Artificial Sequence
  Description of Artificial Sequence: Synthetic oligonucleotide
gagccggcaatggcatgattggcttcc

SEQ ID NO: 222407 - DNA, 28 bp, Artificial Sequence
  Description of Artificial Sequence: Synthetic oligonucleotide
agccggcaatggcatgattggcttccag

SEQ ID NO: 222408 - DNA, 27 bp, Artificial Sequence
  Description of Artificial Sequence: Synthetic oligonucleotide
gccggcaatggcatgattggcttccag

SEQ ID NO: 222409 - DNA, 27 bp, Artificial Sequence
  Description of Artificial Sequence: Synthetic oligonucleotide
ccggcaatggcatgattggcttccagg

SEQ ID NO: 222410 - DNA, 41 bp, Artificial Sequence
  Description of Artificial Sequence: Synthetic oligonucleotide
tctggtctcctgacaggtttgctcctaaatcttaaaatatg

SEQ ID NO: 222411 - DNA, 40 bp, Artificial Sequence
  Description of Artificial Sequence: Synthetic oligonucleotide
ctggtctcctgacaggtttgctcctaaatcttaaaatatg

SEQ ID NO: 222412 - DNA, 40 bp, Artificial Sequence
  Description of Artificial Sequence: Synthetic oligonucleotide
tggtctcctgacaggtttgctcctaaatcttaaaatatgg

SEQ ID NO: 222413 - DNA, 39 bp, Artificial Sequence
  Description of Artificial Sequence: Synthetic oligonucleotide
ggtctcctgacaggtttgctcctaaatcttaaaatatgg

SEQ ID NO: 222414 - DNA, 42 bp, Artificial Sequence
  Description of Artificial Sequence: Synthetic oligonucleotide
gtctcctgacaggtttgctcctaaatcttaaaatatggaaag

SEQ ID NO: 222415 - DNA, 42 bp, Artificial Sequence
  Description of Artificial Sequence: Synthetic oligonucleotide
tctcctgacaggtttgctcctaaatcttaaaatatggaaagc

SEQ ID NO: 222416 - DNA, 41 bp, Artificial Sequence
  Description of Artificial Sequence: Synthetic oligonucleotide
ctcctgacaggtttgctcctaaatcttaaaatatggaaagc

SEQ ID NO: 222417 - DNA, 42 bp, Artificial Sequence
  Description of Artificial Sequence: Synthetic oligonucleotide
tcctgacaggtttgctcctaaatcttaaaatatggaaagcac

SEQ ID NO: 222418 - DNA, 41 bp, Artificial Sequence
  Description of Artificial Sequence: Synthetic oligonucleotide
cctgacaggtttgctcctaaatcttaaaatatggaaagcac

SEQ ID NO: 222419 - DNA, 41 bp, Artificial Sequence
  Description of Artificial Sequence: Synthetic oligonucleotide
ctgacaggtttgctcctaaatcttaaaatatggaaagcacc

SEQ ID NO: 222420 - DNA, 42 bp, Artificial Sequence
  Description of Artificial Sequence: Synthetic oligonucleotide
tgacaggtttgctcctaaatcttaaaatatggaaagcacctc

SEQ ID NO: 222421 - DNA, 41 bp, Artificial Sequence
  Description of Artificial Sequence: Synthetic oligonucleotide
gacaggtttgctcctaaatcttaaaatatggaaagcacctc

SEQ ID NO: 222422 - DNA, 43 bp, Artificial Sequence
  Description of Artificial Sequence: Synthetic oligonucleotide
acaggtttgctcctaaatcttaaaatatggaaagcacctcatg

SEQ ID NO: 222423 - DNA, 42 bp, Artificial Sequence
  Description of Artificial Sequence: Synthetic oligonucleotide
caggtttgctcctaaatcttaaaatatggaaagcacctcatg

SEQ ID NO: 222424 - DNA, 43 bp, Artificial Sequence
  Description of Artificial Sequence: Synthetic oligonucleotide
aggtttgctcctaaatcttaaaatatggaaagcacctcatgag

SEQ ID NO: 222425 - DNA, 42 bp, Artificial Sequence
  Description of Artificial Sequence: Synthetic oligonucleotide
ggtttgctcctaaatcttaaaatatggaaagcacctcatgag

SEQ ID NO: 222426 - DNA, 42 bp, Artificial Sequence
  Description of Artificial Sequence: Synthetic oligonucleotide
gtttgctcctaaatcttaaaatatggaaagcacctcatgagg

SEQ ID NO: 222427 - DNA, 42 bp, Artificial Sequence
  Description of Artificial Sequence: Synthetic oligonucleotide
tttgctcctaaatcttaaaatatggaaagcacctcatgaggc

SEQ ID NO: 222428 - DNA, 41 bp, Artificial Sequence
  Description of Artificial Sequence: Synthetic oligonucleotide
ttgctcctaaatcttaaaatatggaaagcacctcatgaggc

SEQ ID NO: 222429 - DNA, 40 bp, Artificial Sequence
  Description of Artificial Sequence: Synthetic oligonucleotide
tgctcctaaatcttaaaatatggaaagcacctcatgaggc

SEQ ID NO: 222430 - DNA, 39 bp, Artificial Sequence
  Description of Artificial Sequence: Synthetic oligonucleotide
gctcctaaatcttaaaatatggaaagcacctcatgaggc

SEQ ID NO: 222431 - DNA, 49 bp, Artificial Sequence
  Description of Artificial Sequence: Synthetic oligonucleotide
ctcctaaatcttaaaatatggaaagcacctcatgaggctaaatattttg

SEQ ID NO: 222432 - DNA, 51 bp, Artificial Sequence
  Description of Artificial Sequence: Synthetic oligonucleotide
tcctaaatcttaaaatatggaaagcacctcatgaggctaaatattttgatg

SEQ ID NO: 222433 - DNA, 50 bp, Artificial Sequence
  Description of Artificial Sequence: Synthetic oligonucleotide
cctaaatcttaaaatatggaaagcacctcatgaggctaaatattttgatg

SEQ ID NO: 222434 - DNA, 51 bp, Artificial Sequence
  Description of Artificial Sequence: Synthetic oligonucleotide
ctaaatcttaaaatatggaaagcacctcatgaggctaaatattttgatgac

SEQ ID NO: 222435 - DNA, 51 bp, Artificial Sequence
  Description of Artificial Sequence: Synthetic oligonucleotide
taaatcttaaaatatggaaagcacctcatgaggctaaatattttgatgacc

SEQ ID NO: 222436 - DNA, 50 bp, Artificial Sequence
  Description of Artificial Sequence: Synthetic oligonucleotide
aaatcttaaaatatggaaagcacctcatgaggctaaatattttgatgacc

SEQ ID NO: 222437 - DNA, 49 bp, Artificial Sequence
  Description of Artificial Sequence: Synthetic oligonucleotide
aatcttaaaatatggaaagcacctcatgaggctaaatattttgatgacc

SEQ ID NO: 222438 - DNA, 48 bp, Artificial Sequence
  Description of Artificial Sequence: Synthetic oligonucleotide
atcttaaaatatggaaagcacctcatgaggctaaatattttgatgacc

SEQ ID NO: 222439 - DNA, 47 bp, Artificial Sequence
  Description of Artificial Sequence: Synthetic oligonucleotide
tcttaaaatatggaaagcacctcatgaggctaaatattttgatgacc

SEQ ID NO: 222440 - DNA, 46 bp, Artificial Sequence
  Description of Artificial Sequence: Synthetic oligonucleotide
cttaaaatatggaaagcacctcatgaggctaaatattttgatgacc

SEQ ID NO: 222441 - DNA, 48 bp, Artificial Sequence
  Description of Artificial Sequence: Synthetic oligonucleotide
ttaaaatatggaaagcacctcatgaggctaaatattttgatgaccaag

SEQ ID NO: 222442 - DNA, 47 bp, Artificial Sequence
  Description of Artificial Sequence: Synthetic oligonucleotide
taaaatatggaaagcacctcatgaggctaaatattttgatgaccaag

SEQ ID NO: 222443 - DNA, 46 bp, Artificial Sequence
  Description of Artificial Sequence: Synthetic oligonucleotide
aaaatatggaaagcacctcatgaggctaaatattttgatgaccaag

SEQ ID NO: 222444 - DNA, 45 bp, Artificial Sequence
  Description of Artificial Sequence: Synthetic oligonucleotide
aaatatggaaagcacctcatgaggctaaatattttgatgaccaag

SEQ ID NO: 222445 - DNA, 44 bp, Artificial Sequence
  Description of Artificial Sequence: Synthetic oligonucleotide
aatatggaaagcacctcatgaggctaaatattttgatgaccaag

SEQ ID NO: 222446 - DNA, 43 bp, Artificial Sequence
  Description of Artificial Sequence: Synthetic oligonucleotide
atatggaaagcacctcatgaggctaaatattttgatgaccaag

SEQ ID NO: 222447 - DNA, 42 bp, Artificial Sequence
  Description of Artificial Sequence: Synthetic oligonucleotide
tatggaaagcacctcatgaggctaaatattttgatgaccaag

SEQ ID NO: 222448 - DNA, 41 bp, Artificial Sequence
  Description of Artificial Sequence: Synthetic oligonucleotide
atggaaagcacctcatgaggctaaatattttgatgaccaag

SEQ ID NO: 222449 - DNA, 40 bp, Artificial Sequence
  Description of Artificial Sequence: Synthetic oligonucleotide
tggaaagcacctcatgaggctaaatattttgatgaccaag

SEQ ID NO: 222450 - DNA, 39 bp, Artificial Sequence
  Description of Artificial Sequence: Synthetic oligonucleotide
ggaaagcacctcatgaggctaaatattttgatgaccaag

SEQ ID NO: 222451 - DNA, 43 bp, Artificial Sequence
  Description of Artificial Sequence: Synthetic oligonucleotide
gaaagcacctcatgaggctaaatattttgatgaccaagttttc

SEQ ID NO: 222452 - DNA, 44 bp, Artificial Sequence
  Description of Artificial Sequence: Synthetic oligonucleotide
aaagcacctcatgaggctaaatattttgatgaccaagttttctg

SEQ ID NO: 222453 - DNA, 43 bp, Artificial Sequence
  Description of Artificial Sequence: Synthetic oligonucleotide
aagcacctcatgaggctaaatattttgatgaccaagttttctg

SEQ ID NO: 222454 - DNA, 42 bp, Artificial Sequence
  Description of Artificial Sequence: Synthetic oligonucleotide
agcacctcatgaggctaaatattttgatgaccaagttttctg

SEQ ID NO: 222455 - DNA, 41 bp, Artificial Sequence
  Description of Artificial Sequence: Synthetic oligonucleotide
gcacctcatgaggctaaatattttgatgaccaagttttctg

SEQ ID NO: 222456 - DNA, 41 bp, Artificial Sequence
  Description of Artificial Sequence: Synthetic oligonucleotide
cacctcatgaggctaaatattttgatgaccaagttttctgg

SEQ ID NO: 222457 - DNA, 43 bp, Artificial Sequence
  Description of Artificial Sequence: Synthetic oligonucleotide
acctcatgaggctaaatattttgatgaccaagttttctggaag

SEQ ID NO: 222458 - DNA, 42 bp, Artificial Sequence
  Description of Artificial Sequence: Synthetic oligonucleotide
cctcatgaggctaaatattttgatgaccaagttttctggaag

SEQ ID NO: 222459 - DNA, 45 bp, Artificial Sequence
  Description of Artificial Sequence: Synthetic oligonucleotide
ctcatgaggctaaatattttgatgaccaagttttctggaagtttc

SEQ ID NO: 222460 - DNA, 45 bp, Artificial Sequence
  Description of Artificial Sequence: Synthetic oligonucleotide
tcatgaggctaaatattttgatgaccaagttttctggaagtttcc

SEQ ID NO: 222461 - DNA, 44 bp, Artificial Sequence
  Description of Artificial Sequence: Synthetic oligonucleotide
catgaggctaaatattttgatgaccaagttttctggaagtttcc

SEQ ID NO: 222462 - DNA, 45 bp, Artificial Sequence
  Description of Artificial Sequence: Synthetic oligonucleotide
atgaggctaaatattttgatgaccaagttttctggaagtttcctc

SEQ ID NO: 222463 - DNA, 44 bp, Artificial Sequence
  Description of Artificial Sequence: Synthetic oligonucleotide
tgaggctaaatattttgatgaccaagttttctggaagtttcctc

SEQ ID NO: 222464 - DNA, 43 bp, Artificial Sequence
  Description of Artificial Sequence: Synthetic oligonucleotide
gaggctaaatattttgatgaccaagttttctggaagtttcctc

SEQ ID NO: 222465 - DNA, 47 bp, Artificial Sequence
  Description of Artificial Sequence: Synthetic oligonucleotide
aggctaaatattttgatgaccaagttttctggaagtttcctcatttg

SEQ ID NO: 222466 - DNA, 25 bp, Artificial Sequence
  Description of Artificial Sequence: Synthetic oligonucleotide
cggcgggccaccatgagtgctatgt

SEQ ID NO: 222467 - DNA, 25 bp, Artificial Sequence
  Description of Artificial Sequence: Synthetic oligonucleotide
ggcgggccaccatgagtgctatgtc

SEQ ID NO: 222468 - DNA, 25 bp, Artificial Sequence
  Description of Artificial Sequence: Synthetic oligonucleotide
gcgggccaccatgagtgctatgtcg

SEQ ID NO: 222469 - DNA, 26 bp, Artificial Sequence
  Description of Artificial Sequence: Synthetic oligonucleotide
cgggccaccatgagtgctatgtcggt

SEQ ID NO: 222470 - DNA, 26 bp, Artificial Sequence
  Description of Artificial Sequence: Synthetic oligonucleotide
gggccaccatgagtgctatgtcggtg

SEQ ID NO: 222471 - DNA, 36 bp, Artificial Sequence
  Description of Artificial Sequence: Synthetic oligonucleotide
tcttcttgtggatgttctggccaagtttcaactctc

SEQ ID NO: 222472 - DNA, 35 bp, Artificial Sequence
  Description of Artificial Sequence: Synthetic oligonucleotide
cttcttgtggatgttctggccaagtttcaactctc

SEQ ID NO: 222473 - DNA, 35 bp, Artificial Sequence
  Description of Artificial Sequence: Synthetic oligonucleotide
ttcttgtggatgttctggccaagtttcaactctcc

SEQ ID NO: 222474 - DNA, 34 bp, Artificial Sequence
  Description of Artificial Sequence: Synthetic oligonucleotide
tcttgtggatgttctggccaagtttcaactctcc

SEQ ID NO: 222475 - DNA, 33 bp, Artificial Sequence
  Description of Artificial Sequence: Synthetic oligonucleotide
cttgtggatgttctggccaagtttcaactctcc

SEQ ID NO: 222476 - DNA, 34 bp, Artificial Sequence
  Description of Artificial Sequence: Synthetic oligonucleotide
ttgtggatgttctggccaagtttcaactctcctc

SEQ ID NO: 222477 - DNA, 33 bp, Artificial Sequence
  Description of Artificial Sequence: Synthetic oligonucleotide
tgtggatgttctggccaagtttcaactctcctc

SEQ ID NO: 222478 - DNA, 32 bp, Artificial Sequence
  Description of Artificial Sequence: Synthetic oligonucleotide
gtggatgttctggccaagtttcaactctcctc

SEQ ID NO: 222479 - DNA, 33 bp, Artificial Sequence
  Description of Artificial Sequence: Synthetic oligonucleotide
tggatgttctggccaagtttcaactctcctctg

SEQ ID NO: 222480 - DNA, 32 bp, Artificial Sequence
  Description of Artificial Sequence: Synthetic oligonucleotide
ggatgttctggccaagtttcaactctcctctg

SEQ ID NO: 222481 - DNA, 32 bp, Artificial Sequence
  Description of Artificial Sequence: Synthetic oligonucleotide
gatgttctggccaagtttcaactctcctctgc

SEQ ID NO: 222482 - DNA, 33 bp, Artificial Sequence
  Description of Artificial Sequence: Synthetic oligonucleotide
atgttctggccaagtttcaactctcctctgctg

SEQ ID NO: 222483 - DNA, 32 bp, Artificial Sequence
  Description of Artificial Sequence: Synthetic oligonucleotide
tgttctggccaagtttcaactctcctctgctg

SEQ ID NO: 222484 - DNA, 31 bp, Artificial Sequence
  Description of Artificial Sequence: Synthetic oligonucleotide
gttctggccaagtttcaactctcctctgctg

SEQ ID NO: 222485 - DNA, 32 bp, Artificial Sequence
  Description of Artificial Sequence: Synthetic oligonucleotide
ttctggccaagtttcaactctcctctgctgag

SEQ ID NO: 222486 - DNA, 31 bp, Artificial Sequence
  Description of Artificial Sequence: Synthetic oligonucleotide
tctggccaagtttcaactctcctctgctgag

SEQ ID NO: 222487 - DNA, 30 bp, Artificial Sequence
  Description of Artificial Sequence: Synthetic oligonucleotide
ctggccaagtttcaactctcctctgctgag

SEQ ID NO: 222488 - DNA, 32 bp, Artificial Sequence
  Description of Artificial Sequence: Synthetic oligonucleotide
tggccaagtttcaactctcctctgctgagaag

SEQ ID NO: 222489 - DNA, 31 bp, Artificial Sequence
  Description of Artificial Sequence: Synthetic oligonucleotide
ggccaagtttcaactctcctctgctgagaag

SEQ ID NO: 222490 - DNA, 32 bp, Artificial Sequence
  Description of Artificial Sequence: Synthetic oligonucleotide
gccaagtttcaactctcctctgctgagaagtc

SEQ ID NO: 222491 - DNA, 32 bp, Artificial Sequence
  Description of Artificial Sequence: Synthetic oligonucleotide
ccaagtttcaactctcctctgctgagaagtcc

SEQ ID NO: 222492 - DNA, 35 bp, Artificial Sequence
  Description of Artificial Sequence: Synthetic oligonucleotide
caagtttcaactctcctctgctgagaagtccaatc

SEQ ID NO: 222493 - DNA, 35 bp, Artificial Sequence
  Description of Artificial Sequence: Synthetic oligonucleotide
aagtttcaactctcctctgctgagaagtccaatcg

SEQ ID NO: 222494 - DNA, 34 bp, Artificial Sequence
  Description of Artificial Sequence: Synthetic oligonucleotide
agtttcaactctcctctgctgagaagtccaatcg

SEQ ID NO: 222495 - DNA, 33 bp, Artificial Sequence
  Description of Artificial Sequence: Synthetic oligonucleotide
gtttcaactctcctctgctgagaagtccaatcg

SEQ ID NO: 222496 - DNA, 36 bp, Artificial Sequence
  Description of Artificial Sequence: Synthetic oligonucleotide
tttcaactctcctctgctgagaagtccaatcgaaag

SEQ ID NO: 222497 - DNA, 35 bp, Artificial Sequence
  Description of Artificial Sequence: Synthetic oligonucleotide
ttcaactctcctctgctgagaagtccaatcgaaag

SEQ ID NO: 222498 - DNA, 29 bp, Artificial Sequence
  Description of Artificial Sequence: Synthetic oligonucleotide
aagatctgaccgtgatggcggccattgtc

SEQ ID NO: 222499 - DNA, 28 bp, Artificial Sequence
  Description of Artificial Sequence: Synthetic oligonucleotide
agatctgaccgtgatggcggccattgtc

SEQ ID NO: 222500 - DNA, 27 bp, Artificial Sequence
  Description of Artificial Sequence: Synthetic oligonucleotide
gatctgaccgtgatggcggccattgtc

SEQ ID NO: 222501 - DNA, 29 bp, Artificial Sequence
  Description of Artificial Sequence: Synthetic oligonucleotide
atctgaccgtgatggcggccattgtcttg

SEQ ID NO: 222502 - DNA, 28 bp, Artificial Sequence
  Description of Artificial Sequence: Synthetic oligonucleotide
tctgaccgtgatggcggccattgtcttg

SEQ ID NO: 222503 - DNA, 27 bp, Artificial Sequence
  Description of Artificial Sequence: Synthetic oligonucleotide
ctgaccgtgatggcggccattgtcttg

SEQ ID NO: 222504 - DNA, 27 bp, Artificial Sequence
  Description of Artificial Sequence: Synthetic oligonucleotide
tgaccgtgatggcggccattgtcttgg

SEQ ID NO: 222505 - DNA, 26 bp, Artificial Sequence
  Description of Artificial Sequence: Synthetic oligonucleotide
gaccgtgatggcggccattgtcttgg

SEQ ID NO: 222506 - DNA, 26 bp, Artificial Sequence
  Description of Artificial Sequence: Synthetic oligonucleotide
accgtgatggcggccattgtcttggg

SEQ ID NO: 222507 - DNA, 25 bp, Artificial Sequence
  Description of Artificial Sequence: Synthetic oligonucleotide
ccgtgatggcggccattgtcttggg

SEQ ID NO: 222508 - DNA, 27 bp, Artificial Sequence
  Description of Artificial Sequence: Synthetic oligonucleotide
cgtgatggcggccattgtcttgggctt

SEQ ID NO: 222509 - DNA, 27 bp, Artificial Sequence
  Description of Artificial Sequence: Synthetic oligonucleotide
gtgatggcggccattgtcttgggcttc

SEQ ID NO: 222510 - DNA, 27 bp, Artificial Sequence
  Description of Artificial Sequence: Synthetic oligonucleotide
tgatggcggccattgtcttgggcttcc

SEQ ID NO: 222511 - DNA, 27 bp, Artificial Sequence
  Description of Artificial Sequence: Synthetic oligonucleotide
gatggcggccattgtcttgggcttcct

SEQ ID NO: 222512 - DNA, 27 bp, Artificial Sequence
  Description of Artificial Sequence: Synthetic oligonucleotide
atggcggccattgtcttgggcttcctc

SEQ ID NO: 222513 - DNA, 27 bp, Artificial Sequence
  Description of Artificial Sequence: Synthetic oligonucleotide
tggcggccattgtcttgggcttcctca

SEQ ID NO: 222514 - DNA, 26 bp, Artificial Sequence
  Description of Artificial Sequence: Synthetic oligonucleotide
ggcggccattgtcttgggcttcctca

SEQ ID NO: 222515 - DNA, 26 bp, Artificial Sequence
  Description of Artificial Sequence: Synthetic oligonucleotide
gcggccattgtcttgggcttcctcac

SEQ ID NO: 222516 - DNA, 27 bp, Artificial Sequence
  Description of Artificial Sequence: Synthetic oligonucleotide
cggccattgtcttgggcttcctcacct

SEQ ID NO: 222517 - DNA, 27 bp, Artificial Sequence
  Description of Artificial Sequence: Synthetic oligonucleotide
ggccattgtcttgggcttcctcacctc

SEQ ID NO: 222518 - DNA, 27 bp, Artificial Sequence
  Description of Artificial Sequence: Synthetic oligonucleotide
gccattgtcttgggcttcctcacctcg

SEQ ID NO: 222519 - DNA, 28 bp, Artificial Sequence
  Description of Artificial Sequence: Synthetic oligonucleotide
ccattgtcttgggcttcctcacctcgag

SEQ ID NO: 222520 - DNA, 31 bp, Artificial Sequence
  Description of Artificial Sequence: Synthetic oligonucleotide
cattgtcttgggcttcctcacctcgagtttc

SEQ ID NO: 222521 - DNA, 31 bp, Artificial Sequence
  Description of Artificial Sequence: Synthetic oligonucleotide
attgtcttgggcttcctcacctcgagtttcc

SEQ ID NO: 222522 - DNA, 30 bp, Artificial Sequence
  Description of Artificial Sequence: Synthetic oligonucleotide
ttgtcttgggcttcctcacctcgagtttcc

SEQ ID NO: 222523 - DNA, 29 bp, Artificial Sequence
  Description of Artificial Sequence: Synthetic oligonucleotide
tgtcttgggcttcctcacctcgagtttcc

SEQ ID NO: 222524 - DNA, 28 bp, Artificial Sequence
  Description of Artificial Sequence: Synthetic oligonucleotide
gtcttgggcttcctcacctcgagtttcc

SEQ ID NO: 222525 - DNA, 28 bp, Artificial Sequence
  Description of Artificial Sequence: Synthetic oligonucleotide
tcttgggcttcctcacctcgagtttccg

SEQ ID NO: 222526 - DNA, 31 bp, Artificial Sequence
  Description of Artificial Sequence: Synthetic oligonucleotide
tattcggctggccaccatgagtgctatgttg

SEQ ID NO: 222527 - DNA, 30 bp, Artificial Sequence
  Description of Artificial Sequence: Synthetic oligonucleotide
attcggctggccaccatgagtgctatgttg

SEQ ID NO: 222528 - DNA, 29 bp, Artificial Sequence
  Description of Artificial Sequence: Synthetic oligonucleotide
ttcggctggccaccatgagtgctatgttg

SEQ ID NO: 222529 - DNA, 28 bp, Artificial Sequence
  Description of Artificial Sequence: Synthetic oligonucleotide
tcggctggccaccatgagtgctatgttg

SEQ ID NO: 222530 - DNA, 27 bp, Artificial Sequence
  Description of Artificial Sequence: Synthetic oligonucleotide
cggctggccaccatgagtgctatgttg

SEQ ID NO: 222531 - DNA, 27 bp, Artificial Sequence
  Description of Artificial Sequence: Synthetic oligonucleotide
ggctggccaccatgagtgctatgttgg

SEQ ID NO: 222532 - DNA, 28 bp, Artificial Sequence
  Description of Artificial Sequence: Synthetic oligonucleotide
gctggccaccatgagtgctatgttggtg

SEQ ID NO: 222533 - DNA, 28 bp, Artificial Sequence
  Description of Artificial Sequence: Synthetic oligonucleotide
ctggccaccatgagtgctatgttggtgc

SEQ ID NO: 222534 - DNA, 29 bp, Artificial Sequence
  Description of Artificial Sequence: Synthetic oligonucleotide
tggccaccatgagtgctatgttggtgctg

SEQ ID NO: 222535 - DNA, 28 bp, Artificial Sequence
  Description of Artificial Sequence: Synthetic oligonucleotide
ggccaccatgagtgctatgttggtgctg

SEQ ID NO: 222536 - DNA, 30 bp, Artificial Sequence
  Description of Artificial Sequence: Synthetic oligonucleotide
gccaccatgagtgctatgttggtgctgatc

SEQ ID NO: 222537 - DNA, 31 bp, Artificial Sequence
  Description of Artificial Sequence: Synthetic oligonucleotide
ccaccatgagtgctatgttggtgctgatctc

SEQ ID NO: 222538 - DNA, 32 bp, Artificial Sequence
  Description of Artificial Sequence: Synthetic oligonucleotide
caccatgagtgctatgttggtgctgatctcag

SEQ ID NO: 222539 - DNA, 32 bp, Artificial Sequence
  Description of Artificial Sequence: Synthetic oligonucleotide
accatgagtgctatgttggtgctgatctcagc

SEQ ID NO: 222540 - DNA, 31 bp, Artificial Sequence
  Description of Artificial Sequence: Synthetic oligonucleotide
ccatgagtgctatgttggtgctgatctcagc

SEQ ID NO: 222541 - DNA, 31 bp, Artificial Sequence
  Description of Artificial Sequence: Synthetic oligonucleotide
catgagtgctatgttggtgctgatctcagcg

SEQ ID NO: 222542 - DNA, 31 bp, Artificial Sequence
  Description of Artificial Sequence: Synthetic oligonucleotide
atgagtgctatgttggtgctgatctcagcgg

SEQ ID NO: 222543 - DNA, 30 bp, Artificial Sequence
  Description of Artificial Sequence: Synthetic oligonucleotide
tgagtgctatgttggtgctgatctcagcgg

SEQ ID NO: 222544 - DNA, 29 bp, Artificial Sequence
  Description of Artificial Sequence: Synthetic oligonucleotide
gagtgctatgttggtgctgatctcagcgg

SEQ ID NO: 222545 - DNA, 29 bp, Artificial Sequence
  Description of Artificial Sequence: Synthetic oligonucleotide
agtgctatgttggtgctgatctcagcggg

SEQ ID NO: 222546 - DNA, 28 bp, Artificial Sequence
  Description of Artificial Sequence: Synthetic oligonucleotide
gtgctatgttggtgctgatctcagcggg

SEQ ID NO: 222547 - DNA, 29 bp, Artificial Sequence
  Description of Artificial Sequence: Synthetic oligonucleotide
tgctatgttggtgctgatctcagcgggtg

SEQ ID NO: 222548 - DNA, 28 bp, Artificial Sequence
  Description of Artificial Sequence: Synthetic oligonucleotide
gctatgttggtgctgatctcagcgggtg

SEQ ID NO: 222549 - DNA, 28 bp, Artificial Sequence
  Description of Artificial Sequence: Synthetic oligonucleotide
ctatgttggtgctgatctcagcgggtgc

SEQ ID NO: 222550 - DNA, 29 bp, Artificial Sequence
  Description of Artificial Sequence: Synthetic oligonucleotide
tatgttggtgctgatctcagcgggtgctg

SEQ ID NO: 222551 - DNA, 28 bp, Artificial Sequence
  Description of Artificial Sequence: Synthetic oligonucleotide
atgttggtgctgatctcagcgggtgctg

SEQ ID NO: 222552 - DNA, 27 bp, Artificial Sequence
  Description of Artificial Sequence: Synthetic oligonucleotide
tgttggtgctgatctcagcgggtgctg

SEQ ID NO: 222553 - DNA, 27 bp, Artificial Sequence
  Description of Artificial Sequence: Synthetic oligonucleotide
gttggtgctgatctcagcgggtgctgt

SEQ ID NO: 222554 - DNA, 27 bp, Artificial Sequence
  Description of Artificial Sequence: Synthetic oligonucleotide
ttggtgctgatctcagcgggtgctgtc

SEQ ID NO: 222555 - DNA, 27 bp, Artificial Sequence
  Description of Artificial Sequence: Synthetic oligonucleotide
tggtgctgatctcagcgggtgctgtct

SEQ ID NO: 222556 - DNA, 30 bp, Artificial Sequence
  Description of Artificial Sequence: Synthetic oligonucleotide
tattgggctggccaccatgagtgctttgtc

SEQ ID NO: 222557 - DNA, 29 bp, Artificial Sequence
  Description of Artificial Sequence: Synthetic oligonucleotide
attgggctggccaccatgagtgctttgtc

SEQ ID NO: 222558 - DNA, 28 bp, Artificial Sequence
  Description of Artificial Sequence: Synthetic oligonucleotide
ttgggctggccaccatgagtgctttgtc

SEQ ID NO: 222559 - DNA, 27 bp, Artificial Sequence
  Description of Artificial Sequence: Synthetic oligonucleotide
tgggctggccaccatgagtgctttgtc

SEQ ID NO: 222560 - DNA, 26 bp, Artificial Sequence
  Description of Artificial Sequence: Synthetic oligonucleotide
gggctggccaccatgagtgctttgtc

SEQ ID NO: 222561 - DNA, 38 bp, Artificial Sequence
  Description of Artificial Sequence: Synthetic oligonucleotide
ctgaggatggtcatcagtaatatcttcaacacagactg

SEQ ID NO: 222562 - DNA, 38 bp, Artificial Sequence
  Description of Artificial Sequence: Synthetic oligonucleotide
tgaggatggtcatcagtaatatcttcaacacagactgc

SEQ ID NO: 222563 - DNA, 37 bp, Artificial Sequence
  Description of Artificial Sequence: Synthetic oligonucleotide
gaggatggtcatcagtaatatcttcaacacagactgc

SEQ ID NO: 222564 - DNA, 37 bp, Artificial Sequence
  Description of Artificial Sequence: Synthetic oligonucleotide
aggatggtcatcagtaatatcttcaacacagactgcc

SEQ ID NO: 222565 - DNA, 36 bp, Artificial Sequence
  Description of Artificial Sequence: Synthetic oligonucleotide
ggatggtcatcagtaatatcttcaacacagactgcc

SEQ ID NO: 222566 - DNA, 37 bp, Artificial Sequence
  Description of Artificial Sequence: Synthetic oligonucleotide
gatggtcatcagtaatatcttcaacacagactgccac

SEQ ID NO: 222567 - DNA, 39 bp, Artificial Sequence
  Description of Artificial Sequence: Synthetic oligonucleotide
atggtcatcagtaatatcttcaacacagactgccacatg

SEQ ID NO: 222568 - DNA, 38 bp, Artificial Sequence
  Description of Artificial Sequence: Synthetic oligonucleotide
tggtcatcagtaatatcttcaacacagactgccacatg

SEQ ID NO: 222569 - DNA, 37 bp, Artificial Sequence
  Description of Artificial Sequence: Synthetic oligonucleotide
ggtcatcagtaatatcttcaacacagactgccacatg

SEQ ID NO: 222570 - DNA, 39 bp, Artificial Sequence
  Description of Artificial Sequence: Synthetic oligonucleotide
gtcatcagtaatatcttcaacacagactgccacatgaac

SEQ ID NO: 222571 - DNA, 41 bp, Artificial Sequence
  Description of Artificial Sequence: Synthetic oligonucleotide
tcatcagtaatatcttcaacacagactgccacatgaacatg

SEQ ID NO: 222572 - DNA, 40 bp, Artificial Sequence
  Description of Artificial Sequence: Synthetic oligonucleotide
catcagtaatatcttcaacacagactgccacatgaacatg

SEQ ID NO: 222573 - DNA, 42 bp, Artificial Sequence
  Description of Artificial Sequence: Synthetic oligonucleotide
atcagtaatatcttcaacacagactgccacatgaacatgatg

SEQ ID NO: 222574 - DNA, 41 bp, Artificial Sequence
  Description of Artificial Sequence: Synthetic oligonucleotide
tcagtaatatcttcaacacagactgccacatgaacatgatg

SEQ ID NO: 222575 - DNA, 40 bp, Artificial Sequence
  Description of Artificial Sequence: Synthetic oligonucleotide
cagtaatatcttcaacacagactgccacatgaacatgatg

SEQ ID NO: 222576 - DNA, 40 bp, Artificial Sequence
  Description of Artificial Sequence: Synthetic oligonucleotide
agtaatatcttcaacacagactgccacatgaacatgatgc

SEQ ID NO: 222577 - DNA, 39 bp, Artificial Sequence
  Description of Artificial Sequence: Synthetic oligonucleotide
gtaatatcttcaacacagactgccacatgaacatgatgc

SEQ ID NO: 222578 - DNA, 40 bp, Artificial Sequence
  Description of Artificial Sequence: Synthetic oligonucleotide
taatatcttcaacacagactgccacatgaacatgatgcac

SEQ ID NO: 222579 - DNA, 39 bp, Artificial Sequence
  Description of Artificial Sequence: Synthetic oligonucleotide
aatatcttcaacacagactgccacatgaacatgatgcac

SEQ ID NO: 222580 - DNA, 38 bp, Artificial Sequence
  Description of Artificial Sequence: Synthetic oligonucleotide
atatcttcaacacagactgccacatgaacatgatgcac

SEQ ID NO: 222581 - DNA, 37 bp, Artificial Sequence
  Description of Artificial Sequence: Synthetic oligonucleotide
tatcttcaacacagactgccacatgaacatgatgcac

SEQ ID NO: 222582 - DNA, 36 bp, Artificial Sequence
  Description of Artificial Sequence: Synthetic oligonucleotide
atcttcaacacagactgccacatgaacatgatgcac

SEQ ID NO: 222583 - DNA, 35 bp, Artificial Sequence
  Description of Artificial Sequence: Synthetic oligonucleotide
tcttcaacacagactgccacatgaacatgatgcac

SEQ ID NO: 222584 - DNA, 34 bp, Artificial Sequence
  Description of Artificial Sequence: Synthetic oligonucleotide
cttcaacacagactgccacatgaacatgatgcac

SEQ ID NO: 222585 - DNA, 36 bp, Artificial Sequence
  Description of Artificial Sequence: Synthetic oligonucleotide
ttcaacacagactgccacatgaacatgatgcacatc

SEQ ID NO: 222586 - DNA, 35 bp, Artificial Sequence
  Description of Artificial Sequence: Synthetic oligonucleotide
tcaacacagactgccacatgaacatgatgcacatc

SEQ ID NO: 222587 - DNA, 34 bp, Artificial Sequence
  Description of Artificial Sequence: Synthetic oligonucleotide
caacacagactgccacatgaacatgatgcacatc

SEQ ID NO: 222588 - DNA, 36 bp, Artificial Sequence
  Description of Artificial Sequence: Synthetic oligonucleotide
aacacagactgccacatgaacatgatgcacatctac

SEQ ID NO: 222589 - DNA, 35 bp, Artificial Sequence
  Description of Artificial Sequence: Synthetic oligonucleotide
acacagactgccacatgaacatgatgcacatctac

SEQ ID NO: 222590 - DNA, 34 bp, Artificial Sequence
  Description of Artificial Sequence: Synthetic oligonucleotide
cacagactgccacatgaacatgatgcacatctac

SEQ ID NO: 222591 - DNA, 34 bp, Artificial Sequence
  Description of Artificial Sequence: Synthetic oligonucleotide
acagactgccacatgaacatgatgcacatctacg

SEQ ID NO: 222592 - DNA, 33 bp, Artificial Sequence
  Description of Artificial Sequence: Synthetic oligonucleotide
cagactgccacatgaacatgatgcacatctacg

SEQ ID NO: 222593 - DNA, 34 bp, Artificial Sequence
  Description of Artificial Sequence: Synthetic oligonucleotide
agactgccacatgaacatgatgcacatctacgtg

SEQ ID NO: 222594 - DNA, 33 bp, Artificial Sequence
  Description of Artificial Sequence: Synthetic oligonucleotide
gactgccacatgaacatgatgcacatctacgtg

SEQ ID NO: 222595 - DNA, 35 bp, Artificial Sequence
  Description of Artificial Sequence: Synthetic oligonucleotide
actgccacatgaacatgatgcacatctacgtgttc

SEQ ID NO: 222596 - DNA, 34 bp, Artificial Sequence
  Description of Artificial Sequence: Synthetic oligonucleotide
ctgccacatgaacatgatgcacatctacgtgttc

SEQ ID NO: 222597 - DNA, 34 bp, Artificial Sequence
  Description of Artificial Sequence: Synthetic oligonucleotide
tgccacatgaacatgatgcacatctacgtgttcg

SEQ ID NO: 222598 - DNA, 33 bp, Artificial Sequence
  Description of Artificial Sequence: Synthetic oligonucleotide
gccacatgaacatgatgcacatctacgtgttcg

SEQ ID NO: 222599 - DNA, 33 bp, Artificial Sequence
  Description of Artificial Sequence: Synthetic oligonucleotide
tgggtctgcttggagagatcatctacattgtgc

SEQ ID NO: 222600 - DNA, 32 bp, Artificial Sequence
  Description of Artificial Sequence: Synthetic oligonucleotide
gggtctgcttggagagatcatctacattgtgc

SEQ ID NO: 222601 - DNA, 33 bp, Artificial Sequence
  Description of Artificial Sequence: Synthetic oligonucleotide
ggtctgcttggagagatcatctacattgtgctg

SEQ ID NO: 222602 - DNA, 33 bp, Artificial Sequence
  Description of Artificial Sequence: Synthetic oligonucleotide
gtctgcttggagagatcatctacattgtgctgc

SEQ ID NO: 222603 - DNA, 34 bp, Artificial Sequence
  Description of Artificial Sequence: Synthetic oligonucleotide
tctgcttggagagatcatctacattgtgctgctg

SEQ ID NO: 222604 - DNA, 33 bp, Artificial Sequence
  Description of Artificial Sequence: Synthetic oligonucleotide
ctgcttggagagatcatctacattgtgctgctg

SEQ ID NO: 222605 - DNA, 33 bp, Artificial Sequence
  Description of Artificial Sequence: Synthetic oligonucleotide
tgcttggagagatcatctacattgtgctgctgg

SEQ ID NO: 222606 - DNA, 32 bp, Artificial Sequence
  Description of Artificial Sequence: Synthetic oligonucleotide
gcttggagagatcatctacattgtgctgctgg

SEQ ID NO: 222607 - DNA, 33 bp, Artificial Sequence
  Description of Artificial Sequence: Synthetic oligonucleotide
cttggagagatcatctacattgtgctgctggtg

SEQ ID NO: 222608 - DNA, 33 bp, Artificial Sequence
  Description of Artificial Sequence: Synthetic oligonucleotide
ttggagagatcatctacattgtgctgctggtgc

SEQ ID NO: 222609 - DNA, 32 bp, Artificial Sequence
  Description of Artificial Sequence: Synthetic oligonucleotide
tggagagatcatctacattgtgctgctggtgc

SEQ ID NO: 222610 - DNA, 31 bp, Artificial Sequence
  Description of Artificial Sequence: Synthetic oligonucleotide
ggagagatcatctacattgtgctgctggtgc

SEQ ID NO: 222611 - DNA, 33 bp, Artificial Sequence
  Description of Artificial Sequence: Synthetic oligonucleotide
gagagatcatctacattgtgctgctggtgcttg

SEQ ID NO: 222612 - DNA, 36 bp, Artificial Sequence
  Description of Artificial Sequence: Synthetic oligonucleotide
agagatcatctacattgtgctgctggtgcttgatac

SEQ ID NO: 222613 - DNA, 35 bp, Artificial Sequence
  Description of Artificial Sequence: Synthetic oligonucleotide
gagatcatctacattgtgctgctggtgcttgatac

SEQ ID NO: 222614 - DNA, 35 bp, Artificial Sequence
  Description of Artificial Sequence: Synthetic oligonucleotide
agatcatctacattgtgctgctggtgcttgatacc

SEQ ID NO: 222615 - DNA, 34 bp, Artificial Sequence
  Description of Artificial Sequence: Synthetic oligonucleotide
gatcatctacattgtgctgctggtgcttgatacc

SEQ ID NO: 222616 - DNA, 34 bp, Artificial Sequence
  Description of Artificial Sequence: Synthetic oligonucleotide
atcatctacattgtgctgctggtgcttgataccg

SEQ ID NO: 222617 - DNA, 33 bp, Artificial Sequence
  Description of Artificial Sequence: Synthetic oligonucleotide
tcatctacattgtgctgctggtgcttgataccg

SEQ ID NO: 222618 - DNA, 32 bp, Artificial Sequence
  Description of Artificial Sequence: Synthetic oligonucleotide
catctacattgtgctgctggtgcttgataccg

SEQ ID NO: 222619 - DNA, 33 bp, Artificial Sequence
  Description of Artificial Sequence: Synthetic oligonucleotide
atctacattgtgctgctggtgcttgataccgtc

SEQ ID NO: 222620 - DNA, 32 bp, Artificial Sequence
  Description of Artificial Sequence: Synthetic oligonucleotide
tctacattgtgctgctggtgcttgataccgtc

SEQ ID NO: 222621 - DNA, 31 bp, Artificial Sequence
  Description of Artificial Sequence: Synthetic oligonucleotide
ctacattgtgctgctggtgcttgataccgtc

SEQ ID NO: 222622 - DNA, 31 bp, Artificial Sequence
  Description of Artificial Sequence: Synthetic oligonucleotide
tacattgtgctgctggtgcttgataccgtcg

SEQ ID NO: 222623 - DNA, 30 bp, Artificial Sequence
  Description of Artificial Sequence: Synthetic oligonucleotide
acattgtgctgctggtgcttgataccgtcg

SEQ ID NO: 222624 - DNA, 29 bp, Artificial Sequence
  Description of Artificial Sequence: Synthetic oligonucleotide
cattgtgctgctggtgcttgataccgtcg

SEQ ID NO: 222625 - DNA, 29 bp, Artificial Sequence
  Description of Artificial Sequence: Synthetic oligonucleotide
attgtgctgctggtgcttgataccgtcgg

SEQ ID NO: 222626 - DNA, 28 bp, Artificial Sequence
  Description of Artificial Sequence: Synthetic oligonucleotide
ttgtgctgctggtgcttgataccgtcgg

SEQ ID NO: 222627 - DNA, 27 bp, Artificial Sequence
  Description of Artificial Sequence: Synthetic oligonucleotide
tgtgctgctggtgcttgataccgtcgg

SEQ ID NO: 222628 - DNA, 27 bp, Artificial Sequence
  Description of Artificial Sequence: Synthetic oligonucleotide
gtgctgctggtgcttgataccgtcgga

SEQ ID NO: 222629 - DNA, 27 bp, Artificial Sequence
  Description of Artificial Sequence: Synthetic oligonucleotide
tgctgctggtgcttgataccgtcggag

SEQ ID NO: 222630 - DNA, 26 bp, Artificial Sequence
  Description of Artificial Sequence: Synthetic oligonucleotide
gctgctggtgcttgataccgtcggag

SEQ ID NO: 222631 - DNA, 26 bp, Artificial Sequence
  Description of Artificial Sequence: Synthetic oligonucleotide
ctgctggtgcttgataccgtcggagc

SEQ ID NO: 222632 - DNA, 30 bp, Artificial Sequence
  Description of Artificial Sequence: Synthetic oligonucleotide
gactaccacatgaacctgaggcgcttctac

SEQ ID NO: 222633 - DNA, 30 bp, Artificial Sequence
  Description of Artificial Sequence: Synthetic oligonucleotide
actaccacatgaacctgaggcgcttctacg

SEQ ID NO: 222634 - DNA, 29 bp, Artificial Sequence
  Description of Artificial Sequence: Synthetic oligonucleotide
ctaccacatgaacctgaggcgcttctacg

SEQ ID NO: 222635 - DNA, 30 bp, Artificial Sequence
  Description of Artificial Sequence: Synthetic oligonucleotide
taccacatgaacctgaggcgcttctacgtg

SEQ ID NO: 222636 - DNA, 29 bp, Artificial Sequence
  Description of Artificial Sequence: Synthetic oligonucleotide
accacatgaacctgaggcgcttctacgtg

SEQ ID NO: 222637 - DNA, 28 bp, Artificial Sequence
  Description of Artificial Sequence: Synthetic oligonucleotide
ccacatgaacctgaggcgcttctacgtg

SEQ ID NO: 222638 - DNA, 30 bp, Artificial Sequence
  Description of Artificial Sequence: Synthetic oligonucleotide
cacatgaacctgaggcgcttctacgtgttc

SEQ ID NO: 222639 - DNA, 30 bp, Artificial Sequence
  Description of Artificial Sequence: Synthetic oligonucleotide
acatgaacctgaggcgcttctacgtgttcg

SEQ ID NO: 222640 - DNA, 29 bp, Artificial Sequence
  Description of Artificial Sequence: Synthetic oligonucleotide
catgaacctgaggcgcttctacgtgttcg

SEQ ID NO: 222641 - DNA, 29 bp, Artificial Sequence
  Description of Artificial Sequence: Synthetic oligonucleotide
atgaacctgaggcgcttctacgtgttcgc

SEQ ID NO: 222642 - DNA, 28 bp, Artificial Sequence
  Description of Artificial Sequence: Synthetic oligonucleotide
tgaacctgaggcgcttctacgtgttcgc

SEQ ID NO: 222643 - DNA, 27 bp, Artificial Sequence
  Description of Artificial Sequence: Synthetic oligonucleotide
gaacctgaggcgcttctacgtgttcgc

SEQ ID NO: 222644 - DNA, 28 bp, Artificial Sequence
  Description of Artificial Sequence: Synthetic oligonucleotide
aacctgaggcgcttctacgtgttcgcag

SEQ ID NO: 222645 - DNA, 27 bp, Artificial Sequence
  Description of Artificial Sequence: Synthetic oligonucleotide
acctgaggcgcttctacgtgttcgcag

SEQ ID NO: 222646 - DNA, 26 bp, Artificial Sequence
  Description of Artificial Sequence: Synthetic oligonucleotide
cctgaggcgcttctacgtgttcgcag

SEQ ID NO: 222647 - DNA, 26 bp, Artificial Sequence
  Description of Artificial Sequence: Synthetic oligonucleotide
ctgaggcgcttctacgtgttcgcagc

SEQ ID NO: 222648 - DNA, 27 bp, Artificial Sequence
  Description of Artificial Sequence: Synthetic oligonucleotide
tgaggcgcttctacgtgttcgcagcct

SEQ ID NO: 222649 - DNA, 27 bp, Artificial Sequence
  Description of Artificial Sequence: Synthetic oligonucleotide
gaggcgcttctacgtgttcgcagccta

SEQ ID NO: 222650 - DNA, 31 bp, Artificial Sequence
  Description of Artificial Sequence: Synthetic oligonucleotide
aggcgcttctacgtgttcgcagcctattttg

SEQ ID NO: 222651 - DNA, 30 bp, Artificial Sequence
  Description of Artificial Sequence: Synthetic oligonucleotide
ggcgcttctacgtgttcgcagcctattttg

SEQ ID NO: 222652 - DNA, 30 bp, Artificial Sequence
  Description of Artificial Sequence: Synthetic oligonucleotide
gcgcttctacgtgttcgcagcctattttgg

SEQ ID NO: 222653 - DNA, 30 bp, Artificial Sequence
  Description of Artificial Sequence: Synthetic oligonucleotide
cgcttctacgtgttcgcagcctattttggg

SEQ ID NO: 222654 - DNA, 30 bp, Artificial Sequence
  Description of Artificial Sequence: Synthetic oligonucleotide
gcttctacgtgttcgcagcctattttgggc

SEQ ID NO: 222655 - DNA, 30 bp, Artificial Sequence
  Description of Artificial Sequence: Synthetic oligonucleotide
gccaagtgtcaactctgctctgctgagaac

SEQ ID NO: 222656 - DNA, 31 bp, Artificial Sequence
  Description of Artificial Sequence: Synthetic oligonucleotide
ccaagtgtcaactctgctctgctgagaactc

SEQ ID NO: 222657 - DNA, 31 bp, Artificial Sequence
  Description of Artificial Sequence: Synthetic oligonucleotide
caagtgtcaactctgctctgctgagaactcc

SEQ ID NO: 222658 - DNA, 34 bp, Artificial Sequence
  Description of Artificial Sequence: Synthetic oligonucleotide
aagtgtcaactctgctctgctgagaactccaatc

SEQ ID NO: 222659 - DNA, 33 bp, Artificial Sequence
  Description of Artificial Sequence: Synthetic oligonucleotide
agtgtcaactctgctctgctgagaactccaatc

SEQ ID NO: 222660 - DNA, 32 bp, Artificial Sequence
  Description of Artificial Sequence: Synthetic oligonucleotide
gtgtcaactctgctctgctgagaactccaatc

SEQ ID NO: 222661 - DNA, 32 bp, Artificial Sequence
  Description of Artificial Sequence: Synthetic oligonucleotide
tgtcaactctgctctgctgagaactccaatcc

SEQ ID NO: 222662 - DNA, 31 bp, Artificial Sequence
  Description of Artificial Sequence: Synthetic oligonucleotide
gtcaactctgctctgctgagaactccaatcc

SEQ ID NO: 222663 - DNA, 34 bp, Artificial Sequence
  Description of Artificial Sequence: Synthetic oligonucleotide
tcaactctgctctgctgagaactccaatccaaag

SEQ ID NO: 222664 - DNA, 33 bp, Artificial Sequence
  Description of Artificial Sequence: Synthetic oligonucleotide
caactctgctctgctgagaactccaatccaaag

SEQ ID NO: 222665 - DNA, 33 bp, Artificial Sequence
  Description of Artificial Sequence: Synthetic oligonucleotide
aactctgctctgctgagaactccaatccaaagg

SEQ ID NO: 222666 - DNA, 32 bp, Artificial Sequence
  Description of Artificial Sequence: Synthetic oligonucleotide
actctgctctgctgagaactccaatccaaagg

SEQ ID NO: 222667 - DNA, 31 bp, Artificial Sequence
  Description of Artificial Sequence: Synthetic oligonucleotide
ctctgctctgctgagaactccaatccaaagg

SEQ ID NO: 222668 - DNA, 33 bp, Artificial Sequence
  Description of Artificial Sequence: Synthetic oligonucleotide
tctgctctgctgagaactccaatccaaaggaag

SEQ ID NO: 222669 - DNA, 32 bp, Artificial Sequence
  Description of Artificial Sequence: Synthetic oligonucleotide
ctgctctgctgagaactccaatccaaaggaag

SEQ ID NO: 222670 - DNA, 35 bp, Artificial Sequence
  Description of Artificial Sequence: Synthetic oligonucleotide
tgctctgctgagaactccaatccaaaggaagaatg

SEQ ID NO: 222671 - DNA, 34 bp, Artificial Sequence
  Description of Artificial Sequence: Synthetic oligonucleotide
gctctgctgagaactccaatccaaaggaagaatg

SEQ ID NO: 222672 - DNA, 34 bp, Artificial Sequence
  Description of Artificial Sequence: Synthetic oligonucleotide
ctctgctgagaactccaatccaaaggaagaatgc

SEQ ID NO: 222673 - DNA, 34 bp, Artificial Sequence
  Description of Artificial Sequence: Synthetic oligonucleotide
tctgctgagaactccaatccaaaggaagaatgcc

SEQ ID NO: 222674 - DNA, 33 bp, Artificial Sequence
  Description of Artificial Sequence: Synthetic oligonucleotide
ctgctgagaactccaatccaaaggaagaatgcc

SEQ ID NO: 222675 - DNA, 35 bp, Artificial Sequence
  Description of Artificial Sequence: Synthetic oligonucleotide
tgctgagaactccaatccaaaggaagaatgccatg

SEQ ID NO: 222676 - DNA, 34 bp, Artificial Sequence
  Description of Artificial Sequence: Synthetic oligonucleotide
gctgagaactccaatccaaaggaagaatgccatg

SEQ ID NO: 222677 - DNA, 36 bp, Artificial Sequence
  Description of Artificial Sequence: Synthetic oligonucleotide
ctgagaactccaatccaaaggaagaatgccatgttc

SEQ ID NO: 222678 - DNA, 38 bp, Artificial Sequence
  Description of Artificial Sequence: Synthetic oligonucleotide
tgagaactccaatccaaaggaagaatgccatgttcaac

SEQ ID NO: 222679 - DNA, 37 bp, Artificial Sequence
  Description of Artificial Sequence: Synthetic oligonucleotide
gagaactccaatccaaaggaagaatgccatgttcaac

SEQ ID NO: 222680 - DNA, 38 bp, Artificial Sequence
  Description of Artificial Sequence: Synthetic oligonucleotide
agaactccaatccaaaggaagaatgccatgttcaacac

SEQ ID NO: 222681 - DNA, 37 bp, Artificial Sequence
  Description of Artificial Sequence: Synthetic oligonucleotide
gaactccaatccaaaggaagaatgccatgttcaacac

SEQ ID NO: 222682 - DNA, 37 bp, Artificial Sequence
  Description of Artificial Sequence: Synthetic oligonucleotide
aactccaatccaaaggaagaatgccatgttcaacacc

SEQ ID NO: 222683 - DNA, 36 bp, Artificial Sequence
  Description of Artificial Sequence: Synthetic oligonucleotide
actccaatccaaaggaagaatgccatgttcaacacc

SEQ ID NO: 222684 - DNA, 35 bp, Artificial Sequence
  Description of Artificial Sequence: Synthetic oligonucleotide
ctccaatccaaaggaagaatgccatgttcaacacc

SEQ ID NO: 222685 - DNA, 28 bp, Artificial Sequence
  Description of Artificial Sequence: Synthetic oligonucleotide
aggtgacagctttaggcaccctgaggag

SEQ ID NO: 222686 - DNA, 27 bp, Artificial Sequence
  Description of Artificial Sequence: Synthetic oligonucleotide
ggtgacagctttaggcaccctgaggag

SEQ ID NO: 222687 - DNA, 27 bp, Artificial Sequence
  Description of Artificial Sequence: Synthetic oligonucleotide
gtgacagctttaggcaccctgaggagg

SEQ ID NO: 222688 - DNA, 27 bp, Artificial Sequence
  Description of Artificial Sequence: Synthetic oligonucleotide
tgacagctttaggcaccctgaggaggg

SEQ ID NO: 222689 - DNA, 27 bp, Artificial Sequence
  Description of Artificial Sequence: Synthetic oligonucleotide
gacagctttaggcaccctgaggagggt

SEQ ID NO: 222690 - DNA, 27 bp, Artificial Sequence
  Description of Artificial Sequence: Synthetic oligonucleotide
acagctttaggcaccctgaggagggtc

SEQ ID NO: 222691 - DNA, 27 bp, Artificial Sequence
  Description of Artificial Sequence: Synthetic oligonucleotide
cagctttaggcaccctgaggagggtca

SEQ ID NO: 222692 - DNA, 28 bp, Artificial Sequence
  Description of Artificial Sequence: Synthetic oligonucleotide
agctttaggcaccctgaggagggtcatc

SEQ ID NO: 222693 - DNA, 27 bp, Artificial Sequence
  Description of Artificial Sequence: Synthetic oligonucleotide
gctttaggcaccctgaggagggtcatc

SEQ ID NO: 222694 - DNA, 28 bp, Artificial Sequence
  Description of Artificial Sequence: Synthetic oligonucleotide
ctttaggcaccctgaggagggtcatcag

SEQ ID NO: 222695 - DNA, 31 bp, Artificial Sequence
  Description of Artificial Sequence: Synthetic oligonucleotide
tttaggcaccctgaggagggtcatcagtaag

SEQ ID NO: 222696 - DNA, 30 bp, Artificial Sequence
  Description of Artificial Sequence: Synthetic oligonucleotide
ttaggcaccctgaggagggtcatcagtaag

SEQ ID NO: 222697 - DNA, 29 bp, Artificial Sequence
  Description of Artificial Sequence: Synthetic oligonucleotide
taggcaccctgaggagggtcatcagtaag

SEQ ID NO: 222698 - DNA, 28 bp, Artificial Sequence
  Description of Artificial Sequence: Synthetic oligonucleotide
aggcaccctgaggagggtcatcagtaag

SEQ ID NO: 222699 - DNA, 27 bp, Artificial Sequence
  Description of Artificial Sequence: Synthetic oligonucleotide
ggcaccctgaggagggtcatcagtaag

SEQ ID NO: 222700 - DNA, 29 bp, Artificial Sequence
  Description of Artificial Sequence: Synthetic oligonucleotide
gcaccctgaggagggtcatcagtaagatc

SEQ ID NO: 222701 - DNA, 31 bp, Artificial Sequence
  Description of Artificial Sequence: Synthetic oligonucleotide
caccctgaggagggtcatcagtaagatcttc

SEQ ID NO: 222702 - DNA, 33 bp, Artificial Sequence
  Description of Artificial Sequence: Synthetic oligonucleotide
accctgaggagggtcatcagtaagatcttcaac

SEQ ID NO: 222703 - DNA, 29 bp, Artificial Sequence
  Description of Artificial Sequence: Synthetic oligonucleotide
gtacctcgtgtcacctgatcccttctctg

SEQ ID NO: 222704 - DNA, 30 bp, Artificial Sequence
  Description of Artificial Sequence: Synthetic oligonucleotide
tacctcgtgtcacctgatcccttctctgtg

SEQ ID NO: 222705 - DNA, 29 bp, Artificial Sequence
  Description of Artificial Sequence: Synthetic oligonucleotide
acctcgtgtcacctgatcccttctctgtg

SEQ ID NO: 222706 - DNA, 28 bp, Artificial Sequence
  Description of Artificial Sequence: Synthetic oligonucleotide
cctcgtgtcacctgatcccttctctgtg

SEQ ID NO: 222707 - DNA, 28 bp, Artificial Sequence
  Description of Artificial Sequence: Synthetic oligonucleotide
ctcgtgtcacctgatcccttctctgtgg

SEQ ID NO: 222708 - DNA, 28 bp, Artificial Sequence
  Description of Artificial Sequence: Synthetic oligonucleotide
tcgtgtcacctgatcccttctctgtggc

SEQ ID NO: 222709 - DNA, 27 bp, Artificial Sequence
  Description of Artificial Sequence: Synthetic oligonucleotide
cgtgtcacctgatcccttctctgtggc

SEQ ID NO: 222710 - DNA, 29 bp, Artificial Sequence
  Description of Artificial Sequence: Synthetic oligonucleotide
gtgtcacctgatcccttctctgtggcttg

SEQ ID NO: 222711 - DNA, 29 bp, Artificial Sequence
  Description of Artificial Sequence: Synthetic oligonucleotide
tgtcacctgatcccttctctgtggcttgc

SEQ ID NO: 222712 - DNA, 28 bp, Artificial Sequence
  Description of Artificial Sequence: Synthetic oligonucleotide
gtcacctgatcccttctctgtggcttgc

SEQ ID NO: 222713 - DNA, 28 bp, Artificial Sequence
  Description of Artificial Sequence: Synthetic oligonucleotide
tcacctgatcccttctctgtggcttgcc

SEQ ID NO: 222714 - DNA, 27 bp, Artificial Sequence
  Description of Artificial Sequence: Synthetic oligonucleotide
cacctgatcccttctctgtggcttgcc

SEQ ID NO: 222715 - DNA, 29 bp, Artificial Sequence
  Description of Artificial Sequence: Synthetic oligonucleotide
acctgatcccttctctgtggcttgccatg

SEQ ID NO: 222716 - DNA, 28 bp, Artificial Sequence
  Description of Artificial Sequence: Synthetic oligonucleotide
cctgatcccttctctgtggcttgccatg

SEQ ID NO: 222717 - DNA, 28 bp, Artificial Sequence
  Description of Artificial Sequence: Synthetic oligonucleotide
ctgatcccttctctgtggcttgccatgg

SEQ ID NO: 222718 - DNA, 29 bp, Artificial Sequence
  Description of Artificial Sequence: Synthetic oligonucleotide
tgatcccttctctgtggcttgccatggtg

SEQ ID NO: 222719 - DNA, 28 bp, Artificial Sequence
  Description of Artificial Sequence: Synthetic oligonucleotide
gatcccttctctgtggcttgccatggtg

SEQ ID NO: 222720 - DNA, 28 bp, Artificial Sequence
  Description of Artificial Sequence: Synthetic oligonucleotide
atcccttctctgtggcttgccatggtgc

SEQ ID NO: 222721 - DNA, 27 bp, Artificial Sequence
  Description of Artificial Sequence: Synthetic oligonucleotide
tcccttctctgtggcttgccatggtgc

SEQ ID NO: 222722 - DNA, 27 bp, Artificial Sequence
  Description of Artificial Sequence: Synthetic oligonucleotide
cccttctctgtggcttgccatggtgct

SEQ ID NO: 222723 - DNA, 27 bp, Artificial Sequence
  Description of Artificial Sequence: Synthetic oligonucleotide
ccttctctgtggcttgccatggtgctg

SEQ ID NO: 222724 - DNA, 27 bp, Artificial Sequence
  Description of Artificial Sequence: Synthetic oligonucleotide
cttctctgtggcttgccatggtgctgg

SEQ ID NO: 222725 - DNA, 27 bp, Artificial Sequence
  Description of Artificial Sequence: Synthetic oligonucleotide
ttctctgtggcttgccatggtgctggg

SEQ ID NO: 222726 - DNA, 27 bp, Artificial Sequence
  Description of Artificial Sequence: Synthetic oligonucleotide
tctctgtggcttgccatggtgctgggt

SEQ ID NO: 222727 - DNA, 26 bp, Artificial Sequence
  Description of Artificial Sequence: Synthetic oligonucleotide
ctctgtggcttgccatggtgctgggt

SEQ ID NO: 222728 - DNA, 27 bp, Artificial Sequence
  Description of Artificial Sequence: Synthetic oligonucleotide
tctgtggcttgccatggtgctgggtct

SEQ ID NO: 222729 - DNA, 27 bp, Artificial Sequence
  Description of Artificial Sequence: Synthetic oligonucleotide
ctgtggcttgccatggtgctgggtctt

SEQ ID NO: 222730 - DNA, 27 bp, Artificial Sequence
  Description of Artificial Sequence: Synthetic oligonucleotide
tgtggcttgccatggtgctgggtcttg

SEQ ID NO: 222731 - DNA, 40 bp, Artificial Sequence
  Description of Artificial Sequence: Synthetic oligonucleotide
caatccaaaggaagaatgccatgttcaacacctactatac

SEQ ID NO: 222732 - DNA, 41 bp, Artificial Sequence
  Description of Artificial Sequence: Synthetic oligonucleotide
aatccaaaggaagaatgccatgttcaacacctactatactc

SEQ ID NO: 222733 - DNA, 40 bp, Artificial Sequence
  Description of Artificial Sequence: Synthetic oligonucleotide
atccaaaggaagaatgccatgttcaacacctactatactc

SEQ ID NO: 222734 - DNA, 39 bp, Artificial Sequence
  Description of Artificial Sequence: Synthetic oligonucleotide
tccaaaggaagaatgccatgttcaacacctactatactc

SEQ ID NO: 222735 - DNA, 38 bp, Artificial Sequence
  Description of Artificial Sequence: Synthetic oligonucleotide
ccaaaggaagaatgccatgttcaacacctactatactc

SEQ ID NO: 222736 - DNA, 40 bp, Artificial Sequence
  Description of Artificial Sequence: Synthetic oligonucleotide
caaaggaagaatgccatgttcaacacctactatactctag

SEQ ID NO: 222737 - DNA, 40 bp, Artificial Sequence
  Description of Artificial Sequence: Synthetic oligonucleotide
aaaggaagaatgccatgttcaacacctactatactctagc

SEQ ID NO: 222738 - DNA, 39 bp, Artificial Sequence
  Description of Artificial Sequence: Synthetic oligonucleotide
aaggaagaatgccatgttcaacacctactatactctagc

SEQ ID NO: 222739 - DNA, 38 bp, Artificial Sequence
  Description of Artificial Sequence: Synthetic oligonucleotide
aggaagaatgccatgttcaacacctactatactctagc

SEQ ID NO: 222740 - DNA, 37 bp, Artificial Sequence
  Description of Artificial Sequence: Synthetic oligonucleotide
ggaagaatgccatgttcaacacctactatactctagc

SEQ ID NO: 222741 - DNA, 38 bp, Artificial Sequence
  Description of Artificial Sequence: Synthetic oligonucleotide
gaagaatgccatgttcaacacctactatactctagcag

SEQ ID NO: 222742 - DNA, 39 bp, Artificial Sequence
  Description of Artificial Sequence: Synthetic oligonucleotide
aagaatgccatgttcaacacctactatactctagcagtc

SEQ ID NO: 222743 - DNA, 38 bp, Artificial Sequence
  Description of Artificial Sequence: Synthetic oligonucleotide
agaatgccatgttcaacacctactatactctagcagtc

SEQ ID NO: 222744 - DNA, 37 bp, Artificial Sequence
  Description of Artificial Sequence: Synthetic oligonucleotide
gaatgccatgttcaacacctactatactctagcagtc

SEQ ID NO: 222745 - DNA, 38 bp, Artificial Sequence
  Description of Artificial Sequence: Synthetic oligonucleotide
aatgccatgttcaacacctactatactctagcagtcag

SEQ ID NO: 222746 - DNA, 37 bp, Artificial Sequence
  Description of Artificial Sequence: Synthetic oligonucleotide
atgccatgttcaacacctactatactctagcagtcag

SEQ ID NO: 222747 - DNA, 36 bp, Artificial Sequence
  Description of Artificial Sequence: Synthetic oligonucleotide
tgccatgttcaacacctactatactctagcagtcag

SEQ ID NO: 222748 - DNA, 35 bp, Artificial Sequence
  Description of Artificial Sequence: Synthetic oligonucleotide
gccatgttcaacacctactatactctagcagtcag

SEQ ID NO: 222749 - DNA, 36 bp, Artificial Sequence
  Description of Artificial Sequence: Synthetic oligonucleotide
ccatgttcaacacctactatactctagcagtcagtg

SEQ ID NO: 222750 - DNA, 37 bp, Artificial Sequence
  Description of Artificial Sequence: Synthetic oligonucleotide
catgttcaacacctactatactctagcagtcagtgtg

SEQ ID NO: 222751 - DNA, 37 bp, Artificial Sequence
  Description of Artificial Sequence: Synthetic oligonucleotide
atgttcaacacctactatactctagcagtcagtgtgg

SEQ ID NO: 222752 - DNA, 36 bp, Artificial Sequence
  Description of Artificial Sequence: Synthetic oligonucleotide
tgttcaacacctactatactctagcagtcagtgtgg

SEQ ID NO: 222753 - DNA, 35 bp, Artificial Sequence
  Description of Artificial Sequence: Synthetic oligonucleotide
gttcaacacctactatactctagcagtcagtgtgg

SEQ ID NO: 222754 - DNA, 36 bp, Artificial Sequence
  Description of Artificial Sequence: Synthetic oligonucleotide
ttcaacacctactatactctagcagtcagtgtggtg

SEQ ID NO: 222755 - DNA, 35 bp, Artificial Sequence
  Description of Artificial Sequence: Synthetic oligonucleotide
tcaacacctactatactctagcagtcagtgtggtg

SEQ ID NO: 222756 - DNA, 34 bp, Artificial Sequence
  Description of Artificial Sequence: Synthetic oligonucleotide
caacacctactatactctagcagtcagtgtggtg

SEQ ID NO: 222757 - DNA, 35 bp, Artificial Sequence
  Description of Artificial Sequence: Synthetic oligonucleotide
aacacctactatactctagcagtcagtgtggtgac

SEQ ID NO: 222758 - DNA, 34 bp, Artificial Sequence
  Description of Artificial Sequence: Synthetic oligonucleotide
acacctactatactctagcagtcagtgtggtgac

SEQ ID NO: 222759 - DNA, 33 bp, Artificial Sequence
  Description of Artificial Sequence: Synthetic oligonucleotide
cacctactatactctagcagtcagtgtggtgac

SEQ ID NO: 222760 - DNA, 34 bp, Artificial Sequence
  Description of Artificial Sequence: Synthetic oligonucleotide
acctactatactctagcagtcagtgtggtgacag

SEQ ID NO: 222761 - DNA, 33 bp, Artificial Sequence
  Description of Artificial Sequence: Synthetic oligonucleotide
cctactatactctagcagtcagtgtggtgacag

SEQ ID NO: 222762 - DNA, 33 bp, Artificial Sequence
  Description of Artificial Sequence: Synthetic oligonucleotide
ctactatactctagcagtcagtgtggtgacagc

SEQ ID NO: 222763 - DNA, 33 bp, Artificial Sequence
  Description of Artificial Sequence: Synthetic oligonucleotide
tactatactctagcagtcagtgtggtgacagcc

SEQ ID NO: 222764 - DNA, 32 bp, Artificial Sequence
  Description of Artificial Sequence: Synthetic oligonucleotide
actatactctagcagtcagtgtggtgacagcc

SEQ ID NO: 222765 - DNA, 31 bp, Artificial Sequence
  Description of Artificial Sequence: Synthetic oligonucleotide
ctatactctagcagtcagtgtggtgacagcc

SEQ ID NO: 222766 - DNA, 33 bp, Artificial Sequence
  Description of Artificial Sequence: Synthetic oligonucleotide
tatactctagcagtcagtgtggtgacagccatc

SEQ ID NO: 222767 - DNA, 32 bp, Artificial Sequence
  Description of Artificial Sequence: Synthetic oligonucleotide
atactctagcagtcagtgtggtgacagccatc

SEQ ID NO: 222768 - DNA, 31 bp, Artificial Sequence
  Description of Artificial Sequence: Synthetic oligonucleotide
tactctagcagtcagtgtggtgacagccatc

SEQ ID NO: 222769 - DNA, 30 bp, Artificial Sequence
  Description of Artificial Sequence: Synthetic oligonucleotide
actctagcagtcagtgtggtgacagccatc

SEQ ID NO: 222770 - DNA, 23 bp, Artificial Sequence
  Description of Artificial Sequence: Synthetic oligonucleotide
cgtgatggcggcccttggcttgc

SEQ ID NO: 222771 - DNA, 23 bp, Artificial Sequence
  Description of Artificial Sequence: Synthetic oligonucleotide
gtgatggcggcccttggcttgcg

SEQ ID NO: 222772 - DNA, 25 bp, Artificial Sequence
  Description of Artificial Sequence: Synthetic oligonucleotide
tgatggcggcccttggcttgcgctt

SEQ ID NO: 222773 - DNA, 24 bp, Artificial Sequence
  Description of Artificial Sequence: Synthetic oligonucleotide
gatggcggcccttggcttgcgctt

SEQ ID NO: 222774 - DNA, 24 bp, Artificial Sequence
  Description of Artificial Sequence: Synthetic oligonucleotide
atggcggcccttggcttgcgcttc

SEQ ID NO: 222775 - DNA, 23 bp, Artificial Sequence
  Description of Artificial Sequence: Synthetic oligonucleotide
tggcggcccttggcttgcgcttc

SEQ ID NO: 222776 - DNA, 22 bp, Artificial Sequence
  Description of Artificial Sequence: Synthetic oligonucleotide
ggcggcccttggcttgcgcttc

SEQ ID NO: 222777 - DNA, 23 bp, Artificial Sequence
  Description of Artificial Sequence: Synthetic oligonucleotide
gcggcccttggcttgcgcttcct

SEQ ID NO: 222778 - DNA, 24 bp, Artificial Sequence
  Description of Artificial Sequence: Synthetic oligonucleotide
cggcccttggcttgcgcttcctca

SEQ ID NO: 222779 - DNA, 24 bp, Artificial Sequence
  Description of Artificial Sequence: Synthetic oligonucleotide
ggcccttggcttgcgcttcctcac

SEQ ID NO: 222780 - DNA, 25 bp, Artificial Sequence
  Description of Artificial Sequence: Synthetic oligonucleotide
gcccttggcttgcgcttcctcacct

SEQ ID NO: 222781 - DNA, 27 bp, Artificial Sequence
  Description of Artificial Sequence: Synthetic oligonucleotide
cccttggcttgcgcttcctcacctcaa

SEQ ID NO: 222782 - DNA, 31 bp, Artificial Sequence
  Description of Artificial Sequence: Synthetic oligonucleotide
ccttggcttgcgcttcctcacctcaaatttc

SEQ ID NO: 222783 - DNA, 31 bp, Artificial Sequence
  Description of Artificial Sequence: Synthetic oligonucleotide
cttggcttgcgcttcctcacctcaaatttcc

SEQ ID NO: 222784 - DNA, 31 bp, Artificial Sequence
  Description of Artificial Sequence: Synthetic oligonucleotide
ttggcttgcgcttcctcacctcaaatttccg

SEQ ID NO: 222785 - DNA, 30 bp, Artificial Sequence
  Description of Artificial Sequence: Synthetic oligonucleotide
tggcttgcgcttcctcacctcaaatttccg

SEQ ID NO: 222786 - DNA, 29 bp, Artificial Sequence
  Description of Artificial Sequence: Synthetic oligonucleotide
ggcttgcgcttcctcacctcaaatttccg

SEQ ID NO: 222787 - DNA, 29 bp, Artificial Sequence
  Description of Artificial Sequence: Synthetic oligonucleotide
gcttgcgcttcctcacctcaaatttccgg

SEQ ID NO: 222788 - DNA, 30 bp, Artificial Sequence
  Description of Artificial Sequence: Synthetic oligonucleotide
cttgcgcttcctcacctcaaatttccggag

SEQ ID NO: 222789 - DNA, 31 bp, Artificial Sequence
  Description of Artificial Sequence: Synthetic oligonucleotide
ttgcgcttcctcacctcaaatttccggagac

SEQ ID NO: 222790 - DNA, 30 bp, Artificial Sequence
  Description of Artificial Sequence: Synthetic oligonucleotide
tgcgcttcctcacctcaaatttccggagac

SEQ ID NO: 222791 - DNA, 29 bp, Artificial Sequence
  Description of Artificial Sequence: Synthetic oligonucleotide
gcgcttcctcacctcaaatttccggagac

SEQ ID NO: 222792 - DNA, 30 bp, Artificial Sequence
  Description of Artificial Sequence: Synthetic oligonucleotide
cgcttcctcacctcaaatttccggagacac

SEQ ID NO: 222793 - DNA, 34 bp, Artificial Sequence
  Description of Artificial Sequence: Synthetic oligonucleotide
tgggaaggtggtcatcacactgttcagtattcag

SEQ ID NO: 222794 - DNA, 33 bp, Artificial Sequence
  Description of Artificial Sequence: Synthetic oligonucleotide
gggaaggtggtcatcacactgttcagtattcag

SEQ ID NO: 222795 - DNA, 33 bp, Artificial Sequence
  Description of Artificial Sequence: Synthetic oligonucleotide
ggaaggtggtcatcacactgttcagtattcagc

SEQ ID NO: 222796 - DNA, 34 bp, Artificial Sequence
  Description of Artificial Sequence: Synthetic oligonucleotide
gaaggtggtcatcacactgttcagtattcagctg

SEQ ID NO: 222797 - DNA, 34 bp, Artificial Sequence
  Description of Artificial Sequence: Synthetic oligonucleotide
aaggtggtcatcacactgttcagtattcagctgg

SEQ ID NO: 222798 - DNA, 33 bp, Artificial Sequence
  Description of Artificial Sequence: Synthetic oligonucleotide
aggtggtcatcacactgttcagtattcagctgg

SEQ ID NO: 222799 - DNA, 32 bp, Artificial Sequence
  Description of Artificial Sequence: Synthetic oligonucleotide
ggtggtcatcacactgttcagtattcagctgg

SEQ ID NO: 222800 - DNA, 32 bp, Artificial Sequence
  Description of Artificial Sequence: Synthetic oligonucleotide
gtggtcatcacactgttcagtattcagctggc

SEQ ID NO: 222801 - DNA, 32 bp, Artificial Sequence
  Description of Artificial Sequence: Synthetic oligonucleotide
tggtcatcacactgttcagtattcagctggcc

SEQ ID NO: 222802 - DNA, 31 bp, Artificial Sequence
  Description of Artificial Sequence: Synthetic oligonucleotide
ggtcatcacactgttcagtattcagctggcc

SEQ ID NO: 222803 - DNA, 32 bp, Artificial Sequence
  Description of Artificial Sequence: Synthetic oligonucleotide
gtcatcacactgttcagtattcagctggccac

SEQ ID NO: 222804 - DNA, 32 bp, Artificial Sequence
  Description of Artificial Sequence: Synthetic oligonucleotide
tcatcacactgttcagtattcagctggccacc

SEQ ID NO: 222805 - DNA, 31 bp, Artificial Sequence
  Description of Artificial Sequence: Synthetic oligonucleotide
catcacactgttcagtattcagctggccacc

SEQ ID NO: 222806 - DNA, 33 bp, Artificial Sequence
  Description of Artificial Sequence: Synthetic oligonucleotide
atcacactgttcagtattcagctggccaccatg

SEQ ID NO: 222807 - DNA, 32 bp, Artificial Sequence
  Description of Artificial Sequence: Synthetic oligonucleotide
tcacactgttcagtattcagctggccaccatg

SEQ ID NO: 222808 - DNA, 31 bp, Artificial Sequence
  Description of Artificial Sequence: Synthetic oligonucleotide
cacactgttcagtattcagctggccaccatg

SEQ ID NO: 222809 - DNA, 32 bp, Artificial Sequence
  Description of Artificial Sequence: Synthetic oligonucleotide
acactgttcagtattcagctggccaccatgag

SEQ ID NO: 222810 - DNA, 31 bp, Artificial Sequence
  Description of Artificial Sequence: Synthetic oligonucleotide
cactgttcagtattcagctggccaccatgag

SEQ ID NO: 222811 - DNA, 32 bp, Artificial Sequence
  Description of Artificial Sequence: Synthetic oligonucleotide
actgttcagtattcagctggccaccatgagtg

SEQ ID NO: 222812 - DNA, 31 bp, Artificial Sequence
  Description of Artificial Sequence: Synthetic oligonucleotide
ctgttcagtattcagctggccaccatgagtg

SEQ ID NO: 222813 - DNA, 31 bp, Artificial Sequence
  Description of Artificial Sequence: Synthetic oligonucleotide
tgttcagtattcagctggccaccatgagtgc

SEQ ID NO: 222814 - DNA, 30 bp, Artificial Sequence
  Description of Artificial Sequence: Synthetic oligonucleotide
gttcagtattcagctggccaccatgagtgc

SEQ ID NO: 222815 - DNA, 33 bp, Artificial Sequence
  Description of Artificial Sequence: Synthetic oligonucleotide
ttcagtattcagctggccaccatgagtgctatg

SEQ ID NO: 222816 - DNA, 32 bp, Artificial Sequence
  Description of Artificial Sequence: Synthetic oligonucleotide
tcagtattcagctggccaccatgagtgctatg

SEQ ID NO: 222817 - DNA, 31 bp, Artificial Sequence
  Description of Artificial Sequence: Synthetic oligonucleotide
cagtattcagctggccaccatgagtgctatg

SEQ ID NO: 222818 - DNA, 32 bp, Artificial Sequence
  Description of Artificial Sequence: Synthetic oligonucleotide
agtattcagctggccaccatgagtgctatgtc

SEQ ID NO: 222819 - DNA, 31 bp, Artificial Sequence
  Description of Artificial Sequence: Synthetic oligonucleotide
gtattcagctggccaccatgagtgctatgtc

SEQ ID NO: 222820 - DNA, 29 bp, Artificial Sequence
  Description of Artificial Sequence: Synthetic oligonucleotide
gccctcttcttgtggatgttctggcgaag

SEQ ID NO: 222821 - DNA, 30 bp, Artificial Sequence
  Description of Artificial Sequence: Synthetic oligonucleotide
ccctcttcttgtggatgttctggcgaagtg

SEQ ID NO: 222822 - DNA, 31 bp, Artificial Sequence
  Description of Artificial Sequence: Synthetic oligonucleotide
cctcttcttgtggatgttctggcgaagtgtc

SEQ ID NO: 222823 - DNA, 33 bp, Artificial Sequence
  Description of Artificial Sequence: Synthetic oligonucleotide
ctcttcttgtggatgttctggcgaagtgtcaac

SEQ ID NO: 222824 - DNA, 34 bp, Artificial Sequence
  Description of Artificial Sequence: Synthetic oligonucleotide
tcttcttgtggatgttctggcgaagtgtcaactc

SEQ ID NO: 222825 - DNA, 33 bp, Artificial Sequence
  Description of Artificial Sequence: Synthetic oligonucleotide
cttcttgtggatgttctggcgaagtgtcaactc

SEQ ID NO: 222826 - DNA, 34 bp, Artificial Sequence
  Description of Artificial Sequence: Synthetic oligonucleotide
ttcttgtggatgttctggcgaagtgtcaactctc

SEQ ID NO: 222827 - DNA, 33 bp, Artificial Sequence
  Description of Artificial Sequence: Synthetic oligonucleotide
tcttgtggatgttctggcgaagtgtcaactctc

SEQ ID NO: 222828 - DNA, 32 bp, Artificial Sequence
  Description of Artificial Sequence: Synthetic oligonucleotide
cttgtggatgttctggcgaagtgtcaactctc

SEQ ID NO: 222829 - DNA, 32 bp, Artificial Sequence
  Description of Artificial Sequence: Synthetic oligonucleotide
ttgtggatgttctggcgaagtgtcaactctcc

SEQ ID NO: 222830 - DNA, 31 bp, Artificial Sequence
  Description of Artificial Sequence: Synthetic oligonucleotide
tgtggatgttctggcgaagtgtcaactctcc

SEQ ID NO: 222831 - DNA, 30 bp, Artificial Sequence
  Description of Artificial Sequence: Synthetic oligonucleotide
gtggatgttctggcgaagtgtcaactctcc

SEQ ID NO: 222832 - DNA, 31 bp, Artificial Sequence
  Description of Artificial Sequence: Synthetic oligonucleotide
tggatgttctggcgaagtgtcaactctcctc

SEQ ID NO: 222833 - DNA, 30 bp, Artificial Sequence
  Description of Artificial Sequence: Synthetic oligonucleotide
ggatgttctggcgaagtgtcaactctcctc

SEQ ID NO: 222834 - DNA, 31 bp, Artificial Sequence
  Description of Artificial Sequence: Synthetic oligonucleotide
gatgttctggcgaagtgtcaactctcctctg

SEQ ID NO: 222835 - DNA, 31 bp, Artificial Sequence
  Description of Artificial Sequence: Synthetic oligonucleotide
atgttctggcgaagtgtcaactctcctctgc

SEQ ID NO: 222836 - DNA, 30 bp, Artificial Sequence
  Description of Artificial Sequence: Synthetic oligonucleotide
tgttctggcgaagtgtcaactctcctctgc

SEQ ID NO: 222837 - DNA, 29 bp, Artificial Sequence
  Description of Artificial Sequence: Synthetic oligonucleotide
gttctggcgaagtgtcaactctcctctgc

SEQ ID NO: 222838 - DNA, 30 bp, Artificial Sequence
  Description of Artificial Sequence: Synthetic oligonucleotide
ttctggcgaagtgtcaactctcctctgctg

SEQ ID NO: 222839 - DNA, 29 bp, Artificial Sequence
  Description of Artificial Sequence: Synthetic oligonucleotide
tctggcgaagtgtcaactctcctctgctg

SEQ ID NO: 222840 - DNA, 28 bp, Artificial Sequence
  Description of Artificial Sequence: Synthetic oligonucleotide
ctggcgaagtgtcaactctcctctgctg

SEQ ID NO: 222841 - DNA, 29 bp, Artificial Sequence
  Description of Artificial Sequence: Synthetic oligonucleotide
tggcgaagtgtcaactctcctctgctgag

SEQ ID NO: 222842 - DNA, 28 bp, Artificial Sequence
  Description of Artificial Sequence: Synthetic oligonucleotide
ggcgaagtgtcaactctcctctgctgag

SEQ ID NO: 222843 - DNA, 30 bp, Artificial Sequence
  Description of Artificial Sequence: Synthetic oligonucleotide
gcgaagtgtcaactctcctctgctgagaag

SEQ ID NO: 222844 - DNA, 31 bp, Artificial Sequence
  Description of Artificial Sequence: Synthetic oligonucleotide
cgaagtgtcaactctcctctgctgagaagtc

SEQ ID NO: 222845 - DNA, 31 bp, Artificial Sequence
  Description of Artificial Sequence: Synthetic oligonucleotide
gaagtgtcaactctcctctgctgagaagtcc

SEQ ID NO: 222846 - DNA, 25 bp, Artificial Sequence
  Description of Artificial Sequence: Synthetic oligonucleotide
ccttctccgtggcttgccatggtgc

SEQ ID NO: 222847 - DNA, 25 bp, Artificial Sequence
  Description of Artificial Sequence: Synthetic oligonucleotide
cttctccgtggcttgccatggtgcc

SEQ ID NO: 222848 - DNA, 25 bp, Artificial Sequence
  Description of Artificial Sequence: Synthetic oligonucleotide
ttctccgtggcttgccatggtgccg

SEQ ID NO: 222849 - DNA, 24 bp, Artificial Sequence
  Description of Artificial Sequence: Synthetic oligonucleotide
tctccgtggcttgccatggtgccg

SEQ ID NO: 222850 - DNA, 23 bp, Artificial Sequence
  Description of Artificial Sequence: Synthetic oligonucleotide
ctccgtggcttgccatggtgccg

SEQ ID NO: 222851 - DNA, 23 bp, Artificial Sequence
  Description of Artificial Sequence: Synthetic oligonucleotide
tccgtggcttgccatggtgccgg

SEQ ID NO: 222852 - DNA, 22 bp, Artificial Sequence
  Description of Artificial Sequence: Synthetic oligonucleotide
ccgtggcttgccatggtgccgg

SEQ ID NO: 222853 - DNA, 23 bp, Artificial Sequence
  Description of Artificial Sequence: Synthetic oligonucleotide
cgtggcttgccatggtgccgggt

SEQ ID NO: 222854 - DNA, 25 bp, Artificial Sequence
  Description of Artificial Sequence: Synthetic oligonucleotide
gtggcttgccatggtgccgggtctt

SEQ ID NO: 222855 - DNA, 26 bp, Artificial Sequence
  Description of Artificial Sequence: Synthetic oligonucleotide
tggcttgccatggtgccgggtcttgt

SEQ ID NO: 222856 - DNA, 25 bp, Artificial Sequence
  Description of Artificial Sequence: Synthetic oligonucleotide
ggcttgccatggtgccgggtcttgt

SEQ ID NO: 222857 - DNA, 25 bp, Artificial Sequence
  Description of Artificial Sequence: Synthetic oligonucleotide
gcttgccatggtgccgggtcttgtg

SEQ ID NO: 222858 - DNA, 25 bp, Artificial Sequence
  Description of Artificial Sequence: Synthetic oligonucleotide
cttgccatggtgccgggtcttgtgg

SEQ ID NO: 222859 - DNA, 26 bp, Artificial Sequence
  Description of Artificial Sequence: Synthetic oligonucleotide
ttgccatggtgccgggtcttgtggct

SEQ ID NO: 222860 - DNA, 25 bp, Artificial Sequence
  Description of Artificial Sequence: Synthetic oligonucleotide
tgccatggtgccgggtcttgtggct

SEQ ID NO: 222861 - DNA, 24 bp, Artificial Sequence
  Description of Artificial Sequence: Synthetic oligonucleotide
gccatggtgccgggtcttgtggct

SEQ ID NO: 222862 - DNA, 24 bp, Artificial Sequence
  Description of Artificial Sequence: Synthetic oligonucleotide
ccatggtgccgggtcttgtggctg

SEQ ID NO: 222863 - DNA, 24 bp, Artificial Sequence
  Description of Artificial Sequence: Synthetic oligonucleotide
catggtgccgggtcttgtggctgg

SEQ ID NO: 222864 - DNA, 24 bp, Artificial Sequence
  Description of Artificial Sequence: Synthetic oligonucleotide
atggtgccgggtcttgtggctggg

SEQ ID NO: 222865 - DNA, 23 bp, Artificial Sequence
  Description of Artificial Sequence: Synthetic oligonucleotide
tggtgccgggtcttgtggctggg

SEQ ID NO: 222866 - DNA, 22 bp, Artificial Sequence
  Description of Artificial Sequence: Synthetic oligonucleotide
ggtgccgggtcttgtggctggg

SEQ ID NO: 222867 - DNA, 23 bp, Artificial Sequence
  Description of Artificial Sequence: Synthetic oligonucleotide
gtgccgggtcttgtggctgggct

SEQ ID NO: 222868 - DNA, 25 bp, Artificial Sequence
  Description of Artificial Sequence: Synthetic oligonucleotide
tgccgggtcttgtggctgggctgat

SEQ ID NO: 222869 - DNA, 24 bp, Artificial Sequence
  Description of Artificial Sequence: Synthetic oligonucleotide
gccgggtcttgtggctgggctgat

SEQ ID NO: 222870 - DNA, 25 bp, Artificial Sequence
  Description of Artificial Sequence: Synthetic oligonucleotide
ccgggtcttgtggctgggctgatct

SEQ ID NO: 222871 - DNA, 25 bp, Artificial Sequence
  Description of Artificial Sequence: Synthetic oligonucleotide
cgggtcttgtggctgggctgatctc

SEQ ID NO: 222872 - DNA, 27 bp, Artificial Sequence
  Description of Artificial Sequence: Synthetic oligonucleotide
gtgtgcagtgggcaatcctgctggaca

SEQ ID NO: 222873 - DNA, 27 bp, Artificial Sequence
  Description of Artificial Sequence: Synthetic oligonucleotide
tgtgcagtgggcaatcctgctggacag

SEQ ID NO: 222874 - DNA, 26 bp, Artificial Sequence
  Description of Artificial Sequence: Synthetic oligonucleotide
gtgcagtgggcaatcctgctggacag

SEQ ID NO: 222875 - DNA, 27 bp, Artificial Sequence
  Description of Artificial Sequence: Synthetic oligonucleotide
tgcagtgggcaatcctgctggacagct

SEQ ID NO: 222876 - DNA, 27 bp, Artificial Sequence
  Description of Artificial Sequence: Synthetic oligonucleotide
gcagtgggcaatcctgctggacagctt

SEQ ID NO: 222877 - DNA, 27 bp, Artificial Sequence
  Description of Artificial Sequence: Synthetic oligonucleotide
cagtgggcaatcctgctggacagcttc

SEQ ID NO: 222878 - DNA, 27 bp, Artificial Sequence
  Description of Artificial Sequence: Synthetic oligonucleotide
agtgggcaatcctgctggacagcttcc

SEQ ID NO: 222879 - DNA, 27 bp, Artificial Sequence
  Description of Artificial Sequence: Synthetic oligonucleotide
gtgggcaatcctgctggacagcttcct

SEQ ID NO: 222880 - DNA, 27 bp, Artificial Sequence
  Description of Artificial Sequence: Synthetic oligonucleotide
tgggcaatcctgctggacagcttcctg

SEQ ID NO: 222881 - DNA, 27 bp, Artificial Sequence
  Description of Artificial Sequence: Synthetic oligonucleotide
gggcaatcctgctggacagcttcctga

SEQ ID NO: 222882 - DNA, 27 bp, Artificial Sequence
  Description of Artificial Sequence: Synthetic oligonucleotide
ggcaatcctgctggacagcttcctgag

SEQ ID NO: 222883 - DNA, 27 bp, Artificial Sequence
  Description of Artificial Sequence: Synthetic oligonucleotide
gcaatcctgctggacagcttcctgagc

SEQ ID NO: 222884 - DNA, 27 bp, Artificial Sequence
  Description of Artificial Sequence: Synthetic oligonucleotide
caatcctgctggacagcttcctgagcc

SEQ ID NO: 222885 - DNA, 28 bp, Artificial Sequence
  Description of Artificial Sequence: Synthetic oligonucleotide
aatcctgctggacagcttcctgagccag

SEQ ID NO: 222886 - DNA, 27 bp, Artificial Sequence
  Description of Artificial Sequence: Synthetic oligonucleotide
atcctgctggacagcttcctgagccag

SEQ ID NO: 222887 - DNA, 27 bp, Artificial Sequence
  Description of Artificial Sequence: Synthetic oligonucleotide
tcctgctggacagcttcctgagccagt

SEQ ID NO: 222888 - DNA, 27 bp, Artificial Sequence
  Description of Artificial Sequence: Synthetic oligonucleotide
cctgctggacagcttcctgagccagtt

SEQ ID NO: 222889 - DNA, 27 bp, Artificial Sequence
  Description of Artificial Sequence: Synthetic oligonucleotide
ctgctggacagcttcctgagccagttc

SEQ ID NO: 222890 - DNA, 27 bp, Artificial Sequence
  Description of Artificial Sequence: Synthetic oligonucleotide
tgctggacagcttcctgagccagttcc

SEQ ID NO: 222891 - DNA, 26 bp, Artificial Sequence
  Description of Artificial Sequence: Synthetic oligonucleotide
gctggacagcttcctgagccagttcc

SEQ ID NO: 222892 - DNA, 27 bp, Artificial Sequence
  Description of Artificial Sequence: Synthetic oligonucleotide
ctggacagcttcctgagccagttccct

SEQ ID NO: 222893 - DNA, 27 bp, Artificial Sequence
  Description of Artificial Sequence: Synthetic oligonucleotide
tggacagcttcctgagccagttccctc

SEQ ID NO: 222894 - DNA, 26 bp, Artificial Sequence
  Description of Artificial Sequence: Synthetic oligonucleotide
ggacagcttcctgagccagttccctc

SEQ ID NO: 222895 - DNA, 27 bp, Artificial Sequence
  Description of Artificial Sequence: Synthetic oligonucleotide
gacagcttcctgagccagttccctcct

SEQ ID NO: 222896 - DNA, 27 bp, Artificial Sequence
  Description of Artificial Sequence: Synthetic oligonucleotide
acagcttcctgagccagttccctcctg

SEQ ID NO: 222897 - DNA, 26 bp, Artificial Sequence
  Description of Artificial Sequence: Synthetic oligonucleotide
cagcttcctgagccagttccctcctg

SEQ ID NO: 222898 - DNA, 26 bp, Artificial Sequence
  Description of Artificial Sequence: Synthetic oligonucleotide
agcttcctgagccagttccctcctgg

SEQ ID NO: 222899 - DNA, 27 bp, Artificial Sequence
  Description of Artificial Sequence: Synthetic oligonucleotide
cggctggccaccatgaatgctatgtcg

SEQ ID NO: 222900 - DNA, 27 bp, Artificial Sequence
  Description of Artificial Sequence: Synthetic oligonucleotide
ggctggccaccatgaatgctatgtcgg

SEQ ID NO: 222901 - DNA, 28 bp, Artificial Sequence
  Description of Artificial Sequence: Synthetic oligonucleotide
gctggccaccatgaatgctatgtcggtg

SEQ ID NO: 222902 - DNA, 28 bp, Artificial Sequence
  Description of Artificial Sequence: Synthetic oligonucleotide
ctggccaccatgaatgctatgtcggtgc

SEQ ID NO: 222903 - DNA, 29 bp, Artificial Sequence
  Description of Artificial Sequence: Synthetic oligonucleotide
tggccaccatgaatgctatgtcggtgctg

SEQ ID NO: 222904 - DNA, 28 bp, Artificial Sequence
  Description of Artificial Sequence: Synthetic oligonucleotide
ggccaccatgaatgctatgtcggtgctg

SEQ ID NO: 222905 - DNA, 30 bp, Artificial Sequence
  Description of Artificial Sequence: Synthetic oligonucleotide
gccaccatgaatgctatgtcggtgctgatc

SEQ ID NO: 222906 - DNA, 31 bp, Artificial Sequence
  Description of Artificial Sequence: Synthetic oligonucleotide
ccaccatgaatgctatgtcggtgctgatctc

SEQ ID NO: 222907 - DNA, 32 bp, Artificial Sequence
  Description of Artificial Sequence: Synthetic oligonucleotide
caccatgaatgctatgtcggtgctgatctcag

SEQ ID NO: 222908 - DNA, 32 bp, Artificial Sequence
  Description of Artificial Sequence: Synthetic oligonucleotide
accatgaatgctatgtcggtgctgatctcagc

SEQ ID NO: 222909 - DNA, 31 bp, Artificial Sequence
  Description of Artificial Sequence: Synthetic oligonucleotide
ccatgaatgctatgtcggtgctgatctcagc

SEQ ID NO: 222910 - DNA, 31 bp, Artificial Sequence
  Description of Artificial Sequence: Synthetic oligonucleotide
catgaatgctatgtcggtgctgatctcagcg

SEQ ID NO: 222911 - DNA, 31 bp, Artificial Sequence
  Description of Artificial Sequence: Synthetic oligonucleotide
atgaatgctatgtcggtgctgatctcagcgg

SEQ ID NO: 222912 - DNA, 30 bp, Artificial Sequence
  Description of Artificial Sequence: Synthetic oligonucleotide
tgaatgctatgtcggtgctgatctcagcgg

SEQ ID NO: 222913 - DNA, 29 bp, Artificial Sequence
  Description of Artificial Sequence: Synthetic oligonucleotide
gaatgctatgtcggtgctgatctcagcgg

SEQ ID NO: 222914 - DNA, 29 bp, Artificial Sequence
  Description of Artificial Sequence: Synthetic oligonucleotide
aatgctatgtcggtgctgatctcagcggg

SEQ ID NO: 222915 - DNA, 28 bp, Artificial Sequence
  Description of Artificial Sequence: Synthetic oligonucleotide
atgctatgtcggtgctgatctcagcggg

SEQ ID NO: 222916 - DNA, 34 bp, Artificial Sequence
  Description of Artificial Sequence: Synthetic oligonucleotide
tttaggcaccctgaggagggtcatcagtaatatc

SEQ ID NO: 222917 - DNA, 33 bp, Artificial Sequence
  Description of Artificial Sequence: Synthetic oligonucleotide
ttaggcaccctgaggagggtcatcagtaatatc

SEQ ID NO: 222918 - DNA, 32 bp, Artificial Sequence
  Description of Artificial Sequence: Synthetic oligonucleotide
taggcaccctgaggagggtcatcagtaatatc

SEQ ID NO: 222919 - DNA, 31 bp, Artificial Sequence
  Description of Artificial Sequence: Synthetic oligonucleotide
aggcaccctgaggagggtcatcagtaatatc

SEQ ID NO: 222920 - DNA, 30 bp, Artificial Sequence
  Description of Artificial Sequence: Synthetic oligonucleotide
ggcaccctgaggagggtcatcagtaatatc

SEQ ID NO: 222921 - DNA, 32 bp, Artificial Sequence
  Description of Artificial Sequence: Synthetic oligonucleotide
gcaccctgaggagggtcatcagtaatatcttc

SEQ ID NO: 222922 - DNA, 34 bp, Artificial Sequence
  Description of Artificial Sequence: Synthetic oligonucleotide
caccctgaggagggtcatcagtaatatcttcaac

SEQ ID NO: 222923 - DNA, 35 bp, Artificial Sequence
  Description of Artificial Sequence: Synthetic oligonucleotide
accctgaggagggtcatcagtaatatcttcaacac

SEQ ID NO: 222924 - DNA, 34 bp, Artificial Sequence
  Description of Artificial Sequence: Synthetic oligonucleotide
ccctgaggagggtcatcagtaatatcttcaacac

SEQ ID NO: 222925 - DNA, 35 bp, Artificial Sequence
  Description of Artificial Sequence: Synthetic oligonucleotide
cctgaggagggtcatcagtaatatcttcaacacag

SEQ ID NO: 222926 - DNA, 36 bp, Artificial Sequence
  Description of Artificial Sequence: Synthetic oligonucleotide
ctgaggagggtcatcagtaatatcttcaacacagac

SEQ ID NO: 222927 - DNA, 38 bp, Artificial Sequence
  Description of Artificial Sequence: Synthetic oligonucleotide
tgaggagggtcatcagtaatatcttcaacacagactac

SEQ ID NO: 222928 - DNA, 37 bp, Artificial Sequence
  Description of Artificial Sequence: Synthetic oligonucleotide
gaggagggtcatcagtaatatcttcaacacagactac

SEQ ID NO: 222929 - DNA, 37 bp, Artificial Sequence
  Description of Artificial Sequence: Synthetic oligonucleotide
aggagggtcatcagtaatatcttcaacacagactacc

SEQ ID NO: 222930 - DNA, 36 bp, Artificial Sequence
  Description of Artificial Sequence: Synthetic oligonucleotide
ggagggtcatcagtaatatcttcaacacagactacc

SEQ ID NO: 222931 - DNA, 37 bp, Artificial Sequence
  Description of Artificial Sequence: Synthetic oligonucleotide
gagggtcatcagtaatatcttcaacacagactaccac

SEQ ID NO: 222932 - DNA, 39 bp, Artificial Sequence
  Description of Artificial Sequence: Synthetic oligonucleotide
agggtcatcagtaatatcttcaacacagactaccacatg

SEQ ID NO: 222933 - DNA, 38 bp, Artificial Sequence
  Description of Artificial Sequence: Synthetic oligonucleotide
gggtcatcagtaatatcttcaacacagactaccacatg

SEQ ID NO: 222934 - DNA, 29 bp, Artificial Sequence
  Description of Artificial Sequence: Synthetic oligonucleotide
ctcctcagcattggggaactcagcttgtc

SEQ ID NO: 222935 - DNA, 29 bp, Artificial Sequence
  Description of Artificial Sequence: Synthetic oligonucleotide
tcctcagcattggggaactcagcttgtcc

SEQ ID NO: 222936 - DNA, 28 bp, Artificial Sequence
  Description of Artificial Sequence: Synthetic oligonucleotide
cctcagcattggggaactcagcttgtcc

SEQ ID NO: 222937 - DNA, 30 bp, Artificial Sequence
  Description of Artificial Sequence: Synthetic oligonucleotide
ctcagcattggggaactcagcttgtccatc

SEQ ID NO: 222938 - DNA, 30 bp, Artificial Sequence
  Description of Artificial Sequence: Synthetic oligonucleotide
tcagcattggggaactcagcttgtccatcg

SEQ ID NO: 222939 - DNA, 29 bp, Artificial Sequence
  Description of Artificial Sequence: Synthetic oligonucleotide
cagcattggggaactcagcttgtccatcg

SEQ ID NO: 222940 - DNA, 30 bp, Artificial Sequence
  Description of Artificial Sequence: Synthetic oligonucleotide
agcattggggaactcagcttgtccatcgtg

SEQ ID NO: 222941 - DNA, 29 bp, Artificial Sequence
  Description of Artificial Sequence: Synthetic oligonucleotide
gcattggggaactcagcttgtccatcgtg

SEQ ID NO: 222942 - DNA, 32 bp, Artificial Sequence
  Description of Artificial Sequence: Synthetic oligonucleotide
cattggggaactcagcttgtccatcgtgatag

SEQ ID NO: 222943 - DNA, 32 bp, Artificial Sequence
  Description of Artificial Sequence: Synthetic oligonucleotide
attggggaactcagcttgtccatcgtgatagc

SEQ ID NO: 222944 - DNA, 31 bp, Artificial Sequence
  Description of Artificial Sequence: Synthetic oligonucleotide
ttggggaactcagcttgtccatcgtgatagc

SEQ ID NO: 222945 - DNA, 30 bp, Artificial Sequence
  Description of Artificial Sequence: Synthetic oligonucleotide
tggggaactcagcttgtccatcgtgatagc

SEQ ID NO: 222946 - DNA, 29 bp, Artificial Sequence
  Description of Artificial Sequence: Synthetic oligonucleotide
ggggaactcagcttgtccatcgtgatagc

SEQ ID NO: 222947 - DNA, 30 bp, Artificial Sequence
  Description of Artificial Sequence: Synthetic oligonucleotide
gggaactcagcttgtccatcgtgatagctc

SEQ ID NO: 222948 - DNA, 31 bp, Artificial Sequence
  Description of Artificial Sequence: Synthetic oligonucleotide
ggaactcagcttgtccatcgtgatagctctc

SEQ ID NO: 222949 - DNA, 32 bp, Artificial Sequence
  Description of Artificial Sequence: Synthetic oligonucleotide
gaactcagcttgtccatcgtgatagctctcac

SEQ ID NO: 222950 - DNA, 32 bp, Artificial Sequence
  Description of Artificial Sequence: Synthetic oligonucleotide
aactcagcttgtccatcgtgatagctctcacg

SEQ ID NO: 222951 - DNA, 31 bp, Artificial Sequence
  Description of Artificial Sequence: Synthetic oligonucleotide
actcagcttgtccatcgtgatagctctcacg

SEQ ID NO: 222952 - DNA, 30 bp, Artificial Sequence
  Description of Artificial Sequence: Synthetic oligonucleotide
ctcagcttgtccatcgtgatagctctcacg

SEQ ID NO: 222953 - DNA, 31 bp, Artificial Sequence
  Description of Artificial Sequence: Synthetic oligonucleotide
tcagcttgtccatcgtgatagctctcacgtc

SEQ ID NO: 222954 - DNA, 30 bp, Artificial Sequence
  Description of Artificial Sequence: Synthetic oligonucleotide
cagcttgtccatcgtgatagctctcacgtc

SEQ ID NO: 222955 - DNA, 31 bp, Artificial Sequence
  Description of Artificial Sequence: Synthetic oligonucleotide
agcttgtccatcgtgatagctctcacgtctg

SEQ ID NO: 222956 - DNA, 30 bp, Artificial Sequence
  Description of Artificial Sequence: Synthetic oligonucleotide
gcttgtccatcgtgatagctctcacgtctg

SEQ ID NO: 222957 - DNA, 30 bp, Artificial Sequence
  Description of Artificial Sequence: Synthetic oligonucleotide
cttgtccatcgtgatagctctcacgtctgg

SEQ ID NO: 222958 - DNA, 31 bp, Artificial Sequence
  Description of Artificial Sequence: Synthetic oligonucleotide
ttgtccatcgtgatagctctcacgtctggtc

SEQ ID NO: 222959 - DNA, 30 bp, Artificial Sequence
  Description of Artificial Sequence: Synthetic oligonucleotide
tgtccatcgtgatagctctcacgtctggtc

SEQ ID NO: 222960 - DNA, 29 bp, Artificial Sequence
  Description of Artificial Sequence: Synthetic oligonucleotide
gtccatcgtgatagctctcacgtctggtc

SEQ ID NO: 222961 - DNA, 30 bp, Artificial Sequence
  Description of Artificial Sequence: Synthetic oligonucleotide
tccatcgtgatagctctcacgtctggtctc

SEQ ID NO: 222962 - DNA, 31 bp, Artificial Sequence
  Description of Artificial Sequence: Synthetic oligonucleotide
tattcggctggccaccatgagtgctttgttg

SEQ ID NO: 222963 - DNA, 30 bp, Artificial Sequence
  Description of Artificial Sequence: Synthetic oligonucleotide
attcggctggccaccatgagtgctttgttg

SEQ ID NO: 222964 - DNA, 29 bp, Artificial Sequence
  Description of Artificial Sequence: Synthetic oligonucleotide
ttcggctggccaccatgagtgctttgttg

SEQ ID NO: 222965 - DNA, 28 bp, Artificial Sequence
  Description of Artificial Sequence: Synthetic oligonucleotide
tcggctggccaccatgagtgctttgttg

SEQ ID NO: 222966 - DNA, 27 bp, Artificial Sequence
  Description of Artificial Sequence: Synthetic oligonucleotide
cggctggccaccatgagtgctttgttg

SEQ ID NO: 222967 - DNA, 27 bp, Artificial Sequence
  Description of Artificial Sequence: Synthetic oligonucleotide
ggctggccaccatgagtgctttgttgg

SEQ ID NO: 222968 - DNA, 28 bp, Artificial Sequence
  Description of Artificial Sequence: Synthetic oligonucleotide
gctggccaccatgagtgctttgttggtg

SEQ ID NO: 222969 - DNA, 28 bp, Artificial Sequence
  Description of Artificial Sequence: Synthetic oligonucleotide
ctggccaccatgagtgctttgttggtgc

SEQ ID NO: 222970 - DNA, 29 bp, Artificial Sequence
  Description of Artificial Sequence: Synthetic oligonucleotide
tggccaccatgagtgctttgttggtgctg

SEQ ID NO: 222971 - DNA, 28 bp, Artificial Sequence
  Description of Artificial Sequence: Synthetic oligonucleotide
ggccaccatgagtgctttgttggtgctg

SEQ ID NO: 222972 - DNA, 30 bp, Artificial Sequence
  Description of Artificial Sequence: Synthetic oligonucleotide
gccaccatgagtgctttgttggtgctgatc

SEQ ID NO: 222973 - DNA, 31 bp, Artificial Sequence
  Description of Artificial Sequence: Synthetic oligonucleotide
ccaccatgagtgctttgttggtgctgatctc

SEQ ID NO: 222974 - DNA, 32 bp, Artificial Sequence
  Description of Artificial Sequence: Synthetic oligonucleotide
caccatgagtgctttgttggtgctgatctcag

SEQ ID NO: 222975 - DNA, 33 bp, Artificial Sequence
  Description of Artificial Sequence: Synthetic oligonucleotide
accatgagtgctttgttggtgctgatctcagtg

SEQ ID NO: 222976 - DNA, 32 bp, Artificial Sequence
  Description of Artificial Sequence: Synthetic oligonucleotide
ccatgagtgctttgttggtgctgatctcagtg

SEQ ID NO: 222977 - DNA, 32 bp, Artificial Sequence
  Description of Artificial Sequence: Synthetic oligonucleotide
catgagtgctttgttggtgctgatctcagtgg

SEQ ID NO: 222978 - DNA, 34 bp, Artificial Sequence
  Description of Artificial Sequence: Synthetic oligonucleotide
atgagtgctttgttggtgctgatctcagtggatg

SEQ ID NO: 222979 - DNA, 33 bp, Artificial Sequence
  Description of Artificial Sequence: Synthetic oligonucleotide
tgagtgctttgttggtgctgatctcagtggatg

SEQ ID NO: 222980 - DNA, 32 bp, Artificial Sequence
  Description of Artificial Sequence: Synthetic oligonucleotide
gagtgctttgttggtgctgatctcagtggatg

SEQ ID NO: 222981 - DNA, 32 bp, Artificial Sequence
  Description of Artificial Sequence: Synthetic oligonucleotide
agtgctttgttggtgctgatctcagtggatgc

SEQ ID NO: 222982 - DNA, 31 bp, Artificial Sequence
  Description of Artificial Sequence: Synthetic oligonucleotide
gtgctttgttggtgctgatctcagtggatgc

SEQ ID NO: 222983 - DNA, 32 bp, Artificial Sequence
  Description of Artificial Sequence: Synthetic oligonucleotide
tgctttgttggtgctgatctcagtggatgctg

SEQ ID NO: 222984 - DNA, 31 bp, Artificial Sequence
  Description of Artificial Sequence: Synthetic oligonucleotide
gctttgttggtgctgatctcagtggatgctg

SEQ ID NO: 222985 - DNA, 32 bp, Artificial Sequence
  Description of Artificial Sequence: Synthetic oligonucleotide
ctttgttggtgctgatctcagtggatgctgtc

SEQ ID NO: 222986 - DNA, 34 bp, Artificial Sequence
  Description of Artificial Sequence: Synthetic oligonucleotide
tttgttggtgctgatctcagtggatgctgtcttg

SEQ ID NO: 222987 - DNA, 33 bp, Artificial Sequence
  Description of Artificial Sequence: Synthetic oligonucleotide
ttgttggtgctgatctcagtggatgctgtcttg

SEQ ID NO: 222988 - DNA, 32 bp, Artificial Sequence
  Description of Artificial Sequence: Synthetic oligonucleotide
tgttggtgctgatctcagtggatgctgtcttg

SEQ ID NO: 222989 - DNA, 31 bp, Artificial Sequence
  Description of Artificial Sequence: Synthetic oligonucleotide
gttggtgctgatctcagtggatgctgtcttg

SEQ ID NO: 222990 - DNA, 31 bp, Artificial Sequence
  Description of Artificial Sequence: Synthetic oligonucleotide
ttggtgctgatctcagtggatgctgtcttgg

SEQ ID NO: 222991 - DNA, 30 bp, Artificial Sequence
  Description of Artificial Sequence: Synthetic oligonucleotide
tggtgctgatctcagtggatgctgtcttgg

SEQ ID NO: 222992 - DNA, 32 bp, Artificial Sequence
  Description of Artificial Sequence: Synthetic oligonucleotide
ccctaacactggaagcagctctcattctcttc

SEQ ID NO: 222993 - DNA, 42 bp, Artificial Sequence
  Description of Artificial Sequence: Synthetic oligonucleotide
cctaacactggaagcagctctcattctcttctatttttttac

SEQ ID NO: 222994 - DNA, 42 bp, Artificial Sequence
  Description of Artificial Sequence: Synthetic oligonucleotide
ctaacactggaagcagctctcattctcttctatttttttacc

SEQ ID NO: 222995 - DNA, 42 bp, Artificial Sequence
  Description of Artificial Sequence: Synthetic oligonucleotide
taacactggaagcagctctcattctcttctatttttttaccc

SEQ ID NO: 222996 - DNA, 41 bp, Artificial Sequence
  Description of Artificial Sequence: Synthetic oligonucleotide
aacactggaagcagctctcattctcttctatttttttaccc

SEQ ID NO: 222997 - DNA, 40 bp, Artificial Sequence
  Description of Artificial Sequence: Synthetic oligonucleotide
acactggaagcagctctcattctcttctatttttttaccc

SEQ ID NO: 222998 - DNA, 39 bp, Artificial Sequence
  Description of Artificial Sequence: Synthetic oligonucleotide
cactggaagcagctctcattctcttctatttttttaccc

SEQ ID NO: 222999 - DNA, 40 bp, Artificial Sequence
  Description of Artificial Sequence: Synthetic oligonucleotide
actggaagcagctctcattctcttctatttttttacccac

SEQ ID NO: 223000 - DNA, 39 bp, Artificial Sequence
  Description of Artificial Sequence: Synthetic oligonucleotide
ctggaagcagctctcattctcttctatttttttacccac

SEQ ID NO: 223001 - DNA, 42 bp, Artificial Sequence
  Description of Artificial Sequence: Synthetic oligonucleotide
tggaagcagctctcattctcttctatttttttacccactatg

SEQ ID NO: 223002 - DNA, 41 bp, Artificial Sequence
  Description of Artificial Sequence: Synthetic oligonucleotide
ggaagcagctctcattctcttctatttttttacccactatg

SEQ ID NO: 223003 - DNA, 42 bp, Artificial Sequence
  Description of Artificial Sequence: Synthetic oligonucleotide
gaagcagctctcattctcttctatttttttacccactatgac

SEQ ID NO: 223004 - DNA, 42 bp, Artificial Sequence
  Description of Artificial Sequence: Synthetic oligonucleotide
aagcagctctcattctcttctatttttttacccactatgacg

SEQ ID NO: 223005 - DNA, 41 bp, Artificial Sequence
  Description of Artificial Sequence: Synthetic oligonucleotide
agcagctctcattctcttctatttttttacccactatgacg

SEQ ID NO: 223006 - DNA, 40 bp, Artificial Sequence
  Description of Artificial Sequence: Synthetic oligonucleotide
gcagctctcattctcttctatttttttacccactatgacg

SEQ ID NO: 223007 - DNA, 40 bp, Artificial Sequence
  Description of Artificial Sequence: Synthetic oligonucleotide
cagctctcattctcttctatttttttacccactatgacgc

SEQ ID NO: 223008 - DNA, 42 bp, Artificial Sequence
  Description of Artificial Sequence: Synthetic oligonucleotide
agctctcattctcttctatttttttacccactatgacgcttc

SEQ ID NO: 223009 - DNA, 41 bp, Artificial Sequence
  Description of Artificial Sequence: Synthetic oligonucleotide
gctctcattctcttctatttttttacccactatgacgcttc

SEQ ID NO: 223010 - DNA, 41 bp, Artificial Sequence
  Description of Artificial Sequence: Synthetic oligonucleotide
ctctcattctcttctatttttttacccactatgacgcttcc

SEQ ID NO: 223011 - DNA, 44 bp, Artificial Sequence
  Description of Artificial Sequence: Synthetic oligonucleotide
tctcattctcttctatttttttacccactatgacgcttccttag

SEQ ID NO: 223012 - DNA, 43 bp, Artificial Sequence
  Description of Artificial Sequence: Synthetic oligonucleotide
ctcattctcttctatttttttacccactatgacgcttccttag

SEQ ID NO: 223013 - DNA, 44 bp, Artificial Sequence
  Description of Artificial Sequence: Synthetic oligonucleotide
tcattctcttctatttttttacccactatgacgcttccttagag

SEQ ID NO: 223014 - DNA, 43 bp, Artificial Sequence
  Description of Artificial Sequence: Synthetic oligonucleotide
cattctcttctatttttttacccactatgacgcttccttagag

SEQ ID NO: 223015 - DNA, 43 bp, Artificial Sequence
  Description of Artificial Sequence: Synthetic oligonucleotide
attctcttctatttttttacccactatgacgcttccttagagg

SEQ ID NO: 223016 - DNA, 42 bp, Artificial Sequence
  Description of Artificial Sequence: Synthetic oligonucleotide
ttctcttctatttttttacccactatgacgcttccttagagg

SEQ ID NO: 223017 - DNA, 41 bp, Artificial Sequence
  Description of Artificial Sequence: Synthetic oligonucleotide
tctcttctatttttttacccactatgacgcttccttagagg

SEQ ID NO: 223018 - DNA, 29 bp, Artificial Sequence
  Description of Artificial Sequence: Synthetic oligonucleotide
atgagctctaagtacccgcggtctgtctg

SEQ ID NO: 223019 - DNA, 28 bp, Artificial Sequence
  Description of Artificial Sequence: Synthetic oligonucleotide
tgagctctaagtacccgcggtctgtctg

SEQ ID NO: 223020 - DNA, 27 bp, Artificial Sequence
  Description of Artificial Sequence: Synthetic oligonucleotide
gagctctaagtacccgcggtctgtctg

SEQ ID NO: 223021 - DNA, 27 bp, Artificial Sequence
  Description of Artificial Sequence: Synthetic oligonucleotide
agctctaagtacccgcggtctgtctgg

SEQ ID NO: 223022 - DNA, 26 bp, Artificial Sequence
  Description of Artificial Sequence: Synthetic oligonucleotide
gctctaagtacccgcggtctgtctgg

SEQ ID NO: 223023 - DNA, 26 bp, Artificial Sequence
  Description of Artificial Sequence: Synthetic oligonucleotide
ctctaagtacccgcggtctgtctggc

SEQ ID NO: 223024 - DNA, 26 bp, Artificial Sequence
  Description of Artificial Sequence: Synthetic oligonucleotide
tctaagtacccgcggtctgtctggcg

SEQ ID NO: 223025 - DNA, 25 bp, Artificial Sequence
  Description of Artificial Sequence: Synthetic oligonucleotide
ctaagtacccgcggtctgtctggcg

SEQ ID NO: 223026 - DNA, 26 bp, Artificial Sequence
  Description of Artificial Sequence: Synthetic oligonucleotide
taagtacccgcggtctgtctggcgct

SEQ ID NO: 223027 - DNA, 25 bp, Artificial Sequence
  Description of Artificial Sequence: Synthetic oligonucleotide
aagtacccgcggtctgtctggcgct

SEQ ID NO: 223028 - DNA, 24 bp, Artificial Sequence
  Description of Artificial Sequence: Synthetic oligonucleotide
agtacccgcggtctgtctggcgct

SEQ ID NO: 223029 - DNA, 23 bp, Artificial Sequence
  Description of Artificial Sequence: Synthetic oligonucleotide
gtacccgcggtctgtctggcgct

SEQ ID NO: 223030 - DNA, 23 bp, Artificial Sequence
  Description of Artificial Sequence: Synthetic oligonucleotide
tacccgcggtctgtctggcgctg

SEQ ID NO: 223031 - DNA, 22 bp, Artificial Sequence
  Description of Artificial Sequence: Synthetic oligonucleotide
acccgcggtctgtctggcgctg

SEQ ID NO: 223032 - DNA, 21 bp, Artificial Sequence
  Description of Artificial Sequence: Synthetic oligonucleotide
cccgcggtctgtctggcgctg

SEQ ID NO: 223033 - DNA, 21 bp, Artificial Sequence
  Description of Artificial Sequence: Synthetic oligonucleotide
ccgcggtctgtctggcgctgc

SEQ ID NO: 223034 - DNA, 22 bp, Artificial Sequence
  Description of Artificial Sequence: Synthetic oligonucleotide
cgcggtctgtctggcgctgcct

SEQ ID NO: 223035 - DNA, 22 bp, Artificial Sequence
  Description of Artificial Sequence: Synthetic oligonucleotide
gcggtctgtctggcgctgcctg

SEQ ID NO: 223036 - DNA, 22 bp, Artificial Sequence
  Description of Artificial Sequence: Synthetic oligonucleotide
cggtctgtctggcgctgcctgc

SEQ ID NO: 223037 - DNA, 22 bp, Artificial Sequence
  Description of Artificial Sequence: Synthetic oligonucleotide
ggtctgtctggcgctgcctgcc

SEQ ID NO: 223038 - DNA, 22 bp, Artificial Sequence
  Description of Artificial Sequence: Synthetic oligonucleotide
gtctgtctggcgctgcctgccc

SEQ ID NO: 223039 - DNA, 23 bp, Artificial Sequence
  Description of Artificial Sequence: Synthetic oligonucleotide
tctgtctggcgctgcctgcccct

SEQ ID NO: 223040 - DNA, 22 bp, Artificial Sequence
  Description of Artificial Sequence: Synthetic oligonucleotide
ctgtctggcgctgcctgcccct

SEQ ID NO: 223041 - DNA, 23 bp, Artificial Sequence
  Description of Artificial Sequence: Synthetic oligonucleotide
tgtctggcgctgcctgcccctct

SEQ ID NO: 223042 - DNA, 22 bp, Artificial Sequence
  Description of Artificial Sequence: Synthetic oligonucleotide
gtctggcgctgcctgcccctct

SEQ ID NO: 223043 - DNA, 22 bp, Artificial Sequence
  Description of Artificial Sequence: Synthetic oligonucleotide
tctggcgctgcctgcccctctg

SEQ ID NO: 223044 - DNA, 21 bp, Artificial Sequence
  Description of Artificial Sequence: Synthetic oligonucleotide
ctggcgctgcctgcccctctg

SEQ ID NO: 223045 - DNA, 21 bp, Artificial Sequence
  Description of Artificial Sequence: Synthetic oligonucleotide
tggcgctgcctgcccctctgg

SEQ ID NO: 223046 - DNA, 27 bp, Artificial Sequence
  Description of Artificial Sequence: Synthetic oligonucleotide
aggtgacagctttaggcaccctgaggg

SEQ ID NO: 223047 - DNA, 27 bp, Artificial Sequence
  Description of Artificial Sequence: Synthetic oligonucleotide
ggtgacagctttaggcaccctgagggt

SEQ ID NO: 223048 - DNA, 27 bp, Artificial Sequence
  Description of Artificial Sequence: Synthetic oligonucleotide
gtgacagctttaggcaccctgagggtg

SEQ ID NO: 223049 - DNA, 27 bp, Artificial Sequence
  Description of Artificial Sequence: Synthetic oligonucleotide
tgacagctttaggcaccctgagggtgg

SEQ ID NO: 223050 - DNA, 27 bp, Artificial Sequence
  Description of Artificial Sequence: Synthetic oligonucleotide
gacagctttaggcaccctgagggtggt

SEQ ID NO: 223051 - DNA, 27 bp, Artificial Sequence
  Description of Artificial Sequence: Synthetic oligonucleotide
acagctttaggcaccctgagggtggtc

SEQ ID NO: 223052 - DNA, 27 bp, Artificial Sequence
  Description of Artificial Sequence: Synthetic oligonucleotide
cagctttaggcaccctgagggtggtca

SEQ ID NO: 223053 - DNA, 28 bp, Artificial Sequence
  Description of Artificial Sequence: Synthetic oligonucleotide
agctttaggcaccctgagggtggtcatc

SEQ ID NO: 223054 - DNA, 27 bp, Artificial Sequence
  Description of Artificial Sequence: Synthetic oligonucleotide
gctttaggcaccctgagggtggtcatc

SEQ ID NO: 223055 - DNA, 28 bp, Artificial Sequence
  Description of Artificial Sequence: Synthetic oligonucleotide
ctttaggcaccctgagggtggtcatcag

SEQ ID NO: 223056 - DNA, 34 bp, Artificial Sequence
  Description of Artificial Sequence: Synthetic oligonucleotide
tttaggcaccctgagggtggtcatcagtaatatc

SEQ ID NO: 223057 - DNA, 33 bp, Artificial Sequence
  Description of Artificial Sequence: Synthetic oligonucleotide
ttaggcaccctgagggtggtcatcagtaatatc

SEQ ID NO: 223058 - DNA, 32 bp, Artificial Sequence
  Description of Artificial Sequence: Synthetic oligonucleotide
taggcaccctgagggtggtcatcagtaatatc

SEQ ID NO: 223059 - DNA, 31 bp, Artificial Sequence
  Description of Artificial Sequence: Synthetic oligonucleotide
aggcaccctgagggtggtcatcagtaatatc

SEQ ID NO: 223060 - DNA, 30 bp, Artificial Sequence
  Description of Artificial Sequence: Synthetic oligonucleotide
ggcaccctgagggtggtcatcagtaatatc

SEQ ID NO: 223061 - DNA, 32 bp, Artificial Sequence
  Description of Artificial Sequence: Synthetic oligonucleotide
gcaccctgagggtggtcatcagtaatatcttc

SEQ ID NO: 223062 - DNA, 34 bp, Artificial Sequence
  Description of Artificial Sequence: Synthetic oligonucleotide
caccctgagggtggtcatcagtaatatcttcaac

SEQ ID NO: 223063 - DNA, 35 bp, Artificial Sequence
  Description of Artificial Sequence: Synthetic oligonucleotide
accctgagggtggtcatcagtaatatcttcaacac

SEQ ID NO: 223064 - DNA, 34 bp, Artificial Sequence
  Description of Artificial Sequence: Synthetic oligonucleotide
ccctgagggtggtcatcagtaatatcttcaacac

SEQ ID NO: 223065 - DNA, 35 bp, Artificial Sequence
  Description of Artificial Sequence: Synthetic oligonucleotide
cctgagggtggtcatcagtaatatcttcaacacag

SEQ ID NO: 223066 - DNA, 36 bp, Artificial Sequence
  Description of Artificial Sequence: Synthetic oligonucleotide
ctgagggtggtcatcagtaatatcttcaacacagac

SEQ ID NO: 223067 - DNA, 38 bp, Artificial Sequence
  Description of Artificial Sequence: Synthetic oligonucleotide
tgagggtggtcatcagtaatatcttcaacacagactac

SEQ ID NO: 223068 - DNA, 37 bp, Artificial Sequence
  Description of Artificial Sequence: Synthetic oligonucleotide
gagggtggtcatcagtaatatcttcaacacagactac

SEQ ID NO: 223069 - DNA, 37 bp, Artificial Sequence
  Description of Artificial Sequence: Synthetic oligonucleotide
agggtggtcatcagtaatatcttcaacacagactacc

SEQ ID NO: 223070 - DNA, 36 bp, Artificial Sequence
  Description of Artificial Sequence: Synthetic oligonucleotide
gggtggtcatcagtaatatcttcaacacagactacc

SEQ ID NO: 223071 - DNA, 37 bp, Artificial Sequence
  Description of Artificial Sequence: Synthetic oligonucleotide
ggtggtcatcagtaatatcttcaacacagactaccac

SEQ ID NO: 223072 - DNA, 39 bp, Artificial Sequence
  Description of Artificial Sequence: Synthetic oligonucleotide
gtggtcatcagtaatatcttcaacacagactaccacatg

SEQ ID NO: 223073 - DNA, 28 bp, Artificial Sequence
  Description of Artificial Sequence: Synthetic oligonucleotide
tggacagcttcctgagccagttcccttc

SEQ ID NO: 223074 - DNA, 27 bp, Artificial Sequence
  Description of Artificial Sequence: Synthetic oligonucleotide
ggacagcttcctgagccagttcccttc

SEQ ID NO: 223075 - DNA, 28 bp, Artificial Sequence
  Description of Artificial Sequence: Synthetic oligonucleotide
gacagcttcctgagccagttcccttctg

SEQ ID NO: 223076 - DNA, 28 bp, Artificial Sequence
  Description of Artificial Sequence: Synthetic oligonucleotide
acagcttcctgagccagttcccttctgg

SEQ ID NO: 223077 - DNA, 27 bp, Artificial Sequence
  Description of Artificial Sequence: Synthetic oligonucleotide
cagcttcctgagccagttcccttctgg

SEQ ID NO: 223078 - DNA, 27 bp, Artificial Sequence
  Description of Artificial Sequence: Synthetic oligonucleotide
agcttcctgagccagttcccttctggg

SEQ ID NO: 223079 - DNA, 40 bp, Artificial Sequence
  Description of Artificial Sequence: Synthetic oligonucleotide
taacactggaagcagctctcattctcctcttctatttttc

SEQ ID NO: 223080 - DNA, 39 bp, Artificial Sequence
  Description of Artificial Sequence: Synthetic oligonucleotide
aacactggaagcagctctcattctcctcttctatttttc

SEQ ID NO: 223081 - DNA, 38 bp, Artificial Sequence
  Description of Artificial Sequence: Synthetic oligonucleotide
acactggaagcagctctcattctcctcttctatttttc

SEQ ID NO: 223082 - DNA, 37 bp, Artificial Sequence
  Description of Artificial Sequence: Synthetic oligonucleotide
cactggaagcagctctcattctcctcttctatttttc

SEQ ID NO: 223083 - DNA, 39 bp, Artificial Sequence
  Description of Artificial Sequence: Synthetic oligonucleotide
actggaagcagctctcattctcctcttctatttttctac

SEQ ID NO: 223084 - DNA, 38 bp, Artificial Sequence
  Description of Artificial Sequence: Synthetic oligonucleotide
ctggaagcagctctcattctcctcttctatttttctac

SEQ ID NO: 223085 - DNA, 38 bp, Artificial Sequence
  Description of Artificial Sequence: Synthetic oligonucleotide
tggaagcagctctcattctcctcttctatttttctacc

SEQ ID NO: 223086 - DNA, 37 bp, Artificial Sequence
  Description of Artificial Sequence: Synthetic oligonucleotide
ggaagcagctctcattctcctcttctatttttctacc

SEQ ID NO: 223087 - DNA, 37 bp, Artificial Sequence
  Description of Artificial Sequence: Synthetic oligonucleotide
gaagcagctctcattctcctcttctatttttctaccc

SEQ ID NO: 223088 - DNA, 38 bp, Artificial Sequence
  Description of Artificial Sequence: Synthetic oligonucleotide
aagcagctctcattctcctcttctatttttctacccac

SEQ ID NO: 223089 - DNA, 37 bp, Artificial Sequence
  Description of Artificial Sequence: Synthetic oligonucleotide
agcagctctcattctcctcttctatttttctacccac

SEQ ID NO: 223090 - DNA, 36 bp, Artificial Sequence
  Description of Artificial Sequence: Synthetic oligonucleotide
gcagctctcattctcctcttctatttttctacccac

SEQ ID NO: 223091 - DNA, 39 bp, Artificial Sequence
  Description of Artificial Sequence: Synthetic oligonucleotide
cagctctcattctcctcttctatttttctacccactatg

SEQ ID NO: 223092 - DNA, 40 bp, Artificial Sequence
  Description of Artificial Sequence: Synthetic oligonucleotide
agctctcattctcctcttctatttttctacccactatgac

SEQ ID NO: 223093 - DNA, 39 bp, Artificial Sequence
  Description of Artificial Sequence: Synthetic oligonucleotide
gctctcattctcctcttctatttttctacccactatgac

SEQ ID NO: 223094 - DNA, 39 bp, Artificial Sequence
  Description of Artificial Sequence: Synthetic oligonucleotide
ctctcattctcctcttctatttttctacccactatgacg

SEQ ID NO: 223095 - DNA, 39 bp, Artificial Sequence
  Description of Artificial Sequence: Synthetic oligonucleotide
tctcattctcctcttctatttttctacccactatgacgc

SEQ ID NO: 223096 - DNA, 38 bp, Artificial Sequence
  Description of Artificial Sequence: Synthetic oligonucleotide
ctcattctcctcttctatttttctacccactatgacgc

SEQ ID NO: 223097 - DNA, 40 bp, Artificial Sequence
  Description of Artificial Sequence: Synthetic oligonucleotide
tcattctcctcttctatttttctacccactatgacgcttc

SEQ ID NO: 223098 - DNA, 39 bp, Artificial Sequence
  Description of Artificial Sequence: Synthetic oligonucleotide
cattctcctcttctatttttctacccactatgacgcttc

SEQ ID NO: 223099 - DNA, 39 bp, Artificial Sequence
  Description of Artificial Sequence: Synthetic oligonucleotide
attctcctcttctatttttctacccactatgacgcttcc

SEQ ID NO: 223100 - DNA, 38 bp, Artificial Sequence
  Description of Artificial Sequence: Synthetic oligonucleotide
ttctcctcttctatttttctacccactatgacgcttcc

SEQ ID NO: 223101 - DNA, 37 bp, Artificial Sequence
  Description of Artificial Sequence: Synthetic oligonucleotide
tctcctcttctatttttctacccactatgacgcttcc

SEQ ID NO: 223102 - DNA, 36 bp, Artificial Sequence
  Description of Artificial Sequence: Synthetic oligonucleotide
ctcctcttctatttttctacccactatgacgcttcc

SEQ ID NO: 223103 - DNA, 39 bp, Artificial Sequence
  Description of Artificial Sequence: Synthetic oligonucleotide
tcctcttctatttttctacccactatgacgcttccttag

SEQ ID NO: 223104 - DNA, 38 bp, Artificial Sequence
  Description of Artificial Sequence: Synthetic oligonucleotide
cctcttctatttttctacccactatgacgcttccttag

SEQ ID NO: 223105 - DNA, 39 bp, Artificial Sequence
  Description of Artificial Sequence: Synthetic oligonucleotide
ctcttctatttttctacccactatgacgcttccttagag

SEQ ID NO: 223106 - DNA, 39 bp, Artificial Sequence
  Description of Artificial Sequence: Synthetic oligonucleotide
tcttctatttttctacccactatgacgcttccttagagg

SEQ ID NO: 223107 - DNA, 38 bp, Artificial Sequence
  Description of Artificial Sequence: Synthetic oligonucleotide
cttctatttttctacccactatgacgcttccttagagg

SEQ ID NO: 223108 - DNA, 40 bp, Artificial Sequence
  Description of Artificial Sequence: Synthetic oligonucleotide
ttctatttttctacccactatgacgcttccttagaggatc

SEQ ID NO: 223109 - DNA, 39 bp, Artificial Sequence
  Description of Artificial Sequence: Synthetic oligonucleotide
tctatttttctacccactatgacgcttccttagaggatc

SEQ ID NO: 223110 - DNA, 38 bp, Artificial Sequence
  Description of Artificial Sequence: Synthetic oligonucleotide
ctatttttctacccactatgacgcttccttagaggatc

SEQ ID NO: 223111 - DNA, 42 bp, Artificial Sequence
  Description of Artificial Sequence: Synthetic oligonucleotide
tatttttctacccactatgacgcttccttagaggatcaaaag

SEQ ID NO: 223112 - DNA, 41 bp, Artificial Sequence
  Description of Artificial Sequence: Synthetic oligonucleotide
atttttctacccactatgacgcttccttagaggatcaaaag

SEQ ID NO: 223113 - DNA, 40 bp, Artificial Sequence
  Description of Artificial Sequence: Synthetic oligonucleotide
tttttctacccactatgacgcttccttagaggatcaaaag

SEQ ID NO: 223114 - DNA, 39 bp, Artificial Sequence
  Description of Artificial Sequence: Synthetic oligonucleotide
ttttctacccactatgacgcttccttagaggatcaaaag

SEQ ID NO: 223115 - DNA, 38 bp, Artificial Sequence
  Description of Artificial Sequence: Synthetic oligonucleotide
tttctacccactatgacgcttccttagaggatcaaaag

SEQ ID NO: 223116 - DNA, 37 bp, Artificial Sequence
  Description of Artificial Sequence: Synthetic oligonucleotide
ttctacccactatgacgcttccttagaggatcaaaag

SEQ ID NO: 223117 - DNA, 36 bp, Artificial Sequence
  Description of Artificial Sequence: Synthetic oligonucleotide
tctacccactatgacgcttccttagaggatcaaaag

SEQ ID NO: 223118 - DNA, 35 bp, Artificial Sequence
  Description of Artificial Sequence: Synthetic oligonucleotide
ctacccactatgacgcttccttagaggatcaaaag

SEQ ID NO: 223119 - DNA, 37 bp, Artificial Sequence
  Description of Artificial Sequence: Synthetic oligonucleotide
gaaaggaagaatgccatgttcaacacctactatgctg

SEQ ID NO: 223120 - DNA, 28 bp, Artificial Sequence
  Description of Artificial Sequence: Synthetic oligonucleotide
ttggccaagatctgactgtgatggcggc

SEQ ID NO: 223121 - DNA, 27 bp, Artificial Sequence
  Description of Artificial Sequence: Synthetic oligonucleotide
tggccaagatctgactgtgatggcggc

SEQ ID NO: 223122 - DNA, 26 bp, Artificial Sequence
  Description of Artificial Sequence: Synthetic oligonucleotide
ggccaagatctgactgtgatggcggc

SEQ ID NO: 223123 - DNA, 27 bp, Artificial Sequence
  Description of Artificial Sequence: Synthetic oligonucleotide
gccaagatctgactgtgatggcggcca

SEQ ID NO: 223124 - DNA, 29 bp, Artificial Sequence
  Description of Artificial Sequence: Synthetic oligonucleotide
ccaagatctgactgtgatggcggccattg

SEQ ID NO: 223125 - DNA, 29 bp, Artificial Sequence
  Description of Artificial Sequence: Synthetic oligonucleotide
caagatctgactgtgatggcggccattgg

SEQ ID NO: 223126 - DNA, 29 bp, Artificial Sequence
  Description of Artificial Sequence: Synthetic oligonucleotide
aagatctgactgtgatggcggccattggc

SEQ ID NO: 223127 - DNA, 28 bp, Artificial Sequence
  Description of Artificial Sequence: Synthetic oligonucleotide
agatctgactgtgatggcggccattggc

SEQ ID NO: 223128 - DNA, 27 bp, Artificial Sequence
  Description of Artificial Sequence: Synthetic oligonucleotide
gatctgactgtgatggcggccattggc

SEQ ID NO: 223129 - DNA, 29 bp, Artificial Sequence
  Description of Artificial Sequence: Synthetic oligonucleotide
atctgactgtgatggcggccattggcttg

SEQ ID NO: 223130 - DNA, 28 bp, Artificial Sequence
  Description of Artificial Sequence: Synthetic oligonucleotide
tctgactgtgatggcggccattggcttg

SEQ ID NO: 223131 - DNA, 27 bp, Artificial Sequence
  Description of Artificial Sequence: Synthetic oligonucleotide
ctgactgtgatggcggccattggcttg

SEQ ID NO: 223132 - DNA, 27 bp, Artificial Sequence
  Description of Artificial Sequence: Synthetic oligonucleotide
tgactgtgatggcggccattggcttgg

SEQ ID NO: 223133 - DNA, 26 bp, Artificial Sequence
  Description of Artificial Sequence: Synthetic oligonucleotide
gactgtgatggcggccattggcttgg

SEQ ID NO: 223134 - DNA, 26 bp, Artificial Sequence
  Description of Artificial Sequence: Synthetic oligonucleotide
actgtgatggcggccattggcttggg

SEQ ID NO: 223135 - DNA, 25 bp, Artificial Sequence
  Description of Artificial Sequence: Synthetic oligonucleotide
ctgtgatggcggccattggcttggg

SEQ ID NO: 223136 - DNA, 27 bp, Artificial Sequence
  Description of Artificial Sequence: Synthetic oligonucleotide
tgtgatggcggccattggcttgggctt

SEQ ID NO: 223137 - DNA, 20 bp, Artificial Sequence
  Description of Artificial Sequence: Synthetic oligonucleotide
ctgcctgcccctctgggccc

SEQ ID NO: 223138 - DNA, 22 bp, Artificial Sequence
  Description of Artificial Sequence: Synthetic oligonucleotide
tgcctgcccctctgggccccaa

SEQ ID NO: 223139 - DNA, 21 bp, Artificial Sequence
  Description of Artificial Sequence: Synthetic oligonucleotide
gcctgcccctctgggccccaa

SEQ ID NO: 223140 - DNA, 22 bp, Artificial Sequence
  Description of Artificial Sequence: Synthetic oligonucleotide
cctgcccctctgggccccaaca

SEQ ID NO: 223141 - DNA, 23 bp, Artificial Sequence
  Description of Artificial Sequence: Synthetic oligonucleotide
ctgcccctctgggccccaacact

SEQ ID NO: 223142 - DNA, 23 bp, Artificial Sequence
  Description of Artificial Sequence: Synthetic oligonucleotide
tgcccctctgggccccaacactg

SEQ ID NO: 223143 - DNA, 22 bp, Artificial Sequence
  Description of Artificial Sequence: Synthetic oligonucleotide
gcccctctgggccccaacactg

SEQ ID NO: 223144 - DNA, 24 bp, Artificial Sequence
  Description of Artificial Sequence: Synthetic oligonucleotide
cccctctgggccccaacactggaa

SEQ ID NO: 223145 - DNA, 24 bp, Artificial Sequence
  Description of Artificial Sequence: Synthetic oligonucleotide
ccctctgggccccaacactggaag

SEQ ID NO: 223146 - DNA, 25 bp, Artificial Sequence
  Description of Artificial Sequence: Synthetic oligonucleotide
cctctgggccccaacactggaagca

SEQ ID NO: 223147 - DNA, 25 bp, Artificial Sequence
  Description of Artificial Sequence: Synthetic oligonucleotide
ctctgggccccaacactggaagcag

SEQ ID NO: 223148 - DNA, 26 bp, Artificial Sequence
  Description of Artificial Sequence: Synthetic oligonucleotide
tctgggccccaacactggaagcagct

SEQ ID NO: 223149 - DNA, 25 bp, Artificial Sequence
  Description of Artificial Sequence: Synthetic oligonucleotide
ctgggccccaacactggaagcagct

SEQ ID NO: 223150 - DNA, 26 bp, Artificial Sequence
  Description of Artificial Sequence: Synthetic oligonucleotide
tgggccccaacactggaagcagctct

SEQ ID NO: 223151 - DNA, 25 bp, Artificial Sequence
  Description of Artificial Sequence: Synthetic oligonucleotide
gggccccaacactggaagcagctct

SEQ ID NO: 223152 - DNA, 27 bp, Artificial Sequence
  Description of Artificial Sequence: Synthetic oligonucleotide
ggccccaacactggaagcagctctcat

SEQ ID NO: 223153 - DNA, 28 bp, Artificial Sequence
  Description of Artificial Sequence: Synthetic oligonucleotide
gccccaacactggaagcagctctcattc

SEQ ID NO: 223154 - DNA, 29 bp, Artificial Sequence
  Description of Artificial Sequence: Synthetic oligonucleotide
ccccaacactggaagcagctctcattctc

SEQ ID NO: 223155 - DNA, 29 bp, Artificial Sequence
  Description of Artificial Sequence: Synthetic oligonucleotide
cccaacactggaagcagctctcattctcc

SEQ ID NO: 223156 - DNA, 30 bp, Artificial Sequence
  Description of Artificial Sequence: Synthetic oligonucleotide
ccaacactggaagcagctctcattctcctc

SEQ ID NO: 223157 - DNA, 32 bp, Artificial Sequence
  Description of Artificial Sequence: Synthetic oligonucleotide
caacactggaagcagctctcattctcctcttc

SEQ ID NO: 223158 - DNA, 30 bp, Artificial Sequence
  Description of Artificial Sequence: Synthetic oligonucleotide
gatgctgtcttggggaaggtcaacttggag

SEQ ID NO: 223159 - DNA, 30 bp, Artificial Sequence
  Description of Artificial Sequence: Synthetic oligonucleotide
atgctgtcttggggaaggtcaacttggagc

SEQ ID NO: 223160 - DNA, 29 bp, Artificial Sequence
  Description of Artificial Sequence: Synthetic oligonucleotide
tgctgtcttggggaaggtcaacttggagc

SEQ ID NO: 223161 - DNA, 28 bp, Artificial Sequence
  Description of Artificial Sequence: Synthetic oligonucleotide
gctgtcttggggaaggtcaacttggagc

SEQ ID NO: 223162 - DNA, 29 bp, Artificial Sequence
  Description of Artificial Sequence: Synthetic oligonucleotide
ctgtcttggggaaggtcaacttggagcag

SEQ ID NO: 223163 - DNA, 31 bp, Artificial Sequence
  Description of Artificial Sequence: Synthetic oligonucleotide
tgtcttggggaaggtcaacttggagcagttg

SEQ ID NO: 223164 - DNA, 30 bp, Artificial Sequence
  Description of Artificial Sequence: Synthetic oligonucleotide
gtcttggggaaggtcaacttggagcagttg

SEQ ID NO: 223165 - DNA, 30 bp, Artificial Sequence
  Description of Artificial Sequence: Synthetic oligonucleotide
tcttggggaaggtcaacttggagcagttgg

SEQ ID NO: 223166 - DNA, 29 bp, Artificial Sequence
  Description of Artificial Sequence: Synthetic oligonucleotide
cttggggaaggtcaacttggagcagttgg

SEQ ID NO: 223167 - DNA, 30 bp, Artificial Sequence
  Description of Artificial Sequence: Synthetic oligonucleotide
ttggggaaggtcaacttggagcagttggtg

SEQ ID NO: 223168 - DNA, 29 bp, Artificial Sequence
  Description of Artificial Sequence: Synthetic oligonucleotide
tggggaaggtcaacttggagcagttggtg

SEQ ID NO: 223169 - DNA, 28 bp, Artificial Sequence
  Description of Artificial Sequence: Synthetic oligonucleotide
ggggaaggtcaacttggagcagttggtg

SEQ ID NO: 223170 - DNA, 28 bp, Artificial Sequence
  Description of Artificial Sequence: Synthetic oligonucleotide
gggaaggtcaacttggagcagttggtgg

SEQ ID NO: 223171 - DNA, 29 bp, Artificial Sequence
  Description of Artificial Sequence: Synthetic oligonucleotide
ggaaggtcaacttggagcagttggtggtg

SEQ ID NO: 223172 - DNA, 31 bp, Artificial Sequence
  Description of Artificial Sequence: Synthetic oligonucleotide
gaaggtcaacttggagcagttggtggtgatg

SEQ ID NO: 223173 - DNA, 31 bp, Artificial Sequence
  Description of Artificial Sequence: Synthetic oligonucleotide
aaggtcaacttggagcagttggtggtgatgg

SEQ ID NO: 223174 - DNA, 30 bp, Artificial Sequence
  Description of Artificial Sequence: Synthetic oligonucleotide
aggtcaacttggagcagttggtggtgatgg

SEQ ID NO: 223175 - DNA, 29 bp, Artificial Sequence
  Description of Artificial Sequence: Synthetic oligonucleotide
ggtcaacttggagcagttggtggtgatgg

SEQ ID NO: 223176 - DNA, 30 bp, Artificial Sequence
  Description of Artificial Sequence: Synthetic oligonucleotide
gtcaacttggagcagttggtggtgatggtg

SEQ ID NO: 223177 - DNA, 30 bp, Artificial Sequence
  Description of Artificial Sequence: Synthetic oligonucleotide
tcaacttggagcagttggtggtgatggtgc

SEQ ID NO: 223178 - DNA, 29 bp, Artificial Sequence
  Description of Artificial Sequence: Synthetic oligonucleotide
caacttggagcagttggtggtgatggtgc

SEQ ID NO: 223179 - DNA, 30 bp, Artificial Sequence
  Description of Artificial Sequence: Synthetic oligonucleotide
aacttggagcagttggtggtgatggtgctg

SEQ ID NO: 223180 - DNA, 29 bp, Artificial Sequence
  Description of Artificial Sequence: Synthetic oligonucleotide
acttggagcagttggtggtgatggtgctg

SEQ ID NO: 223181 - DNA, 28 bp, Artificial Sequence
  Description of Artificial Sequence: Synthetic oligonucleotide
cttggagcagttggtggtgatggtgctg

SEQ ID NO: 223182 - DNA, 28 bp, Artificial Sequence
  Description of Artificial Sequence: Synthetic oligonucleotide
ttggagcagttggtggtgatggtgctgg

SEQ ID NO: 223183 - DNA, 27 bp, Artificial Sequence
  Description of Artificial Sequence: Synthetic oligonucleotide
tggagcagttggtggtgatggtgctgg

SEQ ID NO: 223184 - DNA, 27 bp, Artificial Sequence
  Description of Artificial Sequence: Synthetic oligonucleotide
ggagcagttggtggtgatggtgctggt

SEQ ID NO: 223185 - DNA, 27 bp, Artificial Sequence
  Description of Artificial Sequence: Synthetic oligonucleotide
gagcagttggtggtgatggtgctggtg

SEQ ID NO: 223186 - DNA, 27 bp, Artificial Sequence
  Description of Artificial Sequence: Synthetic oligonucleotide
agcagttggtggtgatggtgctggtgg

SEQ ID NO: 223187 - DNA, 32 bp, Artificial Sequence
  Description of Artificial Sequence: Synthetic oligonucleotide
aactcagcttggccatcgtgatagctctcatg

SEQ ID NO: 223188 - DNA, 31 bp, Artificial Sequence
  Description of Artificial Sequence: Synthetic oligonucleotide
actcagcttggccatcgtgatagctctcatg

SEQ ID NO: 223189 - DNA, 30 bp, Artificial Sequence
  Description of Artificial Sequence: Synthetic oligonucleotide
ctcagcttggccatcgtgatagctctcatg

SEQ ID NO: 223190 - DNA, 31 bp, Artificial Sequence
  Description of Artificial Sequence: Synthetic oligonucleotide
tcagcttggccatcgtgatagctctcatgtc

SEQ ID NO: 223191 - DNA, 30 bp, Artificial Sequence
  Description of Artificial Sequence: Synthetic oligonucleotide
cagcttggccatcgtgatagctctcatgtc

SEQ ID NO: 223192 - DNA, 31 bp, Artificial Sequence
  Description of Artificial Sequence: Synthetic oligonucleotide
agcttggccatcgtgatagctctcatgtctg

SEQ ID NO: 223193 - DNA, 30 bp, Artificial Sequence
  Description of Artificial Sequence: Synthetic oligonucleotide
gcttggccatcgtgatagctctcatgtctg

SEQ ID NO: 223194 - DNA, 30 bp, Artificial Sequence
  Description of Artificial Sequence: Synthetic oligonucleotide
cttggccatcgtgatagctctcatgtctgg

SEQ ID NO: 223195 - DNA, 31 bp, Artificial Sequence
  Description of Artificial Sequence: Synthetic oligonucleotide
ttggccatcgtgatagctctcatgtctggtc

SEQ ID NO: 223196 - DNA, 30 bp, Artificial Sequence
  Description of Artificial Sequence: Synthetic oligonucleotide
tggccatcgtgatagctctcatgtctggtc

SEQ ID NO: 223197 - DNA, 29 bp, Artificial Sequence
  Description of Artificial Sequence: Synthetic oligonucleotide
ggccatcgtgatagctctcatgtctggtc

SEQ ID NO: 223198 - DNA, 30 bp, Artificial Sequence
  Description of Artificial Sequence: Synthetic oligonucleotide
gccatcgtgatagctctcatgtctggtctc

SEQ ID NO: 223199 - DNA, 30 bp, Artificial Sequence
  Description of Artificial Sequence: Synthetic oligonucleotide
ccatcgtgatagctctcatgtctggtctcc

SEQ ID NO: 223200 - DNA, 31 bp, Artificial Sequence
  Description of Artificial Sequence: Synthetic oligonucleotide
catcgtgatagctctcatgtctggtctcctg

SEQ ID NO: 223201 - DNA, 32 bp, Artificial Sequence
  Description of Artificial Sequence: Synthetic oligonucleotide
atcgtgatagctctcatgtctggtctcctgac

SEQ ID NO: 223202 - DNA, 31 bp, Artificial Sequence
  Description of Artificial Sequence: Synthetic oligonucleotide
tcgtgatagctctcatgtctggtctcctgac

SEQ ID NO: 223203 - DNA, 30 bp, Artificial Sequence
  Description of Artificial Sequence: Synthetic oligonucleotide
cgtgatagctctcatgtctggtctcctgac

SEQ ID NO: 223204 - DNA, 31 bp, Artificial Sequence
  Description of Artificial Sequence: Synthetic oligonucleotide
gtgatagctctcatgtctggtctcctgacag

SEQ ID NO: 223205 - DNA, 31 bp, Artificial Sequence
  Description of Artificial Sequence: Synthetic oligonucleotide
tgatagctctcatgtctggtctcctgacagg

SEQ ID NO: 223206 - DNA, 30 bp, Artificial Sequence
  Description of Artificial Sequence: Synthetic oligonucleotide
gatagctctcatgtctggtctcctgacagg

SEQ ID NO: 223207 - DNA, 33 bp, Artificial Sequence
  Description of Artificial Sequence: Synthetic oligonucleotide
atagctctcatgtctggtctcctgacaggtttg

SEQ ID NO: 223208 - DNA, 32 bp, Artificial Sequence
  Description of Artificial Sequence: Synthetic oligonucleotide
tagctctcatgtctggtctcctgacaggtttg

SEQ ID NO: 223209 - DNA, 31 bp, Artificial Sequence
  Description of Artificial Sequence: Synthetic oligonucleotide
agctctcatgtctggtctcctgacaggtttg

SEQ ID NO: 223210 - DNA, 30 bp, Artificial Sequence
  Description of Artificial Sequence: Synthetic oligonucleotide
gctctcatgtctggtctcctgacaggtttg

SEQ ID NO: 223211 - DNA, 30 bp, Artificial Sequence
  Description of Artificial Sequence: Synthetic oligonucleotide
ctctcatgtctggtctcctgacaggtttgc

SEQ ID NO: 223212 - DNA, 31 bp, Artificial Sequence
  Description of Artificial Sequence: Synthetic oligonucleotide
tctcatgtctggtctcctgacaggtttgctc

SEQ ID NO: 223213 - DNA, 30 bp, Artificial Sequence
  Description of Artificial Sequence: Synthetic oligonucleotide
ctcatgtctggtctcctgacaggtttgctc

SEQ ID NO: 223214 - DNA, 30 bp, Artificial Sequence
  Description of Artificial Sequence: Synthetic oligonucleotide
tcatgtctggtctcctgacaggtttgctcc

SEQ ID NO: 223215 - DNA, 29 bp, Artificial Sequence
  Description of Artificial Sequence: Synthetic oligonucleotide
catgtctggtctcctgacaggtttgctcc

SEQ ID NO: 223216 - DNA, 34 bp, Artificial Sequence
  Description of Artificial Sequence: Synthetic oligonucleotide
atgtctggtctcctgacaggtttgctcctaaatc

SEQ ID NO: 223217 - DNA, 33 bp, Artificial Sequence
  Description of Artificial Sequence: Synthetic oligonucleotide
tgtctggtctcctgacaggtttgctcctaaatc

SEQ ID NO: 223218 - DNA, 34 bp, Artificial Sequence
  Description of Artificial Sequence: Synthetic oligonucleotide
catgttcaacacctactatgctgtagcagtcagc

SEQ ID NO: 223219 - DNA, 34 bp, Artificial Sequence
  Description of Artificial Sequence: Synthetic oligonucleotide
atgttcaacacctactatgctgtagcagtcagcg

SEQ ID NO: 223220 - DNA, 39 bp, Artificial Sequence
  Description of Artificial Sequence: Synthetic oligonucleotide
aagtttcaactctgctctgctgagaagtccaatcaaaag

SEQ ID NO: 223221 - DNA, 38 bp, Artificial Sequence
  Description of Artificial Sequence: Synthetic oligonucleotide
agtttcaactctgctctgctgagaagtccaatcaaaag

SEQ ID NO: 223222 - DNA, 37 bp, Artificial Sequence
  Description of Artificial Sequence: Synthetic oligonucleotide
gtttcaactctgctctgctgagaagtccaatcaaaag

SEQ ID NO: 223223 - DNA, 37 bp, Artificial Sequence
  Description of Artificial Sequence: Synthetic oligonucleotide
tttcaactctgctctgctgagaagtccaatcaaaagg

SEQ ID NO: 223224 - DNA, 36 bp, Artificial Sequence
  Description of Artificial Sequence: Synthetic oligonucleotide
ttcaactctgctctgctgagaagtccaatcaaaagg

SEQ ID NO: 223225 - DNA, 35 bp, Artificial Sequence
  Description of Artificial Sequence: Synthetic oligonucleotide
tcaactctgctctgctgagaagtccaatcaaaagg

SEQ ID NO: 223226 - DNA, 34 bp, Artificial Sequence
  Description of Artificial Sequence: Synthetic oligonucleotide
caactctgctctgctgagaagtccaatcaaaagg

SEQ ID NO: 223227 - DNA, 36 bp, Artificial Sequence
  Description of Artificial Sequence: Synthetic oligonucleotide
aactctgctctgctgagaagtccaatcaaaaggaag

SEQ ID NO: 223228 - DNA, 35 bp, Artificial Sequence
  Description of Artificial Sequence: Synthetic oligonucleotide
actctgctctgctgagaagtccaatcaaaaggaag

SEQ ID NO: 223229 - DNA, 34 bp, Artificial Sequence
  Description of Artificial Sequence: Synthetic oligonucleotide
ctctgctctgctgagaagtccaatcaaaaggaag

SEQ ID NO: 223230 - DNA, 37 bp, Artificial Sequence
  Description of Artificial Sequence: Synthetic oligonucleotide
tctgctctgctgagaagtccaatcaaaaggaagaatg

SEQ ID NO: 223231 - DNA, 36 bp, Artificial Sequence
  Description of Artificial Sequence: Synthetic oligonucleotide
ctgctctgctgagaagtccaatcaaaaggaagaatg

SEQ ID NO: 223232 - DNA, 36 bp, Artificial Sequence
  Description of Artificial Sequence: Synthetic oligonucleotide
tgctctgctgagaagtccaatcaaaaggaagaatgc

SEQ ID NO: 223233 - DNA, 35 bp, Artificial Sequence
  Description of Artificial Sequence: Synthetic oligonucleotide
gctctgctgagaagtccaatcaaaaggaagaatgc

SEQ ID NO: 223234 - DNA, 35 bp, Artificial Sequence
  Description of Artificial Sequence: Synthetic oligonucleotide
ctctgctgagaagtccaatcaaaaggaagaatgcc

SEQ ID NO: 223235 - DNA, 35 bp, Artificial Sequence
  Description of Artificial Sequence: Synthetic oligonucleotide
tctgctgagaagtccaatcaaaaggaagaatgccg

SEQ ID NO: 223236 - DNA, 34 bp, Artificial Sequence
  Description of Artificial Sequence: Synthetic oligonucleotide
ctgctgagaagtccaatcaaaaggaagaatgccg

SEQ ID NO: 223237 - DNA, 35 bp, Artificial Sequence
  Description of Artificial Sequence: Synthetic oligonucleotide
tgctgagaagtccaatcaaaaggaagaatgccgtg

SEQ ID NO: 223238 - DNA, 34 bp, Artificial Sequence
  Description of Artificial Sequence: Synthetic oligonucleotide
gctgagaagtccaatcaaaaggaagaatgccgtg

SEQ ID NO: 223239 - DNA, 36 bp, Artificial Sequence
  Description of Artificial Sequence: Synthetic oligonucleotide
ctgagaagtccaatcaaaaggaagaatgccgtgttc

SEQ ID NO: 223240 - DNA, 38 bp, Artificial Sequence
  Description of Artificial Sequence: Synthetic oligonucleotide
tgagaagtccaatcaaaaggaagaatgccgtgttcaac

SEQ ID NO: 223241 - DNA, 37 bp, Artificial Sequence
  Description of Artificial Sequence: Synthetic oligonucleotide
gagaagtccaatcaaaaggaagaatgccgtgttcaac

SEQ ID NO: 223242 - DNA, 38 bp, Artificial Sequence
  Description of Artificial Sequence: Synthetic oligonucleotide
agaagtccaatcaaaaggaagaatgccgtgttcaacac

SEQ ID NO: 223243 - DNA, 37 bp, Artificial Sequence
  Description of Artificial Sequence: Synthetic oligonucleotide
gaagtccaatcaaaaggaagaatgccgtgttcaacac

SEQ ID NO: 223244 - DNA, 37 bp, Artificial Sequence
  Description of Artificial Sequence: Synthetic oligonucleotide
aagtccaatcaaaaggaagaatgccgtgttcaacacc

SEQ ID NO: 223245 - DNA, 36 bp, Artificial Sequence
  Description of Artificial Sequence: Synthetic oligonucleotide
agtccaatcaaaaggaagaatgccgtgttcaacacc

SEQ ID NO: 223246 - DNA, 35 bp, Artificial Sequence
  Description of Artificial Sequence: Synthetic oligonucleotide
gtccaatcaaaaggaagaatgccgtgttcaacacc

SEQ ID NO: 223247 - DNA, 37 bp, Artificial Sequence
  Description of Artificial Sequence: Synthetic oligonucleotide
tccaatcaaaaggaagaatgccgtgttcaacacctac

SEQ ID NO: 223248 - DNA, 36 bp, Artificial Sequence
  Description of Artificial Sequence: Synthetic oligonucleotide
ccaatcaaaaggaagaatgccgtgttcaacacctac

SEQ ID NO: 223249 - DNA, 39 bp, Artificial Sequence
  Description of Artificial Sequence: Synthetic oligonucleotide
caatcaaaaggaagaatgccgtgttcaacacctactatg

SEQ ID NO: 223250 - DNA, 39 bp, Artificial Sequence
  Description of Artificial Sequence: Synthetic oligonucleotide
aatcaaaaggaagaatgccgtgttcaacacctactatgc

SEQ ID NO: 223251 - DNA, 38 bp, Artificial Sequence
  Description of Artificial Sequence: Synthetic oligonucleotide
atcaaaaggaagaatgccgtgttcaacacctactatgc

SEQ ID NO: 223252 - DNA, 37 bp, Artificial Sequence
  Description of Artificial Sequence: Synthetic oligonucleotide
tcaaaaggaagaatgccgtgttcaacacctactatgc

SEQ ID NO: 223253 - DNA, 36 bp, Artificial Sequence
  Description of Artificial Sequence: Synthetic oligonucleotide
caaaaggaagaatgccgtgttcaacacctactatgc

SEQ ID NO: 223254 - DNA, 37 bp, Artificial Sequence
  Description of Artificial Sequence: Synthetic oligonucleotide
aaaaggaagaatgccgtgttcaacacctactatgctg

SEQ ID NO: 223255 - DNA, 35 bp, Artificial Sequence
  Description of Artificial Sequence: Synthetic oligonucleotide
aagtttcaactctgctctgctgagaagtccaatcc

SEQ ID NO: 223256 - DNA, 34 bp, Artificial Sequence
  Description of Artificial Sequence: Synthetic oligonucleotide
agtttcaactctgctctgctgagaagtccaatcc

SEQ ID NO: 223257 - DNA, 33 bp, Artificial Sequence
  Description of Artificial Sequence: Synthetic oligonucleotide
gtttcaactctgctctgctgagaagtccaatcc

SEQ ID NO: 223258 - DNA, 36 bp, Artificial Sequence
  Description of Artificial Sequence: Synthetic oligonucleotide
tttcaactctgctctgctgagaagtccaatccaaag

SEQ ID NO: 223259 - DNA, 35 bp, Artificial Sequence
  Description of Artificial Sequence: Synthetic oligonucleotide
ttcaactctgctctgctgagaagtccaatccaaag

SEQ ID NO: 223260 - DNA, 23 bp, Artificial Sequence
  Description of Artificial Sequence: Synthetic oligonucleotide
gggggagccaagtacctgccggt

SEQ ID NO: 223261 - DNA, 24 bp, Artificial Sequence
  Description of Artificial Sequence: Synthetic oligonucleotide
ggggagccaagtacctgccggtgt

SEQ ID NO: 223262 - DNA, 26 bp, Artificial Sequence
  Description of Artificial Sequence: Synthetic oligonucleotide
gggagccaagtacctgccggtgtgtt

SEQ ID NO: 223263 - DNA, 27 bp, Artificial Sequence
  Description of Artificial Sequence: Synthetic oligonucleotide
ggagccaagtacctgccggtgtgttgt

SEQ ID NO: 223264 - DNA, 29 bp, Artificial Sequence
  Description of Artificial Sequence: Synthetic oligonucleotide
gagccaagtacctgccggtgtgttgtaac

SEQ ID NO: 223265 - DNA, 29 bp, Artificial Sequence
  Description of Artificial Sequence: Synthetic oligonucleotide
agccaagtacctgccggtgtgttgtaacc

SEQ ID NO: 223266 - DNA, 28 bp, Artificial Sequence
  Description of Artificial Sequence: Synthetic oligonucleotide
gccaagtacctgccggtgtgttgtaacc

SEQ ID NO: 223267 - DNA, 28 bp, Artificial Sequence
  Description of Artificial Sequence: Synthetic oligonucleotide
ccaagtacctgccggtgtgttgtaaccg

SEQ ID NO: 223268 - DNA, 29 bp, Artificial Sequence
  Description of Artificial Sequence: Synthetic oligonucleotide
caagtacctgccggtgtgttgtaaccgag

SEQ ID NO: 223269 - DNA, 30 bp, Artificial Sequence
  Description of Artificial Sequence: Synthetic oligonucleotide
aagtacctgccggtgtgttgtaaccgagtg

SEQ ID NO: 223270 - DNA, 29 bp, Artificial Sequence
  Description of Artificial Sequence: Synthetic oligonucleotide
agtacctgccggtgtgttgtaaccgagtg

SEQ ID NO: 223271 - DNA, 28 bp, Artificial Sequence
  Description of Artificial Sequence: Synthetic oligonucleotide
gtacctgccggtgtgttgtaaccgagtg

SEQ ID NO: 223272 - DNA, 28 bp, Artificial Sequence
  Description of Artificial Sequence: Synthetic oligonucleotide
tacctgccggtgtgttgtaaccgagtgc

SEQ ID NO: 223273 - DNA, 27 bp, Artificial Sequence
  Description of Artificial Sequence: Synthetic oligonucleotide
acctgccggtgtgttgtaaccgagtgc

SEQ ID NO: 223274 - DNA, 39 bp, Artificial Sequence
  Description of Artificial Sequence: Synthetic oligonucleotide
caacctgaggatggtcatcagtaatatcttcaacactac

SEQ ID NO: 223275 - DNA, 39 bp, Artificial Sequence
  Description of Artificial Sequence: Synthetic oligonucleotide
aacctgaggatggtcatcagtaatatcttcaacactacc

SEQ ID NO: 223276 - DNA, 38 bp, Artificial Sequence
  Description of Artificial Sequence: Synthetic oligonucleotide
acctgaggatggtcatcagtaatatcttcaacactacc

SEQ ID NO: 223277 - DNA, 37 bp, Artificial Sequence
  Description of Artificial Sequence: Synthetic oligonucleotide
cctgaggatggtcatcagtaatatcttcaacactacc

SEQ ID NO: 223278 - DNA, 38 bp, Artificial Sequence
  Description of Artificial Sequence: Synthetic oligonucleotide
ctgaggatggtcatcagtaatatcttcaacactaccac

SEQ ID NO: 223279 - DNA, 40 bp, Artificial Sequence
  Description of Artificial Sequence: Synthetic oligonucleotide
tgaggatggtcatcagtaatatcttcaacactaccacatg

SEQ ID NO: 223280 - DNA, 39 bp, Artificial Sequence
  Description of Artificial Sequence: Synthetic oligonucleotide
gaggatggtcatcagtaatatcttcaacactaccacatg

SEQ ID NO: 223281 - DNA, 41 bp, Artificial Sequence
  Description of Artificial Sequence: Synthetic oligonucleotide
aggatggtcatcagtaatatcttcaacactaccacatgaac

SEQ ID NO: 223282 - DNA, 40 bp, Artificial Sequence
  Description of Artificial Sequence: Synthetic oligonucleotide
ggatggtcatcagtaatatcttcaacactaccacatgaac

SEQ ID NO: 223283 - DNA, 42 bp, Artificial Sequence
  Description of Artificial Sequence: Synthetic oligonucleotide
gatggtcatcagtaatatcttcaacactaccacatgaacatg

SEQ ID NO: 223284 - DNA, 44 bp, Artificial Sequence
  Description of Artificial Sequence: Synthetic oligonucleotide
atggtcatcagtaatatcttcaacactaccacatgaacatgatg

SEQ ID NO: 223285 - DNA, 43 bp, Artificial Sequence
  Description of Artificial Sequence: Synthetic oligonucleotide
tggtcatcagtaatatcttcaacactaccacatgaacatgatg

SEQ ID NO: 223286 - DNA, 42 bp, Artificial Sequence
  Description of Artificial Sequence: Synthetic oligonucleotide
ggtcatcagtaatatcttcaacactaccacatgaacatgatg

SEQ ID NO: 223287 - DNA, 42 bp, Artificial Sequence
  Description of Artificial Sequence: Synthetic oligonucleotide
gtcatcagtaatatcttcaacactaccacatgaacatgatgc

SEQ ID NO: 223288 - DNA, 43 bp, Artificial Sequence
  Description of Artificial Sequence: Synthetic oligonucleotide
tcatcagtaatatcttcaacactaccacatgaacatgatgcac

SEQ ID NO: 223289 - DNA, 42 bp, Artificial Sequence
  Description of Artificial Sequence: Synthetic oligonucleotide
catcagtaatatcttcaacactaccacatgaacatgatgcac

SEQ ID NO: 223290 - DNA, 44 bp, Artificial Sequence
  Description of Artificial Sequence: Synthetic oligonucleotide
atcagtaatatcttcaacactaccacatgaacatgatgcacatc

SEQ ID NO: 223291 - DNA, 43 bp, Artificial Sequence
  Description of Artificial Sequence: Synthetic oligonucleotide
tcagtaatatcttcaacactaccacatgaacatgatgcacatc

SEQ ID NO: 223292 - DNA, 42 bp, Artificial Sequence
  Description of Artificial Sequence: Synthetic oligonucleotide
cagtaatatcttcaacactaccacatgaacatgatgcacatc

SEQ ID NO: 223293 - DNA, 44 bp, Artificial Sequence
  Description of Artificial Sequence: Synthetic oligonucleotide
agtaatatcttcaacactaccacatgaacatgatgcacatctac

SEQ ID NO: 223294 - DNA, 43 bp, Artificial Sequence
  Description of Artificial Sequence: Synthetic oligonucleotide
gtaatatcttcaacactaccacatgaacatgatgcacatctac

SEQ ID NO: 223295 - DNA, 43 bp, Artificial Sequence
  Description of Artificial Sequence: Synthetic oligonucleotide
taatatcttcaacactaccacatgaacatgatgcacatctacg

SEQ ID NO: 223296 - DNA, 42 bp, Artificial Sequence
  Description of Artificial Sequence: Synthetic oligonucleotide
aatatcttcaacactaccacatgaacatgatgcacatctacg

SEQ ID NO: 223297 - DNA, 41 bp, Artificial Sequence
  Description of Artificial Sequence: Synthetic oligonucleotide
atatcttcaacactaccacatgaacatgatgcacatctacg

SEQ ID NO: 223298 - DNA, 40 bp, Artificial Sequence
  Description of Artificial Sequence: Synthetic oligonucleotide
tatcttcaacactaccacatgaacatgatgcacatctacg

SEQ ID NO: 223299 - DNA, 39 bp, Artificial Sequence
  Description of Artificial Sequence: Synthetic oligonucleotide
atcttcaacactaccacatgaacatgatgcacatctacg

SEQ ID NO: 223300 - DNA, 38 bp, Artificial Sequence
  Description of Artificial Sequence: Synthetic oligonucleotide
tcttcaacactaccacatgaacatgatgcacatctacg

SEQ ID NO: 223301 - DNA, 37 bp, Artificial Sequence
  Description of Artificial Sequence: Synthetic oligonucleotide
cttcaacactaccacatgaacatgatgcacatctacg

SEQ ID NO: 223302 - DNA, 38 bp, Artificial Sequence
  Description of Artificial Sequence: Synthetic oligonucleotide
ttcaacactaccacatgaacatgatgcacatctacgtg

SEQ ID NO: 223303 - DNA, 37 bp, Artificial Sequence
  Description of Artificial Sequence: Synthetic oligonucleotide
tcaacactaccacatgaacatgatgcacatctacgtg

SEQ ID NO: 223304 - DNA, 36 bp, Artificial Sequence
  Description of Artificial Sequence: Synthetic oligonucleotide
caacactaccacatgaacatgatgcacatctacgtg

SEQ ID NO: 223305 - DNA, 38 bp, Artificial Sequence
  Description of Artificial Sequence: Synthetic oligonucleotide
aacactaccacatgaacatgatgcacatctacgtgttc

SEQ ID NO: 223306 - DNA, 37 bp, Artificial Sequence
  Description of Artificial Sequence: Synthetic oligonucleotide
acactaccacatgaacatgatgcacatctacgtgttc

SEQ ID NO: 223307 - DNA, 36 bp, Artificial Sequence
  Description of Artificial Sequence: Synthetic oligonucleotide
cactaccacatgaacatgatgcacatctacgtgttc

SEQ ID NO: 223308 - DNA, 33 bp, Artificial Sequence
  Description of Artificial Sequence: Synthetic oligonucleotide
ctgagaagtccaatcgaaaggaagaatgccgtc

SEQ ID NO: 223309 - DNA, 35 bp, Artificial Sequence
  Description of Artificial Sequence: Synthetic oligonucleotide
tgagaagtccaatcgaaaggaagaatgccgtcttc

SEQ ID NO: 223310 - DNA, 34 bp, Artificial Sequence
  Description of Artificial Sequence: Synthetic oligonucleotide
gagaagtccaatcgaaaggaagaatgccgtcttc

SEQ ID NO: 223311 - DNA, 36 bp, Artificial Sequence
  Description of Artificial Sequence: Synthetic oligonucleotide
agaagtccaatcgaaaggaagaatgccgtcttcaac

SEQ ID NO: 223312 - DNA, 35 bp, Artificial Sequence
  Description of Artificial Sequence: Synthetic oligonucleotide
gaagtccaatcgaaaggaagaatgccgtcttcaac

SEQ ID NO: 223313 - DNA, 36 bp, Artificial Sequence
  Description of Artificial Sequence: Synthetic oligonucleotide
aagtccaatcgaaaggaagaatgccgtcttcaacac

SEQ ID NO: 223314 - DNA, 35 bp, Artificial Sequence
  Description of Artificial Sequence: Synthetic oligonucleotide
agtccaatcgaaaggaagaatgccgtcttcaacac

SEQ ID NO: 223315 - DNA, 34 bp, Artificial Sequence
  Description of Artificial Sequence: Synthetic oligonucleotide
gtccaatcgaaaggaagaatgccgtcttcaacac

SEQ ID NO: 223316 - DNA, 34 bp, Artificial Sequence
  Description of Artificial Sequence: Synthetic oligonucleotide
tccaatcgaaaggaagaatgccgtcttcaacacc

SEQ ID NO: 223317 - DNA, 33 bp, Artificial Sequence
  Description of Artificial Sequence: Synthetic oligonucleotide
ccaatcgaaaggaagaatgccgtcttcaacacc

SEQ ID NO: 223318 - DNA, 35 bp, Artificial Sequence
  Description of Artificial Sequence: Synthetic oligonucleotide
caatcgaaaggaagaatgccgtcttcaacacctac

SEQ ID NO: 223319 - DNA, 38 bp, Artificial Sequence
  Description of Artificial Sequence: Synthetic oligonucleotide
aatcgaaaggaagaatgccgtcttcaacacctactatg

SEQ ID NO: 223320 - DNA, 37 bp, Artificial Sequence
  Description of Artificial Sequence: Synthetic oligonucleotide
atcgaaaggaagaatgccgtcttcaacacctactatg

SEQ ID NO: 223321 - DNA, 36 bp, Artificial Sequence
  Description of Artificial Sequence: Synthetic oligonucleotide
tcgaaaggaagaatgccgtcttcaacacctactatg

SEQ ID NO: 223322 - DNA, 35 bp, Artificial Sequence
  Description of Artificial Sequence: Synthetic oligonucleotide
cgaaaggaagaatgccgtcttcaacacctactatg

SEQ ID NO: 223323 - DNA, 35 bp, Artificial Sequence
  Description of Artificial Sequence: Synthetic oligonucleotide
gaaaggaagaatgccgtcttcaacacctactatgc

SEQ ID NO: 223324 - DNA, 36 bp, Artificial Sequence
  Description of Artificial Sequence: Synthetic oligonucleotide
aaaggaagaatgccgtcttcaacacctactatgctg

SEQ ID NO: 223325 - DNA, 35 bp, Artificial Sequence
  Description of Artificial Sequence: Synthetic oligonucleotide
aaggaagaatgccgtcttcaacacctactatgctg

SEQ ID NO: 223326 - DNA, 34 bp, Artificial Sequence
  Description of Artificial Sequence: Synthetic oligonucleotide
aggaagaatgccgtcttcaacacctactatgctg

SEQ ID NO: 223327 - DNA, 33 bp, Artificial Sequence
  Description of Artificial Sequence: Synthetic oligonucleotide
ggaagaatgccgtcttcaacacctactatgctg

SEQ ID NO: 223328 - DNA, 35 bp, Artificial Sequence
  Description of Artificial Sequence: Synthetic oligonucleotide
gaagaatgccgtcttcaacacctactatgctgtag

SEQ ID NO: 223329 - DNA, 35 bp, Artificial Sequence
  Description of Artificial Sequence: Synthetic oligonucleotide
aagaatgccgtcttcaacacctactatgctgtagc

SEQ ID NO: 223330 - DNA, 34 bp, Artificial Sequence
  Description of Artificial Sequence: Synthetic oligonucleotide
agaatgccgtcttcaacacctactatgctgtagc

SEQ ID NO: 223331 - DNA, 33 bp, Artificial Sequence
  Description of Artificial Sequence: Synthetic oligonucleotide
gaatgccgtcttcaacacctactatgctgtagc

SEQ ID NO: 223332 - DNA, 34 bp, Artificial Sequence
  Description of Artificial Sequence: Synthetic oligonucleotide
aatgccgtcttcaacacctactatgctgtagcag

SEQ ID NO: 223333 - DNA, 33 bp, Artificial Sequence
  Description of Artificial Sequence: Synthetic oligonucleotide
atgccgtcttcaacacctactatgctgtagcag

SEQ ID NO: 223334 - DNA, 32 bp, Artificial Sequence
  Description of Artificial Sequence: Synthetic oligonucleotide
tgccgtcttcaacacctactatgctgtagcag

SEQ ID NO: 223335 - DNA, 31 bp, Artificial Sequence
  Description of Artificial Sequence: Synthetic oligonucleotide
gccgtcttcaacacctactatgctgtagcag

SEQ ID NO: 223336 - DNA, 32 bp, Artificial Sequence
  Description of Artificial Sequence: Synthetic oligonucleotide
ccgtcttcaacacctactatgctgtagcagtc

SEQ ID NO: 223337 - DNA, 33 bp, Artificial Sequence
  Description of Artificial Sequence: Synthetic oligonucleotide
cgtcttcaacacctactatgctgtagcagtcag

SEQ ID NO: 223338 - DNA, 33 bp, Artificial Sequence
  Description of Artificial Sequence: Synthetic oligonucleotide
gtcttcaacacctactatgctgtagcagtcagc

SEQ ID NO: 223339 - DNA, 33 bp, Artificial Sequence
  Description of Artificial Sequence: Synthetic oligonucleotide
tcttcaacacctactatgctgtagcagtcagcg

SEQ ID NO: 223340 - DNA, 32 bp, Artificial Sequence
  Description of Artificial Sequence: Synthetic oligonucleotide
cttcaacacctactatgctgtagcagtcagcg

SEQ ID NO: 223341 - DNA, 25 bp, Artificial Sequence
  Description of Artificial Sequence: Synthetic oligonucleotide
cccttggcttgggcttcctcacctc

SEQ ID NO: 223342 - DNA, 26 bp, Artificial Sequence
  Description of Artificial Sequence: Synthetic oligonucleotide
ccttggcttgggcttcctcacctcga

SEQ ID NO: 223343 - DNA, 27 bp, Artificial Sequence
  Description of Artificial Sequence: Synthetic oligonucleotide
cttggcttgggcttcctcacctcgagt

SEQ ID NO: 223344 - DNA, 34 bp, Artificial Sequence
  Description of Artificial Sequence: Synthetic oligonucleotide
gtgttcaacacctactatgctgtagcagtcagtg

SEQ ID NO: 223345 - DNA, 30 bp, Artificial Sequence
  Description of Artificial Sequence: Synthetic oligonucleotide
ttggctcacccccaaaggaagatcagcaag

SEQ ID NO: 223346 - DNA, 29 bp, Artificial Sequence
  Description of Artificial Sequence: Synthetic oligonucleotide
tggctcacccccaaaggaagatcagcaag

SEQ ID NO: 223347 - DNA, 28 bp, Artificial Sequence
  Description of Artificial Sequence: Synthetic oligonucleotide
ggctcacccccaaaggaagatcagcaag

SEQ ID NO: 223348 - DNA, 29 bp, Artificial Sequence
  Description of Artificial Sequence: Synthetic oligonucleotide
gctcacccccaaaggaagatcagcaagac

SEQ ID NO: 223349 - DNA, 33 bp, Artificial Sequence
  Description of Artificial Sequence: Synthetic oligonucleotide
ctcacccccaaaggaagatcagcaagacttatg

SEQ ID NO: 223350 - DNA, 34 bp, Artificial Sequence
  Description of Artificial Sequence: Synthetic oligonucleotide
tcacccccaaaggaagatcagcaagacttatgtg

SEQ ID NO: 223351 - DNA, 33 bp, Artificial Sequence
  Description of Artificial Sequence: Synthetic oligonucleotide
cacccccaaaggaagatcagcaagacttatgtg

SEQ ID NO: 223352 - DNA, 33 bp, Artificial Sequence
  Description of Artificial Sequence: Synthetic oligonucleotide
acccccaaaggaagatcagcaagacttatgtgc

SEQ ID NO: 223353 - DNA, 32 bp, Artificial Sequence
  Description of Artificial Sequence: Synthetic oligonucleotide
cccccaaaggaagatcagcaagacttatgtgc

SEQ ID NO: 223354 - DNA, 33 bp, Artificial Sequence
  Description of Artificial Sequence: Synthetic oligonucleotide
ccccaaaggaagatcagcaagacttatgtgcac

SEQ ID NO: 223355 - DNA, 34 bp, Artificial Sequence
  Description of Artificial Sequence: Synthetic oligonucleotide
cccaaaggaagatcagcaagacttatgtgcacag

SEQ ID NO: 223356 - DNA, 35 bp, Artificial Sequence
  Description of Artificial Sequence: Synthetic oligonucleotide
ccaaaggaagatcagcaagacttatgtgcacagtg

SEQ ID NO: 223357 - DNA, 35 bp, Artificial Sequence
  Description of Artificial Sequence: Synthetic oligonucleotide
caaaggaagatcagcaagacttatgtgcacagtgc

SEQ ID NO: 223358 - DNA, 35 bp, Artificial Sequence
  Description of Artificial Sequence: Synthetic oligonucleotide
aaaggaagatcagcaagacttatgtgcacagtgcg

SEQ ID NO: 223359 - DNA, 34 bp, Artificial Sequence
  Description of Artificial Sequence: Synthetic oligonucleotide
aaggaagatcagcaagacttatgtgcacagtgcg

SEQ ID NO: 223360 - DNA, 33 bp, Artificial Sequence
  Description of Artificial Sequence: Synthetic oligonucleotide
aggaagatcagcaagacttatgtgcacagtgcg

SEQ ID NO: 223361 - DNA, 31 bp, Artificial Sequence
  Description of Artificial Sequence: Synthetic oligonucleotide
tacccgagggaacggaggataaagatcagag

SEQ ID NO: 223362 - DNA, 30 bp, Artificial Sequence
  Description of Artificial Sequence: Synthetic oligonucleotide
acccgagggaacggaggataaagatcagag

SEQ ID NO: 223363 - DNA, 29 bp, Artificial Sequence
  Description of Artificial Sequence: Synthetic oligonucleotide
cccgagggaacggaggataaagatcagag

SEQ ID NO: 223364 - DNA, 30 bp, Artificial Sequence
  Description of Artificial Sequence: Synthetic oligonucleotide
ccgagggaacggaggataaagatcagagag

SEQ ID NO: 223365 - DNA, 30 bp, Artificial Sequence
  Description of Artificial Sequence: Synthetic oligonucleotide
cgagggaacggaggataaagatcagagagc

SEQ ID NO: 223366 - DNA, 32 bp, Artificial Sequence
  Description of Artificial Sequence: Synthetic oligonucleotide
gagggaacggaggataaagatcagagagcaac

SEQ ID NO: 223367 - DNA, 32 bp, Artificial Sequence
  Description of Artificial Sequence: Synthetic oligonucleotide
agggaacggaggataaagatcagagagcaacg

SEQ ID NO: 223368 - DNA, 31 bp, Artificial Sequence
  Description of Artificial Sequence: Synthetic oligonucleotide
gggaacggaggataaagatcagagagcaacg

SEQ ID NO: 223369 - DNA, 34 bp, Artificial Sequence
  Description of Artificial Sequence: Synthetic oligonucleotide
ggaacggaggataaagatcagagagcaacgatac

SEQ ID NO: 223370 - DNA, 34 bp, Artificial Sequence
  Description of Artificial Sequence: Synthetic oligonucleotide
gaacggaggataaagatcagagagcaacgatacc

SEQ ID NO: 223371 - DNA, 34 bp, Artificial Sequence
  Description of Artificial Sequence: Synthetic oligonucleotide
aacggaggataaagatcagagagcaacgataccc

SEQ ID NO: 223372 - DNA, 33 bp, Artificial Sequence
  Description of Artificial Sequence: Synthetic oligonucleotide
acggaggataaagatcagagagcaacgataccc

SEQ ID NO: 223373 - DNA, 32 bp, Artificial Sequence
  Description of Artificial Sequence: Synthetic oligonucleotide
cggaggataaagatcagagagcaacgataccc

SEQ ID NO: 223374 - DNA, 33 bp, Artificial Sequence
  Description of Artificial Sequence: Synthetic oligonucleotide
ggaggataaagatcagagagcaacgatacccag

SEQ ID NO: 223375 - DNA, 36 bp, Artificial Sequence
  Description of Artificial Sequence: Synthetic oligonucleotide
gaggataaagatcagagagcaacgatacccagtttg

SEQ ID NO: 223376 - DNA, 37 bp, Artificial Sequence
  Description of Artificial Sequence: Synthetic oligonucleotide
aggataaagatcagagagcaacgatacccagtttgtc

SEQ ID NO: 223377 - DNA, 36 bp, Artificial Sequence
  Description of Artificial Sequence: Synthetic oligonucleotide
ggataaagatcagagagcaacgatacccagtttgtc

SEQ ID NO: 223378 - DNA, 37 bp, Artificial Sequence
  Description of Artificial Sequence: Synthetic oligonucleotide
gataaagatcagagagcaacgatacccagtttgtctg

SEQ ID NO: 223379 - DNA, 37 bp, Artificial Sequence
  Description of Artificial Sequence: Synthetic oligonucleotide
ataaagatcagagagcaacgatacccagtttgtctgc

SEQ ID NO: 223380 - DNA, 36 bp, Artificial Sequence
  Description of Artificial Sequence: Synthetic oligonucleotide
taaagatcagagagcaacgatacccagtttgtctgc

SEQ ID NO: 223381 - DNA, 35 bp, Artificial Sequence
  Description of Artificial Sequence: Synthetic oligonucleotide
aaagatcagagagcaacgatacccagtttgtctgc

SEQ ID NO: 223382 - DNA, 34 bp, Artificial Sequence
  Description of Artificial Sequence: Synthetic oligonucleotide
aagatcagagagcaacgatacccagtttgtctgc

SEQ ID NO: 223383 - DNA, 33 bp, Artificial Sequence
  Description of Artificial Sequence: Synthetic oligonucleotide
agatcagagagcaacgatacccagtttgtctgc

SEQ ID NO: 223384 - DNA, 41 bp, Artificial Sequence
  Description of Artificial Sequence: Synthetic oligonucleotide
gtttgctcctaaatctcaaaatatggaaagcacctcatgag

SEQ ID NO: 223385 - DNA, 41 bp, Artificial Sequence
  Description of Artificial Sequence: Synthetic oligonucleotide
tttgctcctaaatctcaaaatatggaaagcacctcatgagg

SEQ ID NO: 223386 - DNA, 40 bp, Artificial Sequence
  Description of Artificial Sequence: Synthetic oligonucleotide
ttgctcctaaatctcaaaatatggaaagcacctcatgagg

SEQ ID NO: 223387 - DNA, 39 bp, Artificial Sequence
  Description of Artificial Sequence: Synthetic oligonucleotide
tgctcctaaatctcaaaatatggaaagcacctcatgagg

SEQ ID NO: 223388 - DNA, 38 bp, Artificial Sequence
  Description of Artificial Sequence: Synthetic oligonucleotide
gctcctaaatctcaaaatatggaaagcacctcatgagg

SEQ ID NO: 223389 - DNA, 38 bp, Artificial Sequence
  Description of Artificial Sequence: Synthetic oligonucleotide
ctcctaaatctcaaaatatggaaagcacctcatgaggc

SEQ ID NO: 223390 - DNA, 48 bp, Artificial Sequence
  Description of Artificial Sequence: Synthetic oligonucleotide
tcctaaatctcaaaatatggaaagcacctcatgaggctaaatattttg

SEQ ID NO: 223391 - DNA, 47 bp, Artificial Sequence
  Description of Artificial Sequence: Synthetic oligonucleotide
cctaaatctcaaaatatggaaagcacctcatgaggctaaatattttg

SEQ ID NO: 223392 - DNA, 49 bp, Artificial Sequence
  Description of Artificial Sequence: Synthetic oligonucleotide
ctaaatctcaaaatatggaaagcacctcatgaggctaaatattttgatg

SEQ ID NO: 223393 - DNA, 50 bp, Artificial Sequence
  Description of Artificial Sequence: Synthetic oligonucleotide
taaatctcaaaatatggaaagcacctcatgaggctaaatattttgatgac

SEQ ID NO: 223394 - DNA, 49 bp, Artificial Sequence
  Description of Artificial Sequence: Synthetic oligonucleotide
aaatctcaaaatatggaaagcacctcatgaggctaaatattttgatgac

SEQ ID NO: 223395 - DNA, 48 bp, Artificial Sequence
  Description of Artificial Sequence: Synthetic oligonucleotide
aatctcaaaatatggaaagcacctcatgaggctaaatattttgatgac

SEQ ID NO: 223396 - DNA, 47 bp, Artificial Sequence
  Description of Artificial Sequence: Synthetic oligonucleotide
atctcaaaatatggaaagcacctcatgaggctaaatattttgatgac

SEQ ID NO: 223397 - DNA, 46 bp, Artificial Sequence
  Description of Artificial Sequence: Synthetic oligonucleotide
tctcaaaatatggaaagcacctcatgaggctaaatattttgatgac

SEQ ID NO: 223398 - DNA, 45 bp, Artificial Sequence
  Description of Artificial Sequence: Synthetic oligonucleotide
ctcaaaatatggaaagcacctcatgaggctaaatattttgatgac

SEQ ID NO: 223399 - DNA, 45 bp, Artificial Sequence
  Description of Artificial Sequence: Synthetic oligonucleotide
tcaaaatatggaaagcacctcatgaggctaaatattttgatgacc

SEQ ID NO: 223400 - DNA, 44 bp, Artificial Sequence
  Description of Artificial Sequence: Synthetic oligonucleotide
caaaatatggaaagcacctcatgaggctaaatattttgatgacc

SEQ ID NO: 223401 - DNA, 34 bp, Artificial Sequence
  Description of Artificial Sequence: Synthetic oligonucleotide
tctgctgagaagtccaatcgaaaggaagaatgcg

SEQ ID NO: 223402 - DNA, 33 bp, Artificial Sequence
  Description of Artificial Sequence: Synthetic oligonucleotide
ctgctgagaagtccaatcgaaaggaagaatgcg

SEQ ID NO: 223403 - DNA, 34 bp, Artificial Sequence
  Description of Artificial Sequence: Synthetic oligonucleotide
tgctgagaagtccaatcgaaaggaagaatgcgtg

SEQ ID NO: 223404 - DNA, 33 bp, Artificial Sequence
  Description of Artificial Sequence: Synthetic oligonucleotide
gctgagaagtccaatcgaaaggaagaatgcgtg

SEQ ID NO: 223405 - DNA, 35 bp, Artificial Sequence
  Description of Artificial Sequence: Synthetic oligonucleotide
ctgagaagtccaatcgaaaggaagaatgcgtgttc

SEQ ID NO: 223406 - DNA, 37 bp, Artificial Sequence
  Description of Artificial Sequence: Synthetic oligonucleotide
tgagaagtccaatcgaaaggaagaatgcgtgttcaac

SEQ ID NO: 223407 - DNA, 36 bp, Artificial Sequence
  Description of Artificial Sequence: Synthetic oligonucleotide
gagaagtccaatcgaaaggaagaatgcgtgttcaac

SEQ ID NO: 223408 - DNA, 37 bp, Artificial Sequence
  Description of Artificial Sequence: Synthetic oligonucleotide
agaagtccaatcgaaaggaagaatgcgtgttcaacac

SEQ ID NO: 223409 - DNA, 36 bp, Artificial Sequence
  Description of Artificial Sequence: Synthetic oligonucleotide
gaagtccaatcgaaaggaagaatgcgtgttcaacac

SEQ ID NO: 223410 - DNA, 36 bp, Artificial Sequence
  Description of Artificial Sequence: Synthetic oligonucleotide
aagtccaatcgaaaggaagaatgcgtgttcaacacc

SEQ ID NO: 223411 - DNA, 35 bp, Artificial Sequence
  Description of Artificial Sequence: Synthetic oligonucleotide
agtccaatcgaaaggaagaatgcgtgttcaacacc

SEQ ID NO: 223412 - DNA, 34 bp, Artificial Sequence
  Description of Artificial Sequence: Synthetic oligonucleotide
gtccaatcgaaaggaagaatgcgtgttcaacacc

SEQ ID NO: 223413 - DNA, 36 bp, Artificial Sequence
  Description of Artificial Sequence: Synthetic oligonucleotide
tccaatcgaaaggaagaatgcgtgttcaacacctac

SEQ ID NO: 223414 - DNA, 35 bp, Artificial Sequence
  Description of Artificial Sequence: Synthetic oligonucleotide
ccaatcgaaaggaagaatgcgtgttcaacacctac

SEQ ID NO: 223415 - DNA, 38 bp, Artificial Sequence
  Description of Artificial Sequence: Synthetic oligonucleotide
caatcgaaaggaagaatgcgtgttcaacacctactatg

SEQ ID NO: 223416 - DNA, 38 bp, Artificial Sequence
  Description of Artificial Sequence: Synthetic oligonucleotide
aatcgaaaggaagaatgcgtgttcaacacctactatgc

SEQ ID NO: 223417 - DNA, 37 bp, Artificial Sequence
  Description of Artificial Sequence: Synthetic oligonucleotide
atcgaaaggaagaatgcgtgttcaacacctactatgc

SEQ ID NO: 223418 - DNA, 36 bp, Artificial Sequence
  Description of Artificial Sequence: Synthetic oligonucleotide
tcgaaaggaagaatgcgtgttcaacacctactatgc

SEQ ID NO: 223419 - DNA, 35 bp, Artificial Sequence
  Description of Artificial Sequence: Synthetic oligonucleotide
cgaaaggaagaatgcgtgttcaacacctactatgc

SEQ ID NO: 223420 - DNA, 36 bp, Artificial Sequence
  Description of Artificial Sequence: Synthetic oligonucleotide
gaaaggaagaatgcgtgttcaacacctactatgctg

SEQ ID NO: 223421 - DNA, 38 bp, Artificial Sequence
  Description of Artificial Sequence: Synthetic oligonucleotide
aaaggaagaatgcgtgttcaacacctactatgctgtag

SEQ ID NO: 223422 - DNA, 37 bp, Artificial Sequence
  Description of Artificial Sequence: Synthetic oligonucleotide
aaggaagaatgcgtgttcaacacctactatgctgtag

SEQ ID NO: 223423 - DNA, 36 bp, Artificial Sequence
  Description of Artificial Sequence: Synthetic oligonucleotide
aggaagaatgcgtgttcaacacctactatgctgtag

SEQ ID NO: 223424 - DNA, 35 bp, Artificial Sequence
  Description of Artificial Sequence: Synthetic oligonucleotide
ggaagaatgcgtgttcaacacctactatgctgtag

SEQ ID NO: 223425 - DNA, 35 bp, Artificial Sequence
  Description of Artificial Sequence: Synthetic oligonucleotide
gaagaatgcgtgttcaacacctactatgctgtagc

SEQ ID NO: 223426 - DNA, 36 bp, Artificial Sequence
  Description of Artificial Sequence: Synthetic oligonucleotide
aagaatgcgtgttcaacacctactatgctgtagcag

SEQ ID NO: 223427 - DNA, 35 bp, Artificial Sequence
  Description of Artificial Sequence: Synthetic oligonucleotide
agaatgcgtgttcaacacctactatgctgtagcag

SEQ ID NO: 223428 - DNA, 34 bp, Artificial Sequence
  Description of Artificial Sequence: Synthetic oligonucleotide
gaatgcgtgttcaacacctactatgctgtagcag

SEQ ID NO: 223429 - DNA, 35 bp, Artificial Sequence
  Description of Artificial Sequence: Synthetic oligonucleotide
aatgcgtgttcaacacctactatgctgtagcagtc

SEQ ID NO: 223430 - DNA, 34 bp, Artificial Sequence
  Description of Artificial Sequence: Synthetic oligonucleotide
atgcgtgttcaacacctactatgctgtagcagtc

SEQ ID NO: 223431 - DNA, 33 bp, Artificial Sequence
  Description of Artificial Sequence: Synthetic oligonucleotide
tgcgtgttcaacacctactatgctgtagcagtc

SEQ ID NO: 223432 - DNA, 32 bp, Artificial Sequence
  Description of Artificial Sequence: Synthetic oligonucleotide
gcgtgttcaacacctactatgctgtagcagtc

SEQ ID NO: 223433 - DNA, 27 bp, Artificial Sequence
  Description of Artificial Sequence: Synthetic oligonucleotide
atggtgctgggtcttgtggctgggctt

SEQ ID NO: 223434 - DNA, 26 bp, Artificial Sequence
  Description of Artificial Sequence: Synthetic oligonucleotide
tggtgctgggtcttgtggctgggctt

SEQ ID NO: 223435 - DNA, 25 bp, Artificial Sequence
  Description of Artificial Sequence: Synthetic oligonucleotide
ggtgctgggtcttgtggctgggctt

SEQ ID NO: 223436 - DNA, 25 bp, Artificial Sequence
  Description of Artificial Sequence: Synthetic oligonucleotide
gtgctgggtcttgtggctgggcttg

SEQ ID NO: 223437 - DNA, 25 bp, Artificial Sequence
  Description of Artificial Sequence: Synthetic oligonucleotide
tgctgggtcttgtggctgggcttgg

SEQ ID NO: 223438 - DNA, 24 bp, Artificial Sequence
  Description of Artificial Sequence: Synthetic oligonucleotide
gctgggtcttgtggctgggcttgg

SEQ ID NO: 223439 - DNA, 25 bp, Artificial Sequence
  Description of Artificial Sequence: Synthetic oligonucleotide
ctgggtcttgtggctgggcttggct

SEQ ID NO: 223440 - DNA, 27 bp, Artificial Sequence
  Description of Artificial Sequence: Synthetic oligonucleotide
tgggtcttgtggctgggcttggctgat

SEQ ID NO: 223441 - DNA, 26 bp, Artificial Sequence
  Description of Artificial Sequence: Synthetic oligonucleotide
gggtcttgtggctgggcttggctgat

SEQ ID NO: 223442 - DNA, 27 bp, Artificial Sequence
  Description of Artificial Sequence: Synthetic oligonucleotide
ggtcttgtggctgggcttggctgatct

SEQ ID NO: 223443 - DNA, 27 bp, Artificial Sequence
  Description of Artificial Sequence: Synthetic oligonucleotide
gtcttgtggctgggcttggctgatctc

SEQ ID NO: 223444 - DNA, 27 bp, Artificial Sequence
  Description of Artificial Sequence: Synthetic oligonucleotide
tcttgtggctgggcttggctgatctcc

SEQ ID NO: 223445 - DNA, 26 bp, Artificial Sequence
  Description of Artificial Sequence: Synthetic oligonucleotide
cttgtggctgggcttggctgatctcc

SEQ ID NO: 223446 - DNA, 27 bp, Artificial Sequence
  Description of Artificial Sequence: Synthetic oligonucleotide
ttgtggctgggcttggctgatctccgt

SEQ ID NO: 223447 - DNA, 26 bp, Artificial Sequence
  Description of Artificial Sequence: Synthetic oligonucleotide
tgtggctgggcttggctgatctccgt

SEQ ID NO: 223448 - DNA, 25 bp, Artificial Sequence
  Description of Artificial Sequence: Synthetic oligonucleotide
gtggctgggcttggctgatctccgt

SEQ ID NO: 223449 - DNA, 25 bp, Artificial Sequence
  Description of Artificial Sequence: Synthetic oligonucleotide
tggctgggcttggctgatctccgtc

SEQ ID NO: 223450 - DNA, 24 bp, Artificial Sequence
  Description of Artificial Sequence: Synthetic oligonucleotide
ggctgggcttggctgatctccgtc

SEQ ID NO: 223451 - DNA, 24 bp, Artificial Sequence
  Description of Artificial Sequence: Synthetic oligonucleotide
gctgggcttggctgatctccgtcg

SEQ ID NO: 223452 - DNA, 24 bp, Artificial Sequence
  Description of Artificial Sequence: Synthetic oligonucleotide
ctgggcttggctgatctccgtcgg

SEQ ID NO: 223453 - DNA, 24 bp, Artificial Sequence
  Description of Artificial Sequence: Synthetic oligonucleotide
tgggcttggctgatctccgtcggg

SEQ ID NO: 223454 - DNA, 23 bp, Artificial Sequence
  Description of Artificial Sequence: Synthetic oligonucleotide
gggcttggctgatctccgtcggg

SEQ ID NO: 223455 - DNA, 23 bp, Artificial Sequence
  Description of Artificial Sequence: Synthetic oligonucleotide
ggcttggctgatctccgtcgggg

SEQ ID NO: 223456 - DNA, 24 bp, Artificial Sequence
  Description of Artificial Sequence: Synthetic oligonucleotide
gcttggctgatctccgtcggggga

SEQ ID NO: 223457 - DNA, 24 bp, Artificial Sequence
  Description of Artificial Sequence: Synthetic oligonucleotide
cttggctgatctccgtcgggggag

SEQ ID NO: 223458 - DNA, 24 bp, Artificial Sequence
  Description of Artificial Sequence: Synthetic oligonucleotide
ttggctgatctccgtcgggggagc

SEQ ID NO: 223459 - DNA, 23 bp, Artificial Sequence
  Description of Artificial Sequence: Synthetic oligonucleotide
tggctgatctccgtcgggggagc

SEQ ID NO: 223460 - DNA, 28 bp, Artificial Sequence
  Description of Artificial Sequence: Synthetic oligonucleotide
ttcatgctggcgcttggtgtgcagtgag

SEQ ID NO: 223461 - DNA, 27 bp, Artificial Sequence
  Description of Artificial Sequence: Synthetic oligonucleotide
tcatgctggcgcttggtgtgcagtgag

SEQ ID NO: 223462 - DNA, 26 bp, Artificial Sequence
  Description of Artificial Sequence: Synthetic oligonucleotide
catgctggcgcttggtgtgcagtgag

SEQ ID NO: 223463 - DNA, 27 bp, Artificial Sequence
  Description of Artificial Sequence: Synthetic oligonucleotide
atgctggcgcttggtgtgcagtgagca

SEQ ID NO: 223464 - DNA, 27 bp, Artificial Sequence
  Description of Artificial Sequence: Synthetic oligonucleotide
tgctggcgcttggtgtgcagtgagcaa

SEQ ID NO: 223465 - DNA, 27 bp, Artificial Sequence
  Description of Artificial Sequence: Synthetic oligonucleotide
gctggcgcttggtgtgcagtgagcaat

SEQ ID NO: 223466 - DNA, 27 bp, Artificial Sequence
  Description of Artificial Sequence: Synthetic oligonucleotide
ctggcgcttggtgtgcagtgagcaatc

SEQ ID NO: 223467 - DNA, 27 bp, Artificial Sequence
  Description of Artificial Sequence: Synthetic oligonucleotide
tggcgcttggtgtgcagtgagcaatcc

SEQ ID NO: 223468 - DNA, 27 bp, Artificial Sequence
  Description of Artificial Sequence: Synthetic oligonucleotide
ggcgcttggtgtgcagtgagcaatcct

SEQ ID NO: 223469 - DNA, 27 bp, Artificial Sequence
  Description of Artificial Sequence: Synthetic oligonucleotide
gcgcttggtgtgcagtgagcaatcctg

SEQ ID NO: 223470 - DNA, 27 bp, Artificial Sequence
  Description of Artificial Sequence: Synthetic oligonucleotide
cgcttggtgtgcagtgagcaatcctgc

SEQ ID NO: 223471 - DNA, 28 bp, Artificial Sequence
  Description of Artificial Sequence: Synthetic oligonucleotide
gcttggtgtgcagtgagcaatcctgctg

SEQ ID NO: 223472 - DNA, 28 bp, Artificial Sequence
  Description of Artificial Sequence: Synthetic oligonucleotide
cttggtgtgcagtgagcaatcctgctgg

SEQ ID NO: 223473 - DNA, 29 bp, Artificial Sequence
  Description of Artificial Sequence: Synthetic oligonucleotide
ttggtgtgcagtgagcaatcctgctggac

SEQ ID NO: 223474 - DNA, 28 bp, Artificial Sequence
  Description of Artificial Sequence: Synthetic oligonucleotide
tggtgtgcagtgagcaatcctgctggac

SEQ ID NO: 223475 - DNA, 27 bp, Artificial Sequence
  Description of Artificial Sequence: Synthetic oligonucleotide
ggtgtgcagtgagcaatcctgctggac

SEQ ID NO: 223476 - DNA, 27 bp, Artificial Sequence
  Description of Artificial Sequence: Synthetic oligonucleotide
gtgtgcagtgagcaatcctgctggacg

SEQ ID NO: 223477 - DNA, 27 bp, Artificial Sequence
  Description of Artificial Sequence: Synthetic oligonucleotide
tgtgcagtgagcaatcctgctggacgg

SEQ ID NO: 223478 - DNA, 26 bp, Artificial Sequence
  Description of Artificial Sequence: Synthetic oligonucleotide
gtgcagtgagcaatcctgctggacgg

SEQ ID NO: 223479 - DNA, 27 bp, Artificial Sequence
  Description of Artificial Sequence: Synthetic oligonucleotide
tgcagtgagcaatcctgctggacggct

SEQ ID NO: 223480 - DNA, 27 bp, Artificial Sequence
  Description of Artificial Sequence: Synthetic oligonucleotide
gcagtgagcaatcctgctggacggctt

SEQ ID NO: 223481 - DNA, 27 bp, Artificial Sequence
  Description of Artificial Sequence: Synthetic oligonucleotide
cagtgagcaatcctgctggacggcttc

SEQ ID NO: 223482 - DNA, 27 bp, Artificial Sequence
  Description of Artificial Sequence: Synthetic oligonucleotide
agtgagcaatcctgctggacggcttcc

SEQ ID NO: 223483 - DNA, 27 bp, Artificial Sequence
  Description of Artificial Sequence: Synthetic oligonucleotide
gtgagcaatcctgctggacggcttcct

SEQ ID NO: 223484 - DNA, 27 bp, Artificial Sequence
  Description of Artificial Sequence: Synthetic oligonucleotide
tgagcaatcctgctggacggcttcctg

SEQ ID NO: 223485 - DNA, 27 bp, Artificial Sequence
  Description of Artificial Sequence: Synthetic oligonucleotide
gagcaatcctgctggacggcttcctga

SEQ ID NO: 223486 - DNA, 27 bp, Artificial Sequence
  Description of Artificial Sequence: Synthetic oligonucleotide
agcaatcctgctggacggcttcctgag

SEQ ID NO: 223487 - DNA, 27 bp, Artificial Sequence
  Description of Artificial Sequence: Synthetic oligonucleotide
atgctgggcgccctcttcttgtggatc

SEQ ID NO: 223488 - DNA, 27 bp, Artificial Sequence
  Description of Artificial Sequence: Synthetic oligonucleotide
tgctgggcgccctcttcttgtggatct

SEQ ID NO: 223489 - DNA, 27 bp, Artificial Sequence
  Description of Artificial Sequence: Synthetic oligonucleotide
gctgggcgccctcttcttgtggatctt

SEQ ID NO: 223490 - DNA, 27 bp, Artificial Sequence
  Description of Artificial Sequence: Synthetic oligonucleotide
ctgggcgccctcttcttgtggatcttc

SEQ ID NO: 223491 - DNA, 28 bp, Artificial Sequence
  Description of Artificial Sequence: Synthetic oligonucleotide
tgggcgccctcttcttgtggatcttctg

SEQ ID NO: 223492 - DNA, 27 bp, Artificial Sequence
  Description of Artificial Sequence: Synthetic oligonucleotide
gggcgccctcttcttgtggatcttctg

SEQ ID NO: 223493 - DNA, 27 bp, Artificial Sequence
  Description of Artificial Sequence: Synthetic oligonucleotide
ggcgccctcttcttgtggatcttctgg

SEQ ID NO: 223494 - DNA, 27 bp, Artificial Sequence
  Description of Artificial Sequence: Synthetic oligonucleotide
gcgccctcttcttgtggatcttctggc

SEQ ID NO: 223495 - DNA, 27 bp, Artificial Sequence
  Description of Artificial Sequence: Synthetic oligonucleotide
cgccctcttcttgtggatcttctggcc

SEQ ID NO: 223496 - DNA, 29 bp, Artificial Sequence
  Description of Artificial Sequence: Synthetic oligonucleotide
gccctcttcttgtggatcttctggccaag

SEQ ID NO: 223497 - DNA, 30 bp, Artificial Sequence
  Description of Artificial Sequence: Synthetic oligonucleotide
ccctcttcttgtggatcttctggccaagtg

SEQ ID NO: 223498 - DNA, 31 bp, Artificial Sequence
  Description of Artificial Sequence: Synthetic oligonucleotide
cctcttcttgtggatcttctggccaagtgtc

SEQ ID NO: 223499 - DNA, 33 bp, Artificial Sequence
  Description of Artificial Sequence: Synthetic oligonucleotide
ctcttcttgtggatcttctggccaagtgtcaac

SEQ ID NO: 223500 - DNA, 34 bp, Artificial Sequence
  Description of Artificial Sequence: Synthetic oligonucleotide
tcttcttgtggatcttctggccaagtgtcaactc

SEQ ID NO: 223501 - DNA, 33 bp, Artificial Sequence
  Description of Artificial Sequence: Synthetic oligonucleotide
cttcttgtggatcttctggccaagtgtcaactc

SEQ ID NO: 223502 - DNA, 34 bp, Artificial Sequence
  Description of Artificial Sequence: Synthetic oligonucleotide
ttcttgtggatcttctggccaagtgtcaactctg

SEQ ID NO: 223503 - DNA, 33 bp, Artificial Sequence
  Description of Artificial Sequence: Synthetic oligonucleotide
tcttgtggatcttctggccaagtgtcaactctg

SEQ ID NO: 223504 - DNA, 32 bp, Artificial Sequence
  Description of Artificial Sequence: Synthetic oligonucleotide
cttgtggatcttctggccaagtgtcaactctg

SEQ ID NO: 223505 - DNA, 32 bp, Artificial Sequence
  Description of Artificial Sequence: Synthetic oligonucleotide
ttgtggatcttctggccaagtgtcaactctgc

SEQ ID NO: 223506 - DNA, 31 bp, Artificial Sequence
  Description of Artificial Sequence: Synthetic oligonucleotide
tgtggatcttctggccaagtgtcaactctgc

SEQ ID NO: 223507 - DNA, 30 bp, Artificial Sequence
  Description of Artificial Sequence: Synthetic oligonucleotide
gtggatcttctggccaagtgtcaactctgc

SEQ ID NO: 223508 - DNA, 31 bp, Artificial Sequence
  Description of Artificial Sequence: Synthetic oligonucleotide
tggatcttctggccaagtgtcaactctgctc

SEQ ID NO: 223509 - DNA, 30 bp, Artificial Sequence
  Description of Artificial Sequence: Synthetic oligonucleotide
ggatcttctggccaagtgtcaactctgctc

SEQ ID NO: 223510 - DNA, 31 bp, Artificial Sequence
  Description of Artificial Sequence: Synthetic oligonucleotide
gatcttctggccaagtgtcaactctgctctg

SEQ ID NO: 223511 - DNA, 31 bp, Artificial Sequence
  Description of Artificial Sequence: Synthetic oligonucleotide
atcttctggccaagtgtcaactctgctctgc

SEQ ID NO: 223512 - DNA, 30 bp, Artificial Sequence
  Description of Artificial Sequence: Synthetic oligonucleotide
tcttctggccaagtgtcaactctgctctgc

SEQ ID NO: 223513 - DNA, 29 bp, Artificial Sequence
  Description of Artificial Sequence: Synthetic oligonucleotide
cttctggccaagtgtcaactctgctctgc

SEQ ID NO: 223514 - DNA, 32 bp, Artificial Sequence
  Description of Artificial Sequence: Synthetic oligonucleotide
ccctcttcttgtggatcttctggccaagtttc

SEQ ID NO: 223515 - DNA, 34 bp, Artificial Sequence
  Description of Artificial Sequence: Synthetic oligonucleotide
cctcttcttgtggatcttctggccaagtttcaac

SEQ ID NO: 223516 - DNA, 37 bp, Artificial Sequence
  Description of Artificial Sequence: Synthetic oligonucleotide
ctcttcttgtggatcttctggccaagtttcaactttg

SEQ ID NO: 223517 - DNA, 37 bp, Artificial Sequence
  Description of Artificial Sequence: Synthetic oligonucleotide
tcttcttgtggatcttctggccaagtttcaactttgc

SEQ ID NO: 223518 - DNA, 36 bp, Artificial Sequence
  Description of Artificial Sequence: Synthetic oligonucleotide
cttcttgtggatcttctggccaagtttcaactttgc

SEQ ID NO: 223519 - DNA, 37 bp, Artificial Sequence
  Description of Artificial Sequence: Synthetic oligonucleotide
ttcttgtggatcttctggccaagtttcaactttgctc

SEQ ID NO: 223520 - DNA, 36 bp, Artificial Sequence
  Description of Artificial Sequence: Synthetic oligonucleotide
tcttgtggatcttctggccaagtttcaactttgctc

SEQ ID NO: 223521 - DNA, 35 bp, Artificial Sequence
  Description of Artificial Sequence: Synthetic oligonucleotide
cttgtggatcttctggccaagtttcaactttgctc

SEQ ID NO: 223522 - DNA, 36 bp, Artificial Sequence
  Description of Artificial Sequence: Synthetic oligonucleotide
ttgtggatcttctggccaagtttcaactttgctctg

SEQ ID NO: 223523 - DNA, 35 bp, Artificial Sequence
  Description of Artificial Sequence: Synthetic oligonucleotide
tgtggatcttctggccaagtttcaactttgctctg

SEQ ID NO: 223524 - DNA, 34 bp, Artificial Sequence
  Description of Artificial Sequence: Synthetic oligonucleotide
gtggatcttctggccaagtttcaactttgctctg

SEQ ID NO: 223525 - DNA, 34 bp, Artificial Sequence
  Description of Artificial Sequence: Synthetic oligonucleotide
tggatcttctggccaagtttcaactttgctctgc

SEQ ID NO: 223526 - DNA, 33 bp, Artificial Sequence
  Description of Artificial Sequence: Synthetic oligonucleotide
ggatcttctggccaagtttcaactttgctctgc

SEQ ID NO: 223527 - DNA, 34 bp, Artificial Sequence
  Description of Artificial Sequence: Synthetic oligonucleotide
gatcttctggccaagtttcaactttgctctgctg

SEQ ID NO: 223528 - DNA, 35 bp, Artificial Sequence
  Description of Artificial Sequence: Synthetic oligonucleotide
atcttctggccaagtttcaactttgctctgctgag

SEQ ID NO: 223529 - DNA, 34 bp, Artificial Sequence
  Description of Artificial Sequence: Synthetic oligonucleotide
tcttctggccaagtttcaactttgctctgctgag

SEQ ID NO: 223530 - DNA, 33 bp, Artificial Sequence
  Description of Artificial Sequence: Synthetic oligonucleotide
cttctggccaagtttcaactttgctctgctgag

SEQ ID NO: 223531 - DNA, 35 bp, Artificial Sequence
  Description of Artificial Sequence: Synthetic oligonucleotide
ttctggccaagtttcaactttgctctgctgagaag

SEQ ID NO: 223532 - DNA, 34 bp, Artificial Sequence
  Description of Artificial Sequence: Synthetic oligonucleotide
tctggccaagtttcaactttgctctgctgagaag

SEQ ID NO: 223533 - DNA, 33 bp, Artificial Sequence
  Description of Artificial Sequence: Synthetic oligonucleotide
ctggccaagtttcaactttgctctgctgagaag

SEQ ID NO: 223534 - DNA, 34 bp, Artificial Sequence
  Description of Artificial Sequence: Synthetic oligonucleotide
tggccaagtttcaactttgctctgctgagaagtc

SEQ ID NO: 223535 - DNA, 33 bp, Artificial Sequence
  Description of Artificial Sequence: Synthetic oligonucleotide
ggccaagtttcaactttgctctgctgagaagtc

SEQ ID NO: 223536 - DNA, 33 bp, Artificial Sequence
  Description of Artificial Sequence: Synthetic oligonucleotide
gccaagtttcaactttgctctgctgagaagtcc

SEQ ID NO: 223537 - DNA, 36 bp, Artificial Sequence
  Description of Artificial Sequence: Synthetic oligonucleotide
ccaagtttcaactttgctctgctgagaagtccaatc

SEQ ID NO: 223538 - DNA, 36 bp, Artificial Sequence
  Description of Artificial Sequence: Synthetic oligonucleotide
caagtttcaactttgctctgctgagaagtccaatcg

SEQ ID NO: 223539 - DNA, 39 bp, Artificial Sequence
  Description of Artificial Sequence: Synthetic oligonucleotide
aagtttcaactttgctctgctgagaagtccaatcgaaag

SEQ ID NO: 223540 - DNA, 38 bp, Artificial Sequence
  Description of Artificial Sequence: Synthetic oligonucleotide
agtttcaactttgctctgctgagaagtccaatcgaaag

SEQ ID NO: 223541 - DNA, 37 bp, Artificial Sequence
  Description of Artificial Sequence: Synthetic oligonucleotide
gtttcaactttgctctgctgagaagtccaatcgaaag

SEQ ID NO: 223542 - DNA, 37 bp, Artificial Sequence
  Description of Artificial Sequence: Synthetic oligonucleotide
tttcaactttgctctgctgagaagtccaatcgaaagg

SEQ ID NO: 223543 - DNA, 36 bp, Artificial Sequence
  Description of Artificial Sequence: Synthetic oligonucleotide
ttcaactttgctctgctgagaagtccaatcgaaagg

SEQ ID NO: 223544 - DNA, 35 bp, Artificial Sequence
  Description of Artificial Sequence: Synthetic oligonucleotide
tcaactttgctctgctgagaagtccaatcgaaagg

SEQ ID NO: 223545 - DNA, 34 bp, Artificial Sequence
  Description of Artificial Sequence: Synthetic oligonucleotide
caactttgctctgctgagaagtccaatcgaaagg

SEQ ID NO: 223546 - DNA, 36 bp, Artificial Sequence
  Description of Artificial Sequence: Synthetic oligonucleotide
aactttgctctgctgagaagtccaatcgaaaggaag

SEQ ID NO: 223547 - DNA, 35 bp, Artificial Sequence
  Description of Artificial Sequence: Synthetic oligonucleotide
actttgctctgctgagaagtccaatcgaaaggaag

SEQ ID NO: 223548 - DNA, 34 bp, Artificial Sequence
  Description of Artificial Sequence: Synthetic oligonucleotide
ctttgctctgctgagaagtccaatcgaaaggaag

SEQ ID NO: 223549 - DNA, 37 bp, Artificial Sequence
  Description of Artificial Sequence: Synthetic oligonucleotide
tttgctctgctgagaagtccaatcgaaaggaagaatg

SEQ ID NO: 223550 - DNA, 36 bp, Artificial Sequence
  Description of Artificial Sequence: Synthetic oligonucleotide
ttgctctgctgagaagtccaatcgaaaggaagaatg

SEQ ID NO: 223551 - DNA, 32 bp, Artificial Sequence
  Description of Artificial Sequence: Synthetic oligonucleotide
ttctgggaaggtggtcatcacactgttcagac

SEQ ID NO: 223552 - DNA, 31 bp, Artificial Sequence
  Description of Artificial Sequence: Synthetic oligonucleotide
tctgggaaggtggtcatcacactgttcagac

SEQ ID NO: 223553 - DNA, 30 bp, Artificial Sequence
  Description of Artificial Sequence: Synthetic oligonucleotide
ctgggaaggtggtcatcacactgttcagac

SEQ ID NO: 223554 - DNA, 31 bp, Artificial Sequence
  Description of Artificial Sequence: Synthetic oligonucleotide
tgggaaggtggtcatcacactgttcagacag

SEQ ID NO: 223555 - DNA, 30 bp, Artificial Sequence
  Description of Artificial Sequence: Synthetic oligonucleotide
gggaaggtggtcatcacactgttcagacag

SEQ ID NO: 223556 - DNA, 31 bp, Artificial Sequence
  Description of Artificial Sequence: Synthetic oligonucleotide
ggaaggtggtcatcacactgttcagacagac

SEQ ID NO: 223557 - DNA, 33 bp, Artificial Sequence
  Description of Artificial Sequence: Synthetic oligonucleotide
gaaggtggtcatcacactgttcagacagactac

SEQ ID NO: 223558 - DNA, 33 bp, Artificial Sequence
  Description of Artificial Sequence: Synthetic oligonucleotide
aaggtggtcatcacactgttcagacagactacc

SEQ ID NO: 223559 - DNA, 32 bp, Artificial Sequence
  Description of Artificial Sequence: Synthetic oligonucleotide
aggtggtcatcacactgttcagacagactacc

SEQ ID NO: 223560 - DNA, 31 bp, Artificial Sequence
  Description of Artificial Sequence: Synthetic oligonucleotide
ggtggtcatcacactgttcagacagactacc

SEQ ID NO: 223561 - DNA, 32 bp, Artificial Sequence
  Description of Artificial Sequence: Synthetic oligonucleotide
gtggtcatcacactgttcagacagactaccac

SEQ ID NO: 223562 - DNA, 34 bp, Artificial Sequence
  Description of Artificial Sequence: Synthetic oligonucleotide
tggtcatcacactgttcagacagactaccacatg

SEQ ID NO: 223563 - DNA, 33 bp, Artificial Sequence
  Description of Artificial Sequence: Synthetic oligonucleotide
ggtcatcacactgttcagacagactaccacatg

SEQ ID NO: 223564 - DNA, 35 bp, Artificial Sequence
  Description of Artificial Sequence: Synthetic oligonucleotide
gtcatcacactgttcagacagactaccacatgaac

SEQ ID NO: 223565 - DNA, 37 bp, Artificial Sequence
  Description of Artificial Sequence: Synthetic oligonucleotide
tcatcacactgttcagacagactaccacatgaacatg

SEQ ID NO: 223566 - DNA, 36 bp, Artificial Sequence
  Description of Artificial Sequence: Synthetic oligonucleotide
catcacactgttcagacagactaccacatgaacatg

SEQ ID NO: 223567 - DNA, 38 bp, Artificial Sequence
  Description of Artificial Sequence: Synthetic oligonucleotide
atcacactgttcagacagactaccacatgaacatgatg

SEQ ID NO: 223568 - DNA, 37 bp, Artificial Sequence
  Description of Artificial Sequence: Synthetic oligonucleotide
tcacactgttcagacagactaccacatgaacatgatg

SEQ ID NO: 223569 - DNA, 36 bp, Artificial Sequence
  Description of Artificial Sequence: Synthetic oligonucleotide
cacactgttcagacagactaccacatgaacatgatg

SEQ ID NO: 223570 - DNA, 36 bp, Artificial Sequence
  Description of Artificial Sequence: Synthetic oligonucleotide
acactgttcagacagactaccacatgaacatgatgc

SEQ ID NO: 223571 - DNA, 35 bp, Artificial Sequence
  Description of Artificial Sequence: Synthetic oligonucleotide
cactgttcagacagactaccacatgaacatgatgc

SEQ ID NO: 223572 - DNA, 36 bp, Artificial Sequence
  Description of Artificial Sequence: Synthetic oligonucleotide
actgttcagacagactaccacatgaacatgatgcac

SEQ ID NO: 223573 - DNA, 35 bp, Artificial Sequence
  Description of Artificial Sequence: Synthetic oligonucleotide
ctgttcagacagactaccacatgaacatgatgcac

SEQ ID NO: 223574 - DNA, 37 bp, Artificial Sequence
  Description of Artificial Sequence: Synthetic oligonucleotide
tgttcagacagactaccacatgaacatgatgcacatc

SEQ ID NO: 223575 - DNA, 36 bp, Artificial Sequence
  Description of Artificial Sequence: Synthetic oligonucleotide
gttcagacagactaccacatgaacatgatgcacatc

SEQ ID NO: 223576 - DNA, 38 bp, Artificial Sequence
  Description of Artificial Sequence: Synthetic oligonucleotide
ttcagacagactaccacatgaacatgatgcacatctac

SEQ ID NO: 223577 - DNA, 37 bp, Artificial Sequence
  Description of Artificial Sequence: Synthetic oligonucleotide
tcagacagactaccacatgaacatgatgcacatctac

SEQ ID NO: 223578 - DNA, 36 bp, Artificial Sequence
  Description of Artificial Sequence: Synthetic oligonucleotide
cagacagactaccacatgaacatgatgcacatctac

SEQ ID NO: 223579 - DNA, 36 bp, Artificial Sequence
  Description of Artificial Sequence: Synthetic oligonucleotide
agacagactaccacatgaacatgatgcacatctacg

SEQ ID NO: 223580 - DNA, 35 bp, Artificial Sequence
  Description of Artificial Sequence: Synthetic oligonucleotide
gacagactaccacatgaacatgatgcacatctacg

SEQ ID NO: 223581 - DNA, 28 bp, Artificial Sequence
  Description of Artificial Sequence: Synthetic oligonucleotide
cctctacccgagggaacggaggataatg

SEQ ID NO: 223582 - DNA, 30 bp, Artificial Sequence
  Description of Artificial Sequence: Synthetic oligonucleotide
ctctacccgagggaacggaggataatgatc

SEQ ID NO: 223583 - DNA, 31 bp, Artificial Sequence
  Description of Artificial Sequence: Synthetic oligonucleotide
tctacccgagggaacggaggataatgatcag

SEQ ID NO: 223584 - DNA, 30 bp, Artificial Sequence
  Description of Artificial Sequence: Synthetic oligonucleotide
ctacccgagggaacggaggataatgatcag

SEQ ID NO: 223585 - DNA, 31 bp, Artificial Sequence
  Description of Artificial Sequence: Synthetic oligonucleotide
tacccgagggaacggaggataatgatcagac

SEQ ID NO: 223586 - DNA, 30 bp, Artificial Sequence
  Description of Artificial Sequence: Synthetic oligonucleotide
acccgagggaacggaggataatgatcagac

SEQ ID NO: 223587 - DNA, 29 bp, Artificial Sequence
  Description of Artificial Sequence: Synthetic oligonucleotide
cccgagggaacggaggataatgatcagac

SEQ ID NO: 223588 - DNA, 30 bp, Artificial Sequence
  Description of Artificial Sequence: Synthetic oligonucleotide
ccgagggaacggaggataatgatcagacag

SEQ ID NO: 223589 - DNA, 30 bp, Artificial Sequence
  Description of Artificial Sequence: Synthetic oligonucleotide
cgagggaacggaggataatgatcagacagc

SEQ ID NO: 223590 - DNA, 32 bp, Artificial Sequence
  Description of Artificial Sequence: Synthetic oligonucleotide
gagggaacggaggataatgatcagacagcaac

SEQ ID NO: 223591 - DNA, 32 bp, Artificial Sequence
  Description of Artificial Sequence: Synthetic oligonucleotide
agggaacggaggataatgatcagacagcaacg

SEQ ID NO: 223592 - DNA, 31 bp, Artificial Sequence
  Description of Artificial Sequence: Synthetic oligonucleotide
gggaacggaggataatgatcagacagcaacg

SEQ ID NO: 223593 - DNA, 34 bp, Artificial Sequence
  Description of Artificial Sequence: Synthetic oligonucleotide
ggaacggaggataatgatcagacagcaacgatac

SEQ ID NO: 223594 - DNA, 34 bp, Artificial Sequence
  Description of Artificial Sequence: Synthetic oligonucleotide
gaacggaggataatgatcagacagcaacgatacc

SEQ ID NO: 223595 - DNA, 34 bp, Artificial Sequence
  Description of Artificial Sequence: Synthetic oligonucleotide
aacggaggataatgatcagacagcaacgataccc

SEQ ID NO: 223596 - DNA, 33 bp, Artificial Sequence
  Description of Artificial Sequence: Synthetic oligonucleotide
acggaggataatgatcagacagcaacgataccc

SEQ ID NO: 223597 - DNA, 32 bp, Artificial Sequence
  Description of Artificial Sequence: Synthetic oligonucleotide
cggaggataatgatcagacagcaacgataccc

SEQ ID NO: 223598 - DNA, 33 bp, Artificial Sequence
  Description of Artificial Sequence: Synthetic oligonucleotide
ggaggataatgatcagacagcaacgatacccag

SEQ ID NO: 223599 - DNA, 36 bp, Artificial Sequence
  Description of Artificial Sequence: Synthetic oligonucleotide
gaggataatgatcagacagcaacgatacccagtttg

SEQ ID NO: 223600 - DNA, 37 bp, Artificial Sequence
  Description of Artificial Sequence: Synthetic oligonucleotide
aggataatgatcagacagcaacgatacccagtttgtc

SEQ ID NO: 223601 - DNA, 36 bp, Artificial Sequence
  Description of Artificial Sequence: Synthetic oligonucleotide
ggataatgatcagacagcaacgatacccagtttgtc

SEQ ID NO: 223602 - DNA, 37 bp, Artificial Sequence
  Description of Artificial Sequence: Synthetic oligonucleotide
gataatgatcagacagcaacgatacccagtttgtctg

SEQ ID NO: 223603 - DNA, 37 bp, Artificial Sequence
  Description of Artificial Sequence: Synthetic oligonucleotide
ataatgatcagacagcaacgatacccagtttgtctgc

SEQ ID NO: 223604 - DNA, 36 bp, Artificial Sequence
  Description of Artificial Sequence: Synthetic oligonucleotide
taatgatcagacagcaacgatacccagtttgtctgc

SEQ ID NO: 223605 - DNA, 35 bp, Artificial Sequence
  Description of Artificial Sequence: Synthetic oligonucleotide
aatgatcagacagcaacgatacccagtttgtctgc

SEQ ID NO: 223606 - DNA, 34 bp, Artificial Sequence
  Description of Artificial Sequence: Synthetic oligonucleotide
atgatcagacagcaacgatacccagtttgtctgc

SEQ ID NO: 223607 - DNA, 33 bp, Artificial Sequence
  Description of Artificial Sequence: Synthetic oligonucleotide
tgatcagacagcaacgatacccagtttgtctgc

SEQ ID NO: 223608 - DNA, 27 bp, Artificial Sequence
  Description of Artificial Sequence: Synthetic oligonucleotide
ctcacccccaagggaagatcagcaagg

SEQ ID NO: 223609 - DNA, 27 bp, Artificial Sequence
  Description of Artificial Sequence: Synthetic oligonucleotide
tcacccccaagggaagatcagcaaggg

SEQ ID NO: 223610 - DNA, 26 bp, Artificial Sequence
  Description of Artificial Sequence: Synthetic oligonucleotide
cacccccaagggaagatcagcaaggg

SEQ ID NO: 223611 - DNA, 27 bp, Artificial Sequence
  Description of Artificial Sequence: Synthetic oligonucleotide
acccccaagggaagatcagcaaggggt

SEQ ID NO: 223612 - DNA, 26 bp, Artificial Sequence
  Description of Artificial Sequence: Synthetic oligonucleotide
cccccaagggaagatcagcaaggggt

SEQ ID NO: 223613 - DNA, 27 bp, Artificial Sequence
  Description of Artificial Sequence: Synthetic oligonucleotide
ccccaagggaagatcagcaaggggtgt

SEQ ID NO: 223614 - DNA, 28 bp, Artificial Sequence
  Description of Artificial Sequence: Synthetic oligonucleotide
cccaagggaagatcagcaaggggtgttg

SEQ ID NO: 223615 - DNA, 31 bp, Artificial Sequence
  Description of Artificial Sequence: Synthetic oligonucleotide
ccaagggaagatcagcaaggggtgttgtaac

SEQ ID NO: 223616 - DNA, 31 bp, Artificial Sequence
  Description of Artificial Sequence: Synthetic oligonucleotide
caagggaagatcagcaaggggtgttgtaacc

SEQ ID NO: 223617 - DNA, 31 bp, Artificial Sequence
  Description of Artificial Sequence: Synthetic oligonucleotide
aagggaagatcagcaaggggtgttgtaaccg

SEQ ID NO: 223618 - DNA, 30 bp, Artificial Sequence
  Description of Artificial Sequence: Synthetic oligonucleotide
agggaagatcagcaaggggtgttgtaaccg

SEQ ID NO: 223619 - DNA, 29 bp, Artificial Sequence
  Description of Artificial Sequence: Synthetic oligonucleotide
gggaagatcagcaaggggtgttgtaaccg

SEQ ID NO: 223620 - DNA, 30 bp, Artificial Sequence
  Description of Artificial Sequence: Synthetic oligonucleotide
ggaagatcagcaaggggtgttgtaaccgag

SEQ ID NO: 223621 - DNA, 32 bp, Artificial Sequence
  Description of Artificial Sequence: Synthetic oligonucleotide
gaagatcagcaaggggtgttgtaaccgagtac

SEQ ID NO: 223622 - DNA, 33 bp, Artificial Sequence
  Description of Artificial Sequence: Synthetic oligonucleotide
aagatcagcaaggggtgttgtaaccgagtactg

SEQ ID NO: 223623 - DNA, 32 bp, Artificial Sequence
  Description of Artificial Sequence: Synthetic oligonucleotide
agatcagcaaggggtgttgtaaccgagtactg

SEQ ID NO: 223624 - DNA, 31 bp, Artificial Sequence
  Description of Artificial Sequence: Synthetic oligonucleotide
gatcagcaaggggtgttgtaaccgagtactg

SEQ ID NO: 223625 - DNA, 31 bp, Artificial Sequence
  Description of Artificial Sequence: Synthetic oligonucleotide
atcagcaaggggtgttgtaaccgagtactgg

SEQ ID NO: 223626 - DNA, 30 bp, Artificial Sequence
  Description of Artificial Sequence: Synthetic oligonucleotide
tcagcaaggggtgttgtaaccgagtactgg

SEQ ID NO: 223627 - DNA, 29 bp, Artificial Sequence
  Description of Artificial Sequence: Synthetic oligonucleotide
cagcaaggggtgttgtaaccgagtactgg

SEQ ID NO: 223628 - DNA, 29 bp, Artificial Sequence
  Description of Artificial Sequence: Synthetic oligonucleotide
agcaaggggtgttgtaaccgagtactggg

SEQ ID NO: 223629 - DNA, 28 bp, Artificial Sequence
  Description of Artificial Sequence: Synthetic oligonucleotide
gcaaggggtgttgtaaccgagtactggg

SEQ ID NO: 223630 - DNA, 28 bp, Artificial Sequence
  Description of Artificial Sequence: Synthetic oligonucleotide
caaggggtgttgtaaccgagtactgggg

SEQ ID NO: 223631 - DNA, 31 bp, Artificial Sequence
  Description of Artificial Sequence: Synthetic oligonucleotide
aaggggtgttgtaaccgagtactggggattc

SEQ ID NO: 223632 - DNA, 30 bp, Artificial Sequence
  Description of Artificial Sequence: Synthetic oligonucleotide
aggggtgttgtaaccgagtactggggattc

SEQ ID NO: 223633 - DNA, 29 bp, Artificial Sequence
  Description of Artificial Sequence: Synthetic oligonucleotide
ggggtgttgtaaccgagtactggggattc

SEQ ID NO: 223634 - DNA, 29 bp, Artificial Sequence
  Description of Artificial Sequence: Synthetic oligonucleotide
gggtgttgtaaccgagtactggggattcc

SEQ ID NO: 223635 - DNA, 29 bp, Artificial Sequence
  Description of Artificial Sequence: Synthetic oligonucleotide
ggtgttgtaaccgagtactggggattccc

SEQ ID NO: 223636 - DNA, 29 bp, Artificial Sequence
  Description of Artificial Sequence: Synthetic oligonucleotide
gtgttgtaaccgagtactggggattcccc

SEQ ID NO: 223637 - DNA, 30 bp, Artificial Sequence
  Description of Artificial Sequence: Synthetic oligonucleotide
tgttgtaaccgagtactggggattccccac

SEQ ID NO: 223638 - DNA, 29 bp, Artificial Sequence
  Description of Artificial Sequence: Synthetic oligonucleotide
gttgtaaccgagtactggggattccccac

SEQ ID NO: 223639 - DNA, 30 bp, Artificial Sequence
  Description of Artificial Sequence: Synthetic oligonucleotide
ttgtaaccgagtactggggattccccacag

SEQ ID NO: 223640 - DNA, 29 bp, Artificial Sequence
  Description of Artificial Sequence: Synthetic oligonucleotide
tgtaaccgagtactggggattccccacag

SEQ ID NO: 223641 - DNA, 28 bp, Artificial Sequence
  Description of Artificial Sequence: Synthetic oligonucleotide
gtaaccgagtactggggattccccacag

SEQ ID NO: 223642 - DNA, 28 bp, Artificial Sequence
  Description of Artificial Sequence: Synthetic oligonucleotide
taaccgagtactggggattccccacagc

SEQ ID NO: 223643 - DNA, 27 bp, Artificial Sequence
  Description of Artificial Sequence: Synthetic oligonucleotide
aaccgagtactggggattccccacagc

SEQ ID NO: 223644 - DNA, 27 bp, Artificial Sequence
  Description of Artificial Sequence: Synthetic oligonucleotide
accgagtactggggattccccacagct

SEQ ID NO: 223645 - DNA, 26 bp, Artificial Sequence
  Description of Artificial Sequence: Synthetic oligonucleotide
ccgagtactggggattccccacagct

SEQ ID NO: 223646 - DNA, 26 bp, Artificial Sequence
  Description of Artificial Sequence: Synthetic oligonucleotide
cgagtactggggattccccacagctc

SEQ ID NO: 223647 - DNA, 27 bp, Artificial Sequence
  Description of Artificial Sequence: Synthetic oligonucleotide
gagtactggggattccccacagctcca

SEQ ID NO: 223648 - DNA, 28 bp, Artificial Sequence
  Description of Artificial Sequence: Synthetic oligonucleotide
agtactggggattccccacagctccatc

SEQ ID NO: 223649 - DNA, 27 bp, Artificial Sequence
  Description of Artificial Sequence: Synthetic oligonucleotide
gtactggggattccccacagctccatc

SEQ ID NO: 223650 - DNA, 29 bp, Artificial Sequence
  Description of Artificial Sequence: Synthetic oligonucleotide
tactggggattccccacagctccatcatg

SEQ ID NO: 223651 - DNA, 28 bp, Artificial Sequence
  Description of Artificial Sequence: Synthetic oligonucleotide
actggggattccccacagctccatcatg

SEQ ID NO: 223652 - DNA, 33 bp, Artificial Sequence
  Description of Artificial Sequence: Synthetic oligonucleotide
ggtctgcttggagagatcacctacattgtgttg

SEQ ID NO: 223653 - DNA, 33 bp, Artificial Sequence
  Description of Artificial Sequence: Synthetic oligonucleotide
gtctgcttggagagatcacctacattgtgttgc

SEQ ID NO: 223654 - DNA, 34 bp, Artificial Sequence
  Description of Artificial Sequence: Synthetic oligonucleotide
tctgcttggagagatcacctacattgtgttgctg

SEQ ID NO: 223655 - DNA, 33 bp, Artificial Sequence
  Description of Artificial Sequence: Synthetic oligonucleotide
ctgcttggagagatcacctacattgtgttgctg

SEQ ID NO: 223656 - DNA, 33 bp, Artificial Sequence
  Description of Artificial Sequence: Synthetic oligonucleotide
tgcttggagagatcacctacattgtgttgctgg

SEQ ID NO: 223657 - DNA, 32 bp, Artificial Sequence
  Description of Artificial Sequence: Synthetic oligonucleotide
gcttggagagatcacctacattgtgttgctgg

SEQ ID NO: 223658 - DNA, 33 bp, Artificial Sequence
  Description of Artificial Sequence: Synthetic oligonucleotide
cttggagagatcacctacattgtgttgctggtg

SEQ ID NO: 223659 - DNA, 33 bp, Artificial Sequence
  Description of Artificial Sequence: Synthetic oligonucleotide
ttggagagatcacctacattgtgttgctggtgc

SEQ ID NO: 223660 - DNA, 32 bp, Artificial Sequence
  Description of Artificial Sequence: Synthetic oligonucleotide
tggagagatcacctacattgtgttgctggtgc

SEQ ID NO: 223661 - DNA, 31 bp, Artificial Sequence
  Description of Artificial Sequence: Synthetic oligonucleotide
ggagagatcacctacattgtgttgctggtgc

SEQ ID NO: 223662 - DNA, 33 bp, Artificial Sequence
  Description of Artificial Sequence: Synthetic oligonucleotide
gagagatcacctacattgtgttgctggtgcttg

SEQ ID NO: 223663 - DNA, 36 bp, Artificial Sequence
  Description of Artificial Sequence: Synthetic oligonucleotide
agagatcacctacattgtgttgctggtgcttgatac

SEQ ID NO: 223664 - DNA, 35 bp, Artificial Sequence
  Description of Artificial Sequence: Synthetic oligonucleotide
gagatcacctacattgtgttgctggtgcttgatac

SEQ ID NO: 223665 - DNA, 35 bp, Artificial Sequence
  Description of Artificial Sequence: Synthetic oligonucleotide
agatcacctacattgtgttgctggtgcttgatacc

SEQ ID NO: 223666 - DNA, 34 bp, Artificial Sequence
  Description of Artificial Sequence: Synthetic oligonucleotide
gatcacctacattgtgttgctggtgcttgatacc

SEQ ID NO: 223667 - DNA, 34 bp, Artificial Sequence
  Description of Artificial Sequence: Synthetic oligonucleotide
atcacctacattgtgttgctggtgcttgataccg

SEQ ID NO: 223668 - DNA, 33 bp, Artificial Sequence
  Description of Artificial Sequence: Synthetic oligonucleotide
tcacctacattgtgttgctggtgcttgataccg

SEQ ID NO: 223669 - DNA, 32 bp, Artificial Sequence
  Description of Artificial Sequence: Synthetic oligonucleotide
cacctacattgtgttgctggtgcttgataccg

SEQ ID NO: 223670 - DNA, 33 bp, Artificial Sequence
  Description of Artificial Sequence: Synthetic oligonucleotide
acctacattgtgttgctggtgcttgataccgtc

SEQ ID NO: 223671 - DNA, 32 bp, Artificial Sequence
  Description of Artificial Sequence: Synthetic oligonucleotide
cctacattgtgttgctggtgcttgataccgtc

SEQ ID NO: 223672 - DNA, 24 bp, Artificial Sequence
  Description of Artificial Sequence: Synthetic oligonucleotide
cgtcgggggagccaagtacctgct

SEQ ID NO: 223673 - DNA, 24 bp, Artificial Sequence
  Description of Artificial Sequence: Synthetic oligonucleotide
gtcgggggagccaagtacctgctg

SEQ ID NO: 223674 - DNA, 32 bp, Artificial Sequence
  Description of Artificial Sequence: Synthetic oligonucleotide
tctgctctgctgagaagtccaatcgaaaggac

SEQ ID NO: 223675 - DNA, 31 bp, Artificial Sequence
  Description of Artificial Sequence: Synthetic oligonucleotide
ctgctctgctgagaagtccaatcgaaaggac

SEQ ID NO: 223676 - DNA, 31 bp, Artificial Sequence
  Description of Artificial Sequence: Synthetic oligonucleotide
tgctctgctgagaagtccaatcgaaaggacg

SEQ ID NO: 223677 - DNA, 30 bp, Artificial Sequence
  Description of Artificial Sequence: Synthetic oligonucleotide
gctctgctgagaagtccaatcgaaaggacg

SEQ ID NO: 223678 - DNA, 33 bp, Artificial Sequence
  Description of Artificial Sequence: Synthetic oligonucleotide
ctctgctgagaagtccaatcgaaaggacgaatg

SEQ ID NO: 223679 - DNA, 33 bp, Artificial Sequence
  Description of Artificial Sequence: Synthetic oligonucleotide
tctgctgagaagtccaatcgaaaggacgaatgc

SEQ ID NO: 223680 - DNA, 32 bp, Artificial Sequence
  Description of Artificial Sequence: Synthetic oligonucleotide
ctgctgagaagtccaatcgaaaggacgaatgc

SEQ ID NO: 223681 - DNA, 32 bp, Artificial Sequence
  Description of Artificial Sequence: Synthetic oligonucleotide
tgctgagaagtccaatcgaaaggacgaatgcc

SEQ ID NO: 223682 - DNA, 31 bp, Artificial Sequence
  Description of Artificial Sequence: Synthetic oligonucleotide
gctgagaagtccaatcgaaaggacgaatgcc

SEQ ID NO: 223683 - DNA, 31 bp, Artificial Sequence
  Description of Artificial Sequence: Synthetic oligonucleotide
ctgagaagtccaatcgaaaggacgaatgccg

SEQ ID NO: 223684 - DNA, 32 bp, Artificial Sequence
  Description of Artificial Sequence: Synthetic oligonucleotide
tgagaagtccaatcgaaaggacgaatgccgtg

SEQ ID NO: 223685 - DNA, 31 bp, Artificial Sequence
  Description of Artificial Sequence: Synthetic oligonucleotide
gagaagtccaatcgaaaggacgaatgccgtg

SEQ ID NO: 223686 - DNA, 33 bp, Artificial Sequence
  Description of Artificial Sequence: Synthetic oligonucleotide
agaagtccaatcgaaaggacgaatgccgtgttc

SEQ ID NO: 223687 - DNA, 32 bp, Artificial Sequence
  Description of Artificial Sequence: Synthetic oligonucleotide
gaagtccaatcgaaaggacgaatgccgtgttc

SEQ ID NO: 223688 - DNA, 34 bp, Artificial Sequence
  Description of Artificial Sequence: Synthetic oligonucleotide
aagtccaatcgaaaggacgaatgccgtgttcaac

SEQ ID NO: 223689 - DNA, 33 bp, Artificial Sequence
  Description of Artificial Sequence: Synthetic oligonucleotide
agtccaatcgaaaggacgaatgccgtgttcaac

SEQ ID NO: 223690 - DNA, 32 bp, Artificial Sequence
  Description of Artificial Sequence: Synthetic oligonucleotide
gtccaatcgaaaggacgaatgccgtgttcaac

SEQ ID NO: 223691 - DNA, 33 bp, Artificial Sequence
  Description of Artificial Sequence: Synthetic oligonucleotide
tccaatcgaaaggacgaatgccgtgttcaacac

SEQ ID NO: 223692 - DNA, 32 bp, Artificial Sequence
  Description of Artificial Sequence: Synthetic oligonucleotide
ccaatcgaaaggacgaatgccgtgttcaacac

SEQ ID NO: 223693 - DNA, 32 bp, Artificial Sequence
  Description of Artificial Sequence: Synthetic oligonucleotide
caatcgaaaggacgaatgccgtgttcaacacc

SEQ ID NO: 223694 - DNA, 34 bp, Artificial Sequence
  Description of Artificial Sequence: Synthetic oligonucleotide
aatcgaaaggacgaatgccgtgttcaacacctac

SEQ ID NO: 223695 - DNA, 33 bp, Artificial Sequence
  Description of Artificial Sequence: Synthetic oligonucleotide
atcgaaaggacgaatgccgtgttcaacacctac

SEQ ID NO: 223696 - DNA, 32 bp, Artificial Sequence
  Description of Artificial Sequence: Synthetic oligonucleotide
tcgaaaggacgaatgccgtgttcaacacctac

SEQ ID NO: 223697 - DNA, 31 bp, Artificial Sequence
  Description of Artificial Sequence: Synthetic oligonucleotide
cgaaaggacgaatgccgtgttcaacacctac

SEQ ID NO: 223698 - DNA, 34 bp, Artificial Sequence
  Description of Artificial Sequence: Synthetic oligonucleotide
gaaaggacgaatgccgtgttcaacacctactatg

SEQ ID NO: 223699 - DNA, 34 bp, Artificial Sequence
  Description of Artificial Sequence: Synthetic oligonucleotide
aaaggacgaatgccgtgttcaacacctactatgc

SEQ ID NO: 223700 - DNA, 33 bp, Artificial Sequence
  Description of Artificial Sequence: Synthetic oligonucleotide
aaggacgaatgccgtgttcaacacctactatgc

SEQ ID NO: 223701 - DNA, 32 bp, Artificial Sequence
  Description of Artificial Sequence: Synthetic oligonucleotide
aggacgaatgccgtgttcaacacctactatgc

SEQ ID NO: 223702 - DNA, 31 bp, Artificial Sequence
  Description of Artificial Sequence: Synthetic oligonucleotide
ggacgaatgccgtgttcaacacctactatgc

SEQ ID NO: 223703 - DNA, 32 bp, Artificial Sequence
  Description of Artificial Sequence: Synthetic oligonucleotide
gacgaatgccgtgttcaacacctactatgctg

SEQ ID NO: 223704 - DNA, 34 bp, Artificial Sequence
  Description of Artificial Sequence: Synthetic oligonucleotide
acgaatgccgtgttcaacacctactatgctgtag

SEQ ID NO: 223705 - DNA, 33 bp, Artificial Sequence
  Description of Artificial Sequence: Synthetic oligonucleotide
cgaatgccgtgttcaacacctactatgctgtag

SEQ ID NO: 223706 - DNA, 41 bp, Artificial Sequence
  Description of Artificial Sequence: Synthetic oligonucleotide
cacctcatgaggctaaatattttgatgaccaagttttctgc

SEQ ID NO: 223707 - DNA, 43 bp, Artificial Sequence
  Description of Artificial Sequence: Synthetic oligonucleotide
acctcatgaggctaaatattttgatgaccaagttttctgcaag

SEQ ID NO: 223708 - DNA, 29 bp, Artificial Sequence
  Description of Artificial Sequence: Synthetic oligonucleotide
atgagctctaagtacccgtggtctgtccg

SEQ ID NO: 223709 - DNA, 28 bp, Artificial Sequence
  Description of Artificial Sequence: Synthetic oligonucleotide
tgagctctaagtacccgtggtctgtccg

SEQ ID NO: 223710 - DNA, 27 bp, Artificial Sequence
  Description of Artificial Sequence: Synthetic oligonucleotide
gagctctaagtacccgtggtctgtccg

SEQ ID NO: 223711 - DNA, 27 bp, Artificial Sequence
  Description of Artificial Sequence: Synthetic oligonucleotide
agctctaagtacccgtggtctgtccgg

SEQ ID NO: 223712 - DNA, 26 bp, Artificial Sequence
  Description of Artificial Sequence: Synthetic oligonucleotide
gctctaagtacccgtggtctgtccgg

SEQ ID NO: 223713 - DNA, 26 bp, Artificial Sequence
  Description of Artificial Sequence: Synthetic oligonucleotide
ctctaagtacccgtggtctgtccggc

SEQ ID NO: 223714 - DNA, 26 bp, Artificial Sequence
  Description of Artificial Sequence: Synthetic oligonucleotide
tctaagtacccgtggtctgtccggcg

SEQ ID NO: 223715 - DNA, 25 bp, Artificial Sequence
  Description of Artificial Sequence: Synthetic oligonucleotide
ctaagtacccgtggtctgtccggcg

SEQ ID NO: 223716 - DNA, 26 bp, Artificial Sequence
  Description of Artificial Sequence: Synthetic oligonucleotide
taagtacccgtggtctgtccggcgct

SEQ ID NO: 223717 - DNA, 25 bp, Artificial Sequence
  Description of Artificial Sequence: Synthetic oligonucleotide
aagtacccgtggtctgtccggcgct

SEQ ID NO: 223718 - DNA, 24 bp, Artificial Sequence
  Description of Artificial Sequence: Synthetic oligonucleotide
agtacccgtggtctgtccggcgct

SEQ ID NO: 223719 - DNA, 23 bp, Artificial Sequence
  Description of Artificial Sequence: Synthetic oligonucleotide
gtacccgtggtctgtccggcgct

SEQ ID NO: 223720 - DNA, 23 bp, Artificial Sequence
  Description of Artificial Sequence: Synthetic oligonucleotide
tacccgtggtctgtccggcgctg

SEQ ID NO: 223721 - DNA, 22 bp, Artificial Sequence
  Description of Artificial Sequence: Synthetic oligonucleotide
acccgtggtctgtccggcgctg

SEQ ID NO: 223722 - DNA, 21 bp, Artificial Sequence
  Description of Artificial Sequence: Synthetic oligonucleotide
cccgtggtctgtccggcgctg

SEQ ID NO: 223723 - DNA, 21 bp, Artificial Sequence
  Description of Artificial Sequence: Synthetic oligonucleotide
ccgtggtctgtccggcgctgc

SEQ ID NO: 223724 - DNA, 22 bp, Artificial Sequence
  Description of Artificial Sequence: Synthetic oligonucleotide
cgtggtctgtccggcgctgcct

SEQ ID NO: 223725 - DNA, 22 bp, Artificial Sequence
  Description of Artificial Sequence: Synthetic oligonucleotide
gtggtctgtccggcgctgcctg

SEQ ID NO: 223726 - DNA, 22 bp, Artificial Sequence
  Description of Artificial Sequence: Synthetic oligonucleotide
tggtctgtccggcgctgcctgc

SEQ ID NO: 223727 - DNA, 27 bp, Artificial Sequence
  Description of Artificial Sequence: Synthetic oligonucleotide
tgctggtgcttgataccgtcggagcca

SEQ ID NO: 223728 - DNA, 26 bp, Artificial Sequence
  Description of Artificial Sequence: Synthetic oligonucleotide
gctggtgcttgataccgtcggagcca

SEQ ID NO: 223729 - DNA, 26 bp, Artificial Sequence
  Description of Artificial Sequence: Synthetic oligonucleotide
ctggtgcttgataccgtcggagccag

SEQ ID NO: 223730 - DNA, 27 bp, Artificial Sequence
  Description of Artificial Sequence: Synthetic oligonucleotide
tggtgcttgataccgtcggagccagca

SEQ ID NO: 223731 - DNA, 27 bp, Artificial Sequence
  Description of Artificial Sequence: Synthetic oligonucleotide
ggtgcttgataccgtcggagccagcaa

SEQ ID NO: 223732 - DNA, 28 bp, Artificial Sequence
  Description of Artificial Sequence: Synthetic oligonucleotide
gtgcttgataccgtcggagccagcaatg

SEQ ID NO: 223733 - DNA, 28 bp, Artificial Sequence
  Description of Artificial Sequence: Synthetic oligonucleotide
tgcttgataccgtcggagccagcaatgg

SEQ ID NO: 223734 - DNA, 27 bp, Artificial Sequence
  Description of Artificial Sequence: Synthetic oligonucleotide
gcttgataccgtcggagccagcaatgg

SEQ ID NO: 223735 - DNA, 27 bp, Artificial Sequence
  Description of Artificial Sequence: Synthetic oligonucleotide
cttgataccgtcggagccagcaatggc

SEQ ID NO: 223736 - DNA, 28 bp, Artificial Sequence
  Description of Artificial Sequence: Synthetic oligonucleotide
gcgccctcttcttgtggatgttctggtc

SEQ ID NO: 223737 - DNA, 30 bp, Artificial Sequence
  Description of Artificial Sequence: Synthetic oligonucleotide
cgccctcttcttgtggatgttctggtcaag

SEQ ID NO: 223738 - DNA, 33 bp, Artificial Sequence
  Description of Artificial Sequence: Synthetic oligonucleotide
gccctcttcttgtggatgttctggtcaagtttc

SEQ ID NO: 223739 - DNA, 35 bp, Artificial Sequence
  Description of Artificial Sequence: Synthetic oligonucleotide
ccctcttcttgtggatgttctggtcaagtttcaac

SEQ ID NO: 223740 - DNA, 36 bp, Artificial Sequence
  Description of Artificial Sequence: Synthetic oligonucleotide
cctcttcttgtggatgttctggtcaagtttcaactc

SEQ ID NO: 223741 - DNA, 37 bp, Artificial Sequence
  Description of Artificial Sequence: Synthetic oligonucleotide
ctcttcttgtggatgttctggtcaagtttcaactctg

SEQ ID NO: 223742 - DNA, 37 bp, Artificial Sequence
  Description of Artificial Sequence: Synthetic oligonucleotide
tcttcttgtggatgttctggtcaagtttcaactctgc

SEQ ID NO: 223743 - DNA, 36 bp, Artificial Sequence
  Description of Artificial Sequence: Synthetic oligonucleotide
cttcttgtggatgttctggtcaagtttcaactctgc

SEQ ID NO: 223744 - DNA, 37 bp, Artificial Sequence
  Description of Artificial Sequence: Synthetic oligonucleotide
ttcttgtggatgttctggtcaagtttcaactctgctc

SEQ ID NO: 223745 - DNA, 36 bp, Artificial Sequence
  Description of Artificial Sequence: Synthetic oligonucleotide
tcttgtggatgttctggtcaagtttcaactctgctc

SEQ ID NO: 223746 - DNA, 35 bp, Artificial Sequence
  Description of Artificial Sequence: Synthetic oligonucleotide
cttgtggatgttctggtcaagtttcaactctgctc

SEQ ID NO: 223747 - DNA, 36 bp, Artificial Sequence
  Description of Artificial Sequence: Synthetic oligonucleotide
ttgtggatgttctggtcaagtttcaactctgctctg

SEQ ID NO: 223748 - DNA, 35 bp, Artificial Sequence
  Description of Artificial Sequence: Synthetic oligonucleotide
tgtggatgttctggtcaagtttcaactctgctctg

SEQ ID NO: 223749 - DNA, 34 bp, Artificial Sequence
  Description of Artificial Sequence: Synthetic oligonucleotide
gtggatgttctggtcaagtttcaactctgctctg

SEQ ID NO: 223750 - DNA, 34 bp, Artificial Sequence
  Description of Artificial Sequence: Synthetic oligonucleotide
tggatgttctggtcaagtttcaactctgctctgc

SEQ ID NO: 223751 - DNA, 33 bp, Artificial Sequence
  Description of Artificial Sequence: Synthetic oligonucleotide
ggatgttctggtcaagtttcaactctgctctgc

SEQ ID NO: 223752 - DNA, 34 bp, Artificial Sequence
  Description of Artificial Sequence: Synthetic oligonucleotide
gatgttctggtcaagtttcaactctgctctgctg

SEQ ID NO: 223753 - DNA, 35 bp, Artificial Sequence
  Description of Artificial Sequence: Synthetic oligonucleotide
atgttctggtcaagtttcaactctgctctgctgag

SEQ ID NO: 223754 - DNA, 34 bp, Artificial Sequence
  Description of Artificial Sequence: Synthetic oligonucleotide
tgttctggtcaagtttcaactctgctctgctgag

SEQ ID NO: 223755 - DNA, 33 bp, Artificial Sequence
  Description of Artificial Sequence: Synthetic oligonucleotide
gttctggtcaagtttcaactctgctctgctgag

SEQ ID NO: 223756 - DNA, 35 bp, Artificial Sequence
  Description of Artificial Sequence: Synthetic oligonucleotide
ttctggtcaagtttcaactctgctctgctgagaag

SEQ ID NO: 223757 - DNA, 34 bp, Artificial Sequence
  Description of Artificial Sequence: Synthetic oligonucleotide
tctggtcaagtttcaactctgctctgctgagaag

SEQ ID NO: 223758 - DNA, 33 bp, Artificial Sequence
  Description of Artificial Sequence: Synthetic oligonucleotide
ctggtcaagtttcaactctgctctgctgagaag

SEQ ID NO: 223759 - DNA, 34 bp, Artificial Sequence
  Description of Artificial Sequence: Synthetic oligonucleotide
tggtcaagtttcaactctgctctgctgagaagtc

SEQ ID NO: 223760 - DNA, 33 bp, Artificial Sequence
  Description of Artificial Sequence: Synthetic oligonucleotide
ggtcaagtttcaactctgctctgctgagaagtc

SEQ ID NO: 223761 - DNA, 33 bp, Artificial Sequence
  Description of Artificial Sequence: Synthetic oligonucleotide
gtcaagtttcaactctgctctgctgagaagtcc

SEQ ID NO: 223762 - DNA, 36 bp, Artificial Sequence
  Description of Artificial Sequence: Synthetic oligonucleotide
tcaagtttcaactctgctctgctgagaagtccaatc

SEQ ID NO: 223763 - DNA, 29 bp, Artificial Sequence
  Description of Artificial Sequence: Synthetic oligonucleotide
tgatagctctcacgtctggtctcctgacc

SEQ ID NO: 223764 - DNA, 28 bp, Artificial Sequence
  Description of Artificial Sequence: Synthetic oligonucleotide
gatagctctcacgtctggtctcctgacc

SEQ ID NO: 223765 - DNA, 28 bp, Artificial Sequence
  Description of Artificial Sequence: Synthetic oligonucleotide
atagctctcacgtctggtctcctgaccg

SEQ ID NO: 223766 - DNA, 28 bp, Artificial Sequence
  Description of Artificial Sequence: Synthetic oligonucleotide
atgagctctaagtacccgcggtctgacc

SEQ ID NO: 223767 - DNA, 27 bp, Artificial Sequence
  Description of Artificial Sequence: Synthetic oligonucleotide
tgagctctaagtacccgcggtctgacc

SEQ ID NO: 223768 - DNA, 26 bp, Artificial Sequence
  Description of Artificial Sequence: Synthetic oligonucleotide
gagctctaagtacccgcggtctgacc

SEQ ID NO: 223769 - DNA, 26 bp, Artificial Sequence
  Description of Artificial Sequence: Synthetic oligonucleotide
agctctaagtacccgcggtctgaccg

SEQ ID NO: 223770 - DNA, 25 bp, Artificial Sequence
  Description of Artificial Sequence: Synthetic oligonucleotide
gctctaagtacccgcggtctgaccg

SEQ ID NO: 223771 - DNA, 25 bp, Artificial Sequence
  Description of Artificial Sequence: Synthetic oligonucleotide
ctctaagtacccgcggtctgaccgg

SEQ ID NO: 223772 - DNA, 25 bp, Artificial Sequence
  Description of Artificial Sequence: Synthetic oligonucleotide
tctaagtacccgcggtctgaccggc

SEQ ID NO: 223773 - DNA, 24 bp, Artificial Sequence
  Description of Artificial Sequence: Synthetic oligonucleotide
ctaagtacccgcggtctgaccggc

SEQ ID NO: 223774 - DNA, 24 bp, Artificial Sequence
  Description of Artificial Sequence: Synthetic oligonucleotide
taagtacccgcggtctgaccggcg

SEQ ID NO: 223775 - DNA, 23 bp, Artificial Sequence
  Description of Artificial Sequence: Synthetic oligonucleotide
aagtacccgcggtctgaccggcg

SEQ ID NO: 223776 - DNA, 22 bp, Artificial Sequence
  Description of Artificial Sequence: Synthetic oligonucleotide
agtacccgcggtctgaccggcg

SEQ ID NO: 223777 - DNA, 21 bp, Artificial Sequence
  Description of Artificial Sequence: Synthetic oligonucleotide
gtacccgcggtctgaccggcg

SEQ ID NO: 223778 - DNA, 22 bp, Artificial Sequence
  Description of Artificial Sequence: Synthetic oligonucleotide
tacccgcggtctgaccggcgct

SEQ ID NO: 223779 - DNA, 21 bp, Artificial Sequence
  Description of Artificial Sequence: Synthetic oligonucleotide
acccgcggtctgaccggcgct

SEQ ID NO: 223780 - DNA, 20 bp, Artificial Sequence
  Description of Artificial Sequence: Synthetic oligonucleotide
cccgcggtctgaccggcgct

SEQ ID NO: 223781 - DNA, 20 bp, Artificial Sequence
  Description of Artificial Sequence: Synthetic oligonucleotide
ccgcggtctgaccggcgctg

SEQ ID NO: 223782 - DNA, 20 bp, Artificial Sequence
  Description of Artificial Sequence: Synthetic oligonucleotide
cgcggtctgaccggcgctgc

SEQ ID NO: 223783 - DNA, 21 bp, Artificial Sequence
  Description of Artificial Sequence: Synthetic oligonucleotide
gcggtctgaccggcgctgcct

SEQ ID NO: 223784 - DNA, 21 bp, Artificial Sequence
  Description of Artificial Sequence: Synthetic oligonucleotide
cggtctgaccggcgctgcctg

SEQ ID NO: 223785 - DNA, 21 bp, Artificial Sequence
  Description of Artificial Sequence: Synthetic oligonucleotide
ggtctgaccggcgctgcctgc

SEQ ID NO: 223786 - DNA, 21 bp, Artificial Sequence
  Description of Artificial Sequence: Synthetic oligonucleotide
gtctgaccggcgctgcctgcc

SEQ ID NO: 223787 - DNA, 21 bp, Artificial Sequence
  Description of Artificial Sequence: Synthetic oligonucleotide
tctgaccggcgctgcctgccc

SEQ ID NO: 223788 - DNA, 20 bp, Artificial Sequence
  Description of Artificial Sequence: Synthetic oligonucleotide
ctgaccggcgctgcctgccc

SEQ ID NO: 223789 - DNA, 21 bp, Artificial Sequence
  Description of Artificial Sequence: Synthetic oligonucleotide
tgaccggcgctgcctgcccct

SEQ ID NO: 223790 - DNA, 20 bp, Artificial Sequence
  Description of Artificial Sequence: Synthetic oligonucleotide
gaccggcgctgcctgcccct

SEQ ID NO: 223791 - DNA, 21 bp, Artificial Sequence
  Description of Artificial Sequence: Synthetic oligonucleotide
accggcgctgcctgcccctct

SEQ ID NO: 223792 - DNA, 29 bp, Artificial Sequence
  Description of Artificial Sequence: Synthetic oligonucleotide
atgagctctaagtacctgcggtctgtccg

SEQ ID NO: 223793 - DNA, 28 bp, Artificial Sequence
  Description of Artificial Sequence: Synthetic oligonucleotide
tgagctctaagtacctgcggtctgtccg

SEQ ID NO: 223794 - DNA, 27 bp, Artificial Sequence
  Description of Artificial Sequence: Synthetic oligonucleotide
gagctctaagtacctgcggtctgtccg

SEQ ID NO: 223795 - DNA, 27 bp, Artificial Sequence
  Description of Artificial Sequence: Synthetic oligonucleotide
agctctaagtacctgcggtctgtccgg

SEQ ID NO: 223796 - DNA, 26 bp, Artificial Sequence
  Description of Artificial Sequence: Synthetic oligonucleotide
gctctaagtacctgcggtctgtccgg

SEQ ID NO: 223797 - DNA, 26 bp, Artificial Sequence
  Description of Artificial Sequence: Synthetic oligonucleotide
ctctaagtacctgcggtctgtccggc

SEQ ID NO: 223798 - DNA, 26 bp, Artificial Sequence
  Description of Artificial Sequence: Synthetic oligonucleotide
tctaagtacctgcggtctgtccggcg

SEQ ID NO: 223799 - DNA, 25 bp, Artificial Sequence
  Description of Artificial Sequence: Synthetic oligonucleotide
ctaagtacctgcggtctgtccggcg

SEQ ID NO: 223800 - DNA, 26 bp, Artificial Sequence
  Description of Artificial Sequence: Synthetic oligonucleotide
taagtacctgcggtctgtccggcgct

SEQ ID NO: 223801 - DNA, 25 bp, Artificial Sequence
  Description of Artificial Sequence: Synthetic oligonucleotide
aagtacctgcggtctgtccggcgct

SEQ ID NO: 223802 - DNA, 24 bp, Artificial Sequence
  Description of Artificial Sequence: Synthetic oligonucleotide
agtacctgcggtctgtccggcgct

SEQ ID NO: 223803 - DNA, 23 bp, Artificial Sequence
  Description of Artificial Sequence: Synthetic oligonucleotide
gtacctgcggtctgtccggcgct

SEQ ID NO: 223804 - DNA, 23 bp, Artificial Sequence
  Description of Artificial Sequence: Synthetic oligonucleotide
tacctgcggtctgtccggcgctg

SEQ ID NO: 223805 - DNA, 22 bp, Artificial Sequence
  Description of Artificial Sequence: Synthetic oligonucleotide
acctgcggtctgtccggcgctg

SEQ ID NO: 223806 - DNA, 21 bp, Artificial Sequence
  Description of Artificial Sequence: Synthetic oligonucleotide
cctgcggtctgtccggcgctg

SEQ ID NO: 223807 - DNA, 21 bp, Artificial Sequence
  Description of Artificial Sequence: Synthetic oligonucleotide
ctgcggtctgtccggcgctgc

SEQ ID NO: 223808 - DNA, 22 bp, Artificial Sequence
  Description of Artificial Sequence: Synthetic oligonucleotide
tgcggtctgtccggcgctgcct

SEQ ID NO: 223809 - DNA, 33 bp, Artificial Sequence
  Description of Artificial Sequence: Synthetic oligonucleotide
tacaacttcagcttgctgggtctgcttggaatg

SEQ ID NO: 223810 - DNA, 32 bp, Artificial Sequence
  Description of Artificial Sequence: Synthetic oligonucleotide
acaacttcagcttgctgggtctgcttggaatg

SEQ ID NO: 223811 - DNA, 31 bp, Artificial Sequence
  Description of Artificial Sequence: Synthetic oligonucleotide
caacttcagcttgctgggtctgcttggaatg

SEQ ID NO: 223812 - DNA, 33 bp, Artificial Sequence
  Description of Artificial Sequence: Synthetic oligonucleotide
aacttcagcttgctgggtctgcttggaatgatc

SEQ ID NO: 223813 - DNA, 32 bp, Artificial Sequence
  Description of Artificial Sequence: Synthetic oligonucleotide
acttcagcttgctgggtctgcttggaatgatc

SEQ ID NO: 223814 - DNA, 31 bp, Artificial Sequence
  Description of Artificial Sequence: Synthetic oligonucleotide
cttcagcttgctgggtctgcttggaatgatc

SEQ ID NO: 223815 - DNA, 33 bp, Artificial Sequence
  Description of Artificial Sequence: Synthetic oligonucleotide
ttcagcttgctgggtctgcttggaatgatcatc

SEQ ID NO: 223816 - DNA, 32 bp, Artificial Sequence
  Description of Artificial Sequence: Synthetic oligonucleotide
tcagcttgctgggtctgcttggaatgatcatc

SEQ ID NO: 223817 - DNA, 31 bp, Artificial Sequence
  Description of Artificial Sequence: Synthetic oligonucleotide
cagcttgctgggtctgcttggaatgatcatc

SEQ ID NO: 223818 - DNA, 33 bp, Artificial Sequence
  Description of Artificial Sequence: Synthetic oligonucleotide
agcttgctgggtctgcttggaatgatcatctac

SEQ ID NO: 223819 - DNA, 32 bp, Artificial Sequence
  Description of Artificial Sequence: Synthetic oligonucleotide
gcttgctgggtctgcttggaatgatcatctac

SEQ ID NO: 223820 - DNA, 35 bp, Artificial Sequence
  Description of Artificial Sequence: Synthetic oligonucleotide
cttgctgggtctgcttggaatgatcatctacattg

SEQ ID NO: 223821 - DNA, 36 bp, Artificial Sequence
  Description of Artificial Sequence: Synthetic oligonucleotide
ttgctgggtctgcttggaatgatcatctacattgtg

SEQ ID NO: 223822 - DNA, 35 bp, Artificial Sequence
  Description of Artificial Sequence: Synthetic oligonucleotide
tgctgggtctgcttggaatgatcatctacattgtg

SEQ ID NO: 223823 - DNA, 34 bp, Artificial Sequence
  Description of Artificial Sequence: Synthetic oligonucleotide
gctgggtctgcttggaatgatcatctacattgtg

SEQ ID NO: 223824 - DNA, 34 bp, Artificial Sequence
  Description of Artificial Sequence: Synthetic oligonucleotide
ctgggtctgcttggaatgatcatctacattgtgc

SEQ ID NO: 223825 - DNA, 35 bp, Artificial Sequence
  Description of Artificial Sequence: Synthetic oligonucleotide
tgggtctgcttggaatgatcatctacattgtgctg

SEQ ID NO: 223826 - DNA, 34 bp, Artificial Sequence
  Description of Artificial Sequence: Synthetic oligonucleotide
gggtctgcttggaatgatcatctacattgtgctg

SEQ ID NO: 223827 - DNA, 34 bp, Artificial Sequence
  Description of Artificial Sequence: Synthetic oligonucleotide
ggtctgcttggaatgatcatctacattgtgctgc

SEQ ID NO: 223828 - DNA, 35 bp, Artificial Sequence
  Description of Artificial Sequence: Synthetic oligonucleotide
gtctgcttggaatgatcatctacattgtgctgctg

SEQ ID NO: 223829 - DNA, 35 bp, Artificial Sequence
  Description of Artificial Sequence: Synthetic oligonucleotide
tctgcttggaatgatcatctacattgtgctgctgg

SEQ ID NO: 223830 - DNA, 34 bp, Artificial Sequence
  Description of Artificial Sequence: Synthetic oligonucleotide
ctgcttggaatgatcatctacattgtgctgctgg

SEQ ID NO: 223831 - DNA, 35 bp, Artificial Sequence
  Description of Artificial Sequence: Synthetic oligonucleotide
tgcttggaatgatcatctacattgtgctgctggtg

SEQ ID NO: 223832 - DNA, 34 bp, Artificial Sequence
  Description of Artificial Sequence: Synthetic oligonucleotide
gcttggaatgatcatctacattgtgctgctggtg

SEQ ID NO: 223833 - DNA, 34 bp, Artificial Sequence
  Description of Artificial Sequence: Synthetic oligonucleotide
cttggaatgatcatctacattgtgctgctggtgc

SEQ ID NO: 223834 - DNA, 36 bp, Artificial Sequence
  Description of Artificial Sequence: Synthetic oligonucleotide
ttggaatgatcatctacattgtgctgctggtgcttg

SEQ ID NO: 223835 - DNA, 35 bp, Artificial Sequence
  Description of Artificial Sequence: Synthetic oligonucleotide
tggaatgatcatctacattgtgctgctggtgcttg

SEQ ID NO: 223836 - DNA, 34 bp, Artificial Sequence
  Description of Artificial Sequence: Synthetic oligonucleotide
ggaatgatcatctacattgtgctgctggtgcttg

SEQ ID NO: 223837 - DNA, 37 bp, Artificial Sequence
  Description of Artificial Sequence: Synthetic oligonucleotide
gaatgatcatctacattgtgctgctggtgcttgatac

SEQ ID NO: 223838 - DNA, 37 bp, Artificial Sequence
  Description of Artificial Sequence: Synthetic oligonucleotide
aatgatcatctacattgtgctgctggtgcttgatacc

SEQ ID NO: 223839 - DNA, 36 bp, Artificial Sequence
  Description of Artificial Sequence: Synthetic oligonucleotide
atgatcatctacattgtgctgctggtgcttgatacc

SEQ ID NO: 223840 - DNA, 35 bp, Artificial Sequence
  Description of Artificial Sequence: Synthetic oligonucleotide
tgatcatctacattgtgctgctggtgcttgatacc

SEQ ID NO: 223841 - DNA, 32 bp, Artificial Sequence
  Description of Artificial Sequence: Synthetic oligonucleotide
ggaacggaggataaagatcagacagcaacgac

SEQ ID NO: 223842 - DNA, 33 bp, Artificial Sequence
  Description of Artificial Sequence: Synthetic oligonucleotide
gaacggaggataaagatcagacagcaacgacac

SEQ ID NO: 223843 - DNA, 33 bp, Artificial Sequence
  Description of Artificial Sequence: Synthetic oligonucleotide
aacggaggataaagatcagacagcaacgacacc

SEQ ID NO: 223844 - DNA, 32 bp, Artificial Sequence
  Description of Artificial Sequence: Synthetic oligonucleotide
acggaggataaagatcagacagcaacgacacc

SEQ ID NO: 223845 - DNA, 31 bp, Artificial Sequence
  Description of Artificial Sequence: Synthetic oligonucleotide
cggaggataaagatcagacagcaacgacacc

SEQ ID NO: 223846 - DNA, 31 bp, Artificial Sequence
  Description of Artificial Sequence: Synthetic oligonucleotide
ggaggataaagatcagacagcaacgacaccc

SEQ ID NO: 223847 - DNA, 32 bp, Artificial Sequence
  Description of Artificial Sequence: Synthetic oligonucleotide
gaggataaagatcagacagcaacgacacccag

SEQ ID NO: 223848 - DNA, 35 bp, Artificial Sequence
  Description of Artificial Sequence: Synthetic oligonucleotide
aggataaagatcagacagcaacgacacccagtttg

SEQ ID NO: 223849 - DNA, 34 bp, Artificial Sequence
  Description of Artificial Sequence: Synthetic oligonucleotide
ggataaagatcagacagcaacgacacccagtttg

SEQ ID NO: 223850 - DNA, 35 bp, Artificial Sequence
  Description of Artificial Sequence: Synthetic oligonucleotide
gataaagatcagacagcaacgacacccagtttgtc

SEQ ID NO: 223851 - DNA, 36 bp, Artificial Sequence
  Description of Artificial Sequence: Synthetic oligonucleotide
ataaagatcagacagcaacgacacccagtttgtctg

SEQ ID NO: 223852 - DNA, 35 bp, Artificial Sequence
  Description of Artificial Sequence: Synthetic oligonucleotide
taaagatcagacagcaacgacacccagtttgtctg

SEQ ID NO: 223853 - DNA, 34 bp, Artificial Sequence
  Description of Artificial Sequence: Synthetic oligonucleotide
aaagatcagacagcaacgacacccagtttgtctg

SEQ ID NO: 223854 - DNA, 33 bp, Artificial Sequence
  Description of Artificial Sequence: Synthetic oligonucleotide
aagatcagacagcaacgacacccagtttgtctg

SEQ ID NO: 223855 - DNA, 32 bp, Artificial Sequence
  Description of Artificial Sequence: Synthetic oligonucleotide
agatcagacagcaacgacacccagtttgtctg

SEQ ID NO: 223856 - DNA, 31 bp, Artificial Sequence
  Description of Artificial Sequence: Synthetic oligonucleotide
gatcagacagcaacgacacccagtttgtctg

SEQ ID NO: 223857 - DNA, 31 bp, Artificial Sequence
  Description of Artificial Sequence: Synthetic oligonucleotide
atcagacagcaacgacacccagtttgtctgc

SEQ ID NO: 223858 - DNA, 30 bp, Artificial Sequence
  Description of Artificial Sequence: Synthetic oligonucleotide
tcagacagcaacgacacccagtttgtctgc

SEQ ID NO: 223859 - DNA, 29 bp, Artificial Sequence
  Description of Artificial Sequence: Synthetic oligonucleotide
cagacagcaacgacacccagtttgtctgc

SEQ ID NO: 223860 - DNA, 29 bp, Artificial Sequence
  Description of Artificial Sequence: Synthetic oligonucleotide
agacagcaacgacacccagtttgtctgcc

SEQ ID NO: 223861 - DNA, 28 bp, Artificial Sequence
  Description of Artificial Sequence: Synthetic oligonucleotide
gacagcaacgacacccagtttgtctgcc

SEQ ID NO: 223862 - DNA, 30 bp, Artificial Sequence
  Description of Artificial Sequence: Synthetic oligonucleotide
acagcaacgacacccagtttgtctgccatg

SEQ ID NO: 223863 - DNA, 29 bp, Artificial Sequence
  Description of Artificial Sequence: Synthetic oligonucleotide
cagcaacgacacccagtttgtctgccatg

SEQ ID NO: 223864 - DNA, 29 bp, Artificial Sequence
  Description of Artificial Sequence: Synthetic oligonucleotide
agcaacgacacccagtttgtctgccatgc

SEQ ID NO: 223865 - DNA, 28 bp, Artificial Sequence
  Description of Artificial Sequence: Synthetic oligonucleotide
gcaacgacacccagtttgtctgccatgc

SEQ ID NO: 223866 - DNA, 29 bp, Artificial Sequence
  Description of Artificial Sequence: Synthetic oligonucleotide
caacgacacccagtttgtctgccatgctg

SEQ ID NO: 223867 - DNA, 29 bp, Artificial Sequence
  Description of Artificial Sequence: Synthetic oligonucleotide
aacgacacccagtttgtctgccatgctgg

SEQ ID NO: 223868 - DNA, 36 bp, Artificial Sequence
  Description of Artificial Sequence: Synthetic oligonucleotide
tttcaactctgctctgctgagaagtccaatcgaatg

SEQ ID NO: 223869 - DNA, 35 bp, Artificial Sequence
  Description of Artificial Sequence: Synthetic oligonucleotide
ttcaactctgctctgctgagaagtccaatcgaatg

SEQ ID NO: 223870 - DNA, 34 bp, Artificial Sequence
  Description of Artificial Sequence: Synthetic oligonucleotide
tcaactctgctctgctgagaagtccaatcgaatg

SEQ ID NO: 223871 - DNA, 33 bp, Artificial Sequence
  Description of Artificial Sequence: Synthetic oligonucleotide
caactctgctctgctgagaagtccaatcgaatg

SEQ ID NO: 223872 - DNA, 33 bp, Artificial Sequence
  Description of Artificial Sequence: Synthetic oligonucleotide
aactctgctctgctgagaagtccaatcgaatgg

SEQ ID NO: 223873 - DNA, 32 bp, Artificial Sequence
  Description of Artificial Sequence: Synthetic oligonucleotide
actctgctctgctgagaagtccaatcgaatgg

SEQ ID NO: 223874 - DNA, 31 bp, Artificial Sequence
  Description of Artificial Sequence: Synthetic oligonucleotide
ctctgctctgctgagaagtccaatcgaatgg

SEQ ID NO: 223875 - DNA, 33 bp, Artificial Sequence
  Description of Artificial Sequence: Synthetic oligonucleotide
tctgctctgctgagaagtccaatcgaatggaag

SEQ ID NO: 223876 - DNA, 32 bp, Artificial Sequence
  Description of Artificial Sequence: Synthetic oligonucleotide
ctgctctgctgagaagtccaatcgaatggaag

SEQ ID NO: 223877 - DNA, 35 bp, Artificial Sequence
  Description of Artificial Sequence: Synthetic oligonucleotide
tgctctgctgagaagtccaatcgaatggaagaatg

SEQ ID NO: 223878 - DNA, 34 bp, Artificial Sequence
  Description of Artificial Sequence: Synthetic oligonucleotide
gctctgctgagaagtccaatcgaatggaagaatg

SEQ ID NO: 223879 - DNA, 34 bp, Artificial Sequence
  Description of Artificial Sequence: Synthetic oligonucleotide
ctctgctgagaagtccaatcgaatggaagaatgc

SEQ ID NO: 223880 - DNA, 34 bp, Artificial Sequence
  Description of Artificial Sequence: Synthetic oligonucleotide
tctgctgagaagtccaatcgaatggaagaatgcc

SEQ ID NO: 223881 - DNA, 33 bp, Artificial Sequence
  Description of Artificial Sequence: Synthetic oligonucleotide
ctgctgagaagtccaatcgaatggaagaatgcc

SEQ ID NO: 223882 - DNA, 33 bp, Artificial Sequence
  Description of Artificial Sequence: Synthetic oligonucleotide
tgctgagaagtccaatcgaatggaagaatgccg

SEQ ID NO: 223883 - DNA, 32 bp, Artificial Sequence
  Description of Artificial Sequence: Synthetic oligonucleotide
gctgagaagtccaatcgaatggaagaatgccg

SEQ ID NO: 223884 - DNA, 33 bp, Artificial Sequence
  Description of Artificial Sequence: Synthetic oligonucleotide
ctgagaagtccaatcgaatggaagaatgccgtg

SEQ ID NO: 223885 - DNA, 35 bp, Artificial Sequence
  Description of Artificial Sequence: Synthetic oligonucleotide
tgagaagtccaatcgaatggaagaatgccgtgttc

SEQ ID NO: 223886 - DNA, 34 bp, Artificial Sequence
  Description of Artificial Sequence: Synthetic oligonucleotide
gagaagtccaatcgaatggaagaatgccgtgttc

SEQ ID NO: 223887 - DNA, 36 bp, Artificial Sequence
  Description of Artificial Sequence: Synthetic oligonucleotide
agaagtccaatcgaatggaagaatgccgtgttcaac

SEQ ID NO: 223888 - DNA, 35 bp, Artificial Sequence
  Description of Artificial Sequence: Synthetic oligonucleotide
gaagtccaatcgaatggaagaatgccgtgttcaac

SEQ ID NO: 223889 - DNA, 36 bp, Artificial Sequence
  Description of Artificial Sequence: Synthetic oligonucleotide
aagtccaatcgaatggaagaatgccgtgttcaacac

SEQ ID NO: 223890 - DNA, 35 bp, Artificial Sequence
  Description of Artificial Sequence: Synthetic oligonucleotide
agtccaatcgaatggaagaatgccgtgttcaacac

SEQ ID NO: 223891 - DNA, 34 bp, Artificial Sequence
  Description of Artificial Sequence: Synthetic oligonucleotide
gtccaatcgaatggaagaatgccgtgttcaacac

SEQ ID NO: 223892 - DNA, 34 bp, Artificial Sequence
  Description of Artificial Sequence: Synthetic oligonucleotide
tccaatcgaatggaagaatgccgtgttcaacacc

SEQ ID NO: 223893 - DNA, 33 bp, Artificial Sequence
  Description of Artificial Sequence: Synthetic oligonucleotide
ccaatcgaatggaagaatgccgtgttcaacacc

SEQ ID NO: 223894 - DNA, 35 bp, Artificial Sequence
  Description of Artificial Sequence: Synthetic oligonucleotide
caatcgaatggaagaatgccgtgttcaacacctac

SEQ ID NO: 223895 - DNA, 38 bp, Artificial Sequence
  Description of Artificial Sequence: Synthetic oligonucleotide
aatcgaatggaagaatgccgtgttcaacacctactatg

SEQ ID NO: 223896 - DNA, 37 bp, Artificial Sequence
  Description of Artificial Sequence: Synthetic oligonucleotide
atcgaatggaagaatgccgtgttcaacacctactatg

SEQ ID NO: 223897 - DNA, 36 bp, Artificial Sequence
  Description of Artificial Sequence: Synthetic oligonucleotide
tcgaatggaagaatgccgtgttcaacacctactatg

SEQ ID NO: 223898 - DNA, 35 bp, Artificial Sequence
  Description of Artificial Sequence: Synthetic oligonucleotide
cgaatggaagaatgccgtgttcaacacctactatg

SEQ ID NO: 223899 - DNA, 35 bp, Artificial Sequence
  Description of Artificial Sequence: Synthetic oligonucleotide
gaatggaagaatgccgtgttcaacacctactatgc

SEQ ID NO: 223900 - DNA, 36 bp, Artificial Sequence
  Description of Artificial Sequence: Synthetic oligonucleotide
aatggaagaatgccgtgttcaacacctactatgctg

SEQ ID NO: 223901 - DNA, 35 bp, Artificial Sequence
  Description of Artificial Sequence: Synthetic oligonucleotide
atggaagaatgccgtgttcaacacctactatgctg

SEQ ID NO: 223902 - DNA, 34 bp, Artificial Sequence
  Description of Artificial Sequence: Synthetic oligonucleotide
tggaagaatgccgtgttcaacacctactatgctg

SEQ ID NO: 223903 - DNA, 29 bp, Artificial Sequence
  Description of Artificial Sequence: Synthetic oligonucleotide
tcagcattggggaactcagcttggccaac

SEQ ID NO: 223904 - DNA, 28 bp, Artificial Sequence
  Description of Artificial Sequence: Synthetic oligonucleotide
cagcattggggaactcagcttggccaac

SEQ ID NO: 223905 - DNA, 28 bp, Artificial Sequence
  Description of Artificial Sequence: Synthetic oligonucleotide
agcattggggaactcagcttggccaacg

SEQ ID NO: 223906 - DNA, 27 bp, Artificial Sequence
  Description of Artificial Sequence: Synthetic oligonucleotide
gcattggggaactcagcttggccaacg

SEQ ID NO: 223907 - DNA, 28 bp, Artificial Sequence
  Description of Artificial Sequence: Synthetic oligonucleotide
cattggggaactcagcttggccaacgtg

SEQ ID NO: 223908 - DNA, 31 bp, Artificial Sequence
  Description of Artificial Sequence: Synthetic oligonucleotide
attggggaactcagcttggccaacgtgatag

SEQ ID NO: 223909 - DNA, 30 bp, Artificial Sequence
  Description of Artificial Sequence: Synthetic oligonucleotide
ttggggaactcagcttggccaacgtgatag

SEQ ID NO: 223910 - DNA, 29 bp, Artificial Sequence
  Description of Artificial Sequence: Synthetic oligonucleotide
tggggaactcagcttggccaacgtgatag

SEQ ID NO: 223911 - DNA, 28 bp, Artificial Sequence
  Description of Artificial Sequence: Synthetic oligonucleotide
ggggaactcagcttggccaacgtgatag

SEQ ID NO: 223912 - DNA, 28 bp, Artificial Sequence
  Description of Artificial Sequence: Synthetic oligonucleotide
gggaactcagcttggccaacgtgatagc

SEQ ID NO: 223913 - DNA, 29 bp, Artificial Sequence
  Description of Artificial Sequence: Synthetic oligonucleotide
ggaactcagcttggccaacgtgatagctc

SEQ ID NO: 223914 - DNA, 30 bp, Artificial Sequence
  Description of Artificial Sequence: Synthetic oligonucleotide
gaactcagcttggccaacgtgatagctctc

SEQ ID NO: 223915 - DNA, 31 bp, Artificial Sequence
  Description of Artificial Sequence: Synthetic oligonucleotide
aactcagcttggccaacgtgatagctctcac

SEQ ID NO: 223916 - DNA, 30 bp, Artificial Sequence
  Description of Artificial Sequence: Synthetic oligonucleotide
actcagcttggccaacgtgatagctctcac

SEQ ID NO: 223917 - DNA, 29 bp, Artificial Sequence
  Description of Artificial Sequence: Synthetic oligonucleotide
ctcagcttggccaacgtgatagctctcac

SEQ ID NO: 223918 - DNA, 29 bp, Artificial Sequence
  Description of Artificial Sequence: Synthetic oligonucleotide
tcagcttggccaacgtgatagctctcacg

SEQ ID NO: 223919 - DNA, 28 bp, Artificial Sequence
  Description of Artificial Sequence: Synthetic oligonucleotide
cagcttggccaacgtgatagctctcacg

SEQ ID NO: 223920 - DNA, 29 bp, Artificial Sequence
  Description of Artificial Sequence: Synthetic oligonucleotide
agcttggccaacgtgatagctctcacgtc

SEQ ID NO: 223921 - DNA, 28 bp, Artificial Sequence
  Description of Artificial Sequence: Synthetic oligonucleotide
gcttggccaacgtgatagctctcacgtc

SEQ ID NO: 223922 - DNA, 29 bp, Artificial Sequence
  Description of Artificial Sequence: Synthetic oligonucleotide
cttggccaacgtgatagctctcacgtctg

SEQ ID NO: 223923 - DNA, 29 bp, Artificial Sequence
  Description of Artificial Sequence: Synthetic oligonucleotide
ttggccaacgtgatagctctcacgtctgg

SEQ ID NO: 223924 - DNA, 28 bp, Artificial Sequence
  Description of Artificial Sequence: Synthetic oligonucleotide
tggccaacgtgatagctctcacgtctgg

SEQ ID NO: 223925 - DNA, 27 bp, Artificial Sequence
  Description of Artificial Sequence: Synthetic oligonucleotide
ggccaacgtgatagctctcacgtctgg

SEQ ID NO: 223926 - DNA, 28 bp, Artificial Sequence
  Description of Artificial Sequence: Synthetic oligonucleotide
gccaacgtgatagctctcacgtctggtc

SEQ ID NO: 223927 - DNA, 29 bp, Artificial Sequence
  Description of Artificial Sequence: Synthetic oligonucleotide
ccaacgtgatagctctcacgtctggtctc

SEQ ID NO: 223928 - DNA, 29 bp, Artificial Sequence
  Description of Artificial Sequence: Synthetic oligonucleotide
caacgtgatagctctcacgtctggtctcc

SEQ ID NO: 223929 - DNA, 30 bp, Artificial Sequence
  Description of Artificial Sequence: Synthetic oligonucleotide
aacgtgatagctctcacgtctggtctcctg

SEQ ID NO: 223930 - DNA, 29 bp, Artificial Sequence
  Description of Artificial Sequence: Synthetic oligonucleotide
acgtgatagctctcacgtctggtctcctg

SEQ ID NO: 223931 - DNA, 30 bp, Artificial Sequence
  Description of Artificial Sequence: Synthetic oligonucleotide
ccttcaacctcttcatgctggcgcttgatg

SEQ ID NO: 223932 - DNA, 31 bp, Artificial Sequence
  Description of Artificial Sequence: Synthetic oligonucleotide
cttcaacctcttcatgctggcgcttgatgtg

SEQ ID NO: 223933 - DNA, 31 bp, Artificial Sequence
  Description of Artificial Sequence: Synthetic oligonucleotide
ttcaacctcttcatgctggcgcttgatgtgc

SEQ ID NO: 223934 - DNA, 30 bp, Artificial Sequence
  Description of Artificial Sequence: Synthetic oligonucleotide
tcaacctcttcatgctggcgcttgatgtgc

SEQ ID NO: 223935 - DNA, 29 bp, Artificial Sequence
  Description of Artificial Sequence: Synthetic oligonucleotide
caacctcttcatgctggcgcttgatgtgc

SEQ ID NO: 223936 - DNA, 30 bp, Artificial Sequence
  Description of Artificial Sequence: Synthetic oligonucleotide
aacctcttcatgctggcgcttgatgtgcag

SEQ ID NO: 223937 - DNA, 29 bp, Artificial Sequence
  Description of Artificial Sequence: Synthetic oligonucleotide
acctcttcatgctggcgcttgatgtgcag

SEQ ID NO: 223938 - DNA, 28 bp, Artificial Sequence
  Description of Artificial Sequence: Synthetic oligonucleotide
cctcttcatgctggcgcttgatgtgcag

SEQ ID NO: 223939 - DNA, 29 bp, Artificial Sequence
  Description of Artificial Sequence: Synthetic oligonucleotide
ctcttcatgctggcgcttgatgtgcagtg

SEQ ID NO: 223940 - DNA, 29 bp, Artificial Sequence
  Description of Artificial Sequence: Synthetic oligonucleotide
tcttcatgctggcgcttgatgtgcagtgg

SEQ ID NO: 223941 - DNA, 28 bp, Artificial Sequence
  Description of Artificial Sequence: Synthetic oligonucleotide
cttcatgctggcgcttgatgtgcagtgg

SEQ ID NO: 223942 - DNA, 28 bp, Artificial Sequence
  Description of Artificial Sequence: Synthetic oligonucleotide
ttcatgctggcgcttgatgtgcagtggg

SEQ ID NO: 223943 - DNA, 27 bp, Artificial Sequence
  Description of Artificial Sequence: Synthetic oligonucleotide
tcatgctggcgcttgatgtgcagtggg

SEQ ID NO: 223944 - DNA, 26 bp, Artificial Sequence
  Description of Artificial Sequence: Synthetic oligonucleotide
catgctggcgcttgatgtgcagtggg

SEQ ID NO: 223945 - DNA, 27 bp, Artificial Sequence
  Description of Artificial Sequence: Synthetic oligonucleotide
atgctggcgcttgatgtgcagtgggca

SEQ ID NO: 223946 - DNA, 27 bp, Artificial Sequence
  Description of Artificial Sequence: Synthetic oligonucleotide
tgctggcgcttgatgtgcagtgggcaa

SEQ ID NO: 223947 - DNA, 27 bp, Artificial Sequence
  Description of Artificial Sequence: Synthetic oligonucleotide
gctggcgcttgatgtgcagtgggcaat

SEQ ID NO: 223948 - DNA, 27 bp, Artificial Sequence
  Description of Artificial Sequence: Synthetic oligonucleotide
ctggcgcttgatgtgcagtgggcaatc

SEQ ID NO: 223949 - DNA, 27 bp, Artificial Sequence
  Description of Artificial Sequence: Synthetic oligonucleotide
tggcgcttgatgtgcagtgggcaatcc

SEQ ID NO: 223950 - DNA, 27 bp, Artificial Sequence
  Description of Artificial Sequence: Synthetic oligonucleotide
ggcgcttgatgtgcagtgggcaatcct

SEQ ID NO: 223951 - DNA, 27 bp, Artificial Sequence
  Description of Artificial Sequence: Synthetic oligonucleotide
gcgcttgatgtgcagtgggcaatcctg

SEQ ID NO: 223952 - DNA, 27 bp, Artificial Sequence
  Description of Artificial Sequence: Synthetic oligonucleotide
cgcttgatgtgcagtgggcaatcctgc

SEQ ID NO: 223953 - DNA, 28 bp, Artificial Sequence
  Description of Artificial Sequence: Synthetic oligonucleotide
gcttgatgtgcagtgggcaatcctgctg

SEQ ID NO: 223954 - DNA, 28 bp, Artificial Sequence
  Description of Artificial Sequence: Synthetic oligonucleotide
cttgatgtgcagtgggcaatcctgctgg

SEQ ID NO: 223955 - DNA, 29 bp, Artificial Sequence
  Description of Artificial Sequence: Synthetic oligonucleotide
ttgatgtgcagtgggcaatcctgctggac

SEQ ID NO: 223956 - DNA, 28 bp, Artificial Sequence
  Description of Artificial Sequence: Synthetic oligonucleotide
tgatgtgcagtgggcaatcctgctggac

SEQ ID NO: 223957 - DNA, 27 bp, Artificial Sequence
  Description of Artificial Sequence: Synthetic oligonucleotide
gatgtgcagtgggcaatcctgctggac

SEQ ID NO: 223958 - DNA, 27 bp, Artificial Sequence
  Description of Artificial Sequence: Synthetic oligonucleotide
atgtgcagtgggcaatcctgctggacg

SEQ ID NO: 223959 - DNA, 25 bp, Artificial Sequence
  Description of Artificial Sequence: Synthetic oligonucleotide
caggaggcgtggctgtgggtacctt

SEQ ID NO: 223960 - DNA, 26 bp, Artificial Sequence
  Description of Artificial Sequence: Synthetic oligonucleotide
aggaggcgtggctgtgggtaccttgt

SEQ ID NO: 223961 - DNA, 25 bp, Artificial Sequence
  Description of Artificial Sequence: Synthetic oligonucleotide
ggaggcgtggctgtgggtaccttgt

SEQ ID NO: 223962 - DNA, 26 bp, Artificial Sequence
  Description of Artificial Sequence: Synthetic oligonucleotide
gaggcgtggctgtgggtaccttgtgt

SEQ ID NO: 223963 - DNA, 27 bp, Artificial Sequence
  Description of Artificial Sequence: Synthetic oligonucleotide
aggcgtggctgtgggtaccttgtgtca

SEQ ID NO: 223964 - DNA, 26 bp, Artificial Sequence
  Description of Artificial Sequence: Synthetic oligonucleotide
ggcgtggctgtgggtaccttgtgtca

SEQ ID NO: 223965 - DNA, 26 bp, Artificial Sequence
  Description of Artificial Sequence: Synthetic oligonucleotide
gcgtggctgtgggtaccttgtgtcac

SEQ ID NO: 223966 - DNA, 27 bp, Artificial Sequence
  Description of Artificial Sequence: Synthetic oligonucleotide
cgtggctgtgggtaccttgtgtcacct

SEQ ID NO: 223967 - DNA, 27 bp, Artificial Sequence
  Description of Artificial Sequence: Synthetic oligonucleotide
gtggctgtgggtaccttgtgtcacctg

SEQ ID NO: 223968 - DNA, 29 bp, Artificial Sequence
  Description of Artificial Sequence: Synthetic oligonucleotide
tggctgtgggtaccttgtgtcacctgatc

SEQ ID NO: 223969 - DNA, 28 bp, Artificial Sequence
  Description of Artificial Sequence: Synthetic oligonucleotide
ggctgtgggtaccttgtgtcacctgatc

SEQ ID NO: 223970 - DNA, 28 bp, Artificial Sequence
  Description of Artificial Sequence: Synthetic oligonucleotide
gctgtgggtaccttgtgtcacctgatcc

SEQ ID NO: 223971 - DNA, 28 bp, Artificial Sequence
  Description of Artificial Sequence: Synthetic oligonucleotide
ctgtgggtaccttgtgtcacctgatccc

SEQ ID NO: 223972 - DNA, 30 bp, Artificial Sequence
  Description of Artificial Sequence: Synthetic oligonucleotide
tgtgggtaccttgtgtcacctgatcccttc

SEQ ID NO: 223973 - DNA, 29 bp, Artificial Sequence
  Description of Artificial Sequence: Synthetic oligonucleotide
gtgggtaccttgtgtcacctgatcccttc

SEQ ID NO: 223974 - DNA, 30 bp, Artificial Sequence
  Description of Artificial Sequence: Synthetic oligonucleotide
tgggtaccttgtgtcacctgatcccttctc

SEQ ID NO: 223975 - DNA, 29 bp, Artificial Sequence
  Description of Artificial Sequence: Synthetic oligonucleotide
gggtaccttgtgtcacctgatcccttctc

SEQ ID NO: 223976 - DNA, 29 bp, Artificial Sequence
  Description of Artificial Sequence: Synthetic oligonucleotide
ggtaccttgtgtcacctgatcccttctcc

SEQ ID NO: 223977 - DNA, 29 bp, Artificial Sequence
  Description of Artificial Sequence: Synthetic oligonucleotide
gtaccttgtgtcacctgatcccttctccg

SEQ ID NO: 223978 - DNA, 30 bp, Artificial Sequence
  Description of Artificial Sequence: Synthetic oligonucleotide
taccttgtgtcacctgatcccttctccgtg

SEQ ID NO: 223979 - DNA, 29 bp, Artificial Sequence
  Description of Artificial Sequence: Synthetic oligonucleotide
accttgtgtcacctgatcccttctccgtg

SEQ ID NO: 223980 - DNA, 28 bp, Artificial Sequence
  Description of Artificial Sequence: Synthetic oligonucleotide
ccttgtgtcacctgatcccttctccgtg

SEQ ID NO: 223981 - DNA, 28 bp, Artificial Sequence
  Description of Artificial Sequence: Synthetic oligonucleotide
cttgtgtcacctgatcccttctccgtgg

SEQ ID NO: 223982 - DNA, 28 bp, Artificial Sequence
  Description of Artificial Sequence: Synthetic oligonucleotide
ttgtgtcacctgatcccttctccgtggc

SEQ ID NO: 223983 - DNA, 27 bp, Artificial Sequence
  Description of Artificial Sequence: Synthetic oligonucleotide
tgtgtcacctgatcccttctccgtggc

SEQ ID NO: 223984 - DNA, 29 bp, Artificial Sequence
  Description of Artificial Sequence: Synthetic oligonucleotide
gatcaaaaggggctcgtggcatcctatcg

SEQ ID NO: 223985 - DNA, 30 bp, Artificial Sequence
  Description of Artificial Sequence: Synthetic oligonucleotide
atcaaaaggggctcgtggcatcctatcgag

SEQ ID NO: 223986 - DNA, 49 bp, Artificial Sequence
  Description of Artificial Sequence: Synthetic oligonucleotide
ctcctaaatcttaaaatatggaaagcacctcatgaggctaaataatttg

SEQ ID NO: 223987 - DNA, 51 bp, Artificial Sequence
  Description of Artificial Sequence: Synthetic oligonucleotide
tcctaaatcttaaaatatggaaagcacctcatgaggctaaataatttgatg

SEQ ID NO: 223988 - DNA, 50 bp, Artificial Sequence
  Description of Artificial Sequence: Synthetic oligonucleotide
cctaaatcttaaaatatggaaagcacctcatgaggctaaataatttgatg

SEQ ID NO: 223989 - DNA, 51 bp, Artificial Sequence
  Description of Artificial Sequence: Synthetic oligonucleotide
ctaaatcttaaaatatggaaagcacctcatgaggctaaataatttgatgac

SEQ ID NO: 223990 - DNA, 51 bp, Artificial Sequence
  Description of Artificial Sequence: Synthetic oligonucleotide
taaatcttaaaatatggaaagcacctcatgaggctaaataatttgatgacc

SEQ ID NO: 223991 - DNA, 50 bp, Artificial Sequence
  Description of Artificial Sequence: Synthetic oligonucleotide
aaatcttaaaatatggaaagcacctcatgaggctaaataatttgatgacc

SEQ ID NO: 223992 - DNA, 49 bp, Artificial Sequence
  Description of Artificial Sequence: Synthetic oligonucleotide
aatcttaaaatatggaaagcacctcatgaggctaaataatttgatgacc

SEQ ID NO: 223993 - DNA, 48 bp, Artificial Sequence
  Description of Artificial Sequence: Synthetic oligonucleotide
atcttaaaatatggaaagcacctcatgaggctaaataatttgatgacc

SEQ ID NO: 223994 - DNA, 47 bp, Artificial Sequence
  Description of Artificial Sequence: Synthetic oligonucleotide
tcttaaaatatggaaagcacctcatgaggctaaataatttgatgacc

SEQ ID NO: 223995 - DNA, 46 bp, Artificial Sequence
  Description of Artificial Sequence: Synthetic oligonucleotide
cttaaaatatggaaagcacctcatgaggctaaataatttgatgacc

SEQ ID NO: 223996 - DNA, 48 bp, Artificial Sequence
  Description of Artificial Sequence: Synthetic oligonucleotide
ttaaaatatggaaagcacctcatgaggctaaataatttgatgaccaag

SEQ ID NO: 223997 - DNA, 47 bp, Artificial Sequence
  Description of Artificial Sequence: Synthetic oligonucleotide
taaaatatggaaagcacctcatgaggctaaataatttgatgaccaag

SEQ ID NO: 223998 - DNA, 46 bp, Artificial Sequence
  Description of Artificial Sequence: Synthetic oligonucleotide
aaaatatggaaagcacctcatgaggctaaataatttgatgaccaag

SEQ ID NO: 223999 - DNA, 45 bp, Artificial Sequence
  Description of Artificial Sequence: Synthetic oligonucleotide
aaatatggaaagcacctcatgaggctaaataatttgatgaccaag

SEQ ID NO: 224000 - DNA, 44 bp, Artificial Sequence
  Description of Artificial Sequence: Synthetic oligonucleotide
aatatggaaagcacctcatgaggctaaataatttgatgaccaag

SEQ ID NO: 224001 - DNA, 43 bp, Artificial Sequence
  Description of Artificial Sequence: Synthetic oligonucleotide
atatggaaagcacctcatgaggctaaataatttgatgaccaag

SEQ ID NO: 224002 - DNA, 42 bp, Artificial Sequence
  Description of Artificial Sequence: Synthetic oligonucleotide
tatggaaagcacctcatgaggctaaataatttgatgaccaag

SEQ ID NO: 224003 - DNA, 41 bp, Artificial Sequence
  Description of Artificial Sequence: Synthetic oligonucleotide
atggaaagcacctcatgaggctaaataatttgatgaccaag

SEQ ID NO: 224004 - DNA, 40 bp, Artificial Sequence
  Description of Artificial Sequence: Synthetic oligonucleotide
tggaaagcacctcatgaggctaaataatttgatgaccaag

SEQ ID NO: 224005 - DNA, 39 bp, Artificial Sequence
  Description of Artificial Sequence: Synthetic oligonucleotide
ggaaagcacctcatgaggctaaataatttgatgaccaag

SEQ ID NO: 224006 - DNA, 43 bp, Artificial Sequence
  Description of Artificial Sequence: Synthetic oligonucleotide
gaaagcacctcatgaggctaaataatttgatgaccaagttttc

SEQ ID NO: 224007 - DNA, 44 bp, Artificial Sequence
  Description of Artificial Sequence: Synthetic oligonucleotide
aaagcacctcatgaggctaaataatttgatgaccaagttttctg

SEQ ID NO: 224008 - DNA, 43 bp, Artificial Sequence
  Description of Artificial Sequence: Synthetic oligonucleotide
aagcacctcatgaggctaaataatttgatgaccaagttttctg

SEQ ID NO: 224009 - DNA, 42 bp, Artificial Sequence
  Description of Artificial Sequence: Synthetic oligonucleotide
agcacctcatgaggctaaataatttgatgaccaagttttctg

SEQ ID NO: 224010 - DNA, 41 bp, Artificial Sequence
  Description of Artificial Sequence: Synthetic oligonucleotide
gcacctcatgaggctaaataatttgatgaccaagttttctg

SEQ ID NO: 224011 - DNA, 41 bp, Artificial Sequence
  Description of Artificial Sequence: Synthetic oligonucleotide
cacctcatgaggctaaataatttgatgaccaagttttctgg

SEQ ID NO: 224012 - DNA, 43 bp, Artificial Sequence
  Description of Artificial Sequence: Synthetic oligonucleotide
acctcatgaggctaaataatttgatgaccaagttttctggaag

SEQ ID NO: 224013 - DNA, 27 bp, Artificial Sequence
  Description of Artificial Sequence: Synthetic oligonucleotide
cattggcttgggcttcctcacctcgac

SEQ ID NO: 224014 - DNA, 30 bp, Artificial Sequence
  Description of Artificial Sequence: Synthetic oligonucleotide
attggcttgggcttcctcacctcgactttc

SEQ ID NO: 224015 - DNA, 29 bp, Artificial Sequence
  Description of Artificial Sequence: Synthetic oligonucleotide
ttggcttgggcttcctcacctcgactttc

SEQ ID NO: 224016 - DNA, 28 bp, Artificial Sequence
  Description of Artificial Sequence: Synthetic oligonucleotide
tggcttgggcttcctcacctcgactttc

SEQ ID NO: 224017 - DNA, 27 bp, Artificial Sequence
  Description of Artificial Sequence: Synthetic oligonucleotide
ggcttgggcttcctcacctcgactttc

SEQ ID NO: 224018 - DNA, 27 bp, Artificial Sequence
  Description of Artificial Sequence: Synthetic oligonucleotide
gcttgggcttcctcacctcgactttcc

SEQ ID NO: 224019 - DNA, 27 bp, Artificial Sequence
  Description of Artificial Sequence: Synthetic oligonucleotide
cttgggcttcctcacctcgactttccg

SEQ ID NO: 224020 - DNA, 27 bp, Artificial Sequence
  Description of Artificial Sequence: Synthetic oligonucleotide
ttgggcttcctcacctcgactttccgg

SEQ ID NO: 224021 - DNA, 27 bp, Artificial Sequence
  Description of Artificial Sequence: Synthetic oligonucleotide
tgggcttcctcacctcgactttccgga

SEQ ID NO: 224022 - DNA, 26 bp, Artificial Sequence
  Description of Artificial Sequence: Synthetic oligonucleotide
gggcttcctcacctcgactttccgga

SEQ ID NO: 224023 - DNA, 27 bp, Artificial Sequence
  Description of Artificial Sequence: Synthetic oligonucleotide
ggcttcctcacctcgactttccggaga

SEQ ID NO: 224024 - DNA, 27 bp, Artificial Sequence
  Description of Artificial Sequence: Synthetic oligonucleotide
gcttcctcacctcgactttccggagac

SEQ ID NO: 224025 - DNA, 28 bp, Artificial Sequence
  Description of Artificial Sequence: Synthetic oligonucleotide
cttcctcacctcgactttccggagacac

SEQ ID NO: 224026 - DNA, 29 bp, Artificial Sequence
  Description of Artificial Sequence: Synthetic oligonucleotide
ttcctcacctcgactttccggagacacag

SEQ ID NO: 224027 - DNA, 28 bp, Artificial Sequence
  Description of Artificial Sequence: Synthetic oligonucleotide
tcctcacctcgactttccggagacacag

SEQ ID NO: 224028 - DNA, 27 bp, Artificial Sequence
  Description of Artificial Sequence: Synthetic oligonucleotide
cctcacctcgactttccggagacacag

SEQ ID NO: 224029 - DNA, 27 bp, Artificial Sequence
  Description of Artificial Sequence: Synthetic oligonucleotide
ctcacctcgactttccggagacacagc

SEQ ID NO: 224030 - DNA, 28 bp, Artificial Sequence
  Description of Artificial Sequence: Synthetic oligonucleotide
tcacctcgactttccggagacacagctg

SEQ ID NO: 224031 - DNA, 27 bp, Artificial Sequence
  Description of Artificial Sequence: Synthetic oligonucleotide
cacctcgactttccggagacacagctg

SEQ ID NO: 224032 - DNA, 27 bp, Artificial Sequence
  Description of Artificial Sequence: Synthetic oligonucleotide
acctcgactttccggagacacagctgg

SEQ ID NO: 224033 - DNA, 27 bp, Artificial Sequence
  Description of Artificial Sequence: Synthetic oligonucleotide
cctcgactttccggagacacagctgga

SEQ ID NO: 224034 - DNA, 27 bp, Artificial Sequence
  Description of Artificial Sequence: Synthetic oligonucleotide
ctcgactttccggagacacagctggag

SEQ ID NO: 224035 - DNA, 27 bp, Artificial Sequence
  Description of Artificial Sequence: Synthetic oligonucleotide
tcgactttccggagacacagctggagc

SEQ ID NO: 224036 - DNA, 27 bp, Artificial Sequence
  Description of Artificial Sequence: Synthetic oligonucleotide
cgactttccggagacacagctggagca

SEQ ID NO: 224037 - DNA, 27 bp, Artificial Sequence
  Description of Artificial Sequence: Synthetic oligonucleotide
gactttccggagacacagctggagcag

SEQ ID NO: 224038 - DNA, 28 bp, Artificial Sequence
  Description of Artificial Sequence: Synthetic oligonucleotide
actttccggagacacagctggagcagtg

SEQ ID NO: 224039 - DNA, 27 bp, Artificial Sequence
  Description of Artificial Sequence: Synthetic oligonucleotide
ctttccggagacacagctggagcagtg

SEQ ID NO: 224040 - DNA, 45 bp, Artificial Sequence
  Description of Artificial Sequence: Synthetic oligonucleotide
agtaatatcttcaacacagactaccacatgaacatgatgcaaatc

SEQ ID NO: 224041 - DNA, 44 bp, Artificial Sequence
  Description of Artificial Sequence: Synthetic oligonucleotide
gtaatatcttcaacacagactaccacatgaacatgatgcaaatc

SEQ ID NO: 224042 - DNA, 46 bp, Artificial Sequence
  Description of Artificial Sequence: Synthetic oligonucleotide
taatatcttcaacacagactaccacatgaacatgatgcaaatctac

SEQ ID NO: 224043 - DNA, 45 bp, Artificial Sequence
  Description of Artificial Sequence: Synthetic oligonucleotide
aatatcttcaacacagactaccacatgaacatgatgcaaatctac

SEQ ID NO: 224044 - DNA, 44 bp, Artificial Sequence
  Description of Artificial Sequence: Synthetic oligonucleotide
atatcttcaacacagactaccacatgaacatgatgcaaatctac

SEQ ID NO: 224045 - DNA, 43 bp, Artificial Sequence
  Description of Artificial Sequence: Synthetic oligonucleotide
tatcttcaacacagactaccacatgaacatgatgcaaatctac

SEQ ID NO: 224046 - DNA, 42 bp, Artificial Sequence
  Description of Artificial Sequence: Synthetic oligonucleotide
atcttcaacacagactaccacatgaacatgatgcaaatctac

SEQ ID NO: 224047 - DNA, 41 bp, Artificial Sequence
  Description of Artificial Sequence: Synthetic oligonucleotide
tcttcaacacagactaccacatgaacatgatgcaaatctac

SEQ ID NO: 224048 - DNA, 40 bp, Artificial Sequence
  Description of Artificial Sequence: Synthetic oligonucleotide
cttcaacacagactaccacatgaacatgatgcaaatctac

SEQ ID NO: 224049 - DNA, 40 bp, Artificial Sequence
  Description of Artificial Sequence: Synthetic oligonucleotide
ttcaacacagactaccacatgaacatgatgcaaatctacg

SEQ ID NO: 224050 - DNA, 39 bp, Artificial Sequence
  Description of Artificial Sequence: Synthetic oligonucleotide
tcaacacagactaccacatgaacatgatgcaaatctacg

SEQ ID NO: 224051 - DNA, 38 bp, Artificial Sequence
  Description of Artificial Sequence: Synthetic oligonucleotide
caacacagactaccacatgaacatgatgcaaatctacg

SEQ ID NO: 224052 - DNA, 39 bp, Artificial Sequence
  Description of Artificial Sequence: Synthetic oligonucleotide
aacacagactaccacatgaacatgatgcaaatctacgtg

SEQ ID NO: 224053 - DNA, 38 bp, Artificial Sequence
  Description of Artificial Sequence: Synthetic oligonucleotide
acacagactaccacatgaacatgatgcaaatctacgtg

SEQ ID NO: 224054 - DNA, 37 bp, Artificial Sequence
  Description of Artificial Sequence: Synthetic oligonucleotide
cacagactaccacatgaacatgatgcaaatctacgtg

SEQ ID NO: 224055 - DNA, 39 bp, Artificial Sequence
  Description of Artificial Sequence: Synthetic oligonucleotide
acagactaccacatgaacatgatgcaaatctacgtgttc

SEQ ID NO: 224056 - DNA, 38 bp, Artificial Sequence
  Description of Artificial Sequence: Synthetic oligonucleotide
cagactaccacatgaacatgatgcaaatctacgtgttc

SEQ ID NO: 224057 - DNA, 38 bp, Artificial Sequence
  Description of Artificial Sequence: Synthetic oligonucleotide
agactaccacatgaacatgatgcaaatctacgtgttcg

SEQ ID NO: 224058 - DNA, 37 bp, Artificial Sequence
  Description of Artificial Sequence: Synthetic oligonucleotide
gactaccacatgaacatgatgcaaatctacgtgttcg

SEQ ID NO: 224059 - DNA, 37 bp, Artificial Sequence
  Description of Artificial Sequence: Synthetic oligonucleotide
actaccacatgaacatgatgcaaatctacgtgttcgc

SEQ ID NO: 224060 - DNA, 36 bp, Artificial Sequence
  Description of Artificial Sequence: Synthetic oligonucleotide
ctaccacatgaacatgatgcaaatctacgtgttcgc

SEQ ID NO: 224061 - DNA, 37 bp, Artificial Sequence
  Description of Artificial Sequence: Synthetic oligonucleotide
taccacatgaacatgatgcaaatctacgtgttcgcag

SEQ ID NO: 224062 - DNA, 36 bp, Artificial Sequence
  Description of Artificial Sequence: Synthetic oligonucleotide
accacatgaacatgatgcaaatctacgtgttcgcag

SEQ ID NO: 224063 - DNA, 35 bp, Artificial Sequence
  Description of Artificial Sequence: Synthetic oligonucleotide
ccacatgaacatgatgcaaatctacgtgttcgcag

SEQ ID NO: 224064 - DNA, 35 bp, Artificial Sequence
  Description of Artificial Sequence: Synthetic oligonucleotide
cacatgaacatgatgcaaatctacgtgttcgcagc

SEQ ID NO: 224065 - DNA, 35 bp, Artificial Sequence
  Description of Artificial Sequence: Synthetic oligonucleotide
acatgaacatgatgcaaatctacgtgttcgcagcc

SEQ ID NO: 224066 - DNA, 34 bp, Artificial Sequence
  Description of Artificial Sequence: Synthetic oligonucleotide
catgaacatgatgcaaatctacgtgttcgcagcc

SEQ ID NO: 224067 - DNA, 40 bp, Artificial Sequence
  Description of Artificial Sequence: Synthetic oligonucleotide
atgaacatgatgcaaatctacgtgttcgcagcctattttg

SEQ ID NO: 224068 - DNA, 39 bp, Artificial Sequence
  Description of Artificial Sequence: Synthetic oligonucleotide
tgaacatgatgcaaatctacgtgttcgcagcctattttg

SEQ ID NO: 224069 - DNA, 38 bp, Artificial Sequence
  Description of Artificial Sequence: Synthetic oligonucleotide
gaacatgatgcaaatctacgtgttcgcagcctattttg

SEQ ID NO: 224070 - DNA, 38 bp, Artificial Sequence
  Description of Artificial Sequence: Synthetic oligonucleotide
aacatgatgcaaatctacgtgttcgcagcctattttgg

SEQ ID NO: 224071 - DNA, 37 bp, Artificial Sequence
  Description of Artificial Sequence: Synthetic oligonucleotide
acatgatgcaaatctacgtgttcgcagcctattttgg

SEQ ID NO: 224072 - DNA, 36 bp, Artificial Sequence
  Description of Artificial Sequence: Synthetic oligonucleotide
catgatgcaaatctacgtgttcgcagcctattttgg

SEQ ID NO: 224073 - DNA, 36 bp, Artificial Sequence
  Description of Artificial Sequence: Synthetic oligonucleotide
atgatgcaaatctacgtgttcgcagcctattttggg

SEQ ID NO: 224074 - DNA, 35 bp, Artificial Sequence
  Description of Artificial Sequence: Synthetic oligonucleotide
tgatgcaaatctacgtgttcgcagcctattttggg

SEQ ID NO: 224075 - DNA, 34 bp, Artificial Sequence
  Description of Artificial Sequence: Synthetic oligonucleotide
gatgcaaatctacgtgttcgcagcctattttggg

SEQ ID NO: 224076 - DNA, 34 bp, Artificial Sequence
  Description of Artificial Sequence: Synthetic oligonucleotide
atgcaaatctacgtgttcgcagcctattttgggc

SEQ ID NO: 224077 - DNA, 33 bp, Artificial Sequence
  Description of Artificial Sequence: Synthetic oligonucleotide
tgcaaatctacgtgttcgcagcctattttgggc

SEQ ID NO: 224078 - DNA, 32 bp, Artificial Sequence
  Description of Artificial Sequence: Synthetic oligonucleotide
gcaaatctacgtgttcgcagcctattttgggc

SEQ ID NO: 224079 - DNA, 33 bp, Artificial Sequence
  Description of Artificial Sequence: Synthetic oligonucleotide
caaatctacgtgttcgcagcctattttgggctg

SEQ ID NO: 224080 - DNA, 34 bp, Artificial Sequence
  Description of Artificial Sequence: Synthetic oligonucleotide
aaatctacgtgttcgcagcctattttgggctgtc

SEQ ID NO: 224081 - DNA, 33 bp, Artificial Sequence
  Description of Artificial Sequence: Synthetic oligonucleotide
aatctacgtgttcgcagcctattttgggctgtc

SEQ ID NO: 224082 - DNA, 45 bp, Artificial Sequence
  Description of Artificial Sequence: Synthetic oligonucleotide
gaaagcacctcatgaggctaaatattttgatgaccaagttttatg

SEQ ID NO: 224083 - DNA, 45 bp, Artificial Sequence
  Description of Artificial Sequence: Synthetic oligonucleotide
aaagcacctcatgaggctaaatattttgatgaccaagttttatgg

SEQ ID NO: 224084 - DNA, 44 bp, Artificial Sequence
  Description of Artificial Sequence: Synthetic oligonucleotide
aagcacctcatgaggctaaatattttgatgaccaagttttatgg

SEQ ID NO: 224085 - DNA, 43 bp, Artificial Sequence
  Description of Artificial Sequence: Synthetic oligonucleotide
agcacctcatgaggctaaatattttgatgaccaagttttatgg

SEQ ID NO: 224086 - DNA, 42 bp, Artificial Sequence
  Description of Artificial Sequence: Synthetic oligonucleotide
gcacctcatgaggctaaatattttgatgaccaagttttatgg

SEQ ID NO: 224087 - DNA, 44 bp, Artificial Sequence
  Description of Artificial Sequence: Synthetic oligonucleotide
cacctcatgaggctaaatattttgatgaccaagttttatggaag

SEQ ID NO: 224088 - DNA, 47 bp, Artificial Sequence
  Description of Artificial Sequence: Synthetic oligonucleotide
acctcatgaggctaaatattttgatgaccaagttttatggaagtttc

SEQ ID NO: 224089 - DNA, 46 bp, Artificial Sequence
  Description of Artificial Sequence: Synthetic oligonucleotide
cctcatgaggctaaatattttgatgaccaagttttatggaagtttc

SEQ ID NO: 224090 - DNA, 46 bp, Artificial Sequence
  Description of Artificial Sequence: Synthetic oligonucleotide
ctcatgaggctaaatattttgatgaccaagttttatggaagtttcc

SEQ ID NO: 224091 - DNA, 47 bp, Artificial Sequence
  Description of Artificial Sequence: Synthetic oligonucleotide
tcatgaggctaaatattttgatgaccaagttttatggaagtttcctc

SEQ ID NO: 224092 - DNA, 46 bp, Artificial Sequence
  Description of Artificial Sequence: Synthetic oligonucleotide
catgaggctaaatattttgatgaccaagttttatggaagtttcctc

SEQ ID NO: 224093 - DNA, 50 bp, Artificial Sequence
  Description of Artificial Sequence: Synthetic oligonucleotide
atgaggctaaatattttgatgaccaagttttatggaagtttcctcatttg

SEQ ID NO: 224094 - DNA, 49 bp, Artificial Sequence
  Description of Artificial Sequence: Synthetic oligonucleotide
tgaggctaaatattttgatgaccaagttttatggaagtttcctcatttg

SEQ ID NO: 224095 - DNA, 48 bp, Artificial Sequence
  Description of Artificial Sequence: Synthetic oligonucleotide
gaggctaaatattttgatgaccaagttttatggaagtttcctcatttg

SEQ ID NO: 224096 - DNA, 48 bp, Artificial Sequence
  Description of Artificial Sequence: Synthetic oligonucleotide
aggctaaatattttgatgaccaagttttatggaagtttcctcatttgg

SEQ ID NO: 224097 - DNA, 47 bp, Artificial Sequence
  Description of Artificial Sequence: Synthetic oligonucleotide
ggctaaatattttgatgaccaagttttatggaagtttcctcatttgg

SEQ ID NO: 224098 - DNA, 47 bp, Artificial Sequence
  Description of Artificial Sequence: Synthetic oligonucleotide
gctaaatattttgatgaccaagttttatggaagtttcctcatttggc

SEQ ID NO: 224099 - DNA, 48 bp, Artificial Sequence
  Description of Artificial Sequence: Synthetic oligonucleotide
ctaaatattttgatgaccaagttttatggaagtttcctcatttggctg

SEQ ID NO: 224100 - DNA, 50 bp, Artificial Sequence
  Description of Artificial Sequence: Synthetic oligonucleotide
taaatattttgatgaccaagttttatggaagtttcctcatttggctgttg

SEQ ID NO: 224101 - DNA, 49 bp, Artificial Sequence
  Description of Artificial Sequence: Synthetic oligonucleotide
aaatattttgatgaccaagttttatggaagtttcctcatttggctgttg

SEQ ID NO: 224102 - DNA, 48 bp, Artificial Sequence
  Description of Artificial Sequence: Synthetic oligonucleotide
aatattttgatgaccaagttttatggaagtttcctcatttggctgttg

SEQ ID NO: 224103 - DNA, 47 bp, Artificial Sequence
  Description of Artificial Sequence: Synthetic oligonucleotide
atattttgatgaccaagttttatggaagtttcctcatttggctgttg

SEQ ID NO: 224104 - DNA, 46 bp, Artificial Sequence
  Description of Artificial Sequence: Synthetic oligonucleotide
tattttgatgaccaagttttatggaagtttcctcatttggctgttg

SEQ ID NO: 224105 - DNA, 45 bp, Artificial Sequence
  Description of Artificial Sequence: Synthetic oligonucleotide
attttgatgaccaagttttatggaagtttcctcatttggctgttg

SEQ ID NO: 224106 - DNA, 44 bp, Artificial Sequence
  Description of Artificial Sequence: Synthetic oligonucleotide
ttttgatgaccaagttttatggaagtttcctcatttggctgttg

SEQ ID NO: 224107 - DNA, 43 bp, Artificial Sequence
  Description of Artificial Sequence: Synthetic oligonucleotide
tttgatgaccaagttttatggaagtttcctcatttggctgttg

SEQ ID NO: 224108 - DNA, 42 bp, Artificial Sequence
  Description of Artificial Sequence: Synthetic oligonucleotide
ttgatgaccaagttttatggaagtttcctcatttggctgttg

SEQ ID NO: 224109 - DNA, 41 bp, Artificial Sequence
  Description of Artificial Sequence: Synthetic oligonucleotide
tgatgaccaagttttatggaagtttcctcatttggctgttg

SEQ ID NO: 224110 - DNA, 40 bp, Artificial Sequence
  Description of Artificial Sequence: Synthetic oligonucleotide
gatgaccaagttttatggaagtttcctcatttggctgttg

SEQ ID NO: 224111 - DNA, 40 bp, Artificial Sequence
  Description of Artificial Sequence: Synthetic oligonucleotide
atgaccaagttttatggaagtttcctcatttggctgttgg

SEQ ID NO: 224112 - DNA, 39 bp, Artificial Sequence
  Description of Artificial Sequence: Synthetic oligonucleotide
tgaccaagttttatggaagtttcctcatttggctgttgg

SEQ ID NO: 224113 - DNA, 38 bp, Artificial Sequence
  Description of Artificial Sequence: Synthetic oligonucleotide
gaccaagttttatggaagtttcctcatttggctgttgg

SEQ ID NO: 224114 - DNA, 39 bp, Artificial Sequence
  Description of Artificial Sequence: Synthetic oligonucleotide
aacacagactaccacatgaacatgatgcacatctacatg

SEQ ID NO: 224115 - DNA, 38 bp, Artificial Sequence
  Description of Artificial Sequence: Synthetic oligonucleotide
acacagactaccacatgaacatgatgcacatctacatg

SEQ ID NO: 224116 - DNA, 37 bp, Artificial Sequence
  Description of Artificial Sequence: Synthetic oligonucleotide
cacagactaccacatgaacatgatgcacatctacatg

SEQ ID NO: 224117 - DNA, 39 bp, Artificial Sequence
  Description of Artificial Sequence: Synthetic oligonucleotide
acagactaccacatgaacatgatgcacatctacatgttc

SEQ ID NO: 224118 - DNA, 38 bp, Artificial Sequence
  Description of Artificial Sequence: Synthetic oligonucleotide
cagactaccacatgaacatgatgcacatctacatgttc

SEQ ID NO: 224119 - DNA, 38 bp, Artificial Sequence
  Description of Artificial Sequence: Synthetic oligonucleotide
agactaccacatgaacatgatgcacatctacatgttcg

SEQ ID NO: 224120 - DNA, 37 bp, Artificial Sequence
  Description of Artificial Sequence: Synthetic oligonucleotide
gactaccacatgaacatgatgcacatctacatgttcg

SEQ ID NO: 224121 - DNA, 37 bp, Artificial Sequence
  Description of Artificial Sequence: Synthetic oligonucleotide
actaccacatgaacatgatgcacatctacatgttcgc

SEQ ID NO: 224122 - DNA, 36 bp, Artificial Sequence
  Description of Artificial Sequence: Synthetic oligonucleotide
ctaccacatgaacatgatgcacatctacatgttcgc

SEQ ID NO: 224123 - DNA, 37 bp, Artificial Sequence
  Description of Artificial Sequence: Synthetic oligonucleotide
taccacatgaacatgatgcacatctacatgttcgcag

SEQ ID NO: 224124 - DNA, 36 bp, Artificial Sequence
  Description of Artificial Sequence: Synthetic oligonucleotide
accacatgaacatgatgcacatctacatgttcgcag

SEQ ID NO: 224125 - DNA, 35 bp, Artificial Sequence
  Description of Artificial Sequence: Synthetic oligonucleotide
ccacatgaacatgatgcacatctacatgttcgcag

SEQ ID NO: 224126 - DNA, 35 bp, Artificial Sequence
  Description of Artificial Sequence: Synthetic oligonucleotide
cacatgaacatgatgcacatctacatgttcgcagc

SEQ ID NO: 224127 - DNA, 35 bp, Artificial Sequence
  Description of Artificial Sequence: Synthetic oligonucleotide
acatgaacatgatgcacatctacatgttcgcagcc

SEQ ID NO: 224128 - DNA, 34 bp, Artificial Sequence
  Description of Artificial Sequence: Synthetic oligonucleotide
catgaacatgatgcacatctacatgttcgcagcc

SEQ ID NO: 224129 - DNA, 40 bp, Artificial Sequence
  Description of Artificial Sequence: Synthetic oligonucleotide
atgaacatgatgcacatctacatgttcgcagcctattttg

SEQ ID NO: 224130 - DNA, 39 bp, Artificial Sequence
  Description of Artificial Sequence: Synthetic oligonucleotide
tgaacatgatgcacatctacatgttcgcagcctattttg

SEQ ID NO: 224131 - DNA, 38 bp, Artificial Sequence
  Description of Artificial Sequence: Synthetic oligonucleotide
gaacatgatgcacatctacatgttcgcagcctattttg

SEQ ID NO: 224132 - DNA, 38 bp, Artificial Sequence
  Description of Artificial Sequence: Synthetic oligonucleotide
aacatgatgcacatctacatgttcgcagcctattttgg

SEQ ID NO: 224133 - DNA, 37 bp, Artificial Sequence
  Description of Artificial Sequence: Synthetic oligonucleotide
acatgatgcacatctacatgttcgcagcctattttgg

SEQ ID NO: 224134 - DNA, 36 bp, Artificial Sequence
  Description of Artificial Sequence: Synthetic oligonucleotide
catgatgcacatctacatgttcgcagcctattttgg

SEQ ID NO: 224135 - DNA, 36 bp, Artificial Sequence
  Description of Artificial Sequence: Synthetic oligonucleotide
atgatgcacatctacatgttcgcagcctattttggg

SEQ ID NO: 224136 - DNA, 35 bp, Artificial Sequence
  Description of Artificial Sequence: Synthetic oligonucleotide
tgatgcacatctacatgttcgcagcctattttggg

SEQ ID NO: 224137 - DNA, 34 bp, Artificial Sequence
  Description of Artificial Sequence: Synthetic oligonucleotide
gatgcacatctacatgttcgcagcctattttggg

SEQ ID NO: 224138 - DNA, 34 bp, Artificial Sequence
  Description of Artificial Sequence: Synthetic oligonucleotide
atgcacatctacatgttcgcagcctattttgggc

SEQ ID NO: 224139 - DNA, 33 bp, Artificial Sequence
  Description of Artificial Sequence: Synthetic oligonucleotide
tgcacatctacatgttcgcagcctattttgggc

SEQ ID NO: 224140 - DNA, 32 bp, Artificial Sequence
  Description of Artificial Sequence: Synthetic oligonucleotide
gcacatctacatgttcgcagcctattttgggc

SEQ ID NO: 224141 - DNA, 33 bp, Artificial Sequence
  Description of Artificial Sequence: Synthetic oligonucleotide
cacatctacatgttcgcagcctattttgggctg

SEQ ID NO: 224142 - DNA, 34 bp, Artificial Sequence
  Description of Artificial Sequence: Synthetic oligonucleotide
acatctacatgttcgcagcctattttgggctgtc

SEQ ID NO: 224143 - DNA, 33 bp, Artificial Sequence
  Description of Artificial Sequence: Synthetic oligonucleotide
catctacatgttcgcagcctattttgggctgtc

SEQ ID NO: 224144 - DNA, 34 bp, Artificial Sequence
  Description of Artificial Sequence: Synthetic oligonucleotide
atctacatgttcgcagcctattttgggctgtctg

SEQ ID NO: 224145 - DNA, 33 bp, Artificial Sequence
  Description of Artificial Sequence: Synthetic oligonucleotide
tctacatgttcgcagcctattttgggctgtctg

SEQ ID NO: 224146 - DNA, 32 bp, Artificial Sequence
  Description of Artificial Sequence: Synthetic oligonucleotide
ctacatgttcgcagcctattttgggctgtctg

SEQ ID NO: 224147 - DNA, 33 bp, Artificial Sequence
  Description of Artificial Sequence: Synthetic oligonucleotide
tacatgttcgcagcctattttgggctgtctgtg

SEQ ID NO: 224148 - DNA, 32 bp, Artificial Sequence
  Description of Artificial Sequence: Synthetic oligonucleotide
acatgttcgcagcctattttgggctgtctgtg

SEQ ID NO: 224149 - DNA, 31 bp, Artificial Sequence
  Description of Artificial Sequence: Synthetic oligonucleotide
catgttcgcagcctattttgggctgtctgtg

SEQ ID NO: 224150 - DNA, 31 bp, Artificial Sequence
  Description of Artificial Sequence: Synthetic oligonucleotide
atgttcgcagcctattttgggctgtctgtgg

SEQ ID NO: 224151 - DNA, 35 bp, Artificial Sequence
  Description of Artificial Sequence: Synthetic oligonucleotide
atgttctggccaagtttcaactctgctctgctaag

SEQ ID NO: 224152 - DNA, 34 bp, Artificial Sequence
  Description of Artificial Sequence: Synthetic oligonucleotide
tgttctggccaagtttcaactctgctctgctaag

SEQ ID NO: 224153 - DNA, 33 bp, Artificial Sequence
  Description of Artificial Sequence: Synthetic oligonucleotide
gttctggccaagtttcaactctgctctgctaag

SEQ ID NO: 224154 - DNA, 34 bp, Artificial Sequence
  Description of Artificial Sequence: Synthetic oligonucleotide
ttctggccaagtttcaactctgctctgctaagtc

SEQ ID NO: 224155 - DNA, 33 bp, Artificial Sequence
  Description of Artificial Sequence: Synthetic oligonucleotide
tctggccaagtttcaactctgctctgctaagtc

SEQ ID NO: 224156 - DNA, 32 bp, Artificial Sequence
  Description of Artificial Sequence: Synthetic oligonucleotide
ctggccaagtttcaactctgctctgctaagtc

SEQ ID NO: 224157 - DNA, 32 bp, Artificial Sequence
  Description of Artificial Sequence: Synthetic oligonucleotide
tggccaagtttcaactctgctctgctaagtcc

SEQ ID NO: 224158 - DNA, 31 bp, Artificial Sequence
  Description of Artificial Sequence: Synthetic oligonucleotide
ggccaagtttcaactctgctctgctaagtcc

SEQ ID NO: 224159 - DNA, 34 bp, Artificial Sequence
  Description of Artificial Sequence: Synthetic oligonucleotide
gccaagtttcaactctgctctgctaagtccaatc

SEQ ID NO: 224160 - DNA, 34 bp, Artificial Sequence
  Description of Artificial Sequence: Synthetic oligonucleotide
ccaagtttcaactctgctctgctaagtccaatcg

SEQ ID NO: 224161 - DNA, 37 bp, Artificial Sequence
  Description of Artificial Sequence: Synthetic oligonucleotide
caagtttcaactctgctctgctaagtccaatcgaaag

SEQ ID NO: 224162 - DNA, 37 bp, Artificial Sequence
  Description of Artificial Sequence: Synthetic oligonucleotide
aagtttcaactctgctctgctaagtccaatcgaaagg

SEQ ID NO: 224163 - DNA, 36 bp, Artificial Sequence
  Description of Artificial Sequence: Synthetic oligonucleotide
agtttcaactctgctctgctaagtccaatcgaaagg

SEQ ID NO: 224164 - DNA, 35 bp, Artificial Sequence
  Description of Artificial Sequence: Synthetic oligonucleotide
gtttcaactctgctctgctaagtccaatcgaaagg

SEQ ID NO: 224165 - DNA, 37 bp, Artificial Sequence
  Description of Artificial Sequence: Synthetic oligonucleotide
tttcaactctgctctgctaagtccaatcgaaaggaag

SEQ ID NO: 224166 - DNA, 36 bp, Artificial Sequence
  Description of Artificial Sequence: Synthetic oligonucleotide
ttcaactctgctctgctaagtccaatcgaaaggaag

SEQ ID NO: 224167 - DNA, 35 bp, Artificial Sequence
  Description of Artificial Sequence: Synthetic oligonucleotide
tcaactctgctctgctaagtccaatcgaaaggaag

SEQ ID NO: 224168 - DNA, 34 bp, Artificial Sequence
  Description of Artificial Sequence: Synthetic oligonucleotide
caactctgctctgctaagtccaatcgaaaggaag

SEQ ID NO: 224169 - DNA, 37 bp, Artificial Sequence
  Description of Artificial Sequence: Synthetic oligonucleotide
aactctgctctgctaagtccaatcgaaaggaagaatg

SEQ ID NO: 224170 - DNA, 36 bp, Artificial Sequence
  Description of Artificial Sequence: Synthetic oligonucleotide
actctgctctgctaagtccaatcgaaaggaagaatg

SEQ ID NO: 224171 - DNA, 35 bp, Artificial Sequence
  Description of Artificial Sequence: Synthetic oligonucleotide
ctctgctctgctaagtccaatcgaaaggaagaatg

SEQ ID NO: 224172 - DNA, 35 bp, Artificial Sequence
  Description of Artificial Sequence: Synthetic oligonucleotide
tctgctctgctaagtccaatcgaaaggaagaatgc

SEQ ID NO: 224173 - DNA, 34 bp, Artificial Sequence
  Description of Artificial Sequence: Synthetic oligonucleotide
ctgctctgctaagtccaatcgaaaggaagaatgc

SEQ ID NO: 224174 - DNA, 34 bp, Artificial Sequence
  Description of Artificial Sequence: Synthetic oligonucleotide
tgctctgctaagtccaatcgaaaggaagaatgcc

SEQ ID NO: 224175 - DNA, 33 bp, Artificial Sequence
  Description of Artificial Sequence: Synthetic oligonucleotide
gctctgctaagtccaatcgaaaggaagaatgcc

SEQ ID NO: 224176 - DNA, 33 bp, Artificial Sequence
  Description of Artificial Sequence: Synthetic oligonucleotide
ctctgctaagtccaatcgaaaggaagaatgccg

SEQ ID NO: 224177 - DNA, 34 bp, Artificial Sequence
  Description of Artificial Sequence: Synthetic oligonucleotide
tctgctaagtccaatcgaaaggaagaatgccgtg

SEQ ID NO: 224178 - DNA, 33 bp, Artificial Sequence
  Description of Artificial Sequence: Synthetic oligonucleotide
ctgctaagtccaatcgaaaggaagaatgccgtg

SEQ ID NO: 224179 - DNA, 35 bp, Artificial Sequence
  Description of Artificial Sequence: Synthetic oligonucleotide
tgctaagtccaatcgaaaggaagaatgccgtgttc

SEQ ID NO: 224180 - DNA, 34 bp, Artificial Sequence
  Description of Artificial Sequence: Synthetic oligonucleotide
gctaagtccaatcgaaaggaagaatgccgtgttc

SEQ ID NO: 224181 - DNA, 36 bp, Artificial Sequence
  Description of Artificial Sequence: Synthetic oligonucleotide
ctaagtccaatcgaaaggaagaatgccgtgttcaac

SEQ ID NO: 224182 - DNA, 37 bp, Artificial Sequence
  Description of Artificial Sequence: Synthetic oligonucleotide
taagtccaatcgaaaggaagaatgccgtgttcaacac

SEQ ID NO: 224183 - DNA, 36 bp, Artificial Sequence
  Description of Artificial Sequence: Synthetic oligonucleotide
aatcgaaaggaagaatgccgtgttcaacacctactg

SEQ ID NO: 224184 - DNA, 35 bp, Artificial Sequence
  Description of Artificial Sequence: Synthetic oligonucleotide
atcgaaaggaagaatgccgtgttcaacacctactg

SEQ ID NO: 224185 - DNA, 34 bp, Artificial Sequence
  Description of Artificial Sequence: Synthetic oligonucleotide
tcgaaaggaagaatgccgtgttcaacacctactg

SEQ ID NO: 224186 - DNA, 33 bp, Artificial Sequence
  Description of Artificial Sequence: Synthetic oligonucleotide
cgaaaggaagaatgccgtgttcaacacctactg

SEQ ID NO: 224187 - DNA, 34 bp, Artificial Sequence
  Description of Artificial Sequence: Synthetic oligonucleotide
gaaaggaagaatgccgtgttcaacacctactgtg

SEQ ID NO: 224188 - DNA, 34 bp, Artificial Sequence
  Description of Artificial Sequence: Synthetic oligonucleotide
aaaggaagaatgccgtgttcaacacctactgtgc

SEQ ID NO: 224189 - DNA, 33 bp, Artificial Sequence
  Description of Artificial Sequence: Synthetic oligonucleotide
aaggaagaatgccgtgttcaacacctactgtgc

SEQ ID NO: 224190 - DNA, 32 bp, Artificial Sequence
  Description of Artificial Sequence: Synthetic oligonucleotide
aggaagaatgccgtgttcaacacctactgtgc

SEQ ID NO: 224191 - DNA, 31 bp, Artificial Sequence
  Description of Artificial Sequence: Synthetic oligonucleotide
ggaagaatgccgtgttcaacacctactgtgc

SEQ ID NO: 224192 - DNA, 32 bp, Artificial Sequence
  Description of Artificial Sequence: Synthetic oligonucleotide
gaagaatgccgtgttcaacacctactgtgctg

SEQ ID NO: 224193 - DNA, 34 bp, Artificial Sequence
  Description of Artificial Sequence: Synthetic oligonucleotide
aagaatgccgtgttcaacacctactgtgctgtag

SEQ ID NO: 224194 - DNA, 33 bp, Artificial Sequence
  Description of Artificial Sequence: Synthetic oligonucleotide
agaatgccgtgttcaacacctactgtgctgtag

SEQ ID NO: 224195 - DNA, 32 bp, Artificial Sequence
  Description of Artificial Sequence: Synthetic oligonucleotide
gaatgccgtgttcaacacctactgtgctgtag

SEQ ID NO: 224196 - DNA, 32 bp, Artificial Sequence
  Description of Artificial Sequence: Synthetic oligonucleotide
aatgccgtgttcaacacctactgtgctgtagc

SEQ ID NO: 224197 - DNA, 31 bp, Artificial Sequence
  Description of Artificial Sequence: Synthetic oligonucleotide
atgccgtgttcaacacctactgtgctgtagc

SEQ ID NO: 224198 - DNA, 30 bp, Artificial Sequence
  Description of Artificial Sequence: Synthetic oligonucleotide
tgccgtgttcaacacctactgtgctgtagc

SEQ ID NO: 224199 - DNA, 29 bp, Artificial Sequence
  Description of Artificial Sequence: Synthetic oligonucleotide
gccgtgttcaacacctactgtgctgtagc

SEQ ID NO: 224200 - DNA, 30 bp, Artificial Sequence
  Description of Artificial Sequence: Synthetic oligonucleotide
ccgtgttcaacacctactgtgctgtagcag

SEQ ID NO: 224201 - DNA, 31 bp, Artificial Sequence
  Description of Artificial Sequence: Synthetic oligonucleotide
cgtgttcaacacctactgtgctgtagcagtc

SEQ ID NO: 224202 - DNA, 32 bp, Artificial Sequence
  Description of Artificial Sequence: Synthetic oligonucleotide
gtgttcaacacctactgtgctgtagcagtcag

SEQ ID NO: 224203 - DNA, 32 bp, Artificial Sequence
  Description of Artificial Sequence: Synthetic oligonucleotide
tgttcaacacctactgtgctgtagcagtcagc

SEQ ID NO: 224204 - DNA, 31 bp, Artificial Sequence
  Description of Artificial Sequence: Synthetic oligonucleotide
gttcaacacctactgtgctgtagcagtcagc

SEQ ID NO: 224205 - DNA, 31 bp, Artificial Sequence
  Description of Artificial Sequence: Synthetic oligonucleotide
ttcaacacctactgtgctgtagcagtcagcg

SEQ ID NO: 224206 - DNA, 30 bp, Artificial Sequence
  Description of Artificial Sequence: Synthetic oligonucleotide
tcaacacctactgtgctgtagcagtcagcg

SEQ ID NO: 224207 - DNA, 29 bp, Artificial Sequence
  Description of Artificial Sequence: Synthetic oligonucleotide
caacacctactgtgctgtagcagtcagcg

SEQ ID NO: 224208 - DNA, 30 bp, Artificial Sequence
  Description of Artificial Sequence: Synthetic oligonucleotide
aacacctactgtgctgtagcagtcagcgtg

SEQ ID NO: 224209 - DNA, 29 bp, Artificial Sequence
  Description of Artificial Sequence: Synthetic oligonucleotide
acacctactgtgctgtagcagtcagcgtg

SEQ ID NO: 224210 - DNA, 28 bp, Artificial Sequence
  Description of Artificial Sequence: Synthetic oligonucleotide
cacctactgtgctgtagcagtcagcgtg

SEQ ID NO: 224211 - DNA, 28 bp, Artificial Sequence
  Description of Artificial Sequence: Synthetic oligonucleotide
acctactgtgctgtagcagtcagcgtgg

SEQ ID NO: 224212 - DNA, 27 bp, Artificial Sequence
  Description of Artificial Sequence: Synthetic oligonucleotide
cctactgtgctgtagcagtcagcgtgg

SEQ ID NO: 224213 - DNA, 28 bp, Artificial Sequence
  Description of Artificial Sequence: Synthetic oligonucleotide
ctactgtgctgtagcagtcagcgtggtg

SEQ ID NO: 224214 - DNA, 29 bp, Artificial Sequence
  Description of Artificial Sequence: Synthetic oligonucleotide
tactgtgctgtagcagtcagcgtggtgac

SEQ ID NO: 224215 - DNA, 28 bp, Artificial Sequence
  Description of Artificial Sequence: Synthetic oligonucleotide
actgtgctgtagcagtcagcgtggtgac

SEQ ID NO: 224216 - DNA, 27 bp, Artificial Sequence
  Description of Artificial Sequence: Synthetic oligonucleotide
ctgtgctgtagcagtcagcgtggtgac

SEQ ID NO: 224217 - DNA, 28 bp, Artificial Sequence
  Description of Artificial Sequence: Synthetic oligonucleotide
tgtgctgtagcagtcagcgtggtgacag

SEQ ID NO: 224218 - DNA, 27 bp, Artificial Sequence
  Description of Artificial Sequence: Synthetic oligonucleotide
gtgctgtagcagtcagcgtggtgacag

SEQ ID NO: 224219 - DNA, 23 bp, Artificial Sequence
  Description of Artificial Sequence: Synthetic oligonucleotide
ggtgttggcaggaggcgtggctg

SEQ ID NO: 224220 - DNA, 23 bp, Artificial Sequence
  Description of Artificial Sequence: Synthetic oligonucleotide
gtgttggcaggaggcgtggctgg

SEQ ID NO: 224221 - DNA, 23 bp, Artificial Sequence
  Description of Artificial Sequence: Synthetic oligonucleotide
tgttggcaggaggcgtggctggg

SEQ ID NO: 224222 - DNA, 22 bp, Artificial Sequence
  Description of Artificial Sequence: Synthetic oligonucleotide
gttggcaggaggcgtggctggg

SEQ ID NO: 224223 - DNA, 22 bp, Artificial Sequence
  Description of Artificial Sequence: Synthetic oligonucleotide
ttggcaggaggcgtggctgggg

SEQ ID NO: 224224 - DNA, 21 bp, Artificial Sequence
  Description of Artificial Sequence: Synthetic oligonucleotide
tggcaggaggcgtggctgggg

SEQ ID NO: 224225 - DNA, 20 bp, Artificial Sequence
  Description of Artificial Sequence: Synthetic oligonucleotide
ggcaggaggcgtggctgggg

SEQ ID NO: 224226 - DNA, 22 bp, Artificial Sequence
  Description of Artificial Sequence: Synthetic oligonucleotide
gcaggaggcgtggctgggggta

SEQ ID NO: 224227 - DNA, 22 bp, Artificial Sequence
  Description of Artificial Sequence: Synthetic oligonucleotide
caggaggcgtggctgggggtac

SEQ ID NO: 224228 - DNA, 23 bp, Artificial Sequence
  Description of Artificial Sequence: Synthetic oligonucleotide
aggaggcgtggctgggggtacct

SEQ ID NO: 224229 - DNA, 22 bp, Artificial Sequence
  Description of Artificial Sequence: Synthetic oligonucleotide
ggaggcgtggctgggggtacct

SEQ ID NO: 224230 - DNA, 22 bp, Artificial Sequence
  Description of Artificial Sequence: Synthetic oligonucleotide
gaggcgtggctgggggtacctc

SEQ ID NO: 224231 - DNA, 23 bp, Artificial Sequence
  Description of Artificial Sequence: Synthetic oligonucleotide
aggcgtggctgggggtacctcgt

SEQ ID NO: 224232 - DNA, 22 bp, Artificial Sequence
  Description of Artificial Sequence: Synthetic oligonucleotide
ggcgtggctgggggtacctcgt

SEQ ID NO: 224233 - DNA, 23 bp, Artificial Sequence
  Description of Artificial Sequence: Synthetic oligonucleotide
gcgtggctgggggtacctcgtgt

SEQ ID NO: 224234 - DNA, 24 bp, Artificial Sequence
  Description of Artificial Sequence: Synthetic oligonucleotide
cgtggctgggggtacctcgtgtca

SEQ ID NO: 224235 - DNA, 24 bp, Artificial Sequence
  Description of Artificial Sequence: Synthetic oligonucleotide
gtggctgggggtacctcgtgtcac

SEQ ID NO: 224236 - DNA, 25 bp, Artificial Sequence
  Description of Artificial Sequence: Synthetic oligonucleotide
tggctgggggtacctcgtgtcacct

SEQ ID NO: 224237 - DNA, 24 bp, Artificial Sequence
  Description of Artificial Sequence: Synthetic oligonucleotide
ggctgggggtacctcgtgtcacct

SEQ ID NO: 224238 - DNA, 26 bp, Artificial Sequence
  Description of Artificial Sequence: Synthetic oligonucleotide
gctgggggtacctcgtgtcacctgat

SEQ ID NO: 224239 - DNA, 26 bp, Artificial Sequence
  Description of Artificial Sequence: Synthetic oligonucleotide
ctgggggtacctcgtgtcacctgatc

SEQ ID NO: 224240 - DNA, 26 bp, Artificial Sequence
  Description of Artificial Sequence: Synthetic oligonucleotide
tgggggtacctcgtgtcacctgatcc

SEQ ID NO: 224241 - DNA, 25 bp, Artificial Sequence
  Description of Artificial Sequence: Synthetic oligonucleotide
gggggtacctcgtgtcacctgatcc

SEQ ID NO: 224242 - DNA, 27 bp, Artificial Sequence
  Description of Artificial Sequence: Synthetic oligonucleotide
ggggtacctcgtgtcacctgatccctt

SEQ ID NO: 224243 - DNA, 52 bp, Artificial Sequence
  Description of Artificial Sequence: Synthetic oligonucleotide
ttgctcctaaatcttaaaatatggaaagcacctcatgagactaaatattttg

SEQ ID NO: 224244 - DNA, 51 bp, Artificial Sequence
  Description of Artificial Sequence: Synthetic oligonucleotide
tgctcctaaatcttaaaatatggaaagcacctcatgagactaaatattttg

SEQ ID NO: 224245 - DNA, 50 bp, Artificial Sequence
  Description of Artificial Sequence: Synthetic oligonucleotide
gctcctaaatcttaaaatatggaaagcacctcatgagactaaatattttg

SEQ ID NO: 224246 - DNA, 52 bp, Artificial Sequence
  Description of Artificial Sequence: Synthetic oligonucleotide
ctcctaaatcttaaaatatggaaagcacctcatgagactaaatattttgatg

SEQ ID NO: 224247 - DNA, 53 bp, Artificial Sequence
  Description of Artificial Sequence: Synthetic oligonucleotide
tcctaaatcttaaaatatggaaagcacctcatgagactaaatattttgatgac

SEQ ID NO: 224248 - DNA, 52 bp, Artificial Sequence
  Description of Artificial Sequence: Synthetic oligonucleotide
cctaaatcttaaaatatggaaagcacctcatgagactaaatattttgatgac

SEQ ID NO: 224249 - DNA, 52 bp, Artificial Sequence
  Description of Artificial Sequence: Synthetic oligonucleotide
ctaaatcttaaaatatggaaagcacctcatgagactaaatattttgatgacc

SEQ ID NO: 224250 - DNA, 54 bp, Artificial Sequence
  Description of Artificial Sequence: Synthetic oligonucleotide
taaatcttaaaatatggaaagcacctcatgagactaaatattttgatgaccaag

SEQ ID NO: 224251 - DNA, 53 bp, Artificial Sequence
  Description of Artificial Sequence: Synthetic oligonucleotide
aaatcttaaaatatggaaagcacctcatgagactaaatattttgatgaccaag

SEQ ID NO: 224252 - DNA, 52 bp, Artificial Sequence
  Description of Artificial Sequence: Synthetic oligonucleotide
aatcttaaaatatggaaagcacctcatgagactaaatattttgatgaccaag

SEQ ID NO: 224253 - DNA, 51 bp, Artificial Sequence
  Description of Artificial Sequence: Synthetic oligonucleotide
atcttaaaatatggaaagcacctcatgagactaaatattttgatgaccaag

SEQ ID NO: 224254 - DNA, 50 bp, Artificial Sequence
  Description of Artificial Sequence: Synthetic oligonucleotide
tcttaaaatatggaaagcacctcatgagactaaatattttgatgaccaag

SEQ ID NO: 224255 - DNA, 49 bp, Artificial Sequence
  Description of Artificial Sequence: Synthetic oligonucleotide
cttaaaatatggaaagcacctcatgagactaaatattttgatgaccaag

SEQ ID NO: 224256 - DNA, 53 bp, Artificial Sequence
  Description of Artificial Sequence: Synthetic oligonucleotide
ttaaaatatggaaagcacctcatgagactaaatattttgatgaccaagttttc

SEQ ID NO: 224257 - DNA, 52 bp, Artificial Sequence
  Description of Artificial Sequence: Synthetic oligonucleotide
taaaatatggaaagcacctcatgagactaaatattttgatgaccaagttttc

SEQ ID NO: 224258 - DNA, 51 bp, Artificial Sequence
  Description of Artificial Sequence: Synthetic oligonucleotide
aaaatatggaaagcacctcatgagactaaatattttgatgaccaagttttc

SEQ ID NO: 224259 - DNA, 50 bp, Artificial Sequence
  Description of Artificial Sequence: Synthetic oligonucleotide
aaatatggaaagcacctcatgagactaaatattttgatgaccaagttttc

SEQ ID NO: 224260 - DNA, 49 bp, Artificial Sequence
  Description of Artificial Sequence: Synthetic oligonucleotide
aatatggaaagcacctcatgagactaaatattttgatgaccaagttttc

SEQ ID NO: 224261 - DNA, 48 bp, Artificial Sequence
  Description of Artificial Sequence: Synthetic oligonucleotide
atatggaaagcacctcatgagactaaatattttgatgaccaagttttc

SEQ ID NO: 224262 - DNA, 47 bp, Artificial Sequence
  Description of Artificial Sequence: Synthetic oligonucleotide
tatggaaagcacctcatgagactaaatattttgatgaccaagttttc

SEQ ID NO: 224263 - DNA, 46 bp, Artificial Sequence
  Description of Artificial Sequence: Synthetic oligonucleotide
atggaaagcacctcatgagactaaatattttgatgaccaagttttc

SEQ ID NO: 224264 - DNA, 45 bp, Artificial Sequence
  Description of Artificial Sequence: Synthetic oligonucleotide
tggaaagcacctcatgagactaaatattttgatgaccaagttttc

SEQ ID NO: 224265 - DNA, 44 bp, Artificial Sequence
  Description of Artificial Sequence: Synthetic oligonucleotide
ggaaagcacctcatgagactaaatattttgatgaccaagttttc

SEQ ID NO: 224266 - DNA, 45 bp, Artificial Sequence
  Description of Artificial Sequence: Synthetic oligonucleotide
gaaagcacctcatgagactaaatattttgatgaccaagttttctg

SEQ ID NO: 224267 - DNA, 45 bp, Artificial Sequence
  Description of Artificial Sequence: Synthetic oligonucleotide
aaagcacctcatgagactaaatattttgatgaccaagttttctgg

SEQ ID NO: 224268 - DNA, 44 bp, Artificial Sequence
  Description of Artificial Sequence: Synthetic oligonucleotide
aagcacctcatgagactaaatattttgatgaccaagttttctgg

SEQ ID NO: 224269 - DNA, 43 bp, Artificial Sequence
  Description of Artificial Sequence: Synthetic oligonucleotide
agcacctcatgagactaaatattttgatgaccaagttttctgg

SEQ ID NO: 224270 - DNA, 42 bp, Artificial Sequence
  Description of Artificial Sequence: Synthetic oligonucleotide
gcacctcatgagactaaatattttgatgaccaagttttctgg

SEQ ID NO: 224271 - DNA, 44 bp, Artificial Sequence
  Description of Artificial Sequence: Synthetic oligonucleotide
cacctcatgagactaaatattttgatgaccaagttttctggaag

SEQ ID NO: 224272 - DNA, 31 bp, Artificial Sequence
  Description of Artificial Sequence: Synthetic oligonucleotide
agtgctttgtcggtgctgatctcagtggaag

SEQ ID NO: 224273 - DNA, 30 bp, Artificial Sequence
  Description of Artificial Sequence: Synthetic oligonucleotide
gtgctttgtcggtgctgatctcagtggaag

SEQ ID NO: 224274 - DNA, 30 bp, Artificial Sequence
  Description of Artificial Sequence: Synthetic oligonucleotide
tgctttgtcggtgctgatctcagtggaagc

SEQ ID NO: 224275 - DNA, 29 bp, Artificial Sequence
  Description of Artificial Sequence: Synthetic oligonucleotide
gctttgtcggtgctgatctcagtggaagc

SEQ ID NO: 224276 - DNA, 30 bp, Artificial Sequence
  Description of Artificial Sequence: Synthetic oligonucleotide
ctttgtcggtgctgatctcagtggaagctg

SEQ ID NO: 224277 - DNA, 31 bp, Artificial Sequence
  Description of Artificial Sequence: Synthetic oligonucleotide
tttgtcggtgctgatctcagtggaagctgtc

SEQ ID NO: 224278 - DNA, 30 bp, Artificial Sequence
  Description of Artificial Sequence: Synthetic oligonucleotide
ttgtcggtgctgatctcagtggaagctgtc

SEQ ID NO: 224279 - DNA, 29 bp, Artificial Sequence
  Description of Artificial Sequence: Synthetic oligonucleotide
tgtcggtgctgatctcagtggaagctgtc

SEQ ID NO: 224280 - DNA, 28 bp, Artificial Sequence
  Description of Artificial Sequence: Synthetic oligonucleotide
gtcggtgctgatctcagtggaagctgtc

SEQ ID NO: 224281 - DNA, 30 bp, Artificial Sequence
  Description of Artificial Sequence: Synthetic oligonucleotide
tcggtgctgatctcagtggaagctgtcttg

SEQ ID NO: 224282 - DNA, 29 bp, Artificial Sequence
  Description of Artificial Sequence: Synthetic oligonucleotide
cggtgctgatctcagtggaagctgtcttg

SEQ ID NO: 224283 - DNA, 29 bp, Artificial Sequence
  Description of Artificial Sequence: Synthetic oligonucleotide
ggtgctgatctcagtggaagctgtcttgg

SEQ ID NO: 224284 - DNA, 29 bp, Artificial Sequence
  Description of Artificial Sequence: Synthetic oligonucleotide
gtgctgatctcagtggaagctgtcttggg

SEQ ID NO: 224285 - DNA, 29 bp, Artificial Sequence
  Description of Artificial Sequence: Synthetic oligonucleotide
tgctgatctcagtggaagctgtcttgggg

SEQ ID NO: 224286 - DNA, 28 bp, Artificial Sequence
  Description of Artificial Sequence: Synthetic oligonucleotide
gctgatctcagtggaagctgtcttgggg

SEQ ID NO: 224287 - DNA, 30 bp, Artificial Sequence
  Description of Artificial Sequence: Synthetic oligonucleotide
ctgatctcagtggaagctgtcttggggaag

SEQ ID NO: 224288 - DNA, 30 bp, Artificial Sequence
  Description of Artificial Sequence: Synthetic oligonucleotide
tgatctcagtggaagctgtcttggggaagg

SEQ ID NO: 224289 - DNA, 29 bp, Artificial Sequence
  Description of Artificial Sequence: Synthetic oligonucleotide
gatctcagtggaagctgtcttggggaagg

SEQ ID NO: 224290 - DNA, 30 bp, Artificial Sequence
  Description of Artificial Sequence: Synthetic oligonucleotide
atctcagtggaagctgtcttggggaaggtc

SEQ ID NO: 224291 - DNA, 29 bp, Artificial Sequence
  Description of Artificial Sequence: Synthetic oligonucleotide
tctcagtggaagctgtcttggggaaggtc

SEQ ID NO: 224292 - DNA, 28 bp, Artificial Sequence
  Description of Artificial Sequence: Synthetic oligonucleotide
ctcagtggaagctgtcttggggaaggtc

SEQ ID NO: 224293 - DNA, 30 bp, Artificial Sequence
  Description of Artificial Sequence: Synthetic oligonucleotide
tcagtggaagctgtcttggggaaggtcaac

SEQ ID NO: 224294 - DNA, 29 bp, Artificial Sequence
  Description of Artificial Sequence: Synthetic oligonucleotide
cagtggaagctgtcttggggaaggtcaac

SEQ ID NO: 224295 - DNA, 31 bp, Artificial Sequence
  Description of Artificial Sequence: Synthetic oligonucleotide
agtggaagctgtcttggggaaggtcaacttg

SEQ ID NO: 224296 - DNA, 30 bp, Artificial Sequence
  Description of Artificial Sequence: Synthetic oligonucleotide
gtggaagctgtcttggggaaggtcaacttg

SEQ ID NO: 224297 - DNA, 30 bp, Artificial Sequence
  Description of Artificial Sequence: Synthetic oligonucleotide
tggaagctgtcttggggaaggtcaacttgg

SEQ ID NO: 224298 - DNA, 29 bp, Artificial Sequence
  Description of Artificial Sequence: Synthetic oligonucleotide
ggaagctgtcttggggaaggtcaacttgg

SEQ ID NO: 224299 - DNA, 29 bp, Artificial Sequence
  Description of Artificial Sequence: Synthetic oligonucleotide
gaagctgtcttggggaaggtcaacttggc

SEQ ID NO: 224300 - DNA, 29 bp, Artificial Sequence
  Description of Artificial Sequence: Synthetic oligonucleotide
aagctgtcttggggaaggtcaacttggcg

SEQ ID NO: 224301 - DNA, 28 bp, Artificial Sequence
  Description of Artificial Sequence: Synthetic oligonucleotide
agctgtcttggggaaggtcaacttggcg

SEQ ID NO: 224302 - DNA, 33 bp, Artificial Sequence
  Description of Artificial Sequence: Synthetic oligonucleotide
cgagggaacggaggataaagatcagacagtaac

SEQ ID NO: 224303 - DNA, 33 bp, Artificial Sequence
  Description of Artificial Sequence: Synthetic oligonucleotide
gagggaacggaggataaagatcagacagtaacg

SEQ ID NO: 224304 - DNA, 36 bp, Artificial Sequence
  Description of Artificial Sequence: Synthetic oligonucleotide
agggaacggaggataaagatcagacagtaacgatac

SEQ ID NO: 224305 - DNA, 35 bp, Artificial Sequence
  Description of Artificial Sequence: Synthetic oligonucleotide
gggaacggaggataaagatcagacagtaacgatac

SEQ ID NO: 224306 - DNA, 35 bp, Artificial Sequence
  Description of Artificial Sequence: Synthetic oligonucleotide
ggaacggaggataaagatcagacagtaacgatacc

SEQ ID NO: 224307 - DNA, 35 bp, Artificial Sequence
  Description of Artificial Sequence: Synthetic oligonucleotide
gaacggaggataaagatcagacagtaacgataccc

SEQ ID NO: 224308 - DNA, 36 bp, Artificial Sequence
  Description of Artificial Sequence: Synthetic oligonucleotide
aacggaggataaagatcagacagtaacgatacccag

SEQ ID NO: 224309 - DNA, 35 bp, Artificial Sequence
  Description of Artificial Sequence: Synthetic oligonucleotide
acggaggataaagatcagacagtaacgatacccag

SEQ ID NO: 224310 - DNA, 34 bp, Artificial Sequence
  Description of Artificial Sequence: Synthetic oligonucleotide
cggaggataaagatcagacagtaacgatacccag

SEQ ID NO: 224311 - DNA, 37 bp, Artificial Sequence
  Description of Artificial Sequence: Synthetic oligonucleotide
ggaggataaagatcagacagtaacgatacccagtttg

SEQ ID NO: 224312 - DNA, 38 bp, Artificial Sequence
  Description of Artificial Sequence: Synthetic oligonucleotide
gaggataaagatcagacagtaacgatacccagtttgtc

SEQ ID NO: 224313 - DNA, 39 bp, Artificial Sequence
  Description of Artificial Sequence: Synthetic oligonucleotide
aggataaagatcagacagtaacgatacccagtttgtctg

SEQ ID NO: 224314 - DNA, 38 bp, Artificial Sequence
  Description of Artificial Sequence: Synthetic oligonucleotide
ggataaagatcagacagtaacgatacccagtttgtctg

SEQ ID NO: 224315 - DNA, 38 bp, Artificial Sequence
  Description of Artificial Sequence: Synthetic oligonucleotide
gataaagatcagacagtaacgatacccagtttgtctgc

SEQ ID NO: 224316 - DNA, 38 bp, Artificial Sequence
  Description of Artificial Sequence: Synthetic oligonucleotide
ataaagatcagacagtaacgatacccagtttgtctgcc

SEQ ID NO: 224317 - DNA, 37 bp, Artificial Sequence
  Description of Artificial Sequence: Synthetic oligonucleotide
taaagatcagacagtaacgatacccagtttgtctgcc

SEQ ID NO: 224318 - DNA, 36 bp, Artificial Sequence
  Description of Artificial Sequence: Synthetic oligonucleotide
aaagatcagacagtaacgatacccagtttgtctgcc

SEQ ID NO: 224319 - DNA, 35 bp, Artificial Sequence
  Description of Artificial Sequence: Synthetic oligonucleotide
aagatcagacagtaacgatacccagtttgtctgcc

SEQ ID NO: 224320 - DNA, 34 bp, Artificial Sequence
  Description of Artificial Sequence: Synthetic oligonucleotide
agatcagacagtaacgatacccagtttgtctgcc

SEQ ID NO: 224321 - DNA, 33 bp, Artificial Sequence
  Description of Artificial Sequence: Synthetic oligonucleotide
gatcagacagtaacgatacccagtttgtctgcc

SEQ ID NO: 224322 - DNA, 35 bp, Artificial Sequence
  Description of Artificial Sequence: Synthetic oligonucleotide
atcagacagtaacgatacccagtttgtctgccatg

SEQ ID NO: 224323 - DNA, 34 bp, Artificial Sequence
  Description of Artificial Sequence: Synthetic oligonucleotide
tcagacagtaacgatacccagtttgtctgccatg

SEQ ID NO: 224324 - DNA, 33 bp, Artificial Sequence
  Description of Artificial Sequence: Synthetic oligonucleotide
cagacagtaacgatacccagtttgtctgccatg

SEQ ID NO: 224325 - DNA, 33 bp, Artificial Sequence
  Description of Artificial Sequence: Synthetic oligonucleotide
agacagtaacgatacccagtttgtctgccatgc

SEQ ID NO: 224326 - DNA, 32 bp, Artificial Sequence
  Description of Artificial Sequence: Synthetic oligonucleotide
gacagtaacgatacccagtttgtctgccatgc

SEQ ID NO: 224327 - DNA, 33 bp, Artificial Sequence
  Description of Artificial Sequence: Synthetic oligonucleotide
acagtaacgatacccagtttgtctgccatgctg

SEQ ID NO: 224328 - DNA, 32 bp, Artificial Sequence
  Description of Artificial Sequence: Synthetic oligonucleotide
cagtaacgatacccagtttgtctgccatgctg

SEQ ID NO: 224329 - DNA, 32 bp, Artificial Sequence
  Description of Artificial Sequence: Synthetic oligonucleotide
agtaacgatacccagtttgtctgccatgctgg

SEQ ID NO: 224330 - DNA, 43 bp, Artificial Sequence
  Description of Artificial Sequence: Synthetic oligonucleotide
gtttgctcctaaatcttaaaatatggaaagcacctcatgagrc

SEQ ID NO: 224331 - DNA, 53 bp, Artificial Sequence
  Description of Artificial Sequence: Synthetic oligonucleotide
tttgctcctaaatcttaaaatatggaaagcacctcatgagrctaaatattttg

SEQ ID NO: 224332 - DNA, 52 bp, Artificial Sequence
  Description of Artificial Sequence: Synthetic oligonucleotide
ttgctcctaaatcttaaaatatggaaagcacctcatgagrctaaatattttg

SEQ ID NO: 224333 - DNA, 51 bp, Artificial Sequence
  Description of Artificial Sequence: Synthetic oligonucleotide
tgctcctaaatcttaaaatatggaaagcacctcatgagrctaaatattttg

SEQ ID NO: 224334 - DNA, 50 bp, Artificial Sequence
  Description of Artificial Sequence: Synthetic oligonucleotide
gctcctaaatcttaaaatatggaaagcacctcatgagrctaaatattttg

SEQ ID NO: 224335 - DNA, 52 bp, Artificial Sequence
  Description of Artificial Sequence: Synthetic oligonucleotide
ctcctaaatcttaaaatatggaaagcacctcatgagrctaaatattttgatg

SEQ ID NO: 224336 - DNA, 53 bp, Artificial Sequence
  Description of Artificial Sequence: Synthetic oligonucleotide
tcctaaatcttaaaatatggaaagcacctcatgagrctaaatattttgatgac

SEQ ID NO: 224337 - DNA, 52 bp, Artificial Sequence
  Description of Artificial Sequence: Synthetic oligonucleotide
cctaaatcttaaaatatggaaagcacctcatgagrctaaatattttgatgac

SEQ ID NO: 224338 - DNA, 52 bp, Artificial Sequence
  Description of Artificial Sequence: Synthetic oligonucleotide
ctaaatcttaaaatatggaaagcacctcatgagrctaaatattttgatgacc

SEQ ID NO: 224339 - DNA, 54 bp, Artificial Sequence
  Description of Artificial Sequence: Synthetic oligonucleotide
taaatcttaaaatatggaaagcacctcatgagrctaaatattttgatgaccaag

SEQ ID NO: 224340 - DNA, 53 bp, Artificial Sequence
  Description of Artificial Sequence: Synthetic oligonucleotide
aaatcttaaaatatggaaagcacctcatgagrctaaatattttgatgaccaag

SEQ ID NO: 224341 - DNA, 52 bp, Artificial Sequence
  Description of Artificial Sequence: Synthetic oligonucleotide
aatcttaaaatatggaaagcacctcatgagrctaaatattttgatgaccaag

SEQ ID NO: 224342 - DNA, 51 bp, Artificial Sequence
  Description of Artificial Sequence: Synthetic oligonucleotide
atcttaaaatatggaaagcacctcatgagrctaaatattttgatgaccaag

SEQ ID NO: 224343 - DNA, 50 bp, Artificial Sequence
  Description of Artificial Sequence: Synthetic oligonucleotide
tcttaaaatatggaaagcacctcatgagrctaaatattttgatgaccaag

SEQ ID NO: 224344 - DNA, 49 bp, Artificial Sequence
  Description of Artificial Sequence: Synthetic oligonucleotide
cttaaaatatggaaagcacctcatgagrctaaatattttgatgaccaag

SEQ ID NO: 224345 - DNA, 53 bp, Artificial Sequence
  Description of Artificial Sequence: Synthetic oligonucleotide
ttaaaatatggaaagcacctcatgagrctaaatattttgatgaccaagttttc

SEQ ID NO: 224346 - DNA, 52 bp, Artificial Sequence
  Description of Artificial Sequence: Synthetic oligonucleotide
taaaatatggaaagcacctcatgagrctaaatattttgatgaccaagttttc

SEQ ID NO: 224347 - DNA, 51 bp, Artificial Sequence
  Description of Artificial Sequence: Synthetic oligonucleotide
aaaatatggaaagcacctcatgagrctaaatattttgatgaccaagttttc

SEQ ID NO: 224348 - DNA, 50 bp, Artificial Sequence
  Description of Artificial Sequence: Synthetic oligonucleotide
aaatatggaaagcacctcatgagrctaaatattttgatgaccaagttttc

SEQ ID NO: 224349 - DNA, 49 bp, Artificial Sequence
  Description of Artificial Sequence: Synthetic oligonucleotide
aatatggaaagcacctcatgagrctaaatattttgatgaccaagttttc

SEQ ID NO: 224350 - DNA, 48 bp, Artificial Sequence
  Description of Artificial Sequence: Synthetic oligonucleotide
atatggaaagcacctcatgagrctaaatattttgatgaccaagttttc

SEQ ID NO: 224351 - DNA, 47 bp, Artificial Sequence
  Description of Artificial Sequence: Synthetic oligonucleotide
tatggaaagcacctcatgagrctaaatattttgatgaccaagttttc

SEQ ID NO: 224352 - DNA, 46 bp, Artificial Sequence
  Description of Artificial Sequence: Synthetic oligonucleotide
atggaaagcacctcatgagrctaaatattttgatgaccaagttttc

SEQ ID NO: 224353 - DNA, 45 bp, Artificial Sequence
  Description of Artificial Sequence: Synthetic oligonucleotide
tggaaagcacctcatgagrctaaatattttgatgaccaagttttc

SEQ ID NO: 224354 - DNA, 44 bp, Artificial Sequence
  Description of Artificial Sequence: Synthetic oligonucleotide
ggaaagcacctcatgagrctaaatattttgatgaccaagttttc

SEQ ID NO: 224355 - DNA, 45 bp, Artificial Sequence
  Description of Artificial Sequence: Synthetic oligonucleotide
gaaagcacctcatgagrctaaatattttgatgaccaagttttctg

SEQ ID NO: 224356 - DNA, 45 bp, Artificial Sequence
  Description of Artificial Sequence: Synthetic oligonucleotide
aaagcacctcatgagrctaaatattttgatgaccaagttttctgg

SEQ ID NO: 224357 - DNA, 44 bp, Artificial Sequence
  Description of Artificial Sequence: Synthetic oligonucleotide
aagcacctcatgagrctaaatattttgatgaccaagttttctgg

SEQ ID NO: 224358 - DNA, 43 bp, Artificial Sequence
  Description of Artificial Sequence: Synthetic oligonucleotide
agcacctcatgagrctaaatattttgatgaccaagttttctgg

SEQ ID NO: 224359 - DNA, 42 bp, Artificial Sequence
  Description of Artificial Sequence: Synthetic oligonucleotide
gcacctcatgagrctaaatattttgatgaccaagttttctgg

SEQ ID NO: 224360 - DNA, 44 bp, Artificial Sequence
  Description of Artificial Sequence: Synthetic oligonucleotide
cacctcatgagrctaaatattttgatgaccaagttttctggaag

SEQ ID NO: 224361 - DNA, 30 bp, Artificial Sequence
  Description of Artificial Sequence: Synthetic oligonucleotide
gatgctgtcttggggaaggtcaacttggtg

SEQ ID NO: 224362 - DNA, 30 bp, Artificial Sequence
  Description of Artificial Sequence: Synthetic oligonucleotide
atgctgtcttggggaaggtcaacttggtgc

SEQ ID NO: 224363 - DNA, 29 bp, Artificial Sequence
  Description of Artificial Sequence: Synthetic oligonucleotide
tgctgtcttggggaaggtcaacttggtgc

SEQ ID NO: 224364 - DNA, 28 bp, Artificial Sequence
  Description of Artificial Sequence: Synthetic oligonucleotide
gctgtcttggggaaggtcaacttggtgc

SEQ ID NO: 224365 - DNA, 29 bp, Artificial Sequence
  Description of Artificial Sequence: Synthetic oligonucleotide
ctgtcttggggaaggtcaacttggtgcag

SEQ ID NO: 224366 - DNA, 31 bp, Artificial Sequence
  Description of Artificial Sequence: Synthetic oligonucleotide
tgtcttggggaaggtcaacttggtgcagttg

SEQ ID NO: 224367 - DNA, 30 bp, Artificial Sequence
  Description of Artificial Sequence: Synthetic oligonucleotide
gtcttggggaaggtcaacttggtgcagttg

SEQ ID NO: 224368 - DNA, 30 bp, Artificial Sequence
  Description of Artificial Sequence: Synthetic oligonucleotide
tcttggggaaggtcaacttggtgcagttgg

SEQ ID NO: 224369 - DNA, 29 bp, Artificial Sequence
  Description of Artificial Sequence: Synthetic oligonucleotide
cttggggaaggtcaacttggtgcagttgg

SEQ ID NO: 224370 - DNA, 30 bp, Artificial Sequence
  Description of Artificial Sequence: Synthetic oligonucleotide
ttggggaaggtcaacttggtgcagttggtg

SEQ ID NO: 224371 - DNA, 29 bp, Artificial Sequence
  Description of Artificial Sequence: Synthetic oligonucleotide
tggggaaggtcaacttggtgcagttggtg

SEQ ID NO: 224372 - DNA, 28 bp, Artificial Sequence
  Description of Artificial Sequence: Synthetic oligonucleotide
ggggaaggtcaacttggtgcagttggtg

SEQ ID NO: 224373 - DNA, 28 bp, Artificial Sequence
  Description of Artificial Sequence: Synthetic oligonucleotide
gggaaggtcaacttggtgcagttggtgg

SEQ ID NO: 224374 - DNA, 29 bp, Artificial Sequence
  Description of Artificial Sequence: Synthetic oligonucleotide
ggaaggtcaacttggtgcagttggtggtg

SEQ ID NO: 224375 - DNA, 31 bp, Artificial Sequence
  Description of Artificial Sequence: Synthetic oligonucleotide
gaaggtcaacttggtgcagttggtggtgatg

SEQ ID NO: 224376 - DNA, 31 bp, Artificial Sequence
  Description of Artificial Sequence: Synthetic oligonucleotide
aaggtcaacttggtgcagttggtggtgatgg

SEQ ID NO: 224377 - DNA, 30 bp, Artificial Sequence
  Description of Artificial Sequence: Synthetic oligonucleotide
aggtcaacttggtgcagttggtggtgatgg

SEQ ID NO: 224378 - DNA, 29 bp, Artificial Sequence
  Description of Artificial Sequence: Synthetic oligonucleotide
ggtcaacttggtgcagttggtggtgatgg

SEQ ID NO: 224379 - DNA, 30 bp, Artificial Sequence
  Description of Artificial Sequence: Synthetic oligonucleotide
gtcaacttggtgcagttggtggtgatggtg

SEQ ID NO: 224380 - DNA, 30 bp, Artificial Sequence
  Description of Artificial Sequence: Synthetic oligonucleotide
tcaacttggtgcagttggtggtgatggtgc

SEQ ID NO: 224381 - DNA, 29 bp, Artificial Sequence
  Description of Artificial Sequence: Synthetic oligonucleotide
caacttggtgcagttggtggtgatggtgc

SEQ ID NO: 224382 - DNA, 30 bp, Artificial Sequence
  Description of Artificial Sequence: Synthetic oligonucleotide
aacttggtgcagttggtggtgatggtgctg

SEQ ID NO: 224383 - DNA, 29 bp, Artificial Sequence
  Description of Artificial Sequence: Synthetic oligonucleotide
acttggtgcagttggtggtgatggtgctg

SEQ ID NO: 224384 - DNA, 28 bp, Artificial Sequence
  Description of Artificial Sequence: Synthetic oligonucleotide
cttggtgcagttggtggtgatggtgctg

SEQ ID NO: 224385 - DNA, 28 bp, Artificial Sequence
  Description of Artificial Sequence: Synthetic oligonucleotide
ttggtgcagttggtggtgatggtgctgg

SEQ ID NO: 224386 - DNA, 27 bp, Artificial Sequence
  Description of Artificial Sequence: Synthetic oligonucleotide
tggtgcagttggtggtgatggtgctgg

SEQ ID NO: 224387 - DNA, 27 bp, Artificial Sequence
  Description of Artificial Sequence: Synthetic oligonucleotide
ggtgcagttggtggtgatggtgctggt

SEQ ID NO: 224388 - DNA, 27 bp, Artificial Sequence
  Description of Artificial Sequence: Synthetic oligonucleotide
gtgcagttggtggtgatggtgctggtg

SEQ ID NO: 224389 - DNA, 27 bp, Artificial Sequence
  Description of Artificial Sequence: Synthetic oligonucleotide
tgcagttggtggtgatggtgctggtgg

SEQ ID NO: 224390 - DNA, 43 bp, Artificial Sequence
  Description of Artificial Sequence: Synthetic oligonucleotide
tcatcagtaatatcttcaacacagactaccacatgaacatgac

SEQ ID NO: 224391 - DNA, 42 bp, Artificial Sequence
  Description of Artificial Sequence: Synthetic oligonucleotide
catcagtaatatcttcaacacagactaccacatgaacatgac

SEQ ID NO: 224392 - DNA, 42 bp, Artificial Sequence
  Description of Artificial Sequence: Synthetic oligonucleotide
atcagtaatatcttcaacacagactaccacatgaacatgacg

SEQ ID NO: 224393 - DNA, 41 bp, Artificial Sequence
  Description of Artificial Sequence: Synthetic oligonucleotide
tcagtaatatcttcaacacagactaccacatgaacatgacg

SEQ ID NO: 224394 - DNA, 40 bp, Artificial Sequence
  Description of Artificial Sequence: Synthetic oligonucleotide
cagtaatatcttcaacacagactaccacatgaacatgacg

SEQ ID NO: 224395 - DNA, 40 bp, Artificial Sequence
  Description of Artificial Sequence: Synthetic oligonucleotide
agtaatatcttcaacacagactaccacatgaacatgacgc

SEQ ID NO: 224396 - DNA, 39 bp, Artificial Sequence
  Description of Artificial Sequence: Synthetic oligonucleotide
gtaatatcttcaacacagactaccacatgaacatgacgc

SEQ ID NO: 224397 - DNA, 40 bp, Artificial Sequence
  Description of Artificial Sequence: Synthetic oligonucleotide
taatatcttcaacacagactaccacatgaacatgacgcac

SEQ ID NO: 224398 - DNA, 39 bp, Artificial Sequence
  Description of Artificial Sequence: Synthetic oligonucleotide
aatatcttcaacacagactaccacatgaacatgacgcac

SEQ ID NO: 224399 - DNA, 38 bp, Artificial Sequence
  Description of Artificial Sequence: Synthetic oligonucleotide
atatcttcaacacagactaccacatgaacatgacgcac

SEQ ID NO: 224400 - DNA, 37 bp, Artificial Sequence
  Description of Artificial Sequence: Synthetic oligonucleotide
tatcttcaacacagactaccacatgaacatgacgcac

SEQ ID NO: 224401 - DNA, 36 bp, Artificial Sequence
  Description of Artificial Sequence: Synthetic oligonucleotide
atcttcaacacagactaccacatgaacatgacgcac

SEQ ID NO: 224402 - DNA, 35 bp, Artificial Sequence
  Description of Artificial Sequence: Synthetic oligonucleotide
tcttcaacacagactaccacatgaacatgacgcac

SEQ ID NO: 224403 - DNA, 34 bp, Artificial Sequence
  Description of Artificial Sequence: Synthetic oligonucleotide
cttcaacacagactaccacatgaacatgacgcac

SEQ ID NO: 224404 - DNA, 36 bp, Artificial Sequence
  Description of Artificial Sequence: Synthetic oligonucleotide
ttcaacacagactaccacatgaacatgacgcacatc

SEQ ID NO: 224405 - DNA, 35 bp, Artificial Sequence
  Description of Artificial Sequence: Synthetic oligonucleotide
tcaacacagactaccacatgaacatgacgcacatc

SEQ ID NO: 224406 - DNA, 34 bp, Artificial Sequence
  Description of Artificial Sequence: Synthetic oligonucleotide
caacacagactaccacatgaacatgacgcacatc

SEQ ID NO: 224407 - DNA, 36 bp, Artificial Sequence
  Description of Artificial Sequence: Synthetic oligonucleotide
aacacagactaccacatgaacatgacgcacatctac

SEQ ID NO: 224408 - DNA, 35 bp, Artificial Sequence
  Description of Artificial Sequence: Synthetic oligonucleotide
acacagactaccacatgaacatgacgcacatctac

SEQ ID NO: 224409 - DNA, 34 bp, Artificial Sequence
  Description of Artificial Sequence: Synthetic oligonucleotide
cacagactaccacatgaacatgacgcacatctac

SEQ ID NO: 224410 - DNA, 34 bp, Artificial Sequence
  Description of Artificial Sequence: Synthetic oligonucleotide
acagactaccacatgaacatgacgcacatctacg

SEQ ID NO: 224411 - DNA, 33 bp, Artificial Sequence
  Description of Artificial Sequence: Synthetic oligonucleotide
cagactaccacatgaacatgacgcacatctacg

SEQ ID NO: 224412 - DNA, 34 bp, Artificial Sequence
  Description of Artificial Sequence: Synthetic oligonucleotide
agactaccacatgaacatgacgcacatctacgtg

SEQ ID NO: 224413 - DNA, 33 bp, Artificial Sequence
  Description of Artificial Sequence: Synthetic oligonucleotide
gactaccacatgaacatgacgcacatctacgtg

SEQ ID NO: 224414 - DNA, 35 bp, Artificial Sequence
  Description of Artificial Sequence: Synthetic oligonucleotide
actaccacatgaacatgacgcacatctacgtgttc

SEQ ID NO: 224415 - DNA, 34 bp, Artificial Sequence
  Description of Artificial Sequence: Synthetic oligonucleotide
ctaccacatgaacatgacgcacatctacgtgttc

SEQ ID NO: 224416 - DNA, 34 bp, Artificial Sequence
  Description of Artificial Sequence: Synthetic oligonucleotide
taccacatgaacatgacgcacatctacgtgttcg

SEQ ID NO: 224417 - DNA, 33 bp, Artificial Sequence
  Description of Artificial Sequence: Synthetic oligonucleotide
accacatgaacatgacgcacatctacgtgttcg

SEQ ID NO: 224418 - DNA, 32 bp, Artificial Sequence
  Description of Artificial Sequence: Synthetic oligonucleotide
ccacatgaacatgacgcacatctacgtgttcg

SEQ ID NO: 224419 - DNA, 32 bp, Artificial Sequence
  Description of Artificial Sequence: Synthetic oligonucleotide
cacatgaacatgacgcacatctacgtgttcgc

SEQ ID NO: 224420 - DNA, 33 bp, Artificial Sequence
  Description of Artificial Sequence: Synthetic oligonucleotide
acatgaacatgacgcacatctacgtgttcgcag

SEQ ID NO: 224421 - DNA, 32 bp, Artificial Sequence
  Description of Artificial Sequence: Synthetic oligonucleotide
catgaacatgacgcacatctacgtgttcgcag

SEQ ID NO: 224422 - DNA, 32 bp, Artificial Sequence
  Description of Artificial Sequence: Synthetic oligonucleotide
atgaacatgacgcacatctacgtgttcgcagc

SEQ ID NO: 224423 - DNA, 31 bp, Artificial Sequence
  Description of Artificial Sequence: Synthetic oligonucleotide
tgaacatgacgcacatctacgtgttcgcagc

SEQ ID NO: 224424 - DNA, 30 bp, Artificial Sequence
  Description of Artificial Sequence: Synthetic oligonucleotide
gaacatgacgcacatctacgtgttcgcagc

SEQ ID NO: 224425 - DNA, 30 bp, Artificial Sequence
  Description of Artificial Sequence: Synthetic oligonucleotide
aacatgacgcacatctacgtgttcgcagcc

SEQ ID NO: 224426 - DNA, 29 bp, Artificial Sequence
  Description of Artificial Sequence: Synthetic oligonucleotide
acatgacgcacatctacgtgttcgcagcc

SEQ ID NO: 224427 - DNA, 28 bp, Artificial Sequence
  Description of Artificial Sequence: Synthetic oligonucleotide
catgacgcacatctacgtgttcgcagcc

SEQ ID NO: 224428 - DNA, 34 bp, Artificial Sequence
  Description of Artificial Sequence: Synthetic oligonucleotide
atgacgcacatctacgtgttcgcagcctattttg

SEQ ID NO: 224429 - DNA, 33 bp, Artificial Sequence
  Description of Artificial Sequence: Synthetic oligonucleotide
tgacgcacatctacgtgttcgcagcctattttg

SEQ ID NO: 224430 - DNA, 32 bp, Artificial Sequence
  Description of Artificial Sequence: Synthetic oligonucleotide
gacgcacatctacgtgttcgcagcctattttg

SEQ ID NO: 224431 - DNA, 32 bp, Artificial Sequence
  Description of Artificial Sequence: Synthetic oligonucleotide
acgcacatctacgtgttcgcagcctattttgg

SEQ ID NO: 224432 - DNA, 31 bp, Artificial Sequence
  Description of Artificial Sequence: Synthetic oligonucleotide
cgcacatctacgtgttcgcagcctattttgg

SEQ ID NO: 224433 - DNA, 42 bp, Artificial Sequence
  Description of Artificial Sequence: Synthetic oligonucleotide
tcttctatttttttacccactatgacgcttccttagaggaac

SEQ ID NO: 224434 - DNA, 41 bp, Artificial Sequence
  Description of Artificial Sequence: Synthetic oligonucleotide
cttctatttttttacccactatgacgcttccttagaggaac

SEQ ID NO: 224435 - DNA, 45 bp, Artificial Sequence
  Description of Artificial Sequence: Synthetic oligonucleotide
ttctatttttttacccactatgacgcttccttagaggaacaaaag

SEQ ID NO: 224436 - DNA, 44 bp, Artificial Sequence
  Description of Artificial Sequence: Synthetic oligonucleotide
tctatttttttacccactatgacgcttccttagaggaacaaaag

SEQ ID NO: 224437 - DNA, 43 bp, Artificial Sequence
  Description of Artificial Sequence: Synthetic oligonucleotide
ctatttttttacccactatgacgcttccttagaggaacaaaag

SEQ ID NO: 224438 - DNA, 43 bp, Artificial Sequence
  Description of Artificial Sequence: Synthetic oligonucleotide
tatttttttacccactatgacgcttccttagaggaacaaaagg

SEQ ID NO: 224439 - DNA, 42 bp, Artificial Sequence
  Description of Artificial Sequence: Synthetic oligonucleotide
atttttttacccactatgacgcttccttagaggaacaaaagg

SEQ ID NO: 224440 - DNA, 41 bp, Artificial Sequence
  Description of Artificial Sequence: Synthetic oligonucleotide
tttttttacccactatgacgcttccttagaggaacaaaagg

SEQ ID NO: 224441 - DNA, 40 bp, Artificial Sequence
  Description of Artificial Sequence: Synthetic oligonucleotide
ttttttacccactatgacgcttccttagaggaacaaaagg

SEQ ID NO: 224442 - DNA, 39 bp, Artificial Sequence
  Description of Artificial Sequence: Synthetic oligonucleotide
tttttacccactatgacgcttccttagaggaacaaaagg

SEQ ID NO: 224443 - DNA, 38 bp, Artificial Sequence
  Description of Artificial Sequence: Synthetic oligonucleotide
ttttacccactatgacgcttccttagaggaacaaaagg

SEQ ID NO: 224444 - DNA, 37 bp, Artificial Sequence
  Description of Artificial Sequence: Synthetic oligonucleotide
tttacccactatgacgcttccttagaggaacaaaagg

SEQ ID NO: 224445 - DNA, 36 bp, Artificial Sequence
  Description of Artificial Sequence: Synthetic oligonucleotide
ttacccactatgacgcttccttagaggaacaaaagg

SEQ ID NO: 224446 - DNA, 35 bp, Artificial Sequence
  Description of Artificial Sequence: Synthetic oligonucleotide
tacccactatgacgcttccttagaggaacaaaagg

SEQ ID NO: 224447 - DNA, 34 bp, Artificial Sequence
  Description of Artificial Sequence: Synthetic oligonucleotide
acccactatgacgcttccttagaggaacaaaagg

SEQ ID NO: 224448 - DNA, 33 bp, Artificial Sequence
  Description of Artificial Sequence: Synthetic oligonucleotide
cccactatgacgcttccttagaggaacaaaagg

SEQ ID NO: 224449 - DNA, 33 bp, Artificial Sequence
  Description of Artificial Sequence: Synthetic oligonucleotide
ccactatgacgcttccttagaggaacaaaaggg

SEQ ID NO: 224450 - DNA, 33 bp, Artificial Sequence
  Description of Artificial Sequence: Synthetic oligonucleotide
cactatgacgcttccttagaggaacaaaagggg

SEQ ID NO: 224451 - DNA, 33 bp, Artificial Sequence
  Description of Artificial Sequence: Synthetic oligonucleotide
actatgacgcttccttagaggaacaaaaggggc

SEQ ID NO: 224452 - DNA, 32 bp, Artificial Sequence
  Description of Artificial Sequence: Synthetic oligonucleotide
ctatgacgcttccttagaggaacaaaaggggc

SEQ ID NO: 224453 - DNA, 33 bp, Artificial Sequence
  Description of Artificial Sequence: Synthetic oligonucleotide
tatgacgcttccttagaggaacaaaaggggctc

SEQ ID NO: 224454 - DNA, 32 bp, Artificial Sequence
  Description of Artificial Sequence: Synthetic oligonucleotide
atgacgcttccttagaggaacaaaaggggctc

SEQ ID NO: 224455 - DNA, 31 bp, Artificial Sequence
  Description of Artificial Sequence: Synthetic oligonucleotide
tgacgcttccttagaggaacaaaaggggctc

SEQ ID NO: 224456 - DNA, 30 bp, Artificial Sequence
  Description of Artificial Sequence: Synthetic oligonucleotide
gacgcttccttagaggaacaaaaggggctc

SEQ ID NO: 224457 - DNA, 30 bp, Artificial Sequence
  Description of Artificial Sequence: Synthetic oligonucleotide
acgcttccttagaggaacaaaaggggctcg

SEQ ID NO: 224458 - DNA, 29 bp, Artificial Sequence
  Description of Artificial Sequence: Synthetic oligonucleotide
cgcttccttagaggaacaaaaggggctcg

SEQ ID NO: 224459 - DNA, 30 bp, Artificial Sequence
  Description of Artificial Sequence: Synthetic oligonucleotide
gcttccttagaggaacaaaaggggctcgtg

SEQ ID NO: 224460 - DNA, 30 bp, Artificial Sequence
  Description of Artificial Sequence: Synthetic oligonucleotide
cttccttagaggaacaaaaggggctcgtgg

SEQ ID NO: 224461 - DNA, 30 bp, Artificial Sequence
  Description of Artificial Sequence: Synthetic oligonucleotide
ttccttagaggaacaaaaggggctcgtggc

SEQ ID NO: 224462 - DNA, 29 bp, Artificial Sequence
  Description of Artificial Sequence: Synthetic oligonucleotide
tccttagaggaacaaaaggggctcgtggc

SEQ ID NO: 224463 - DNA, 28 bp, Artificial Sequence
  Description of Artificial Sequence: Synthetic oligonucleotide
ccttagaggaacaaaaggggctcgtggc

SEQ ID NO: 224464 - DNA, 30 bp, Artificial Sequence
  Description of Artificial Sequence: Synthetic oligonucleotide
cttagaggaacaaaaggggctcgtggcatc

SEQ ID NO: 224465 - DNA, 30 bp, Artificial Sequence
  Description of Artificial Sequence: Synthetic oligonucleotide
ttagaggaacaaaaggggctcgtggcatcc

SEQ ID NO: 224466 - DNA, 29 bp, Artificial Sequence
  Description of Artificial Sequence: Synthetic oligonucleotide
tagaggaacaaaaggggctcgtggcatcc

SEQ ID NO: 224467 - DNA, 28 bp, Artificial Sequence
  Description of Artificial Sequence: Synthetic oligonucleotide
agaggaacaaaaggggctcgtggcatcc

SEQ ID NO: 224468 - DNA, 27 bp, Artificial Sequence
  Description of Artificial Sequence: Synthetic oligonucleotide
gaggaacaaaaggggctcgtggcatcc

SEQ ID NO: 224469 - DNA, 30 bp, Artificial Sequence
  Description of Artificial Sequence: Synthetic oligonucleotide
aggaacaaaaggggctcgtggcatcctatc

SEQ ID NO: 224470 - DNA, 29 bp, Artificial Sequence
  Description of Artificial Sequence: Synthetic oligonucleotide
ggaacaaaaggggctcgtggcatcctatc

SEQ ID NO: 224471 - DNA, 31 bp, Artificial Sequence
  Description of Artificial Sequence: Synthetic oligonucleotide
gaacaaaaggggctcgtggcatcctatcaag

SEQ ID NO: 224472 - DNA, 33 bp, Artificial Sequence
  Description of Artificial Sequence: Synthetic oligonucleotide
aacaaaaggggctcgtggcatcctatcaagttg

SEQ ID NO: 224473 - DNA, 32 bp, Artificial Sequence
  Description of Artificial Sequence: Synthetic oligonucleotide
acaaaaggggctcgtggcatcctatcaagttg

SEQ ID NO: 224474 - DNA, 28 bp, Artificial Sequence
  Description of Artificial Sequence: Synthetic oligonucleotide
cgtggtgacagccatctcagggtcattc

SEQ ID NO: 224475 - DNA, 30 bp, Artificial Sequence
  Description of Artificial Sequence: Synthetic oligonucleotide
gtggtgacagccatctcagggtcattcttg

SEQ ID NO: 224476 - DNA, 30 bp, Artificial Sequence
  Description of Artificial Sequence: Synthetic oligonucleotide
tggtgacagccatctcagggtcattcttgg

SEQ ID NO: 224477 - DNA, 29 bp, Artificial Sequence
  Description of Artificial Sequence: Synthetic oligonucleotide
ggtgacagccatctcagggtcattcttgg

SEQ ID NO: 224478 - DNA, 29 bp, Artificial Sequence
  Description of Artificial Sequence: Synthetic oligonucleotide
gtgacagccatctcagggtcattcttggc

SEQ ID NO: 224479 - DNA, 30 bp, Artificial Sequence
  Description of Artificial Sequence: Synthetic oligonucleotide
tgacagccatctcagggtcattcttggctc

SEQ ID NO: 224480 - DNA, 29 bp, Artificial Sequence
  Description of Artificial Sequence: Synthetic oligonucleotide
gacagccatctcagggtcattcttggctc

SEQ ID NO: 224481 - DNA, 30 bp, Artificial Sequence
  Description of Artificial Sequence: Synthetic oligonucleotide
acagccatctcagggtcattcttggctcac

SEQ ID NO: 224482 - DNA, 29 bp, Artificial Sequence
  Description of Artificial Sequence: Synthetic oligonucleotide
cagccatctcagggtcattcttggctcac

SEQ ID NO: 224483 - DNA, 29 bp, Artificial Sequence
  Description of Artificial Sequence: Synthetic oligonucleotide
agccatctcagggtcattcttggctcacc

SEQ ID NO: 224484 - DNA, 28 bp, Artificial Sequence
  Description of Artificial Sequence: Synthetic oligonucleotide
gccatctcagggtcattcttggctcacc

SEQ ID NO: 224485 - DNA, 28 bp, Artificial Sequence
  Description of Artificial Sequence: Synthetic oligonucleotide
ccatctcagggtcattcttggctcaccc

SEQ ID NO: 224486 - DNA, 28 bp, Artificial Sequence
  Description of Artificial Sequence: Synthetic oligonucleotide
catctcagggtcattcttggctcacccc

SEQ ID NO: 224487 - DNA, 28 bp, Artificial Sequence
  Description of Artificial Sequence: Synthetic oligonucleotide
atctcagggtcattcttggctcaccccc

SEQ ID NO: 224488 - DNA, 27 bp, Artificial Sequence
  Description of Artificial Sequence: Synthetic oligonucleotide
tctcagggtcattcttggctcaccccc

SEQ ID NO: 224489 - DNA, 27 bp, Artificial Sequence
  Description of Artificial Sequence: Synthetic oligonucleotide
ctcagggtcattcttggctcaccccca

SEQ ID NO: 224490 - DNA, 28 bp, Artificial Sequence
  Description of Artificial Sequence: Synthetic oligonucleotide
tcagggtcattcttggctcacccccaag

SEQ ID NO: 224491 - DNA, 27 bp, Artificial Sequence
  Description of Artificial Sequence: Synthetic oligonucleotide
cagggtcattcttggctcacccccaag

SEQ ID NO: 224492 - DNA, 27 bp, Artificial Sequence
  Description of Artificial Sequence: Synthetic oligonucleotide
agggtcattcttggctcacccccaagg

SEQ ID NO: 224493 - DNA, 26 bp, Artificial Sequence
  Description of Artificial Sequence: Synthetic oligonucleotide
gggtcattcttggctcacccccaagg

SEQ ID NO: 224494 - DNA, 27 bp, Artificial Sequence
  Description of Artificial Sequence: Synthetic oligonucleotide
ggtcattcttggctcacccccaaggga

SEQ ID NO: 224495 - DNA, 28 bp, Artificial Sequence
  Description of Artificial Sequence: Synthetic oligonucleotide
gtcattcttggctcacccccaagggaag

SEQ ID NO: 224496 - DNA, 30 bp, Artificial Sequence
  Description of Artificial Sequence: Synthetic oligonucleotide
tcattcttggctcacccccaagggaagatc

SEQ ID NO: 224497 - DNA, 29 bp, Artificial Sequence
  Description of Artificial Sequence: Synthetic oligonucleotide
cattcttggctcacccccaagggaagatc

SEQ ID NO: 224498 - DNA, 30 bp, Artificial Sequence
  Description of Artificial Sequence: Synthetic oligonucleotide
attcttggctcacccccaagggaagatcag

SEQ ID NO: 224499 - DNA, 29 bp, Artificial Sequence
  Description of Artificial Sequence: Synthetic oligonucleotide
ttcttggctcacccccaagggaagatcag

SEQ ID NO: 224500 - DNA, 28 bp, Artificial Sequence
  Description of Artificial Sequence: Synthetic oligonucleotide
tcttggctcacccccaagggaagatcag

SEQ ID NO: 224501 - DNA, 38 bp, Artificial Sequence
  Description of Artificial Sequence: Synthetic oligonucleotide
aatcgaaaggaagaatgccgtgttcaacacctacaatg

SEQ ID NO: 224502 - DNA, 37 bp, Artificial Sequence
  Description of Artificial Sequence: Synthetic oligonucleotide
atcgaaaggaagaatgccgtgttcaacacctacaatg

SEQ ID NO: 224503 - DNA, 36 bp, Artificial Sequence
  Description of Artificial Sequence: Synthetic oligonucleotide
tcgaaaggaagaatgccgtgttcaacacctacaatg

SEQ ID NO: 224504 - DNA, 35 bp, Artificial Sequence
  Description of Artificial Sequence: Synthetic oligonucleotide
cgaaaggaagaatgccgtgttcaacacctacaatg

SEQ ID NO: 224505 - DNA, 35 bp, Artificial Sequence
  Description of Artificial Sequence: Synthetic oligonucleotide
gaaaggaagaatgccgtgttcaacacctacaatgc

SEQ ID NO: 224506 - DNA, 36 bp, Artificial Sequence
  Description of Artificial Sequence: Synthetic oligonucleotide
aaaggaagaatgccgtgttcaacacctacaatgctg

SEQ ID NO: 224507 - DNA, 35 bp, Artificial Sequence
  Description of Artificial Sequence: Synthetic oligonucleotide
aaggaagaatgccgtgttcaacacctacaatgctg

SEQ ID NO: 224508 - DNA, 34 bp, Artificial Sequence
  Description of Artificial Sequence: Synthetic oligonucleotide
aggaagaatgccgtgttcaacacctacaatgctg

SEQ ID NO: 224509 - DNA, 33 bp, Artificial Sequence
  Description of Artificial Sequence: Synthetic oligonucleotide
ggaagaatgccgtgttcaacacctacaatgctg

SEQ ID NO: 224510 - DNA, 35 bp, Artificial Sequence
  Description of Artificial Sequence: Synthetic oligonucleotide
gaagaatgccgtgttcaacacctacaatgctgtag

SEQ ID NO: 224511 - DNA, 35 bp, Artificial Sequence
  Description of Artificial Sequence: Synthetic oligonucleotide
aagaatgccgtgttcaacacctacaatgctgtagc

SEQ ID NO: 224512 - DNA, 34 bp, Artificial Sequence
  Description of Artificial Sequence: Synthetic oligonucleotide
agaatgccgtgttcaacacctacaatgctgtagc

SEQ ID NO: 224513 - DNA, 33 bp, Artificial Sequence
  Description of Artificial Sequence: Synthetic oligonucleotide
gaatgccgtgttcaacacctacaatgctgtagc

SEQ ID NO: 224514 - DNA, 34 bp, Artificial Sequence
  Description of Artificial Sequence: Synthetic oligonucleotide
aatgccgtgttcaacacctacaatgctgtagcag

SEQ ID NO: 224515 - DNA, 33 bp, Artificial Sequence
  Description of Artificial Sequence: Synthetic oligonucleotide
atgccgtgttcaacacctacaatgctgtagcag

SEQ ID NO: 224516 - DNA, 32 bp, Artificial Sequence
  Description of Artificial Sequence: Synthetic oligonucleotide
tgccgtgttcaacacctacaatgctgtagcag

SEQ ID NO: 224517 - DNA, 31 bp, Artificial Sequence
  Description of Artificial Sequence: Synthetic oligonucleotide
gccgtgttcaacacctacaatgctgtagcag

SEQ ID NO: 224518 - DNA, 32 bp, Artificial Sequence
  Description of Artificial Sequence: Synthetic oligonucleotide
ccgtgttcaacacctacaatgctgtagcagtc

SEQ ID NO: 224519 - DNA, 33 bp, Artificial Sequence
  Description of Artificial Sequence: Synthetic oligonucleotide
cgtgttcaacacctacaatgctgtagcagtcag

SEQ ID NO: 224520 - DNA, 33 bp, Artificial Sequence
  Description of Artificial Sequence: Synthetic oligonucleotide
gtgttcaacacctacaatgctgtagcagtcagc

SEQ ID NO: 224521 - DNA, 33 bp, Artificial Sequence
  Description of Artificial Sequence: Synthetic oligonucleotide
tgttcaacacctacaatgctgtagcagtcagcg

SEQ ID NO: 224522 - DNA, 32 bp, Artificial Sequence
  Description of Artificial Sequence: Synthetic oligonucleotide
gttcaacacctacaatgctgtagcagtcagcg

SEQ ID NO: 224523 - DNA, 33 bp, Artificial Sequence
  Description of Artificial Sequence: Synthetic oligonucleotide
ttcaacacctacaatgctgtagcagtcagcgtg

SEQ ID NO: 224524 - DNA, 32 bp, Artificial Sequence
  Description of Artificial Sequence: Synthetic oligonucleotide
tcaacacctacaatgctgtagcagtcagcgtg

SEQ ID NO: 224525 - DNA, 31 bp, Artificial Sequence
  Description of Artificial Sequence: Synthetic oligonucleotide
caacacctacaatgctgtagcagtcagcgtg

SEQ ID NO: 224526 - DNA, 31 bp, Artificial Sequence
  Description of Artificial Sequence: Synthetic oligonucleotide
aacacctacaatgctgtagcagtcagcgtgg

SEQ ID NO: 224527 - DNA, 30 bp, Artificial Sequence
  Description of Artificial Sequence: Synthetic oligonucleotide
acacctacaatgctgtagcagtcagcgtgg

SEQ ID NO: 224528 - DNA, 29 bp, Artificial Sequence
  Description of Artificial Sequence: Synthetic oligonucleotide
cacctacaatgctgtagcagtcagcgtgg

SEQ ID NO: 224529 - DNA, 30 bp, Artificial Sequence
  Description of Artificial Sequence: Synthetic oligonucleotide
acctacaatgctgtagcagtcagcgtggtg

SEQ ID NO: 224530 - DNA, 29 bp, Artificial Sequence
  Description of Artificial Sequence: Synthetic oligonucleotide
cctacaatgctgtagcagtcagcgtggtg

SEQ ID NO: 224531 - DNA, 30 bp, Artificial Sequence
  Description of Artificial Sequence: Synthetic oligonucleotide
ctacaatgctgtagcagtcagcgtggtgac

SEQ ID NO: 224532 - DNA, 31 bp, Artificial Sequence
  Description of Artificial Sequence: Synthetic oligonucleotide
tacaatgctgtagcagtcagcgtggtgacag

SEQ ID NO: 224533 - DNA, 30 bp, Artificial Sequence
  Description of Artificial Sequence: Synthetic oligonucleotide
acaatgctgtagcagtcagcgtggtgacag

SEQ ID NO: 224534 - DNA, 29 bp, Artificial Sequence
  Description of Artificial Sequence: Synthetic oligonucleotide
caatgctgtagcagtcagcgtggtgacag

SEQ ID NO: 224535 - DNA, 29 bp, Artificial Sequence
  Description of Artificial Sequence: Synthetic oligonucleotide
aatgctgtagcagtcagcgtggtgacagc

SEQ ID NO: 224536 - DNA, 34 bp, Artificial Sequence
  Description of Artificial Sequence: Synthetic oligonucleotide
tctgctctgctgagaagtccaatcgaaaggaatg

SEQ ID NO: 224537 - DNA, 33 bp, Artificial Sequence
  Description of Artificial Sequence: Synthetic oligonucleotide
ctgctctgctgagaagtccaatcgaaaggaatg

SEQ ID NO: 224538 - DNA, 33 bp, Artificial Sequence
  Description of Artificial Sequence: Synthetic oligonucleotide
tgctctgctgagaagtccaatcgaaaggaatgc

SEQ ID NO: 224539 - DNA, 32 bp, Artificial Sequence
  Description of Artificial Sequence: Synthetic oligonucleotide
gctctgctgagaagtccaatcgaaaggaatgc

SEQ ID NO: 224540 - DNA, 32 bp, Artificial Sequence
  Description of Artificial Sequence: Synthetic oligonucleotide
ctctgctgagaagtccaatcgaaaggaatgcc

SEQ ID NO: 224541 - DNA, 32 bp, Artificial Sequence
  Description of Artificial Sequence: Synthetic oligonucleotide
tctgctgagaagtccaatcgaaaggaatgccg

SEQ ID NO: 224542 - DNA, 31 bp, Artificial Sequence
  Description of Artificial Sequence: Synthetic oligonucleotide
ctgctgagaagtccaatcgaaaggaatgccg

SEQ ID NO: 224543 - DNA, 32 bp, Artificial Sequence
  Description of Artificial Sequence: Synthetic oligonucleotide
tgctgagaagtccaatcgaaaggaatgccgtg

SEQ ID NO: 224544 - DNA, 31 bp, Artificial Sequence
  Description of Artificial Sequence: Synthetic oligonucleotide
gctgagaagtccaatcgaaaggaatgccgtg

SEQ ID NO: 224545 - DNA, 33 bp, Artificial Sequence
  Description of Artificial Sequence: Synthetic oligonucleotide
ctgagaagtccaatcgaaaggaatgccgtgttc

SEQ ID NO: 224546 - DNA, 35 bp, Artificial Sequence
  Description of Artificial Sequence: Synthetic oligonucleotide
tgagaagtccaatcgaaaggaatgccgtgttcaac

SEQ ID NO: 224547 - DNA, 34 bp, Artificial Sequence
  Description of Artificial Sequence: Synthetic oligonucleotide
gagaagtccaatcgaaaggaatgccgtgttcaac

SEQ ID NO: 224548 - DNA, 35 bp, Artificial Sequence
  Description of Artificial Sequence: Synthetic oligonucleotide
agaagtccaatcgaaaggaatgccgtgttcaacac

SEQ ID NO: 224549 - DNA, 34 bp, Artificial Sequence
  Description of Artificial Sequence: Synthetic oligonucleotide
gaagtccaatcgaaaggaatgccgtgttcaacac

SEQ ID NO: 224550 - DNA, 34 bp, Artificial Sequence
  Description of Artificial Sequence: Synthetic oligonucleotide
aagtccaatcgaaaggaatgccgtgttcaacacc

SEQ ID NO: 224551 - DNA, 33 bp, Artificial Sequence
  Description of Artificial Sequence: Synthetic oligonucleotide
agtccaatcgaaaggaatgccgtgttcaacacc

SEQ ID NO: 224552 - DNA, 32 bp, Artificial Sequence
  Description of Artificial Sequence: Synthetic oligonucleotide
gtccaatcgaaaggaatgccgtgttcaacacc

SEQ ID NO: 224553 - DNA, 34 bp, Artificial Sequence
  Description of Artificial Sequence: Synthetic oligonucleotide
tccaatcgaaaggaatgccgtgttcaacacctac

SEQ ID NO: 224554 - DNA, 33 bp, Artificial Sequence
  Description of Artificial Sequence: Synthetic oligonucleotide
ccaatcgaaaggaatgccgtgttcaacacctac

SEQ ID NO: 224555 - DNA, 36 bp, Artificial Sequence
  Description of Artificial Sequence: Synthetic oligonucleotide
caatcgaaaggaatgccgtgttcaacacctactatg

SEQ ID NO: 224556 - DNA, 36 bp, Artificial Sequence
  Description of Artificial Sequence: Synthetic oligonucleotide
aatcgaaaggaatgccgtgttcaacacctactatgc

SEQ ID NO: 224557 - DNA, 35 bp, Artificial Sequence
  Description of Artificial Sequence: Synthetic oligonucleotide
atcgaaaggaatgccgtgttcaacacctactatgc

SEQ ID NO: 224558 - DNA, 34 bp, Artificial Sequence
  Description of Artificial Sequence: Synthetic oligonucleotide
tcgaaaggaatgccgtgttcaacacctactatgc

SEQ ID NO: 224559 - DNA, 33 bp, Artificial Sequence
  Description of Artificial Sequence: Synthetic oligonucleotide
cgaaaggaatgccgtgttcaacacctactatgc

SEQ ID NO: 224560 - DNA, 34 bp, Artificial Sequence
  Description of Artificial Sequence: Synthetic oligonucleotide
gaaaggaatgccgtgttcaacacctactatgctg

SEQ ID NO: 224561 - DNA, 36 bp, Artificial Sequence
  Description of Artificial Sequence: Synthetic oligonucleotide
aaaggaatgccgtgttcaacacctactatgctgtag

SEQ ID NO: 224562 - DNA, 35 bp, Artificial Sequence
  Description of Artificial Sequence: Synthetic oligonucleotide
aaggaatgccgtgttcaacacctactatgctgtag

SEQ ID NO: 224563 - DNA, 34 bp, Artificial Sequence
  Description of Artificial Sequence: Synthetic oligonucleotide
aggaatgccgtgttcaacacctactatgctgtag

SEQ ID NO: 224564 - DNA, 33 bp, Artificial Sequence
  Description of Artificial Sequence: Synthetic oligonucleotide
ggaatgccgtgttcaacacctactatgctgtag

SEQ ID NO: 224565 - DNA, 32 bp, Artificial Sequence
  Description of Artificial Sequence: Synthetic oligonucleotide
atctacgtgttcgcagcctattttgggctgac

SEQ ID NO: 224566 - DNA, 33 bp, Artificial Sequence
  Description of Artificial Sequence: Synthetic oligonucleotide
gccctcttcttgtggatgttctggacaagtttc

SEQ ID NO: 224567 - DNA, 35 bp, Artificial Sequence
  Description of Artificial Sequence: Synthetic oligonucleotide
ccctcttcttgtggatgttctggacaagtttcaac

SEQ ID NO: 224568 - DNA, 36 bp, Artificial Sequence
  Description of Artificial Sequence: Synthetic oligonucleotide
cctcttcttgtggatgttctggacaagtttcaactc

SEQ ID NO: 224569 - DNA, 37 bp, Artificial Sequence
  Description of Artificial Sequence: Synthetic oligonucleotide
ctcttcttgtggatgttctggacaagtttcaactctg

SEQ ID NO: 224570 - DNA, 37 bp, Artificial Sequence
  Description of Artificial Sequence: Synthetic oligonucleotide
tcttcttgtggatgttctggacaagtttcaactctgc

SEQ ID NO: 224571 - DNA, 36 bp, Artificial Sequence
  Description of Artificial Sequence: Synthetic oligonucleotide
cttcttgtggatgttctggacaagtttcaactctgc

SEQ ID NO: 224572 - DNA, 37 bp, Artificial Sequence
  Description of Artificial Sequence: Synthetic oligonucleotide
ttcttgtggatgttctggacaagtttcaactctgctc

SEQ ID NO: 224573 - DNA, 36 bp, Artificial Sequence
  Description of Artificial Sequence: Synthetic oligonucleotide
tcttgtggatgttctggacaagtttcaactctgctc

SEQ ID NO: 224574 - DNA, 35 bp, Artificial Sequence
  Description of Artificial Sequence: Synthetic oligonucleotide
cttgtggatgttctggacaagtttcaactctgctc

SEQ ID NO: 224575 - DNA, 36 bp, Artificial Sequence
  Description of Artificial Sequence: Synthetic oligonucleotide
ttgtggatgttctggacaagtttcaactctgctctg

SEQ ID NO: 224576 - DNA, 35 bp, Artificial Sequence
  Description of Artificial Sequence: Synthetic oligonucleotide
tgtggatgttctggacaagtttcaactctgctctg

SEQ ID NO: 224577 - DNA, 34 bp, Artificial Sequence
  Description of Artificial Sequence: Synthetic oligonucleotide
gtggatgttctggacaagtttcaactctgctctg

SEQ ID NO: 224578 - DNA, 34 bp, Artificial Sequence
  Description of Artificial Sequence: Synthetic oligonucleotide
tggatgttctggacaagtttcaactctgctctgc

SEQ ID NO: 224579 - DNA, 33 bp, Artificial Sequence
  Description of Artificial Sequence: Synthetic oligonucleotide
ggatgttctggacaagtttcaactctgctctgc

SEQ ID NO: 224580 - DNA, 34 bp, Artificial Sequence
  Description of Artificial Sequence: Synthetic oligonucleotide
gatgttctggacaagtttcaactctgctctgctg

SEQ ID NO: 224581 - DNA, 35 bp, Artificial Sequence
  Description of Artificial Sequence: Synthetic oligonucleotide
atgttctggacaagtttcaactctgctctgctgag

SEQ ID NO: 224582 - DNA, 34 bp, Artificial Sequence
  Description of Artificial Sequence: Synthetic oligonucleotide
tgttctggacaagtttcaactctgctctgctgag

SEQ ID NO: 224583 - DNA, 33 bp, Artificial Sequence
  Description of Artificial Sequence: Synthetic oligonucleotide
gttctggacaagtttcaactctgctctgctgag

SEQ ID NO: 224584 - DNA, 35 bp, Artificial Sequence
  Description of Artificial Sequence: Synthetic oligonucleotide
ttctggacaagtttcaactctgctctgctgagaag

SEQ ID NO: 224585 - DNA, 34 bp, Artificial Sequence
  Description of Artificial Sequence: Synthetic oligonucleotide
tctggacaagtttcaactctgctctgctgagaag

SEQ ID NO: 224586 - DNA, 33 bp, Artificial Sequence
  Description of Artificial Sequence: Synthetic oligonucleotide
ctggacaagtttcaactctgctctgctgagaag

SEQ ID NO: 224587 - DNA, 34 bp, Artificial Sequence
  Description of Artificial Sequence: Synthetic oligonucleotide
tggacaagtttcaactctgctctgctgagaagtc

SEQ ID NO: 224588 - DNA, 33 bp, Artificial Sequence
  Description of Artificial Sequence: Synthetic oligonucleotide
ggacaagtttcaactctgctctgctgagaagtc

SEQ ID NO: 224589 - DNA, 33 bp, Artificial Sequence
  Description of Artificial Sequence: Synthetic oligonucleotide
gacaagtttcaactctgctctgctgagaagtcc

SEQ ID NO: 224590 - DNA, 36 bp, Artificial Sequence
  Description of Artificial Sequence: Synthetic oligonucleotide
acaagtttcaactctgctctgctgagaagtccaatc

SEQ ID NO: 224591 - DNA, 26 bp, Artificial Sequence
  Description of Artificial Sequence: Synthetic oligonucleotide
tgataccgtcggagccggcaatggca

SEQ ID NO: 224592 - DNA, 25 bp, Artificial Sequence
  Description of Artificial Sequence: Synthetic oligonucleotide
gataccgtcggagccggcaatggca

SEQ ID NO: 224593 - DNA, 25 bp, Artificial Sequence
  Description of Artificial Sequence: Synthetic oligonucleotide
ataccgtcggagccggcaatggcac

SEQ ID NO: 224594 - DNA, 35 bp, Artificial Sequence
  Description of Artificial Sequence: Synthetic oligonucleotide
ctcttcttgtggatcttctggccaagtttcaactc

SEQ ID NO: 224595 - DNA, 36 bp, Artificial Sequence
  Description of Artificial Sequence: Synthetic oligonucleotide
tcttcttgtggatcttctggccaagtttcaactctg

SEQ ID NO: 224596 - DNA, 35 bp, Artificial Sequence
  Description of Artificial Sequence: Synthetic oligonucleotide
cttcttgtggatcttctggccaagtttcaactctg

SEQ ID NO: 224597 - DNA, 35 bp, Artificial Sequence
  Description of Artificial Sequence: Synthetic oligonucleotide
ttcttgtggatcttctggccaagtttcaactctgc

SEQ ID NO: 224598 - DNA, 34 bp, Artificial Sequence
  Description of Artificial Sequence: Synthetic oligonucleotide
tcttgtggatcttctggccaagtttcaactctgc

SEQ ID NO: 224599 - DNA, 33 bp, Artificial Sequence
  Description of Artificial Sequence: Synthetic oligonucleotide
cttgtggatcttctggccaagtttcaactctgc

SEQ ID NO: 224600 - DNA, 34 bp, Artificial Sequence
  Description of Artificial Sequence: Synthetic oligonucleotide
ttgtggatcttctggccaagtttcaactctgctc

SEQ ID NO: 224601 - DNA, 33 bp, Artificial Sequence
  Description of Artificial Sequence: Synthetic oligonucleotide
tgtggatcttctggccaagtttcaactctgctc

SEQ ID NO: 224602 - DNA, 32 bp, Artificial Sequence
  Description of Artificial Sequence: Synthetic oligonucleotide
gtggatcttctggccaagtttcaactctgctc

SEQ ID NO: 224603 - DNA, 33 bp, Artificial Sequence
  Description of Artificial Sequence: Synthetic oligonucleotide
tggatcttctggccaagtttcaactctgctctg

SEQ ID NO: 224604 - DNA, 32 bp, Artificial Sequence
  Description of Artificial Sequence: Synthetic oligonucleotide
ggatcttctggccaagtttcaactctgctctg

SEQ ID NO: 224605 - DNA, 32 bp, Artificial Sequence
  Description of Artificial Sequence: Synthetic oligonucleotide
gatcttctggccaagtttcaactctgctctgc

SEQ ID NO: 224606 - DNA, 33 bp, Artificial Sequence
  Description of Artificial Sequence: Synthetic oligonucleotide
atcttctggccaagtttcaactctgctctgctg

SEQ ID NO: 224607 - DNA, 32 bp, Artificial Sequence
  Description of Artificial Sequence: Synthetic oligonucleotide
tcttctggccaagtttcaactctgctctgctg

SEQ ID NO: 224608 - DNA, 31 bp, Artificial Sequence
  Description of Artificial Sequence: Synthetic oligonucleotide
cttctggccaagtttcaactctgctctgctg

SEQ ID NO: 224609 - DNA, 27 bp, Artificial Sequence
  Description of Artificial Sequence: Synthetic oligonucleotide
tgtgcacagtgcggtgttggcaggaga

SEQ ID NO: 224610 - DNA, 26 bp, Artificial Sequence
  Description of Artificial Sequence: Synthetic oligonucleotide
gtgcacagtgcggtgttggcaggaga

SEQ ID NO: 224611 - DNA, 26 bp, Artificial Sequence
  Description of Artificial Sequence: Synthetic oligonucleotide
tgcacagtgcggtgttggcaggagac

SEQ ID NO: 224612 - DNA, 25 bp, Artificial Sequence
  Description of Artificial Sequence: Synthetic oligonucleotide
gcacagtgcggtgttggcaggagac

SEQ ID NO: 224613 - DNA, 26 bp, Artificial Sequence
  Description of Artificial Sequence: Synthetic oligonucleotide
cacagtgcggtgttggcaggagacgt

SEQ ID NO: 224614 - DNA, 26 bp, Artificial Sequence
  Description of Artificial Sequence: Synthetic oligonucleotide
acagtgcggtgttggcaggagacgtg

SEQ ID NO: 224615 - DNA, 25 bp, Artificial Sequence
  Description of Artificial Sequence: Synthetic oligonucleotide
cagtgcggtgttggcaggagacgtg

SEQ ID NO: 224616 - DNA, 25 bp, Artificial Sequence
  Description of Artificial Sequence: Synthetic oligonucleotide
agtgcggtgttggcaggagacgtgg

SEQ ID NO: 224617 - DNA, 24 bp, Artificial Sequence
  Description of Artificial Sequence: Synthetic oligonucleotide
gtgcggtgttggcaggagacgtgg

SEQ ID NO: 224618 - DNA, 25 bp, Artificial Sequence
  Description of Artificial Sequence: Synthetic oligonucleotide
tgcggtgttggcaggagacgtggct

SEQ ID NO: 224619 - DNA, 24 bp, Artificial Sequence
  Description of Artificial Sequence: Synthetic oligonucleotide
gcggtgttggcaggagacgtggct

SEQ ID NO: 224620 - DNA, 25 bp, Artificial Sequence
  Description of Artificial Sequence: Synthetic oligonucleotide
cggtgttggcaggagacgtggctgt

SEQ ID NO: 224621 - DNA, 25 bp, Artificial Sequence
  Description of Artificial Sequence: Synthetic oligonucleotide
ggtgttggcaggagacgtggctgtg

SEQ ID NO: 224622 - DNA, 25 bp, Artificial Sequence
  Description of Artificial Sequence: Synthetic oligonucleotide
gtgttggcaggagacgtggctgtgg

SEQ ID NO: 224623 - DNA, 27 bp, Artificial Sequence
  Description of Artificial Sequence: Synthetic oligonucleotide
tgttggcaggagacgtggctgtgggta

SEQ ID NO: 224624 - DNA, 26 bp, Artificial Sequence
  Description of Artificial Sequence: Synthetic oligonucleotide
gttggcaggagacgtggctgtgggta

SEQ ID NO: 224625 - DNA, 26 bp, Artificial Sequence
  Description of Artificial Sequence: Synthetic oligonucleotide
ttggcaggagacgtggctgtgggtac

SEQ ID NO: 224626 - DNA, 25 bp, Artificial Sequence
  Description of Artificial Sequence: Synthetic oligonucleotide
tggcaggagacgtggctgtgggtac

SEQ ID NO: 224627 - DNA, 24 bp, Artificial Sequence
  Description of Artificial Sequence: Synthetic oligonucleotide
ggcaggagacgtggctgtgggtac

SEQ ID NO: 224628 - DNA, 25 bp, Artificial Sequence
  Description of Artificial Sequence: Synthetic oligonucleotide
gcaggagacgtggctgtgggtacct

SEQ ID NO: 224629 - DNA, 25 bp, Artificial Sequence
  Description of Artificial Sequence: Synthetic oligonucleotide
caggagacgtggctgtgggtacctc

SEQ ID NO: 224630 - DNA, 26 bp, Artificial Sequence
  Description of Artificial Sequence: Synthetic oligonucleotide
aggagacgtggctgtgggtacctcgt

SEQ ID NO: 224631 - DNA, 25 bp, Artificial Sequence
  Description of Artificial Sequence: Synthetic oligonucleotide
ggagacgtggctgtgggtacctcgt

SEQ ID NO: 224632 - DNA, 26 bp, Artificial Sequence
  Description of Artificial Sequence: Synthetic oligonucleotide
gagacgtggctgtgggtacctcgtgt

SEQ ID NO: 224633 - DNA, 27 bp, Artificial Sequence
  Description of Artificial Sequence: Synthetic oligonucleotide
agacgtggctgtgggtacctcgtgtca

SEQ ID NO: 224634 - DNA, 26 bp, Artificial Sequence
  Description of Artificial Sequence: Synthetic oligonucleotide
gacgtggctgtgggtacctcgtgtca

SEQ ID NO: 224635 - DNA, 26 bp, Artificial Sequence
  Description of Artificial Sequence: Synthetic oligonucleotide
acgtggctgtgggtacctcgtgtcac

SEQ ID NO: 224636 - DNA, 31 bp, Artificial Sequence
  Description of Artificial Sequence: Synthetic oligonucleotide
gctacaacttcagcttgctgggtctgcttag

SEQ ID NO: 224637 - DNA, 32 bp, Artificial Sequence
  Description of Artificial Sequence: Synthetic oligonucleotide
ctacaacttcagcttgctgggtctgcttagag

SEQ ID NO: 224638 - DNA, 33 bp, Artificial Sequence
  Description of Artificial Sequence: Synthetic oligonucleotide
tacaacttcagcttgctgggtctgcttagagag

SEQ ID NO: 224639 - DNA, 32 bp, Artificial Sequence
  Description of Artificial Sequence: Synthetic oligonucleotide
acaacttcagcttgctgggtctgcttagagag

SEQ ID NO: 224640 - DNA, 31 bp, Artificial Sequence
  Description of Artificial Sequence: Synthetic oligonucleotide
caacttcagcttgctgggtctgcttagagag

SEQ ID NO: 224641 - DNA, 33 bp, Artificial Sequence
  Description of Artificial Sequence: Synthetic oligonucleotide
aacttcagcttgctgggtctgcttagagagatc

SEQ ID NO: 224642 - DNA, 32 bp, Artificial Sequence
  Description of Artificial Sequence: Synthetic oligonucleotide
acttcagcttgctgggtctgcttagagagatc

SEQ ID NO: 224643 - DNA, 31 bp, Artificial Sequence
  Description of Artificial Sequence: Synthetic oligonucleotide
cttcagcttgctgggtctgcttagagagatc

SEQ ID NO: 224644 - DNA, 33 bp, Artificial Sequence
  Description of Artificial Sequence: Synthetic oligonucleotide
ttcagcttgctgggtctgcttagagagatcatc

SEQ ID NO: 224645 - DNA, 32 bp, Artificial Sequence
  Description of Artificial Sequence: Synthetic oligonucleotide
tcagcttgctgggtctgcttagagagatcatc

SEQ ID NO: 224646 - DNA, 31 bp, Artificial Sequence
  Description of Artificial Sequence: Synthetic oligonucleotide
cagcttgctgggtctgcttagagagatcatc

SEQ ID NO: 224647 - DNA, 33 bp, Artificial Sequence
  Description of Artificial Sequence: Synthetic oligonucleotide
agcttgctgggtctgcttagagagatcatctac

SEQ ID NO: 224648 - DNA, 32 bp, Artificial Sequence
  Description of Artificial Sequence: Synthetic oligonucleotide
gcttgctgggtctgcttagagagatcatctac

SEQ ID NO: 224649 - DNA, 35 bp, Artificial Sequence
  Description of Artificial Sequence: Synthetic oligonucleotide
cttgctgggtctgcttagagagatcatctacattg

SEQ ID NO: 224650 - DNA, 36 bp, Artificial Sequence
  Description of Artificial Sequence: Synthetic oligonucleotide
ttgctgggtctgcttagagagatcatctacattgtg

SEQ ID NO: 224651 - DNA, 35 bp, Artificial Sequence
  Description of Artificial Sequence: Synthetic oligonucleotide
tgctgggtctgcttagagagatcatctacattgtg

SEQ ID NO: 224652 - DNA, 34 bp, Artificial Sequence
  Description of Artificial Sequence: Synthetic oligonucleotide
gctgggtctgcttagagagatcatctacattgtg

SEQ ID NO: 224653 - DNA, 34 bp, Artificial Sequence
  Description of Artificial Sequence: Synthetic oligonucleotide
ctgggtctgcttagagagatcatctacattgtgc

SEQ ID NO: 224654 - DNA, 35 bp, Artificial Sequence
  Description of Artificial Sequence: Synthetic oligonucleotide
tgggtctgcttagagagatcatctacattgtgctg

SEQ ID NO: 224655 - DNA, 34 bp, Artificial Sequence
  Description of Artificial Sequence: Synthetic oligonucleotide
gggtctgcttagagagatcatctacattgtgctg

SEQ ID NO: 224656 - DNA, 34 bp, Artificial Sequence
  Description of Artificial Sequence: Synthetic oligonucleotide
ggtctgcttagagagatcatctacattgtgctgc

SEQ ID NO: 224657 - DNA, 35 bp, Artificial Sequence
  Description of Artificial Sequence: Synthetic oligonucleotide
gtctgcttagagagatcatctacattgtgctgctg

SEQ ID NO: 224658 - DNA, 35 bp, Artificial Sequence
  Description of Artificial Sequence: Synthetic oligonucleotide
tctgcttagagagatcatctacattgtgctgctgg

SEQ ID NO: 224659 - DNA, 34 bp, Artificial Sequence
  Description of Artificial Sequence: Synthetic oligonucleotide
ctgcttagagagatcatctacattgtgctgctgg

SEQ ID NO: 224660 - DNA, 35 bp, Artificial Sequence
  Description of Artificial Sequence: Synthetic oligonucleotide
tgcttagagagatcatctacattgtgctgctggtg

SEQ ID NO: 224661 - DNA, 34 bp, Artificial Sequence
  Description of Artificial Sequence: Synthetic oligonucleotide
gcttagagagatcatctacattgtgctgctggtg

SEQ ID NO: 224662 - DNA, 34 bp, Artificial Sequence
  Description of Artificial Sequence: Synthetic oligonucleotide
cttagagagatcatctacattgtgctgctggtgc

SEQ ID NO: 224663 - DNA, 36 bp, Artificial Sequence
  Description of Artificial Sequence: Synthetic oligonucleotide
ttagagagatcatctacattgtgctgctggtgcttg

SEQ ID NO: 224664 - DNA, 35 bp, Artificial Sequence
  Description of Artificial Sequence: Synthetic oligonucleotide
tagagagatcatctacattgtgctgctggtgcttg

SEQ ID NO: 224665 - DNA, 34 bp, Artificial Sequence
  Description of Artificial Sequence: Synthetic oligonucleotide
agagagatcatctacattgtgctgctggtgcttg

SEQ ID NO: 224666 - DNA, 31 bp, Artificial Sequence
  Description of Artificial Sequence: Synthetic oligonucleotide
ctgatctcagtggatgctgtcttggggaatg

SEQ ID NO: 224667 - DNA, 32 bp, Artificial Sequence
  Description of Artificial Sequence: Synthetic oligonucleotide
tgatctcagtggatgctgtcttggggaatgtc

SEQ ID NO: 224668 - DNA, 31 bp, Artificial Sequence
  Description of Artificial Sequence: Synthetic oligonucleotide
gatctcagtggatgctgtcttggggaatgtc

SEQ ID NO: 224669 - DNA, 33 bp, Artificial Sequence
  Description of Artificial Sequence: Synthetic oligonucleotide
atctcagtggatgctgtcttggggaatgtcaac

SEQ ID NO: 224670 - DNA, 32 bp, Artificial Sequence
  Description of Artificial Sequence: Synthetic oligonucleotide
tctcagtggatgctgtcttggggaatgtcaac

SEQ ID NO: 224671 - DNA, 31 bp, Artificial Sequence
  Description of Artificial Sequence: Synthetic oligonucleotide
ctcagtggatgctgtcttggggaatgtcaac

SEQ ID NO: 224672 - DNA, 33 bp, Artificial Sequence
  Description of Artificial Sequence: Synthetic oligonucleotide
tcagtggatgctgtcttggggaatgtcaacttg

SEQ ID NO: 224673 - DNA, 32 bp, Artificial Sequence
  Description of Artificial Sequence: Synthetic oligonucleotide
cagtggatgctgtcttggggaatgtcaacttg

SEQ ID NO: 224674 - DNA, 32 bp, Artificial Sequence
  Description of Artificial Sequence: Synthetic oligonucleotide
agtggatgctgtcttggggaatgtcaacttgg

SEQ ID NO: 224675 - DNA, 31 bp, Artificial Sequence
  Description of Artificial Sequence: Synthetic oligonucleotide
gtggatgctgtcttggggaatgtcaacttgg

SEQ ID NO: 224676 - DNA, 31 bp, Artificial Sequence
  Description of Artificial Sequence: Synthetic oligonucleotide
tggatgctgtcttggggaatgtcaacttggc

SEQ ID NO: 224677 - DNA, 30 bp, Artificial Sequence
  Description of Artificial Sequence: Synthetic oligonucleotide
ggatgctgtcttggggaatgtcaacttggc

SEQ ID NO: 224678 - DNA, 30 bp, Artificial Sequence
  Description of Artificial Sequence: Synthetic oligonucleotide
gatgctgtcttggggaatgtcaacttggcg

SEQ ID NO: 224679 - DNA, 30 bp, Artificial Sequence
  Description of Artificial Sequence: Synthetic oligonucleotide
atgctgtcttggggaatgtcaacttggcgc

SEQ ID NO: 224680 - DNA, 29 bp, Artificial Sequence
  Description of Artificial Sequence: Synthetic oligonucleotide
tgctgtcttggggaatgtcaacttggcgc

SEQ ID NO: 224681 - DNA, 28 bp, Artificial Sequence
  Description of Artificial Sequence: Synthetic oligonucleotide
gctgtcttggggaatgtcaacttggcgc

SEQ ID NO: 224682 - DNA, 29 bp, Artificial Sequence
  Description of Artificial Sequence: Synthetic oligonucleotide
ctgtcttggggaatgtcaacttggcgcag

SEQ ID NO: 224683 - DNA, 31 bp, Artificial Sequence
  Description of Artificial Sequence: Synthetic oligonucleotide
tgtcttggggaatgtcaacttggcgcagttg

SEQ ID NO: 224684 - DNA, 30 bp, Artificial Sequence
  Description of Artificial Sequence: Synthetic oligonucleotide
gtcttggggaatgtcaacttggcgcagttg

SEQ ID NO: 224685 - DNA, 30 bp, Artificial Sequence
  Description of Artificial Sequence: Synthetic oligonucleotide
tcttggggaatgtcaacttggcgcagttgg

SEQ ID NO: 224686 - DNA, 29 bp, Artificial Sequence
  Description of Artificial Sequence: Synthetic oligonucleotide
cttggggaatgtcaacttggcgcagttgg

SEQ ID NO: 224687 - DNA, 30 bp, Artificial Sequence
  Description of Artificial Sequence: Synthetic oligonucleotide
ttggggaatgtcaacttggcgcagttggtg

SEQ ID NO: 224688 - DNA, 29 bp, Artificial Sequence
  Description of Artificial Sequence: Synthetic oligonucleotide
tggggaatgtcaacttggcgcagttggtg

SEQ ID NO: 224689 - DNA, 28 bp, Artificial Sequence
  Description of Artificial Sequence: Synthetic oligonucleotide
ggggaatgtcaacttggcgcagttggtg

SEQ ID NO: 224690 - DNA, 28 bp, Artificial Sequence
  Description of Artificial Sequence: Synthetic oligonucleotide
gggaatgtcaacttggcgcagttggtgg

SEQ ID NO: 224691 - DNA, 29 bp, Artificial Sequence
  Description of Artificial Sequence: Synthetic oligonucleotide
ggaatgtcaacttggcgcagttggtggtg

SEQ ID NO: 224692 - DNA, 31 bp, Artificial Sequence
  Description of Artificial Sequence: Synthetic oligonucleotide
gaatgtcaacttggcgcagttggtggtgatg

SEQ ID NO: 224693 - DNA, 31 bp, Artificial Sequence
  Description of Artificial Sequence: Synthetic oligonucleotide
aatgtcaacttggcgcagttggtggtgatgg

SEQ ID NO: 224694 - DNA, 30 bp, Artificial Sequence
  Description of Artificial Sequence: Synthetic oligonucleotide
atgtcaacttggcgcagttggtggtgatgg

SEQ ID NO: 224695 - DNA, 29 bp, Artificial Sequence
  Description of Artificial Sequence: Synthetic oligonucleotide
tgtcaacttggcgcagttggtggtgatgg

SEQ ID NO: 224696 - DNA, 32 bp, Artificial Sequence
  Description of Artificial Sequence: Synthetic oligonucleotide
tggatcttctggccaagtttcaactctgctcc

SEQ ID NO: 224697 - DNA, 31 bp, Artificial Sequence
  Description of Artificial Sequence: Synthetic oligonucleotide
ggatcttctggccaagtttcaactctgctcc

SEQ ID NO: 224698 - DNA, 31 bp, Artificial Sequence
  Description of Artificial Sequence: Synthetic oligonucleotide
gatcttctggccaagtttcaactctgctccg

SEQ ID NO: 224699 - DNA, 31 bp, Artificial Sequence
  Description of Artificial Sequence: Synthetic oligonucleotide
atcttctggccaagtttcaactctgctccgc

SEQ ID NO: 224700 - DNA, 30 bp, Artificial Sequence
  Description of Artificial Sequence: Synthetic oligonucleotide
tcttctggccaagtttcaactctgctccgc

SEQ ID NO: 224701 - DNA, 29 bp, Artificial Sequence
  Description of Artificial Sequence: Synthetic oligonucleotide
cttctggccaagtttcaactctgctccgc

SEQ ID NO: 224702 - DNA, 30 bp, Artificial Sequence
  Description of Artificial Sequence: Synthetic oligonucleotide
ttctggccaagtttcaactctgctccgctg

SEQ ID NO: 224703 - DNA, 29 bp, Artificial Sequence
  Description of Artificial Sequence: Synthetic oligonucleotide
tctggccaagtttcaactctgctccgctg

SEQ ID NO: 224704 - DNA, 28 bp, Artificial Sequence
  Description of Artificial Sequence: Synthetic oligonucleotide
ctggccaagtttcaactctgctccgctg

SEQ ID NO: 224705 - DNA, 29 bp, Artificial Sequence
  Description of Artificial Sequence: Synthetic oligonucleotide
tggccaagtttcaactctgctccgctgag

SEQ ID NO: 224706 - DNA, 28 bp, Artificial Sequence
  Description of Artificial Sequence: Synthetic oligonucleotide
ggccaagtttcaactctgctccgctgag

SEQ ID NO: 224707 - DNA, 30 bp, Artificial Sequence
  Description of Artificial Sequence: Synthetic oligonucleotide
gccaagtttcaactctgctccgctgagaag

SEQ ID NO: 224708 - DNA, 31 bp, Artificial Sequence
  Description of Artificial Sequence: Synthetic oligonucleotide
ccaagtttcaactctgctccgctgagaagtc

SEQ ID NO: 224709 - DNA, 31 bp, Artificial Sequence
  Description of Artificial Sequence: Synthetic oligonucleotide
caagtttcaactctgctccgctgagaagtcc

SEQ ID NO: 224710 - DNA, 34 bp, Artificial Sequence
  Description of Artificial Sequence: Synthetic oligonucleotide
aagtttcaactctgctccgctgagaagtccaatc

SEQ ID NO: 224711 - DNA, 33 bp, Artificial Sequence
  Description of Artificial Sequence: Synthetic oligonucleotide
agtttcaactctgctccgctgagaagtccaatc

SEQ ID NO: 224712 - DNA, 32 bp, Artificial Sequence
  Description of Artificial Sequence: Synthetic oligonucleotide
gtttcaactctgctccgctgagaagtccaatc

SEQ ID NO: 224713 - DNA, 32 bp, Artificial Sequence
  Description of Artificial Sequence: Synthetic oligonucleotide
tttcaactctgctccgctgagaagtccaatcg

SEQ ID NO: 224714 - DNA, 31 bp, Artificial Sequence
  Description of Artificial Sequence: Synthetic oligonucleotide
ttcaactctgctccgctgagaagtccaatcg

SEQ ID NO: 224715 - DNA, 30 bp, Artificial Sequence
  Description of Artificial Sequence: Synthetic oligonucleotide
tcaactctgctccgctgagaagtccaatcg

SEQ ID NO: 224716 - DNA, 29 bp, Artificial Sequence
  Description of Artificial Sequence: Synthetic oligonucleotide
caactctgctccgctgagaagtccaatcg

SEQ ID NO: 224717 - DNA, 32 bp, Artificial Sequence
  Description of Artificial Sequence: Synthetic oligonucleotide
aactctgctccgctgagaagtccaatcgaaag

SEQ ID NO: 224718 - DNA, 31 bp, Artificial Sequence
  Description of Artificial Sequence: Synthetic oligonucleotide
actctgctccgctgagaagtccaatcgaaag

SEQ ID NO: 224719 - DNA, 30 bp, Artificial Sequence
  Description of Artificial Sequence: Synthetic oligonucleotide
ctctgctccgctgagaagtccaatcgaaag

SEQ ID NO: 224720 - DNA, 30 bp, Artificial Sequence
  Description of Artificial Sequence: Synthetic oligonucleotide
tctgctccgctgagaagtccaatcgaaagg

SEQ ID NO: 224721 - DNA, 29 bp, Artificial Sequence
  Description of Artificial Sequence: Synthetic oligonucleotide
ctgctccgctgagaagtccaatcgaaagg

SEQ ID NO: 224722 - DNA, 31 bp, Artificial Sequence
  Description of Artificial Sequence: Synthetic oligonucleotide
tgctccgctgagaagtccaatcgaaaggaag

SEQ ID NO: 224723 - DNA, 30 bp, Artificial Sequence
  Description of Artificial Sequence: Synthetic oligonucleotide
gctccgctgagaagtccaatcgaaaggaag

SEQ ID NO: 224724 - DNA, 33 bp, Artificial Sequence
  Description of Artificial Sequence: Synthetic oligonucleotide
ctccgctgagaagtccaatcgaaaggaagaatg

SEQ ID NO: 224725 - DNA, 33 bp, Artificial Sequence
  Description of Artificial Sequence: Synthetic oligonucleotide
tccgctgagaagtccaatcgaaaggaagaatgc

SEQ ID NO: 224726 - DNA, 32 bp, Artificial Sequence
  Description of Artificial Sequence: Synthetic oligonucleotide
ccgctgagaagtccaatcgaaaggaagaatgc

SEQ ID NO: 224727 - DNA, 32 bp, Artificial Sequence
  Description of Artificial Sequence: Synthetic oligonucleotide
cgctgagaagtccaatcgaaaggaagaatgcc

SEQ ID NO: 224728 - DNA, 26 bp, Artificial Sequence
  Description of Artificial Sequence: Synthetic oligonucleotide
tcgggggagccaagtacctgccgttt

SEQ ID NO: 224729 - DNA, 25 bp, Artificial Sequence
  Description of Artificial Sequence: Synthetic oligonucleotide
cgggggagccaagtacctgccgttt

SEQ ID NO: 224730 - DNA, 25 bp, Artificial Sequence
  Description of Artificial Sequence: Synthetic oligonucleotide
gggggagccaagtacctgccgtttc

SEQ ID NO: 224731 - DNA, 26 bp, Artificial Sequence
  Description of Artificial Sequence: Synthetic oligonucleotide
ggggagccaagtacctgccgtttcct

SEQ ID NO: 224732 - DNA, 27 bp, Artificial Sequence
  Description of Artificial Sequence: Synthetic oligonucleotide
gggagccaagtacctgccgtttcctca

SEQ ID NO: 224733 - DNA, 30 bp, Artificial Sequence
  Description of Artificial Sequence: Synthetic oligonucleotide
ggagccaagtacctgccgtttcctcatttg

SEQ ID NO: 224734 - DNA, 30 bp, Artificial Sequence
  Description of Artificial Sequence: Synthetic oligonucleotide
gagccaagtacctgccgtttcctcatttgg

SEQ ID NO: 224735 - DNA, 30 bp, Artificial Sequence
  Description of Artificial Sequence: Synthetic oligonucleotide
agccaagtacctgccgtttcctcatttggc

SEQ ID NO: 224736 - DNA, 29 bp, Artificial Sequence
  Description of Artificial Sequence: Synthetic oligonucleotide
gccaagtacctgccgtttcctcatttggc

SEQ ID NO: 224737 - DNA, 30 bp, Artificial Sequence
  Description of Artificial Sequence: Synthetic oligonucleotide
ccaagtacctgccgtttcctcatttggctg

SEQ ID NO: 224738 - DNA, 32 bp, Artificial Sequence
  Description of Artificial Sequence: Synthetic oligonucleotide
caagtacctgccgtttcctcatttggctgttg

SEQ ID NO: 224739 - DNA, 32 bp, Artificial Sequence
  Description of Artificial Sequence: Synthetic oligonucleotide
aagtacctgccgtttcctcatttggctgttgg

SEQ ID NO: 224740 - DNA, 31 bp, Artificial Sequence
  Description of Artificial Sequence: Synthetic oligonucleotide
agtacctgccgtttcctcatttggctgttgg

SEQ ID NO: 224741 - DNA, 30 bp, Artificial Sequence
  Description of Artificial Sequence: Synthetic oligonucleotide
gtacctgccgtttcctcatttggctgttgg

SEQ ID NO: 224742 - DNA, 25 bp, Artificial Sequence
  Description of Artificial Sequence: Synthetic oligonucleotide
gggggagccaagtacctgccggatt

SEQ ID NO: 224743 - DNA, 25 bp, Artificial Sequence
  Description of Artificial Sequence: Synthetic oligonucleotide
ggggagccaagtacctgccggattg

SEQ ID NO: 224744 - DNA, 25 bp, Artificial Sequence
  Description of Artificial Sequence: Synthetic oligonucleotide
gggagccaagtacctgccggattgg

SEQ ID NO: 224745 - DNA, 27 bp, Artificial Sequence
  Description of Artificial Sequence: Synthetic oligonucleotide
ggagccaagtacctgccggattggctt

SEQ ID NO: 224746 - DNA, 27 bp, Artificial Sequence
  Description of Artificial Sequence: Synthetic oligonucleotide
gagccaagtacctgccggattggcttc

SEQ ID NO: 224747 - DNA, 27 bp, Artificial Sequence
  Description of Artificial Sequence: Synthetic oligonucleotide
agccaagtacctgccggattggcttcc

SEQ ID NO: 224748 - DNA, 27 bp, Artificial Sequence
  Description of Artificial Sequence: Synthetic oligonucleotide
gccaagtacctgccggattggcttcca

SEQ ID NO: 224749 - DNA, 27 bp, Artificial Sequence
  Description of Artificial Sequence: Synthetic oligonucleotide
ccaagtacctgccggattggcttccag

SEQ ID NO: 224750 - DNA, 27 bp, Artificial Sequence
  Description of Artificial Sequence: Synthetic oligonucleotide
caagtacctgccggattggcttccagg

SEQ ID NO: 224751 - DNA, 28 bp, Artificial Sequence
  Description of Artificial Sequence: Synthetic oligonucleotide
aagtacctgccggattggcttccaggtc

SEQ ID NO: 224752 - DNA, 27 bp, Artificial Sequence
  Description of Artificial Sequence: Synthetic oligonucleotide
agtacctgccggattggcttccaggtc

SEQ ID NO: 224753 - DNA, 26 bp, Artificial Sequence
  Description of Artificial Sequence: Synthetic oligonucleotide
gtacctgccggattggcttccaggtc

SEQ ID NO: 224754 - DNA, 27 bp, Artificial Sequence
  Description of Artificial Sequence: Synthetic oligonucleotide
tacctgccggattggcttccaggtcct

SEQ ID NO: 224755 - DNA, 26 bp, Artificial Sequence
  Description of Artificial Sequence: Synthetic oligonucleotide
acctgccggattggcttccaggtcct

SEQ ID NO: 224756 - DNA, 32 bp, Artificial Sequence
  Description of Artificial Sequence: Synthetic oligonucleotide
atagctctcacgtctggtctcctgacagtttc

SEQ ID NO: 224757 - DNA, 31 bp, Artificial Sequence
  Description of Artificial Sequence: Synthetic oligonucleotide
tagctctcacgtctggtctcctgacagtttc

SEQ ID NO: 224758 - DNA, 30 bp, Artificial Sequence
  Description of Artificial Sequence: Synthetic oligonucleotide
agctctcacgtctggtctcctgacagtttc

SEQ ID NO: 224759 - DNA, 29 bp, Artificial Sequence
  Description of Artificial Sequence: Synthetic oligonucleotide
gctctcacgtctggtctcctgacagtttc

SEQ ID NO: 224760 - DNA, 29 bp, Artificial Sequence
  Description of Artificial Sequence: Synthetic oligonucleotide
ctctcacgtctggtctcctgacagtttcc

SEQ ID NO: 224761 - DNA, 30 bp, Artificial Sequence
  Description of Artificial Sequence: Synthetic oligonucleotide
tctcacgtctggtctcctgacagtttcctc

SEQ ID NO: 224762 - DNA, 29 bp, Artificial Sequence
  Description of Artificial Sequence: Synthetic oligonucleotide
ctcacgtctggtctcctgacagtttcctc

SEQ ID NO: 224763 - DNA, 33 bp, Artificial Sequence
  Description of Artificial Sequence: Synthetic oligonucleotide
tcacgtctggtctcctgacagtttcctcatttg

SEQ ID NO: 224764 - DNA, 32 bp, Artificial Sequence
  Description of Artificial Sequence: Synthetic oligonucleotide
cacgtctggtctcctgacagtttcctcatttg

SEQ ID NO: 224765 - DNA, 32 bp, Artificial Sequence
  Description of Artificial Sequence: Synthetic oligonucleotide
acgtctggtctcctgacagtttcctcatttgg

SEQ ID NO: 224766 - DNA, 31 bp, Artificial Sequence
  Description of Artificial Sequence: Synthetic oligonucleotide
cgtctggtctcctgacagtttcctcatttgg

SEQ ID NO: 224767 - DNA, 31 bp, Artificial Sequence
  Description of Artificial Sequence: Synthetic oligonucleotide
gtctggtctcctgacagtttcctcatttggc

SEQ ID NO: 224768 - DNA, 32 bp, Artificial Sequence
  Description of Artificial Sequence: Synthetic oligonucleotide
tctggtctcctgacagtttcctcatttggctg

SEQ ID NO: 224769 - DNA, 31 bp, Artificial Sequence
  Description of Artificial Sequence: Synthetic oligonucleotide
ctggtctcctgacagtttcctcatttggctg

SEQ ID NO: 224770 - DNA, 33 bp, Artificial Sequence
  Description of Artificial Sequence: Synthetic oligonucleotide
tggtctcctgacagtttcctcatttggctgttg

SEQ ID NO: 224771 - DNA, 32 bp, Artificial Sequence
  Description of Artificial Sequence: Synthetic oligonucleotide
ggtctcctgacagtttcctcatttggctgttg

SEQ ID NO: 224772 - DNA, 32 bp, Artificial Sequence
  Description of Artificial Sequence: Synthetic oligonucleotide
gtctcctgacagtttcctcatttggctgttgg

SEQ ID NO: 224773 - DNA, 27 bp, Artificial Sequence
  Description of Artificial Sequence: Synthetic oligonucleotide
gataccgtcggagccggcaatggcatt

SEQ ID NO: 224774 - DNA, 29 bp, Artificial Sequence
  Description of Artificial Sequence: Synthetic oligonucleotide
ataccgtcggagccggcaatggcattttc

SEQ ID NO: 224775 - DNA, 28 bp, Artificial Sequence
  Description of Artificial Sequence: Synthetic oligonucleotide
taccgtcggagccggcaatggcattttc

SEQ ID NO: 224776 - DNA, 27 bp, Artificial Sequence
  Description of Artificial Sequence: Synthetic oligonucleotide
accgtcggagccggcaatggcattttc

SEQ ID NO: 224777 - DNA, 26 bp, Artificial Sequence
  Description of Artificial Sequence: Synthetic oligonucleotide
ccgtcggagccggcaatggcattttc

SEQ ID NO: 224778 - DNA, 27 bp, Artificial Sequence
  Description of Artificial Sequence: Synthetic oligonucleotide
cgtcggagccggcaatggcattttcct

SEQ ID NO: 224779 - DNA, 27 bp, Artificial Sequence
  Description of Artificial Sequence: Synthetic oligonucleotide
gtcggagccggcaatggcattttcctc

SEQ ID NO: 224780 - DNA, 31 bp, Artificial Sequence
  Description of Artificial Sequence: Synthetic oligonucleotide
tcggagccggcaatggcattttcctcatttg

SEQ ID NO: 224781 - DNA, 30 bp, Artificial Sequence
  Description of Artificial Sequence: Synthetic oligonucleotide
cggagccggcaatggcattttcctcatttg

SEQ ID NO: 224782 - DNA, 30 bp, Artificial Sequence
  Description of Artificial Sequence: Synthetic oligonucleotide
ggagccggcaatggcattttcctcatttgg

SEQ ID NO: 224783 - DNA, 30 bp, Artificial Sequence
  Description of Artificial Sequence: Synthetic oligonucleotide
gagccggcaatggcattttcctcatttggc

SEQ ID NO: 224784 - DNA, 31 bp, Artificial Sequence
  Description of Artificial Sequence: Synthetic oligonucleotide
agccggcaatggcattttcctcatttggctg

SEQ ID NO: 224785 - DNA, 30 bp, Artificial Sequence
  Description of Artificial Sequence: Synthetic oligonucleotide
gccggcaatggcattttcctcatttggctg

SEQ ID NO: 224786 - DNA, 32 bp, Artificial Sequence
  Description of Artificial Sequence: Synthetic oligonucleotide
ccggcaatggcattttcctcatttggctgttg

SEQ ID NO: 224787 - DNA, 32 bp, Artificial Sequence
  Description of Artificial Sequence: Synthetic oligonucleotide
cggcaatggcattttcctcatttggctgttgg

SEQ ID NO: 224788 - DNA, 27 bp, Artificial Sequence
  Description of Artificial Sequence: Synthetic oligonucleotide
cggcaatggcatgattggcttccaggc

SEQ ID NO: 224789 - DNA, 27 bp, Artificial Sequence
  Description of Artificial Sequence: Synthetic oligonucleotide
ggcaatggcatgattggcttccaggcc

SEQ ID NO: 224790 - DNA, 27 bp, Artificial Sequence
  Description of Artificial Sequence: Synthetic oligonucleotide
gcaatggcatgattggcttccaggccc

SEQ ID NO: 224791 - DNA, 28 bp, Artificial Sequence
  Description of Artificial Sequence: Synthetic oligonucleotide
caatggcatgattggcttccaggccctc

SEQ ID NO: 224792 - DNA, 28 bp, Artificial Sequence
  Description of Artificial Sequence: Synthetic oligonucleotide
aatggcatgattggcttccaggccctcc

SEQ ID NO: 224793 - DNA, 27 bp, Artificial Sequence
  Description of Artificial Sequence: Synthetic oligonucleotide
atggcatgattggcttccaggccctcc

SEQ ID NO: 224794 - DNA, 27 bp, Artificial Sequence
  Description of Artificial Sequence: Synthetic oligonucleotide
tggcatgattggcttccaggccctcct

SEQ ID NO: 224795 - DNA, 26 bp, Artificial Sequence
  Description of Artificial Sequence: Synthetic oligonucleotide
ggcatgattggcttccaggccctcct

SEQ ID NO: 224796 - DNA, 27 bp, Artificial Sequence
  Description of Artificial Sequence: Synthetic oligonucleotide
gcatgattggcttccaggccctcctca

SEQ ID NO: 224797 - DNA, 27 bp, Artificial Sequence
  Description of Artificial Sequence: Synthetic oligonucleotide
catgattggcttccaggccctcctcag

SEQ ID NO: 224798 - DNA, 27 bp, Artificial Sequence
  Description of Artificial Sequence: Synthetic oligonucleotide
atgattggcttccaggccctcctcagc

SEQ ID NO: 224799 - DNA, 27 bp, Artificial Sequence
  Description of Artificial Sequence: Synthetic oligonucleotide
tgattggcttccaggccctcctcagca

SEQ ID NO: 224800 - DNA, 27 bp, Artificial Sequence
  Description of Artificial Sequence: Synthetic oligonucleotide
gattggcttccaggccctcctcagcat

SEQ ID NO: 224801 - DNA, 28 bp, Artificial Sequence
  Description of Artificial Sequence: Synthetic oligonucleotide
attggcttccaggccctcctcagcattg

SEQ ID NO: 224802 - DNA, 27 bp, Artificial Sequence
  Description of Artificial Sequence: Synthetic oligonucleotide
ttggcttccaggccctcctcagcattg

SEQ ID NO: 224803 - DNA, 26 bp, Artificial Sequence
  Description of Artificial Sequence: Synthetic oligonucleotide
tggcttccaggccctcctcagcattg

SEQ ID NO: 224804 - DNA, 25 bp, Artificial Sequence
  Description of Artificial Sequence: Synthetic oligonucleotide
ggcttccaggccctcctcagcattg

SEQ ID NO: 224805 - DNA, 25 bp, Artificial Sequence
  Description of Artificial Sequence: Synthetic oligonucleotide
gcttccaggccctcctcagcattgg

SEQ ID NO: 224806 - DNA, 25 bp, Artificial Sequence
  Description of Artificial Sequence: Synthetic oligonucleotide
cttccaggccctcctcagcattggg

SEQ ID NO: 224807 - DNA, 27 bp, Artificial Sequence
  Description of Artificial Sequence: Synthetic oligonucleotide
ttccaggccctcctcagcattggggaa

SEQ ID NO: 224808 - DNA, 26 bp, Artificial Sequence
  Description of Artificial Sequence: Synthetic oligonucleotide
tccaggccctcctcagcattggggaa

SEQ ID NO: 224809 - DNA, 25 bp, Artificial Sequence
  Description of Artificial Sequence: Synthetic oligonucleotide
ccaggccctcctcagcattggggaa

SEQ ID NO: 224810 - DNA, 26 bp, Artificial Sequence
  Description of Artificial Sequence: Synthetic oligonucleotide
caggccctcctcagcattggggaact

SEQ ID NO: 224811 - DNA, 27 bp, Artificial Sequence
  Description of Artificial Sequence: Synthetic oligonucleotide
aggccctcctcagcattggggaactca

SEQ ID NO: 224812 - DNA, 26 bp, Artificial Sequence
  Description of Artificial Sequence: Synthetic oligonucleotide
ggccctcctcagcattggggaactca

SEQ ID NO: 224813 - DNA, 26 bp, Artificial Sequence
  Description of Artificial Sequence: Synthetic oligonucleotide
gccctcctcagcattggggaactcag

SEQ ID NO: 224814 - DNA, 27 bp, Artificial Sequence
  Description of Artificial Sequence: Synthetic oligonucleotide
ccctcctcagcattggggaactcagct

SEQ ID NO: 224815 - DNA, 42 bp, Artificial Sequence
  Description of Artificial Sequence: Synthetic oligonucleotide
gtttgctcctaaatcttaaaatatggaaagcacctcatgtgg

SEQ ID NO: 224816 - DNA, 42 bp, Artificial Sequence
  Description of Artificial Sequence: Synthetic oligonucleotide
tttgctcctaaatcttaaaatatggaaagcacctcatgtggc

SEQ ID NO: 224817 - DNA, 41 bp, Artificial Sequence
  Description of Artificial Sequence: Synthetic oligonucleotide
ttgctcctaaatcttaaaatatggaaagcacctcatgtggc

SEQ ID NO: 224818 - DNA, 40 bp, Artificial Sequence
  Description of Artificial Sequence: Synthetic oligonucleotide
tgctcctaaatcttaaaatatggaaagcacctcatgtggc

SEQ ID NO: 224819 - DNA, 39 bp, Artificial Sequence
  Description of Artificial Sequence: Synthetic oligonucleotide
gctcctaaatcttaaaatatggaaagcacctcatgtggc

SEQ ID NO: 224820 - DNA, 49 bp, Artificial Sequence
  Description of Artificial Sequence: Synthetic oligonucleotide
ctcctaaatcttaaaatatggaaagcacctcatgtggctaaatattttg

SEQ ID NO: 224821 - DNA, 51 bp, Artificial Sequence
  Description of Artificial Sequence: Synthetic oligonucleotide
tcctaaatcttaaaatatggaaagcacctcatgtggctaaatattttgatg

SEQ ID NO: 224822 - DNA, 50 bp, Artificial Sequence
  Description of Artificial Sequence: Synthetic oligonucleotide
cctaaatcttaaaatatggaaagcacctcatgtggctaaatattttgatg

SEQ ID NO: 224823 - DNA, 51 bp, Artificial Sequence
  Description of Artificial Sequence: Synthetic oligonucleotide
ctaaatcttaaaatatggaaagcacctcatgtggctaaatattttgatgac

SEQ ID NO: 224824 - DNA, 51 bp, Artificial Sequence
  Description of Artificial Sequence: Synthetic oligonucleotide
taaatcttaaaatatggaaagcacctcatgtggctaaatattttgatgacc

SEQ ID NO: 224825 - DNA, 50 bp, Artificial Sequence
  Description of Artificial Sequence: Synthetic oligonucleotide
aaatcttaaaatatggaaagcacctcatgtggctaaatattttgatgacc

SEQ ID NO: 224826 - DNA, 49 bp, Artificial Sequence
  Description of Artificial Sequence: Synthetic oligonucleotide
aatcttaaaatatggaaagcacctcatgtggctaaatattttgatgacc

SEQ ID NO: 224827 - DNA, 48 bp, Artificial Sequence
  Description of Artificial Sequence: Synthetic oligonucleotide
atcttaaaatatggaaagcacctcatgtggctaaatattttgatgacc

SEQ ID NO: 224828 - DNA, 47 bp, Artificial Sequence
  Description of Artificial Sequence: Synthetic oligonucleotide
tcttaaaatatggaaagcacctcatgtggctaaatattttgatgacc

SEQ ID NO: 224829 - DNA, 46 bp, Artificial Sequence
  Description of Artificial Sequence: Synthetic oligonucleotide
cttaaaatatggaaagcacctcatgtggctaaatattttgatgacc

SEQ ID NO: 224830 - DNA, 48 bp, Artificial Sequence
  Description of Artificial Sequence: Synthetic oligonucleotide
ttaaaatatggaaagcacctcatgtggctaaatattttgatgaccaag

SEQ ID NO: 224831 - DNA, 47 bp, Artificial Sequence
  Description of Artificial Sequence: Synthetic oligonucleotide
taaaatatggaaagcacctcatgtggctaaatattttgatgaccaag

SEQ ID NO: 224832 - DNA, 33 bp, Artificial Sequence
  Description of Artificial Sequence: Synthetic oligonucleotide
gtgttcaacacctactatgctctagcagtcagc

SEQ ID NO: 224833 - DNA, 33 bp, Artificial Sequence
  Description of Artificial Sequence: Synthetic oligonucleotide
tgttcaacacctactatgctctagcagtcagcg

SEQ ID NO: 224834 - DNA, 32 bp, Artificial Sequence
  Description of Artificial Sequence: Synthetic oligonucleotide
gttcaacacctactatgctctagcagtcagcg

SEQ ID NO: 224835 - DNA, 33 bp, Artificial Sequence
  Description of Artificial Sequence: Synthetic oligonucleotide
ttcaacacctactatgctctagcagtcagcgtg

SEQ ID NO: 224836 - DNA, 32 bp, Artificial Sequence
  Description of Artificial Sequence: Synthetic oligonucleotide
tcaacacctactatgctctagcagtcagcgtg

SEQ ID NO: 224837 - DNA, 31 bp, Artificial Sequence
  Description of Artificial Sequence: Synthetic oligonucleotide
caacacctactatgctctagcagtcagcgtg

SEQ ID NO: 224838 - DNA, 31 bp, Artificial Sequence
  Description of Artificial Sequence: Synthetic oligonucleotide
aacacctactatgctctagcagtcagcgtgg

SEQ ID NO: 224839 - DNA, 30 bp, Artificial Sequence
  Description of Artificial Sequence: Synthetic oligonucleotide
acacctactatgctctagcagtcagcgtgg

SEQ ID NO: 224840 - DNA, 29 bp, Artificial Sequence
  Description of Artificial Sequence: Synthetic oligonucleotide
cacctactatgctctagcagtcagcgtgg

SEQ ID NO: 224841 - DNA, 30 bp, Artificial Sequence
  Description of Artificial Sequence: Synthetic oligonucleotide
acctactatgctctagcagtcagcgtggtg

SEQ ID NO: 224842 - DNA, 29 bp, Artificial Sequence
  Description of Artificial Sequence: Synthetic oligonucleotide
cctactatgctctagcagtcagcgtggtg

SEQ ID NO: 224843 - DNA, 30 bp, Artificial Sequence
  Description of Artificial Sequence: Synthetic oligonucleotide
ctactatgctctagcagtcagcgtggtgac

SEQ ID NO: 224844 - DNA, 31 bp, Artificial Sequence
  Description of Artificial Sequence: Synthetic oligonucleotide
tactatgctctagcagtcagcgtggtgacag

SEQ ID NO: 224845 - DNA, 30 bp, Artificial Sequence
  Description of Artificial Sequence: Synthetic oligonucleotide
actatgctctagcagtcagcgtggtgacag

SEQ ID NO: 224846 - DNA, 29 bp, Artificial Sequence
  Description of Artificial Sequence: Synthetic oligonucleotide
ctatgctctagcagtcagcgtggtgacag

SEQ ID NO: 224847 - DNA, 29 bp, Artificial Sequence
  Description of Artificial Sequence: Synthetic oligonucleotide
tatgctctagcagtcagcgtggtgacagc

SEQ ID NO: 224848 - DNA, 28 bp, Artificial Sequence
  Description of Artificial Sequence: Synthetic oligonucleotide
atgctctagcagtcagcgtggtgacagc

SEQ ID NO: 224849 - DNA, 27 bp, Artificial Sequence
  Description of Artificial Sequence: Synthetic oligonucleotide
tgctctagcagtcagcgtggtgacagc

SEQ ID NO: 224850 - DNA, 26 bp, Artificial Sequence
  Description of Artificial Sequence: Synthetic oligonucleotide
gctctagcagtcagcgtggtgacagc

SEQ ID NO: 224851 - DNA, 27 bp, Artificial Sequence
  Description of Artificial Sequence: Synthetic oligonucleotide
ctctagcagtcagcgtggtgacagcca

SEQ ID NO: 224852 - DNA, 28 bp, Artificial Sequence
  Description of Artificial Sequence: Synthetic oligonucleotide
tctagcagtcagcgtggtgacagccatc

SEQ ID NO: 224853 - DNA, 27 bp, Artificial Sequence
  Description of Artificial Sequence: Synthetic oligonucleotide
ctagcagtcagcgtggtgacagccatc

SEQ ID NO: 224854 - DNA, 31 bp, Artificial Sequence
  Description of Artificial Sequence: Synthetic oligonucleotide
tacccgagggaacggaggataatgatcagag

SEQ ID NO: 224855 - DNA, 30 bp, Artificial Sequence
  Description of Artificial Sequence: Synthetic oligonucleotide
acccgagggaacggaggataatgatcagag

SEQ ID NO: 224856 - DNA, 29 bp, Artificial Sequence
  Description of Artificial Sequence: Synthetic oligonucleotide
cccgagggaacggaggataatgatcagag

SEQ ID NO: 224857 - DNA, 30 bp, Artificial Sequence
  Description of Artificial Sequence: Synthetic oligonucleotide
ccgagggaacggaggataatgatcagagag

SEQ ID NO: 224858 - DNA, 30 bp, Artificial Sequence
  Description of Artificial Sequence: Synthetic oligonucleotide
cgagggaacggaggataatgatcagagagc

SEQ ID NO: 224859 - DNA, 32 bp, Artificial Sequence
  Description of Artificial Sequence: Synthetic oligonucleotide
gagggaacggaggataatgatcagagagcaac

SEQ ID NO: 224860 - DNA, 31 bp, Artificial Sequence
  Description of Artificial Sequence: Synthetic oligonucleotide
ccgtgttcaacacctactatgctgtagcagg

SEQ ID NO: 224861 - DNA, 31 bp, Artificial Sequence
  Description of Artificial Sequence: Synthetic oligonucleotide
cgtgttcaacacctactatgctgtagcaggc

SEQ ID NO: 224862 - DNA, 32 bp, Artificial Sequence
  Description of Artificial Sequence: Synthetic oligonucleotide
gtgttcaacacctactatgctgtagcaggcag

SEQ ID NO: 224863 - DNA, 32 bp, Artificial Sequence
  Description of Artificial Sequence: Synthetic oligonucleotide
tgttcaacacctactatgctgtagcaggcagc

SEQ ID NO: 224864 - DNA, 31 bp, Artificial Sequence
  Description of Artificial Sequence: Synthetic oligonucleotide
gttcaacacctactatgctgtagcaggcagc

SEQ ID NO: 224865 - DNA, 31 bp, Artificial Sequence
  Description of Artificial Sequence: Synthetic oligonucleotide
ttcaacacctactatgctgtagcaggcagcg

SEQ ID NO: 224866 - DNA, 30 bp, Artificial Sequence
  Description of Artificial Sequence: Synthetic oligonucleotide
tcaacacctactatgctgtagcaggcagcg

SEQ ID NO: 224867 - DNA, 29 bp, Artificial Sequence
  Description of Artificial Sequence: Synthetic oligonucleotide
caacacctactatgctgtagcaggcagcg

SEQ ID NO: 224868 - DNA, 30 bp, Artificial Sequence
  Description of Artificial Sequence: Synthetic oligonucleotide
aacacctactatgctgtagcaggcagcgtg

SEQ ID NO: 224869 - DNA, 29 bp, Artificial Sequence
  Description of Artificial Sequence: Synthetic oligonucleotide
acacctactatgctgtagcaggcagcgtg

SEQ ID NO: 224870 - DNA, 28 bp, Artificial Sequence
  Description of Artificial Sequence: Synthetic oligonucleotide
cacctactatgctgtagcaggcagcgtg

SEQ ID NO: 224871 - DNA, 28 bp, Artificial Sequence
  Description of Artificial Sequence: Synthetic oligonucleotide
acctactatgctgtagcaggcagcgtgg

SEQ ID NO: 224872 - DNA, 27 bp, Artificial Sequence
  Description of Artificial Sequence: Synthetic oligonucleotide
cctactatgctgtagcaggcagcgtgg

SEQ ID NO: 224873 - DNA, 28 bp, Artificial Sequence
  Description of Artificial Sequence: Synthetic oligonucleotide
ctactatgctgtagcaggcagcgtggtg

SEQ ID NO: 224874 - DNA, 29 bp, Artificial Sequence
  Description of Artificial Sequence: Synthetic oligonucleotide
tactatgctgtagcaggcagcgtggtgac

SEQ ID NO: 224875 - DNA, 28 bp, Artificial Sequence
  Description of Artificial Sequence: Synthetic oligonucleotide
actatgctgtagcaggcagcgtggtgac

SEQ ID NO: 224876 - DNA, 27 bp, Artificial Sequence
  Description of Artificial Sequence: Synthetic oligonucleotide
ctatgctgtagcaggcagcgtggtgac

SEQ ID NO: 224877 - DNA, 28 bp, Artificial Sequence
  Description of Artificial Sequence: Synthetic oligonucleotide
tatgctgtagcaggcagcgtggtgacag

SEQ ID NO: 224878 - DNA, 27 bp, Artificial Sequence
  Description of Artificial Sequence: Synthetic oligonucleotide
atgctgtagcaggcagcgtggtgacag

SEQ ID NO: 224879 - DNA, 26 bp, Artificial Sequence
  Description of Artificial Sequence: Synthetic oligonucleotide
tgctgtagcaggcagcgtggtgacag

SEQ ID NO: 224880 - DNA, 25 bp, Artificial Sequence
  Description of Artificial Sequence: Synthetic oligonucleotide
gctgtagcaggcagcgtggtgacag

SEQ ID NO: 224881 - DNA, 25 bp, Artificial Sequence
  Description of Artificial Sequence: Synthetic oligonucleotide
ctgtagcaggcagcgtggtgacagc

SEQ ID NO: 224882 - DNA, 27 bp, Artificial Sequence
  Description of Artificial Sequence: Synthetic oligonucleotide
tgtagcaggcagcgtggtgacagccat

SEQ ID NO: 224883 - DNA, 26 bp, Artificial Sequence
  Description of Artificial Sequence: Synthetic oligonucleotide
gtagcaggcagcgtggtgacagccat

SEQ ID NO: 224884 - DNA, 27 bp, Artificial Sequence
  Description of Artificial Sequence: Synthetic oligonucleotide
tagcaggcagcgtggtgacagccatct

SEQ ID NO: 224885 - DNA, 26 bp, Artificial Sequence
  Description of Artificial Sequence: Synthetic oligonucleotide
agcaggcagcgtggtgacagccatct

SEQ ID NO: 224886 - DNA, 25 bp, Artificial Sequence
  Description of Artificial Sequence: Synthetic oligonucleotide
gcaggcagcgtggtgacagccatct

SEQ ID NO: 224887 - DNA, 26 bp, Artificial Sequence
  Description of Artificial Sequence: Synthetic oligonucleotide
caggcagcgtggtgacagccatctca

SEQ ID NO: 224888 - DNA, 26 bp, Artificial Sequence
  Description of Artificial Sequence: Synthetic oligonucleotide
aggcagcgtggtgacagccatctcag

SEQ ID NO: 224889 - DNA, 25 bp, Artificial Sequence
  Description of Artificial Sequence: Synthetic oligonucleotide
ggcagcgtggtgacagccatctcag

SEQ ID NO: 224890 - DNA, 25 bp, Artificial Sequence
  Description of Artificial Sequence: Synthetic oligonucleotide
gcagcgtggtgacagccatctcagg

SEQ ID NO: 224891 - DNA, 27 bp, Artificial Sequence
  Description of Artificial Sequence: Synthetic oligonucleotide
ctgatctccgtcgggggagccaagtaa

SEQ ID NO: 224892 - DNA, 27 bp, Artificial Sequence
  Description of Artificial Sequence: Synthetic oligonucleotide
tgatctccgtcgggggagccaagtaac

SEQ ID NO: 224893 - DNA, 27 bp, Artificial Sequence
  Description of Artificial Sequence: Synthetic oligonucleotide
gatctccgtcgggggagccaagtaact

SEQ ID NO: 224894 - DNA, 27 bp, Artificial Sequence
  Description of Artificial Sequence: Synthetic oligonucleotide
atctccgtcgggggagccaagtaactg

SEQ ID NO: 224895 - DNA, 26 bp, Artificial Sequence
  Description of Artificial Sequence: Synthetic oligonucleotide
tctccgtcgggggagccaagtaactg

SEQ ID NO: 224896 - DNA, 25 bp, Artificial Sequence
  Description of Artificial Sequence: Synthetic oligonucleotide
ctccgtcgggggagccaagtaactg

SEQ ID NO: 224897 - DNA, 25 bp, Artificial Sequence
  Description of Artificial Sequence: Synthetic oligonucleotide
tccgtcgggggagccaagtaactgc

SEQ ID NO: 224898 - DNA, 24 bp, Artificial Sequence
  Description of Artificial Sequence: Synthetic oligonucleotide
ccgtcgggggagccaagtaactgc

SEQ ID NO: 224899 - DNA, 24 bp, Artificial Sequence
  Description of Artificial Sequence: Synthetic oligonucleotide
cgtcgggggagccaagtaactgcc

SEQ ID NO: 224900 - DNA, 24 bp, Artificial Sequence
  Description of Artificial Sequence: Synthetic oligonucleotide
gtcgggggagccaagtaactgccg

SEQ ID NO: 224901 - DNA, 28 bp, Artificial Sequence
  Description of Artificial Sequence: Synthetic oligonucleotide
cagttcccttctgggaaggtggtcatcc

SEQ ID NO: 224902 - DNA, 29 bp, Artificial Sequence
  Description of Artificial Sequence: Synthetic oligonucleotide
agttcccttctgggaaggtggtcatccac

SEQ ID NO: 224903 - DNA, 28 bp, Artificial Sequence
  Description of Artificial Sequence: Synthetic oligonucleotide
gttcccttctgggaaggtggtcatccac

SEQ ID NO: 224904 - DNA, 29 bp, Artificial Sequence
  Description of Artificial Sequence: Synthetic oligonucleotide
ttcccttctgggaaggtggtcatccactg

SEQ ID NO: 224905 - DNA, 28 bp, Artificial Sequence
  Description of Artificial Sequence: Synthetic oligonucleotide
tcccttctgggaaggtggtcatccactg

SEQ ID NO: 224906 - DNA, 27 bp, Artificial Sequence
  Description of Artificial Sequence: Synthetic oligonucleotide
cccttctgggaaggtggtcatccactg

SEQ ID NO: 224907 - DNA, 29 bp, Artificial Sequence
  Description of Artificial Sequence: Synthetic oligonucleotide
ccttctgggaaggtggtcatccactgttc

SEQ ID NO: 224908 - DNA, 30 bp, Artificial Sequence
  Description of Artificial Sequence: Synthetic oligonucleotide
cttctgggaaggtggtcatccactgttcag

SEQ ID NO: 224909 - DNA, 25 bp, Artificial Sequence
  Description of Artificial Sequence: Synthetic oligonucleotide
gcgccctcttcttgtggggttctgg

SEQ ID NO: 224910 - DNA, 25 bp, Artificial Sequence
  Description of Artificial Sequence: Synthetic oligonucleotide
cgccctcttcttgtggggttctggc

SEQ ID NO: 224911 - DNA, 27 bp, Artificial Sequence
  Description of Artificial Sequence: Synthetic oligonucleotide
gccctcttcttgtggggttctggccaa

SEQ ID NO: 224912 - DNA, 27 bp, Artificial Sequence
  Description of Artificial Sequence: Synthetic oligonucleotide
ccctcttcttgtggggttctggccaag

SEQ ID NO: 224913 - DNA, 30 bp, Artificial Sequence
  Description of Artificial Sequence: Synthetic oligonucleotide
cctcttcttgtggggttctggccaagtttc

SEQ ID NO: 224914 - DNA, 32 bp, Artificial Sequence
  Description of Artificial Sequence: Synthetic oligonucleotide
ctcttcttgtggggttctggccaagtttcaac

SEQ ID NO: 224915 - DNA, 33 bp, Artificial Sequence
  Description of Artificial Sequence: Synthetic oligonucleotide
tcttcttgtggggttctggccaagtttcaactc

SEQ ID NO: 224916 - DNA, 32 bp, Artificial Sequence
  Description of Artificial Sequence: Synthetic oligonucleotide
cttcttgtggggttctggccaagtttcaactc

SEQ ID NO: 224917 - DNA, 33 bp, Artificial Sequence
  Description of Artificial Sequence: Synthetic oligonucleotide
ttcttgtggggttctggccaagtttcaactctg

SEQ ID NO: 224918 - DNA, 32 bp, Artificial Sequence
  Description of Artificial Sequence: Synthetic oligonucleotide
tcttgtggggttctggccaagtttcaactctg

SEQ ID NO: 224919 - DNA, 31 bp, Artificial Sequence
  Description of Artificial Sequence: Synthetic oligonucleotide
cttgtggggttctggccaagtttcaactctg

SEQ ID NO: 224920 - DNA, 31 bp, Artificial Sequence
  Description of Artificial Sequence: Synthetic oligonucleotide
ttgtggggttctggccaagtttcaactctgc

SEQ ID NO: 224921 - DNA, 30 bp, Artificial Sequence
  Description of Artificial Sequence: Synthetic oligonucleotide
tgtggggttctggccaagtttcaactctgc

SEQ ID NO: 224922 - DNA, 29 bp, Artificial Sequence
  Description of Artificial Sequence: Synthetic oligonucleotide
gtggggttctggccaagtttcaactctgc

SEQ ID NO: 224923 - DNA, 30 bp, Artificial Sequence
  Description of Artificial Sequence: Synthetic oligonucleotide
tggggttctggccaagtttcaactctgctc

SEQ ID NO: 224924 - DNA, 29 bp, Artificial Sequence
  Description of Artificial Sequence: Synthetic oligonucleotide
ggggttctggccaagtttcaactctgctc

SEQ ID NO: 224925 - DNA, 30 bp, Artificial Sequence
  Description of Artificial Sequence: Synthetic oligonucleotide
gggttctggccaagtttcaactctgctctg

SEQ ID NO: 224926 - DNA, 30 bp, Artificial Sequence
  Description of Artificial Sequence: Synthetic oligonucleotide
ggttctggccaagtttcaactctgctctgc

SEQ ID NO: 224927 - DNA, 40 bp, Artificial Sequence
  Description of Artificial Sequence: Synthetic oligonucleotide
tcctcttctatttttttacccactatgacgcttccttagg

SEQ ID NO: 224928 - DNA, 39 bp, Artificial Sequence
  Description of Artificial Sequence: Synthetic oligonucleotide
cctcttctatttttttacccactatgacgcttccttagg

SEQ ID NO: 224929 - DNA, 39 bp, Artificial Sequence
  Description of Artificial Sequence: Synthetic oligonucleotide
ctcttctatttttttacccactatgacgcttccttaggg

SEQ ID NO: 224930 - DNA, 39 bp, Artificial Sequence
  Description of Artificial Sequence: Synthetic oligonucleotide
tcttctatttttttacccactatgacgcttccttagggg

SEQ ID NO: 224931 - DNA, 38 bp, Artificial Sequence
  Description of Artificial Sequence: Synthetic oligonucleotide
cttctatttttttacccactatgacgcttccttagggg

SEQ ID NO: 224932 - DNA, 40 bp, Artificial Sequence
  Description of Artificial Sequence: Synthetic oligonucleotide
ttctatttttttacccactatgacgcttccttaggggatc

SEQ ID NO: 224933 - DNA, 39 bp, Artificial Sequence
  Description of Artificial Sequence: Synthetic oligonucleotide
tctatttttttacccactatgacgcttccttaggggatc

SEQ ID NO: 224934 - DNA, 38 bp, Artificial Sequence
  Description of Artificial Sequence: Synthetic oligonucleotide
ctatttttttacccactatgacgcttccttaggggatc

SEQ ID NO: 224935 - DNA, 42 bp, Artificial Sequence
  Description of Artificial Sequence: Synthetic oligonucleotide
tatttttttacccactatgacgcttccttaggggatcaaaag

SEQ ID NO: 224936 - DNA, 41 bp, Artificial Sequence
  Description of Artificial Sequence: Synthetic oligonucleotide
atttttttacccactatgacgcttccttaggggatcaaaag

SEQ ID NO: 224937 - DNA, 40 bp, Artificial Sequence
  Description of Artificial Sequence: Synthetic oligonucleotide
tttttttacccactatgacgcttccttaggggatcaaaag

SEQ ID NO: 224938 - DNA, 39 bp, Artificial Sequence
  Description of Artificial Sequence: Synthetic oligonucleotide
ttttttacccactatgacgcttccttaggggatcaaaag

SEQ ID NO: 224939 - DNA, 38 bp, Artificial Sequence
  Description of Artificial Sequence: Synthetic oligonucleotide
tttttacccactatgacgcttccttaggggatcaaaag

SEQ ID NO: 224940 - DNA, 37 bp, Artificial Sequence
  Description of Artificial Sequence: Synthetic oligonucleotide
ttttacccactatgacgcttccttaggggatcaaaag

SEQ ID NO: 224941 - DNA, 36 bp, Artificial Sequence
  Description of Artificial Sequence: Synthetic oligonucleotide
tttacccactatgacgcttccttaggggatcaaaag

SEQ ID NO: 224942 - DNA, 35 bp, Artificial Sequence
  Description of Artificial Sequence: Synthetic oligonucleotide
ttacccactatgacgcttccttaggggatcaaaag

SEQ ID NO: 224943 - DNA, 34 bp, Artificial Sequence
  Description of Artificial Sequence: Synthetic oligonucleotide
tacccactatgacgcttccttaggggatcaaaag

SEQ ID NO: 224944 - DNA, 33 bp, Artificial Sequence
  Description of Artificial Sequence: Synthetic oligonucleotide
acccactatgacgcttccttaggggatcaaaag

SEQ ID NO: 224945 - DNA, 32 bp, Artificial Sequence
  Description of Artificial Sequence: Synthetic oligonucleotide
cccactatgacgcttccttaggggatcaaaag

SEQ ID NO: 224946 - DNA, 32 bp, Artificial Sequence
  Description of Artificial Sequence: Synthetic oligonucleotide
ccactatgacgcttccttaggggatcaaaagg

SEQ ID NO: 224947 - DNA, 32 bp, Artificial Sequence
  Description of Artificial Sequence: Synthetic oligonucleotide
cactatgacgcttccttaggggatcaaaaggg

SEQ ID NO: 224948 - DNA, 32 bp, Artificial Sequence
  Description of Artificial Sequence: Synthetic oligonucleotide
actatgacgcttccttaggggatcaaaagggg

SEQ ID NO: 224949 - DNA, 31 bp, Artificial Sequence
  Description of Artificial Sequence: Synthetic oligonucleotide
ctatgacgcttccttaggggatcaaaagggg

SEQ ID NO: 224950 - DNA, 31 bp, Artificial Sequence
  Description of Artificial Sequence: Synthetic oligonucleotide
tatgacgcttccttaggggatcaaaaggggc

SEQ ID NO: 224951 - DNA, 30 bp, Artificial Sequence
  Description of Artificial Sequence: Synthetic oligonucleotide
atgacgcttccttaggggatcaaaaggggc

SEQ ID NO: 224952 - DNA, 29 bp, Artificial Sequence
  Description of Artificial Sequence: Synthetic oligonucleotide
tgacgcttccttaggggatcaaaaggggc

SEQ ID NO: 224953 - DNA, 28 bp, Artificial Sequence
  Description of Artificial Sequence: Synthetic oligonucleotide
gacgcttccttaggggatcaaaaggggc

SEQ ID NO: 224954 - DNA, 29 bp, Artificial Sequence
  Description of Artificial Sequence: Synthetic oligonucleotide
acgcttccttaggggatcaaaaggggctc

SEQ ID NO: 224955 - DNA, 28 bp, Artificial Sequence
  Description of Artificial Sequence: Synthetic oligonucleotide
cgcttccttaggggatcaaaaggggctc

SEQ ID NO: 224956 - DNA, 28 bp, Artificial Sequence
  Description of Artificial Sequence: Synthetic oligonucleotide
gcttccttaggggatcaaaaggggctcg

SEQ ID NO: 224957 - DNA, 29 bp, Artificial Sequence
  Description of Artificial Sequence: Synthetic oligonucleotide
cttccttaggggatcaaaaggggctcgtg

SEQ ID NO: 224958 - DNA, 29 bp, Artificial Sequence
  Description of Artificial Sequence: Synthetic oligonucleotide
ttccttaggggatcaaaaggggctcgtgg

SEQ ID NO: 224959 - DNA, 28 bp, Artificial Sequence
  Description of Artificial Sequence: Synthetic oligonucleotide
tccttaggggatcaaaaggggctcgtgg

SEQ ID NO: 224960 - DNA, 27 bp, Artificial Sequence
  Description of Artificial Sequence: Synthetic oligonucleotide
ccttaggggatcaaaaggggctcgtgg

SEQ ID NO: 224961 - DNA, 27 bp, Artificial Sequence
  Description of Artificial Sequence: Synthetic oligonucleotide
cttaggggatcaaaaggggctcgtggc

SEQ ID NO: 224962 - DNA, 29 bp, Artificial Sequence
  Description of Artificial Sequence: Synthetic oligonucleotide
ttaggggatcaaaaggggctcgtggcatc

SEQ ID NO: 224963 - DNA, 28 bp, Artificial Sequence
  Description of Artificial Sequence: Synthetic oligonucleotide
taggggatcaaaaggggctcgtggcatc

SEQ ID NO: 224964 - DNA, 27 bp, Artificial Sequence
  Description of Artificial Sequence: Synthetic oligonucleotide
aggggatcaaaaggggctcgtggcatc

SEQ ID NO: 224965 - DNA, 26 bp, Artificial Sequence
  Description of Artificial Sequence: Synthetic oligonucleotide
ggggatcaaaaggggctcgtggcatc

SEQ ID NO: 224966 - DNA, 27 bp, Artificial Sequence
  Description of Artificial Sequence: Synthetic oligonucleotide
gggatcaaaaggggctcgtggcatcct

SEQ ID NO: 224967 - DNA, 27 bp, Artificial Sequence
  Description of Artificial Sequence: Synthetic oligonucleotide
gcaatcctgctggacggcttcctgagt

SEQ ID NO: 224968 - DNA, 27 bp, Artificial Sequence
  Description of Artificial Sequence: Synthetic oligonucleotide
caatcctgctggacggcttcctgagtc

SEQ ID NO: 224969 - DNA, 28 bp, Artificial Sequence
  Description of Artificial Sequence: Synthetic oligonucleotide
aatcctgctggacggcttcctgagtcag

SEQ ID NO: 224970 - DNA, 27 bp, Artificial Sequence
  Description of Artificial Sequence: Synthetic oligonucleotide
atcctgctggacggcttcctgagtcag

SEQ ID NO: 224971 - DNA, 27 bp, Artificial Sequence
  Description of Artificial Sequence: Synthetic oligonucleotide
tcctgctggacggcttcctgagtcagt

SEQ ID NO: 224972 - DNA, 27 bp, Artificial Sequence
  Description of Artificial Sequence: Synthetic oligonucleotide
cctgctggacggcttcctgagtcagtt

SEQ ID NO: 224973 - DNA, 27 bp, Artificial Sequence
  Description of Artificial Sequence: Synthetic oligonucleotide
ctgctggacggcttcctgagtcagttc

SEQ ID NO: 224974 - DNA, 27 bp, Artificial Sequence
  Description of Artificial Sequence: Synthetic oligonucleotide
tgctggacggcttcctgagtcagttcc

SEQ ID NO: 224975 - DNA, 26 bp, Artificial Sequence
  Description of Artificial Sequence: Synthetic oligonucleotide
gctggacggcttcctgagtcagttcc

SEQ ID NO: 224976 - DNA, 27 bp, Artificial Sequence
  Description of Artificial Sequence: Synthetic oligonucleotide
ctggacggcttcctgagtcagttccct

SEQ ID NO: 224977 - DNA, 27 bp, Artificial Sequence
  Description of Artificial Sequence: Synthetic oligonucleotide
tggacggcttcctgagtcagttccctc

SEQ ID NO: 224978 - DNA, 26 bp, Artificial Sequence
  Description of Artificial Sequence: Synthetic oligonucleotide
ggacggcttcctgagtcagttccctc

SEQ ID NO: 224979 - DNA, 27 bp, Artificial Sequence
  Description of Artificial Sequence: Synthetic oligonucleotide
gacggcttcctgagtcagttccctcct

SEQ ID NO: 224980 - DNA, 27 bp, Artificial Sequence
  Description of Artificial Sequence: Synthetic oligonucleotide
acggcttcctgagtcagttccctcctg

SEQ ID NO: 224981 - DNA, 26 bp, Artificial Sequence
  Description of Artificial Sequence: Synthetic oligonucleotide
cggcttcctgagtcagttccctcctg

SEQ ID NO: 224982 - DNA, 26 bp, Artificial Sequence
  Description of Artificial Sequence: Synthetic oligonucleotide
ggcttcctgagtcagttccctcctgg

SEQ ID NO: 224983 - DNA, 27 bp, Artificial Sequence
  Description of Artificial Sequence: Synthetic oligonucleotide
gcttcctgagtcagttccctcctggga

SEQ ID NO: 224984 - DNA, 28 bp, Artificial Sequence
  Description of Artificial Sequence: Synthetic oligonucleotide
cttcctgagtcagttccctcctgggaag

SEQ ID NO: 224985 - DNA, 28 bp, Artificial Sequence
  Description of Artificial Sequence: Synthetic oligonucleotide
ttcctgagtcagttccctcctgggaagg

SEQ ID NO: 224986 - DNA, 27 bp, Artificial Sequence
  Description of Artificial Sequence: Synthetic oligonucleotide
tcctgagtcagttccctcctgggaagg

SEQ ID NO: 224987 - DNA, 27 bp, Artificial Sequence
  Description of Artificial Sequence: Synthetic oligonucleotide
cctgagtcagttccctcctgggaaggt

SEQ ID NO: 224988 - DNA, 27 bp, Artificial Sequence
  Description of Artificial Sequence: Synthetic oligonucleotide
ctgagtcagttccctcctgggaaggtg

SEQ ID NO: 224989 - DNA, 27 bp, Artificial Sequence
  Description of Artificial Sequence: Synthetic oligonucleotide
tgagtcagttccctcctgggaaggtgg

SEQ ID NO: 224990 - DNA, 27 bp, Artificial Sequence
  Description of Artificial Sequence: Synthetic oligonucleotide
gagtcagttccctcctgggaaggtggt

SEQ ID NO: 224991 - DNA, 27 bp, Artificial Sequence
  Description of Artificial Sequence: Synthetic oligonucleotide
agtcagttccctcctgggaaggtggtc

SEQ ID NO: 224992 - DNA, 27 bp, Artificial Sequence
  Description of Artificial Sequence: Synthetic oligonucleotide
gtcagttccctcctgggaaggtggtca

SEQ ID NO: 224993 - DNA, 28 bp, Artificial Sequence
  Description of Artificial Sequence: Synthetic oligonucleotide
tcagttccctcctgggaaggtggtcatc

SEQ ID NO: 224994 - DNA, 30 bp, Artificial Sequence
  Description of Artificial Sequence: Synthetic oligonucleotide
catgagtgctttgtcggtgctgatctcagc

SEQ ID NO: 224995 - DNA, 30 bp, Artificial Sequence
  Description of Artificial Sequence: Synthetic oligonucleotide
atgagtgctttgtcggtgctgatctcagcg

SEQ ID NO: 224996 - DNA, 29 bp, Artificial Sequence
  Description of Artificial Sequence: Synthetic oligonucleotide
tgagtgctttgtcggtgctgatctcagcg

SEQ ID NO: 224997 - DNA, 28 bp, Artificial Sequence
  Description of Artificial Sequence: Synthetic oligonucleotide
gagtgctttgtcggtgctgatctcagcg

SEQ ID NO: 224998 - DNA, 28 bp, Artificial Sequence
  Description of Artificial Sequence: Synthetic oligonucleotide
agtgctttgtcggtgctgatctcagcgg

SEQ ID NO: 224999 - DNA, 27 bp, Artificial Sequence
  Description of Artificial Sequence: Synthetic oligonucleotide
gtgctttgtcggtgctgatctcagcgg

SEQ ID NO: 225000 - DNA, 29 bp, Artificial Sequence
  Description of Artificial Sequence: Synthetic oligonucleotide
tgctttgtcggtgctgatctcagcggatg

SEQ ID NO: 225001 - DNA, 28 bp, Artificial Sequence
  Description of Artificial Sequence: Synthetic oligonucleotide
gctttgtcggtgctgatctcagcggatg

SEQ ID NO: 225002 - DNA, 28 bp, Artificial Sequence
  Description of Artificial Sequence: Synthetic oligonucleotide
ctttgtcggtgctgatctcagcggatgc

SEQ ID NO: 225003 - DNA, 29 bp, Artificial Sequence
  Description of Artificial Sequence: Synthetic oligonucleotide
tttgtcggtgctgatctcagcggatgctg

SEQ ID NO: 225004 - DNA, 28 bp, Artificial Sequence
  Description of Artificial Sequence: Synthetic oligonucleotide
ttgtcggtgctgatctcagcggatgctg

SEQ ID NO: 225005 - DNA, 27 bp, Artificial Sequence
  Description of Artificial Sequence: Synthetic oligonucleotide
tgtcggtgctgatctcagcggatgctg

SEQ ID NO: 225006 - DNA, 27 bp, Artificial Sequence
  Description of Artificial Sequence: Synthetic oligonucleotide
gtcggtgctgatctcagcggatgctgt

SEQ ID NO: 225007 - DNA, 27 bp, Artificial Sequence
  Description of Artificial Sequence: Synthetic oligonucleotide
tcggtgctgatctcagcggatgctgtc

SEQ ID NO: 225008 - DNA, 27 bp, Artificial Sequence
  Description of Artificial Sequence: Synthetic oligonucleotide
cggtgctgatctcagcggatgctgtct

SEQ ID NO: 225009 - DNA, 28 bp, Artificial Sequence
  Description of Artificial Sequence: Synthetic oligonucleotide
ggtgctgatctcagcggatgctgtcttg

SEQ ID NO: 225010 - DNA, 28 bp, Artificial Sequence
  Description of Artificial Sequence: Synthetic oligonucleotide
gtgctgatctcagcggatgctgtcttgg

SEQ ID NO: 225011 - DNA, 28 bp, Artificial Sequence
  Description of Artificial Sequence: Synthetic oligonucleotide
tgctgatctcagcggatgctgtcttggg

SEQ ID NO: 225012 - DNA, 27 bp, Artificial Sequence
  Description of Artificial Sequence: Synthetic oligonucleotide
gctgatctcagcggatgctgtcttggg

SEQ ID NO: 225013 - DNA, 27 bp, Artificial Sequence
  Description of Artificial Sequence: Synthetic oligonucleotide
ctgatctcagcggatgctgtcttgggg

SEQ ID NO: 225014 - DNA, 29 bp, Artificial Sequence
  Description of Artificial Sequence: Synthetic oligonucleotide
tgatctcagcggatgctgtcttggggaag

SEQ ID NO: 225015 - DNA, 28 bp, Artificial Sequence
  Description of Artificial Sequence: Synthetic oligonucleotide
gatctcagcggatgctgtcttggggaag

SEQ ID NO: 225016 - DNA, 28 bp, Artificial Sequence
  Description of Artificial Sequence: Synthetic oligonucleotide
atctcagcggatgctgtcttggggaagg

SEQ ID NO: 225017 - DNA, 27 bp, Artificial Sequence
  Description of Artificial Sequence: Synthetic oligonucleotide
tctcagcggatgctgtcttggggaagg

SEQ ID NO: 225018 - DNA, 27 bp, Artificial Sequence
  Description of Artificial Sequence: Synthetic oligonucleotide
ctcagcggatgctgtcttggggaaggt

SEQ ID NO: 225019 - DNA, 27 bp, Artificial Sequence
  Description of Artificial Sequence: Synthetic oligonucleotide
tcagcggatgctgtcttggggaaggtc

SEQ ID NO: 225020 - DNA, 27 bp, Artificial Sequence
  Description of Artificial Sequence: Synthetic oligonucleotide
cagcggatgctgtcttggggaaggtca

SEQ ID NO: 225021 - DNA, 28 bp, Artificial Sequence
  Description of Artificial Sequence: Synthetic oligonucleotide
agcggatgctgtcttggggaaggtcaac

SEQ ID NO: 225022 - DNA, 27 bp, Artificial Sequence
  Description of Artificial Sequence: Synthetic oligonucleotide
gcggatgctgtcttggggaaggtcaac

SEQ ID NO: 225023 - DNA, 29 bp, Artificial Sequence
  Description of Artificial Sequence: Synthetic oligonucleotide
cggatgctgtcttggggaaggtcaacttg

SEQ ID NO: 225024 - DNA, 30 bp, Artificial Sequence
  Description of Artificial Sequence: Synthetic oligonucleotide
ttgtaaccgagtgctggggattcaccacag

SEQ ID NO: 225025 - DNA, 29 bp, Artificial Sequence
  Description of Artificial Sequence: Synthetic oligonucleotide
tgtaaccgagtgctggggattcaccacag

SEQ ID NO: 225026 - DNA, 28 bp, Artificial Sequence
  Description of Artificial Sequence: Synthetic oligonucleotide
gtaaccgagtgctggggattcaccacag

SEQ ID NO: 225027 - DNA, 28 bp, Artificial Sequence
  Description of Artificial Sequence: Synthetic oligonucleotide
taaccgagtgctggggattcaccacagc

SEQ ID NO: 225028 - DNA, 27 bp, Artificial Sequence
  Description of Artificial Sequence: Synthetic oligonucleotide
aaccgagtgctggggattcaccacagc

SEQ ID NO: 225029 - DNA, 27 bp, Artificial Sequence
  Description of Artificial Sequence: Synthetic oligonucleotide
accgagtgctggggattcaccacagct

SEQ ID NO: 225030 - DNA, 26 bp, Artificial Sequence
  Description of Artificial Sequence: Synthetic oligonucleotide
ccgagtgctggggattcaccacagct

SEQ ID NO: 225031 - DNA, 26 bp, Artificial Sequence
  Description of Artificial Sequence: Synthetic oligonucleotide
cgagtgctggggattcaccacagctc

SEQ ID NO: 225032 - DNA, 27 bp, Artificial Sequence
  Description of Artificial Sequence: Synthetic oligonucleotide
gagtgctggggattcaccacagctcca

SEQ ID NO: 225033 - DNA, 28 bp, Artificial Sequence
  Description of Artificial Sequence: Synthetic oligonucleotide
agtgctggggattcaccacagctccatc

SEQ ID NO: 225034 - DNA, 27 bp, Artificial Sequence
  Description of Artificial Sequence: Synthetic oligonucleotide
gtgctggggattcaccacagctccatc

SEQ ID NO: 225035 - DNA, 29 bp, Artificial Sequence
  Description of Artificial Sequence: Synthetic oligonucleotide
tgctggggattcaccacagctccatcatg

SEQ ID NO: 225036 - DNA, 28 bp, Artificial Sequence
  Description of Artificial Sequence: Synthetic oligonucleotide
gctggggattcaccacagctccatcatg

SEQ ID NO: 225037 - DNA, 28 bp, Artificial Sequence
  Description of Artificial Sequence: Synthetic oligonucleotide
ctggggattcaccacagctccatcatgg

SEQ ID NO: 225038 - DNA, 28 bp, Artificial Sequence
  Description of Artificial Sequence: Synthetic oligonucleotide
tggggattcaccacagctccatcatggg

SEQ ID NO: 225039 - DNA, 27 bp, Artificial Sequence
  Description of Artificial Sequence: Synthetic oligonucleotide
ggggattcaccacagctccatcatggg

SEQ ID NO: 225040 - DNA, 27 bp, Artificial Sequence
  Description of Artificial Sequence: Synthetic oligonucleotide
gggattcaccacagctccatcatgggc

SEQ ID NO: 225041 - DNA, 29 bp, Artificial Sequence
  Description of Artificial Sequence: Synthetic oligonucleotide
ggattcaccacagctccatcatgggctac

SEQ ID NO: 225042 - DNA, 31 bp, Artificial Sequence
  Description of Artificial Sequence: Synthetic oligonucleotide
gattcaccacagctccatcatgggctacaac

SEQ ID NO: 225043 - DNA, 33 bp, Artificial Sequence
  Description of Artificial Sequence: Synthetic oligonucleotide
attcaccacagctccatcatgggctacaacttc

SEQ ID NO: 225044 - DNA, 32 bp, Artificial Sequence
  Description of Artificial Sequence: Synthetic oligonucleotide
ttcaccacagctccatcatgggctacaacttc

SEQ ID NO: 225045 - DNA, 31 bp, Artificial Sequence
  Description of Artificial Sequence: Synthetic oligonucleotide
tcaccacagctccatcatgggctacaacttc

SEQ ID NO: 225046 - DNA, 30 bp, Artificial Sequence
  Description of Artificial Sequence: Synthetic oligonucleotide
caccacagctccatcatgggctacaacttc

SEQ ID NO: 225047 - DNA, 31 bp, Artificial Sequence
  Description of Artificial Sequence: Synthetic oligonucleotide
accacagctccatcatgggctacaacttcag

SEQ ID NO: 225048 - DNA, 25 bp, Artificial Sequence
  Description of Artificial Sequence: Synthetic oligonucleotide
gggggagccaagtacctgccggttt

SEQ ID NO: 225049 - DNA, 25 bp, Artificial Sequence
  Description of Artificial Sequence: Synthetic oligonucleotide
ggggagccaagtacctgccggtttg

SEQ ID NO: 225050 - DNA, 26 bp, Artificial Sequence
  Description of Artificial Sequence: Synthetic oligonucleotide
gggagccaagtacctgccggtttgct

SEQ ID NO: 225051 - DNA, 26 bp, Artificial Sequence
  Description of Artificial Sequence: Synthetic oligonucleotide
ggagccaagtacctgccggtttgctc

SEQ ID NO: 225052 - DNA, 27 bp, Artificial Sequence
  Description of Artificial Sequence: Synthetic oligonucleotide
gagccaagtacctgccggtttgctcct

SEQ ID NO: 225053 - DNA, 43 bp, Artificial Sequence
  Description of Artificial Sequence: Synthetic oligonucleotide
aggtttgctcctaaatcttaaaatatggaaagcacctcatgtg

SEQ ID NO: 225054 - DNA, 42 bp, Artificial Sequence
  Description of Artificial Sequence: Synthetic oligonucleotide
ggtttgctcctaaatcttaaaatatggaaagcacctcatgtg

SEQ ID NO: 225055 - DNA, 29 bp, Artificial Sequence
  Description of Artificial Sequence: Synthetic oligonucleotide
gatacccagtttgtctgccatgctgggag

SEQ ID NO: 225056 - DNA, 29 bp, Artificial Sequence
  Description of Artificial Sequence: Synthetic oligonucleotide
atacccagtttgtctgccatgctgggagc

SEQ ID NO: 225057 - DNA, 28 bp, Artificial Sequence
  Description of Artificial Sequence: Synthetic oligonucleotide
tacccagtttgtctgccatgctgggagc

SEQ ID NO: 225058 - DNA, 27 bp, Artificial Sequence
  Description of Artificial Sequence: Synthetic oligonucleotide
acccagtttgtctgccatgctgggagc

SEQ ID NO: 225059 - DNA, 26 bp, Artificial Sequence
  Description of Artificial Sequence: Synthetic oligonucleotide
cccagtttgtctgccatgctgggagc

SEQ ID NO: 225060 - DNA, 26 bp, Artificial Sequence
  Description of Artificial Sequence: Synthetic oligonucleotide
ccagtttgtctgccatgctgggagcc

SEQ ID NO: 225061 - DNA, 27 bp, Artificial Sequence
  Description of Artificial Sequence: Synthetic oligonucleotide
cagtttgtctgccatgctgggagccct

SEQ ID NO: 225062 - DNA, 27 bp, Artificial Sequence
  Description of Artificial Sequence: Synthetic oligonucleotide
agtttgtctgccatgctgggagccctc

SEQ ID NO: 225063 - DNA, 27 bp, Artificial Sequence
  Description of Artificial Sequence: Synthetic oligonucleotide
gtttgtctgccatgctgggagccctct

SEQ ID NO: 225064 - DNA, 28 bp, Artificial Sequence
  Description of Artificial Sequence: Synthetic oligonucleotide
tttgtctgccatgctgggagccctcttc

SEQ ID NO: 225065 - DNA, 27 bp, Artificial Sequence
  Description of Artificial Sequence: Synthetic oligonucleotide
ttgtctgccatgctgggagccctcttc

SEQ ID NO: 225066 - DNA, 27 bp, Artificial Sequence
  Description of Artificial Sequence: Synthetic oligonucleotide
tgtctgccatgctgggagccctcttct

SEQ ID NO: 225067 - DNA, 27 bp, Artificial Sequence
  Description of Artificial Sequence: Synthetic oligonucleotide
gtctgccatgctgggagccctcttctt

SEQ ID NO: 225068 - DNA, 27 bp, Artificial Sequence
  Description of Artificial Sequence: Synthetic oligonucleotide
tctgccatgctgggagccctcttcttg

SEQ ID NO: 225069 - DNA, 27 bp, Artificial Sequence
  Description of Artificial Sequence: Synthetic oligonucleotide
ctgccatgctgggagccctcttcttgt

SEQ ID NO: 225070 - DNA, 27 bp, Artificial Sequence
  Description of Artificial Sequence: Synthetic oligonucleotide
tgccatgctgggagccctcttcttgtg

SEQ ID NO: 225071 - DNA, 26 bp, Artificial Sequence
  Description of Artificial Sequence: Synthetic oligonucleotide
gccatgctgggagccctcttcttgtg

SEQ ID NO: 225072 - DNA, 27 bp, Artificial Sequence
  Description of Artificial Sequence: Synthetic oligonucleotide
ccatgctgggagccctcttcttgtgga

SEQ ID NO: 225073 - DNA, 28 bp, Artificial Sequence
  Description of Artificial Sequence: Synthetic oligonucleotide
catgctgggagccctcttcttgtggatg

SEQ ID NO: 225074 - DNA, 30 bp, Artificial Sequence
  Description of Artificial Sequence: Synthetic oligonucleotide
atgctgggagccctcttcttgtggatgttc

SEQ ID NO: 225075 - DNA, 29 bp, Artificial Sequence
  Description of Artificial Sequence: Synthetic oligonucleotide
tgctgggagccctcttcttgtggatgttc

SEQ ID NO: 225076 - DNA, 28 bp, Artificial Sequence
  Description of Artificial Sequence: Synthetic oligonucleotide
gctgggagccctcttcttgtggatgttc

SEQ ID NO: 225077 - DNA, 29 bp, Artificial Sequence
  Description of Artificial Sequence: Synthetic oligonucleotide
ctgggagccctcttcttgtggatgttctg

SEQ ID NO: 225078 - DNA, 29 bp, Artificial Sequence
  Description of Artificial Sequence: Synthetic oligonucleotide
tgggagccctcttcttgtggatgttctgg

SEQ ID NO: 225079 - DNA, 28 bp, Artificial Sequence
  Description of Artificial Sequence: Synthetic oligonucleotide
gggagccctcttcttgtggatgttctgg

SEQ ID NO: 225080 - DNA, 28 bp, Artificial Sequence
  Description of Artificial Sequence: Synthetic oligonucleotide
ggagccctcttcttgtggatgttctggc

SEQ ID NO: 225081 - DNA, 28 bp, Artificial Sequence
  Description of Artificial Sequence: Synthetic oligonucleotide
gagccctcttcttgtggatgttctggcc

SEQ ID NO: 225082 - DNA, 30 bp, Artificial Sequence
  Description of Artificial Sequence: Synthetic oligonucleotide
agccctcttcttgtggatgttctggccaag

SEQ ID NO: 225083 - DNA, 32 bp, Artificial Sequence
  Description of Artificial Sequence: Synthetic oligonucleotide
ttctacgtgttcgcagcctattttgggctgtc

SEQ ID NO: 225084 - DNA, 21 bp, Artificial Sequence
  Description of Artificial Sequence: Synthetic oligonucleotide
ggggagccaagtgcctgccgg

SEQ ID NO: 225085 - DNA, 21 bp, Artificial Sequence
  Description of Artificial Sequence: Synthetic oligonucleotide
gggagccaagtgcctgccggg

SEQ ID NO: 225086 - DNA, 22 bp, Artificial Sequence
  Description of Artificial Sequence: Synthetic oligonucleotide
ggagccaagtgcctgccggggt

SEQ ID NO: 225087 - DNA, 24 bp, Artificial Sequence
  Description of Artificial Sequence: Synthetic oligonucleotide
gagccaagtgcctgccggggtgtt

SEQ ID NO: 225088 - DNA, 27 bp, Artificial Sequence
  Description of Artificial Sequence: Synthetic oligonucleotide
agccaagtgcctgccggggtgttgtaa

SEQ ID NO: 225089 - DNA, 26 bp, Artificial Sequence
  Description of Artificial Sequence: Synthetic oligonucleotide
gccaagtgcctgccggggtgttgtaa

SEQ ID NO: 225090 - DNA, 26 bp, Artificial Sequence
  Description of Artificial Sequence: Synthetic oligonucleotide
ccaagtgcctgccggggtgttgtaac

SEQ ID NO: 225091 - DNA, 26 bp, Artificial Sequence
  Description of Artificial Sequence: Synthetic oligonucleotide
caagtgcctgccggggtgttgtaacc

SEQ ID NO: 225092 - DNA, 27 bp, Artificial Sequence
  Description of Artificial Sequence: Synthetic oligonucleotide
aagtgcctgccggggtgttgtaaccga

SEQ ID NO: 225093 - DNA, 26 bp, Artificial Sequence
  Description of Artificial Sequence: Synthetic oligonucleotide
agtgcctgccggggtgttgtaaccga

SEQ ID NO: 225094 - DNA, 25 bp, Artificial Sequence
  Description of Artificial Sequence: Synthetic oligonucleotide
gtgcctgccggggtgttgtaaccga

SEQ ID NO: 225095 - DNA, 26 bp, Artificial Sequence
  Description of Artificial Sequence: Synthetic oligonucleotide
tgcctgccggggtgttgtaaccgagt

SEQ ID NO: 225096 - DNA, 25 bp, Artificial Sequence
  Description of Artificial Sequence: Synthetic oligonucleotide
gcctgccggggtgttgtaaccgagt

SEQ ID NO: 225097 - DNA, 24 bp, Artificial Sequence
  Description of Artificial Sequence: Synthetic oligonucleotide
cctccagcggctcccatgtcactc

SEQ ID NO: 225098 - DNA, 27 bp, Artificial Sequence
  Description of Artificial Sequence: Synthetic oligonucleotide
atggagatggcgagttctgctggctcc

SEQ ID NO: 225099 - DNA, 27 bp, Artificial Sequence
  Description of Artificial Sequence: Synthetic oligonucleotide
tggagatggcgagttctgctggctcct

SEQ ID NO: 225100 - DNA, 26 bp, Artificial Sequence
  Description of Artificial Sequence: Synthetic oligonucleotide
ggagatggcgagttctgctggctcct

SEQ ID NO: 225101 - DNA, 26 bp, Artificial Sequence
  Description of Artificial Sequence: Synthetic oligonucleotide
gagatggcgagttctgctggctcctg

SEQ ID NO: 225102 - DNA, 26 bp, Artificial Sequence
  Description of Artificial Sequence: Synthetic oligonucleotide
agatggcgagttctgctggctcctgg

SEQ ID NO: 225103 - DNA, 25 bp, Artificial Sequence
  Description of Artificial Sequence: Synthetic oligonucleotide
gatggcgagttctgctggctcctgg

SEQ ID NO: 225104 - DNA, 26 bp, Artificial Sequence
  Description of Artificial Sequence: Synthetic oligonucleotide
atggcgagttctgctggctcctggct

SEQ ID NO: 225105 - DNA, 25 bp, Artificial Sequence
  Description of Artificial Sequence: Synthetic oligonucleotide
tggcgagttctgctggctcctggct

SEQ ID NO: 225106 - DNA, 24 bp, Artificial Sequence
  Description of Artificial Sequence: Synthetic oligonucleotide
ggcgagttctgctggctcctggct

SEQ ID NO: 225107 - DNA, 25 bp, Artificial Sequence
  Description of Artificial Sequence: Synthetic oligonucleotide
gcgagttctgctggctcctggctct

SEQ ID NO: 225108 - DNA, 26 bp, Artificial Sequence
  Description of Artificial Sequence: Synthetic oligonucleotide
cgagttctgctggctcctggctctct

SEQ ID NO: 225109 - DNA, 26 bp, Artificial Sequence
  Description of Artificial Sequence: Synthetic oligonucleotide
gagttctgctggctcctggctctctg

SEQ ID NO: 225110 - DNA, 26 bp, Artificial Sequence
  Description of Artificial Sequence: Synthetic oligonucleotide
agttctgctggctcctggctctctgg

SEQ ID NO: 225111 - DNA, 25 bp, Artificial Sequence
  Description of Artificial Sequence: Synthetic oligonucleotide
gttctgctggctcctggctctctgg

SEQ ID NO: 225112 - DNA, 26 bp, Artificial Sequence
  Description of Artificial Sequence: Synthetic oligonucleotide
ttctgctggctcctggctctctggct

SEQ ID NO: 225113 - DNA, 25 bp, Artificial Sequence
  Description of Artificial Sequence: Synthetic oligonucleotide
tctgctggctcctggctctctggct

SEQ ID NO: 225114 - DNA, 24 bp, Artificial Sequence
  Description of Artificial Sequence: Synthetic oligonucleotide
ctgctggctcctggctctctggct

SEQ ID NO: 225115 - DNA, 24 bp, Artificial Sequence
  Description of Artificial Sequence: Synthetic oligonucleotide
tgctggctcctggctctctggctg

SEQ ID NO: 225116 - DNA, 23 bp, Artificial Sequence
  Description of Artificial Sequence: Synthetic oligonucleotide
gctggctcctggctctctggctg

SEQ ID NO: 225117 - DNA, 23 bp, Artificial Sequence
  Description of Artificial Sequence: Synthetic oligonucleotide
ctggctcctggctctctggctgc

SEQ ID NO: 225118 - DNA, 24 bp, Artificial Sequence
  Description of Artificial Sequence: Synthetic oligonucleotide
tggctcctggctctctggctgcct

SEQ ID NO: 225119 - DNA, 23 bp, Artificial Sequence
  Description of Artificial Sequence: Synthetic oligonucleotide
ggctcctggctctctggctgcct

SEQ ID NO: 225120 - DNA, 25 bp, Artificial Sequence
  Description of Artificial Sequence: Synthetic oligonucleotide
gctcctggctctctggctgcctcat

SEQ ID NO: 225121 - DNA, 25 bp, Artificial Sequence
  Description of Artificial Sequence: Synthetic oligonucleotide
ctcctggctctctggctgcctcatc

SEQ ID NO: 225122 - DNA, 25 bp, Artificial Sequence
  Description of Artificial Sequence: Synthetic oligonucleotide
tcctggctctctggctgcctcatcc

SEQ ID NO: 225123 - DNA, 24 bp, Artificial Sequence
  Description of Artificial Sequence: Synthetic oligonucleotide
cctggctctctggctgcctcatcc

SEQ ID NO: 225124 - DNA, 25 bp, Artificial Sequence
  Description of Artificial Sequence: Synthetic oligonucleotide
ctggctctctggctgcctcatccct

SEQ ID NO: 225125 - DNA, 26 bp, Artificial Sequence
  Description of Artificial Sequence: Synthetic oligonucleotide
tggctctctggctgcctcatccctct

SEQ ID NO: 225126 - DNA, 25 bp, Artificial Sequence
  Description of Artificial Sequence: Synthetic oligonucleotide
ggctctctggctgcctcatccctct

SEQ ID NO: 225127 - DNA, 25 bp, Artificial Sequence
  Description of Artificial Sequence: Synthetic oligonucleotide
gctctctggctgcctcatccctctc

SEQ ID NO: 225128 - DNA, 26 bp, Artificial Sequence
  Description of Artificial Sequence: Synthetic oligonucleotide
ctctctggctgcctcatccctctcgt

SEQ ID NO: 225129 - DNA, 27 bp, Artificial Sequence
  Description of Artificial Sequence: Synthetic oligonucleotide
tctctggctgcctcatccctctcgtct

SEQ ID NO: 225130 - DNA, 27 bp, Artificial Sequence
  Description of Artificial Sequence: Synthetic oligonucleotide
ctctggctgcctcatccctctcgtctt

SEQ ID NO: 225131 - DNA, 27 bp, Artificial Sequence
  Description of Artificial Sequence: Synthetic oligonucleotide
tctggctgcctcatccctctcgtcttc

SEQ ID NO: 225132 - DNA, 26 bp, Artificial Sequence
  Description of Artificial Sequence: Synthetic oligonucleotide
ctggctgcctcatccctctcgtcttc

SEQ ID NO: 225133 - DNA, 27 bp, Artificial Sequence
  Description of Artificial Sequence: Synthetic oligonucleotide
tggctgcctcatccctctcgtcttcct

SEQ ID NO: 225134 - DNA, 26 bp, Artificial Sequence
  Description of Artificial Sequence: Synthetic oligonucleotide
ggctgcctcatccctctcgtcttcct

SEQ ID NO: 225135 - DNA, 26 bp, Artificial Sequence
  Description of Artificial Sequence: Synthetic oligonucleotide
gctgcctcatccctctcgtcttcctc

SEQ ID NO: 225136 - DNA, 26 bp, Artificial Sequence
  Description of Artificial Sequence: Synthetic oligonucleotide
ctgcctcatccctctcgtcttcctcc

SEQ ID NO: 225137 - DNA, 26 bp, Artificial Sequence
  Description of Artificial Sequence: Synthetic oligonucleotide
tgcctcatccctctcgtcttcctccg

SEQ ID NO: 225138 - DNA, 25 bp, Artificial Sequence
  Description of Artificial Sequence: Synthetic oligonucleotide
gcctcatccctctcgtcttcctccg

SEQ ID NO: 225139 - DNA, 25 bp, Artificial Sequence
  Description of Artificial Sequence: Synthetic oligonucleotide
cctcatccctctcgtcttcctccgg

SEQ ID NO: 225140 - DNA, 26 bp, Artificial Sequence
  Description of Artificial Sequence: Synthetic oligonucleotide
ctcatccctctcgtcttcctccggct

SEQ ID NO: 225141 - DNA, 27 bp, Artificial Sequence
  Description of Artificial Sequence: Synthetic oligonucleotide
tcatccctctcgtcttcctccggctgt

SEQ ID NO: 225142 - DNA, 26 bp, Artificial Sequence
  Description of Artificial Sequence: Synthetic oligonucleotide
catccctctcgtcttcctccggctgt

SEQ ID NO: 225143 - DNA, 27 bp, Artificial Sequence
  Description of Artificial Sequence: Synthetic oligonucleotide
atccctctcgtcttcctccggctgtct

SEQ ID NO: 225144 - DNA, 26 bp, Artificial Sequence
  Description of Artificial Sequence: Synthetic oligonucleotide
tccctctcgtcttcctccggctgtct

SEQ ID NO: 225145 - DNA, 25 bp, Artificial Sequence
  Description of Artificial Sequence: Synthetic oligonucleotide
ccctctcgtcttcctccggctgtct

SEQ ID NO: 225146 - DNA, 26 bp, Artificial Sequence
  Description of Artificial Sequence: Synthetic oligonucleotide
cctctcgtcttcctccggctgtctgt

SEQ ID NO: 225147 - DNA, 26 bp, Artificial Sequence
  Description of Artificial Sequence: Synthetic oligonucleotide
ctctcgtcttcctccggctgtctgtg

SEQ ID NO: 225148 - DNA, 27 bp, Artificial Sequence
  Description of Artificial Sequence: Synthetic oligonucleotide
tctcgtcttcctccggctgtctgtgca

SEQ ID NO: 225149 - DNA, 27 bp, Artificial Sequence
  Description of Artificial Sequence: Synthetic oligonucleotide
ctcgtcttcctccggctgtctgtgcat

SEQ ID NO: 225150 - DNA, 27 bp, Artificial Sequence
  Description of Artificial Sequence: Synthetic oligonucleotide
tcgtcttcctccggctgtctgtgcatg

SEQ ID NO: 225151 - DNA, 27 bp, Artificial Sequence
  Description of Artificial Sequence: Synthetic oligonucleotide
cgtcttcctccggctgtctgtgcatgt

SEQ ID NO: 225152 - DNA, 27 bp, Artificial Sequence
  Description of Artificial Sequence: Synthetic oligonucleotide
gtcttcctccggctgtctgtgcatgtg

SEQ ID NO: 225153 - DNA, 28 bp, Artificial Sequence
  Description of Artificial Sequence: Synthetic oligonucleotide
tcttcctccggctgtctgtgcatgtgtc

SEQ ID NO: 225154 - DNA, 27 bp, Artificial Sequence
  Description of Artificial Sequence: Synthetic oligonucleotide
cttcctccggctgtctgtgcatgtgtc

SEQ ID NO: 225155 - DNA, 28 bp, Artificial Sequence
  Description of Artificial Sequence: Synthetic oligonucleotide
ttcctccggctgtctgtgcatgtgtcag

SEQ ID NO: 225156 - DNA, 27 bp, Artificial Sequence
  Description of Artificial Sequence: Synthetic oligonucleotide
tcctccggctgtctgtgcatgtgtcag

SEQ ID NO: 225157 - DNA, 26 bp, Artificial Sequence
  Description of Artificial Sequence: Synthetic oligonucleotide
cctccggctgtctgtgcatgtgtcag

SEQ ID NO: 225158 - DNA, 26 bp, Artificial Sequence
  Description of Artificial Sequence: Synthetic oligonucleotide
ctccggctgtctgtgcatgtgtcagg

SEQ ID NO: 225159 - DNA, 26 bp, Artificial Sequence
  Description of Artificial Sequence: Synthetic oligonucleotide
tccggctgtctgtgcatgtgtcaggc

SEQ ID NO: 225160 - DNA, 25 bp, Artificial Sequence
  Description of Artificial Sequence: Synthetic oligonucleotide
ccggctgtctgtgcatgtgtcaggc

SEQ ID NO: 225161 - DNA, 26 bp, Artificial Sequence
  Description of Artificial Sequence: Synthetic oligonucleotide
cggctgtctgtgcatgtgtcaggcca

SEQ ID NO: 225162 - DNA, 26 bp, Artificial Sequence
  Description of Artificial Sequence: Synthetic oligonucleotide
ggctgtctgtgcatgtgtcaggccac

SEQ ID NO: 225163 - DNA, 26 bp, Artificial Sequence
  Description of Artificial Sequence: Synthetic oligonucleotide
gctgtctgtgcatgtgtcaggccacg

SEQ ID NO: 225164 - DNA, 27 bp, Artificial Sequence
  Description of Artificial Sequence: Synthetic oligonucleotide
ctgtctgtgcatgtgtcaggccacgca

SEQ ID NO: 225165 - DNA, 27 bp, Artificial Sequence
  Description of Artificial Sequence: Synthetic oligonucleotide
tgtctgtgcatgtgtcaggccacgcag

SEQ ID NO: 225166 - DNA, 26 bp, Artificial Sequence
  Description of Artificial Sequence: Synthetic oligonucleotide
gtctgtgcatgtgtcaggccacgcag

SEQ ID NO: 225167 - DNA, 26 bp, Artificial Sequence
  Description of Artificial Sequence: Synthetic oligonucleotide
tctgtgcatgtgtcaggccacgcagg

SEQ ID NO: 225168 - DNA, 25 bp, Artificial Sequence
  Description of Artificial Sequence: Synthetic oligonucleotide
ctgtgcatgtgtcaggccacgcagg

SEQ ID NO: 225169 - DNA, 25 bp, Artificial Sequence
  Description of Artificial Sequence: Synthetic oligonucleotide
tgtgcatgtgtcaggccacgcaggg

SEQ ID NO: 225170 - DNA, 24 bp, Artificial Sequence
  Description of Artificial Sequence: Synthetic oligonucleotide
gtgcatgtgtcaggccacgcaggg

SEQ ID NO: 225171 - DNA, 26 bp, Artificial Sequence
  Description of Artificial Sequence: Synthetic oligonucleotide
tgcatgtgtcaggccacgcaggggat

SEQ ID NO: 225172 - DNA, 25 bp, Artificial Sequence
  Description of Artificial Sequence: Synthetic oligonucleotide
gcatgtgtcaggccacgcaggggat

SEQ ID NO: 225173 - DNA, 25 bp, Artificial Sequence
  Description of Artificial Sequence: Synthetic oligonucleotide
catgtgtcaggccacgcaggggatg

SEQ ID NO: 225174 - DNA, 25 bp, Artificial Sequence
  Description of Artificial Sequence: Synthetic oligonucleotide
atgtgtcaggccacgcaggggatgc

SEQ ID NO: 225175 - DNA, 24 bp, Artificial Sequence
  Description of Artificial Sequence: Synthetic oligonucleotide
tgtgtcaggccacgcaggggatgc

SEQ ID NO: 225176 - DNA, 23 bp, Artificial Sequence
  Description of Artificial Sequence: Synthetic oligonucleotide
gtgtcaggccacgcaggggatgc

SEQ ID NO: 225177 - DNA, 23 bp, Artificial Sequence
  Description of Artificial Sequence: Synthetic oligonucleotide
tgtcaggccacgcaggggatgcc

SEQ ID NO: 225178 - DNA, 22 bp, Artificial Sequence
  Description of Artificial Sequence: Synthetic oligonucleotide
gtcaggccacgcaggggatgcc

SEQ ID NO: 225179 - DNA, 22 bp, Artificial Sequence
  Description of Artificial Sequence: Synthetic oligonucleotide
tcaggccacgcaggggatgccg

SEQ ID NO: 225180 - DNA, 21 bp, Artificial Sequence
  Description of Artificial Sequence: Synthetic oligonucleotide
caggccacgcaggggatgccg

SEQ ID NO: 225181 - DNA, 21 bp, Artificial Sequence
  Description of Artificial Sequence: Synthetic oligonucleotide
aggccacgcaggggatgccgg

SEQ ID NO: 225182 - DNA, 20 bp, Artificial Sequence
  Description of Artificial Sequence: Synthetic oligonucleotide
ggccacgcaggggatgccgg

SEQ ID NO: 225183 - DNA, 22 bp, Artificial Sequence
  Description of Artificial Sequence: Synthetic oligonucleotide
gccacgcaggggatgccggcaa

SEQ ID NO: 225184 - DNA, 24 bp, Artificial Sequence
  Description of Artificial Sequence: Synthetic oligonucleotide
ccacgcaggggatgccggcaagtt

SEQ ID NO: 225185 - DNA, 24 bp, Artificial Sequence
  Description of Artificial Sequence: Synthetic oligonucleotide
cacgcaggggatgccggcaagttc

SEQ ID NO: 225186 - DNA, 25 bp, Artificial Sequence
  Description of Artificial Sequence: Synthetic oligonucleotide
acgcaggggatgccggcaagttcca

SEQ ID NO: 225187 - DNA, 24 bp, Artificial Sequence
  Description of Artificial Sequence: Synthetic oligonucleotide
cgcaggggatgccggcaagttcca

SEQ ID NO: 225188 - DNA, 24 bp, Artificial Sequence
  Description of Artificial Sequence: Synthetic oligonucleotide
gcaggggatgccggcaagttccac

SEQ ID NO: 225189 - DNA, 25 bp, Artificial Sequence
  Description of Artificial Sequence: Synthetic oligonucleotide
caggggatgccggcaagttccacgt

SEQ ID NO: 225190 - DNA, 25 bp, Artificial Sequence
  Description of Artificial Sequence: Synthetic oligonucleotide
aggggatgccggcaagttccacgtg

SEQ ID NO: 225191 - DNA, 24 bp, Artificial Sequence
  Description of Artificial Sequence: Synthetic oligonucleotide
ggggatgccggcaagttccacgtg

SEQ ID NO: 225192 - DNA, 24 bp, Artificial Sequence
  Description of Artificial Sequence: Synthetic oligonucleotide
gggatgccggcaagttccacgtgg

SEQ ID NO: 225193 - DNA, 24 bp, Artificial Sequence
  Description of Artificial Sequence: Synthetic oligonucleotide
ggatgccggcaagttccacgtggc

SEQ ID NO: 225194 - DNA, 24 bp, Artificial Sequence
  Description of Artificial Sequence: Synthetic oligonucleotide
gatgccggcaagttccacgtggcc

SEQ ID NO: 225195 - DNA, 26 bp, Artificial Sequence
  Description of Artificial Sequence: Synthetic oligonucleotide
atgccggcaagttccacgtggcccta

SEQ ID NO: 225196 - DNA, 25 bp, Artificial Sequence
  Description of Artificial Sequence: Synthetic oligonucleotide
tgccggcaagttccacgtggcccta

SEQ ID NO: 225197 - DNA, 24 bp, Artificial Sequence
  Description of Artificial Sequence: Synthetic oligonucleotide
gccggcaagttccacgtggcccta

SEQ ID NO: 225198 - DNA, 26 bp, Artificial Sequence
  Description of Artificial Sequence: Synthetic oligonucleotide
ccggcaagttccacgtggccctacta

SEQ ID NO: 225199 - DNA, 26 bp, Artificial Sequence
  Description of Artificial Sequence: Synthetic oligonucleotide
cggcaagttccacgtggccctactag

SEQ ID NO: 225200 - DNA, 26 bp, Artificial Sequence
  Description of Artificial Sequence: Synthetic oligonucleotide
ggcaagttccacgtggccctactagg

SEQ ID NO: 225201 - DNA, 26 bp, Artificial Sequence
  Description of Artificial Sequence: Synthetic oligonucleotide
gcaagttccacgtggccctactaggg

SEQ ID NO: 225202 - DNA, 26 bp, Artificial Sequence
  Description of Artificial Sequence: Synthetic oligonucleotide
caagttccacgtggccctactagggg

SEQ ID NO: 225203 - DNA, 26 bp, Artificial Sequence
  Description of Artificial Sequence: Synthetic oligonucleotide
aagttccacgtggccctactaggggg

SEQ ID NO: 225204 - DNA, 25 bp, Artificial Sequence
  Description of Artificial Sequence: Synthetic oligonucleotide
agttccacgtggccctactaggggg

SEQ ID NO: 225205 - DNA, 24 bp, Artificial Sequence
  Description of Artificial Sequence: Synthetic oligonucleotide
gttccacgtggccctactaggggg

SEQ ID NO: 225206 - DNA, 25 bp, Artificial Sequence
  Description of Artificial Sequence: Synthetic oligonucleotide
ttccacgtggccctactagggggca

SEQ ID NO: 225207 - DNA, 24 bp, Artificial Sequence
  Description of Artificial Sequence: Synthetic oligonucleotide
tccacgtggccctactagggggca

SEQ ID NO: 225208 - DNA, 23 bp, Artificial Sequence
  Description of Artificial Sequence: Synthetic oligonucleotide
ccacgtggccctactagggggca

SEQ ID NO: 225209 - DNA, 24 bp, Artificial Sequence
  Description of Artificial Sequence: Synthetic oligonucleotide
cacgtggccctactagggggcaca

SEQ ID NO: 225210 - DNA, 24 bp, Artificial Sequence
  Description of Artificial Sequence: Synthetic oligonucleotide
acgtggccctactagggggcacag

SEQ ID NO: 225211 - DNA, 23 bp, Artificial Sequence
  Description of Artificial Sequence: Synthetic oligonucleotide
cgtggccctactagggggcacag

SEQ ID NO: 225212 - DNA, 23 bp, Artificial Sequence
  Description of Artificial Sequence: Synthetic oligonucleotide
gtggccctactagggggcacagc

SEQ ID NO: 225213 - DNA, 23 bp, Artificial Sequence
  Description of Artificial Sequence: Synthetic oligonucleotide
tggccctactagggggcacagcc

SEQ ID NO: 225214 - DNA, 22 bp, Artificial Sequence
  Description of Artificial Sequence: Synthetic oligonucleotide
ggccctactagggggcacagcc

SEQ ID NO: 225215 - DNA, 23 bp, Artificial Sequence
  Description of Artificial Sequence: Synthetic oligonucleotide
gccctactagggggcacagccga

SEQ ID NO: 225216 - DNA, 23 bp, Artificial Sequence
  Description of Artificial Sequence: Synthetic oligonucleotide
ccctactagggggcacagccgag

SEQ ID NO: 225217 - DNA, 24 bp, Artificial Sequence
  Description of Artificial Sequence: Synthetic oligonucleotide
cctactagggggcacagccgagct

SEQ ID NO: 225218 - DNA, 24 bp, Artificial Sequence
  Description of Artificial Sequence: Synthetic oligonucleotide
ctactagggggcacagccgagctg

SEQ ID NO: 225219 - DNA, 25 bp, Artificial Sequence
  Description of Artificial Sequence: Synthetic oligonucleotide
tactagggggcacagccgagctgct

SEQ ID NO: 225220 - DNA, 24 bp, Artificial Sequence
  Description of Artificial Sequence: Synthetic oligonucleotide
actagggggcacagccgagctgct

SEQ ID NO: 225221 - DNA, 23 bp, Artificial Sequence
  Description of Artificial Sequence: Synthetic oligonucleotide
ctagggggcacagccgagctgct

SEQ ID NO: 225222 - DNA, 24 bp, Artificial Sequence
  Description of Artificial Sequence: Synthetic oligonucleotide
tagggggcacagccgagctgctct

SEQ ID NO: 225223 - DNA, 23 bp, Artificial Sequence
  Description of Artificial Sequence: Synthetic oligonucleotide
agggggcacagccgagctgctct

SEQ ID NO: 225224 - DNA, 22 bp, Artificial Sequence
  Description of Artificial Sequence: Synthetic oligonucleotide
gggggcacagccgagctgctct

SEQ ID NO: 225225 - DNA, 22 bp, Artificial Sequence
  Description of Artificial Sequence: Synthetic oligonucleotide
ggggcacagccgagctgctctg

SEQ ID NO: 225226 - DNA, 22 bp, Artificial Sequence
  Description of Artificial Sequence: Synthetic oligonucleotide
gggcacagccgagctgctctgc

SEQ ID NO: 225227 - DNA, 22 bp, Artificial Sequence
  Description of Artificial Sequence: Synthetic oligonucleotide
ggcacagccgagctgctctgcc

SEQ ID NO: 225228 - DNA, 23 bp, Artificial Sequence
  Description of Artificial Sequence: Synthetic oligonucleotide
gcacagccgagctgctctgccct

SEQ ID NO: 225229 - DNA, 24 bp, Artificial Sequence
  Description of Artificial Sequence: Synthetic oligonucleotide
cacagccgagctgctctgccctct

SEQ ID NO: 225230 - DNA, 25 bp, Artificial Sequence
  Description of Artificial Sequence: Synthetic oligonucleotide
acagccgagctgctctgccctctct

SEQ ID NO: 225231 - DNA, 24 bp, Artificial Sequence
  Description of Artificial Sequence: Synthetic oligonucleotide
cagccgagctgctctgccctctct

SEQ ID NO: 225232 - DNA, 24 bp, Artificial Sequence
  Description of Artificial Sequence: Synthetic oligonucleotide
agccgagctgctctgccctctctc

SEQ ID NO: 225233 - DNA, 23 bp, Artificial Sequence
  Description of Artificial Sequence: Synthetic oligonucleotide
gccgagctgctctgccctctctc

SEQ ID NO: 225234 - DNA, 23 bp, Artificial Sequence
  Description of Artificial Sequence: Synthetic oligonucleotide
ccgagctgctctgccctctctcc

SEQ ID NO: 225235 - DNA, 24 bp, Artificial Sequence
  Description of Artificial Sequence: Synthetic oligonucleotide
cgagctgctctgccctctctccct

SEQ ID NO: 225236 - DNA, 25 bp, Artificial Sequence
  Description of Artificial Sequence: Synthetic oligonucleotide
gagctgctctgccctctctccctct

SEQ ID NO: 225237 - DNA, 25 bp, Artificial Sequence
  Description of Artificial Sequence: Synthetic oligonucleotide
agctgctctgccctctctccctctg

SEQ ID NO: 225238 - DNA, 24 bp, Artificial Sequence
  Description of Artificial Sequence: Synthetic oligonucleotide
gctgctctgccctctctccctctg

SEQ ID NO: 225239 - DNA, 24 bp, Artificial Sequence
  Description of Artificial Sequence: Synthetic oligonucleotide
ctgctctgccctctctccctctgg

SEQ ID NO: 225240 - DNA, 24 bp, Artificial Sequence
  Description of Artificial Sequence: Synthetic oligonucleotide
tgctctgccctctctccctctggc

SEQ ID NO: 225241 - DNA, 23 bp, Artificial Sequence
  Description of Artificial Sequence: Synthetic oligonucleotide
gctctgccctctctccctctggc

SEQ ID NO: 225242 - DNA, 23 bp, Artificial Sequence
  Description of Artificial Sequence: Synthetic oligonucleotide
ctctgccctctctccctctggcc

SEQ ID NO: 225243 - DNA, 23 bp, Artificial Sequence
  Description of Artificial Sequence: Synthetic oligonucleotide
tctgccctctctccctctggccc

SEQ ID NO: 225244 - DNA, 22 bp, Artificial Sequence
  Description of Artificial Sequence: Synthetic oligonucleotide
ctgccctctctccctctggccc

SEQ ID NO: 225245 - DNA, 22 bp, Artificial Sequence
  Description of Artificial Sequence: Synthetic oligonucleotide
tgccctctctccctctggcccg

SEQ ID NO: 225246 - DNA, 21 bp, Artificial Sequence
  Description of Artificial Sequence: Synthetic oligonucleotide
gccctctctccctctggcccg

SEQ ID NO: 225247 - DNA, 21 bp, Artificial Sequence
  Description of Artificial Sequence: Synthetic oligonucleotide
ccctctctccctctggcccgg

SEQ ID NO: 225248 - DNA, 22 bp, Artificial Sequence
  Description of Artificial Sequence: Synthetic oligonucleotide
cctctctccctctggcccggga

SEQ ID NO: 225249 - DNA, 22 bp, Artificial Sequence
  Description of Artificial Sequence: Synthetic oligonucleotide
ctctctccctctggcccgggac

SEQ ID NO: 225250 - DNA, 22 bp, Artificial Sequence
  Description of Artificial Sequence: Synthetic oligonucleotide
tctctccctctggcccgggacg

SEQ ID NO: 225251 - DNA, 21 bp, Artificial Sequence
  Description of Artificial Sequence: Synthetic oligonucleotide
ctctccctctggcccgggacg

SEQ ID NO: 225252 - DNA, 23 bp, Artificial Sequence
  Description of Artificial Sequence: Synthetic oligonucleotide
tctccctctggcccgggacggta

SEQ ID NO: 225253 - DNA, 22 bp, Artificial Sequence
  Description of Artificial Sequence: Synthetic oligonucleotide
ctccctctggcccgggacggta

SEQ ID NO: 225254 - DNA, 22 bp, Artificial Sequence
  Description of Artificial Sequence: Synthetic oligonucleotide
tccctctggcccgggacggtac

SEQ ID NO: 225255 - DNA, 21 bp, Artificial Sequence
  Description of Artificial Sequence: Synthetic oligonucleotide
ccctctggcccgggacggtac

SEQ ID NO: 225256 - DNA, 21 bp, Artificial Sequence
  Description of Artificial Sequence: Synthetic oligonucleotide
cctctggcccgggacggtacc

SEQ ID NO: 225257 - DNA, 23 bp, Artificial Sequence
  Description of Artificial Sequence: Synthetic oligonucleotide
ctctggcccgggacggtacccaa

SEQ ID NO: 225258 - DNA, 23 bp, Artificial Sequence
  Description of Artificial Sequence: Synthetic oligonucleotide
tctggcccgggacggtacccaag

SEQ ID NO: 225259 - DNA, 22 bp, Artificial Sequence
  Description of Artificial Sequence: Synthetic oligonucleotide
ctggcccgggacggtacccaag

SEQ ID NO: 225260 - DNA, 23 bp, Artificial Sequence
  Description of Artificial Sequence: Synthetic oligonucleotide
tggcccgggacggtacccaagga

SEQ ID NO: 225261 - DNA, 22 bp, Artificial Sequence
  Description of Artificial Sequence: Synthetic oligonucleotide
ggcccgggacggtacccaagga

SEQ ID NO: 225262 - DNA, 22 bp, Artificial Sequence
  Description of Artificial Sequence: Synthetic oligonucleotide
gcccgggacggtacccaaggag

SEQ ID NO: 225263 - DNA, 23 bp, Artificial Sequence
  Description of Artificial Sequence: Synthetic oligonucleotide
cccgggacggtacccaaggaggt

SEQ ID NO: 225264 - DNA, 24 bp, Artificial Sequence
  Description of Artificial Sequence: Synthetic oligonucleotide
ccgggacggtacccaaggaggtga

SEQ ID NO: 225265 - DNA, 24 bp, Artificial Sequence
  Description of Artificial Sequence: Synthetic oligonucleotide
cgggacggtacccaaggaggtgag

SEQ ID NO: 225266 - DNA, 25 bp, Artificial Sequence
  Description of Artificial Sequence: Synthetic oligonucleotide
gggacggtacccaaggaggtgaggt

SEQ ID NO: 225267 - DNA, 25 bp, Artificial Sequence
  Description of Artificial Sequence: Synthetic oligonucleotide
ggacggtacccaaggaggtgaggtg

SEQ ID NO: 225268 - DNA, 25 bp, Artificial Sequence
  Description of Artificial Sequence: Synthetic oligonucleotide
gacggtacccaaggaggtgaggtgg

SEQ ID NO: 225269 - DNA, 26 bp, Artificial Sequence
  Description of Artificial Sequence: Synthetic oligonucleotide
acggtacccaaggaggtgaggtggct

SEQ ID NO: 225270 - DNA, 25 bp, Artificial Sequence
  Description of Artificial Sequence: Synthetic oligonucleotide
cggtacccaaggaggtgaggtggct

SEQ ID NO: 225271 - DNA, 25 bp, Artificial Sequence
  Description of Artificial Sequence: Synthetic oligonucleotide
ggtacccaaggaggtgaggtggctg

SEQ ID NO: 225272 - DNA, 25 bp, Artificial Sequence
  Description of Artificial Sequence: Synthetic oligonucleotide
gtacccaaggaggtgaggtggctgc

SEQ ID NO: 225273 - DNA, 25 bp, Artificial Sequence
  Description of Artificial Sequence: Synthetic oligonucleotide
tacccaaggaggtgaggtggctgcg

SEQ ID NO: 225274 - DNA, 24 bp, Artificial Sequence
  Description of Artificial Sequence: Synthetic oligonucleotide
acccaaggaggtgaggtggctgcg

SEQ ID NO: 225275 - DNA, 23 bp, Artificial Sequence
  Description of Artificial Sequence: Synthetic oligonucleotide
cccaaggaggtgaggtggctgcg

SEQ ID NO: 225276 - DNA, 24 bp, Artificial Sequence
  Description of Artificial Sequence: Synthetic oligonucleotide
ccaaggaggtgaggtggctgcggt

SEQ ID NO: 225277 - DNA, 24 bp, Artificial Sequence
  Description of Artificial Sequence: Synthetic oligonucleotide
caaggaggtgaggtggctgcggtc

SEQ ID NO: 225278 - DNA, 24 bp, Artificial Sequence
  Description of Artificial Sequence: Synthetic oligonucleotide
aaggaggtgaggtggctgcggtcc

SEQ ID NO: 225279 - DNA, 23 bp, Artificial Sequence
  Description of Artificial Sequence: Synthetic oligonucleotide
aggaggtgaggtggctgcggtcc

SEQ ID NO: 225280 - DNA, 22 bp, Artificial Sequence
  Description of Artificial Sequence: Synthetic oligonucleotide
ggaggtgaggtggctgcggtcc

SEQ ID NO: 225281 - DNA, 22 bp, Artificial Sequence
  Description of Artificial Sequence: Synthetic oligonucleotide
gaggtgaggtggctgcggtccc

SEQ ID NO: 225282 - DNA, 25 bp, Artificial Sequence
  Description of Artificial Sequence: Synthetic oligonucleotide
aggtgaggtggctgcggtccccatt

SEQ ID NO: 225283 - DNA, 24 bp, Artificial Sequence
  Description of Artificial Sequence: Synthetic oligonucleotide
ggtgaggtggctgcggtccccatt

SEQ ID NO: 225284 - DNA, 24 bp, Artificial Sequence
  Description of Artificial Sequence: Synthetic oligonucleotide
gtgaggtggctgcggtccccattc

SEQ ID NO: 225285 - DNA, 24 bp, Artificial Sequence
  Description of Artificial Sequence: Synthetic oligonucleotide
tgaggtggctgcggtccccattcc

SEQ ID NO: 225286 - DNA, 23 bp, Artificial Sequence
  Description of Artificial Sequence: Synthetic oligonucleotide
gaggtggctgcggtccccattcc

SEQ ID NO: 225287 - DNA, 23 bp, Artificial Sequence
  Description of Artificial Sequence: Synthetic oligonucleotide
aggtggctgcggtccccattccc

SEQ ID NO: 225288 - DNA, 22 bp, Artificial Sequence
  Description of Artificial Sequence: Synthetic oligonucleotide
ggtggctgcggtccccattccc

SEQ ID NO: 225289 - DNA, 22 bp, Artificial Sequence
  Description of Artificial Sequence: Synthetic oligonucleotide
gtggctgcggtccccattcccg

SEQ ID NO: 225290 - DNA, 23 bp, Artificial Sequence
  Description of Artificial Sequence: Synthetic oligonucleotide
tggctgcggtccccattcccgca

SEQ ID NO: 225291 - DNA, 22 bp, Artificial Sequence
  Description of Artificial Sequence: Synthetic oligonucleotide
ggctgcggtccccattcccgca

SEQ ID NO: 225292 - DNA, 22 bp, Artificial Sequence
  Description of Artificial Sequence: Synthetic oligonucleotide
gctgcggtccccattcccgcag

SEQ ID NO: 225293 - DNA, 22 bp, Artificial Sequence
  Description of Artificial Sequence: Synthetic oligonucleotide
ctgcggtccccattcccgcagc

SEQ ID NO: 225294 - DNA, 22 bp, Artificial Sequence
  Description of Artificial Sequence: Synthetic oligonucleotide
tgcggtccccattcccgcagcg

SEQ ID NO: 225295 - DNA, 21 bp, Artificial Sequence
  Description of Artificial Sequence: Synthetic oligonucleotide
gcggtccccattcccgcagcg

SEQ ID NO: 225296 - DNA, 22 bp, Artificial Sequence
  Description of Artificial Sequence: Synthetic oligonucleotide
cggtccccattcccgcagcgct

SEQ ID NO: 225297 - DNA, 22 bp, Artificial Sequence
  Description of Artificial Sequence: Synthetic oligonucleotide
ggtccccattcccgcagcgctc

SEQ ID NO: 225298 - DNA, 22 bp, Artificial Sequence
  Description of Artificial Sequence: Synthetic oligonucleotide
gtccccattcccgcagcgctcc

SEQ ID NO: 225299 - DNA, 23 bp, Artificial Sequence
  Description of Artificial Sequence: Synthetic oligonucleotide
tccccattcccgcagcgctccca

SEQ ID NO: 225300 - DNA, 22 bp, Artificial Sequence
  Description of Artificial Sequence: Synthetic oligonucleotide
ccccattcccgcagcgctccca

SEQ ID NO: 225301 - DNA, 22 bp, Artificial Sequence
  Description of Artificial Sequence: Synthetic oligonucleotide
cccattcccgcagcgctcccag

SEQ ID NO: 225302 - DNA, 22 bp, Artificial Sequence
  Description of Artificial Sequence: Synthetic oligonucleotide
ccattcccgcagcgctcccagg

SEQ ID NO: 225303 - DNA, 23 bp, Artificial Sequence
  Description of Artificial Sequence: Synthetic oligonucleotide
cattcccgcagcgctcccaggct

SEQ ID NO: 225304 - DNA, 25 bp, Artificial Sequence
  Description of Artificial Sequence: Synthetic oligonucleotide
attcccgcagcgctcccaggctgtt

SEQ ID NO: 225305 - DNA, 24 bp, Artificial Sequence
  Description of Artificial Sequence: Synthetic oligonucleotide
ttcccgcagcgctcccaggctgtt

SEQ ID NO: 225306 - DNA, 23 bp, Artificial Sequence
  Description of Artificial Sequence: Synthetic oligonucleotide
tcccgcagcgctcccaggctgtt

SEQ ID NO: 225307 - DNA, 22 bp, Artificial Sequence
  Description of Artificial Sequence: Synthetic oligonucleotide
cccgcagcgctcccaggctgtt

SEQ ID NO: 225308 - DNA, 23 bp, Artificial Sequence
  Description of Artificial Sequence: Synthetic oligonucleotide
ccgcagcgctcccaggctgttca

SEQ ID NO: 225309 - DNA, 27 bp, Artificial Sequence
  Description of Artificial Sequence: Synthetic oligonucleotide
cgcagcgctcccaggctgttcacatat

SEQ ID NO: 225310 - DNA, 28 bp, Artificial Sequence
  Description of Artificial Sequence: Synthetic oligonucleotide
gcagcgctcccaggctgttcacatattc

SEQ ID NO: 225311 - DNA, 28 bp, Artificial Sequence
  Description of Artificial Sequence: Synthetic oligonucleotide
cagcgctcccaggctgttcacatattcc

SEQ ID NO: 225312 - DNA, 28 bp, Artificial Sequence
  Description of Artificial Sequence: Synthetic oligonucleotide
agcgctcccaggctgttcacatattccg

SEQ ID NO: 225313 - DNA, 27 bp, Artificial Sequence
  Description of Artificial Sequence: Synthetic oligonucleotide
gcgctcccaggctgttcacatattccg

SEQ ID NO: 225314 - DNA, 27 bp, Artificial Sequence
  Description of Artificial Sequence: Synthetic oligonucleotide
cgctcccaggctgttcacatattccgg

SEQ ID NO: 225315 - DNA, 27 bp, Artificial Sequence
  Description of Artificial Sequence: Synthetic oligonucleotide
gctcccaggctgttcacatattccggg

SEQ ID NO: 225316 - DNA, 29 bp, Artificial Sequence
  Description of Artificial Sequence: Synthetic oligonucleotide
ctcccaggctgttcacatattccgggatg

SEQ ID NO: 225317 - DNA, 29 bp, Artificial Sequence
  Description of Artificial Sequence: Synthetic oligonucleotide
tcccaggctgttcacatattccgggatgg

SEQ ID NO: 225318 - DNA, 28 bp, Artificial Sequence
  Description of Artificial Sequence: Synthetic oligonucleotide
cccaggctgttcacatattccgggatgg

SEQ ID NO: 225319 - DNA, 28 bp, Artificial Sequence
  Description of Artificial Sequence: Synthetic oligonucleotide
ccaggctgttcacatattccgggatggg

SEQ ID NO: 225320 - DNA, 30 bp, Artificial Sequence
  Description of Artificial Sequence: Synthetic oligonucleotide
caggctgttcacatattccgggatgggaag

SEQ ID NO: 225321 - DNA, 30 bp, Artificial Sequence
  Description of Artificial Sequence: Synthetic oligonucleotide
aggctgttcacatattccgggatgggaagg

SEQ ID NO: 225322 - DNA, 29 bp, Artificial Sequence
  Description of Artificial Sequence: Synthetic oligonucleotide
ggctgttcacatattccgggatgggaagg

SEQ ID NO: 225323 - DNA, 30 bp, Artificial Sequence
  Description of Artificial Sequence: Synthetic oligonucleotide
gctgttcacatattccgggatgggaaggac

SEQ ID NO: 225324 - DNA, 30 bp, Artificial Sequence
  Description of Artificial Sequence: Synthetic oligonucleotide
ctgttcacatattccgggatgggaaggacc

SEQ ID NO: 225325 - DNA, 31 bp, Artificial Sequence
  Description of Artificial Sequence: Synthetic oligonucleotide
tgttcacatattccgggatgggaaggaccag

SEQ ID NO: 225326 - DNA, 30 bp, Artificial Sequence
  Description of Artificial Sequence: Synthetic oligonucleotide
gttcacatattccgggatgggaaggaccag

SEQ ID NO: 225327 - DNA, 30 bp, Artificial Sequence
  Description of Artificial Sequence: Synthetic oligonucleotide
ttcacatattccgggatgggaaggaccagg

SEQ ID NO: 225328 - DNA, 29 bp, Artificial Sequence
  Description of Artificial Sequence: Synthetic oligonucleotide
tcacatattccgggatgggaaggaccagg

SEQ ID NO: 225329 - DNA, 28 bp, Artificial Sequence
  Description of Artificial Sequence: Synthetic oligonucleotide
cacatattccgggatgggaaggaccagg

SEQ ID NO: 225330 - DNA, 30 bp, Artificial Sequence
  Description of Artificial Sequence: Synthetic oligonucleotide
acatattccgggatgggaaggaccaggatg

SEQ ID NO: 225331 - DNA, 29 bp, Artificial Sequence
  Description of Artificial Sequence: Synthetic oligonucleotide
catattccgggatgggaaggaccaggatg

SEQ ID NO: 225332 - DNA, 31 bp, Artificial Sequence
  Description of Artificial Sequence: Synthetic oligonucleotide
atattccgggatgggaaggaccaggatgaag

SEQ ID NO: 225333 - DNA, 30 bp, Artificial Sequence
  Description of Artificial Sequence: Synthetic oligonucleotide
tattccgggatgggaaggaccaggatgaag

SEQ ID NO: 225334 - DNA, 29 bp, Artificial Sequence
  Description of Artificial Sequence: Synthetic oligonucleotide
attccgggatgggaaggaccaggatgaag

SEQ ID NO: 225335 - DNA, 28 bp, Artificial Sequence
  Description of Artificial Sequence: Synthetic oligonucleotide
ttccgggatgggaaggaccaggatgaag

SEQ ID NO: 225336 - DNA, 27 bp, Artificial Sequence
  Description of Artificial Sequence: Synthetic oligonucleotide
tccgggatgggaaggaccaggatgaag

SEQ ID NO: 225337 - DNA, 27 bp, Artificial Sequence
  Description of Artificial Sequence: Synthetic oligonucleotide
ccgggatgggaaggaccaggatgaaga

SEQ ID NO: 225338 - DNA, 28 bp, Artificial Sequence
  Description of Artificial Sequence: Synthetic oligonucleotide
cgggatgggaaggaccaggatgaagatc

SEQ ID NO: 225339 - DNA, 29 bp, Artificial Sequence
  Description of Artificial Sequence: Synthetic oligonucleotide
gggatgggaaggaccaggatgaagatctg

SEQ ID NO: 225340 - DNA, 31 bp, Artificial Sequence
  Description of Artificial Sequence: Synthetic oligonucleotide
ggatgggaaggaccaggatgaagatctgatg

SEQ ID NO: 225341 - DNA, 31 bp, Artificial Sequence
  Description of Artificial Sequence: Synthetic oligonucleotide
gatgggaaggaccaggatgaagatctgatgc

SEQ ID NO: 225342 - DNA, 31 bp, Artificial Sequence
  Description of Artificial Sequence: Synthetic oligonucleotide
atgggaaggaccaggatgaagatctgatgcc

SEQ ID NO: 225343 - DNA, 30 bp, Artificial Sequence
  Description of Artificial Sequence: Synthetic oligonucleotide
tgggaaggaccaggatgaagatctgatgcc

SEQ ID NO: 225344 - DNA, 29 bp, Artificial Sequence
  Description of Artificial Sequence: Synthetic oligonucleotide
gggaaggaccaggatgaagatctgatgcc

SEQ ID NO: 225345 - DNA, 29 bp, Artificial Sequence
  Description of Artificial Sequence: Synthetic oligonucleotide
ggaaggaccaggatgaagatctgatgccg

SEQ ID NO: 225346 - DNA, 29 bp, Artificial Sequence
  Description of Artificial Sequence: Synthetic oligonucleotide
gaaggaccaggatgaagatctgatgccgg

SEQ ID NO: 225347 - DNA, 36 bp, Artificial Sequence
  Description of Artificial Sequence: Synthetic oligonucleotide
aaggaccaggatgaagatctgatgccggaatataag

SEQ ID NO: 225348 - DNA, 35 bp, Artificial Sequence
  Description of Artificial Sequence: Synthetic oligonucleotide
aggaccaggatgaagatctgatgccggaatataag

SEQ ID NO: 225349 - DNA, 34 bp, Artificial Sequence
  Description of Artificial Sequence: Synthetic oligonucleotide
ggaccaggatgaagatctgatgccggaatataag

SEQ ID NO: 225350 - DNA, 34 bp, Artificial Sequence
  Description of Artificial Sequence: Synthetic oligonucleotide
gaccaggatgaagatctgatgccggaatataagg

SEQ ID NO: 225351 - DNA, 34 bp, Artificial Sequence
  Description of Artificial Sequence: Synthetic oligonucleotide
accaggatgaagatctgatgccggaatataaggg

SEQ ID NO: 225352 - DNA, 33 bp, Artificial Sequence
  Description of Artificial Sequence: Synthetic oligonucleotide
ccaggatgaagatctgatgccggaatataaggg

SEQ ID NO: 225353 - DNA, 33 bp, Artificial Sequence
  Description of Artificial Sequence: Synthetic oligonucleotide
caggatgaagatctgatgccggaatataagggg

SEQ ID NO: 225354 - DNA, 34 bp, Artificial Sequence
  Description of Artificial Sequence: Synthetic oligonucleotide
aggatgaagatctgatgccggaatataaggggag

SEQ ID NO: 225355 - DNA, 33 bp, Artificial Sequence
  Description of Artificial Sequence: Synthetic oligonucleotide
ggatgaagatctgatgccggaatataaggggag

SEQ ID NO: 225356 - DNA, 33 bp, Artificial Sequence
  Description of Artificial Sequence: Synthetic oligonucleotide
gatgaagatctgatgccggaatataaggggagg

SEQ ID NO: 225357 - DNA, 34 bp, Artificial Sequence
  Description of Artificial Sequence: Synthetic oligonucleotide
atgaagatctgatgccggaatataaggggaggac

SEQ ID NO: 225358 - DNA, 33 bp, Artificial Sequence
  Description of Artificial Sequence: Synthetic oligonucleotide
tgaagatctgatgccggaatataaggggaggac

SEQ ID NO: 225359 - DNA, 32 bp, Artificial Sequence
  Description of Artificial Sequence: Synthetic oligonucleotide
gaagatctgatgccggaatataaggggaggac

SEQ ID NO: 225360 - DNA, 32 bp, Artificial Sequence
  Description of Artificial Sequence: Synthetic oligonucleotide
aagatctgatgccggaatataaggggaggacg

SEQ ID NO: 225361 - DNA, 31 bp, Artificial Sequence
  Description of Artificial Sequence: Synthetic oligonucleotide
agatctgatgccggaatataaggggaggacg

SEQ ID NO: 225362 - DNA, 30 bp, Artificial Sequence
  Description of Artificial Sequence: Synthetic oligonucleotide
gatctgatgccggaatataaggggaggacg

SEQ ID NO: 225363 - DNA, 30 bp, Artificial Sequence
  Description of Artificial Sequence: Synthetic oligonucleotide
atctgatgccggaatataaggggaggacgg

SEQ ID NO: 225364 - DNA, 29 bp, Artificial Sequence
  Description of Artificial Sequence: Synthetic oligonucleotide
tctgatgccggaatataaggggaggacgg

SEQ ID NO: 225365 - DNA, 28 bp, Artificial Sequence
  Description of Artificial Sequence: Synthetic oligonucleotide
ctgatgccggaatataaggggaggacgg

SEQ ID NO: 225366 - DNA, 29 bp, Artificial Sequence
  Description of Artificial Sequence: Synthetic oligonucleotide
tgatgccggaatataaggggaggacggtg

SEQ ID NO: 225367 - DNA, 28 bp, Artificial Sequence
  Description of Artificial Sequence: Synthetic oligonucleotide
gatgccggaatataaggggaggacggtg

SEQ ID NO: 225368 - DNA, 28 bp, Artificial Sequence
  Description of Artificial Sequence: Synthetic oligonucleotide
atgccggaatataaggggaggacggtgc

SEQ ID NO: 225369 - DNA, 27 bp, Artificial Sequence
  Description of Artificial Sequence: Synthetic oligonucleotide
tgccggaatataaggggaggacggtgc

SEQ ID NO: 225370 - DNA, 27 bp, Artificial Sequence
  Description of Artificial Sequence: Synthetic oligonucleotide
gccggaatataaggggaggacggtgct

SEQ ID NO: 225371 - DNA, 28 bp, Artificial Sequence
  Description of Artificial Sequence: Synthetic oligonucleotide
ccggaatataaggggaggacggtgctag

SEQ ID NO: 225372 - DNA, 29 bp, Artificial Sequence
  Description of Artificial Sequence: Synthetic oligonucleotide
cggaatataaggggaggacggtgctagtg

SEQ ID NO: 225373 - DNA, 30 bp, Artificial Sequence
  Description of Artificial Sequence: Synthetic oligonucleotide
ggaatataaggggaggacggtgctagtgag

SEQ ID NO: 225374 - DNA, 31 bp, Artificial Sequence
  Description of Artificial Sequence: Synthetic oligonucleotide
gaatataaggggaggacggtgctagtgagag

SEQ ID NO: 225375 - DNA, 33 bp, Artificial Sequence
  Description of Artificial Sequence: Synthetic oligonucleotide
aatataaggggaggacggtgctagtgagagatg

SEQ ID NO: 225376 - DNA, 32 bp, Artificial Sequence
  Description of Artificial Sequence: Synthetic oligonucleotide
atataaggggaggacggtgctagtgagagatg

SEQ ID NO: 225377 - DNA, 31 bp, Artificial Sequence
  Description of Artificial Sequence: Synthetic oligonucleotide
tataaggggaggacggtgctagtgagagatg

SEQ ID NO: 225378 - DNA, 30 bp, Artificial Sequence
  Description of Artificial Sequence: Synthetic oligonucleotide
ataaggggaggacggtgctagtgagagatg

SEQ ID NO: 225379 - DNA, 29 bp, Artificial Sequence
  Description of Artificial Sequence: Synthetic oligonucleotide
taaggggaggacggtgctagtgagagatg

SEQ ID NO: 225380 - DNA, 28 bp, Artificial Sequence
  Description of Artificial Sequence: Synthetic oligonucleotide
aaggggaggacggtgctagtgagagatg

SEQ ID NO: 225381 - DNA, 27 bp, Artificial Sequence
  Description of Artificial Sequence: Synthetic oligonucleotide
aggggaggacggtgctagtgagagatg

SEQ ID NO: 225382 - DNA, 26 bp, Artificial Sequence
  Description of Artificial Sequence: Synthetic oligonucleotide
ggggaggacggtgctagtgagagatg

SEQ ID NO: 225383 - DNA, 26 bp, Artificial Sequence
  Description of Artificial Sequence: Synthetic oligonucleotide
gggaggacggtgctagtgagagatgc

SEQ ID NO: 225384 - DNA, 26 bp, Artificial Sequence
  Description of Artificial Sequence: Synthetic oligonucleotide
ggaggacggtgctagtgagagatgcc

SEQ ID NO: 225385 - DNA, 27 bp, Artificial Sequence
  Description of Artificial Sequence: Synthetic oligonucleotide
gaggacggtgctagtgagagatgccca

SEQ ID NO: 225386 - DNA, 28 bp, Artificial Sequence
  Description of Artificial Sequence: Synthetic oligonucleotide
aggacggtgctagtgagagatgcccaag

SEQ ID NO: 225387 - DNA, 27 bp, Artificial Sequence
  Description of Artificial Sequence: Synthetic oligonucleotide
ggacggtgctagtgagagatgcccaag

SEQ ID NO: 225388 - DNA, 28 bp, Artificial Sequence
  Description of Artificial Sequence: Synthetic oligonucleotide
gacggtgctagtgagagatgcccaagag

SEQ ID NO: 225389 - DNA, 28 bp, Artificial Sequence
  Description of Artificial Sequence: Synthetic oligonucleotide
acggtgctagtgagagatgcccaagagg

SEQ ID NO: 225390 - DNA, 27 bp, Artificial Sequence
  Description of Artificial Sequence: Synthetic oligonucleotide
cggtgctagtgagagatgcccaagagg

SEQ ID NO: 225391 - DNA, 27 bp, Artificial Sequence
  Description of Artificial Sequence: Synthetic oligonucleotide
ggtgctagtgagagatgcccaagaggg

SEQ ID NO: 225392 - DNA, 29 bp, Artificial Sequence
  Description of Artificial Sequence: Synthetic oligonucleotide
gtgctagtgagagatgcccaagagggaag

SEQ ID NO: 225393 - DNA, 30 bp, Artificial Sequence
  Description of Artificial Sequence: Synthetic oligonucleotide
tgctagtgagagatgcccaagagggaagtg

SEQ ID NO: 225394 - DNA, 29 bp, Artificial Sequence
  Description of Artificial Sequence: Synthetic oligonucleotide
gctagtgagagatgcccaagagggaagtg

SEQ ID NO: 225395 - DNA, 30 bp, Artificial Sequence
  Description of Artificial Sequence: Synthetic oligonucleotide
ctagtgagagatgcccaagagggaagtgtc

SEQ ID NO: 225396 - DNA, 31 bp, Artificial Sequence
  Description of Artificial Sequence: Synthetic oligonucleotide
tagtgagagatgcccaagagggaagtgtcac

SEQ ID NO: 225397 - DNA, 30 bp, Artificial Sequence
  Description of Artificial Sequence: Synthetic oligonucleotide
agtgagagatgcccaagagggaagtgtcac

SEQ ID NO: 225398 - DNA, 29 bp, Artificial Sequence
  Description of Artificial Sequence: Synthetic oligonucleotide
gtgagagatgcccaagagggaagtgtcac

SEQ ID NO: 225399 - DNA, 30 bp, Artificial Sequence
  Description of Artificial Sequence: Synthetic oligonucleotide
tgagagatgcccaagagggaagtgtcactc

SEQ ID NO: 225400 - DNA, 29 bp, Artificial Sequence
  Description of Artificial Sequence: Synthetic oligonucleotide
gagagatgcccaagagggaagtgtcactc

SEQ ID NO: 225401 - DNA, 30 bp, Artificial Sequence
  Description of Artificial Sequence: Synthetic oligonucleotide
agagatgcccaagagggaagtgtcactctg

SEQ ID NO: 225402 - DNA, 29 bp, Artificial Sequence
  Description of Artificial Sequence: Synthetic oligonucleotide
gagatgcccaagagggaagtgtcactctg

SEQ ID NO: 225403 - DNA, 29 bp, Artificial Sequence
  Description of Artificial Sequence: Synthetic oligonucleotide
agatgcccaagagggaagtgtcactctgc

SEQ ID NO: 225404 - DNA, 28 bp, Artificial Sequence
  Description of Artificial Sequence: Synthetic oligonucleotide
gatgcccaagagggaagtgtcactctgc

SEQ ID NO: 225405 - DNA, 29 bp, Artificial Sequence
  Description of Artificial Sequence: Synthetic oligonucleotide
atgcccaagagggaagtgtcactctgcag

SEQ ID NO: 225406 - DNA, 28 bp, Artificial Sequence
  Description of Artificial Sequence: Synthetic oligonucleotide
tgcccaagagggaagtgtcactctgcag

SEQ ID NO: 225407 - DNA, 27 bp, Artificial Sequence
  Description of Artificial Sequence: Synthetic oligonucleotide
gcccaagagggaagtgtcactctgcag

SEQ ID NO: 225408 - DNA, 29 bp, Artificial Sequence
  Description of Artificial Sequence: Synthetic oligonucleotide
cccaagagggaagtgtcactctgcagatc

SEQ ID NO: 225409 - DNA, 29 bp, Artificial Sequence
  Description of Artificial Sequence: Synthetic oligonucleotide
ccaagagggaagtgtcactctgcagatcc

SEQ ID NO: 225410 - DNA, 31 bp, Artificial Sequence
  Description of Artificial Sequence: Synthetic oligonucleotide
caagagggaagtgtcactctgcagatccttg

SEQ ID NO: 225411 - DNA, 32 bp, Artificial Sequence
  Description of Artificial Sequence: Synthetic oligonucleotide
aagagggaagtgtcactctgcagatccttgac

SEQ ID NO: 225412 - DNA, 31 bp, Artificial Sequence
  Description of Artificial Sequence: Synthetic oligonucleotide
agagggaagtgtcactctgcagatccttgac

SEQ ID NO: 225413 - DNA, 30 bp, Artificial Sequence
  Description of Artificial Sequence: Synthetic oligonucleotide
gagggaagtgtcactctgcagatccttgac

SEQ ID NO: 225414 - DNA, 30 bp, Artificial Sequence
  Description of Artificial Sequence: Synthetic oligonucleotide
agggaagtgtcactctgcagatccttgacg

SEQ ID NO: 225415 - DNA, 29 bp, Artificial Sequence
  Description of Artificial Sequence: Synthetic oligonucleotide
gggaagtgtcactctgcagatccttgacg

SEQ ID NO: 225416 - DNA, 30 bp, Artificial Sequence
  Description of Artificial Sequence: Synthetic oligonucleotide
ggaagtgtcactctgcagatccttgacgtg

SEQ ID NO: 225417 - DNA, 30 bp, Artificial Sequence
  Description of Artificial Sequence: Synthetic oligonucleotide
gaagtgtcactctgcagatccttgacgtgc

SEQ ID NO: 225418 - DNA, 30 bp, Artificial Sequence
  Description of Artificial Sequence: Synthetic oligonucleotide
aagtgtcactctgcagatccttgacgtgcg

SEQ ID NO: 225419 - DNA, 29 bp, Artificial Sequence
  Description of Artificial Sequence: Synthetic oligonucleotide
agtgtcactctgcagatccttgacgtgcg

SEQ ID NO: 225420 - DNA, 28 bp, Artificial Sequence
  Description of Artificial Sequence: Synthetic oligonucleotide
gtgtcactctgcagatccttgacgtgcg

SEQ ID NO: 225421 - DNA, 28 bp, Artificial Sequence
  Description of Artificial Sequence: Synthetic oligonucleotide
tgtcactctgcagatccttgacgtgcgc

SEQ ID NO: 225422 - DNA, 27 bp, Artificial Sequence
  Description of Artificial Sequence: Synthetic oligonucleotide
gtcactctgcagatccttgacgtgcgc

SEQ ID NO: 225423 - DNA, 27 bp, Artificial Sequence
  Description of Artificial Sequence: Synthetic oligonucleotide
tcactctgcagatccttgacgtgcgcc

SEQ ID NO: 225424 - DNA, 27 bp, Artificial Sequence
  Description of Artificial Sequence: Synthetic oligonucleotide
cactctgcagatccttgacgtgcgcct

SEQ ID NO: 225425 - DNA, 28 bp, Artificial Sequence
  Description of Artificial Sequence: Synthetic oligonucleotide
actctgcagatccttgacgtgcgccttg

SEQ ID NO: 225426 - DNA, 27 bp, Artificial Sequence
  Description of Artificial Sequence: Synthetic oligonucleotide
ctctgcagatccttgacgtgcgccttg

SEQ ID NO: 225427 - DNA, 28 bp, Artificial Sequence
  Description of Artificial Sequence: Synthetic oligonucleotide
tctgcagatccttgacgtgcgccttgag

SEQ ID NO: 225428 - DNA, 27 bp, Artificial Sequence
  Description of Artificial Sequence: Synthetic oligonucleotide
ctgcagatccttgacgtgcgccttgag

SEQ ID NO: 225429 - DNA, 27 bp, Artificial Sequence
  Description of Artificial Sequence: Synthetic oligonucleotide
tgcagatccttgacgtgcgccttgagg

SEQ ID NO: 225430 - DNA, 27 bp, Artificial Sequence
  Description of Artificial Sequence: Synthetic oligonucleotide
gcagatccttgacgtgcgccttgagga

SEQ ID NO: 225431 - DNA, 27 bp, Artificial Sequence
  Description of Artificial Sequence: Synthetic oligonucleotide
cagatccttgacgtgcgccttgaggac

SEQ ID NO: 225432 - DNA, 27 bp, Artificial Sequence
  Description of Artificial Sequence: Synthetic oligonucleotide
agatccttgacgtgcgccttgaggacc

SEQ ID NO: 225433 - DNA, 27 bp, Artificial Sequence
  Description of Artificial Sequence: Synthetic oligonucleotide
gatccttgacgtgcgccttgaggacca

SEQ ID NO: 225434 - DNA, 28 bp, Artificial Sequence
  Description of Artificial Sequence: Synthetic oligonucleotide
atccttgacgtgcgccttgaggaccaag

SEQ ID NO: 225435 - DNA, 27 bp, Artificial Sequence
  Description of Artificial Sequence: Synthetic oligonucleotide
tccttgacgtgcgccttgaggaccaag

SEQ ID NO: 225436 - DNA, 26 bp, Artificial Sequence
  Description of Artificial Sequence: Synthetic oligonucleotide
ccttgacgtgcgccttgaggaccaag

SEQ ID NO: 225437 - DNA, 26 bp, Artificial Sequence
  Description of Artificial Sequence: Synthetic oligonucleotide
cttgacgtgcgccttgaggaccaagg

SEQ ID NO: 225438 - DNA, 27 bp, Artificial Sequence
  Description of Artificial Sequence: Synthetic oligonucleotide
ttgacgtgcgccttgaggaccaagggt

SEQ ID NO: 225439 - DNA, 26 bp, Artificial Sequence
  Description of Artificial Sequence: Synthetic oligonucleotide
tgacgtgcgccttgaggaccaagggt

SEQ ID NO: 225440 - DNA, 25 bp, Artificial Sequence
  Description of Artificial Sequence: Synthetic oligonucleotide
gacgtgcgccttgaggaccaagggt

SEQ ID NO: 225441 - DNA, 27 bp, Artificial Sequence
  Description of Artificial Sequence: Synthetic oligonucleotide
acgtgcgccttgaggaccaagggtctt

SEQ ID NO: 225442 - DNA, 27 bp, Artificial Sequence
  Description of Artificial Sequence: Synthetic oligonucleotide
cgtgcgccttgaggaccaagggtctta

SEQ ID NO: 225443 - DNA, 27 bp, Artificial Sequence
  Description of Artificial Sequence: Synthetic oligonucleotide
gtgcgccttgaggaccaagggtcttac

SEQ ID NO: 225444 - DNA, 27 bp, Artificial Sequence
  Description of Artificial Sequence: Synthetic oligonucleotide
tgcgccttgaggaccaagggtcttacc

SEQ ID NO: 225445 - DNA, 26 bp, Artificial Sequence
  Description of Artificial Sequence: Synthetic oligonucleotide
gcgccttgaggaccaagggtcttacc

SEQ ID NO: 225446 - DNA, 27 bp, Artificial Sequence
  Description of Artificial Sequence: Synthetic oligonucleotide
cgccttgaggaccaagggtcttaccga

SEQ ID NO: 225447 - DNA, 28 bp, Artificial Sequence
  Description of Artificial Sequence: Synthetic oligonucleotide
gccttgaggaccaagggtcttaccgatg

SEQ ID NO: 225448 - DNA, 29 bp, Artificial Sequence
  Description of Artificial Sequence: Synthetic oligonucleotide
ccttgaggaccaagggtcttaccgatgtc

SEQ ID NO: 225449 - DNA, 30 bp, Artificial Sequence
  Description of Artificial Sequence: Synthetic oligonucleotide
cttgaggaccaagggtcttaccgatgtctg

SEQ ID NO: 225450 - DNA, 32 bp, Artificial Sequence
  Description of Artificial Sequence: Synthetic oligonucleotide
ttgaggaccaagggtcttaccgatgtctgatc

SEQ ID NO: 225451 - DNA, 31 bp, Artificial Sequence
  Description of Artificial Sequence: Synthetic oligonucleotide
tgaggaccaagggtcttaccgatgtctgatc

SEQ ID NO: 225452 - DNA, 30 bp, Artificial Sequence
  Description of Artificial Sequence: Synthetic oligonucleotide
gaggaccaagggtcttaccgatgtctgatc

SEQ ID NO: 225453 - DNA, 30 bp, Artificial Sequence
  Description of Artificial Sequence: Synthetic oligonucleotide
aggaccaagggtcttaccgatgtctgatcc

SEQ ID NO: 225454 - DNA, 29 bp, Artificial Sequence
  Description of Artificial Sequence: Synthetic oligonucleotide
ggaccaagggtcttaccgatgtctgatcc

SEQ ID NO: 225455 - DNA, 31 bp, Artificial Sequence
  Description of Artificial Sequence: Synthetic oligonucleotide
gaccaagggtcttaccgatgtctgatccaag

SEQ ID NO: 225456 - DNA, 33 bp, Artificial Sequence
  Description of Artificial Sequence: Synthetic oligonucleotide
accaagggtcttaccgatgtctgatccaagttg

SEQ ID NO: 225457 - DNA, 32 bp, Artificial Sequence
  Description of Artificial Sequence: Synthetic oligonucleotide
ccaagggtcttaccgatgtctgatccaagttg

SEQ ID NO: 225458 - DNA, 32 bp, Artificial Sequence
  Description of Artificial Sequence: Synthetic oligonucleotide
caagggtcttaccgatgtctgatccaagttgg

SEQ ID NO: 225459 - DNA, 36 bp, Artificial Sequence
  Description of Artificial Sequence: Synthetic oligonucleotide
aagggtcttaccgatgtctgatccaagttggaaatc

SEQ ID NO: 225460 - DNA, 35 bp, Artificial Sequence
  Description of Artificial Sequence: Synthetic oligonucleotide
agggtcttaccgatgtctgatccaagttggaaatc

SEQ ID NO: 225461 - DNA, 34 bp, Artificial Sequence
  Description of Artificial Sequence: Synthetic oligonucleotide
gggtcttaccgatgtctgatccaagttggaaatc

SEQ ID NO: 225462 - DNA, 35 bp, Artificial Sequence
  Description of Artificial Sequence: Synthetic oligonucleotide
ggtcttaccgatgtctgatccaagttggaaatctg

SEQ ID NO: 225463 - DNA, 36 bp, Artificial Sequence
  Description of Artificial Sequence: Synthetic oligonucleotide
gtcttaccgatgtctgatccaagttggaaatctgag

SEQ ID NO: 225464 - DNA, 40 bp, Artificial Sequence
  Description of Artificial Sequence: Synthetic oligonucleotide
tcttaccgatgtctgatccaagttggaaatctgagtaaag

SEQ ID NO: 225465 - DNA, 39 bp, Artificial Sequence
  Description of Artificial Sequence: Synthetic oligonucleotide
cttaccgatgtctgatccaagttggaaatctgagtaaag

SEQ ID NO: 225466 - DNA, 40 bp, Artificial Sequence
  Description of Artificial Sequence: Synthetic oligonucleotide
ttaccgatgtctgatccaagttggaaatctgagtaaagag

SEQ ID NO: 225467 - DNA, 39 bp, Artificial Sequence
  Description of Artificial Sequence: Synthetic oligonucleotide
taccgatgtctgatccaagttggaaatctgagtaaagag

SEQ ID NO: 225468 - DNA, 38 bp, Artificial Sequence
  Description of Artificial Sequence: Synthetic oligonucleotide
accgatgtctgatccaagttggaaatctgagtaaagag

SEQ ID NO: 225469 - DNA, 37 bp, Artificial Sequence
  Description of Artificial Sequence: Synthetic oligonucleotide
ccgatgtctgatccaagttggaaatctgagtaaagag

SEQ ID NO: 225470 - DNA, 37 bp, Artificial Sequence
  Description of Artificial Sequence: Synthetic oligonucleotide
cgatgtctgatccaagttggaaatctgagtaaagagg

SEQ ID NO: 225471 - DNA, 38 bp, Artificial Sequence
  Description of Artificial Sequence: Synthetic oligonucleotide
gatgtctgatccaagttggaaatctgagtaaagaggac

SEQ ID NO: 225472 - DNA, 39 bp, Artificial Sequence
  Description of Artificial Sequence: Synthetic oligonucleotide
atgtctgatccaagttggaaatctgagtaaagaggacac

SEQ ID NO: 225473 - DNA, 38 bp, Artificial Sequence
  Description of Artificial Sequence: Synthetic oligonucleotide
tgtctgatccaagttggaaatctgagtaaagaggacac

SEQ ID NO: 225474 - DNA, 37 bp, Artificial Sequence
  Description of Artificial Sequence: Synthetic oligonucleotide
gtctgatccaagttggaaatctgagtaaagaggacac

SEQ ID NO: 225475 - DNA, 37 bp, Artificial Sequence
  Description of Artificial Sequence: Synthetic oligonucleotide
tctgatccaagttggaaatctgagtaaagaggacacc

SEQ ID NO: 225476 - DNA, 36 bp, Artificial Sequence
  Description of Artificial Sequence: Synthetic oligonucleotide
ctgatccaagttggaaatctgagtaaagaggacacc

SEQ ID NO: 225477 - DNA, 36 bp, Artificial Sequence
  Description of Artificial Sequence: Synthetic oligonucleotide
tgatccaagttggaaatctgagtaaagaggacaccg

SEQ ID NO: 225478 - DNA, 35 bp, Artificial Sequence
  Description of Artificial Sequence: Synthetic oligonucleotide
gatccaagttggaaatctgagtaaagaggacaccg

SEQ ID NO: 225479 - DNA, 36 bp, Artificial Sequence
  Description of Artificial Sequence: Synthetic oligonucleotide
atccaagttggaaatctgagtaaagaggacaccgtg

SEQ ID NO: 225480 - DNA, 35 bp, Artificial Sequence
  Description of Artificial Sequence: Synthetic oligonucleotide
tccaagttggaaatctgagtaaagaggacaccgtg

SEQ ID NO: 225481 - DNA, 34 bp, Artificial Sequence
  Description of Artificial Sequence: Synthetic oligonucleotide
ccaagttggaaatctgagtaaagaggacaccgtg

SEQ ID NO: 225482 - DNA, 36 bp, Artificial Sequence
  Description of Artificial Sequence: Synthetic oligonucleotide
caagttggaaatctgagtaaagaggacaccgtgatc

SEQ ID NO: 225483 - DNA, 36 bp, Artificial Sequence
  Description of Artificial Sequence: Synthetic oligonucleotide
aagttggaaatctgagtaaagaggacaccgtgatcc

SEQ ID NO: 225484 - DNA, 35 bp, Artificial Sequence
  Description of Artificial Sequence: Synthetic oligonucleotide
agttggaaatctgagtaaagaggacaccgtgatcc

SEQ ID NO: 225485 - DNA, 34 bp, Artificial Sequence
  Description of Artificial Sequence: Synthetic oligonucleotide
gttggaaatctgagtaaagaggacaccgtgatcc

SEQ ID NO: 225486 - DNA, 35 bp, Artificial Sequence
  Description of Artificial Sequence: Synthetic oligonucleotide
ttggaaatctgagtaaagaggacaccgtgatcctg

SEQ ID NO: 225487 - DNA, 34 bp, Artificial Sequence
  Description of Artificial Sequence: Synthetic oligonucleotide
tggaaatctgagtaaagaggacaccgtgatcctg

SEQ ID NO: 225488 - DNA, 33 bp, Artificial Sequence
  Description of Artificial Sequence: Synthetic oligonucleotide
ggaaatctgagtaaagaggacaccgtgatcctg

SEQ ID NO: 225489 - DNA, 33 bp, Artificial Sequence
  Description of Artificial Sequence: Synthetic oligonucleotide
gaaatctgagtaaagaggacaccgtgatcctgc

SEQ ID NO: 225490 - DNA, 34 bp, Artificial Sequence
  Description of Artificial Sequence: Synthetic oligonucleotide
aaatctgagtaaagaggacaccgtgatcctgcag

SEQ ID NO: 225491 - DNA, 33 bp, Artificial Sequence
  Description of Artificial Sequence: Synthetic oligonucleotide
aatctgagtaaagaggacaccgtgatcctgcag

SEQ ID NO: 225492 - DNA, 32 bp, Artificial Sequence
  Description of Artificial Sequence: Synthetic oligonucleotide
atctgagtaaagaggacaccgtgatcctgcag

SEQ ID NO: 225493 - DNA, 31 bp, Artificial Sequence
  Description of Artificial Sequence: Synthetic oligonucleotide
tctgagtaaagaggacaccgtgatcctgcag

SEQ ID NO: 225494 - DNA, 30 bp, Artificial Sequence
  Description of Artificial Sequence: Synthetic oligonucleotide
ctgagtaaagaggacaccgtgatcctgcag

SEQ ID NO: 225495 - DNA, 30 bp, Artificial Sequence
  Description of Artificial Sequence: Synthetic oligonucleotide
tgagtaaagaggacaccgtgatcctgcagg

SEQ ID NO: 225496 - DNA, 29 bp, Artificial Sequence
  Description of Artificial Sequence: Synthetic oligonucleotide
gagtaaagaggacaccgtgatcctgcagg

SEQ ID NO: 225497 - DNA, 31 bp, Artificial Sequence
  Description of Artificial Sequence: Synthetic oligonucleotide
agtaaagaggacaccgtgatcctgcaggttg

SEQ ID NO: 225498 - DNA, 30 bp, Artificial Sequence
  Description of Artificial Sequence: Synthetic oligonucleotide
gtaaagaggacaccgtgatcctgcaggttg

SEQ ID NO: 225499 - DNA, 30 bp, Artificial Sequence
  Description of Artificial Sequence: Synthetic oligonucleotide
taaagaggacaccgtgatcctgcaggttgc

SEQ ID NO: 225500 - DNA, 29 bp, Artificial Sequence
  Description of Artificial Sequence: Synthetic oligonucleotide
aaagaggacaccgtgatcctgcaggttgc

SEQ ID NO: 225501 - DNA, 28 bp, Artificial Sequence
  Description of Artificial Sequence: Synthetic oligonucleotide
aagaggacaccgtgatcctgcaggttgc

SEQ ID NO: 225502 - DNA, 27 bp, Artificial Sequence
  Description of Artificial Sequence: Synthetic oligonucleotide
agaggacaccgtgatcctgcaggttgc

SEQ ID NO: 225503 - DNA, 27 bp, Artificial Sequence
  Description of Artificial Sequence: Synthetic oligonucleotide
gaggacaccgtgatcctgcaggttgca

SEQ ID NO: 225504 - DNA, 27 bp, Artificial Sequence
  Description of Artificial Sequence: Synthetic oligonucleotide
aggacaccgtgatcctgcaggttgcag

SEQ ID NO: 225505 - DNA, 26 bp, Artificial Sequence
  Description of Artificial Sequence: Synthetic oligonucleotide
ggacaccgtgatcctgcaggttgcag

SEQ ID NO: 225506 - DNA, 26 bp, Artificial Sequence
  Description of Artificial Sequence: Synthetic oligonucleotide
gacaccgtgatcctgcaggttgcagc

SEQ ID NO: 225507 - DNA, 26 bp, Artificial Sequence
  Description of Artificial Sequence: Synthetic oligonucleotide
acaccgtgatcctgcaggttgcagcc

SEQ ID NO: 225508 - DNA, 25 bp, Artificial Sequence
  Description of Artificial Sequence: Synthetic oligonucleotide
caccgtgatcctgcaggttgcagcc

SEQ ID NO: 225509 - DNA, 25 bp, Artificial Sequence
  Description of Artificial Sequence: Synthetic oligonucleotide
accgtgatcctgcaggttgcagccc

SEQ ID NO: 225510 - DNA, 24 bp, Artificial Sequence
  Description of Artificial Sequence: Synthetic oligonucleotide
ccgtgatcctgcaggttgcagccc

SEQ ID NO: 225511 - DNA, 26 bp, Artificial Sequence
  Description of Artificial Sequence: Synthetic oligonucleotide
cgtgatcctgcaggttgcagccccat

SEQ ID NO: 225512 - DNA, 27 bp, Artificial Sequence
  Description of Artificial Sequence: Synthetic oligonucleotide
gtgatcctgcaggttgcagccccatct

SEQ ID NO: 225513 - DNA, 27 bp, Artificial Sequence
  Description of Artificial Sequence: Synthetic oligonucleotide
tgatcctgcaggttgcagccccatctg

SEQ ID NO: 225514 - DNA, 27 bp, Artificial Sequence
  Description of Artificial Sequence: Synthetic oligonucleotide
gatcctgcaggttgcagccccatctgt

SEQ ID NO: 225515 - DNA, 27 bp, Artificial Sequence
  Description of Artificial Sequence: Synthetic oligonucleotide
atcctgcaggttgcagccccatctgtg

SEQ ID NO: 225516 - DNA, 26 bp, Artificial Sequence
  Description of Artificial Sequence: Synthetic oligonucleotide
tcctgcaggttgcagccccatctgtg

SEQ ID NO: 225517 - DNA, 25 bp, Artificial Sequence
  Description of Artificial Sequence: Synthetic oligonucleotide
cctgcaggttgcagccccatctgtg

SEQ ID NO: 225518 - DNA, 25 bp, Artificial Sequence
  Description of Artificial Sequence: Synthetic oligonucleotide
ctgcaggttgcagccccatctgtgg

SEQ ID NO: 225519 - DNA, 25 bp, Artificial Sequence
  Description of Artificial Sequence: Synthetic oligonucleotide
tgcaggttgcagccccatctgtggg

SEQ ID NO: 225520 - DNA, 24 bp, Artificial Sequence
  Description of Artificial Sequence: Synthetic oligonucleotide
gcaggttgcagccccatctgtggg

SEQ ID NO: 225521 - DNA, 25 bp, Artificial Sequence
  Description of Artificial Sequence: Synthetic oligonucleotide
caggttgcagccccatctgtgggga

SEQ ID NO: 225522 - DNA, 26 bp, Artificial Sequence
  Description of Artificial Sequence: Synthetic oligonucleotide
aggttgcagccccatctgtggggagt

SEQ ID NO: 225523 - DNA, 25 bp, Artificial Sequence
  Description of Artificial Sequence: Synthetic oligonucleotide
ggttgcagccccatctgtggggagt

SEQ ID NO: 225524 - DNA, 26 bp, Artificial Sequence
  Description of Artificial Sequence: Synthetic oligonucleotide
gttgcagccccatctgtggggagtct

SEQ ID NO: 225525 - DNA, 27 bp, Artificial Sequence
  Description of Artificial Sequence: Synthetic oligonucleotide
ttgcagccccatctgtggggagtctct

SEQ ID NO: 225526 - DNA, 26 bp, Artificial Sequence
  Description of Artificial Sequence: Synthetic oligonucleotide
tgcagccccatctgtggggagtctct

SEQ ID NO: 225527 - DNA, 25 bp, Artificial Sequence
  Description of Artificial Sequence: Synthetic oligonucleotide
gcagccccatctgtggggagtctct

SEQ ID NO: 225528 - DNA, 25 bp, Artificial Sequence
  Description of Artificial Sequence: Synthetic oligonucleotide
cagccccatctgtggggagtctctc

SEQ ID NO: 225529 - DNA, 25 bp, Artificial Sequence
  Description of Artificial Sequence: Synthetic oligonucleotide
agccccatctgtggggagtctctcc

SEQ ID NO: 225530 - DNA, 24 bp, Artificial Sequence
  Description of Artificial Sequence: Synthetic oligonucleotide
gccccatctgtggggagtctctcc

SEQ ID NO: 225531 - DNA, 24 bp, Artificial Sequence
  Description of Artificial Sequence: Synthetic oligonucleotide
ccccatctgtggggagtctctccc

SEQ ID NO: 225532 - DNA, 24 bp, Artificial Sequence
  Description of Artificial Sequence: Synthetic oligonucleotide
cccatctgtggggagtctctcccc

SEQ ID NO: 225533 - DNA, 25 bp, Artificial Sequence
  Description of Artificial Sequence: Synthetic oligonucleotide
ccatctgtggggagtctctccccct

SEQ ID NO: 225534 - DNA, 26 bp, Artificial Sequence
  Description of Artificial Sequence: Synthetic oligonucleotide
catctgtggggagtctctccccctca

SEQ ID NO: 225535 - DNA, 26 bp, Artificial Sequence
  Description of Artificial Sequence: Synthetic oligonucleotide
atctgtggggagtctctccccctcag

SEQ ID NO: 225536 - DNA, 25 bp, Artificial Sequence
  Description of Artificial Sequence: Synthetic oligonucleotide
tctgtggggagtctctccccctcag

SEQ ID NO: 225537 - DNA, 24 bp, Artificial Sequence
  Description of Artificial Sequence: Synthetic oligonucleotide
ctgtggggagtctctccccctcag

SEQ ID NO: 225538 - DNA, 25 bp, Artificial Sequence
  Description of Artificial Sequence: Synthetic oligonucleotide
tgtggggagtctctccccctcagca

SEQ ID NO: 225539 - DNA, 24 bp, Artificial Sequence
  Description of Artificial Sequence: Synthetic oligonucleotide
gtggggagtctctccccctcagca

SEQ ID NO: 225540 - DNA, 25 bp, Artificial Sequence
  Description of Artificial Sequence: Synthetic oligonucleotide
tggggagtctctccccctcagcagt

SEQ ID NO: 225541 - DNA, 24 bp, Artificial Sequence
  Description of Artificial Sequence: Synthetic oligonucleotide
ggggagtctctccccctcagcagt

SEQ ID NO: 225542 - DNA, 24 bp, Artificial Sequence
  Description of Artificial Sequence: Synthetic oligonucleotide
gggagtctctccccctcagcagtg

SEQ ID NO: 225543 - DNA, 24 bp, Artificial Sequence
  Description of Artificial Sequence: Synthetic oligonucleotide
ggagtctctccccctcagcagtgg

SEQ ID NO: 225544 - DNA, 25 bp, Artificial Sequence
  Description of Artificial Sequence: Synthetic oligonucleotide
gagtctctccccctcagcagtggct

SEQ ID NO: 225545 - DNA, 26 bp, Artificial Sequence
  Description of Artificial Sequence: Synthetic oligonucleotide
agtctctccccctcagcagtggctct

SEQ ID NO: 225546 - DNA, 25 bp, Artificial Sequence
  Description of Artificial Sequence: Synthetic oligonucleotide
gtctctccccctcagcagtggctct

SEQ ID NO: 225547 - DNA, 25 bp, Artificial Sequence
  Description of Artificial Sequence: Synthetic oligonucleotide
tctctccccctcagcagtggctctg

SEQ ID NO: 225548 - DNA, 24 bp, Artificial Sequence
  Description of Artificial Sequence: Synthetic oligonucleotide
ctctccccctcagcagtggctctg

SEQ ID NO: 225549 - DNA, 24 bp, Artificial Sequence
  Description of Artificial Sequence: Synthetic oligonucleotide
tctccccctcagcagtggctctgg

SEQ ID NO: 225550 - DNA, 23 bp, Artificial Sequence
  Description of Artificial Sequence: Synthetic oligonucleotide
ctccccctcagcagtggctctgg

SEQ ID NO: 225551 - DNA, 24 bp, Artificial Sequence
  Description of Artificial Sequence: Synthetic oligonucleotide
tccccctcagcagtggctctggct

SEQ ID NO: 225552 - DNA, 23 bp, Artificial Sequence
  Description of Artificial Sequence: Synthetic oligonucleotide
ccccctcagcagtggctctggct

SEQ ID NO: 225553 - DNA, 24 bp, Artificial Sequence
  Description of Artificial Sequence: Synthetic oligonucleotide
cccctcagcagtggctctggctgt

SEQ ID NO: 225554 - DNA, 26 bp, Artificial Sequence
  Description of Artificial Sequence: Synthetic oligonucleotide
ccctcagcagtggctctggctgtgat

SEQ ID NO: 225555 - DNA, 26 bp, Artificial Sequence
  Description of Artificial Sequence: Synthetic oligonucleotide
cctcagcagtggctctggctgtgatc

SEQ ID NO: 225556 - DNA, 27 bp, Artificial Sequence
  Description of Artificial Sequence: Synthetic oligonucleotide
ctcagcagtggctctggctgtgatcct

SEQ ID NO: 225557 - DNA, 27 bp, Artificial Sequence
  Description of Artificial Sequence: Synthetic oligonucleotide
tcagcagtggctctggctgtgatcctg

SEQ ID NO: 225558 - DNA, 26 bp, Artificial Sequence
  Description of Artificial Sequence: Synthetic oligonucleotide
cagcagtggctctggctgtgatcctg

SEQ ID NO: 225559 - DNA, 26 bp, Artificial Sequence
  Description of Artificial Sequence: Synthetic oligonucleotide
agcagtggctctggctgtgatcctgc

SEQ ID NO: 225560 - DNA, 25 bp, Artificial Sequence
  Description of Artificial Sequence: Synthetic oligonucleotide
gcagtggctctggctgtgatcctgc

SEQ ID NO: 225561 - DNA, 26 bp, Artificial Sequence
  Description of Artificial Sequence: Synthetic oligonucleotide
cagtggctctggctgtgatcctgcct

SEQ ID NO: 225562 - DNA, 27 bp, Artificial Sequence
  Description of Artificial Sequence: Synthetic oligonucleotide
agtggctctggctgtgatcctgcctgt

SEQ ID NO: 225563 - DNA, 26 bp, Artificial Sequence
  Description of Artificial Sequence: Synthetic oligonucleotide
gtggctctggctgtgatcctgcctgt

SEQ ID NO: 225564 - DNA, 26 bp, Artificial Sequence
  Description of Artificial Sequence: Synthetic oligonucleotide
tggctctggctgtgatcctgcctgtc

SEQ ID NO: 225565 - DNA, 25 bp, Artificial Sequence
  Description of Artificial Sequence: Synthetic oligonucleotide
ggctctggctgtgatcctgcctgtc

SEQ ID NO: 225566 - DNA, 26 bp, Artificial Sequence
  Description of Artificial Sequence: Synthetic oligonucleotide
gctctggctgtgatcctgcctgtcct

SEQ ID NO: 225567 - DNA, 26 bp, Artificial Sequence
  Description of Artificial Sequence: Synthetic oligonucleotide
ctctggctgtgatcctgcctgtcctg

SEQ ID NO: 225568 - DNA, 27 bp, Artificial Sequence
  Description of Artificial Sequence: Synthetic oligonucleotide
tctggctgtgatcctgcctgtcctggt

SEQ ID NO: 225569 - DNA, 27 bp, Artificial Sequence
  Description of Artificial Sequence: Synthetic oligonucleotide
ctggctgtgatcctgcctgtcctggta

SEQ ID NO: 225570 - DNA, 27 bp, Artificial Sequence
  Description of Artificial Sequence: Synthetic oligonucleotide
tggctgtgatcctgcctgtcctggtac

SEQ ID NO: 225571 - DNA, 27 bp, Artificial Sequence
  Description of Artificial Sequence: Synthetic oligonucleotide
ggctgtgatcctgcctgtcctggtact

SEQ ID NO: 225572 - DNA, 28 bp, Artificial Sequence
  Description of Artificial Sequence: Synthetic oligonucleotide
gctgtgatcctgcctgtcctggtacttc

SEQ ID NO: 225573 - DNA, 29 bp, Artificial Sequence
  Description of Artificial Sequence: Synthetic oligonucleotide
ctgtgatcctgcctgtcctggtacttctc

SEQ ID NO: 225574 - DNA, 31 bp, Artificial Sequence
  Description of Artificial Sequence: Synthetic oligonucleotide
tgtgatcctgcctgtcctggtacttctcatc

SEQ ID NO: 225575 - DNA, 30 bp, Artificial Sequence
  Description of Artificial Sequence: Synthetic oligonucleotide
gtgatcctgcctgtcctggtacttctcatc

SEQ ID NO: 225576 - DNA, 32 bp, Artificial Sequence
  Description of Artificial Sequence: Synthetic oligonucleotide
tgatcctgcctgtcctggtacttctcatcatg

SEQ ID NO: 225577 - DNA, 31 bp, Artificial Sequence
  Description of Artificial Sequence: Synthetic oligonucleotide
gatcctgcctgtcctggtacttctcatcatg

SEQ ID NO: 225578 - DNA, 31 bp, Artificial Sequence
  Description of Artificial Sequence: Synthetic oligonucleotide
atcctgcctgtcctggtacttctcatcatgg

SEQ ID NO: 225579 - DNA, 30 bp, Artificial Sequence
  Description of Artificial Sequence: Synthetic oligonucleotide
tcctgcctgtcctggtacttctcatcatgg

SEQ ID NO: 225580 - DNA, 29 bp, Artificial Sequence
  Description of Artificial Sequence: Synthetic oligonucleotide
cctgcctgtcctggtacttctcatcatgg

SEQ ID NO: 225581 - DNA, 30 bp, Artificial Sequence
  Description of Artificial Sequence: Synthetic oligonucleotide
ctgcctgtcctggtacttctcatcatggtg

SEQ ID NO: 225582 - DNA, 31 bp, Artificial Sequence
  Description of Artificial Sequence: Synthetic oligonucleotide
tgcctgtcctggtacttctcatcatggtgtg

SEQ ID NO: 225583 - DNA, 30 bp, Artificial Sequence
  Description of Artificial Sequence: Synthetic oligonucleotide
gcctgtcctggtacttctcatcatggtgtg

SEQ ID NO: 225584 - DNA, 30 bp, Artificial Sequence
  Description of Artificial Sequence: Synthetic oligonucleotide
cctgtcctggtacttctcatcatggtgtgc

SEQ ID NO: 225585 - DNA, 30 bp, Artificial Sequence
  Description of Artificial Sequence: Synthetic oligonucleotide
ctgtcctggtacttctcatcatggtgtgcc

SEQ ID NO: 225586 - DNA, 33 bp, Artificial Sequence
  Description of Artificial Sequence: Synthetic oligonucleotide
tgtcctggtacttctcatcatggtgtgcctttg

SEQ ID NO: 225587 - DNA, 32 bp, Artificial Sequence
  Description of Artificial Sequence: Synthetic oligonucleotide
gtcctggtacttctcatcatggtgtgcctttg

SEQ ID NO: 225588 - DNA, 32 bp, Artificial Sequence
  Description of Artificial Sequence: Synthetic oligonucleotide
tcctggtacttctcatcatggtgtgcctttgc

SEQ ID NO: 225589 - DNA, 31 bp, Artificial Sequence
  Description of Artificial Sequence: Synthetic oligonucleotide
cctggtacttctcatcatggtgtgcctttgc

SEQ ID NO: 225590 - DNA, 31 bp, Artificial Sequence
  Description of Artificial Sequence: Synthetic oligonucleotide
ctggtacttctcatcatggtgtgcctttgcc

SEQ ID NO: 225591 - DNA, 35 bp, Artificial Sequence
  Description of Artificial Sequence: Synthetic oligonucleotide
tggtacttctcatcatggtgtgcctttgccttatc

SEQ ID NO: 225592 - DNA, 34 bp, Artificial Sequence
  Description of Artificial Sequence: Synthetic oligonucleotide
ggtacttctcatcatggtgtgcctttgccttatc

SEQ ID NO: 225593 - DNA, 35 bp, Artificial Sequence
  Description of Artificial Sequence: Synthetic oligonucleotide
gtacttctcatcatggtgtgcctttgccttatctg

SEQ ID NO: 225594 - DNA, 35 bp, Artificial Sequence
  Description of Artificial Sequence: Synthetic oligonucleotide
tacttctcatcatggtgtgcctttgccttatctgg

SEQ ID NO: 225595 - DNA, 34 bp, Artificial Sequence
  Description of Artificial Sequence: Synthetic oligonucleotide
acttctcatcatggtgtgcctttgccttatctgg

SEQ ID NO: 225596 - DNA, 33 bp, Artificial Sequence
  Description of Artificial Sequence: Synthetic oligonucleotide
cttctcatcatggtgtgcctttgccttatctgg

SEQ ID NO: 225597 - DNA, 35 bp, Artificial Sequence
  Description of Artificial Sequence: Synthetic oligonucleotide
ttctcatcatggtgtgcctttgccttatctggaag

SEQ ID NO: 225598 - DNA, 34 bp, Artificial Sequence
  Description of Artificial Sequence: Synthetic oligonucleotide
tctcatcatggtgtgcctttgccttatctggaag

SEQ ID NO: 225599 - DNA, 33 bp, Artificial Sequence
  Description of Artificial Sequence: Synthetic oligonucleotide
ctcatcatggtgtgcctttgccttatctggaag

SEQ ID NO: 225600 - DNA, 33 bp, Artificial Sequence
  Description of Artificial Sequence: Synthetic oligonucleotide
tcatcatggtgtgcctttgccttatctggaagc

SEQ ID NO: 225601 - DNA, 32 bp, Artificial Sequence
  Description of Artificial Sequence: Synthetic oligonucleotide
catcatggtgtgcctttgccttatctggaagc

SEQ ID NO: 225602 - DNA, 35 bp, Artificial Sequence
  Description of Artificial Sequence: Synthetic oligonucleotide
atcatggtgtgcctttgccttatctggaagcaaag

SEQ ID NO: 225603 - DNA, 34 bp, Artificial Sequence
  Description of Artificial Sequence: Synthetic oligonucleotide
tcatggtgtgcctttgccttatctggaagcaaag

SEQ ID NO: 225604 - DNA, 33 bp, Artificial Sequence
  Description of Artificial Sequence: Synthetic oligonucleotide
catggtgtgcctttgccttatctggaagcaaag

SEQ ID NO: 225605 - DNA, 35 bp, Artificial Sequence
  Description of Artificial Sequence: Synthetic oligonucleotide
atggtgtgcctttgccttatctggaagcaaagaag

SEQ ID NO: 225606 - DNA, 34 bp, Artificial Sequence
  Description of Artificial Sequence: Synthetic oligonucleotide
tggtgtgcctttgccttatctggaagcaaagaag

SEQ ID NO: 225607 - DNA, 33 bp, Artificial Sequence
  Description of Artificial Sequence: Synthetic oligonucleotide
ggtgtgcctttgccttatctggaagcaaagaag

SEQ ID NO: 225608 - DNA, 34 bp, Artificial Sequence
  Description of Artificial Sequence: Synthetic oligonucleotide
gtgtgcctttgccttatctggaagcaaagaagag

SEQ ID NO: 225609 - DNA, 34 bp, Artificial Sequence
  Description of Artificial Sequence: Synthetic oligonucleotide
tgtgcctttgccttatctggaagcaaagaagagc

SEQ ID NO: 225610 - DNA, 33 bp, Artificial Sequence
  Description of Artificial Sequence: Synthetic oligonucleotide
gtgcctttgccttatctggaagcaaagaagagc

SEQ ID NO: 225611 - DNA, 37 bp, Artificial Sequence
  Description of Artificial Sequence: Synthetic oligonucleotide
tgcctttgccttatctggaagcaaagaagagcaaaag

SEQ ID NO: 225612 - DNA, 36 bp, Artificial Sequence
  Description of Artificial Sequence: Synthetic oligonucleotide
gcctttgccttatctggaagcaaagaagagcaaaag

SEQ ID NO: 225613 - DNA, 40 bp, Artificial Sequence
  Description of Artificial Sequence: Synthetic oligonucleotide
cctttgccttatctggaagcaaagaagagcaaaagaaaag

SEQ ID NO: 225614 - DNA, 40 bp, Artificial Sequence
  Description of Artificial Sequence: Synthetic oligonucleotide
ctttgccttatctggaagcaaagaagagcaaaagaaaagc

SEQ ID NO: 225615 - DNA, 42 bp, Artificial Sequence
  Description of Artificial Sequence: Synthetic oligonucleotide
tttgccttatctggaagcaaagaagagcaaaagaaaagcttc

SEQ ID NO: 225616 - DNA, 41 bp, Artificial Sequence
  Description of Artificial Sequence: Synthetic oligonucleotide
ttgccttatctggaagcaaagaagagcaaaagaaaagcttc

SEQ ID NO: 225617 - DNA, 40 bp, Artificial Sequence
  Description of Artificial Sequence: Synthetic oligonucleotide
tgccttatctggaagcaaagaagagcaaaagaaaagcttc

SEQ ID NO: 225618 - DNA, 39 bp, Artificial Sequence
  Description of Artificial Sequence: Synthetic oligonucleotide
gccttatctggaagcaaagaagagcaaaagaaaagcttc

SEQ ID NO: 225619 - DNA, 40 bp, Artificial Sequence
  Description of Artificial Sequence: Synthetic oligonucleotide
ccttatctggaagcaaagaagagcaaaagaaaagcttctc

SEQ ID NO: 225620 - DNA, 43 bp, Artificial Sequence
  Description of Artificial Sequence: Synthetic oligonucleotide
cttatctggaagcaaagaagagcaaaagaaaagcttctctatg

SEQ ID NO: 225621 - DNA, 45 bp, Artificial Sequence
  Description of Artificial Sequence: Synthetic oligonucleotide
ttatctggaagcaaagaagagcaaaagaaaagcttctctatgaac

SEQ ID NO: 225622 - DNA, 44 bp, Artificial Sequence
  Description of Artificial Sequence: Synthetic oligonucleotide
tatctggaagcaaagaagagcaaaagaaaagcttctctatgaac

SEQ ID NO: 225623 - DNA, 43 bp, Artificial Sequence
  Description of Artificial Sequence: Synthetic oligonucleotide
atctggaagcaaagaagagcaaaagaaaagcttctctatgaac

SEQ ID NO: 225624 - DNA, 42 bp, Artificial Sequence
  Description of Artificial Sequence: Synthetic oligonucleotide
tctggaagcaaagaagagcaaaagaaaagcttctctatgaac

SEQ ID NO: 225625 - DNA, 41 bp, Artificial Sequence
  Description of Artificial Sequence: Synthetic oligonucleotide
ctggaagcaaagaagagcaaaagaaaagcttctctatgaac

SEQ ID NO: 225626 - DNA, 43 bp, Artificial Sequence
  Description of Artificial Sequence: Synthetic oligonucleotide
tggaagcaaagaagagcaaaagaaaagcttctctatgaacatg

SEQ ID NO: 225627 - DNA, 42 bp, Artificial Sequence
  Description of Artificial Sequence: Synthetic oligonucleotide
ggaagcaaagaagagcaaaagaaaagcttctctatgaacatg

SEQ ID NO: 225628 - DNA, 43 bp, Artificial Sequence
  Description of Artificial Sequence: Synthetic oligonucleotide
gaagcaaagaagagcaaaagaaaagcttctctatgaacatgtg

SEQ ID NO: 225629 - DNA, 44 bp, Artificial Sequence
  Description of Artificial Sequence: Synthetic oligonucleotide
aagcaaagaagagcaaaagaaaagcttctctatgaacatgtgac

SEQ ID NO: 225630 - DNA, 43 bp, Artificial Sequence
  Description of Artificial Sequence: Synthetic oligonucleotide
agcaaagaagagcaaaagaaaagcttctctatgaacatgtgac

SEQ ID NO: 225631 - DNA, 42 bp, Artificial Sequence
  Description of Artificial Sequence: Synthetic oligonucleotide
gcaaagaagagcaaaagaaaagcttctctatgaacatgtgac

SEQ ID NO: 225632 - DNA, 42 bp, Artificial Sequence
  Description of Artificial Sequence: Synthetic oligonucleotide
caaagaagagcaaaagaaaagcttctctatgaacatgtgacg

SEQ ID NO: 225633 - DNA, 42 bp, Artificial Sequence
  Description of Artificial Sequence: Synthetic oligonucleotide
aaagaagagcaaaagaaaagcttctctatgaacatgtgacgg

SEQ ID NO: 225634 - DNA, 41 bp, Artificial Sequence
  Description of Artificial Sequence: Synthetic oligonucleotide
aagaagagcaaaagaaaagcttctctatgaacatgtgacgg

SEQ ID NO: 225635 - DNA, 40 bp, Artificial Sequence
  Description of Artificial Sequence: Synthetic oligonucleotide
agaagagcaaaagaaaagcttctctatgaacatgtgacgg

SEQ ID NO: 225636 - DNA, 39 bp, Artificial Sequence
  Description of Artificial Sequence: Synthetic oligonucleotide
gaagagcaaaagaaaagcttctctatgaacatgtgacgg

SEQ ID NO: 225637 - DNA, 40 bp, Artificial Sequence
  Description of Artificial Sequence: Synthetic oligonucleotide
aagagcaaaagaaaagcttctctatgaacatgtgacggag

SEQ ID NO: 225638 - DNA, 39 bp, Artificial Sequence
  Description of Artificial Sequence: Synthetic oligonucleotide
agagcaaaagaaaagcttctctatgaacatgtgacggag

SEQ ID NO: 225639 - DNA, 38 bp, Artificial Sequence
  Description of Artificial Sequence: Synthetic oligonucleotide
gagcaaaagaaaagcttctctatgaacatgtgacggag

SEQ ID NO: 225640 - DNA, 38 bp, Artificial Sequence
  Description of Artificial Sequence: Synthetic oligonucleotide
agcaaaagaaaagcttctctatgaacatgtgacggagg

SEQ ID NO: 225641 - DNA, 37 bp, Artificial Sequence
  Description of Artificial Sequence: Synthetic oligonucleotide
gcaaaagaaaagcttctctatgaacatgtgacggagg

SEQ ID NO: 225642 - DNA, 38 bp, Artificial Sequence
  Description of Artificial Sequence: Synthetic oligonucleotide
caaaagaaaagcttctctatgaacatgtgacggaggtg

SEQ ID NO: 225643 - DNA, 38 bp, Artificial Sequence
  Description of Artificial Sequence: Synthetic oligonucleotide
aaaagaaaagcttctctatgaacatgtgacggaggtgg

SEQ ID NO: 225644 - DNA, 37 bp, Artificial Sequence
  Description of Artificial Sequence: Synthetic oligonucleotide
aaagaaaagcttctctatgaacatgtgacggaggtgg

SEQ ID NO: 225645 - DNA, 36 bp, Artificial Sequence
  Description of Artificial Sequence: Synthetic oligonucleotide
aagaaaagcttctctatgaacatgtgacggaggtgg

SEQ ID NO: 225646 - DNA, 35 bp, Artificial Sequence
  Description of Artificial Sequence: Synthetic oligonucleotide
agaaaagcttctctatgaacatgtgacggaggtgg

SEQ ID NO: 225647 - DNA, 34 bp, Artificial Sequence
  Description of Artificial Sequence: Synthetic oligonucleotide
gaaaagcttctctatgaacatgtgacggaggtgg

SEQ ID NO: 225648 - DNA, 35 bp, Artificial Sequence
  Description of Artificial Sequence: Synthetic oligonucleotide
aaaagcttctctatgaacatgtgacggaggtggac

SEQ ID NO: 225649 - DNA, 34 bp, Artificial Sequence
  Description of Artificial Sequence: Synthetic oligonucleotide
aaagcttctctatgaacatgtgacggaggtggac

SEQ ID NO: 225650 - DNA, 33 bp, Artificial Sequence
  Description of Artificial Sequence: Synthetic oligonucleotide
aagcttctctatgaacatgtgacggaggtggac

SEQ ID NO: 225651 - DNA, 32 bp, Artificial Sequence
  Description of Artificial Sequence: Synthetic oligonucleotide
agcttctctatgaacatgtgacggaggtggac

SEQ ID NO: 225652 - DNA, 31 bp, Artificial Sequence
  Description of Artificial Sequence: Synthetic oligonucleotide
gcttctctatgaacatgtgacggaggtggac

SEQ ID NO: 225653 - DNA, 34 bp, Artificial Sequence
  Description of Artificial Sequence: Synthetic oligonucleotide
cttctctatgaacatgtgacggaggtggacaatc

SEQ ID NO: 225654 - DNA, 36 bp, Artificial Sequence
  Description of Artificial Sequence: Synthetic oligonucleotide
ttctctatgaacatgtgacggaggtggacaatcttc

SEQ ID NO: 225655 - DNA, 35 bp, Artificial Sequence
  Description of Artificial Sequence: Synthetic oligonucleotide
tctctatgaacatgtgacggaggtggacaatcttc

SEQ ID NO: 225656 - DNA, 34 bp, Artificial Sequence
  Description of Artificial Sequence: Synthetic oligonucleotide
ctctatgaacatgtgacggaggtggacaatcttc

SEQ ID NO: 225657 - DNA, 37 bp, Artificial Sequence
  Description of Artificial Sequence: Synthetic oligonucleotide
tctatgaacatgtgacggaggtggacaatcttctttc

SEQ ID NO: 225658 - DNA, 36 bp, Artificial Sequence
  Description of Artificial Sequence: Synthetic oligonucleotide
ctatgaacatgtgacggaggtggacaatcttctttc

SEQ ID NO: 225659 - DNA, 37 bp, Artificial Sequence
  Description of Artificial Sequence: Synthetic oligonucleotide
tatgaacatgtgacggaggtggacaatcttctttcag

SEQ ID NO: 225660 - DNA, 36 bp, Artificial Sequence
  Description of Artificial Sequence: Synthetic oligonucleotide
atgaacatgtgacggaggtggacaatcttctttcag

SEQ ID NO: 225661 - DNA, 35 bp, Artificial Sequence
  Description of Artificial Sequence: Synthetic oligonucleotide
tgaacatgtgacggaggtggacaatcttctttcag

SEQ ID NO: 225662 - DNA, 34 bp, Artificial Sequence
  Description of Artificial Sequence: Synthetic oligonucleotide
gaacatgtgacggaggtggacaatcttctttcag

SEQ ID NO: 225663 - DNA, 35 bp, Artificial Sequence
  Description of Artificial Sequence: Synthetic oligonucleotide
aacatgtgacggaggtggacaatcttctttcagac

SEQ ID NO: 225664 - DNA, 34 bp, Artificial Sequence
  Description of Artificial Sequence: Synthetic oligonucleotide
acatgtgacggaggtggacaatcttctttcagac

SEQ ID NO: 225665 - DNA, 33 bp, Artificial Sequence
  Description of Artificial Sequence: Synthetic oligonucleotide
catgtgacggaggtggacaatcttctttcagac

SEQ ID NO: 225666 - DNA, 33 bp, Artificial Sequence
  Description of Artificial Sequence: Synthetic oligonucleotide
atgtgacggaggtggacaatcttctttcagacc

SEQ ID NO: 225667 - DNA, 32 bp, Artificial Sequence
  Description of Artificial Sequence: Synthetic oligonucleotide
tgtgacggaggtggacaatcttctttcagacc

SEQ ID NO: 225668 - DNA, 31 bp, Artificial Sequence
  Description of Artificial Sequence: Synthetic oligonucleotide
gtgacggaggtggacaatcttctttcagacc

SEQ ID NO: 225669 - DNA, 33 bp, Artificial Sequence
  Description of Artificial Sequence: Synthetic oligonucleotide
tgacggaggtggacaatcttctttcagaccatg

SEQ ID NO: 225670 - DNA, 32 bp, Artificial Sequence
  Description of Artificial Sequence: Synthetic oligonucleotide
gacggaggtggacaatcttctttcagaccatg

SEQ ID NO: 225671 - DNA, 32 bp, Artificial Sequence
  Description of Artificial Sequence: Synthetic oligonucleotide
acggaggtggacaatcttctttcagaccatgc

SEQ ID NO: 225672 - DNA, 31 bp, Artificial Sequence
  Description of Artificial Sequence: Synthetic oligonucleotide
cggaggtggacaatcttctttcagaccatgc

SEQ ID NO: 225673 - DNA, 35 bp, Artificial Sequence
  Description of Artificial Sequence: Synthetic oligonucleotide
ggaggtggacaatcttctttcagaccatgctaaag

SEQ ID NO: 225674 - DNA, 40 bp, Artificial Sequence
  Description of Artificial Sequence: Synthetic oligonucleotide
gaggtggacaatcttctttcagaccatgctaaagaaaaag

SEQ ID NO: 225675 - DNA, 40 bp, Artificial Sequence
  Description of Artificial Sequence: Synthetic oligonucleotide
aggtggacaatcttctttcagaccatgctaaagaaaaagg

SEQ ID NO: 225676 - DNA, 39 bp, Artificial Sequence
  Description of Artificial Sequence: Synthetic oligonucleotide
ggtggacaatcttctttcagaccatgctaaagaaaaagg

SEQ ID NO: 225677 - DNA, 43 bp, Artificial Sequence
  Description of Artificial Sequence: Synthetic oligonucleotide
gtggacaatcttctttcagaccatgctaaagaaaaaggaaaac

SEQ ID NO: 225678 - DNA, 44 bp, Artificial Sequence
  Description of Artificial Sequence: Synthetic oligonucleotide
tggacaatcttctttcagaccatgctaaagaaaaaggaaaactc

SEQ ID NO: 225679 - DNA, 43 bp, Artificial Sequence
  Description of Artificial Sequence: Synthetic oligonucleotide
ggacaatcttctttcagaccatgctaaagaaaaaggaaaactc

SEQ ID NO: 225680 - DNA, 43 bp, Artificial Sequence
  Description of Artificial Sequence: Synthetic oligonucleotide
gacaatcttctttcagaccatgctaaagaaaaaggaaaactcc

SEQ ID NO: 225681 - DNA, 48 bp, Artificial Sequence
  Description of Artificial Sequence: Synthetic oligonucleotide
acaatcttctttcagaccatgctaaagaaaaaggaaaactccataaag

SEQ ID NO: 225682 - DNA, 47 bp, Artificial Sequence
  Description of Artificial Sequence: Synthetic oligonucleotide
caatcttctttcagaccatgctaaagaaaaaggaaaactccataaag

SEQ ID NO: 225683 - DNA, 47 bp, Artificial Sequence
  Description of Artificial Sequence: Synthetic oligonucleotide
aatcttctttcagaccatgctaaagaaaaaggaaaactccataaagc

SEQ ID NO: 225684 - DNA, 46 bp, Artificial Sequence
  Description of Artificial Sequence: Synthetic oligonucleotide
atcttctttcagaccatgctaaagaaaaaggaaaactccataaagc

SEQ ID NO: 225685 - DNA, 45 bp, Artificial Sequence
  Description of Artificial Sequence: Synthetic oligonucleotide
tcttctttcagaccatgctaaagaaaaaggaaaactccataaagc

SEQ ID NO: 225686 - DNA, 44 bp, Artificial Sequence
  Description of Artificial Sequence: Synthetic oligonucleotide
cttctttcagaccatgctaaagaaaaaggaaaactccataaagc

SEQ ID NO: 225687 - DNA, 45 bp, Artificial Sequence
  Description of Artificial Sequence: Synthetic oligonucleotide
ttctttcagaccatgctaaagaaaaaggaaaactccataaagctg

SEQ ID NO: 225688 - DNA, 44 bp, Artificial Sequence
  Description of Artificial Sequence: Synthetic oligonucleotide
tctttcagaccatgctaaagaaaaaggaaaactccataaagctg

SEQ ID NO: 225689 - DNA, 43 bp, Artificial Sequence
  Description of Artificial Sequence: Synthetic oligonucleotide
ctttcagaccatgctaaagaaaaaggaaaactccataaagctg

SEQ ID NO: 225690 - DNA, 44 bp, Artificial Sequence
  Description of Artificial Sequence: Synthetic oligonucleotide
tttcagaccatgctaaagaaaaaggaaaactccataaagctgtc

SEQ ID NO: 225691 - DNA, 43 bp, Artificial Sequence
  Description of Artificial Sequence: Synthetic oligonucleotide
ttcagaccatgctaaagaaaaaggaaaactccataaagctgtc

SEQ ID NO: 225692 - DNA, 42 bp, Artificial Sequence
  Description of Artificial Sequence: Synthetic oligonucleotide
tcagaccatgctaaagaaaaaggaaaactccataaagctgtc

SEQ ID NO: 225693 - DNA, 41 bp, Artificial Sequence
  Description of Artificial Sequence: Synthetic oligonucleotide
cagaccatgctaaagaaaaaggaaaactccataaagctgtc

SEQ ID NO: 225694 - DNA, 43 bp, Artificial Sequence
  Description of Artificial Sequence: Synthetic oligonucleotide
agaccatgctaaagaaaaaggaaaactccataaagctgtcaag

SEQ ID NO: 225695 - DNA, 42 bp, Artificial Sequence
  Description of Artificial Sequence: Synthetic oligonucleotide
gaccatgctaaagaaaaaggaaaactccataaagctgtcaag

SEQ ID NO: 225696 - DNA, 45 bp, Artificial Sequence
  Description of Artificial Sequence: Synthetic oligonucleotide
accatgctaaagaaaaaggaaaactccataaagctgtcaagaaac

SEQ ID NO: 225697 - DNA, 44 bp, Artificial Sequence
  Description of Artificial Sequence: Synthetic oligonucleotide
ccatgctaaagaaaaaggaaaactccataaagctgtcaagaaac

SEQ ID NO: 225698 - DNA, 45 bp, Artificial Sequence
  Description of Artificial Sequence: Synthetic oligonucleotide
catgctaaagaaaaaggaaaactccataaagctgtcaagaaactc

SEQ ID NO: 225699 - DNA, 45 bp, Artificial Sequence
  Description of Artificial Sequence: Synthetic oligonucleotide
atgctaaagaaaaaggaaaactccataaagctgtcaagaaactcc

SEQ ID NO: 225700 - DNA, 44 bp, Artificial Sequence
  Description of Artificial Sequence: Synthetic oligonucleotide
tgctaaagaaaaaggaaaactccataaagctgtcaagaaactcc

SEQ ID NO: 225701 - DNA, 43 bp, Artificial Sequence
  Description of Artificial Sequence: Synthetic oligonucleotide
gctaaagaaaaaggaaaactccataaagctgtcaagaaactcc

SEQ ID NO: 225702 - DNA, 43 bp, Artificial Sequence
  Description of Artificial Sequence: Synthetic oligonucleotide
ctaaagaaaaaggaaaactccataaagctgtcaagaaactccg

SEQ ID NO: 225703 - DNA, 43 bp, Artificial Sequence
  Description of Artificial Sequence: Synthetic oligonucleotide
taaagaaaaaggaaaactccataaagctgtcaagaaactccgg

SEQ ID NO: 225704 - DNA, 42 bp, Artificial Sequence
  Description of Artificial Sequence: Synthetic oligonucleotide
aaagaaaaaggaaaactccataaagctgtcaagaaactccgg

SEQ ID NO: 225705 - DNA, 41 bp, Artificial Sequence
  Description of Artificial Sequence: Synthetic oligonucleotide
aagaaaaaggaaaactccataaagctgtcaagaaactccgg

SEQ ID NO: 225706 - DNA, 40 bp, Artificial Sequence
  Description of Artificial Sequence: Synthetic oligonucleotide
agaaaaaggaaaactccataaagctgtcaagaaactccgg

SEQ ID NO: 225707 - DNA, 39 bp, Artificial Sequence
  Description of Artificial Sequence: Synthetic oligonucleotide
gaaaaaggaaaactccataaagctgtcaagaaactccgg

SEQ ID NO: 225708 - DNA, 40 bp, Artificial Sequence
  Description of Artificial Sequence: Synthetic oligonucleotide
aaaaaggaaaactccataaagctgtcaagaaactccggag

SEQ ID NO: 225709 - DNA, 39 bp, Artificial Sequence
  Description of Artificial Sequence: Synthetic oligonucleotide
aaaaggaaaactccataaagctgtcaagaaactccggag

SEQ ID NO: 225710 - DNA, 38 bp, Artificial Sequence
  Description of Artificial Sequence: Synthetic oligonucleotide
aaaggaaaactccataaagctgtcaagaaactccggag

SEQ ID NO: 225711 - DNA, 37 bp, Artificial Sequence
  Description of Artificial Sequence: Synthetic oligonucleotide
aaggaaaactccataaagctgtcaagaaactccggag

SEQ ID NO: 225712 - DNA, 36 bp, Artificial Sequence
  Description of Artificial Sequence: Synthetic oligonucleotide
aggaaaactccataaagctgtcaagaaactccggag

SEQ ID NO: 225713 - DNA, 35 bp, Artificial Sequence
  Description of Artificial Sequence: Synthetic oligonucleotide
ggaaaactccataaagctgtcaagaaactccggag

SEQ ID NO: 225714 - DNA, 36 bp, Artificial Sequence
  Description of Artificial Sequence: Synthetic oligonucleotide
gaaaactccataaagctgtcaagaaactccggagtg

SEQ ID NO: 225715 - DNA, 38 bp, Artificial Sequence
  Description of Artificial Sequence: Synthetic oligonucleotide
aaaactccataaagctgtcaagaaactccggagtgaac

SEQ ID NO: 225716 - DNA, 37 bp, Artificial Sequence
  Description of Artificial Sequence: Synthetic oligonucleotide
aaactccataaagctgtcaagaaactccggagtgaac

SEQ ID NO: 225717 - DNA, 36 bp, Artificial Sequence
  Description of Artificial Sequence: Synthetic oligonucleotide
aactccataaagctgtcaagaaactccggagtgaac

SEQ ID NO: 225718 - DNA, 35 bp, Artificial Sequence
  Description of Artificial Sequence: Synthetic oligonucleotide
actccataaagctgtcaagaaactccggagtgaac

SEQ ID NO: 225719 - DNA, 34 bp, Artificial Sequence
  Description of Artificial Sequence: Synthetic oligonucleotide
ctccataaagctgtcaagaaactccggagtgaac

SEQ ID NO: 225720 - DNA, 35 bp, Artificial Sequence
  Description of Artificial Sequence: Synthetic oligonucleotide
tccataaagctgtcaagaaactccggagtgaactg

SEQ ID NO: 225721 - DNA, 34 bp, Artificial Sequence
  Description of Artificial Sequence: Synthetic oligonucleotide
ccataaagctgtcaagaaactccggagtgaactg

SEQ ID NO: 225722 - DNA, 36 bp, Artificial Sequence
  Description of Artificial Sequence: Synthetic oligonucleotide
cataaagctgtcaagaaactccggagtgaactgaag

SEQ ID NO: 225723 - DNA, 38 bp, Artificial Sequence
  Description of Artificial Sequence: Synthetic oligonucleotide
ataaagctgtcaagaaactccggagtgaactgaagttg

SEQ ID NO: 225724 - DNA, 37 bp, Artificial Sequence
  Description of Artificial Sequence: Synthetic oligonucleotide
taaagctgtcaagaaactccggagtgaactgaagttg

SEQ ID NO: 225725 - DNA, 36 bp, Artificial Sequence
  Description of Artificial Sequence: Synthetic oligonucleotide
aaagctgtcaagaaactccggagtgaactgaagttg

SEQ ID NO: 225726 - DNA, 35 bp, Artificial Sequence
  Description of Artificial Sequence: Synthetic oligonucleotide
aagctgtcaagaaactccggagtgaactgaagttg

SEQ ID NO: 225727 - DNA, 34 bp, Artificial Sequence
  Description of Artificial Sequence: Synthetic oligonucleotide
agctgtcaagaaactccggagtgaactgaagttg

SEQ ID NO: 225728 - DNA, 33 bp, Artificial Sequence
  Description of Artificial Sequence: Synthetic oligonucleotide
gctgtcaagaaactccggagtgaactgaagttg

SEQ ID NO: 225729 - DNA, 37 bp, Artificial Sequence
  Description of Artificial Sequence: Synthetic oligonucleotide
ctgtcaagaaactccggagtgaactgaagttgaaaag

SEQ ID NO: 225730 - DNA, 38 bp, Artificial Sequence
  Description of Artificial Sequence: Synthetic oligonucleotide
tgtcaagaaactccggagtgaactgaagttgaaaagag

SEQ ID NO: 225731 - DNA, 37 bp, Artificial Sequence
  Description of Artificial Sequence: Synthetic oligonucleotide
gtcaagaaactccggagtgaactgaagttgaaaagag

SEQ ID NO: 225732 - DNA, 37 bp, Artificial Sequence
  Description of Artificial Sequence: Synthetic oligonucleotide
tcaagaaactccggagtgaactgaagttgaaaagagc

SEQ ID NO: 225733 - DNA, 36 bp, Artificial Sequence
  Description of Artificial Sequence: Synthetic oligonucleotide
caagaaactccggagtgaactgaagttgaaaagagc

SEQ ID NO: 225734 - DNA, 37 bp, Artificial Sequence
  Description of Artificial Sequence: Synthetic oligonucleotide
aagaaactccggagtgaactgaagttgaaaagagctg

SEQ ID NO: 225735 - DNA, 36 bp, Artificial Sequence
  Description of Artificial Sequence: Synthetic oligonucleotide
agaaactccggagtgaactgaagttgaaaagagctg

SEQ ID NO: 225736 - DNA, 35 bp, Artificial Sequence
  Description of Artificial Sequence: Synthetic oligonucleotide
gaaactccggagtgaactgaagttgaaaagagctg

SEQ ID NO: 225737 - DNA, 35 bp, Artificial Sequence
  Description of Artificial Sequence: Synthetic oligonucleotide
aaactccggagtgaactgaagttgaaaagagctgc

SEQ ID NO: 225738 - DNA, 34 bp, Artificial Sequence
  Description of Artificial Sequence: Synthetic oligonucleotide
aactccggagtgaactgaagttgaaaagagctgc

SEQ ID NO: 225739 - DNA, 33 bp, Artificial Sequence
  Description of Artificial Sequence: Synthetic oligonucleotide
actccggagtgaactgaagttgaaaagagctgc

SEQ ID NO: 225740 - DNA, 32 bp, Artificial Sequence
  Description of Artificial Sequence: Synthetic oligonucleotide
ctccggagtgaactgaagttgaaaagagctgc

SEQ ID NO: 225741 - DNA, 33 bp, Artificial Sequence
  Description of Artificial Sequence: Synthetic oligonucleotide
tccggagtgaactgaagttgaaaagagctgcag

SEQ ID NO: 225742 - DNA, 32 bp, Artificial Sequence
  Description of Artificial Sequence: Synthetic oligonucleotide
ccggagtgaactgaagttgaaaagagctgcag

SEQ ID NO: 225743 - DNA, 32 bp, Artificial Sequence
  Description of Artificial Sequence: Synthetic oligonucleotide
cggagtgaactgaagttgaaaagagctgcagc

SEQ ID NO: 225744 - DNA, 35 bp, Artificial Sequence
  Description of Artificial Sequence: Synthetic oligonucleotide
ggagtgaactgaagttgaaaagagctgcagcaaac

SEQ ID NO: 225745 - DNA, 36 bp, Artificial Sequence
  Description of Artificial Sequence: Synthetic oligonucleotide
gagtgaactgaagttgaaaagagctgcagcaaactc

SEQ ID NO: 225746 - DNA, 37 bp, Artificial Sequence
  Description of Artificial Sequence: Synthetic oligonucleotide
agtgaactgaagttgaaaagagctgcagcaaactcag

SEQ ID NO: 225747 - DNA, 36 bp, Artificial Sequence
  Description of Artificial Sequence: Synthetic oligonucleotide
gtgaactgaagttgaaaagagctgcagcaaactcag

SEQ ID NO: 225748 - DNA, 36 bp, Artificial Sequence
  Description of Artificial Sequence: Synthetic oligonucleotide
tgaactgaagttgaaaagagctgcagcaaactcagg

SEQ ID NO: 225749 - DNA, 35 bp, Artificial Sequence
  Description of Artificial Sequence: Synthetic oligonucleotide
gaactgaagttgaaaagagctgcagcaaactcagg

SEQ ID NO: 225750 - DNA, 35 bp, Artificial Sequence
  Description of Artificial Sequence: Synthetic oligonucleotide
aactgaagttgaaaagagctgcagcaaactcaggc

SEQ ID NO: 225751 - DNA, 34 bp, Artificial Sequence
  Description of Artificial Sequence: Synthetic oligonucleotide
actgaagttgaaaagagctgcagcaaactcaggc

SEQ ID NO: 225752 - DNA, 33 bp, Artificial Sequence
  Description of Artificial Sequence: Synthetic oligonucleotide
ctgaagttgaaaagagctgcagcaaactcaggc

SEQ ID NO: 225753 - DNA, 34 bp, Artificial Sequence
  Description of Artificial Sequence: Synthetic oligonucleotide
tgaagttgaaaagagctgcagcaaactcaggctg

SEQ ID NO: 225754 - DNA, 33 bp, Artificial Sequence
  Description of Artificial Sequence: Synthetic oligonucleotide
gaagttgaaaagagctgcagcaaactcaggctg

SEQ ID NO: 225755 - DNA, 33 bp, Artificial Sequence
  Description of Artificial Sequence: Synthetic oligonucleotide
aagttgaaaagagctgcagcaaactcaggctgg

SEQ ID NO: 225756 - DNA, 32 bp, Artificial Sequence
  Description of Artificial Sequence: Synthetic oligonucleotide
agttgaaaagagctgcagcaaactcaggctgg

SEQ ID NO: 225757 - DNA, 31 bp, Artificial Sequence
  Description of Artificial Sequence: Synthetic oligonucleotide
gttgaaaagagctgcagcaaactcaggctgg

SEQ ID NO: 225758 - DNA, 32 bp, Artificial Sequence
  Description of Artificial Sequence: Synthetic oligonucleotide
ttgaaaagagctgcagcaaactcaggctggag

SEQ ID NO: 225759 - DNA, 31 bp, Artificial Sequence
  Description of Artificial Sequence: Synthetic oligonucleotide
tgaaaagagctgcagcaaactcaggctggag

SEQ ID NO: 225760 - DNA, 30 bp, Artificial Sequence
  Description of Artificial Sequence: Synthetic oligonucleotide
gaaaagagctgcagcaaactcaggctggag

SEQ ID NO: 225761 - DNA, 32 bp, Artificial Sequence
  Description of Artificial Sequence: Synthetic oligonucleotide
aaaagagctgcagcaaactcaggctggagaag

SEQ ID NO: 225762 - DNA, 31 bp, Artificial Sequence
  Description of Artificial Sequence: Synthetic oligonucleotide
aaagagctgcagcaaactcaggctggagaag

SEQ ID NO: 225763 - DNA, 30 bp, Artificial Sequence
  Description of Artificial Sequence: Synthetic oligonucleotide
aagagctgcagcaaactcaggctggagaag

SEQ ID NO: 225764 - DNA, 29 bp, Artificial Sequence
  Description of Artificial Sequence: Synthetic oligonucleotide
agagctgcagcaaactcaggctggagaag

SEQ ID NO: 225765 - DNA, 28 bp, Artificial Sequence
  Description of Artificial Sequence: Synthetic oligonucleotide
gagctgcagcaaactcaggctggagaag

SEQ ID NO: 225766 - DNA, 29 bp, Artificial Sequence
  Description of Artificial Sequence: Synthetic oligonucleotide
agctgcagcaaactcaggctggagaagag

SEQ ID NO: 225767 - DNA, 28 bp, Artificial Sequence
  Description of Artificial Sequence: Synthetic oligonucleotide
gctgcagcaaactcaggctggagaagag

SEQ ID NO: 225768 - DNA, 28 bp, Artificial Sequence
  Description of Artificial Sequence: Synthetic oligonucleotide
ctgcagcaaactcaggctggagaagagc

SEQ ID NO: 225769 - DNA, 28 bp, Artificial Sequence
  Description of Artificial Sequence: Synthetic oligonucleotide
tgcagcaaactcaggctggagaagagcc

SEQ ID NO: 225770 - DNA, 27 bp, Artificial Sequence
  Description of Artificial Sequence: Synthetic oligonucleotide
gcagcaaactcaggctggagaagagcc

SEQ ID NO: 225771 - DNA, 27 bp, Artificial Sequence
  Description of Artificial Sequence: Synthetic oligonucleotide
cagcaaactcaggctggagaagagccc

SEQ ID NO: 225772 - DNA, 27 bp, Artificial Sequence
  Description of Artificial Sequence: Synthetic oligonucleotide
agcaaactcaggctggagaagagcccg

SEQ ID NO: 225773 - DNA, 26 bp, Artificial Sequence
  Description of Artificial Sequence: Synthetic oligonucleotide
gcaaactcaggctggagaagagcccg

SEQ ID NO: 225774 - DNA, 27 bp, Artificial Sequence
  Description of Artificial Sequence: Synthetic oligonucleotide
caaactcaggctggagaagagcccggt

SEQ ID NO: 225775 - DNA, 28 bp, Artificial Sequence
  Description of Artificial Sequence: Synthetic oligonucleotide
aaactcaggctggagaagagcccggttg

SEQ ID NO: 225776 - DNA, 27 bp, Artificial Sequence
  Description of Artificial Sequence: Synthetic oligonucleotide
aactcaggctggagaagagcccggttg

SEQ ID NO: 225777 - DNA, 26 bp, Artificial Sequence
  Description of Artificial Sequence: Synthetic oligonucleotide
actcaggctggagaagagcccggttg

SEQ ID NO: 225778 - DNA, 25 bp, Artificial Sequence
  Description of Artificial Sequence: Synthetic oligonucleotide
ctcaggctggagaagagcccggttg

SEQ ID NO: 225779 - DNA, 27 bp, Artificial Sequence
  Description of Artificial Sequence: Synthetic oligonucleotide
tcaggctggagaagagcccggttgcat

SEQ ID NO: 225780 - DNA, 27 bp, Artificial Sequence
  Description of Artificial Sequence: Synthetic oligonucleotide
caggctggagaagagcccggttgcatt

SEQ ID NO: 225781 - DNA, 29 bp, Artificial Sequence
  Description of Artificial Sequence: Synthetic oligonucleotide
aggctggagaagagcccggttgcattttg

SEQ ID NO: 225782 - DNA, 28 bp, Artificial Sequence
  Description of Artificial Sequence: Synthetic oligonucleotide
ggctggagaagagcccggttgcattttg

SEQ ID NO: 225783 - DNA, 29 bp, Artificial Sequence
  Description of Artificial Sequence: Synthetic oligonucleotide
gctggagaagagcccggttgcattttgtg

SEQ ID NO: 225784 - DNA, 29 bp, Artificial Sequence
  Description of Artificial Sequence: Synthetic oligonucleotide
ctggagaagagcccggttgcattttgtgg

SEQ ID NO: 225785 - DNA, 29 bp, Artificial Sequence
  Description of Artificial Sequence: Synthetic oligonucleotide
tggagaagagcccggttgcattttgtggc

SEQ ID NO: 225786 - DNA, 28 bp, Artificial Sequence
  Description of Artificial Sequence: Synthetic oligonucleotide
ggagaagagcccggttgcattttgtggc

SEQ ID NO: 225787 - DNA, 29 bp, Artificial Sequence
  Description of Artificial Sequence: Synthetic oligonucleotide
gagaagagcccggttgcattttgtggcag

SEQ ID NO: 225788 - DNA, 30 bp, Artificial Sequence
  Description of Artificial Sequence: Synthetic oligonucleotide
agaagagcccggttgcattttgtggcagtg

SEQ ID NO: 225789 - DNA, 29 bp, Artificial Sequence
  Description of Artificial Sequence: Synthetic oligonucleotide
gaagagcccggttgcattttgtggcagtg

SEQ ID NO: 225790 - DNA, 30 bp, Artificial Sequence
  Description of Artificial Sequence: Synthetic oligonucleotide
aagagcccggttgcattttgtggcagtgac

SEQ ID NO: 225791 - DNA, 29 bp, Artificial Sequence
  Description of Artificial Sequence: Synthetic oligonucleotide
agagcccggttgcattttgtggcagtgac

SEQ ID NO: 225792 - DNA, 28 bp, Artificial Sequence
  Description of Artificial Sequence: Synthetic oligonucleotide
gagcccggttgcattttgtggcagtgac

SEQ ID NO: 225793 - DNA, 28 bp, Artificial Sequence
  Description of Artificial Sequence: Synthetic oligonucleotide
agcccggttgcattttgtggcagtgacc

SEQ ID NO: 225794 - DNA, 27 bp, Artificial Sequence
  Description of Artificial Sequence: Synthetic oligonucleotide
gcccggttgcattttgtggcagtgacc

SEQ ID NO: 225795 - DNA, 27 bp, Artificial Sequence
  Description of Artificial Sequence: Synthetic oligonucleotide
cccggttgcattttgtggcagtgaccc

SEQ ID NO: 225796 - DNA, 28 bp, Artificial Sequence
  Description of Artificial Sequence: Synthetic oligonucleotide
ccggttgcattttgtggcagtgaccctg

SEQ ID NO: 225797 - DNA, 28 bp, Artificial Sequence
  Description of Artificial Sequence: Synthetic oligonucleotide
cggttgcattttgtggcagtgaccctgg

SEQ ID NO: 225798 - DNA, 29 bp, Artificial Sequence
  Description of Artificial Sequence: Synthetic oligonucleotide
ggttgcattttgtggcagtgaccctggac

SEQ ID NO: 225799 - DNA, 29 bp, Artificial Sequence
  Description of Artificial Sequence: Synthetic oligonucleotide
gttgcattttgtggcagtgaccctggacc

SEQ ID NO: 225800 - DNA, 29 bp, Artificial Sequence
  Description of Artificial Sequence: Synthetic oligonucleotide
ttgcattttgtggcagtgaccctggaccc

SEQ ID NO: 225801 - DNA, 28 bp, Artificial Sequence
  Description of Artificial Sequence: Synthetic oligonucleotide
tgcattttgtggcagtgaccctggaccc

SEQ ID NO: 225802 - DNA, 27 bp, Artificial Sequence
  Description of Artificial Sequence: Synthetic oligonucleotide
gcattttgtggcagtgaccctggaccc

SEQ ID NO: 225803 - DNA, 28 bp, Artificial Sequence
  Description of Artificial Sequence: Synthetic oligonucleotide
cattttgtggcagtgaccctggacccag

SEQ ID NO: 225804 - DNA, 29 bp, Artificial Sequence
  Description of Artificial Sequence: Synthetic oligonucleotide
attttgtggcagtgaccctggacccagac

SEQ ID NO: 225805 - DNA, 28 bp, Artificial Sequence
  Description of Artificial Sequence: Synthetic oligonucleotide
ttttgtggcagtgaccctggacccagac

SEQ ID NO: 225806 - DNA, 27 bp, Artificial Sequence
  Description of Artificial Sequence: Synthetic oligonucleotide
tttgtggcagtgaccctggacccagac

SEQ ID NO: 225807 - DNA, 27 bp, Artificial Sequence
  Description of Artificial Sequence: Synthetic oligonucleotide
ttgtggcagtgaccctggacccagaca

SEQ ID NO: 225808 - DNA, 26 bp, Artificial Sequence
  Description of Artificial Sequence: Synthetic oligonucleotide
tgtggcagtgaccctggacccagaca

SEQ ID NO: 225809 - DNA, 25 bp, Artificial Sequence
  Description of Artificial Sequence: Synthetic oligonucleotide
gtggcagtgaccctggacccagaca

SEQ ID NO: 225810 - DNA, 26 bp, Artificial Sequence
  Description of Artificial Sequence: Synthetic oligonucleotide
tggcagtgaccctggacccagacaca

SEQ ID NO: 225811 - DNA, 25 bp, Artificial Sequence
  Description of Artificial Sequence: Synthetic oligonucleotide
ggcagtgaccctggacccagacaca

SEQ ID NO: 225812 - DNA, 25 bp, Artificial Sequence
  Description of Artificial Sequence: Synthetic oligonucleotide
gcagtgaccctggacccagacacag

SEQ ID NO: 225813 - DNA, 26 bp, Artificial Sequence
  Description of Artificial Sequence: Synthetic oligonucleotide
cagtgaccctggacccagacacagca

SEQ ID NO: 225814 - DNA, 27 bp, Artificial Sequence
  Description of Artificial Sequence: Synthetic oligonucleotide
agtgaccctggacccagacacagcaca

SEQ ID NO: 225815 - DNA, 27 bp, Artificial Sequence
  Description of Artificial Sequence: Synthetic oligonucleotide
gtgaccctggacccagacacagcacat

SEQ ID NO: 225816 - DNA, 27 bp, Artificial Sequence
  Description of Artificial Sequence: Synthetic oligonucleotide
tgaccctggacccagacacagcacatc

SEQ ID NO: 225817 - DNA, 26 bp, Artificial Sequence
  Description of Artificial Sequence: Synthetic oligonucleotide
gaccctggacccagacacagcacatc

SEQ ID NO: 225818 - DNA, 26 bp, Artificial Sequence
  Description of Artificial Sequence: Synthetic oligonucleotide
accctggacccagacacagcacatcc

SEQ ID NO: 225819 - DNA, 25 bp, Artificial Sequence
  Description of Artificial Sequence: Synthetic oligonucleotide
ccctggacccagacacagcacatcc

SEQ ID NO: 225820 - DNA, 27 bp, Artificial Sequence
  Description of Artificial Sequence: Synthetic oligonucleotide
cctggacccagacacagcacatcccaa

SEQ ID NO: 225821 - DNA, 28 bp, Artificial Sequence
  Description of Artificial Sequence: Synthetic oligonucleotide
ctggacccagacacagcacatcccaaac

SEQ ID NO: 225822 - DNA, 29 bp, Artificial Sequence
  Description of Artificial Sequence: Synthetic oligonucleotide
tggacccagacacagcacatcccaaactc

SEQ ID NO: 225823 - DNA, 28 bp, Artificial Sequence
  Description of Artificial Sequence: Synthetic oligonucleotide
ggacccagacacagcacatcccaaactc

SEQ ID NO: 225824 - DNA, 30 bp, Artificial Sequence
  Description of Artificial Sequence: Synthetic oligonucleotide
gacccagacacagcacatcccaaactcatc

SEQ ID NO: 225825 - DNA, 30 bp, Artificial Sequence
  Description of Artificial Sequence: Synthetic oligonucleotide
acccagacacagcacatcccaaactcatcc

SEQ ID NO: 225826 - DNA, 29 bp, Artificial Sequence
  Description of Artificial Sequence: Synthetic oligonucleotide
cccagacacagcacatcccaaactcatcc

SEQ ID NO: 225827 - DNA, 32 bp, Artificial Sequence
  Description of Artificial Sequence: Synthetic oligonucleotide
ccagacacagcacatcccaaactcatcctttc

SEQ ID NO: 225828 - DNA, 33 bp, Artificial Sequence
  Description of Artificial Sequence: Synthetic oligonucleotide
cagacacagcacatcccaaactcatcctttctg

SEQ ID NO: 225829 - DNA, 34 bp, Artificial Sequence
  Description of Artificial Sequence: Synthetic oligonucleotide
agacacagcacatcccaaactcatcctttctgag

SEQ ID NO: 225830 - DNA, 33 bp, Artificial Sequence
  Description of Artificial Sequence: Synthetic oligonucleotide
gacacagcacatcccaaactcatcctttctgag

SEQ ID NO: 225831 - DNA, 33 bp, Artificial Sequence
  Description of Artificial Sequence: Synthetic oligonucleotide
acacagcacatcccaaactcatcctttctgagg

SEQ ID NO: 225832 - DNA, 32 bp, Artificial Sequence
  Description of Artificial Sequence: Synthetic oligonucleotide
cacagcacatcccaaactcatcctttctgagg

SEQ ID NO: 225833 - DNA, 33 bp, Artificial Sequence
  Description of Artificial Sequence: Synthetic oligonucleotide
acagcacatcccaaactcatcctttctgaggac

SEQ ID NO: 225834 - DNA, 32 bp, Artificial Sequence
  Description of Artificial Sequence: Synthetic oligonucleotide
cagcacatcccaaactcatcctttctgaggac

SEQ ID NO: 225835 - DNA, 32 bp, Artificial Sequence
  Description of Artificial Sequence: Synthetic oligonucleotide
agcacatcccaaactcatcctttctgaggacc

SEQ ID NO: 225836 - DNA, 31 bp, Artificial Sequence
  Description of Artificial Sequence: Synthetic oligonucleotide
gcacatcccaaactcatcctttctgaggacc

SEQ ID NO: 225837 - DNA, 34 bp, Artificial Sequence
  Description of Artificial Sequence: Synthetic oligonucleotide
cacatcccaaactcatcctttctgaggaccaaag

SEQ ID NO: 225838 - DNA, 36 bp, Artificial Sequence
  Description of Artificial Sequence: Synthetic oligonucleotide
acatcccaaactcatcctttctgaggaccaaagatg

SEQ ID NO: 225839 - DNA, 35 bp, Artificial Sequence
  Description of Artificial Sequence: Synthetic oligonucleotide
catcccaaactcatcctttctgaggaccaaagatg

SEQ ID NO: 225840 - DNA, 36 bp, Artificial Sequence
  Description of Artificial Sequence: Synthetic oligonucleotide
atcccaaactcatcctttctgaggaccaaagatgtg

SEQ ID NO: 225841 - DNA, 35 bp, Artificial Sequence
  Description of Artificial Sequence: Synthetic oligonucleotide
tcccaaactcatcctttctgaggaccaaagatgtg

SEQ ID NO: 225842 - DNA, 34 bp, Artificial Sequence
  Description of Artificial Sequence: Synthetic oligonucleotide
cccaaactcatcctttctgaggaccaaagatgtg

SEQ ID NO: 225843 - DNA, 37 bp, Artificial Sequence
  Description of Artificial Sequence: Synthetic oligonucleotide
ccaaactcatcctttctgaggaccaaagatgtgtaag

SEQ ID NO: 225844 - DNA, 37 bp, Artificial Sequence
  Description of Artificial Sequence: Synthetic oligonucleotide
caaactcatcctttctgaggaccaaagatgtgtaagg

SEQ ID NO: 225845 - DNA, 37 bp, Artificial Sequence
  Description of Artificial Sequence: Synthetic oligonucleotide
aaactcatcctttctgaggaccaaagatgtgtaaggc

SEQ ID NO: 225846 - DNA, 36 bp, Artificial Sequence
  Description of Artificial Sequence: Synthetic oligonucleotide
aactcatcctttctgaggaccaaagatgtgtaaggc

SEQ ID NO: 225847 - DNA, 35 bp, Artificial Sequence
  Description of Artificial Sequence: Synthetic oligonucleotide
actcatcctttctgaggaccaaagatgtgtaaggc

SEQ ID NO: 225848 - DNA, 34 bp, Artificial Sequence
  Description of Artificial Sequence: Synthetic oligonucleotide
ctcatcctttctgaggaccaaagatgtgtaaggc

SEQ ID NO: 225849 - DNA, 36 bp, Artificial Sequence
  Description of Artificial Sequence: Synthetic oligonucleotide
tcatcctttctgaggaccaaagatgtgtaaggcttg

SEQ ID NO: 225850 - DNA, 35 bp, Artificial Sequence
  Description of Artificial Sequence: Synthetic oligonucleotide
catcctttctgaggaccaaagatgtgtaaggcttg

SEQ ID NO: 225851 - DNA, 35 bp, Artificial Sequence
  Description of Artificial Sequence: Synthetic oligonucleotide
atcctttctgaggaccaaagatgtgtaaggcttgg

SEQ ID NO: 225852 - DNA, 34 bp, Artificial Sequence
  Description of Artificial Sequence: Synthetic oligonucleotide
tcctttctgaggaccaaagatgtgtaaggcttgg

SEQ ID NO: 225853 - DNA, 33 bp, Artificial Sequence
  Description of Artificial Sequence: Synthetic oligonucleotide
cctttctgaggaccaaagatgtgtaaggcttgg

SEQ ID NO: 225854 - DNA, 34 bp, Artificial Sequence
  Description of Artificial Sequence: Synthetic oligonucleotide
ctttctgaggaccaaagatgtgtaaggcttggag

SEQ ID NO: 225855 - DNA, 35 bp, Artificial Sequence
  Description of Artificial Sequence: Synthetic oligonucleotide
tttctgaggaccaaagatgtgtaaggcttggagac

SEQ ID NO: 225856 - DNA, 34 bp, Artificial Sequence
  Description of Artificial Sequence: Synthetic oligonucleotide
ttctgaggaccaaagatgtgtaaggcttggagac

SEQ ID NO: 225857 - DNA, 33 bp, Artificial Sequence
  Description of Artificial Sequence: Synthetic oligonucleotide
tctgaggaccaaagatgtgtaaggcttggagac

SEQ ID NO: 225858 - DNA, 32 bp, Artificial Sequence
  Description of Artificial Sequence: Synthetic oligonucleotide
ctgaggaccaaagatgtgtaaggcttggagac

SEQ ID NO: 225859 - DNA, 33 bp, Artificial Sequence
  Description of Artificial Sequence: Synthetic oligonucleotide
tgaggaccaaagatgtgtaaggcttggagacag

SEQ ID NO: 225860 - DNA, 32 bp, Artificial Sequence
  Description of Artificial Sequence: Synthetic oligonucleotide
gaggaccaaagatgtgtaaggcttggagacag

SEQ ID NO: 225861 - DNA, 33 bp, Artificial Sequence
  Description of Artificial Sequence: Synthetic oligonucleotide
aggaccaaagatgtgtaaggcttggagacagac

SEQ ID NO: 225862 - DNA, 32 bp, Artificial Sequence
  Description of Artificial Sequence: Synthetic oligonucleotide
ggaccaaagatgtgtaaggcttggagacagac

SEQ ID NO: 225863 - DNA, 32 bp, Artificial Sequence
  Description of Artificial Sequence: Synthetic oligonucleotide
gaccaaagatgtgtaaggcttggagacagacg

SEQ ID NO: 225864 - DNA, 32 bp, Artificial Sequence
  Description of Artificial Sequence: Synthetic oligonucleotide
accaaagatgtgtaaggcttggagacagacgg

SEQ ID NO: 225865 - DNA, 31 bp, Artificial Sequence
  Description of Artificial Sequence: Synthetic oligonucleotide
ccaaagatgtgtaaggcttggagacagacgg

SEQ ID NO: 225866 - DNA, 31 bp, Artificial Sequence
  Description of Artificial Sequence: Synthetic oligonucleotide
caaagatgtgtaaggcttggagacagacggc

SEQ ID NO: 225867 - DNA, 32 bp, Artificial Sequence
  Description of Artificial Sequence: Synthetic oligonucleotide
aaagatgtgtaaggcttggagacagacggcag

SEQ ID NO: 225868 - DNA, 31 bp, Artificial Sequence
  Description of Artificial Sequence: Synthetic oligonucleotide
aagatgtgtaaggcttggagacagacggcag

SEQ ID NO: 225869 - DNA, 30 bp, Artificial Sequence
  Description of Artificial Sequence: Synthetic oligonucleotide
agatgtgtaaggcttggagacagacggcag

SEQ ID NO: 225870 - DNA, 29 bp, Artificial Sequence
  Description of Artificial Sequence: Synthetic oligonucleotide
gatgtgtaaggcttggagacagacggcag

SEQ ID NO: 225871 - DNA, 29 bp, Artificial Sequence
  Description of Artificial Sequence: Synthetic oligonucleotide
atgtgtaaggcttggagacagacggcagc

SEQ ID NO: 225872 - DNA, 28 bp, Artificial Sequence
  Description of Artificial Sequence: Synthetic oligonucleotide
tgtgtaaggcttggagacagacggcagc

SEQ ID NO: 225873 - DNA, 27 bp, Artificial Sequence
  Description of Artificial Sequence: Synthetic oligonucleotide
gtgtaaggcttggagacagacggcagc

SEQ ID NO: 225874 - DNA, 27 bp, Artificial Sequence
  Description of Artificial Sequence: Synthetic oligonucleotide
tgtaaggcttggagacagacggcagcc

SEQ ID NO: 225875 - DNA, 27 bp, Artificial Sequence
  Description of Artificial Sequence: Synthetic oligonucleotide
gtaaggcttggagacagacggcagcct

SEQ ID NO: 225876 - DNA, 27 bp, Artificial Sequence
  Description of Artificial Sequence: Synthetic oligonucleotide
taaggcttggagacagacggcagcctg

SEQ ID NO: 225877 - DNA, 27 bp, Artificial Sequence
  Description of Artificial Sequence: Synthetic oligonucleotide
aaggcttggagacagacggcagcctgt

SEQ ID NO: 225878 - DNA, 27 bp, Artificial Sequence
  Description of Artificial Sequence: Synthetic oligonucleotide
aggcttggagacagacggcagcctgta

SEQ ID NO: 225879 - DNA, 26 bp, Artificial Sequence
  Description of Artificial Sequence: Synthetic oligonucleotide
ggcttggagacagacggcagcctgta

SEQ ID NO: 225880 - DNA, 26 bp, Artificial Sequence
  Description of Artificial Sequence: Synthetic oligonucleotide
gcttggagacagacggcagcctgtac

SEQ ID NO: 225881 - DNA, 27 bp, Artificial Sequence
  Description of Artificial Sequence: Synthetic oligonucleotide
cttggagacagacggcagcctgtacct

SEQ ID NO: 225882 - DNA, 27 bp, Artificial Sequence
  Description of Artificial Sequence: Synthetic oligonucleotide
ttggagacagacggcagcctgtacctg

SEQ ID NO: 225883 - DNA, 27 bp, Artificial Sequence
  Description of Artificial Sequence: Synthetic oligonucleotide
tggagacagacggcagcctgtacctga

SEQ ID NO: 225884 - DNA, 26 bp, Artificial Sequence
  Description of Artificial Sequence: Synthetic oligonucleotide
ggagacagacggcagcctgtacctga

SEQ ID NO: 225885 - DNA, 27 bp, Artificial Sequence
  Description of Artificial Sequence: Synthetic oligonucleotide
gagacagacggcagcctgtacctgaca

SEQ ID NO: 225886 - DNA, 28 bp, Artificial Sequence
  Description of Artificial Sequence: Synthetic oligonucleotide
agacagacggcagcctgtacctgacaac

SEQ ID NO: 225887 - DNA, 27 bp, Artificial Sequence
  Description of Artificial Sequence: Synthetic oligonucleotide
gacagacggcagcctgtacctgacaac

SEQ ID NO: 225888 - DNA, 27 bp, Artificial Sequence
  Description of Artificial Sequence: Synthetic oligonucleotide
acagacggcagcctgtacctgacaacc

SEQ ID NO: 225889 - DNA, 26 bp, Artificial Sequence
  Description of Artificial Sequence: Synthetic oligonucleotide
cagacggcagcctgtacctgacaacc

SEQ ID NO: 225890 - DNA, 26 bp, Artificial Sequence
  Description of Artificial Sequence: Synthetic oligonucleotide
agacggcagcctgtacctgacaaccc

SEQ ID NO: 225891 - DNA, 25 bp, Artificial Sequence
  Description of Artificial Sequence: Synthetic oligonucleotide
gacggcagcctgtacctgacaaccc

SEQ ID NO: 225892 - DNA, 25 bp, Artificial Sequence
  Description of Artificial Sequence: Synthetic oligonucleotide
acggcagcctgtacctgacaacccc

SEQ ID NO: 225893 - DNA, 24 bp, Artificial Sequence
  Description of Artificial Sequence: Synthetic oligonucleotide
cggcagcctgtacctgacaacccc

SEQ ID NO: 225894 - DNA, 25 bp, Artificial Sequence
  Description of Artificial Sequence: Synthetic oligonucleotide
ggcagcctgtacctgacaaccccca

SEQ ID NO: 225895 - DNA, 26 bp, Artificial Sequence
  Description of Artificial Sequence: Synthetic oligonucleotide
gcagcctgtacctgacaacccccaga

SEQ ID NO: 225896 - DNA, 27 bp, Artificial Sequence
  Description of Artificial Sequence: Synthetic oligonucleotide
cagcctgtacctgacaacccccagaga

SEQ ID NO: 225897 - DNA, 30 bp, Artificial Sequence
  Description of Artificial Sequence: Synthetic oligonucleotide
agcctgtacctgacaacccccagagatttg

SEQ ID NO: 225898 - DNA, 29 bp, Artificial Sequence
  Description of Artificial Sequence: Synthetic oligonucleotide
gcctgtacctgacaacccccagagatttg

SEQ ID NO: 225899 - DNA, 33 bp, Artificial Sequence
  Description of Artificial Sequence: Synthetic oligonucleotide
cctgtacctgacaacccccagagatttgatttc

SEQ ID NO: 225900 - DNA, 33 bp, Artificial Sequence
  Description of Artificial Sequence: Synthetic oligonucleotide
ctgtacctgacaacccccagagatttgatttcg

SEQ ID NO: 225901 - DNA, 35 bp, Artificial Sequence
  Description of Artificial Sequence: Synthetic oligonucleotide
tgtacctgacaacccccagagatttgatttcgttg

SEQ ID NO: 225902 - DNA, 34 bp, Artificial Sequence
  Description of Artificial Sequence: Synthetic oligonucleotide
gtacctgacaacccccagagatttgatttcgttg

SEQ ID NO: 225903 - DNA, 35 bp, Artificial Sequence
  Description of Artificial Sequence: Synthetic oligonucleotide
tacctgacaacccccagagatttgatttcgttgtc

SEQ ID NO: 225904 - DNA, 34 bp, Artificial Sequence
  Description of Artificial Sequence: Synthetic oligonucleotide
acctgacaacccccagagatttgatttcgttgtc

SEQ ID NO: 225905 - DNA, 33 bp, Artificial Sequence
  Description of Artificial Sequence: Synthetic oligonucleotide
cctgacaacccccagagatttgatttcgttgtc

SEQ ID NO: 225906 - DNA, 34 bp, Artificial Sequence
  Description of Artificial Sequence: Synthetic oligonucleotide
ctgacaacccccagagatttgatttcgttgtcag

SEQ ID NO: 225907 - DNA, 34 bp, Artificial Sequence
  Description of Artificial Sequence: Synthetic oligonucleotide
tgacaacccccagagatttgatttcgttgtcagc

SEQ ID NO: 225908 - DNA, 33 bp, Artificial Sequence
  Description of Artificial Sequence: Synthetic oligonucleotide
gacaacccccagagatttgatttcgttgtcagc

SEQ ID NO: 225909 - DNA, 35 bp, Artificial Sequence
  Description of Artificial Sequence: Synthetic oligonucleotide
acaacccccagagatttgatttcgttgtcagcatc

SEQ ID NO: 225910 - DNA, 34 bp, Artificial Sequence
  Description of Artificial Sequence: Synthetic oligonucleotide
caacccccagagatttgatttcgttgtcagcatc

SEQ ID NO: 225911 - DNA, 34 bp, Artificial Sequence
  Description of Artificial Sequence: Synthetic oligonucleotide
aacccccagagatttgatttcgttgtcagcatcc

SEQ ID NO: 225912 - DNA, 33 bp, Artificial Sequence
  Description of Artificial Sequence: Synthetic oligonucleotide
acccccagagatttgatttcgttgtcagcatcc

SEQ ID NO: 225913 - DNA, 32 bp, Artificial Sequence
  Description of Artificial Sequence: Synthetic oligonucleotide
cccccagagatttgatttcgttgtcagcatcc

SEQ ID NO: 225914 - DNA, 34 bp, Artificial Sequence
  Description of Artificial Sequence: Synthetic oligonucleotide
ccccagagatttgatttcgttgtcagcatcctag

SEQ ID NO: 225915 - DNA, 34 bp, Artificial Sequence
  Description of Artificial Sequence: Synthetic oligonucleotide
cccagagatttgatttcgttgtcagcatcctagg

SEQ ID NO: 225916 - DNA, 34 bp, Artificial Sequence
  Description of Artificial Sequence: Synthetic oligonucleotide
ccagagatttgatttcgttgtcagcatcctaggc

SEQ ID NO: 225917 - DNA, 35 bp, Artificial Sequence
  Description of Artificial Sequence: Synthetic oligonucleotide
cagagatttgatttcgttgtcagcatcctaggctc

SEQ ID NO: 225918 - DNA, 36 bp, Artificial Sequence
  Description of Artificial Sequence: Synthetic oligonucleotide
agagatttgatttcgttgtcagcatcctaggctctg

SEQ ID NO: 225919 - DNA, 35 bp, Artificial Sequence
  Description of Artificial Sequence: Synthetic oligonucleotide
gagatttgatttcgttgtcagcatcctaggctctg

SEQ ID NO: 225920 - DNA, 36 bp, Artificial Sequence
  Description of Artificial Sequence: Synthetic oligonucleotide
agatttgatttcgttgtcagcatcctaggctctgag

SEQ ID NO: 225921 - DNA, 35 bp, Artificial Sequence
  Description of Artificial Sequence: Synthetic oligonucleotide
gatttgatttcgttgtcagcatcctaggctctgag

SEQ ID NO: 225922 - DNA, 37 bp, Artificial Sequence
  Description of Artificial Sequence: Synthetic oligonucleotide
atttgatttcgttgtcagcatcctaggctctgagtac

SEQ ID NO: 225923 - DNA, 36 bp, Artificial Sequence
  Description of Artificial Sequence: Synthetic oligonucleotide
tttgatttcgttgtcagcatcctaggctctgagtac

SEQ ID NO: 225924 - DNA, 35 bp, Artificial Sequence
  Description of Artificial Sequence: Synthetic oligonucleotide
ttgatttcgttgtcagcatcctaggctctgagtac

SEQ ID NO: 225925 - DNA, 34 bp, Artificial Sequence
  Description of Artificial Sequence: Synthetic oligonucleotide
tgatttcgttgtcagcatcctaggctctgagtac

SEQ ID NO: 225926 - DNA, 33 bp, Artificial Sequence
  Description of Artificial Sequence: Synthetic oligonucleotide
gatttcgttgtcagcatcctaggctctgagtac

SEQ ID NO: 225927 - DNA, 35 bp, Artificial Sequence
  Description of Artificial Sequence: Synthetic oligonucleotide
atttcgttgtcagcatcctaggctctgagtacttc

SEQ ID NO: 225928 - DNA, 34 bp, Artificial Sequence
  Description of Artificial Sequence: Synthetic oligonucleotide
tttcgttgtcagcatcctaggctctgagtacttc

SEQ ID NO: 225929 - DNA, 33 bp, Artificial Sequence
  Description of Artificial Sequence: Synthetic oligonucleotide
ttcgttgtcagcatcctaggctctgagtacttc

SEQ ID NO: 225930 - DNA, 32 bp, Artificial Sequence
  Description of Artificial Sequence: Synthetic oligonucleotide
tcgttgtcagcatcctaggctctgagtacttc

SEQ ID NO: 225931 - DNA, 31 bp, Artificial Sequence
  Description of Artificial Sequence: Synthetic oligonucleotide
cgttgtcagcatcctaggctctgagtacttc

SEQ ID NO: 225932 - DNA, 32 bp, Artificial Sequence
  Description of Artificial Sequence: Synthetic oligonucleotide
gttgtcagcatcctaggctctgagtacttcac

SEQ ID NO: 225933 - DNA, 32 bp, Artificial Sequence
  Description of Artificial Sequence: Synthetic oligonucleotide
ttgtcagcatcctaggctctgagtacttcacg

SEQ ID NO: 225934 - DNA, 31 bp, Artificial Sequence
  Description of Artificial Sequence: Synthetic oligonucleotide
tgtcagcatcctaggctctgagtacttcacg

SEQ ID NO: 225935 - DNA, 30 bp, Artificial Sequence
  Description of Artificial Sequence: Synthetic oligonucleotide
gtcagcatcctaggctctgagtacttcacg

SEQ ID NO: 225936 - DNA, 31 bp, Artificial Sequence
  Description of Artificial Sequence: Synthetic oligonucleotide
tcagcatcctaggctctgagtacttcacgac

SEQ ID NO: 225937 - DNA, 30 bp, Artificial Sequence
  Description of Artificial Sequence: Synthetic oligonucleotide
cagcatcctaggctctgagtacttcacgac

SEQ ID NO: 225938 - DNA, 31 bp, Artificial Sequence
  Description of Artificial Sequence: Synthetic oligonucleotide
agcatcctaggctctgagtacttcacgactg

SEQ ID NO: 225939 - DNA, 30 bp, Artificial Sequence
  Description of Artificial Sequence: Synthetic oligonucleotide
gcatcctaggctctgagtacttcacgactg

SEQ ID NO: 225940 - DNA, 30 bp, Artificial Sequence
  Description of Artificial Sequence: Synthetic oligonucleotide
catcctaggctctgagtacttcacgactgg

SEQ ID NO: 225941 - DNA, 30 bp, Artificial Sequence
  Description of Artificial Sequence: Synthetic oligonucleotide
atcctaggctctgagtacttcacgactggc

SEQ ID NO: 225942 - DNA, 29 bp, Artificial Sequence
  Description of Artificial Sequence: Synthetic oligonucleotide
tcctaggctctgagtacttcacgactggc

SEQ ID NO: 225943 - DNA, 28 bp, Artificial Sequence
  Description of Artificial Sequence: Synthetic oligonucleotide
cctaggctctgagtacttcacgactggc

SEQ ID NO: 225944 - DNA, 29 bp, Artificial Sequence
  Description of Artificial Sequence: Synthetic oligonucleotide
ctaggctctgagtacttcacgactggctg

SEQ ID NO: 225945 - DNA, 29 bp, Artificial Sequence
  Description of Artificial Sequence: Synthetic oligonucleotide
taggctctgagtacttcacgactggctgc

SEQ ID NO: 225946 - DNA, 28 bp, Artificial Sequence
  Description of Artificial Sequence: Synthetic oligonucleotide
aggctctgagtacttcacgactggctgc

SEQ ID NO: 225947 - DNA, 27 bp, Artificial Sequence
  Description of Artificial Sequence: Synthetic oligonucleotide
ggctctgagtacttcacgactggctgc

SEQ ID NO: 225948 - DNA, 27 bp, Artificial Sequence
  Description of Artificial Sequence: Synthetic oligonucleotide
gctctgagtacttcacgactggctgcc

SEQ ID NO: 225949 - DNA, 28 bp, Artificial Sequence
  Description of Artificial Sequence: Synthetic oligonucleotide
ctctgagtacttcacgactggctgccac

SEQ ID NO: 225950 - DNA, 30 bp, Artificial Sequence
  Description of Artificial Sequence: Synthetic oligonucleotide
tctgagtacttcacgactggctgccactac

SEQ ID NO: 225951 - DNA, 29 bp, Artificial Sequence
  Description of Artificial Sequence: Synthetic oligonucleotide
ctgagtacttcacgactggctgccactac

SEQ ID NO: 225952 - DNA, 30 bp, Artificial Sequence
  Description of Artificial Sequence: Synthetic oligonucleotide
tgagtacttcacgactggctgccactactg

SEQ ID NO: 225953 - DNA, 29 bp, Artificial Sequence
  Description of Artificial Sequence: Synthetic oligonucleotide
gagtacttcacgactggctgccactactg

SEQ ID NO: 225954 - DNA, 29 bp, Artificial Sequence
  Description of Artificial Sequence: Synthetic oligonucleotide
agtacttcacgactggctgccactactgg

SEQ ID NO: 225955 - DNA, 28 bp, Artificial Sequence
  Description of Artificial Sequence: Synthetic oligonucleotide
gtacttcacgactggctgccactactgg

SEQ ID NO: 225956 - DNA, 28 bp, Artificial Sequence
  Description of Artificial Sequence: Synthetic oligonucleotide
tacttcacgactggctgccactactggg

SEQ ID NO: 225957 - DNA, 27 bp, Artificial Sequence
  Description of Artificial Sequence: Synthetic oligonucleotide
acttcacgactggctgccactactggg

SEQ ID NO: 225958 - DNA, 27 bp, Artificial Sequence
  Description of Artificial Sequence: Synthetic oligonucleotide
cttcacgactggctgccactactggga

SEQ ID NO: 225959 - DNA, 27 bp, Artificial Sequence
  Description of Artificial Sequence: Synthetic oligonucleotide
ttcacgactggctgccactactgggag

SEQ ID NO: 225960 - DNA, 26 bp, Artificial Sequence
  Description of Artificial Sequence: Synthetic oligonucleotide
tcacgactggctgccactactgggag

SEQ ID NO: 225961 - DNA, 25 bp, Artificial Sequence
  Description of Artificial Sequence: Synthetic oligonucleotide
cacgactggctgccactactgggag

SEQ ID NO: 225962 - DNA, 26 bp, Artificial Sequence
  Description of Artificial Sequence: Synthetic oligonucleotide
acgactggctgccactactgggaggt

SEQ ID NO: 225963 - DNA, 25 bp, Artificial Sequence
  Description of Artificial Sequence: Synthetic oligonucleotide
cgactggctgccactactgggaggt

SEQ ID NO: 225964 - DNA, 27 bp, Artificial Sequence
  Description of Artificial Sequence: Synthetic oligonucleotide
gactggctgccactactgggaggtgta

SEQ ID NO: 225965 - DNA, 28 bp, Artificial Sequence
  Description of Artificial Sequence: Synthetic oligonucleotide
actggctgccactactgggaggtgtatg

SEQ ID NO: 225966 - DNA, 27 bp, Artificial Sequence
  Description of Artificial Sequence: Synthetic oligonucleotide
ctggctgccactactgggaggtgtatg

SEQ ID NO: 225967 - DNA, 28 bp, Artificial Sequence
  Description of Artificial Sequence: Synthetic oligonucleotide
tggctgccactactgggaggtgtatgtg

SEQ ID NO: 225968 - DNA, 27 bp, Artificial Sequence
  Description of Artificial Sequence: Synthetic oligonucleotide
ggctgccactactgggaggtgtatgtg

SEQ ID NO: 225969 - DNA, 27 bp, Artificial Sequence
  Description of Artificial Sequence: Synthetic oligonucleotide
gctgccactactgggaggtgtatgtgg

SEQ ID NO: 225970 - DNA, 27 bp, Artificial Sequence
  Description of Artificial Sequence: Synthetic oligonucleotide
ctgccactactgggaggtgtatgtggg

SEQ ID NO: 225971 - DNA, 28 bp, Artificial Sequence
  Description of Artificial Sequence: Synthetic oligonucleotide
tgccactactgggaggtgtatgtgggag

SEQ ID NO: 225972 - DNA, 27 bp, Artificial Sequence
  Description of Artificial Sequence: Synthetic oligonucleotide
gccactactgggaggtgtatgtgggag

SEQ ID NO: 225973 - DNA, 28 bp, Artificial Sequence
  Description of Artificial Sequence: Synthetic oligonucleotide
ccactactgggaggtgtatgtgggagac

SEQ ID NO: 225974 - DNA, 30 bp, Artificial Sequence
  Description of Artificial Sequence: Synthetic oligonucleotide
cactactgggaggtgtatgtgggagacaag

SEQ ID NO: 225975 - DNA, 31 bp, Artificial Sequence
  Description of Artificial Sequence: Synthetic oligonucleotide
actactgggaggtgtatgtgggagacaagac

SEQ ID NO: 225976 - DNA, 30 bp, Artificial Sequence
  Description of Artificial Sequence: Synthetic oligonucleotide
ctactgggaggtgtatgtgggagacaagac

SEQ ID NO: 225977 - DNA, 30 bp, Artificial Sequence
  Description of Artificial Sequence: Synthetic oligonucleotide
tactgggaggtgtatgtgggagacaagacc

SEQ ID NO: 225978 - DNA, 29 bp, Artificial Sequence
  Description of Artificial Sequence: Synthetic oligonucleotide
actgggaggtgtatgtgggagacaagacc

SEQ ID NO: 225979 - DNA, 28 bp, Artificial Sequence
  Description of Artificial Sequence: Synthetic oligonucleotide
ctgggaggtgtatgtgggagacaagacc

SEQ ID NO: 225980 - DNA, 32 bp, Artificial Sequence
  Description of Artificial Sequence: Synthetic oligonucleotide
tgggaggtgtatgtgggagacaagaccaaatg

SEQ ID NO: 225981 - DNA, 31 bp, Artificial Sequence
  Description of Artificial Sequence: Synthetic oligonucleotide
gggaggtgtatgtgggagacaagaccaaatg

SEQ ID NO: 225982 - DNA, 31 bp, Artificial Sequence
  Description of Artificial Sequence: Synthetic oligonucleotide
ggaggtgtatgtgggagacaagaccaaatgg

SEQ ID NO: 225983 - DNA, 34 bp, Artificial Sequence
  Description of Artificial Sequence: Synthetic oligonucleotide
gaggtgtatgtgggagacaagaccaaatggattc

SEQ ID NO: 225984 - DNA, 36 bp, Artificial Sequence
  Description of Artificial Sequence: Synthetic oligonucleotide
aggtgtatgtgggagacaagaccaaatggattcttg

SEQ ID NO: 225985 - DNA, 35 bp, Artificial Sequence
  Description of Artificial Sequence: Synthetic oligonucleotide
ggtgtatgtgggagacaagaccaaatggattcttg

SEQ ID NO: 225986 - DNA, 35 bp, Artificial Sequence
  Description of Artificial Sequence: Synthetic oligonucleotide
gtgtatgtgggagacaagaccaaatggattcttgg

SEQ ID NO: 225987 - DNA, 36 bp, Artificial Sequence
  Description of Artificial Sequence: Synthetic oligonucleotide
tgtatgtgggagacaagaccaaatggattcttggag

SEQ ID NO: 225988 - DNA, 35 bp, Artificial Sequence
  Description of Artificial Sequence: Synthetic oligonucleotide
gtatgtgggagacaagaccaaatggattcttggag

SEQ ID NO: 225989 - DNA, 38 bp, Artificial Sequence
  Description of Artificial Sequence: Synthetic oligonucleotide
tatgtgggagacaagaccaaatggattcttggagtatg

SEQ ID NO: 225990 - DNA, 37 bp, Artificial Sequence
  Description of Artificial Sequence: Synthetic oligonucleotide
atgtgggagacaagaccaaatggattcttggagtatg

SEQ ID NO: 225991 - DNA, 36 bp, Artificial Sequence
  Description of Artificial Sequence: Synthetic oligonucleotide
tgtgggagacaagaccaaatggattcttggagtatg

SEQ ID NO: 225992 - DNA, 35 bp, Artificial Sequence
  Description of Artificial Sequence: Synthetic oligonucleotide
gtgggagacaagaccaaatggattcttggagtatg

SEQ ID NO: 225993 - DNA, 37 bp, Artificial Sequence
  Description of Artificial Sequence: Synthetic oligonucleotide
tgggagacaagaccaaatggattcttggagtatgtag

SEQ ID NO: 225994 - DNA, 36 bp, Artificial Sequence
  Description of Artificial Sequence: Synthetic oligonucleotide
gggagacaagaccaaatggattcttggagtatgtag

SEQ ID NO: 225995 - DNA, 37 bp, Artificial Sequence
  Description of Artificial Sequence: Synthetic oligonucleotide
ggagacaagaccaaatggattcttggagtatgtagtg

SEQ ID NO: 225996 - DNA, 38 bp, Artificial Sequence
  Description of Artificial Sequence: Synthetic oligonucleotide
gagacaagaccaaatggattcttggagtatgtagtgag

SEQ ID NO: 225997 - DNA, 39 bp, Artificial Sequence
  Description of Artificial Sequence: Synthetic oligonucleotide
agacaagaccaaatggattcttggagtatgtagtgagtc

SEQ ID NO: 225998 - DNA, 38 bp, Artificial Sequence
  Description of Artificial Sequence: Synthetic oligonucleotide
gacaagaccaaatggattcttggagtatgtagtgagtc

SEQ ID NO: 225999 - DNA, 39 bp, Artificial Sequence
  Description of Artificial Sequence: Synthetic oligonucleotide
acaagaccaaatggattcttggagtatgtagtgagtcag

SEQ ID NO: 226000 - DNA, 38 bp, Artificial Sequence
  Description of Artificial Sequence: Synthetic oligonucleotide
caagaccaaatggattcttggagtatgtagtgagtcag

SEQ ID NO: 226001 - DNA, 39 bp, Artificial Sequence
  Description of Artificial Sequence: Synthetic oligonucleotide
aagaccaaatggattcttggagtatgtagtgagtcagtg

SEQ ID NO: 226002 - DNA, 38 bp, Artificial Sequence
  Description of Artificial Sequence: Synthetic oligonucleotide
agaccaaatggattcttggagtatgtagtgagtcagtg

SEQ ID NO: 226003 - DNA, 37 bp, Artificial Sequence
  Description of Artificial Sequence: Synthetic oligonucleotide
gaccaaatggattcttggagtatgtagtgagtcagtg

SEQ ID NO: 226004 - DNA, 38 bp, Artificial Sequence
  Description of Artificial Sequence: Synthetic oligonucleotide
accaaatggattcttggagtatgtagtgagtcagtgag

SEQ ID NO: 226005 - DNA, 37 bp, Artificial Sequence
  Description of Artificial Sequence: Synthetic oligonucleotide
ccaaatggattcttggagtatgtagtgagtcagtgag

SEQ ID NO: 226006 - DNA, 37 bp, Artificial Sequence
  Description of Artificial Sequence: Synthetic oligonucleotide
caaatggattcttggagtatgtagtgagtcagtgagc

SEQ ID NO: 226007 - DNA, 38 bp, Artificial Sequence
  Description of Artificial Sequence: Synthetic oligonucleotide
aaatggattcttggagtatgtagtgagtcagtgagcag

SEQ ID NO: 226008 - DNA, 37 bp, Artificial Sequence
  Description of Artificial Sequence: Synthetic oligonucleotide
aatggattcttggagtatgtagtgagtcagtgagcag

SEQ ID NO: 226009 - DNA, 36 bp, Artificial Sequence
  Description of Artificial Sequence: Synthetic oligonucleotide
atggattcttggagtatgtagtgagtcagtgagcag

SEQ ID NO: 226010 - DNA, 35 bp, Artificial Sequence
  Description of Artificial Sequence: Synthetic oligonucleotide
tggattcttggagtatgtagtgagtcagtgagcag

SEQ ID NO: 226011 - DNA, 34 bp, Artificial Sequence
  Description of Artificial Sequence: Synthetic oligonucleotide
ggattcttggagtatgtagtgagtcagtgagcag

SEQ ID NO: 226012 - DNA, 34 bp, Artificial Sequence
  Description of Artificial Sequence: Synthetic oligonucleotide
gattcttggagtatgtagtgagtcagtgagcagg

SEQ ID NO: 226013 - DNA, 36 bp, Artificial Sequence
  Description of Artificial Sequence: Synthetic oligonucleotide
attcttggagtatgtagtgagtcagtgagcaggaag

SEQ ID NO: 226014 - DNA, 35 bp, Artificial Sequence
  Description of Artificial Sequence: Synthetic oligonucleotide
ttcttggagtatgtagtgagtcagtgagcaggaag

SEQ ID NO: 226015 - DNA, 34 bp, Artificial Sequence
  Description of Artificial Sequence: Synthetic oligonucleotide
tcttggagtatgtagtgagtcagtgagcaggaag

SEQ ID NO: 226016 - DNA, 33 bp, Artificial Sequence
  Description of Artificial Sequence: Synthetic oligonucleotide
cttggagtatgtagtgagtcagtgagcaggaag

SEQ ID NO: 226017 - DNA, 33 bp, Artificial Sequence
  Description of Artificial Sequence: Synthetic oligonucleotide
ttggagtatgtagtgagtcagtgagcaggaagg

SEQ ID NO: 226018 - DNA, 32 bp, Artificial Sequence
  Description of Artificial Sequence: Synthetic oligonucleotide
tggagtatgtagtgagtcagtgagcaggaagg

SEQ ID NO: 226019 - DNA, 31 bp, Artificial Sequence
  Description of Artificial Sequence: Synthetic oligonucleotide
ggagtatgtagtgagtcagtgagcaggaagg

SEQ ID NO: 226020 - DNA, 31 bp, Artificial Sequence
  Description of Artificial Sequence: Synthetic oligonucleotide
gagtatgtagtgagtcagtgagcaggaaggg

SEQ ID NO: 226021 - DNA, 31 bp, Artificial Sequence
  Description of Artificial Sequence: Synthetic oligonucleotide
agtatgtagtgagtcagtgagcaggaagggg

SEQ ID NO: 226022 - DNA, 30 bp, Artificial Sequence
  Description of Artificial Sequence: Synthetic oligonucleotide
gtatgtagtgagtcagtgagcaggaagggg

SEQ ID NO: 226023 - DNA, 32 bp, Artificial Sequence
  Description of Artificial Sequence: Synthetic oligonucleotide
tatgtagtgagtcagtgagcaggaaggggaag

SEQ ID NO: 226024 - DNA, 31 bp, Artificial Sequence
  Description of Artificial Sequence: Synthetic oligonucleotide
atgtagtgagtcagtgagcaggaaggggaag

SEQ ID NO: 226025 - DNA, 30 bp, Artificial Sequence
  Description of Artificial Sequence: Synthetic oligonucleotide
tgtagtgagtcagtgagcaggaaggggaag

SEQ ID NO: 226026 - DNA, 29 bp, Artificial Sequence
  Description of Artificial Sequence: Synthetic oligonucleotide
gtagtgagtcagtgagcaggaaggggaag

SEQ ID NO: 226027 - DNA, 29 bp, Artificial Sequence
  Description of Artificial Sequence: Synthetic oligonucleotide
tagtgagtcagtgagcaggaaggggaagg

SEQ ID NO: 226028 - DNA, 28 bp, Artificial Sequence
  Description of Artificial Sequence: Synthetic oligonucleotide
agtgagtcagtgagcaggaaggggaagg

SEQ ID NO: 226029 - DNA, 27 bp, Artificial Sequence
  Description of Artificial Sequence: Synthetic oligonucleotide
gtgagtcagtgagcaggaaggggaagg

SEQ ID NO: 226030 - DNA, 30 bp, Artificial Sequence
  Description of Artificial Sequence: Synthetic oligonucleotide
tgagtcagtgagcaggaaggggaaggttac

SEQ ID NO: 226031 - DNA, 29 bp, Artificial Sequence
  Description of Artificial Sequence: Synthetic oligonucleotide
gagtcagtgagcaggaaggggaaggttac

SEQ ID NO: 226032 - DNA, 30 bp, Artificial Sequence
  Description of Artificial Sequence: Synthetic oligonucleotide
agtcagtgagcaggaaggggaaggttactg

SEQ ID NO: 226033 - DNA, 29 bp, Artificial Sequence
  Description of Artificial Sequence: Synthetic oligonucleotide
gtcagtgagcaggaaggggaaggttactg

SEQ ID NO: 226034 - DNA, 29 bp, Artificial Sequence
  Description of Artificial Sequence: Synthetic oligonucleotide
tcagtgagcaggaaggggaaggttactgc

SEQ ID NO: 226035 - DNA, 28 bp, Artificial Sequence
  Description of Artificial Sequence: Synthetic oligonucleotide
cagtgagcaggaaggggaaggttactgc

SEQ ID NO: 226036 - DNA, 28 bp, Artificial Sequence
  Description of Artificial Sequence: Synthetic oligonucleotide
agtgagcaggaaggggaaggttactgcc

SEQ ID NO: 226037 - DNA, 27 bp, Artificial Sequence
  Description of Artificial Sequence: Synthetic oligonucleotide
gtgagcaggaaggggaaggttactgcc

SEQ ID NO: 226038 - DNA, 28 bp, Artificial Sequence
  Description of Artificial Sequence: Synthetic oligonucleotide
tgagcaggaaggggaaggttactgcctc

SEQ ID NO: 226039 - DNA, 27 bp, Artificial Sequence
  Description of Artificial Sequence: Synthetic oligonucleotide
gagcaggaaggggaaggttactgcctc

SEQ ID NO: 226040 - DNA, 28 bp, Artificial Sequence
  Description of Artificial Sequence: Synthetic oligonucleotide
agcaggaaggggaaggttactgcctcac

SEQ ID NO: 226041 - DNA, 27 bp, Artificial Sequence
  Description of Artificial Sequence: Synthetic oligonucleotide
gcaggaaggggaaggttactgcctcac

SEQ ID NO: 226042 - DNA, 27 bp, Artificial Sequence
  Description of Artificial Sequence: Synthetic oligonucleotide
caggaaggggaaggttactgcctcacc

SEQ ID NO: 226043 - DNA, 28 bp, Artificial Sequence
  Description of Artificial Sequence: Synthetic oligonucleotide
aggaaggggaaggttactgcctcacctg

SEQ ID NO: 226044 - DNA, 27 bp, Artificial Sequence
  Description of Artificial Sequence: Synthetic oligonucleotide
ggaaggggaaggttactgcctcacctg

SEQ ID NO: 226045 - DNA, 27 bp, Artificial Sequence
  Description of Artificial Sequence: Synthetic oligonucleotide
gaaggggaaggttactgcctcacctgc

SEQ ID NO: 226046 - DNA, 27 bp, Artificial Sequence
  Description of Artificial Sequence: Synthetic oligonucleotide
aaggggaaggttactgcctcacctgcc

SEQ ID NO: 226047 - DNA, 27 bp, Artificial Sequence
  Description of Artificial Sequence: Synthetic oligonucleotide
aggggaaggttactgcctcacctgcca

SEQ ID NO: 226048 - DNA, 27 bp, Artificial Sequence
  Description of Artificial Sequence: Synthetic oligonucleotide
ggggaaggttactgcctcacctgccaa

SEQ ID NO: 226049 - DNA, 28 bp, Artificial Sequence
  Description of Artificial Sequence: Synthetic oligonucleotide
gggaaggttactgcctcacctgccaatg

SEQ ID NO: 226050 - DNA, 28 bp, Artificial Sequence
  Description of Artificial Sequence: Synthetic oligonucleotide
ggaaggttactgcctcacctgccaatgg

SEQ ID NO: 226051 - DNA, 29 bp, Artificial Sequence
  Description of Artificial Sequence: Synthetic oligonucleotide
gaaggttactgcctcacctgccaatggac

SEQ ID NO: 226052 - DNA, 30 bp, Artificial Sequence
  Description of Artificial Sequence: Synthetic oligonucleotide
aaggttactgcctcacctgccaatggacac

SEQ ID NO: 226053 - DNA, 29 bp, Artificial Sequence
  Description of Artificial Sequence: Synthetic oligonucleotide
aggttactgcctcacctgccaatggacac

SEQ ID NO: 226054 - DNA, 28 bp, Artificial Sequence
  Description of Artificial Sequence: Synthetic oligonucleotide
ggttactgcctcacctgccaatggacac

SEQ ID NO: 226055 - DNA, 29 bp, Artificial Sequence
  Description of Artificial Sequence: Synthetic oligonucleotide
gttactgcctcacctgccaatggacactg

SEQ ID NO: 226056 - DNA, 29 bp, Artificial Sequence
  Description of Artificial Sequence: Synthetic oligonucleotide
ttactgcctcacctgccaatggacactgg

SEQ ID NO: 226057 - DNA, 28 bp, Artificial Sequence
  Description of Artificial Sequence: Synthetic oligonucleotide
tactgcctcacctgccaatggacactgg

SEQ ID NO: 226058 - DNA, 27 bp, Artificial Sequence
  Description of Artificial Sequence: Synthetic oligonucleotide
actgcctcacctgccaatggacactgg

SEQ ID NO: 226059 - DNA, 26 bp, Artificial Sequence
  Description of Artificial Sequence: Synthetic oligonucleotide
ctgcctcacctgccaatggacactgg

SEQ ID NO: 226060 - DNA, 27 bp, Artificial Sequence
  Description of Artificial Sequence: Synthetic oligonucleotide
tgcctcacctgccaatggacactggct

SEQ ID NO: 226061 - DNA, 27 bp, Artificial Sequence
  Description of Artificial Sequence: Synthetic oligonucleotide
gcctcacctgccaatggacactggctt

SEQ ID NO: 226062 - DNA, 27 bp, Artificial Sequence
  Description of Artificial Sequence: Synthetic oligonucleotide
cctcacctgccaatggacactggcttc

SEQ ID NO: 226063 - DNA, 28 bp, Artificial Sequence
  Description of Artificial Sequence: Synthetic oligonucleotide
ctcacctgccaatggacactggcttctg

SEQ ID NO: 226064 - DNA, 28 bp, Artificial Sequence
  Description of Artificial Sequence: Synthetic oligonucleotide
tcacctgccaatggacactggcttctgc

SEQ ID NO: 226065 - DNA, 27 bp, Artificial Sequence
  Description of Artificial Sequence: Synthetic oligonucleotide
cacctgccaatggacactggcttctgc

SEQ ID NO: 226066 - DNA, 27 bp, Artificial Sequence
  Description of Artificial Sequence: Synthetic oligonucleotide
acctgccaatggacactggcttctgcg

SEQ ID NO: 226067 - DNA, 27 bp, Artificial Sequence
  Description of Artificial Sequence: Synthetic oligonucleotide
cctgccaatggacactggcttctgcga

SEQ ID NO: 226068 - DNA, 27 bp, Artificial Sequence
  Description of Artificial Sequence: Synthetic oligonucleotide
ctgccaatggacactggcttctgcgac

SEQ ID NO: 226069 - DNA, 28 bp, Artificial Sequence
  Description of Artificial Sequence: Synthetic oligonucleotide
tgccaatggacactggcttctgcgacag

SEQ ID NO: 226070 - DNA, 27 bp, Artificial Sequence
  Description of Artificial Sequence: Synthetic oligonucleotide
gccaatggacactggcttctgcgacag

SEQ ID NO: 226071 - DNA, 28 bp, Artificial Sequence
  Description of Artificial Sequence: Synthetic oligonucleotide
ccaatggacactggcttctgcgacagag

SEQ ID NO: 226072 - DNA, 29 bp, Artificial Sequence
  Description of Artificial Sequence: Synthetic oligonucleotide
caatggacactggcttctgcgacagagtc

SEQ ID NO: 226073 - DNA, 29 bp, Artificial Sequence
  Description of Artificial Sequence: Synthetic oligonucleotide
aatggacactggcttctgcgacagagtcg

SEQ ID NO: 226074 - DNA, 28 bp, Artificial Sequence
  Description of Artificial Sequence: Synthetic oligonucleotide
atggacactggcttctgcgacagagtcg

SEQ ID NO: 226075 - DNA, 27 bp, Artificial Sequence
  Description of Artificial Sequence: Synthetic oligonucleotide
tggacactggcttctgcgacagagtcg

SEQ ID NO: 226076 - DNA, 27 bp, Artificial Sequence
  Description of Artificial Sequence: Synthetic oligonucleotide
ggacactggcttctgcgacagagtcgt

SEQ ID NO: 226077 - DNA, 27 bp, Artificial Sequence
  Description of Artificial Sequence: Synthetic oligonucleotide
gacactggcttctgcgacagagtcgtg

SEQ ID NO: 226078 - DNA, 27 bp, Artificial Sequence
  Description of Artificial Sequence: Synthetic oligonucleotide
acactggcttctgcgacagagtcgtgg

SEQ ID NO: 226079 - DNA, 26 bp, Artificial Sequence
  Description of Artificial Sequence: Synthetic oligonucleotide
cactggcttctgcgacagagtcgtgg

SEQ ID NO: 226080 - DNA, 27 bp, Artificial Sequence
  Description of Artificial Sequence: Synthetic oligonucleotide
actggcttctgcgacagagtcgtggga

SEQ ID NO: 226081 - DNA, 27 bp, Artificial Sequence
  Description of Artificial Sequence: Synthetic oligonucleotide
ctggcttctgcgacagagtcgtgggaa

SEQ ID NO: 226082 - DNA, 28 bp, Artificial Sequence
  Description of Artificial Sequence: Synthetic oligonucleotide
tggcttctgcgacagagtcgtgggaatg

SEQ ID NO: 226083 - DNA, 27 bp, Artificial Sequence
  Description of Artificial Sequence: Synthetic oligonucleotide
ggcttctgcgacagagtcgtgggaatg

SEQ ID NO: 226084 - DNA, 28 bp, Artificial Sequence
  Description of Artificial Sequence: Synthetic oligonucleotide
gcttctgcgacagagtcgtgggaatgag

SEQ ID NO: 226085 - DNA, 31 bp, Artificial Sequence
  Description of Artificial Sequence: Synthetic oligonucleotide
cttctgcgacagagtcgtgggaatgagtatg

SEQ ID NO: 226086 - DNA, 33 bp, Artificial Sequence
  Description of Artificial Sequence: Synthetic oligonucleotide
ttctgcgacagagtcgtgggaatgagtatgaag

SEQ ID NO: 226087 - DNA, 32 bp, Artificial Sequence
  Description of Artificial Sequence: Synthetic oligonucleotide
tctgcgacagagtcgtgggaatgagtatgaag

SEQ ID NO: 226088 - DNA, 31 bp, Artificial Sequence
  Description of Artificial Sequence: Synthetic oligonucleotide
ctgcgacagagtcgtgggaatgagtatgaag

SEQ ID NO: 226089 - DNA, 31 bp, Artificial Sequence
  Description of Artificial Sequence: Synthetic oligonucleotide
tgcgacagagtcgtgggaatgagtatgaagc

SEQ ID NO: 226090 - DNA, 30 bp, Artificial Sequence
  Description of Artificial Sequence: Synthetic oligonucleotide
gcgacagagtcgtgggaatgagtatgaagc

SEQ ID NO: 226091 - DNA, 31 bp, Artificial Sequence
  Description of Artificial Sequence: Synthetic oligonucleotide
cgacagagtcgtgggaatgagtatgaagctc

SEQ ID NO: 226092 - DNA, 32 bp, Artificial Sequence
  Description of Artificial Sequence: Synthetic oligonucleotide
gacagagtcgtgggaatgagtatgaagctctc

SEQ ID NO: 226093 - DNA, 33 bp, Artificial Sequence
  Description of Artificial Sequence: Synthetic oligonucleotide
acagagtcgtgggaatgagtatgaagctctcac

SEQ ID NO: 226094 - DNA, 32 bp, Artificial Sequence
  Description of Artificial Sequence: Synthetic oligonucleotide
cagagtcgtgggaatgagtatgaagctctcac

SEQ ID NO: 226095 - DNA, 34 bp, Artificial Sequence
  Description of Artificial Sequence: Synthetic oligonucleotide
agagtcgtgggaatgagtatgaagctctcacatc

SEQ ID NO: 226096 - DNA, 33 bp, Artificial Sequence
  Description of Artificial Sequence: Synthetic oligonucleotide
gagtcgtgggaatgagtatgaagctctcacatc

SEQ ID NO: 226097 - DNA, 33 bp, Artificial Sequence
  Description of Artificial Sequence: Synthetic oligonucleotide
agtcgtgggaatgagtatgaagctctcacatcc

SEQ ID NO: 226098 - DNA, 32 bp, Artificial Sequence
  Description of Artificial Sequence: Synthetic oligonucleotide
gtcgtgggaatgagtatgaagctctcacatcc

SEQ ID NO: 226099 - DNA, 32 bp, Artificial Sequence
  Description of Artificial Sequence: Synthetic oligonucleotide
tcgtgggaatgagtatgaagctctcacatccc

SEQ ID NO: 226100 - DNA, 31 bp, Artificial Sequence
  Description of Artificial Sequence: Synthetic oligonucleotide
cgtgggaatgagtatgaagctctcacatccc

SEQ ID NO: 226101 - DNA, 31 bp, Artificial Sequence
  Description of Artificial Sequence: Synthetic oligonucleotide
gtgggaatgagtatgaagctctcacatcccc

SEQ ID NO: 226102 - DNA, 31 bp, Artificial Sequence
  Description of Artificial Sequence: Synthetic oligonucleotide
tgggaatgagtatgaagctctcacatccccg

SEQ ID NO: 226103 - DNA, 30 bp, Artificial Sequence
  Description of Artificial Sequence: Synthetic oligonucleotide
gggaatgagtatgaagctctcacatccccg

SEQ ID NO: 226104 - DNA, 30 bp, Artificial Sequence
  Description of Artificial Sequence: Synthetic oligonucleotide
ggaatgagtatgaagctctcacatccccgc

SEQ ID NO: 226105 - DNA, 31 bp, Artificial Sequence
  Description of Artificial Sequence: Synthetic oligonucleotide
gaatgagtatgaagctctcacatccccgcag

SEQ ID NO: 226106 - DNA, 32 bp, Artificial Sequence
  Description of Artificial Sequence: Synthetic oligonucleotide
aatgagtatgaagctctcacatccccgcagac

SEQ ID NO: 226107 - DNA, 31 bp, Artificial Sequence
  Description of Artificial Sequence: Synthetic oligonucleotide
atgagtatgaagctctcacatccccgcagac

SEQ ID NO: 226108 - DNA, 30 bp, Artificial Sequence
  Description of Artificial Sequence: Synthetic oligonucleotide
tgagtatgaagctctcacatccccgcagac

SEQ ID NO: 226109 - DNA, 29 bp, Artificial Sequence
  Description of Artificial Sequence: Synthetic oligonucleotide
gagtatgaagctctcacatccccgcagac

SEQ ID NO: 226110 - DNA, 29 bp, Artificial Sequence
  Description of Artificial Sequence: Synthetic oligonucleotide
agtatgaagctctcacatccccgcagacc

SEQ ID NO: 226111 - DNA, 28 bp, Artificial Sequence
  Description of Artificial Sequence: Synthetic oligonucleotide
gtatgaagctctcacatccccgcagacc

SEQ ID NO: 226112 - DNA, 29 bp, Artificial Sequence
  Description of Artificial Sequence: Synthetic oligonucleotide
tatgaagctctcacatccccgcagacctc

SEQ ID NO: 226113 - DNA, 28 bp, Artificial Sequence
  Description of Artificial Sequence: Synthetic oligonucleotide
atgaagctctcacatccccgcagacctc

SEQ ID NO: 226114 - DNA, 27 bp, Artificial Sequence
  Description of Artificial Sequence: Synthetic oligonucleotide
tgaagctctcacatccccgcagacctc

SEQ ID NO: 226115 - DNA, 26 bp, Artificial Sequence
  Description of Artificial Sequence: Synthetic oligonucleotide
gaagctctcacatccccgcagacctc

SEQ ID NO: 226116 - DNA, 27 bp, Artificial Sequence
  Description of Artificial Sequence: Synthetic oligonucleotide
aagctctcacatccccgcagacctcct

SEQ ID NO: 226117 - DNA, 27 bp, Artificial Sequence
  Description of Artificial Sequence: Synthetic oligonucleotide
agctctcacatccccgcagacctcctt

SEQ ID NO: 226118 - DNA, 26 bp, Artificial Sequence
  Description of Artificial Sequence: Synthetic oligonucleotide
gctctcacatccccgcagacctcctt

SEQ ID NO: 226119 - DNA, 26 bp, Artificial Sequence
  Description of Artificial Sequence: Synthetic oligonucleotide
ctctcacatccccgcagacctccttc

SEQ ID NO: 226120 - DNA, 26 bp, Artificial Sequence
  Description of Artificial Sequence: Synthetic oligonucleotide
tctcacatccccgcagacctccttcc

SEQ ID NO: 226121 - DNA, 25 bp, Artificial Sequence
  Description of Artificial Sequence: Synthetic oligonucleotide
ctcacatccccgcagacctccttcc

SEQ ID NO: 226122 - DNA, 25 bp, Artificial Sequence
  Description of Artificial Sequence: Synthetic oligonucleotide
tcacatccccgcagacctccttccg

SEQ ID NO: 226123 - DNA, 24 bp, Artificial Sequence
  Description of Artificial Sequence: Synthetic oligonucleotide
cacatccccgcagacctccttccg

SEQ ID NO: 226124 - DNA, 24 bp, Artificial Sequence
  Description of Artificial Sequence: Synthetic oligonucleotide
acatccccgcagacctccttccgc

SEQ ID NO: 226125 - DNA, 23 bp, Artificial Sequence
  Description of Artificial Sequence: Synthetic oligonucleotide
catccccgcagacctccttccgc

SEQ ID NO: 226126 - DNA, 27 bp, Artificial Sequence
  Description of Artificial Sequence: Synthetic oligonucleotide
atccccgcagacctccttccgccttaa

SEQ ID NO: 226127 - DNA, 27 bp, Artificial Sequence
  Description of Artificial Sequence: Synthetic oligonucleotide
tccccgcagacctccttccgccttaaa

SEQ ID NO: 226128 - DNA, 26 bp, Artificial Sequence
  Description of Artificial Sequence: Synthetic oligonucleotide
ccccgcagacctccttccgccttaaa

SEQ ID NO: 226129 - DNA, 27 bp, Artificial Sequence
  Description of Artificial Sequence: Synthetic oligonucleotide
cccgcagacctccttccgccttaaaga

SEQ ID NO: 226130 - DNA, 27 bp, Artificial Sequence
  Description of Artificial Sequence: Synthetic oligonucleotide
ccgcagacctccttccgccttaaagag

SEQ ID NO: 226131 - DNA, 27 bp, Artificial Sequence
  Description of Artificial Sequence: Synthetic oligonucleotide
cgcagacctccttccgccttaaagagc

SEQ ID NO: 226132 - DNA, 27 bp, Artificial Sequence
  Description of Artificial Sequence: Synthetic oligonucleotide
gcagacctccttccgccttaaagagcc

SEQ ID NO: 226133 - DNA, 28 bp, Artificial Sequence
  Description of Artificial Sequence: Synthetic oligonucleotide
cagacctccttccgccttaaagagcctc

SEQ ID NO: 226134 - DNA, 28 bp, Artificial Sequence
  Description of Artificial Sequence: Synthetic oligonucleotide
agacctccttccgccttaaagagcctcc

SEQ ID NO: 226135 - DNA, 27 bp, Artificial Sequence
  Description of Artificial Sequence: Synthetic oligonucleotide
gacctccttccgccttaaagagcctcc

SEQ ID NO: 226136 - DNA, 28 bp, Artificial Sequence
  Description of Artificial Sequence: Synthetic oligonucleotide
acctccttccgccttaaagagcctccac

SEQ ID NO: 226137 - DNA, 27 bp, Artificial Sequence
  Description of Artificial Sequence: Synthetic oligonucleotide
cctccttccgccttaaagagcctccac

SEQ ID NO: 226138 - DNA, 27 bp, Artificial Sequence
  Description of Artificial Sequence: Synthetic oligonucleotide
ctccttccgccttaaagagcctccacg

SEQ ID NO: 226139 - DNA, 27 bp, Artificial Sequence
  Description of Artificial Sequence: Synthetic oligonucleotide
tccttccgccttaaagagcctccacgg

SEQ ID NO: 226140 - DNA, 27 bp, Artificial Sequence
  Description of Artificial Sequence: Synthetic oligonucleotide
ccttccgccttaaagagcctccacggt

SEQ ID NO: 226141 - DNA, 27 bp, Artificial Sequence
  Description of Artificial Sequence: Synthetic oligonucleotide
cttccgccttaaagagcctccacggtg

SEQ ID NO: 226142 - DNA, 28 bp, Artificial Sequence
  Description of Artificial Sequence: Synthetic oligonucleotide
ttccgccttaaagagcctccacggtgtg

SEQ ID NO: 226143 - DNA, 27 bp, Artificial Sequence
  Description of Artificial Sequence: Synthetic oligonucleotide
tccgccttaaagagcctccacggtgtg

SEQ ID NO: 226144 - DNA, 27 bp, Artificial Sequence
  Description of Artificial Sequence: Synthetic oligonucleotide
ccgccttaaagagcctccacggtgtgt

SEQ ID NO: 226145 - DNA, 27 bp, Artificial Sequence
  Description of Artificial Sequence: Synthetic oligonucleotide
cgccttaaagagcctccacggtgtgtg

SEQ ID NO: 226146 - DNA, 27 bp, Artificial Sequence
  Description of Artificial Sequence: Synthetic oligonucleotide
gccttaaagagcctccacggtgtgtgg

SEQ ID NO: 226147 - DNA, 27 bp, Artificial Sequence
  Description of Artificial Sequence: Synthetic oligonucleotide
ccttaaagagcctccacggtgtgtggg

SEQ ID NO: 226148 - DNA, 27 bp, Artificial Sequence
  Description of Artificial Sequence: Synthetic oligonucleotide
cttaaagagcctccacggtgtgtgggg

SEQ ID NO: 226149 - DNA, 32 bp, Artificial Sequence
  Description of Artificial Sequence: Synthetic oligonucleotide
ttaaagagcctccacggtgtgtggggattttc

SEQ ID NO: 226150 - DNA, 31 bp, Artificial Sequence
  Description of Artificial Sequence: Synthetic oligonucleotide
taaagagcctccacggtgtgtggggattttc

SEQ ID NO: 226151 - DNA, 30 bp, Artificial Sequence
  Description of Artificial Sequence: Synthetic oligonucleotide
aaagagcctccacggtgtgtggggattttc

SEQ ID NO: 226152 - DNA, 29 bp, Artificial Sequence
  Description of Artificial Sequence: Synthetic oligonucleotide
aagagcctccacggtgtgtggggattttc

SEQ ID NO: 226153 - DNA, 28 bp, Artificial Sequence
  Description of Artificial Sequence: Synthetic oligonucleotide
agagcctccacggtgtgtggggattttc

SEQ ID NO: 226154 - DNA, 27 bp, Artificial Sequence
  Description of Artificial Sequence: Synthetic oligonucleotide
gagcctccacggtgtgtggggattttc

SEQ ID NO: 226155 - DNA, 27 bp, Artificial Sequence
  Description of Artificial Sequence: Synthetic oligonucleotide
agcctccacggtgtgtggggattttcc

SEQ ID NO: 226156 - DNA, 27 bp, Artificial Sequence
  Description of Artificial Sequence: Synthetic oligonucleotide
gcctccacggtgtgtggggattttcct

SEQ ID NO: 226157 - DNA, 27 bp, Artificial Sequence
  Description of Artificial Sequence: Synthetic oligonucleotide
cctccacggtgtgtggggattttcctg

SEQ ID NO: 226158 - DNA, 27 bp, Artificial Sequence
  Description of Artificial Sequence: Synthetic oligonucleotide
ctccacggtgtgtggggattttcctgg

SEQ ID NO: 226159 - DNA, 28 bp, Artificial Sequence
  Description of Artificial Sequence: Synthetic oligonucleotide
tccacggtgtgtggggattttcctggac

SEQ ID NO: 226160 - DNA, 27 bp, Artificial Sequence
  Description of Artificial Sequence: Synthetic oligonucleotide
ccacggtgtgtggggattttcctggac

SEQ ID NO: 226161 - DNA, 30 bp, Artificial Sequence
  Description of Artificial Sequence: Synthetic oligonucleotide
cacggtgtgtggggattttcctggactatg

SEQ ID NO: 226162 - DNA, 32 bp, Artificial Sequence
  Description of Artificial Sequence: Synthetic oligonucleotide
acggtgtgtggggattttcctggactatgaag

SEQ ID NO: 226163 - DNA, 31 bp, Artificial Sequence
  Description of Artificial Sequence: Synthetic oligonucleotide
cggtgtgtggggattttcctggactatgaag

SEQ ID NO: 226164 - DNA, 31 bp, Artificial Sequence
  Description of Artificial Sequence: Synthetic oligonucleotide
ggtgtgtggggattttcctggactatgaagc

SEQ ID NO: 226165 - DNA, 32 bp, Artificial Sequence
  Description of Artificial Sequence: Synthetic oligonucleotide
gtgtgtggggattttcctggactatgaagcag

SEQ ID NO: 226166 - DNA, 32 bp, Artificial Sequence
  Description of Artificial Sequence: Synthetic oligonucleotide
tgtgtggggattttcctggactatgaagcagg

SEQ ID NO: 226167 - DNA, 31 bp, Artificial Sequence
  Description of Artificial Sequence: Synthetic oligonucleotide
gtgtggggattttcctggactatgaagcagg

SEQ ID NO: 226168 - DNA, 32 bp, Artificial Sequence
  Description of Artificial Sequence: Synthetic oligonucleotide
tgtggggattttcctggactatgaagcaggag

SEQ ID NO: 226169 - DNA, 31 bp, Artificial Sequence
  Description of Artificial Sequence: Synthetic oligonucleotide
gtggggattttcctggactatgaagcaggag

SEQ ID NO: 226170 - DNA, 32 bp, Artificial Sequence
  Description of Artificial Sequence: Synthetic oligonucleotide
tggggattttcctggactatgaagcaggagtc

SEQ ID NO: 226171 - DNA, 31 bp, Artificial Sequence
  Description of Artificial Sequence: Synthetic oligonucleotide
ggggattttcctggactatgaagcaggagtc

SEQ ID NO: 226172 - DNA, 33 bp, Artificial Sequence
  Description of Artificial Sequence: Synthetic oligonucleotide
gggattttcctggactatgaagcaggagtcatc

SEQ ID NO: 226173 - DNA, 34 bp, Artificial Sequence
  Description of Artificial Sequence: Synthetic oligonucleotide
ggattttcctggactatgaagcaggagtcatctc

SEQ ID NO: 226174 - DNA, 37 bp, Artificial Sequence
  Description of Artificial Sequence: Synthetic oligonucleotide
gattttcctggactatgaagcaggagtcatctctttc

SEQ ID NO: 226175 - DNA, 39 bp, Artificial Sequence
  Description of Artificial Sequence: Synthetic oligonucleotide
attttcctggactatgaagcaggagtcatctctttctac

SEQ ID NO: 226176 - DNA, 38 bp, Artificial Sequence
  Description of Artificial Sequence: Synthetic oligonucleotide
ttttcctggactatgaagcaggagtcatctctttctac

SEQ ID NO: 226177 - DNA, 37 bp, Artificial Sequence
  Description of Artificial Sequence: Synthetic oligonucleotide
tttcctggactatgaagcaggagtcatctctttctac

SEQ ID NO: 226178 - DNA, 36 bp, Artificial Sequence
  Description of Artificial Sequence: Synthetic oligonucleotide
ttcctggactatgaagcaggagtcatctctttctac

SEQ ID NO: 226179 - DNA, 35 bp, Artificial Sequence
  Description of Artificial Sequence: Synthetic oligonucleotide
tcctggactatgaagcaggagtcatctctttctac

SEQ ID NO: 226180 - DNA, 34 bp, Artificial Sequence
  Description of Artificial Sequence: Synthetic oligonucleotide
cctggactatgaagcaggagtcatctctttctac

SEQ ID NO: 226181 - DNA, 37 bp, Artificial Sequence
  Description of Artificial Sequence: Synthetic oligonucleotide
ctggactatgaagcaggagtcatctctttctacaatg

SEQ ID NO: 226182 - DNA, 38 bp, Artificial Sequence
  Description of Artificial Sequence: Synthetic oligonucleotide
tggactatgaagcaggagtcatctctttctacaatgtg

SEQ ID NO: 226183 - DNA, 37 bp, Artificial Sequence
  Description of Artificial Sequence: Synthetic oligonucleotide
ggactatgaagcaggagtcatctctttctacaatgtg

SEQ ID NO: 226184 - DNA, 38 bp, Artificial Sequence
  Description of Artificial Sequence: Synthetic oligonucleotide
gactatgaagcaggagtcatctctttctacaatgtgac

SEQ ID NO: 226185 - DNA, 38 bp, Artificial Sequence
  Description of Artificial Sequence: Synthetic oligonucleotide
actatgaagcaggagtcatctctttctacaatgtgacc

SEQ ID NO: 226186 - DNA, 37 bp, Artificial Sequence
  Description of Artificial Sequence: Synthetic oligonucleotide
ctatgaagcaggagtcatctctttctacaatgtgacc

SEQ ID NO: 226187 - DNA, 39 bp, Artificial Sequence
  Description of Artificial Sequence: Synthetic oligonucleotide
tatgaagcaggagtcatctctttctacaatgtgaccaac

SEQ ID NO: 226188 - DNA, 38 bp, Artificial Sequence
  Description of Artificial Sequence: Synthetic oligonucleotide
atgaagcaggagtcatctctttctacaatgtgaccaac

SEQ ID NO: 226189 - DNA, 37 bp, Artificial Sequence
  Description of Artificial Sequence: Synthetic oligonucleotide
tgaagcaggagtcatctctttctacaatgtgaccaac

SEQ ID NO: 226190 - DNA, 36 bp, Artificial Sequence
  Description of Artificial Sequence: Synthetic oligonucleotide
gaagcaggagtcatctctttctacaatgtgaccaac

SEQ ID NO: 226191 - DNA, 38 bp, Artificial Sequence
  Description of Artificial Sequence: Synthetic oligonucleotide
aagcaggagtcatctctttctacaatgtgaccaacaag

SEQ ID NO: 226192 - DNA, 37 bp, Artificial Sequence
  Description of Artificial Sequence: Synthetic oligonucleotide
agcaggagtcatctctttctacaatgtgaccaacaag

SEQ ID NO: 226193 - DNA, 36 bp, Artificial Sequence
  Description of Artificial Sequence: Synthetic oligonucleotide
gcaggagtcatctctttctacaatgtgaccaacaag

SEQ ID NO: 226194 - DNA, 37 bp, Artificial Sequence
  Description of Artificial Sequence: Synthetic oligonucleotide
caggagtcatctctttctacaatgtgaccaacaagtc

SEQ ID NO: 226195 - DNA, 37 bp, Artificial Sequence
  Description of Artificial Sequence: Synthetic oligonucleotide
aggagtcatctctttctacaatgtgaccaacaagtcc

SEQ ID NO: 226196 - DNA, 36 bp, Artificial Sequence
  Description of Artificial Sequence: Synthetic oligonucleotide
ggagtcatctctttctacaatgtgaccaacaagtcc

SEQ ID NO: 226197 - DNA, 36 bp, Artificial Sequence
  Description of Artificial Sequence: Synthetic oligonucleotide
gagtcatctctttctacaatgtgaccaacaagtccc

SEQ ID NO: 226198 - DNA, 37 bp, Artificial Sequence
  Description of Artificial Sequence: Synthetic oligonucleotide
agtcatctctttctacaatgtgaccaacaagtcccac

SEQ ID NO: 226199 - DNA, 36 bp, Artificial Sequence
  Description of Artificial Sequence: Synthetic oligonucleotide
gtcatctctttctacaatgtgaccaacaagtcccac

SEQ ID NO: 226200 - DNA, 38 bp, Artificial Sequence
  Description of Artificial Sequence: Synthetic oligonucleotide
tcatctctttctacaatgtgaccaacaagtcccacatc

SEQ ID NO: 226201 - DNA, 37 bp, Artificial Sequence
  Description of Artificial Sequence: Synthetic oligonucleotide
catctctttctacaatgtgaccaacaagtcccacatc

SEQ ID NO: 226202 - DNA, 41 bp, Artificial Sequence
  Description of Artificial Sequence: Synthetic oligonucleotide
atctctttctacaatgtgaccaacaagtcccacatctttac

SEQ ID NO: 226203 - DNA, 40 bp, Artificial Sequence
  Description of Artificial Sequence: Synthetic oligonucleotide
tctctttctacaatgtgaccaacaagtcccacatctttac

SEQ ID NO: 226204 - DNA, 39 bp, Artificial Sequence
  Description of Artificial Sequence: Synthetic oligonucleotide
ctctttctacaatgtgaccaacaagtcccacatctttac

SEQ ID NO: 226205 - DNA, 42 bp, Artificial Sequence
  Description of Artificial Sequence: Synthetic oligonucleotide
tctttctacaatgtgaccaacaagtcccacatctttactttc

SEQ ID NO: 226206 - DNA, 41 bp, Artificial Sequence
  Description of Artificial Sequence: Synthetic oligonucleotide
ctttctacaatgtgaccaacaagtcccacatctttactttc

SEQ ID NO: 226207 - DNA, 42 bp, Artificial Sequence
  Description of Artificial Sequence: Synthetic oligonucleotide
tttctacaatgtgaccaacaagtcccacatctttactttcac

SEQ ID NO: 226208 - DNA, 41 bp, Artificial Sequence
  Description of Artificial Sequence: Synthetic oligonucleotide
ttctacaatgtgaccaacaagtcccacatctttactttcac

SEQ ID NO: 226209 - DNA, 40 bp, Artificial Sequence
  Description of Artificial Sequence: Synthetic oligonucleotide
tctacaatgtgaccaacaagtcccacatctttactttcac

SEQ ID NO: 226210 - DNA, 39 bp, Artificial Sequence
  Description of Artificial Sequence: Synthetic oligonucleotide
ctacaatgtgaccaacaagtcccacatctttactttcac

SEQ ID NO: 226211 - DNA, 39 bp, Artificial Sequence
  Description of Artificial Sequence: Synthetic oligonucleotide
tacaatgtgaccaacaagtcccacatctttactttcacc

SEQ ID NO: 226212 - DNA, 38 bp, Artificial Sequence
  Description of Artificial Sequence: Synthetic oligonucleotide
acaatgtgaccaacaagtcccacatctttactttcacc

SEQ ID NO: 226213 - DNA, 37 bp, Artificial Sequence
  Description of Artificial Sequence: Synthetic oligonucleotide
caatgtgaccaacaagtcccacatctttactttcacc

SEQ ID NO: 226214 - DNA, 37 bp, Artificial Sequence
  Description of Artificial Sequence: Synthetic oligonucleotide
aatgtgaccaacaagtcccacatctttactttcaccc

SEQ ID NO: 226215 - DNA, 36 bp, Artificial Sequence
  Description of Artificial Sequence: Synthetic oligonucleotide
atgtgaccaacaagtcccacatctttactttcaccc

SEQ ID NO: 226216 - DNA, 35 bp, Artificial Sequence
  Description of Artificial Sequence: Synthetic oligonucleotide
tgtgaccaacaagtcccacatctttactttcaccc

SEQ ID NO: 226217 - DNA, 34 bp, Artificial Sequence
  Description of Artificial Sequence: Synthetic oligonucleotide
gtgaccaacaagtcccacatctttactttcaccc

SEQ ID NO: 226218 - DNA, 35 bp, Artificial Sequence
  Description of Artificial Sequence: Synthetic oligonucleotide
tgaccaacaagtcccacatctttactttcacccac

SEQ ID NO: 226219 - DNA, 34 bp, Artificial Sequence
  Description of Artificial Sequence: Synthetic oligonucleotide
gaccaacaagtcccacatctttactttcacccac

SEQ ID NO: 226220 - DNA, 39 bp, Artificial Sequence
  Description of Artificial Sequence: Synthetic oligonucleotide
accaacaagtcccacatctttactttcacccacaatttc

SEQ ID NO: 226221 - DNA, 38 bp, Artificial Sequence
  Description of Artificial Sequence: Synthetic oligonucleotide
ccaacaagtcccacatctttactttcacccacaatttc

SEQ ID NO: 226222 - DNA, 39 bp, Artificial Sequence
  Description of Artificial Sequence: Synthetic oligonucleotide
caacaagtcccacatctttactttcacccacaatttctc

SEQ ID NO: 226223 - DNA, 40 bp, Artificial Sequence
  Description of Artificial Sequence: Synthetic oligonucleotide
aacaagtcccacatctttactttcacccacaatttctctg

SEQ ID NO: 226224 - DNA, 39 bp, Artificial Sequence
  Description of Artificial Sequence: Synthetic oligonucleotide
acaagtcccacatctttactttcacccacaatttctctg

SEQ ID NO: 226225 - DNA, 38 bp, Artificial Sequence
  Description of Artificial Sequence: Synthetic oligonucleotide
caagtcccacatctttactttcacccacaatttctctg

SEQ ID NO: 226226 - DNA, 38 bp, Artificial Sequence
  Description of Artificial Sequence: Synthetic oligonucleotide
aagtcccacatctttactttcacccacaatttctctgg

SEQ ID NO: 226227 - DNA, 37 bp, Artificial Sequence
  Description of Artificial Sequence: Synthetic oligonucleotide
agtcccacatctttactttcacccacaatttctctgg

SEQ ID NO: 226228 - DNA, 36 bp, Artificial Sequence
  Description of Artificial Sequence: Synthetic oligonucleotide
gtcccacatctttactttcacccacaatttctctgg

SEQ ID NO: 226229 - DNA, 36 bp, Artificial Sequence
  Description of Artificial Sequence: Synthetic oligonucleotide
tcccacatctttactttcacccacaatttctctggc

SEQ ID NO: 226230 - DNA, 35 bp, Artificial Sequence
  Description of Artificial Sequence: Synthetic oligonucleotide
cccacatctttactttcacccacaatttctctggc

SEQ ID NO: 226231 - DNA, 35 bp, Artificial Sequence
  Description of Artificial Sequence: Synthetic oligonucleotide
ccacatctttactttcacccacaatttctctggcc

SEQ ID NO: 226232 - DNA, 35 bp, Artificial Sequence
  Description of Artificial Sequence: Synthetic oligonucleotide
cacatctttactttcacccacaatttctctggccc

SEQ ID NO: 226233 - DNA, 35 bp, Artificial Sequence
  Description of Artificial Sequence: Synthetic oligonucleotide
acatctttactttcacccacaatttctctggcccc

SEQ ID NO: 226234 - DNA, 34 bp, Artificial Sequence
  Description of Artificial Sequence: Synthetic oligonucleotide
catctttactttcacccacaatttctctggcccc

SEQ ID NO: 226235 - DNA, 34 bp, Artificial Sequence
  Description of Artificial Sequence: Synthetic oligonucleotide
atctttactttcacccacaatttctctggccccc

SEQ ID NO: 226236 - DNA, 33 bp, Artificial Sequence
  Description of Artificial Sequence: Synthetic oligonucleotide
tctttactttcacccacaatttctctggccccc

SEQ ID NO: 226237 - DNA, 32 bp, Artificial Sequence
  Description of Artificial Sequence: Synthetic oligonucleotide
ctttactttcacccacaatttctctggccccc

SEQ ID NO: 226238 - DNA, 34 bp, Artificial Sequence
  Description of Artificial Sequence: Synthetic oligonucleotide
tttactttcacccacaatttctctggcccccttc

SEQ ID NO: 226239 - DNA, 33 bp, Artificial Sequence
  Description of Artificial Sequence: Synthetic oligonucleotide
ttactttcacccacaatttctctggcccccttc

SEQ ID NO: 226240 - DNA, 32 bp, Artificial Sequence
  Description of Artificial Sequence: Synthetic oligonucleotide
tactttcacccacaatttctctggcccccttc

SEQ ID NO: 226241 - DNA, 31 bp, Artificial Sequence
  Description of Artificial Sequence: Synthetic oligonucleotide
actttcacccacaatttctctggcccccttc

SEQ ID NO: 226242 - DNA, 30 bp, Artificial Sequence
  Description of Artificial Sequence: Synthetic oligonucleotide
ctttcacccacaatttctctggcccccttc

SEQ ID NO: 226243 - DNA, 30 bp, Artificial Sequence
  Description of Artificial Sequence: Synthetic oligonucleotide
tttcacccacaatttctctggcccccttcg

SEQ ID NO: 226244 - DNA, 29 bp, Artificial Sequence
  Description of Artificial Sequence: Synthetic oligonucleotide
ttcacccacaatttctctggcccccttcg

SEQ ID NO: 226245 - DNA, 28 bp, Artificial Sequence
  Description of Artificial Sequence: Synthetic oligonucleotide
tcacccacaatttctctggcccccttcg

SEQ ID NO: 226246 - DNA, 27 bp, Artificial Sequence
  Description of Artificial Sequence: Synthetic oligonucleotide
cacccacaatttctctggcccccttcg

SEQ ID NO: 226247 - DNA, 27 bp, Artificial Sequence
  Description of Artificial Sequence: Synthetic oligonucleotide
acccacaatttctctggcccccttcgc

SEQ ID NO: 226248 - DNA, 26 bp, Artificial Sequence
  Description of Artificial Sequence: Synthetic oligonucleotide
cccacaatttctctggcccccttcgc

SEQ ID NO: 226249 - DNA, 26 bp, Artificial Sequence
  Description of Artificial Sequence: Synthetic oligonucleotide
ccacaatttctctggcccccttcgcc

SEQ ID NO: 226250 - DNA, 27 bp, Artificial Sequence
  Description of Artificial Sequence: Synthetic oligonucleotide
cacaatttctctggcccccttcgccct

SEQ ID NO: 226251 - DNA, 29 bp, Artificial Sequence
  Description of Artificial Sequence: Synthetic oligonucleotide
acaatttctctggcccccttcgccctttc

SEQ ID NO: 226252 - DNA, 28 bp, Artificial Sequence
  Description of Artificial Sequence: Synthetic oligonucleotide
caatttctctggcccccttcgccctttc

SEQ ID NO: 226253 - DNA, 31 bp, Artificial Sequence
  Description of Artificial Sequence: Synthetic oligonucleotide
aatttctctggcccccttcgccctttctttg

SEQ ID NO: 226254 - DNA, 30 bp, Artificial Sequence
  Description of Artificial Sequence: Synthetic oligonucleotide
atttctctggcccccttcgccctttctttg

SEQ ID NO: 226255 - DNA, 29 bp, Artificial Sequence
  Description of Artificial Sequence: Synthetic oligonucleotide
tttctctggcccccttcgccctttctttg

SEQ ID NO: 226256 - DNA, 28 bp, Artificial Sequence
  Description of Artificial Sequence: Synthetic oligonucleotide
ttctctggcccccttcgccctttctttg

SEQ ID NO: 226257 - DNA, 27 bp, Artificial Sequence
  Description of Artificial Sequence: Synthetic oligonucleotide
tctctggcccccttcgccctttctttg

SEQ ID NO: 226258 - DNA, 27 bp, Artificial Sequence
  Description of Artificial Sequence: Synthetic oligonucleotide
ctctggcccccttcgccctttctttga

SEQ ID NO: 226259 - DNA, 28 bp, Artificial Sequence
  Description of Artificial Sequence: Synthetic oligonucleotide
tctggcccccttcgccctttctttgaac

SEQ ID NO: 226260 - DNA, 27 bp, Artificial Sequence
  Description of Artificial Sequence: Synthetic oligonucleotide
ctggcccccttcgccctttctttgaac

SEQ ID NO: 226261 - DNA, 27 bp, Artificial Sequence
  Description of Artificial Sequence: Synthetic oligonucleotide
tggcccccttcgccctttctttgaacc

SEQ ID NO: 226262 - DNA, 27 bp, Artificial Sequence
  Description of Artificial Sequence: Synthetic oligonucleotide
ggcccccttcgccctttctttgaacct

SEQ ID NO: 226263 - DNA, 28 bp, Artificial Sequence
  Description of Artificial Sequence: Synthetic oligonucleotide
gcccccttcgccctttctttgaaccttg

SEQ ID NO: 226264 - DNA, 28 bp, Artificial Sequence
  Description of Artificial Sequence: Synthetic oligonucleotide
cccccttcgccctttctttgaaccttgc

SEQ ID NO: 226265 - DNA, 28 bp, Artificial Sequence
  Description of Artificial Sequence: Synthetic oligonucleotide
ccccttcgccctttctttgaaccttgcc

SEQ ID NO: 226266 - DNA, 30 bp, Artificial Sequence
  Description of Artificial Sequence: Synthetic oligonucleotide
cccttcgccctttctttgaaccttgccttc

SEQ ID NO: 226267 - DNA, 32 bp, Artificial Sequence
  Description of Artificial Sequence: Synthetic oligonucleotide
ccttcgccctttctttgaaccttgccttcatg

SEQ ID NO: 226268 - DNA, 34 bp, Artificial Sequence
  Description of Artificial Sequence: Synthetic oligonucleotide
cttcgccctttctttgaaccttgccttcatgatg

SEQ ID NO: 226269 - DNA, 34 bp, Artificial Sequence
  Description of Artificial Sequence: Synthetic oligonucleotide
ttcgccctttctttgaaccttgccttcatgatgg

SEQ ID NO: 226270 - DNA, 33 bp, Artificial Sequence
  Description of Artificial Sequence: Synthetic oligonucleotide
tcgccctttctttgaaccttgccttcatgatgg

SEQ ID NO: 226271 - DNA, 32 bp, Artificial Sequence
  Description of Artificial Sequence: Synthetic oligonucleotide
cgccctttctttgaaccttgccttcatgatgg

SEQ ID NO: 226272 - DNA, 33 bp, Artificial Sequence
  Description of Artificial Sequence: Synthetic oligonucleotide
gccctttctttgaaccttgccttcatgatggag

SEQ ID NO: 226273 - DNA, 33 bp, Artificial Sequence
  Description of Artificial Sequence: Synthetic oligonucleotide
ccctttctttgaaccttgccttcatgatggagg

SEQ ID NO: 226274 - DNA, 39 bp, Artificial Sequence
  Description of Artificial Sequence: Synthetic oligonucleotide
cctttctttgaaccttgccttcatgatggaggaaaaaac

SEQ ID NO: 226275 - DNA, 40 bp, Artificial Sequence
  Description of Artificial Sequence: Synthetic oligonucleotide
ctttctttgaaccttgccttcatgatggaggaaaaaacac

SEQ ID NO: 226276 - DNA, 41 bp, Artificial Sequence
  Description of Artificial Sequence: Synthetic oligonucleotide
tttctttgaaccttgccttcatgatggaggaaaaaacacag

SEQ ID NO: 226277 - DNA, 40 bp, Artificial Sequence
  Description of Artificial Sequence: Synthetic oligonucleotide
ttctttgaaccttgccttcatgatggaggaaaaaacacag

SEQ ID NO: 226278 - DNA, 39 bp, Artificial Sequence
  Description of Artificial Sequence: Synthetic oligonucleotide
tctttgaaccttgccttcatgatggaggaaaaaacacag

SEQ ID NO: 226279 - DNA, 38 bp, Artificial Sequence
  Description of Artificial Sequence: Synthetic oligonucleotide
ctttgaaccttgccttcatgatggaggaaaaaacacag

SEQ ID NO: 226280 - DNA, 38 bp, Artificial Sequence
  Description of Artificial Sequence: Synthetic oligonucleotide
tttgaaccttgccttcatgatggaggaaaaaacacagc

SEQ ID NO: 226281 - DNA, 37 bp, Artificial Sequence
  Description of Artificial Sequence: Synthetic oligonucleotide
ttgaaccttgccttcatgatggaggaaaaaacacagc

SEQ ID NO: 226282 - DNA, 36 bp, Artificial Sequence
  Description of Artificial Sequence: Synthetic oligonucleotide
tgaaccttgccttcatgatggaggaaaaaacacagc

SEQ ID NO: 226283 - DNA, 35 bp, Artificial Sequence
  Description of Artificial Sequence: Synthetic oligonucleotide
gaaccttgccttcatgatggaggaaaaaacacagc

SEQ ID NO: 226284 - DNA, 36 bp, Artificial Sequence
  Description of Artificial Sequence: Synthetic oligonucleotide
aaccttgccttcatgatggaggaaaaaacacagcac

SEQ ID NO: 226285 - DNA, 35 bp, Artificial Sequence
  Description of Artificial Sequence: Synthetic oligonucleotide
accttgccttcatgatggaggaaaaaacacagcac

SEQ ID NO: 226286 - DNA, 34 bp, Artificial Sequence
  Description of Artificial Sequence: Synthetic oligonucleotide
ccttgccttcatgatggaggaaaaaacacagcac

SEQ ID NO: 226287 - DNA, 34 bp, Artificial Sequence
  Description of Artificial Sequence: Synthetic oligonucleotide
cttgccttcatgatggaggaaaaaacacagcacc

SEQ ID NO: 226288 - DNA, 35 bp, Artificial Sequence
  Description of Artificial Sequence: Synthetic oligonucleotide
ttgccttcatgatggaggaaaaaacacagcacctc

SEQ ID NO: 226289 - DNA, 34 bp, Artificial Sequence
  Description of Artificial Sequence: Synthetic oligonucleotide
tgccttcatgatggaggaaaaaacacagcacctc

SEQ ID NO: 226290 - DNA, 33 bp, Artificial Sequence
  Description of Artificial Sequence: Synthetic oligonucleotide
gccttcatgatggaggaaaaaacacagcacctc

SEQ ID NO: 226291 - DNA, 35 bp, Artificial Sequence
  Description of Artificial Sequence: Synthetic oligonucleotide
ccttcatgatggaggaaaaaacacagcacctctag

SEQ ID NO: 226292 - DNA, 36 bp, Artificial Sequence
  Description of Artificial Sequence: Synthetic oligonucleotide
cttcatgatggaggaaaaaacacagcacctctagtc

SEQ ID NO: 226293 - DNA, 40 bp, Artificial Sequence
  Description of Artificial Sequence: Synthetic oligonucleotide
ttcatgatggaggaaaaaacacagcacctctagtcatttg

SEQ ID NO: 226294 - DNA, 39 bp, Artificial Sequence
  Description of Artificial Sequence: Synthetic oligonucleotide
tcatgatggaggaaaaaacacagcacctctagtcatttg

SEQ ID NO: 226295 - DNA, 38 bp, Artificial Sequence
  Description of Artificial Sequence: Synthetic oligonucleotide
catgatggaggaaaaaacacagcacctctagtcatttg

SEQ ID NO: 226296 - DNA, 40 bp, Artificial Sequence
  Description of Artificial Sequence: Synthetic oligonucleotide
atgatggaggaaaaaacacagcacctctagtcatttgttc

SEQ ID NO: 226297 - DNA, 39 bp, Artificial Sequence
  Description of Artificial Sequence: Synthetic oligonucleotide
tgatggaggaaaaaacacagcacctctagtcatttgttc

SEQ ID NO: 226298 - DNA, 38 bp, Artificial Sequence
  Description of Artificial Sequence: Synthetic oligonucleotide
gatggaggaaaaaacacagcacctctagtcatttgttc

SEQ ID NO: 226299 - DNA, 39 bp, Artificial Sequence
  Description of Artificial Sequence: Synthetic oligonucleotide
atggaggaaaaaacacagcacctctagtcatttgttcag

SEQ ID NO: 226300 - DNA, 38 bp, Artificial Sequence
  Description of Artificial Sequence: Synthetic oligonucleotide
tggaggaaaaaacacagcacctctagtcatttgttcag

SEQ ID NO: 226301 - DNA, 37 bp, Artificial Sequence
  Description of Artificial Sequence: Synthetic oligonucleotide
ggaggaaaaaacacagcacctctagtcatttgttcag

SEQ ID NO: 226302 - DNA, 39 bp, Artificial Sequence
  Description of Artificial Sequence: Synthetic oligonucleotide
gaggaaaaaacacagcacctctagtcatttgttcagaac

SEQ ID NO: 226303 - DNA, 41 bp, Artificial Sequence
  Description of Artificial Sequence: Synthetic oligonucleotide
aggaaaaaacacagcacctctagtcatttgttcagaactac

SEQ ID NO: 226304 - DNA, 40 bp, Artificial Sequence
  Description of Artificial Sequence: Synthetic oligonucleotide
ggaaaaaacacagcacctctagtcatttgttcagaactac

SEQ ID NO: 226305 - DNA, 41 bp, Artificial Sequence
  Description of Artificial Sequence: Synthetic oligonucleotide
gaaaaaacacagcacctctagtcatttgttcagaactacac

SEQ ID NO: 226306 - DNA, 45 bp, Artificial Sequence
  Description of Artificial Sequence: Synthetic oligonucleotide
aaaaaacacagcacctctagtcatttgttcagaactacacaaatc

SEQ ID NO: 226307 - DNA, 44 bp, Artificial Sequence
  Description of Artificial Sequence: Synthetic oligonucleotide
aaaaacacagcacctctagtcatttgttcagaactacacaaatc

SEQ ID NO: 226308 - DNA, 43 bp, Artificial Sequence
  Description of Artificial Sequence: Synthetic oligonucleotide
aaaacacagcacctctagtcatttgttcagaactacacaaatc

SEQ ID NO: 226309 - DNA, 42 bp, Artificial Sequence
  Description of Artificial Sequence: Synthetic oligonucleotide
aaacacagcacctctagtcatttgttcagaactacacaaatc

SEQ ID NO: 226310 - DNA, 41 bp, Artificial Sequence
  Description of Artificial Sequence: Synthetic oligonucleotide
aacacagcacctctagtcatttgttcagaactacacaaatc

SEQ ID NO: 226311 - DNA, 40 bp, Artificial Sequence
  Description of Artificial Sequence: Synthetic oligonucleotide
acacagcacctctagtcatttgttcagaactacacaaatc

SEQ ID NO: 226312 - DNA, 39 bp, Artificial Sequence
  Description of Artificial Sequence: Synthetic oligonucleotide
cacagcacctctagtcatttgttcagaactacacaaatc

SEQ ID NO: 226313 - DNA, 40 bp, Artificial Sequence
  Description of Artificial Sequence: Synthetic oligonucleotide
acagcacctctagtcatttgttcagaactacacaaatcag

SEQ ID NO: 226314 - DNA, 39 bp, Artificial Sequence
  Description of Artificial Sequence: Synthetic oligonucleotide
cagcacctctagtcatttgttcagaactacacaaatcag

SEQ ID NO: 226315 - DNA, 40 bp, Artificial Sequence
  Description of Artificial Sequence: Synthetic oligonucleotide
agcacctctagtcatttgttcagaactacacaaatcagag

SEQ ID NO: 226316 - DNA, 39 bp, Artificial Sequence
  Description of Artificial Sequence: Synthetic oligonucleotide
gcacctctagtcatttgttcagaactacacaaatcagag

SEQ ID NO: 226317 - DNA, 39 bp, Artificial Sequence
  Description of Artificial Sequence: Synthetic oligonucleotide
cacctctagtcatttgttcagaactacacaaatcagagg

SEQ ID NO: 226318 - DNA, 42 bp, Artificial Sequence
  Description of Artificial Sequence: Synthetic oligonucleotide
acctctagtcatttgttcagaactacacaaatcagaggaatc

SEQ ID NO: 226319 - DNA, 41 bp, Artificial Sequence
  Description of Artificial Sequence: Synthetic oligonucleotide
cctctagtcatttgttcagaactacacaaatcagaggaatc

SEQ ID NO: 226320 - DNA, 45 bp, Artificial Sequence
  Description of Artificial Sequence: Synthetic oligonucleotide
ctctagtcatttgttcagaactacacaaatcagaggaatcaattg

SEQ ID NO: 226321 - DNA, 46 bp, Artificial Sequence
  Description of Artificial Sequence: Synthetic oligonucleotide
tctagtcatttgttcagaactacacaaatcagaggaatcaattgtc

SEQ ID NO: 226322 - DNA, 45 bp, Artificial Sequence
  Description of Artificial Sequence: Synthetic oligonucleotide
ctagtcatttgttcagaactacacaaatcagaggaatcaattgtc

SEQ ID NO: 226323 - DNA, 45 bp, Artificial Sequence
  Description of Artificial Sequence: Synthetic oligonucleotide
tagtcatttgttcagaactacacaaatcagaggaatcaattgtcc

SEQ ID NO: 226324 - DNA, 44 bp, Artificial Sequence
  Description of Artificial Sequence: Synthetic oligonucleotide
agtcatttgttcagaactacacaaatcagaggaatcaattgtcc

SEQ ID NO: 226325 - DNA, 43 bp, Artificial Sequence
  Description of Artificial Sequence: Synthetic oligonucleotide
gtcatttgttcagaactacacaaatcagaggaatcaattgtcc

SEQ ID NO: 226326 - DNA, 43 bp, Artificial Sequence
  Description of Artificial Sequence: Synthetic oligonucleotide
tcatttgttcagaactacacaaatcagaggaatcaattgtccc

SEQ ID NO: 226327 - DNA, 42 bp, Artificial Sequence
  Description of Artificial Sequence: Synthetic oligonucleotide
catttgttcagaactacacaaatcagaggaatcaattgtccc

SEQ ID NO: 226328 - DNA, 42 bp, Artificial Sequence
  Description of Artificial Sequence: Synthetic oligonucleotide
atttgttcagaactacacaaatcagaggaatcaattgtcccc

SEQ ID NO: 226329 - DNA, 41 bp, Artificial Sequence
  Description of Artificial Sequence: Synthetic oligonucleotide
tttgttcagaactacacaaatcagaggaatcaattgtcccc

SEQ ID NO: 226330 - DNA, 40 bp, Artificial Sequence
  Description of Artificial Sequence: Synthetic oligonucleotide
ttgttcagaactacacaaatcagaggaatcaattgtcccc

SEQ ID NO: 226331 - DNA, 39 bp, Artificial Sequence
  Description of Artificial Sequence: Synthetic oligonucleotide
tgttcagaactacacaaatcagaggaatcaattgtcccc

SEQ ID NO: 226332 - DNA, 38 bp, Artificial Sequence
  Description of Artificial Sequence: Synthetic oligonucleotide
gttcagaactacacaaatcagaggaatcaattgtcccc

SEQ ID NO: 226333 - DNA, 39 bp, Artificial Sequence
  Description of Artificial Sequence: Synthetic oligonucleotide
ttcagaactacacaaatcagaggaatcaattgtccccag

SEQ ID NO: 226334 - DNA, 38 bp, Artificial Sequence
  Description of Artificial Sequence: Synthetic oligonucleotide
tcagaactacacaaatcagaggaatcaattgtccccag

SEQ ID NO: 226335 - DNA, 37 bp, Artificial Sequence
  Description of Artificial Sequence: Synthetic oligonucleotide
cagaactacacaaatcagaggaatcaattgtccccag

SEQ ID NO: 226336 - DNA, 37 bp, Artificial Sequence
  Description of Artificial Sequence: Synthetic oligonucleotide
agaactacacaaatcagaggaatcaattgtccccagg

SEQ ID NO: 226337 - DNA, 36 bp, Artificial Sequence
  Description of Artificial Sequence: Synthetic oligonucleotide
gaactacacaaatcagaggaatcaattgtccccagg

SEQ ID NO: 226338 - DNA, 36 bp, Artificial Sequence
  Description of Artificial Sequence: Synthetic oligonucleotide
aactacacaaatcagaggaatcaattgtccccaggc

SEQ ID NO: 226339 - DNA, 35 bp, Artificial Sequence
  Description of Artificial Sequence: Synthetic oligonucleotide
actacacaaatcagaggaatcaattgtccccaggc

SEQ ID NO: 226340 - DNA, 34 bp, Artificial Sequence
  Description of Artificial Sequence: Synthetic oligonucleotide
ctacacaaatcagaggaatcaattgtccccaggc

SEQ ID NO: 226341 - DNA, 34 bp, Artificial Sequence
  Description of Artificial Sequence: Synthetic oligonucleotide
tacacaaatcagaggaatcaattgtccccaggcc

SEQ ID NO: 226342 - DNA, 33 bp, Artificial Sequence
  Description of Artificial Sequence: Synthetic oligonucleotide
acacaaatcagaggaatcaattgtccccaggcc

SEQ ID NO: 226343 - DNA, 32 bp, Artificial Sequence
  Description of Artificial Sequence: Synthetic oligonucleotide
cacaaatcagaggaatcaattgtccccaggcc

SEQ ID NO: 226344 - DNA, 33 bp, Artificial Sequence
  Description of Artificial Sequence: Synthetic oligonucleotide
acaaatcagaggaatcaattgtccccaggccag

SEQ ID NO: 226345 - DNA, 32 bp, Artificial Sequence
  Description of Artificial Sequence: Synthetic oligonucleotide
caaatcagaggaatcaattgtccccaggccag

SEQ ID NO: 226346 - DNA, 34 bp, Artificial Sequence
  Description of Artificial Sequence: Synthetic oligonucleotide
aaatcagaggaatcaattgtccccaggccagaag

SEQ ID NO: 226347 - DNA, 33 bp, Artificial Sequence
  Description of Artificial Sequence: Synthetic oligonucleotide
aatcagaggaatcaattgtccccaggccagaag

SEQ ID NO: 226348 - DNA, 32 bp, Artificial Sequence
  Description of Artificial Sequence: Synthetic oligonucleotide
atcagaggaatcaattgtccccaggccagaag

SEQ ID NO: 226349 - DNA, 31 bp, Artificial Sequence
  Description of Artificial Sequence: Synthetic oligonucleotide
tcagaggaatcaattgtccccaggccagaag

SEQ ID NO: 226350 - DNA, 30 bp, Artificial Sequence
  Description of Artificial Sequence: Synthetic oligonucleotide
cagaggaatcaattgtccccaggccagaag

SEQ ID NO: 226351 - DNA, 30 bp, Artificial Sequence
  Description of Artificial Sequence: Synthetic oligonucleotide
agaggaatcaattgtccccaggccagaagg

SEQ ID NO: 226352 - DNA, 29 bp, Artificial Sequence
  Description of Artificial Sequence: Synthetic oligonucleotide
gaggaatcaattgtccccaggccagaagg

SEQ ID NO: 226353 - DNA, 29 bp, Artificial Sequence
  Description of Artificial Sequence: Synthetic oligonucleotide
aggaatcaattgtccccaggccagaaggg

SEQ ID NO: 226354 - DNA, 28 bp, Artificial Sequence
  Description of Artificial Sequence: Synthetic oligonucleotide
ggaatcaattgtccccaggccagaaggg

SEQ ID NO: 226355 - DNA, 31 bp, Artificial Sequence
  Description of Artificial Sequence: Synthetic oligonucleotide
gaatcaattgtccccaggccagaagggaaag

SEQ ID NO: 226356 - DNA, 31 bp, Artificial Sequence
  Description of Artificial Sequence: Synthetic oligonucleotide
aatcaattgtccccaggccagaagggaaagg

SEQ ID NO: 226357 - DNA, 30 bp, Artificial Sequence
  Description of Artificial Sequence: Synthetic oligonucleotide
atcaattgtccccaggccagaagggaaagg

SEQ ID NO: 226358 - DNA, 29 bp, Artificial Sequence
  Description of Artificial Sequence: Synthetic oligonucleotide
tcaattgtccccaggccagaagggaaagg

SEQ ID NO: 226359 - DNA, 28 bp, Artificial Sequence
  Description of Artificial Sequence: Synthetic oligonucleotide
caattgtccccaggccagaagggaaagg

SEQ ID NO: 226360 - DNA, 28 bp, Artificial Sequence
  Description of Artificial Sequence: Synthetic oligonucleotide
aattgtccccaggccagaagggaaaggc

SEQ ID NO: 226361 - DNA, 27 bp, Artificial Sequence
  Description of Artificial Sequence: Synthetic oligonucleotide
attgtccccaggccagaagggaaaggc

SEQ ID NO: 226362 - DNA, 26 bp, Artificial Sequence
  Description of Artificial Sequence: Synthetic oligonucleotide
ttgtccccaggccagaagggaaaggc

SEQ ID NO: 226363 - DNA, 25 bp, Artificial Sequence
  Description of Artificial Sequence: Synthetic oligonucleotide
tgtccccaggccagaagggaaaggc

SEQ ID NO: 226364 - DNA, 24 bp, Artificial Sequence
  Description of Artificial Sequence: Synthetic oligonucleotide
gtccccaggccagaagggaaaggc

SEQ ID NO: 226365 - DNA, 26 bp, Artificial Sequence
  Description of Artificial Sequence: Synthetic oligonucleotide
tccccaggccagaagggaaaggccat

SEQ ID NO: 226366 - DNA, 25 bp, Artificial Sequence
  Description of Artificial Sequence: Synthetic oligonucleotide
ccccaggccagaagggaaaggccat

SEQ ID NO: 226367 - DNA, 25 bp, Artificial Sequence
  Description of Artificial Sequence: Synthetic oligonucleotide
cccaggccagaagggaaaggccatg

SEQ ID NO: 226368 - DNA, 27 bp, Artificial Sequence
  Description of Artificial Sequence: Synthetic oligonucleotide
ccaggccagaagggaaaggccatgcta

SEQ ID NO: 226369 - DNA, 29 bp, Artificial Sequence
  Description of Artificial Sequence: Synthetic oligonucleotide
caggccagaagggaaaggccatgctaatg

SEQ ID NO: 226370 - DNA, 29 bp, Artificial Sequence
  Description of Artificial Sequence: Synthetic oligonucleotide
aggccagaagggaaaggccatgctaatgg

SEQ ID NO: 226371 - DNA, 28 bp, Artificial Sequence
  Description of Artificial Sequence: Synthetic oligonucleotide
ggccagaagggaaaggccatgctaatgg

SEQ ID NO: 226372 - DNA, 29 bp, Artificial Sequence
  Description of Artificial Sequence: Synthetic oligonucleotide
gccagaagggaaaggccatgctaatggag

SEQ ID NO: 226373 - DNA, 31 bp, Artificial Sequence
  Description of Artificial Sequence: Synthetic oligonucleotide
ccagaagggaaaggccatgctaatggagatg

SEQ ID NO: 226374 - DNA, 32 bp, Artificial Sequence
  Description of Artificial Sequence: Synthetic oligonucleotide
cagaagggaaaggccatgctaatggagatgtg

SEQ ID NO: 226375 - DNA, 33 bp, Artificial Sequence
  Description of Artificial Sequence: Synthetic oligonucleotide
agaagggaaaggccatgctaatggagatgtgtc

SEQ ID NO: 226376 - DNA, 32 bp, Artificial Sequence
  Description of Artificial Sequence: Synthetic oligonucleotide
gaagggaaaggccatgctaatggagatgtgtc

SEQ ID NO: 226377 - DNA, 32 bp, Artificial Sequence
  Description of Artificial Sequence: Synthetic oligonucleotide
aagggaaaggccatgctaatggagatgtgtcc

SEQ ID NO: 226378 - DNA, 31 bp, Artificial Sequence
  Description of Artificial Sequence: Synthetic oligonucleotide
agggaaaggccatgctaatggagatgtgtcc

SEQ ID NO: 226379 - DNA, 30 bp, Artificial Sequence
  Description of Artificial Sequence: Synthetic oligonucleotide
gggaaaggccatgctaatggagatgtgtcc

SEQ ID NO: 226380 - DNA, 30 bp, Artificial Sequence
  Description of Artificial Sequence: Synthetic oligonucleotide
ggaaaggccatgctaatggagatgtgtccc

SEQ ID NO: 226381 - DNA, 31 bp, Artificial Sequence
  Description of Artificial Sequence: Synthetic oligonucleotide
gaaaggccatgctaatggagatgtgtccctc

SEQ ID NO: 226382 - DNA, 33 bp, Artificial Sequence
  Description of Artificial Sequence: Synthetic oligonucleotide
aaaggccatgctaatggagatgtgtccctcaag

SEQ ID NO: 226383 - DNA, 32 bp, Artificial Sequence
  Description of Artificial Sequence: Synthetic oligonucleotide
aaggccatgctaatggagatgtgtccctcaag

SEQ ID NO: 226384 - DNA, 31 bp, Artificial Sequence
  Description of Artificial Sequence: Synthetic oligonucleotide
aggccatgctaatggagatgtgtccctcaag

SEQ ID NO: 226385 - DNA, 30 bp, Artificial Sequence
  Description of Artificial Sequence: Synthetic oligonucleotide
ggccatgctaatggagatgtgtccctcaag

SEQ ID NO: 226386 - DNA, 30 bp, Artificial Sequence
  Description of Artificial Sequence: Synthetic oligonucleotide
gccatgctaatggagatgtgtccctcaagg

SEQ ID NO: 226387 - DNA, 31 bp, Artificial Sequence
  Description of Artificial Sequence: Synthetic oligonucleotide
ccatgctaatggagatgtgtccctcaaggtg

SEQ ID NO: 226388 - DNA, 33 bp, Artificial Sequence
  Description of Artificial Sequence: Synthetic oligonucleotide
catgctaatggagatgtgtccctcaaggtgaac

SEQ ID NO: 226389 - DNA, 34 bp, Artificial Sequence
  Description of Artificial Sequence: Synthetic oligonucleotide
atgctaatggagatgtgtccctcaaggtgaactc

SEQ ID NO: 226390 - DNA, 33 bp, Artificial Sequence
  Description of Artificial Sequence: Synthetic oligonucleotide
tgctaatggagatgtgtccctcaaggtgaactc

SEQ ID NO: 226391 - DNA, 32 bp, Artificial Sequence
  Description of Artificial Sequence: Synthetic oligonucleotide
gctaatggagatgtgtccctcaaggtgaactc

SEQ ID NO: 226392 - DNA, 34 bp, Artificial Sequence
  Description of Artificial Sequence: Synthetic oligonucleotide
ctaatggagatgtgtccctcaaggtgaactcttc

SEQ ID NO: 226393 - DNA, 38 bp, Artificial Sequence
  Description of Artificial Sequence: Synthetic oligonucleotide
taatggagatgtgtccctcaaggtgaactcttctttac

SEQ ID NO: 226394 - DNA, 37 bp, Artificial Sequence
  Description of Artificial Sequence: Synthetic oligonucleotide
aatggagatgtgtccctcaaggtgaactcttctttac

SEQ ID NO: 226395 - DNA, 36 bp, Artificial Sequence
  Description of Artificial Sequence: Synthetic oligonucleotide
atggagatgtgtccctcaaggtgaactcttctttac

SEQ ID NO: 226396 - DNA, 35 bp, Artificial Sequence
  Description of Artificial Sequence: Synthetic oligonucleotide
tggagatgtgtccctcaaggtgaactcttctttac

SEQ ID NO: 226397 - DNA, 34 bp, Artificial Sequence
  Description of Artificial Sequence: Synthetic oligonucleotide
ggagatgtgtccctcaaggtgaactcttctttac

SEQ ID NO: 226398 - DNA, 36 bp, Artificial Sequence
  Description of Artificial Sequence: Synthetic oligonucleotide
gagatgtgtccctcaaggtgaactcttctttactac

SEQ ID NO: 226399 - DNA, 36 bp, Artificial Sequence
  Description of Artificial Sequence: Synthetic oligonucleotide
agatgtgtccctcaaggtgaactcttctttactacc

SEQ ID NO: 226400 - DNA, 35 bp, Artificial Sequence
  Description of Artificial Sequence: Synthetic oligonucleotide
gatgtgtccctcaaggtgaactcttctttactacc

SEQ ID NO: 226401 - DNA, 35 bp, Artificial Sequence
  Description of Artificial Sequence: Synthetic oligonucleotide
atgtgtccctcaaggtgaactcttctttactaccc

SEQ ID NO: 226402 - DNA, 34 bp, Artificial Sequence
  Description of Artificial Sequence: Synthetic oligonucleotide
tgtgtccctcaaggtgaactcttctttactaccc

SEQ ID NO: 226403 - DNA, 33 bp, Artificial Sequence
  Description of Artificial Sequence: Synthetic oligonucleotide
gtgtccctcaaggtgaactcttctttactaccc

SEQ ID NO: 226404 - DNA, 33 bp, Artificial Sequence
  Description of Artificial Sequence: Synthetic oligonucleotide
tgtccctcaaggtgaactcttctttactacccc

SEQ ID NO: 226405 - DNA, 32 bp, Artificial Sequence
  Description of Artificial Sequence: Synthetic oligonucleotide
gtccctcaaggtgaactcttctttactacccc

SEQ ID NO: 226406 - DNA, 32 bp, Artificial Sequence
  Description of Artificial Sequence: Synthetic oligonucleotide
tccctcaaggtgaactcttctttactaccccc

SEQ ID NO: 226407 - DNA, 31 bp, Artificial Sequence
  Description of Artificial Sequence: Synthetic oligonucleotide
ccctcaaggtgaactcttctttactaccccc

SEQ ID NO: 226408 - DNA, 31 bp, Artificial Sequence
  Description of Artificial Sequence: Synthetic oligonucleotide
cctcaaggtgaactcttctttactacccccg

SEQ ID NO: 226409 - DNA, 33 bp, Artificial Sequence
  Description of Artificial Sequence: Synthetic oligonucleotide
ctcaaggtgaactcttctttactacccccgaag

SEQ ID NO: 226410 - DNA, 33 bp, Artificial Sequence
  Description of Artificial Sequence: Synthetic oligonucleotide
tcaaggtgaactcttctttactacccccgaagg

SEQ ID NO: 226411 - DNA, 32 bp, Artificial Sequence
  Description of Artificial Sequence: Synthetic oligonucleotide
caaggtgaactcttctttactacccccgaagg

SEQ ID NO: 226412 - DNA, 32 bp, Artificial Sequence
  Description of Artificial Sequence: Synthetic oligonucleotide
aaggtgaactcttctttactacccccgaaggc

SEQ ID NO: 226413 - DNA, 31 bp, Artificial Sequence
  Description of Artificial Sequence: Synthetic oligonucleotide
aggtgaactcttctttactacccccgaaggc

SEQ ID NO: 226414 - DNA, 30 bp, Artificial Sequence
  Description of Artificial Sequence: Synthetic oligonucleotide
ggtgaactcttctttactacccccgaaggc

SEQ ID NO: 226415 - DNA, 30 bp, Artificial Sequence
  Description of Artificial Sequence: Synthetic oligonucleotide
gtgaactcttctttactacccccgaaggcc

SEQ ID NO: 226416 - DNA, 30 bp, Artificial Sequence
  Description of Artificial Sequence: Synthetic oligonucleotide
tgaactcttctttactacccccgaaggccc

SEQ ID NO: 226417 - DNA, 29 bp, Artificial Sequence
  Description of Artificial Sequence: Synthetic oligonucleotide
gaactcttctttactacccccgaaggccc

SEQ ID NO: 226418 - DNA, 29 bp, Artificial Sequence
  Description of Artificial Sequence: Synthetic oligonucleotide
aactcttctttactacccccgaaggcccc

SEQ ID NO: 226419 - DNA, 28 bp, Artificial Sequence
  Description of Artificial Sequence: Synthetic oligonucleotide
actcttctttactacccccgaaggcccc

SEQ ID NO: 226420 - DNA, 27 bp, Artificial Sequence
  Description of Artificial Sequence: Synthetic oligonucleotide
ctcttctttactacccccgaaggcccc

SEQ ID NO: 226421 - DNA, 28 bp, Artificial Sequence
  Description of Artificial Sequence: Synthetic oligonucleotide
tcttctttactacccccgaaggccccag

SEQ ID NO: 226422 - DNA, 27 bp, Artificial Sequence
  Description of Artificial Sequence: Synthetic oligonucleotide
cttctttactacccccgaaggccccag

SEQ ID NO: 226423 - DNA, 28 bp, Artificial Sequence
  Description of Artificial Sequence: Synthetic oligonucleotide
ttctttactacccccgaaggccccagag

SEQ ID NO: 226424 - DNA, 27 bp, Artificial Sequence
  Description of Artificial Sequence: Synthetic oligonucleotide
tctttactacccccgaaggccccagag

SEQ ID NO: 226425 - DNA, 26 bp, Artificial Sequence
  Description of Artificial Sequence: Synthetic oligonucleotide
ctttactacccccgaaggccccagag

SEQ ID NO: 226426 - DNA, 27 bp, Artificial Sequence
  Description of Artificial Sequence: Synthetic oligonucleotide
tttactacccccgaaggccccagagct

SEQ ID NO: 226427 - DNA, 26 bp, Artificial Sequence
  Description of Artificial Sequence: Synthetic oligonucleotide
ttactacccccgaaggccccagagct

SEQ ID NO: 226428 - DNA, 25 bp, Artificial Sequence
  Description of Artificial Sequence: Synthetic oligonucleotide
tactacccccgaaggccccagagct

SEQ ID NO: 226429 - DNA, 24 bp, Artificial Sequence
  Description of Artificial Sequence: Synthetic oligonucleotide
actacccccgaaggccccagagct

SEQ ID NO: 226430 - DNA, 23 bp, Artificial Sequence
  Description of Artificial Sequence: Synthetic oligonucleotide
ctacccccgaaggccccagagct

SEQ ID NO: 226431 - DNA, 25 bp, Artificial Sequence
  Description of Artificial Sequence: Synthetic oligonucleotide
tacccccgaaggccccagagctgaa

SEQ ID NO: 226432 - DNA, 24 bp, Artificial Sequence
  Description of Artificial Sequence: Synthetic oligonucleotide
acccccgaaggccccagagctgaa

SEQ ID NO: 226433 - DNA, 23 bp, Artificial Sequence
  Description of Artificial Sequence: Synthetic oligonucleotide
cccccgaaggccccagagctgaa

SEQ ID NO: 226434 - DNA, 23 bp, Artificial Sequence
  Description of Artificial Sequence: Synthetic oligonucleotide
ccccgaaggccccagagctgaag

SEQ ID NO: 226435 - DNA, 27 bp, Artificial Sequence
  Description of Artificial Sequence: Synthetic oligonucleotide
cccgaaggccccagagctgaaggatat

SEQ ID NO: 226436 - DNA, 30 bp, Artificial Sequence
  Description of Artificial Sequence: Synthetic oligonucleotide
ccgaaggccccagagctgaaggatataatc

SEQ ID NO: 226437 - DNA, 30 bp, Artificial Sequence
  Description of Artificial Sequence: Synthetic oligonucleotide
cgaaggccccagagctgaaggatataatcc

SEQ ID NO: 226438 - DNA, 31 bp, Artificial Sequence
  Description of Artificial Sequence: Synthetic oligonucleotide
gaaggccccagagctgaaggatataatcctg

SEQ ID NO: 226439 - DNA, 32 bp, Artificial Sequence
  Description of Artificial Sequence: Synthetic oligonucleotide
aaggccccagagctgaaggatataatcctgtc

SEQ ID NO: 226440 - DNA, 31 bp, Artificial Sequence
  Description of Artificial Sequence: Synthetic oligonucleotide
aggccccagagctgaaggatataatcctgtc

SEQ ID NO: 226441 - DNA, 30 bp, Artificial Sequence
  Description of Artificial Sequence: Synthetic oligonucleotide
ggccccagagctgaaggatataatcctgtc

SEQ ID NO: 226442 - DNA, 30 bp, Artificial Sequence
  Description of Artificial Sequence: Synthetic oligonucleotide
gccccagagctgaaggatataatcctgtcc

SEQ ID NO: 226443 - DNA, 32 bp, Artificial Sequence
  Description of Artificial Sequence: Synthetic oligonucleotide
ccccagagctgaaggatataatcctgtccttg

SEQ ID NO: 226444 - DNA, 32 bp, Artificial Sequence
  Description of Artificial Sequence: Synthetic oligonucleotide
cccagagctgaaggatataatcctgtccttgc

SEQ ID NO: 226445 - DNA, 32 bp, Artificial Sequence
  Description of Artificial Sequence: Synthetic oligonucleotide
ccagagctgaaggatataatcctgtccttgcc

SEQ ID NO: 226446 - DNA, 32 bp, Artificial Sequence
  Description of Artificial Sequence: Synthetic oligonucleotide
cagagctgaaggatataatcctgtccttgccc

SEQ ID NO: 226447 - DNA, 32 bp, Artificial Sequence
  Description of Artificial Sequence: Synthetic oligonucleotide
agagctgaaggatataatcctgtccttgcccc

SEQ ID NO: 226448 - DNA, 31 bp, Artificial Sequence
  Description of Artificial Sequence: Synthetic oligonucleotide
gagctgaaggatataatcctgtccttgcccc

SEQ ID NO: 226449 - DNA, 31 bp, Artificial Sequence
  Description of Artificial Sequence: Synthetic oligonucleotide
agctgaaggatataatcctgtccttgccccc

SEQ ID NO: 226450 - DNA, 30 bp, Artificial Sequence
  Description of Artificial Sequence: Synthetic oligonucleotide
gctgaaggatataatcctgtccttgccccc

SEQ ID NO: 226451 - DNA, 31 bp, Artificial Sequence
  Description of Artificial Sequence: Synthetic oligonucleotide
ctgaaggatataatcctgtccttgccccctg

SEQ ID NO: 226452 - DNA, 32 bp, Artificial Sequence
  Description of Artificial Sequence: Synthetic oligonucleotide
tgaaggatataatcctgtccttgccccctgac

SEQ ID NO: 226453 - DNA, 31 bp, Artificial Sequence
  Description of Artificial Sequence: Synthetic oligonucleotide
gaaggatataatcctgtccttgccccctgac

SEQ ID NO: 226454 - DNA, 31 bp, Artificial Sequence
  Description of Artificial Sequence: Synthetic oligonucleotide
aaggatataatcctgtccttgccccctgacc

SEQ ID NO: 226455 - DNA, 30 bp, Artificial Sequence
  Description of Artificial Sequence: Synthetic oligonucleotide
aggatataatcctgtccttgccccctgacc

SEQ ID NO: 226456 - DNA, 29 bp, Artificial Sequence
  Description of Artificial Sequence: Synthetic oligonucleotide
ggatataatcctgtccttgccccctgacc

SEQ ID NO: 226457 - DNA, 31 bp, Artificial Sequence
  Description of Artificial Sequence: Synthetic oligonucleotide
gatataatcctgtccttgccccctgaccttg

SEQ ID NO: 226458 - DNA, 31 bp, Artificial Sequence
  Description of Artificial Sequence: Synthetic oligonucleotide
atataatcctgtccttgccccctgaccttgg

SEQ ID NO: 226459 - DNA, 30 bp, Artificial Sequence
  Description of Artificial Sequence: Synthetic oligonucleotide
tataatcctgtccttgccccctgaccttgg

SEQ ID NO: 226460 - DNA, 29 bp, Artificial Sequence
  Description of Artificial Sequence: Synthetic oligonucleotide
ataatcctgtccttgccccctgaccttgg

SEQ ID NO: 226461 - DNA, 28 bp, Artificial Sequence
  Description of Artificial Sequence: Synthetic oligonucleotide
taatcctgtccttgccccctgaccttgg

SEQ ID NO: 226462 - DNA, 27 bp, Artificial Sequence
  Description of Artificial Sequence: Synthetic oligonucleotide
aatcctgtccttgccccctgaccttgg

SEQ ID NO: 226463 - DNA, 26 bp, Artificial Sequence
  Description of Artificial Sequence: Synthetic oligonucleotide
atcctgtccttgccccctgaccttgg

SEQ ID NO: 226464 - DNA, 25 bp, Artificial Sequence
  Description of Artificial Sequence: Synthetic oligonucleotide
tcctgtccttgccccctgaccttgg

SEQ ID NO: 226465 - DNA, 24 bp, Artificial Sequence
  Description of Artificial Sequence: Synthetic oligonucleotide
cctgtccttgccccctgaccttgg

SEQ ID NO: 226466 - DNA, 24 bp, Artificial Sequence
  Description of Artificial Sequence: Synthetic oligonucleotide
ctgtccttgccccctgaccttggc

SEQ ID NO: 226467 - DNA, 24 bp, Artificial Sequence
  Description of Artificial Sequence: Synthetic oligonucleotide
tgtccttgccccctgaccttggcc

SEQ ID NO: 226468 - DNA, 23 bp, Artificial Sequence
  Description of Artificial Sequence: Synthetic oligonucleotide
gtccttgccccctgaccttggcc

SEQ ID NO: 226469 - DNA, 24 bp, Artificial Sequence
  Description of Artificial Sequence: Synthetic oligonucleotide
tccttgccccctgaccttggccca

SEQ ID NO: 226470 - DNA, 23 bp, Artificial Sequence
  Description of Artificial Sequence: Synthetic oligonucleotide
ccttgccccctgaccttggccca

SEQ ID NO: 226471 - DNA, 23 bp, Artificial Sequence
  Description of Artificial Sequence: Synthetic oligonucleotide
cttgccccctgaccttggcccag

SEQ ID NO: 226472 - DNA, 23 bp, Artificial Sequence
  Description of Artificial Sequence: Synthetic oligonucleotide
ttgccccctgaccttggcccagc

SEQ ID NO: 226473 - DNA, 22 bp, Artificial Sequence
  Description of Artificial Sequence: Synthetic oligonucleotide
tgccccctgaccttggcccagc

SEQ ID NO: 226474 - DNA, 21 bp, Artificial Sequence
  Description of Artificial Sequence: Synthetic oligonucleotide
gccccctgaccttggcccagc

SEQ ID NO: 226475 - DNA, 21 bp, Artificial Sequence
  Description of Artificial Sequence: Synthetic oligonucleotide
ccccctgaccttggcccagcc

SEQ ID NO: 226476 - DNA, 23 bp, Artificial Sequence
  Description of Artificial Sequence: Synthetic oligonucleotide
cccctgaccttggcccagccctt

SEQ ID NO: 226477 - DNA, 24 bp, Artificial Sequence
  Description of Artificial Sequence: Synthetic oligonucleotide
ccctgaccttggcccagcccttca

SEQ ID NO: 226478 - DNA, 24 bp, Artificial Sequence
  Description of Artificial Sequence: Synthetic oligonucleotide
cctgaccttggcccagcccttcag

SEQ ID NO: 226479 - DNA, 25 bp, Artificial Sequence
  Description of Artificial Sequence: Synthetic oligonucleotide
ctgaccttggcccagcccttcagga

SEQ ID NO: 226480 - DNA, 25 bp, Artificial Sequence
  Description of Artificial Sequence: Synthetic oligonucleotide
tgaccttggcccagcccttcaggag

SEQ ID NO: 226481 - DNA, 24 bp, Artificial Sequence
  Description of Artificial Sequence: Synthetic oligonucleotide
gaccttggcccagcccttcaggag

SEQ ID NO: 226482 - DNA, 25 bp, Artificial Sequence
  Description of Artificial Sequence: Synthetic oligonucleotide
accttggcccagcccttcaggagct

SEQ ID NO: 226483 - DNA, 24 bp, Artificial Sequence
  Description of Artificial Sequence: Synthetic oligonucleotide
ccttggcccagcccttcaggagct

SEQ ID NO: 226484 - DNA, 26 bp, Artificial Sequence
  Description of Artificial Sequence: Synthetic oligonucleotide
cttggcccagcccttcaggagctcaa

SEQ ID NO: 226485 - DNA, 26 bp, Artificial Sequence
  Description of Artificial Sequence: Synthetic oligonucleotide
ttggcccagcccttcaggagctcaag

SEQ ID NO: 226486 - DNA, 25 bp, Artificial Sequence
  Description of Artificial Sequence: Synthetic oligonucleotide
tggcccagcccttcaggagctcaag

SEQ ID NO: 226487 - DNA, 24 bp, Artificial Sequence
  Description of Artificial Sequence: Synthetic oligonucleotide
ggcccagcccttcaggagctcaag

SEQ ID NO: 226488 - DNA, 24 bp, Artificial Sequence
  Description of Artificial Sequence: Synthetic oligonucleotide
gcccagcccttcaggagctcaagg

SEQ ID NO: 226489 - DNA, 25 bp, Artificial Sequence
  Description of Artificial Sequence: Synthetic oligonucleotide
cccagcccttcaggagctcaaggct

SEQ ID NO: 226490 - DNA, 25 bp, Artificial Sequence
  Description of Artificial Sequence: Synthetic oligonucleotide
ccagcccttcaggagctcaaggctc

SEQ ID NO: 226491 - DNA, 27 bp, Artificial Sequence
  Description of Artificial Sequence: Synthetic oligonucleotide
cagcccttcaggagctcaaggctcctt

SEQ ID NO: 226492 - DNA, 27 bp, Artificial Sequence
  Description of Artificial Sequence: Synthetic oligonucleotide
agcccttcaggagctcaaggctccttc

SEQ ID NO: 226493 - DNA, 27 bp, Artificial Sequence
  Description of Artificial Sequence: Synthetic oligonucleotide
gcccttcaggagctcaaggctccttct

SEQ ID NO: 226494 - DNA, 32 bp, Artificial Sequence
  Description of Artificial Sequence: Synthetic oligonucleotide
cccttcaggagctcaaggctccttctttttag

SEQ ID NO: 226495 - DNA, 24 bp, Artificial Sequence
  Description of Artificial Sequence: Synthetic oligonucleotide
tgcggtccccattcccgcagcgtt

SEQ ID NO: 226496 - DNA, 23 bp, Artificial Sequence
  Description of Artificial Sequence: Synthetic oligonucleotide
gcggtccccattcccgcagcgtt

SEQ ID NO: 226497 - DNA, 23 bp, Artificial Sequence
  Description of Artificial Sequence: Synthetic oligonucleotide
cggtccccattcccgcagcgttc

SEQ ID NO: 226498 - DNA, 23 bp, Artificial Sequence
  Description of Artificial Sequence: Synthetic oligonucleotide
ggtccccattcccgcagcgttcc

SEQ ID NO: 226499 - DNA, 24 bp, Artificial Sequence
  Description of Artificial Sequence: Synthetic oligonucleotide
gtccccattcccgcagcgttccca

SEQ ID NO: 226500 - DNA, 24 bp, Artificial Sequence
  Description of Artificial Sequence: Synthetic oligonucleotide
tccccattcccgcagcgttcccag

SEQ ID NO: 226501 - DNA, 23 bp, Artificial Sequence
  Description of Artificial Sequence: Synthetic oligonucleotide
ccccattcccgcagcgttcccag

SEQ ID NO: 226502 - DNA, 23 bp, Artificial Sequence
  Description of Artificial Sequence: Synthetic oligonucleotide
cccattcccgcagcgttcccagg

SEQ ID NO: 226503 - DNA, 24 bp, Artificial Sequence
  Description of Artificial Sequence: Synthetic oligonucleotide
ccattcccgcagcgttcccaggct

SEQ ID NO: 226504 - DNA, 26 bp, Artificial Sequence
  Description of Artificial Sequence: Synthetic oligonucleotide
cattcccgcagcgttcccaggctgtt

SEQ ID NO: 226505 - DNA, 27 bp, Artificial Sequence
  Description of Artificial Sequence: Synthetic oligonucleotide
attcccgcagcgttcccaggctgttca

SEQ ID NO: 226506 - DNA, 26 bp, Artificial Sequence
  Description of Artificial Sequence: Synthetic oligonucleotide
ttcccgcagcgttcccaggctgttca

SEQ ID NO: 226507 - DNA, 25 bp, Artificial Sequence
  Description of Artificial Sequence: Synthetic oligonucleotide
tcccgcagcgttcccaggctgttca

SEQ ID NO: 226508 - DNA, 24 bp, Artificial Sequence
  Description of Artificial Sequence: Synthetic oligonucleotide
cccgcagcgttcccaggctgttca

SEQ ID NO: 226509 - DNA, 27 bp, Artificial Sequence
  Description of Artificial Sequence: Synthetic oligonucleotide
ccgcagcgttcccaggctgttcacata

SEQ ID NO: 226510 - DNA, 29 bp, Artificial Sequence
  Description of Artificial Sequence: Synthetic oligonucleotide
cgcagcgttcccaggctgttcacatattc

SEQ ID NO: 226511 - DNA, 29 bp, Artificial Sequence
  Description of Artificial Sequence: Synthetic oligonucleotide
gcagcgttcccaggctgttcacatattcc

SEQ ID NO: 226512 - DNA, 29 bp, Artificial Sequence
  Description of Artificial Sequence: Synthetic oligonucleotide
cagcgttcccaggctgttcacatattccg

SEQ ID NO: 226513 - DNA, 29 bp, Artificial Sequence
  Description of Artificial Sequence: Synthetic oligonucleotide
agcgttcccaggctgttcacatattccgg

SEQ ID NO: 226514 - DNA, 28 bp, Artificial Sequence
  Description of Artificial Sequence: Synthetic oligonucleotide
gcgttcccaggctgttcacatattccgg

SEQ ID NO: 226515 - DNA, 28 bp, Artificial Sequence
  Description of Artificial Sequence: Synthetic oligonucleotide
cgttcccaggctgttcacatattccggg

SEQ ID NO: 226516 - DNA, 30 bp, Artificial Sequence
  Description of Artificial Sequence: Synthetic oligonucleotide
gttcccaggctgttcacatattccgggatg

SEQ ID NO: 226517 - DNA, 30 bp, Artificial Sequence
  Description of Artificial Sequence: Synthetic oligonucleotide
ttcccaggctgttcacatattccgggatgg

SEQ ID NO: 226518 - DNA, 27 bp, Artificial Sequence
  Description of Artificial Sequence: Synthetic oligonucleotide
tggctctctggctgcctcatccctctt

SEQ ID NO: 226519 - DNA, 26 bp, Artificial Sequence
  Description of Artificial Sequence: Synthetic oligonucleotide
ggctctctggctgcctcatccctctt

SEQ ID NO: 226520 - DNA, 27 bp, Artificial Sequence
  Description of Artificial Sequence: Synthetic oligonucleotide
gctctctggctgcctcatccctcttgt

SEQ ID NO: 226521 - DNA, 27 bp, Artificial Sequence
  Description of Artificial Sequence: Synthetic oligonucleotide
ctctctggctgcctcatccctcttgtc

SEQ ID NO: 226522 - DNA, 29 bp, Artificial Sequence
  Description of Artificial Sequence: Synthetic oligonucleotide
tctctggctgcctcatccctcttgtcttc

SEQ ID NO: 226523 - DNA, 28 bp, Artificial Sequence
  Description of Artificial Sequence: Synthetic oligonucleotide
ctctggctgcctcatccctcttgtcttc

SEQ ID NO: 226524 - DNA, 28 bp, Artificial Sequence
  Description of Artificial Sequence: Synthetic oligonucleotide
tctggctgcctcatccctcttgtcttcc

SEQ ID NO: 226525 - DNA, 27 bp, Artificial Sequence
  Description of Artificial Sequence: Synthetic oligonucleotide
ctggctgcctcatccctcttgtcttcc

SEQ ID NO: 226526 - DNA, 28 bp, Artificial Sequence
  Description of Artificial Sequence: Synthetic oligonucleotide
tggctgcctcatccctcttgtcttcctc

SEQ ID NO: 226527 - DNA, 27 bp, Artificial Sequence
  Description of Artificial Sequence: Synthetic oligonucleotide
ggctgcctcatccctcttgtcttcctc

SEQ ID NO: 226528 - DNA, 27 bp, Artificial Sequence
  Description of Artificial Sequence: Synthetic oligonucleotide
gctgcctcatccctcttgtcttcctcc

SEQ ID NO: 226529 - DNA, 27 bp, Artificial Sequence
  Description of Artificial Sequence: Synthetic oligonucleotide
ctgcctcatccctcttgtcttcctccg

SEQ ID NO: 226530 - DNA, 27 bp, Artificial Sequence
  Description of Artificial Sequence: Synthetic oligonucleotide
tgcctcatccctcttgtcttcctccgg

SEQ ID NO: 226531 - DNA, 26 bp, Artificial Sequence
  Description of Artificial Sequence: Synthetic oligonucleotide
gcctcatccctcttgtcttcctccgg

SEQ ID NO: 226532 - DNA, 27 bp, Artificial Sequence
  Description of Artificial Sequence: Synthetic oligonucleotide
cctcatccctcttgtcttcctccggct

SEQ ID NO: 226533 - DNA, 27 bp, Artificial Sequence
  Description of Artificial Sequence: Synthetic oligonucleotide
ctcatccctcttgtcttcctccggctg

SEQ ID NO: 226534 - DNA, 28 bp, Artificial Sequence
  Description of Artificial Sequence: Synthetic oligonucleotide
tcatccctcttgtcttcctccggctgtc

SEQ ID NO: 226535 - DNA, 27 bp, Artificial Sequence
  Description of Artificial Sequence: Synthetic oligonucleotide
catccctcttgtcttcctccggctgtc

SEQ ID NO: 226536 - DNA, 28 bp, Artificial Sequence
  Description of Artificial Sequence: Synthetic oligonucleotide
atccctcttgtcttcctccggctgtctg

SEQ ID NO: 226537 - DNA, 27 bp, Artificial Sequence
  Description of Artificial Sequence: Synthetic oligonucleotide
tccctcttgtcttcctccggctgtctg

SEQ ID NO: 226538 - DNA, 27 bp, Artificial Sequence
  Description of Artificial Sequence: Synthetic oligonucleotide
ccctcttgtcttcctccggctgtctgt

SEQ ID NO: 226539 - DNA, 27 bp, Artificial Sequence
  Description of Artificial Sequence: Synthetic oligonucleotide
cctcttgtcttcctccggctgtctgtg

SEQ ID NO: 226540 - DNA, 30 bp, Artificial Sequence
  Description of Artificial Sequence: Synthetic oligonucleotide
ctcttgtcttcctccggctgtctgtgtatg

SEQ ID NO: 226541 - DNA, 31 bp, Artificial Sequence
  Description of Artificial Sequence: Synthetic oligonucleotide
tcttgtcttcctccggctgtctgtgtatgtg

SEQ ID NO: 226542 - DNA, 30 bp, Artificial Sequence
  Description of Artificial Sequence: Synthetic oligonucleotide
cttgtcttcctccggctgtctgtgtatgtg

SEQ ID NO: 226543 - DNA, 31 bp, Artificial Sequence
  Description of Artificial Sequence: Synthetic oligonucleotide
ttgtcttcctccggctgtctgtgtatgtgtc

SEQ ID NO: 226544 - DNA, 30 bp, Artificial Sequence
  Description of Artificial Sequence: Synthetic oligonucleotide
tgtcttcctccggctgtctgtgtatgtgtc

SEQ ID NO: 226545 - DNA, 29 bp, Artificial Sequence
  Description of Artificial Sequence: Synthetic oligonucleotide
gtcttcctccggctgtctgtgtatgtgtc

SEQ ID NO: 226546 - DNA, 30 bp, Artificial Sequence
  Description of Artificial Sequence: Synthetic oligonucleotide
tcttcctccggctgtctgtgtatgtgtcag

SEQ ID NO: 226547 - DNA, 29 bp, Artificial Sequence
  Description of Artificial Sequence: Synthetic oligonucleotide
cttcctccggctgtctgtgtatgtgtcag

SEQ ID NO: 226548 - DNA, 29 bp, Artificial Sequence
  Description of Artificial Sequence: Synthetic oligonucleotide
ttcctccggctgtctgtgtatgtgtcagg

SEQ ID NO: 226549 - DNA, 28 bp, Artificial Sequence
  Description of Artificial Sequence: Synthetic oligonucleotide
tcctccggctgtctgtgtatgtgtcagg

SEQ ID NO: 226550 - DNA, 27 bp, Artificial Sequence
  Description of Artificial Sequence: Synthetic oligonucleotide
cctccggctgtctgtgtatgtgtcagg

SEQ ID NO: 226551 - DNA, 27 bp, Artificial Sequence
  Description of Artificial Sequence: Synthetic oligonucleotide
ctccggctgtctgtgtatgtgtcaggc

SEQ ID NO: 226552 - DNA, 27 bp, Artificial Sequence
  Description of Artificial Sequence: Synthetic oligonucleotide
tccggctgtctgtgtatgtgtcaggcc

SEQ ID NO: 226553 - DNA, 27 bp, Artificial Sequence
  Description of Artificial Sequence: Synthetic oligonucleotide
ccggctgtctgtgtatgtgtcaggcca

SEQ ID NO: 226554 - DNA, 27 bp, Artificial Sequence
  Description of Artificial Sequence: Synthetic oligonucleotide
cggctgtctgtgtatgtgtcaggccac

SEQ ID NO: 226555 - DNA, 27 bp, Artificial Sequence
  Description of Artificial Sequence: Synthetic oligonucleotide
ggctgtctgtgtatgtgtcaggccacg

SEQ ID NO: 226556 - DNA, 27 bp, Artificial Sequence
  Description of Artificial Sequence: Synthetic oligonucleotide
gctgtctgtgtatgtgtcaggccacgc

SEQ ID NO: 226557 - DNA, 28 bp, Artificial Sequence
  Description of Artificial Sequence: Synthetic oligonucleotide
ctgtctgtgtatgtgtcaggccacgcag

SEQ ID NO: 226558 - DNA, 28 bp, Artificial Sequence
  Description of Artificial Sequence: Synthetic oligonucleotide
tgtctgtgtatgtgtcaggccacgcagg

SEQ ID NO: 226559 - DNA, 27 bp, Artificial Sequence
  Description of Artificial Sequence: Synthetic oligonucleotide
gtctgtgtatgtgtcaggccacgcagg

SEQ ID NO: 226560 - DNA, 27 bp, Artificial Sequence
  Description of Artificial Sequence: Synthetic oligonucleotide
tctgtgtatgtgtcaggccacgcaggg

SEQ ID NO: 226561 - DNA, 26 bp, Artificial Sequence
  Description of Artificial Sequence: Synthetic oligonucleotide
ctgtgtatgtgtcaggccacgcaggg

SEQ ID NO: 226562 - DNA, 27 bp, Artificial Sequence
  Description of Artificial Sequence: Synthetic oligonucleotide
tgtgtatgtgtcaggccacgcagggga

SEQ ID NO: 226563 - DNA, 27 bp, Artificial Sequence
  Description of Artificial Sequence: Synthetic oligonucleotide
gtgtatgtgtcaggccacgcaggggat

SEQ ID NO: 226564 - DNA, 27 bp, Artificial Sequence
  Description of Artificial Sequence: Synthetic oligonucleotide
tgtatgtgtcaggccacgcaggggatg

SEQ ID NO: 226565 - DNA, 26 bp, Artificial Sequence
  Description of Artificial Sequence: Synthetic oligonucleotide
gtatgtgtcaggccacgcaggggatg

SEQ ID NO: 226566 - DNA, 26 bp, Artificial Sequence
  Description of Artificial Sequence: Synthetic oligonucleotide
tatgtgtcaggccacgcaggggatgc

SEQ ID NO: 226567 - DNA, 32 bp, Artificial Sequence
  Description of Artificial Sequence: Synthetic oligonucleotide
gaatataaggggaggacggtgctagtgagatg

SEQ ID NO: 226568 - DNA, 32 bp, Artificial Sequence
  Description of Artificial Sequence: Synthetic oligonucleotide
aatataaggggaggacggtgctagtgagatgc

SEQ ID NO: 226569 - DNA, 31 bp, Artificial Sequence
  Description of Artificial Sequence: Synthetic oligonucleotide
atataaggggaggacggtgctagtgagatgc

SEQ ID NO: 226570 - DNA, 30 bp, Artificial Sequence
  Description of Artificial Sequence: Synthetic oligonucleotide
tataaggggaggacggtgctagtgagatgc

SEQ ID NO: 226571 - DNA, 29 bp, Artificial Sequence
  Description of Artificial Sequence: Synthetic oligonucleotide
ataaggggaggacggtgctagtgagatgc

SEQ ID NO: 226572 - DNA, 28 bp, Artificial Sequence
  Description of Artificial Sequence: Synthetic oligonucleotide
taaggggaggacggtgctagtgagatgc

SEQ ID NO: 226573 - DNA, 27 bp, Artificial Sequence
  Description of Artificial Sequence: Synthetic oligonucleotide
aaggggaggacggtgctagtgagatgc

SEQ ID NO: 226574 - DNA, 26 bp, Artificial Sequence
  Description of Artificial Sequence: Synthetic oligonucleotide
aggggaggacggtgctagtgagatgc

SEQ ID NO: 226575 - DNA, 25 bp, Artificial Sequence
  Description of Artificial Sequence: Synthetic oligonucleotide
ggggaggacggtgctagtgagatgc

SEQ ID NO: 226576 - DNA, 25 bp, Artificial Sequence
  Description of Artificial Sequence: Synthetic oligonucleotide
gggaggacggtgctagtgagatgcc

SEQ ID NO: 226577 - DNA, 27 bp, Artificial Sequence
  Description of Artificial Sequence: Synthetic oligonucleotide
ggaggacggtgctagtgagatgcccaa

SEQ ID NO: 226578 - DNA, 27 bp, Artificial Sequence
  Description of Artificial Sequence: Synthetic oligonucleotide
gaggacggtgctagtgagatgcccaag

SEQ ID NO: 226579 - DNA, 28 bp, Artificial Sequence
  Description of Artificial Sequence: Synthetic oligonucleotide
aggacggtgctagtgagatgcccaagag

SEQ ID NO: 226580 - DNA, 27 bp, Artificial Sequence
  Description of Artificial Sequence: Synthetic oligonucleotide
ggacggtgctagtgagatgcccaagag

SEQ ID NO: 226581 - DNA, 27 bp, Artificial Sequence
  Description of Artificial Sequence: Synthetic oligonucleotide
gacggtgctagtgagatgcccaagagg

SEQ ID NO: 226582 - DNA, 27 bp, Artificial Sequence
  Description of Artificial Sequence: Synthetic oligonucleotide
acggtgctagtgagatgcccaagaggg

SEQ ID NO: 226583 - DNA, 27 bp, Artificial Sequence
  Description of Artificial Sequence: Synthetic oligonucleotide
cggtgctagtgagatgcccaagaggga

SEQ ID NO: 226584 - DNA, 28 bp, Artificial Sequence
  Description of Artificial Sequence: Synthetic oligonucleotide
ggtgctagtgagatgcccaagagggaag

SEQ ID NO: 226585 - DNA, 29 bp, Artificial Sequence
  Description of Artificial Sequence: Synthetic oligonucleotide
gtgctagtgagatgcccaagagggaagtg

SEQ ID NO: 226586 - DNA, 30 bp, Artificial Sequence
  Description of Artificial Sequence: Synthetic oligonucleotide
tgctagtgagatgcccaagagggaagtgtc

SEQ ID NO: 226587 - DNA, 29 bp, Artificial Sequence
  Description of Artificial Sequence: Synthetic oligonucleotide
gctagtgagatgcccaagagggaagtgtc

SEQ ID NO: 226588 - DNA, 30 bp, Artificial Sequence
  Description of Artificial Sequence: Synthetic oligonucleotide
ctagtgagatgcccaagagggaagtgtcac

SEQ ID NO: 226589 - DNA, 31 bp, Artificial Sequence
  Description of Artificial Sequence: Synthetic oligonucleotide
tagtgagatgcccaagagggaagtgtcactc

SEQ ID NO: 226590 - DNA, 30 bp, Artificial Sequence
  Description of Artificial Sequence: Synthetic oligonucleotide
agtgagatgcccaagagggaagtgtcactc

SEQ ID NO: 226591 - DNA, 29 bp, Artificial Sequence
  Description of Artificial Sequence: Synthetic oligonucleotide
gtgagatgcccaagagggaagtgtcactc

SEQ ID NO: 226592 - DNA, 30 bp, Artificial Sequence
  Description of Artificial Sequence: Synthetic oligonucleotide
tgagatgcccaagagggaagtgtcactctg

SEQ ID NO: 226593 - DNA, 24 bp, Artificial Sequence
  Description of Artificial Sequence: Synthetic oligonucleotide
tctgccctctctccctctggccca

SEQ ID NO: 226594 - DNA, 23 bp, Artificial Sequence
  Description of Artificial Sequence: Synthetic oligonucleotide
ctgccctctctccctctggccca

SEQ ID NO: 226595 - DNA, 23 bp, Artificial Sequence
  Description of Artificial Sequence: Synthetic oligonucleotide
tgccctctctccctctggcccag

SEQ ID NO: 226596 - DNA, 22 bp, Artificial Sequence
  Description of Artificial Sequence: Synthetic oligonucleotide
gccctctctccctctggcccag

SEQ ID NO: 226597 - DNA, 23 bp, Artificial Sequence
  Description of Artificial Sequence: Synthetic oligonucleotide
ccctctctccctctggcccagga

SEQ ID NO: 226598 - DNA, 23 bp, Artificial Sequence
  Description of Artificial Sequence: Synthetic oligonucleotide
cctctctccctctggcccaggac

SEQ ID NO: 226599 - DNA, 23 bp, Artificial Sequence
  Description of Artificial Sequence: Synthetic oligonucleotide
ctctctccctctggcccaggacg

SEQ ID NO: 226600 - DNA, 25 bp, Artificial Sequence
  Description of Artificial Sequence: Synthetic oligonucleotide
tctctccctctggcccaggacggta

SEQ ID NO: 226601 - DNA, 24 bp, Artificial Sequence
  Description of Artificial Sequence: Synthetic oligonucleotide
ctctccctctggcccaggacggta

SEQ ID NO: 226602 - DNA, 24 bp, Artificial Sequence
  Description of Artificial Sequence: Synthetic oligonucleotide
tctccctctggcccaggacggtac

SEQ ID NO: 226603 - DNA, 23 bp, Artificial Sequence
  Description of Artificial Sequence: Synthetic oligonucleotide
ctccctctggcccaggacggtac

SEQ ID NO: 226604 - DNA, 23 bp, Artificial Sequence
  Description of Artificial Sequence: Synthetic oligonucleotide
tccctctggcccaggacggtacc

SEQ ID NO: 226605 - DNA, 22 bp, Artificial Sequence
  Description of Artificial Sequence: Synthetic oligonucleotide
ccctctggcccaggacggtacc

SEQ ID NO: 226606 - DNA, 24 bp, Artificial Sequence
  Description of Artificial Sequence: Synthetic oligonucleotide
cctctggcccaggacggtacccaa

SEQ ID NO: 226607 - DNA, 24 bp, Artificial Sequence
  Description of Artificial Sequence: Synthetic oligonucleotide
ctctggcccaggacggtacccaag

SEQ ID NO: 226608 - DNA, 25 bp, Artificial Sequence
  Description of Artificial Sequence: Synthetic oligonucleotide
tctggcccaggacggtacccaagga

SEQ ID NO: 226609 - DNA, 24 bp, Artificial Sequence
  Description of Artificial Sequence: Synthetic oligonucleotide
ctggcccaggacggtacccaagga

SEQ ID NO: 226610 - DNA, 24 bp, Artificial Sequence
  Description of Artificial Sequence: Synthetic oligonucleotide
tggcccaggacggtacccaaggag

SEQ ID NO: 226611 - DNA, 23 bp, Artificial Sequence
  Description of Artificial Sequence: Synthetic oligonucleotide
ggcccaggacggtacccaaggag

SEQ ID NO: 226612 - DNA, 24 bp, Artificial Sequence
  Description of Artificial Sequence: Synthetic oligonucleotide
gcccaggacggtacccaaggaggt

SEQ ID NO: 226613 - DNA, 25 bp, Artificial Sequence
  Description of Artificial Sequence: Synthetic oligonucleotide
cccaggacggtacccaaggaggtga

SEQ ID NO: 226614 - DNA, 25 bp, Artificial Sequence
  Description of Artificial Sequence: Synthetic oligonucleotide
ccaggacggtacccaaggaggtgag

SEQ ID NO: 226615 - DNA, 26 bp, Artificial Sequence
  Description of Artificial Sequence: Synthetic oligonucleotide
caggacggtacccaaggaggtgaggt

SEQ ID NO: 226616 - DNA, 26 bp, Artificial Sequence
  Description of Artificial Sequence: Synthetic oligonucleotide
aggacggtacccaaggaggtgaggtg

SEQ ID NO: 226617 - DNA, 22 bp, Artificial Sequence
  Description of Artificial Sequence: Synthetic oligonucleotide
tccctctggcccgggacggtag

SEQ ID NO: 226618 - DNA, 21 bp, Artificial Sequence
  Description of Artificial Sequence: Synthetic oligonucleotide
ccctctggcccgggacggtag

SEQ ID NO: 226619 - DNA, 21 bp, Artificial Sequence
  Description of Artificial Sequence: Synthetic oligonucleotide
cctctggcccgggacggtagc

SEQ ID NO: 226620 - DNA, 23 bp, Artificial Sequence
  Description of Artificial Sequence: Synthetic oligonucleotide
ctctggcccgggacggtagccaa

SEQ ID NO: 226621 - DNA, 23 bp, Artificial Sequence
  Description of Artificial Sequence: Synthetic oligonucleotide
tctggcccgggacggtagccaag

SEQ ID NO: 226622 - DNA, 22 bp, Artificial Sequence
  Description of Artificial Sequence: Synthetic oligonucleotide
ctggcccgggacggtagccaag

SEQ ID NO: 226623 - DNA, 23 bp, Artificial Sequence
  Description of Artificial Sequence: Synthetic oligonucleotide
tggcccgggacggtagccaagga

SEQ ID NO: 226624 - DNA, 22 bp, Artificial Sequence
  Description of Artificial Sequence: Synthetic oligonucleotide
ggcccgggacggtagccaagga

SEQ ID NO: 226625 - DNA, 22 bp, Artificial Sequence
  Description of Artificial Sequence: Synthetic oligonucleotide
gcccgggacggtagccaaggag

SEQ ID NO: 226626 - DNA, 23 bp, Artificial Sequence
  Description of Artificial Sequence: Synthetic oligonucleotide
cccgggacggtagccaaggaggt

SEQ ID NO: 226627 - DNA, 24 bp, Artificial Sequence
  Description of Artificial Sequence: Synthetic oligonucleotide
ccgggacggtagccaaggaggtga

SEQ ID NO: 226628 - DNA, 24 bp, Artificial Sequence
  Description of Artificial Sequence: Synthetic oligonucleotide
cgggacggtagccaaggaggtgag

SEQ ID NO: 226629 - DNA, 25 bp, Artificial Sequence
  Description of Artificial Sequence: Synthetic oligonucleotide
gggacggtagccaaggaggtgaggt

SEQ ID NO: 226630 - DNA, 25 bp, Artificial Sequence
  Description of Artificial Sequence: Synthetic oligonucleotide
ggacggtagccaaggaggtgaggtg

SEQ ID NO: 226631 - DNA, 25 bp, Artificial Sequence
  Description of Artificial Sequence: Synthetic oligonucleotide
gacggtagccaaggaggtgaggtgg

SEQ ID NO: 226632 - DNA, 26 bp, Artificial Sequence
  Description of Artificial Sequence: Synthetic oligonucleotide
acggtagccaaggaggtgaggtggct

SEQ ID NO: 226633 - DNA, 25 bp, Artificial Sequence
  Description of Artificial Sequence: Synthetic oligonucleotide
cggtagccaaggaggtgaggtggct

SEQ ID NO: 226634 - DNA, 25 bp, Artificial Sequence
  Description of Artificial Sequence: Synthetic oligonucleotide
ggtagccaaggaggtgaggtggctg

SEQ ID NO: 226635 - DNA, 25 bp, Artificial Sequence
  Description of Artificial Sequence: Synthetic oligonucleotide
gtagccaaggaggtgaggtggctgc

SEQ ID NO: 226636 - DNA, 25 bp, Artificial Sequence
  Description of Artificial Sequence: Synthetic oligonucleotide
tagccaaggaggtgaggtggctgcg

SEQ ID NO: 226637 - DNA, 24 bp, Artificial Sequence
  Description of Artificial Sequence: Synthetic oligonucleotide
agccaaggaggtgaggtggctgcg

SEQ ID NO: 226638 - DNA, 23 bp, Artificial Sequence
  Description of Artificial Sequence: Synthetic oligonucleotide
gccaaggaggtgaggtggctgcg

SEQ ID NO: 226639 - DNA, 33 bp, Artificial Sequence
  Description of Artificial Sequence: Synthetic oligonucleotide
atgctaatggagatgtgtccctcaaggtgaacc

SEQ ID NO: 226640 - DNA, 32 bp, Artificial Sequence
  Description of Artificial Sequence: Synthetic oligonucleotide
tgctaatggagatgtgtccctcaaggtgaacc

SEQ ID NO: 226641 - DNA, 31 bp, Artificial Sequence
  Description of Artificial Sequence: Synthetic oligonucleotide
gctaatggagatgtgtccctcaaggtgaacc

SEQ ID NO: 226642 - DNA, 31 bp, Artificial Sequence
  Description of Artificial Sequence: Synthetic oligonucleotide
ctaatggagatgtgtccctcaaggtgaaccc

SEQ ID NO: 226643 - DNA, 33 bp, Artificial Sequence
  Description of Artificial Sequence: Synthetic oligonucleotide
taatggagatgtgtccctcaaggtgaacccttc

SEQ ID NO: 226644 - DNA, 32 bp, Artificial Sequence
  Description of Artificial Sequence: Synthetic oligonucleotide
aatggagatgtgtccctcaaggtgaacccttc

SEQ ID NO: 226645 - DNA, 31 bp, Artificial Sequence
  Description of Artificial Sequence: Synthetic oligonucleotide
atggagatgtgtccctcaaggtgaacccttc

SEQ ID NO: 226646 - DNA, 30 bp, Artificial Sequence
  Description of Artificial Sequence: Synthetic oligonucleotide
tggagatgtgtccctcaaggtgaacccttc

SEQ ID NO: 226647 - DNA, 29 bp, Artificial Sequence
  Description of Artificial Sequence: Synthetic oligonucleotide
ggagatgtgtccctcaaggtgaacccttc

SEQ ID NO: 226648 - DNA, 33 bp, Artificial Sequence
  Description of Artificial Sequence: Synthetic oligonucleotide
gagatgtgtccctcaaggtgaacccttctttac

SEQ ID NO: 226649 - DNA, 35 bp, Artificial Sequence
  Description of Artificial Sequence: Synthetic oligonucleotide
agatgtgtccctcaaggtgaacccttctttactac

SEQ ID NO: 226650 - DNA, 34 bp, Artificial Sequence
  Description of Artificial Sequence: Synthetic oligonucleotide
gatgtgtccctcaaggtgaacccttctttactac

SEQ ID NO: 226651 - DNA, 34 bp, Artificial Sequence
  Description of Artificial Sequence: Synthetic oligonucleotide
atgtgtccctcaaggtgaacccttctttactacc

SEQ ID NO: 226652 - DNA, 33 bp, Artificial Sequence
  Description of Artificial Sequence: Synthetic oligonucleotide
tgtgtccctcaaggtgaacccttctttactacc

SEQ ID NO: 226653 - DNA, 32 bp, Artificial Sequence
  Description of Artificial Sequence: Synthetic oligonucleotide
gtgtccctcaaggtgaacccttctttactacc

SEQ ID NO: 226654 - DNA, 32 bp, Artificial Sequence
  Description of Artificial Sequence: Synthetic oligonucleotide
tgtccctcaaggtgaacccttctttactaccc

SEQ ID NO: 226655 - DNA, 31 bp, Artificial Sequence
  Description of Artificial Sequence: Synthetic oligonucleotide
gtccctcaaggtgaacccttctttactaccc

SEQ ID NO: 226656 - DNA, 31 bp, Artificial Sequence
  Description of Artificial Sequence: Synthetic oligonucleotide
tccctcaaggtgaacccttctttactacccc

SEQ ID NO: 226657 - DNA, 30 bp, Artificial Sequence
  Description of Artificial Sequence: Synthetic oligonucleotide
ccctcaaggtgaacccttctttactacccc

SEQ ID NO: 226658 - DNA, 30 bp, Artificial Sequence
  Description of Artificial Sequence: Synthetic oligonucleotide
cctcaaggtgaacccttctttactaccccc

SEQ ID NO: 226659 - DNA, 30 bp, Artificial Sequence
  Description of Artificial Sequence: Synthetic oligonucleotide
ctcaaggtgaacccttctttactacccccg

SEQ ID NO: 226660 - DNA, 32 bp, Artificial Sequence
  Description of Artificial Sequence: Synthetic oligonucleotide
tcaaggtgaacccttctttactacccccgaag

SEQ ID NO: 226661 - DNA, 31 bp, Artificial Sequence
  Description of Artificial Sequence: Synthetic oligonucleotide
caaggtgaacccttctttactacccccgaag

SEQ ID NO: 226662 - DNA, 31 bp, Artificial Sequence
  Description of Artificial Sequence: Synthetic oligonucleotide
aaggtgaacccttctttactacccccgaagg

SEQ ID NO: 226663 - DNA, 30 bp, Artificial Sequence
  Description of Artificial Sequence: Synthetic oligonucleotide
aggtgaacccttctttactacccccgaagg

SEQ ID NO: 226664 - DNA, 29 bp, Artificial Sequence
  Description of Artificial Sequence: Synthetic oligonucleotide
ggtgaacccttctttactacccccgaagg

SEQ ID NO: 226665 - DNA, 29 bp, Artificial Sequence
  Description of Artificial Sequence: Synthetic oligonucleotide
gtgaacccttctttactacccccgaaggc

SEQ ID NO: 226666 - DNA, 29 bp, Artificial Sequence
  Description of Artificial Sequence: Synthetic oligonucleotide
tgaacccttctttactacccccgaaggcc

SEQ ID NO: 226667 - DNA, 28 bp, Artificial Sequence
  Description of Artificial Sequence: Synthetic oligonucleotide
gaacccttctttactacccccgaaggcc

SEQ ID NO: 226668 - DNA, 28 bp, Artificial Sequence
  Description of Artificial Sequence: Synthetic oligonucleotide
aacccttctttactacccccgaaggccc

SEQ ID NO: 226669 - DNA, 27 bp, Artificial Sequence
  Description of Artificial Sequence: Synthetic oligonucleotide
acccttctttactacccccgaaggccc

SEQ ID NO: 226670 - DNA, 26 bp, Artificial Sequence
  Description of Artificial Sequence: Synthetic oligonucleotide
cccttctttactacccccgaaggccc

SEQ ID NO: 226671 - DNA, 27 bp, Artificial Sequence
  Description of Artificial Sequence: Synthetic oligonucleotide
ccttctttactacccccgaaggcccca

SEQ ID NO: 226672 - DNA, 39 bp, Artificial Sequence
  Description of Artificial Sequence: Synthetic oligonucleotide
agcaaaagaaaagcttctctatgaacatgtgacggagac

SEQ ID NO: 226673 - DNA, 38 bp, Artificial Sequence
  Description of Artificial Sequence: Synthetic oligonucleotide
gcaaaagaaaagcttctctatgaacatgtgacggagac

SEQ ID NO: 226674 - DNA, 41 bp, Artificial Sequence
  Description of Artificial Sequence: Synthetic oligonucleotide
caaaagaaaagcttctctatgaacatgtgacggagacaatc

SEQ ID NO: 226675 - DNA, 43 bp, Artificial Sequence
  Description of Artificial Sequence: Synthetic oligonucleotide
aaaagaaaagcttctctatgaacatgtgacggagacaatcttc

SEQ ID NO: 226676 - DNA, 42 bp, Artificial Sequence
  Description of Artificial Sequence: Synthetic oligonucleotide
aaagaaaagcttctctatgaacatgtgacggagacaatcttc

SEQ ID NO: 226677 - DNA, 41 bp, Artificial Sequence
  Description of Artificial Sequence: Synthetic oligonucleotide
aagaaaagcttctctatgaacatgtgacggagacaatcttc

SEQ ID NO: 226678 - DNA, 40 bp, Artificial Sequence
  Description of Artificial Sequence: Synthetic oligonucleotide
agaaaagcttctctatgaacatgtgacggagacaatcttc

SEQ ID NO: 226679 - DNA, 39 bp, Artificial Sequence
  Description of Artificial Sequence: Synthetic oligonucleotide
gaaaagcttctctatgaacatgtgacggagacaatcttc

SEQ ID NO: 226680 - DNA, 42 bp, Artificial Sequence
  Description of Artificial Sequence: Synthetic oligonucleotide
aaaagcttctctatgaacatgtgacggagacaatcttctttc

SEQ ID NO: 226681 - DNA, 41 bp, Artificial Sequence
  Description of Artificial Sequence: Synthetic oligonucleotide
aaagcttctctatgaacatgtgacggagacaatcttctttc

SEQ ID NO: 226682 - DNA, 40 bp, Artificial Sequence
  Description of Artificial Sequence: Synthetic oligonucleotide
aagcttctctatgaacatgtgacggagacaatcttctttc

SEQ ID NO: 226683 - DNA, 39 bp, Artificial Sequence
  Description of Artificial Sequence: Synthetic oligonucleotide
agcttctctatgaacatgtgacggagacaatcttctttc

SEQ ID NO: 226684 - DNA, 38 bp, Artificial Sequence
  Description of Artificial Sequence: Synthetic oligonucleotide
gcttctctatgaacatgtgacggagacaatcttctttc

SEQ ID NO: 226685 - DNA, 39 bp, Artificial Sequence
  Description of Artificial Sequence: Synthetic oligonucleotide
cttctctatgaacatgtgacggagacaatcttctttcag

SEQ ID NO: 226686 - DNA, 40 bp, Artificial Sequence
  Description of Artificial Sequence: Synthetic oligonucleotide
ttctctatgaacatgtgacggagacaatcttctttcagac

SEQ ID NO: 226687 - DNA, 39 bp, Artificial Sequence
  Description of Artificial Sequence: Synthetic oligonucleotide
tctctatgaacatgtgacggagacaatcttctttcagac

SEQ ID NO: 226688 - DNA, 38 bp, Artificial Sequence
  Description of Artificial Sequence: Synthetic oligonucleotide
ctctatgaacatgtgacggagacaatcttctttcagac

SEQ ID NO: 226689 - DNA, 38 bp, Artificial Sequence
  Description of Artificial Sequence: Synthetic oligonucleotide
tctatgaacatgtgacggagacaatcttctttcagacc

SEQ ID NO: 226690 - DNA, 37 bp, Artificial Sequence
  Description of Artificial Sequence: Synthetic oligonucleotide
ctatgaacatgtgacggagacaatcttctttcagacc

SEQ ID NO: 226691 - DNA, 39 bp, Artificial Sequence
  Description of Artificial Sequence: Synthetic oligonucleotide
tatgaacatgtgacggagacaatcttctttcagaccatg

SEQ ID NO: 226692 - DNA, 38 bp, Artificial Sequence
  Description of Artificial Sequence: Synthetic oligonucleotide
atgaacatgtgacggagacaatcttctttcagaccatg

SEQ ID NO: 226693 - DNA, 37 bp, Artificial Sequence
  Description of Artificial Sequence: Synthetic oligonucleotide
tgaacatgtgacggagacaatcttctttcagaccatg

SEQ ID NO: 226694 - DNA, 36 bp, Artificial Sequence
  Description of Artificial Sequence: Synthetic oligonucleotide
gaacatgtgacggagacaatcttctttcagaccatg

SEQ ID NO: 226695 - DNA, 36 bp, Artificial Sequence
  Description of Artificial Sequence: Synthetic oligonucleotide
aacatgtgacggagacaatcttctttcagaccatgc

SEQ ID NO: 226696 - DNA, 35 bp, Artificial Sequence
  Description of Artificial Sequence: Synthetic oligonucleotide
acatgtgacggagacaatcttctttcagaccatgc

SEQ ID NO: 226697 - DNA, 34 bp, Artificial Sequence
  Description of Artificial Sequence: Synthetic oligonucleotide
catgtgacggagacaatcttctttcagaccatgc

SEQ ID NO: 226698 - DNA, 38 bp, Artificial Sequence
  Description of Artificial Sequence: Synthetic oligonucleotide
atgtgacggagacaatcttctttcagaccatgctaaag

SEQ ID NO: 226699 - DNA, 37 bp, Artificial Sequence
  Description of Artificial Sequence: Synthetic oligonucleotide
tgtgacggagacaatcttctttcagaccatgctaaag

SEQ ID NO: 226700 - DNA, 36 bp, Artificial Sequence
  Description of Artificial Sequence: Synthetic oligonucleotide
gtgacggagacaatcttctttcagaccatgctaaag

SEQ ID NO: 226701 - DNA, 41 bp, Artificial Sequence
  Description of Artificial Sequence: Synthetic oligonucleotide
tgacggagacaatcttctttcagaccatgctaaagaaaaag

SEQ ID NO: 226702 - DNA, 40 bp, Artificial Sequence
  Description of Artificial Sequence: Synthetic oligonucleotide
gacggagacaatcttctttcagaccatgctaaagaaaaag

SEQ ID NO: 226703 - DNA, 40 bp, Artificial Sequence
  Description of Artificial Sequence: Synthetic oligonucleotide
acggagacaatcttctttcagaccatgctaaagaaaaagg

SEQ ID NO: 226704 - DNA, 39 bp, Artificial Sequence
  Description of Artificial Sequence: Synthetic oligonucleotide
cggagacaatcttctttcagaccatgctaaagaaaaagg

SEQ ID NO: 226705 - DNA, 43 bp, Artificial Sequence
  Description of Artificial Sequence: Synthetic oligonucleotide
ggagacaatcttctttcagaccatgctaaagaaaaaggaaaac

SEQ ID NO: 226706 - DNA, 44 bp, Artificial Sequence
  Description of Artificial Sequence: Synthetic oligonucleotide
gagacaatcttctttcagaccatgctaaagaaaaaggaaaactc

SEQ ID NO: 226707 - DNA, 44 bp, Artificial Sequence
  Description of Artificial Sequence: Synthetic oligonucleotide
agacaatcttctttcagaccatgctaaagaaaaaggaaaactcc

SEQ ID NO: 226708 - DNA, 34 bp, Artificial Sequence
  Description of Artificial Sequence: Synthetic oligonucleotide
ccttcatgatggaggaaaaaacacagcacctctg

SEQ ID NO: 226709 - DNA, 34 bp, Artificial Sequence
  Description of Artificial Sequence: Synthetic oligonucleotide
cttcatgatggaggaaaaaacacagcacctctgg

SEQ ID NO: 226710 - DNA, 35 bp, Artificial Sequence
  Description of Artificial Sequence: Synthetic oligonucleotide
ttcatgatggaggaaaaaacacagcacctctggtc

SEQ ID NO: 226711 - DNA, 34 bp, Artificial Sequence
  Description of Artificial Sequence: Synthetic oligonucleotide
tcatgatggaggaaaaaacacagcacctctggtc

SEQ ID NO: 226712 - DNA, 33 bp, Artificial Sequence
  Description of Artificial Sequence: Synthetic oligonucleotide
catgatggaggaaaaaacacagcacctctggtc

SEQ ID NO: 226713 - DNA, 37 bp, Artificial Sequence
  Description of Artificial Sequence: Synthetic oligonucleotide
atgatggaggaaaaaacacagcacctctggtcatttg

SEQ ID NO: 226714 - DNA, 36 bp, Artificial Sequence
  Description of Artificial Sequence: Synthetic oligonucleotide
tgatggaggaaaaaacacagcacctctggtcatttg

SEQ ID NO: 226715 - DNA, 35 bp, Artificial Sequence
  Description of Artificial Sequence: Synthetic oligonucleotide
gatggaggaaaaaacacagcacctctggtcatttg

SEQ ID NO: 226716 - DNA, 37 bp, Artificial Sequence
  Description of Artificial Sequence: Synthetic oligonucleotide
atggaggaaaaaacacagcacctctggtcatttgttc

SEQ ID NO: 226717 - DNA, 36 bp, Artificial Sequence
  Description of Artificial Sequence: Synthetic oligonucleotide
tggaggaaaaaacacagcacctctggtcatttgttc

SEQ ID NO: 226718 - DNA, 35 bp, Artificial Sequence
  Description of Artificial Sequence: Synthetic oligonucleotide
ggaggaaaaaacacagcacctctggtcatttgttc

SEQ ID NO: 226719 - DNA, 36 bp, Artificial Sequence
  Description of Artificial Sequence: Synthetic oligonucleotide
gaggaaaaaacacagcacctctggtcatttgttcag

SEQ ID NO: 226720 - DNA, 38 bp, Artificial Sequence
  Description of Artificial Sequence: Synthetic oligonucleotide
aggaaaaaacacagcacctctggtcatttgttcagaac

SEQ ID NO: 226721 - DNA, 37 bp, Artificial Sequence
  Description of Artificial Sequence: Synthetic oligonucleotide
ggaaaaaacacagcacctctggtcatttgttcagaac

SEQ ID NO: 226722 - DNA, 39 bp, Artificial Sequence
  Description of Artificial Sequence: Synthetic oligonucleotide
gaaaaaacacagcacctctggtcatttgttcagaactac

SEQ ID NO: 226723 - DNA, 40 bp, Artificial Sequence
  Description of Artificial Sequence: Synthetic oligonucleotide
aaaaaacacagcacctctggtcatttgttcagaactacac

SEQ ID NO: 226724 - DNA, 39 bp, Artificial Sequence
  Description of Artificial Sequence: Synthetic oligonucleotide
aaaaacacagcacctctggtcatttgttcagaactacac

SEQ ID NO: 226725 - DNA, 38 bp, Artificial Sequence
  Description of Artificial Sequence: Synthetic oligonucleotide
aaaacacagcacctctggtcatttgttcagaactacac

SEQ ID NO: 226726 - DNA, 37 bp, Artificial Sequence
  Description of Artificial Sequence: Synthetic oligonucleotide
aaacacagcacctctggtcatttgttcagaactacac

SEQ ID NO: 226727 - DNA, 36 bp, Artificial Sequence
  Description of Artificial Sequence: Synthetic oligonucleotide
aacacagcacctctggtcatttgttcagaactacac

SEQ ID NO: 226728 - DNA, 35 bp, Artificial Sequence
  Description of Artificial Sequence: Synthetic oligonucleotide
acacagcacctctggtcatttgttcagaactacac

SEQ ID NO: 226729 - DNA, 34 bp, Artificial Sequence
  Description of Artificial Sequence: Synthetic oligonucleotide
cacagcacctctggtcatttgttcagaactacac

SEQ ID NO: 226730 - DNA, 38 bp, Artificial Sequence
  Description of Artificial Sequence: Synthetic oligonucleotide
acagcacctctggtcatttgttcagaactacacaaatc

SEQ ID NO: 226731 - DNA, 37 bp, Artificial Sequence
  Description of Artificial Sequence: Synthetic oligonucleotide
cagcacctctggtcatttgttcagaactacacaaatc

SEQ ID NO: 226732 - DNA, 38 bp, Artificial Sequence
  Description of Artificial Sequence: Synthetic oligonucleotide
agcacctctggtcatttgttcagaactacacaaatcag

SEQ ID NO: 226733 - DNA, 37 bp, Artificial Sequence
  Description of Artificial Sequence: Synthetic oligonucleotide
gcacctctggtcatttgttcagaactacacaaatcag

SEQ ID NO: 226734 - DNA, 38 bp, Artificial Sequence
  Description of Artificial Sequence: Synthetic oligonucleotide
cacctctggtcatttgttcagaactacacaaatcagag

SEQ ID NO: 226735 - DNA, 38 bp, Artificial Sequence
  Description of Artificial Sequence: Synthetic oligonucleotide
acctctggtcatttgttcagaactacacaaatcagagg

SEQ ID NO: 226736 - DNA, 37 bp, Artificial Sequence
  Description of Artificial Sequence: Synthetic oligonucleotide
cctctggtcatttgttcagaactacacaaatcagagg

SEQ ID NO: 226737 - DNA, 40 bp, Artificial Sequence
  Description of Artificial Sequence: Synthetic oligonucleotide
ctctggtcatttgttcagaactacacaaatcagaggaatc

SEQ ID NO: 226738 - DNA, 44 bp, Artificial Sequence
  Description of Artificial Sequence: Synthetic oligonucleotide
tctggtcatttgttcagaactacacaaatcagaggaatcaattg

SEQ ID NO: 226739 - DNA, 43 bp, Artificial Sequence
  Description of Artificial Sequence: Synthetic oligonucleotide
ctggtcatttgttcagaactacacaaatcagaggaatcaattg

SEQ ID NO: 226740 - DNA, 44 bp, Artificial Sequence
  Description of Artificial Sequence: Synthetic oligonucleotide
tggtcatttgttcagaactacacaaatcagaggaatcaattgtc

SEQ ID NO: 226741 - DNA, 43 bp, Artificial Sequence
  Description of Artificial Sequence: Synthetic oligonucleotide
ggtcatttgttcagaactacacaaatcagaggaatcaattgtc

SEQ ID NO: 226742 - DNA, 25 bp, Artificial Sequence
  Description of Artificial Sequence: Synthetic oligonucleotide
tggccctactagggggcacagccaa

SEQ ID NO: 226743 - DNA, 24 bp, Artificial Sequence
  Description of Artificial Sequence: Synthetic oligonucleotide
ggccctactagggggcacagccaa

SEQ ID NO: 226744 - DNA, 24 bp, Artificial Sequence
  Description of Artificial Sequence: Synthetic oligonucleotide
gccctactagggggcacagccaag

SEQ ID NO: 226745 - DNA, 25 bp, Artificial Sequence
  Description of Artificial Sequence: Synthetic oligonucleotide
ccctactagggggcacagccaagct

SEQ ID NO: 226746 - DNA, 25 bp, Artificial Sequence
  Description of Artificial Sequence: Synthetic oligonucleotide
cctactagggggcacagccaagctg

SEQ ID NO: 226747 - DNA, 26 bp, Artificial Sequence
  Description of Artificial Sequence: Synthetic oligonucleotide
ctactagggggcacagccaagctgct

SEQ ID NO: 226748 - DNA, 27 bp, Artificial Sequence
  Description of Artificial Sequence: Synthetic oligonucleotide
tactagggggcacagccaagctgctct

SEQ ID NO: 226749 - DNA, 26 bp, Artificial Sequence
  Description of Artificial Sequence: Synthetic oligonucleotide
actagggggcacagccaagctgctct

SEQ ID NO: 226750 - DNA, 25 bp, Artificial Sequence
  Description of Artificial Sequence: Synthetic oligonucleotide
ctagggggcacagccaagctgctct

SEQ ID NO: 226751 - DNA, 25 bp, Artificial Sequence
  Description of Artificial Sequence: Synthetic oligonucleotide
tagggggcacagccaagctgctctg

SEQ ID NO: 226752 - DNA, 24 bp, Artificial Sequence
  Description of Artificial Sequence: Synthetic oligonucleotide
agggggcacagccaagctgctctg

SEQ ID NO: 226753 - DNA, 23 bp, Artificial Sequence
  Description of Artificial Sequence: Synthetic oligonucleotide
gggggcacagccaagctgctctg

SEQ ID NO: 226754 - DNA, 23 bp, Artificial Sequence
  Description of Artificial Sequence: Synthetic oligonucleotide
ggggcacagccaagctgctctgc

SEQ ID NO: 226755 - DNA, 23 bp, Artificial Sequence
  Description of Artificial Sequence: Synthetic oligonucleotide
gggcacagccaagctgctctgcc

SEQ ID NO: 226756 - DNA, 24 bp, Artificial Sequence
  Description of Artificial Sequence: Synthetic oligonucleotide
ggcacagccaagctgctctgccct

SEQ ID NO: 226757 - DNA, 25 bp, Artificial Sequence
  Description of Artificial Sequence: Synthetic oligonucleotide
gcacagccaagctgctctgccctct

SEQ ID NO: 226758 - DNA, 26 bp, Artificial Sequence
  Description of Artificial Sequence: Synthetic oligonucleotide
cacagccaagctgctctgccctctct

SEQ ID NO: 226759 - DNA, 26 bp, Artificial Sequence
  Description of Artificial Sequence: Synthetic oligonucleotide
acagccaagctgctctgccctctctc

SEQ ID NO: 226760 - DNA, 25 bp, Artificial Sequence
  Description of Artificial Sequence: Synthetic oligonucleotide
cagccaagctgctctgccctctctc

SEQ ID NO: 226761 - DNA, 25 bp, Artificial Sequence
  Description of Artificial Sequence: Synthetic oligonucleotide
agccaagctgctctgccctctctcc

SEQ ID NO: 226762 - DNA, 24 bp, Artificial Sequence
  Description of Artificial Sequence: Synthetic oligonucleotide
gccaagctgctctgccctctctcc

SEQ ID NO: 226763 - DNA, 25 bp, Artificial Sequence
  Description of Artificial Sequence: Synthetic oligonucleotide
ccaagctgctctgccctctctccct

SEQ ID NO: 226764 - DNA, 26 bp, Artificial Sequence
  Description of Artificial Sequence: Synthetic oligonucleotide
caagctgctctgccctctctccctct

SEQ ID NO: 226765 - DNA, 26 bp, Artificial Sequence
  Description of Artificial Sequence: Synthetic oligonucleotide
aagctgctctgccctctctccctctg

SEQ ID NO: 226766 - DNA, 26 bp, Artificial Sequence
  Description of Artificial Sequence: Synthetic oligonucleotide
tttactacccccgaaggccccagagc

SEQ ID NO: 226767 - DNA, 25 bp, Artificial Sequence
  Description of Artificial Sequence: Synthetic oligonucleotide
ttactacccccgaaggccccagagc

SEQ ID NO: 226768 - DNA, 24 bp, Artificial Sequence
  Description of Artificial Sequence: Synthetic oligonucleotide
tactacccccgaaggccccagagc

SEQ ID NO: 226769 - DNA, 23 bp, Artificial Sequence
  Description of Artificial Sequence: Synthetic oligonucleotide
actacccccgaaggccccagagc

SEQ ID NO: 226770 - DNA, 22 bp, Artificial Sequence
  Description of Artificial Sequence: Synthetic oligonucleotide
ctacccccgaaggccccagagc

SEQ ID NO: 226771 - DNA, 25 bp, Artificial Sequence
  Description of Artificial Sequence: Synthetic oligonucleotide
tacccccgaaggccccagagcctaa

SEQ ID NO: 226772 - DNA, 24 bp, Artificial Sequence
  Description of Artificial Sequence: Synthetic oligonucleotide
acccccgaaggccccagagcctaa

SEQ ID NO: 226773 - DNA, 23 bp, Artificial Sequence
  Description of Artificial Sequence: Synthetic oligonucleotide
cccccgaaggccccagagcctaa

SEQ ID NO: 226774 - DNA, 23 bp, Artificial Sequence
  Description of Artificial Sequence: Synthetic oligonucleotide
ccccgaaggccccagagcctaag

SEQ ID NO: 226775 - DNA, 27 bp, Artificial Sequence
  Description of Artificial Sequence: Synthetic oligonucleotide
cccgaaggccccagagcctaaggatat

SEQ ID NO: 226776 - DNA, 30 bp, Artificial Sequence
  Description of Artificial Sequence: Synthetic oligonucleotide
ccgaaggccccagagcctaaggatataatc

SEQ ID NO: 226777 - DNA, 30 bp, Artificial Sequence
  Description of Artificial Sequence: Synthetic oligonucleotide
cgaaggccccagagcctaaggatataatcc

SEQ ID NO: 226778 - DNA, 31 bp, Artificial Sequence
  Description of Artificial Sequence: Synthetic oligonucleotide
gaaggccccagagcctaaggatataatcctg

SEQ ID NO: 226779 - DNA, 32 bp, Artificial Sequence
  Description of Artificial Sequence: Synthetic oligonucleotide
aaggccccagagcctaaggatataatcctgtc

SEQ ID NO: 226780 - DNA, 31 bp, Artificial Sequence
  Description of Artificial Sequence: Synthetic oligonucleotide
aggccccagagcctaaggatataatcctgtc

SEQ ID NO: 226781 - DNA, 30 bp, Artificial Sequence
  Description of Artificial Sequence: Synthetic oligonucleotide
ggccccagagcctaaggatataatcctgtc

SEQ ID NO: 226782 - DNA, 30 bp, Artificial Sequence
  Description of Artificial Sequence: Synthetic oligonucleotide
gccccagagcctaaggatataatcctgtcc

SEQ ID NO: 226783 - DNA, 32 bp, Artificial Sequence
  Description of Artificial Sequence: Synthetic oligonucleotide
ccccagagcctaaggatataatcctgtccttg

SEQ ID NO: 226784 - DNA, 32 bp, Artificial Sequence
  Description of Artificial Sequence: Synthetic oligonucleotide
cccagagcctaaggatataatcctgtccttgc

SEQ ID NO: 226785 - DNA, 32 bp, Artificial Sequence
  Description of Artificial Sequence: Synthetic oligonucleotide
ccagagcctaaggatataatcctgtccttgcc

SEQ ID NO: 226786 - DNA, 32 bp, Artificial Sequence
  Description of Artificial Sequence: Synthetic oligonucleotide
cagagcctaaggatataatcctgtccttgccc

SEQ ID NO: 226787 - DNA, 32 bp, Artificial Sequence
  Description of Artificial Sequence: Synthetic oligonucleotide
agagcctaaggatataatcctgtccttgcccc

SEQ ID NO: 226788 - DNA, 31 bp, Artificial Sequence
  Description of Artificial Sequence: Synthetic oligonucleotide
gagcctaaggatataatcctgtccttgcccc

SEQ ID NO: 226789 - DNA, 31 bp, Artificial Sequence
  Description of Artificial Sequence: Synthetic oligonucleotide
agcctaaggatataatcctgtccttgccccc

SEQ ID NO: 226790 - DNA, 30 bp, Artificial Sequence
  Description of Artificial Sequence: Synthetic oligonucleotide
gcctaaggatataatcctgtccttgccccc

SEQ ID NO: 226791 - DNA, 31 bp, Artificial Sequence
  Description of Artificial Sequence: Synthetic oligonucleotide
cctaaggatataatcctgtccttgccccctg

SEQ ID NO: 226792 - DNA, 32 bp, Artificial Sequence
  Description of Artificial Sequence: Synthetic oligonucleotide
ctaaggatataatcctgtccttgccccctgac

SEQ ID NO: 226793 - DNA, 32 bp, Artificial Sequence
  Description of Artificial Sequence: Synthetic oligonucleotide
taaggatataatcctgtccttgccccctgacc

SEQ ID NO: 226794 - DNA, 35 bp, Artificial Sequence
  Description of Artificial Sequence: Synthetic oligonucleotide
atggcccacttcatcctctttgtctttacggtttc

SEQ ID NO: 226795 - DNA, 34 bp, Artificial Sequence
  Description of Artificial Sequence: Synthetic oligonucleotide
tggcccacttcatcctctttgtctttacggtttc

SEQ ID NO: 226796 - DNA, 33 bp, Artificial Sequence
  Description of Artificial Sequence: Synthetic oligonucleotide
ggcccacttcatcctctttgtctttacggtttc

SEQ ID NO: 226797 - DNA, 33 bp, Artificial Sequence
  Description of Artificial Sequence: Synthetic oligonucleotide
gcccacttcatcctctttgtctttacggtttcc

SEQ ID NO: 226798 - DNA, 34 bp, Artificial Sequence
  Description of Artificial Sequence: Synthetic oligonucleotide
cccacttcatcctctttgtctttacggtttccac

SEQ ID NO: 226799 - DNA, 41 bp, Artificial Sequence
  Description of Artificial Sequence: Synthetic oligonucleotide
ccacttcatcctctttgtctttacggtttccactatatttc

SEQ ID NO: 226800 - DNA, 42 bp, Artificial Sequence
  Description of Artificial Sequence: Synthetic oligonucleotide
cacttcatcctctttgtctttacggtttccactatatttcac

SEQ ID NO: 226801 - DNA, 42 bp, Artificial Sequence
  Description of Artificial Sequence: Synthetic oligonucleotide
acttcatcctctttgtctttacggtttccactatatttcacg

SEQ ID NO: 226802 - DNA, 41 bp, Artificial Sequence
  Description of Artificial Sequence: Synthetic oligonucleotide
cttcatcctctttgtctttacggtttccactatatttcacg

SEQ ID NO: 226803 - DNA, 43 bp, Artificial Sequence
  Description of Artificial Sequence: Synthetic oligonucleotide
ttcatcctctttgtctttacggtttccactatatttcacgttc

SEQ ID NO: 226804 - DNA, 42 bp, Artificial Sequence
  Description of Artificial Sequence: Synthetic oligonucleotide
tcatcctctttgtctttacggtttccactatatttcacgttc

SEQ ID NO: 226805 - DNA, 41 bp, Artificial Sequence
  Description of Artificial Sequence: Synthetic oligonucleotide
catcctctttgtctttacggtttccactatatttcacgttc

SEQ ID NO: 226806 - DNA, 42 bp, Artificial Sequence
  Description of Artificial Sequence: Synthetic oligonucleotide
atcctctttgtctttacggtttccactatatttcacgttcag

SEQ ID NO: 226807 - DNA, 41 bp, Artificial Sequence
  Description of Artificial Sequence: Synthetic oligonucleotide
tcctctttgtctttacggtttccactatatttcacgttcag

SEQ ID NO: 226808 - DNA, 40 bp, Artificial Sequence
  Description of Artificial Sequence: Synthetic oligonucleotide
cctctttgtctttacggtttccactatatttcacgttcag

SEQ ID NO: 226809 - DNA, 40 bp, Artificial Sequence
  Description of Artificial Sequence: Synthetic oligonucleotide
ctctttgtctttacggtttccactatatttcacgttcagc

SEQ ID NO: 226810 - DNA, 41 bp, Artificial Sequence
  Description of Artificial Sequence: Synthetic oligonucleotide
tctttgtctttacggtttccactatatttcacgttcagcag

SEQ ID NO: 226811 - DNA, 40 bp, Artificial Sequence
  Description of Artificial Sequence: Synthetic oligonucleotide
ctttgtctttacggtttccactatatttcacgttcagcag

SEQ ID NO: 226812 - DNA, 40 bp, Artificial Sequence
  Description of Artificial Sequence: Synthetic oligonucleotide
tttgtctttacggtttccactatatttcacgttcagcagc

SEQ ID NO: 226813 - DNA, 39 bp, Artificial Sequence
  Description of Artificial Sequence: Synthetic oligonucleotide
ttgtctttacggtttccactatatttcacgttcagcagc

SEQ ID NO: 226814 - DNA, 38 bp, Artificial Sequence
  Description of Artificial Sequence: Synthetic oligonucleotide
tgtctttacggtttccactatatttcacgttcagcagc

SEQ ID NO: 226815 - DNA, 37 bp, Artificial Sequence
  Description of Artificial Sequence: Synthetic oligonucleotide
gtctttacggtttccactatatttcacgttcagcagc

SEQ ID NO: 226816 - DNA, 37 bp, Artificial Sequence
  Description of Artificial Sequence: Synthetic oligonucleotide
tctttacggtttccactatatttcacgttcagcagcg

SEQ ID NO: 226817 - DNA, 36 bp, Artificial Sequence
  Description of Artificial Sequence: Synthetic oligonucleotide
ctttacggtttccactatatttcacgttcagcagcg

SEQ ID NO: 226818 - DNA, 36 bp, Artificial Sequence
  Description of Artificial Sequence: Synthetic oligonucleotide
tttacggtttccactatatttcacgttcagcagcgg

SEQ ID NO: 226819 - DNA, 35 bp, Artificial Sequence
  Description of Artificial Sequence: Synthetic oligonucleotide
ttacggtttccactatatttcacgttcagcagcgg

SEQ ID NO: 226820 - DNA, 34 bp, Artificial Sequence
  Description of Artificial Sequence: Synthetic oligonucleotide
tacggtttccactatatttcacgttcagcagcgg

SEQ ID NO: 226821 - DNA, 33 bp, Artificial Sequence
  Description of Artificial Sequence: Synthetic oligonucleotide
acggtttccactatatttcacgttcagcagcgg

SEQ ID NO: 226822 - DNA, 32 bp, Artificial Sequence
  Description of Artificial Sequence: Synthetic oligonucleotide
cggtttccactatatttcacgttcagcagcgg

SEQ ID NO: 226823 - DNA, 32 bp, Artificial Sequence
  Description of Artificial Sequence: Synthetic oligonucleotide
ggtttccactatatttcacgttcagcagcggc

SEQ ID NO: 226824 - DNA, 34 bp, Artificial Sequence
  Description of Artificial Sequence: Synthetic oligonucleotide
gtttccactatatttcacgttcagcagcggctag

SEQ ID NO: 226825 - DNA, 34 bp, Artificial Sequence
  Description of Artificial Sequence: Synthetic oligonucleotide
tttccactatatttcacgttcagcagcggctagc

SEQ ID NO: 226826 - DNA, 33 bp, Artificial Sequence
  Description of Artificial Sequence: Synthetic oligonucleotide
ttccactatatttcacgttcagcagcggctagc

SEQ ID NO: 226827 - DNA, 32 bp, Artificial Sequence
  Description of Artificial Sequence: Synthetic oligonucleotide
tccactatatttcacgttcagcagcggctagc

SEQ ID NO: 226828 - DNA, 31 bp, Artificial Sequence
  Description of Artificial Sequence: Synthetic oligonucleotide
ccactatatttcacgttcagcagcggctagc

SEQ ID NO: 226829 - DNA, 31 bp, Artificial Sequence
  Description of Artificial Sequence: Synthetic oligonucleotide
cactatatttcacgttcagcagcggctagcg

SEQ ID NO: 226830 - DNA, 33 bp, Artificial Sequence
  Description of Artificial Sequence: Synthetic oligonucleotide
actatatttcacgttcagcagcggctagcgaag

SEQ ID NO: 226831 - DNA, 32 bp, Artificial Sequence
  Description of Artificial Sequence: Synthetic oligonucleotide
ctatatttcacgttcagcagcggctagcgaag

SEQ ID NO: 226832 - DNA, 35 bp, Artificial Sequence
  Description of Artificial Sequence: Synthetic oligonucleotide
tatatttcacgttcagcagcggctagcgaagattc

SEQ ID NO: 226833 - DNA, 34 bp, Artificial Sequence
  Description of Artificial Sequence: Synthetic oligonucleotide
atatttcacgttcagcagcggctagcgaagattc

SEQ ID NO: 226834 - DNA, 33 bp, Artificial Sequence
  Description of Artificial Sequence: Synthetic oligonucleotide
tatttcacgttcagcagcggctagcgaagattc

SEQ ID NO: 226835 - DNA, 32 bp, Artificial Sequence
  Description of Artificial Sequence: Synthetic oligonucleotide
atttcacgttcagcagcggctagcgaagattc

SEQ ID NO: 226836 - DNA, 31 bp, Artificial Sequence
  Description of Artificial Sequence: Synthetic oligonucleotide
tttcacgttcagcagcggctagcgaagattc

SEQ ID NO: 226837 - DNA, 30 bp, Artificial Sequence
  Description of Artificial Sequence: Synthetic oligonucleotide
ttcacgttcagcagcggctagcgaagattc

SEQ ID NO: 226838 - DNA, 29 bp, Artificial Sequence
  Description of Artificial Sequence: Synthetic oligonucleotide
tcacgttcagcagcggctagcgaagattc

SEQ ID NO: 226839 - DNA, 28 bp, Artificial Sequence
  Description of Artificial Sequence: Synthetic oligonucleotide
cacgttcagcagcggctagcgaagattc

SEQ ID NO: 226840 - DNA, 30 bp, Artificial Sequence
  Description of Artificial Sequence: Synthetic oligonucleotide
acgttcagcagcggctagcgaagattcaag

SEQ ID NO: 226841 - DNA, 29 bp, Artificial Sequence
  Description of Artificial Sequence: Synthetic oligonucleotide
cgttcagcagcggctagcgaagattcaag

SEQ ID NO: 226842 - DNA, 29 bp, Artificial Sequence
  Description of Artificial Sequence: Synthetic oligonucleotide
gttcagcagcggctagcgaagattcaagc

SEQ ID NO: 226843 - DNA, 29 bp, Artificial Sequence
  Description of Artificial Sequence: Synthetic oligonucleotide
ttcagcagcggctagcgaagattcaagcc

SEQ ID NO: 226844 - DNA, 28 bp, Artificial Sequence
  Description of Artificial Sequence: Synthetic oligonucleotide
tcagcagcggctagcgaagattcaagcc

SEQ ID NO: 226845 - DNA, 27 bp, Artificial Sequence
  Description of Artificial Sequence: Synthetic oligonucleotide
cagcagcggctagcgaagattcaagcc

SEQ ID NO: 226846 - DNA, 29 bp, Artificial Sequence
  Description of Artificial Sequence: Synthetic oligonucleotide
agcagcggctagcgaagattcaagccatg

SEQ ID NO: 226847 - DNA, 28 bp, Artificial Sequence
  Description of Artificial Sequence: Synthetic oligonucleotide
gcagcggctagcgaagattcaagccatg

SEQ ID NO: 226848 - DNA, 29 bp, Artificial Sequence
  Description of Artificial Sequence: Synthetic oligonucleotide
cagcggctagcgaagattcaagccatgtg

SEQ ID NO: 226849 - DNA, 29 bp, Artificial Sequence
  Description of Artificial Sequence: Synthetic oligonucleotide
agcggctagcgaagattcaagccatgtgg

SEQ ID NO: 226850 - DNA, 28 bp, Artificial Sequence
  Description of Artificial Sequence: Synthetic oligonucleotide
gcggctagcgaagattcaagccatgtgg

SEQ ID NO: 226851 - DNA, 28 bp, Artificial Sequence
  Description of Artificial Sequence: Synthetic oligonucleotide
cggctagcgaagattcaagccatgtggg

SEQ ID NO: 226852 - DNA, 29 bp, Artificial Sequence
  Description of Artificial Sequence: Synthetic oligonucleotide
ggctagcgaagattcaagccatgtgggag

SEQ ID NO: 226853 - DNA, 32 bp, Artificial Sequence
  Description of Artificial Sequence: Synthetic oligonucleotide
gctagcgaagattcaagccatgtgggagttac

SEQ ID NO: 226854 - DNA, 32 bp, Artificial Sequence
  Description of Artificial Sequence: Synthetic oligonucleotide
ctagcgaagattcaagccatgtgggagttacc

SEQ ID NO: 226855 - DNA, 32 bp, Artificial Sequence
  Description of Artificial Sequence: Synthetic oligonucleotide
tagcgaagattcaagccatgtgggagttaccg

SEQ ID NO: 226856 - DNA, 31 bp, Artificial Sequence
  Description of Artificial Sequence: Synthetic oligonucleotide
agcgaagattcaagccatgtgggagttaccg

SEQ ID NO: 226857 - DNA, 30 bp, Artificial Sequence
  Description of Artificial Sequence: Synthetic oligonucleotide
gcgaagattcaagccatgtgggagttaccg

SEQ ID NO: 226858 - DNA, 30 bp, Artificial Sequence
  Description of Artificial Sequence: Synthetic oligonucleotide
cgaagattcaagccatgtgggagttaccgg

SEQ ID NO: 226859 - DNA, 31 bp, Artificial Sequence
  Description of Artificial Sequence: Synthetic oligonucleotide
gaagattcaagccatgtgggagttaccggtg

SEQ ID NO: 226860 - DNA, 31 bp, Artificial Sequence
  Description of Artificial Sequence: Synthetic oligonucleotide
aagattcaagccatgtgggagttaccggtgc

SEQ ID NO: 226861 - DNA, 30 bp, Artificial Sequence
  Description of Artificial Sequence: Synthetic oligonucleotide
agattcaagccatgtgggagttaccggtgc

SEQ ID NO: 226862 - DNA, 29 bp, Artificial Sequence
  Description of Artificial Sequence: Synthetic oligonucleotide
gattcaagccatgtgggagttaccggtgc

SEQ ID NO: 226863 - DNA, 30 bp, Artificial Sequence
  Description of Artificial Sequence: Synthetic oligonucleotide
attcaagccatgtgggagttaccggtgcag

SEQ ID NO: 226864 - DNA, 29 bp, Artificial Sequence
  Description of Artificial Sequence: Synthetic oligonucleotide
ttcaagccatgtgggagttaccggtgcag

SEQ ID NO: 226865 - DNA, 28 bp, Artificial Sequence
  Description of Artificial Sequence: Synthetic oligonucleotide
tcaagccatgtgggagttaccggtgcag

SEQ ID NO: 226866 - DNA, 27 bp, Artificial Sequence
  Description of Artificial Sequence: Synthetic oligonucleotide
caagccatgtgggagttaccggtgcag

SEQ ID NO: 226867 - DNA, 30 bp, Artificial Sequence
  Description of Artificial Sequence: Synthetic oligonucleotide
aagccatgtgggagttaccggtgcagatac

SEQ ID NO: 226868 - DNA, 29 bp, Artificial Sequence
  Description of Artificial Sequence: Synthetic oligonucleotide
agccatgtgggagttaccggtgcagatac

SEQ ID NO: 226869 - DNA, 28 bp, Artificial Sequence
  Description of Artificial Sequence: Synthetic oligonucleotide
gccatgtgggagttaccggtgcagatac

SEQ ID NO: 226870 - DNA, 28 bp, Artificial Sequence
  Description of Artificial Sequence: Synthetic oligonucleotide
ccatgtgggagttaccggtgcagatacc

SEQ ID NO: 226871 - DNA, 29 bp, Artificial Sequence
  Description of Artificial Sequence: Synthetic oligonucleotide
catgtgggagttaccggtgcagataccag

SEQ ID NO: 226872 - DNA, 30 bp, Artificial Sequence
  Description of Artificial Sequence: Synthetic oligonucleotide
atgtgggagttaccggtgcagataccagtg

SEQ ID NO: 226873 - DNA, 29 bp, Artificial Sequence
  Description of Artificial Sequence: Synthetic oligonucleotide
tgtgggagttaccggtgcagataccagtg

SEQ ID NO: 226874 - DNA, 28 bp, Artificial Sequence
  Description of Artificial Sequence: Synthetic oligonucleotide
gtgggagttaccggtgcagataccagtg

SEQ ID NO: 226875 - DNA, 28 bp, Artificial Sequence
  Description of Artificial Sequence: Synthetic oligonucleotide
tgggagttaccggtgcagataccagtgc

SEQ ID NO: 226876 - DNA, 27 bp, Artificial Sequence
  Description of Artificial Sequence: Synthetic oligonucleotide
gggagttaccggtgcagataccagtgc

SEQ ID NO: 226877 - DNA, 29 bp, Artificial Sequence
  Description of Artificial Sequence: Synthetic oligonucleotide
ggagttaccggtgcagataccagtgctag

SEQ ID NO: 226878 - DNA, 29 bp, Artificial Sequence
  Description of Artificial Sequence: Synthetic oligonucleotide
gagttaccggtgcagataccagtgctagc

SEQ ID NO: 226879 - DNA, 29 bp, Artificial Sequence
  Description of Artificial Sequence: Synthetic oligonucleotide
agttaccggtgcagataccagtgctagcc

SEQ ID NO: 226880 - DNA, 28 bp, Artificial Sequence
  Description of Artificial Sequence: Synthetic oligonucleotide
gttaccggtgcagataccagtgctagcc

SEQ ID NO: 226881 - DNA, 29 bp, Artificial Sequence
  Description of Artificial Sequence: Synthetic oligonucleotide
ttaccggtgcagataccagtgctagcctc

SEQ ID NO: 226882 - DNA, 28 bp, Artificial Sequence
  Description of Artificial Sequence: Synthetic oligonucleotide
taccggtgcagataccagtgctagcctc

SEQ ID NO: 226883 - DNA, 27 bp, Artificial Sequence
  Description of Artificial Sequence: Synthetic oligonucleotide
accggtgcagataccagtgctagcctc

SEQ ID NO: 226884 - DNA, 27 bp, Artificial Sequence
  Description of Artificial Sequence: Synthetic oligonucleotide
ccggtgcagataccagtgctagcctca

SEQ ID NO: 226885 - DNA, 28 bp, Artificial Sequence
  Description of Artificial Sequence: Synthetic oligonucleotide
cggtgcagataccagtgctagcctcaac

SEQ ID NO: 226886 - DNA, 30 bp, Artificial Sequence
  Description of Artificial Sequence: Synthetic oligonucleotide
ggtgcagataccagtgctagcctcaacatc

SEQ ID NO: 226887 - DNA, 33 bp, Artificial Sequence
  Description of Artificial Sequence: Synthetic oligonucleotide
gtgcagataccagtgctagcctcaacatcaaag

SEQ ID NO: 226888 - DNA, 33 bp, Artificial Sequence
  Description of Artificial Sequence: Synthetic oligonucleotide
tgcagataccagtgctagcctcaacatcaaagg

SEQ ID NO: 226889 - DNA, 32 bp, Artificial Sequence
  Description of Artificial Sequence: Synthetic oligonucleotide
gcagataccagtgctagcctcaacatcaaagg

SEQ ID NO: 226890 - DNA, 32 bp, Artificial Sequence
  Description of Artificial Sequence: Synthetic oligonucleotide
cagataccagtgctagcctcaacatcaaaggc

SEQ ID NO: 226891 - DNA, 33 bp, Artificial Sequence
  Description of Artificial Sequence: Synthetic oligonucleotide
agataccagtgctagcctcaacatcaaaggcac

SEQ ID NO: 226892 - DNA, 32 bp, Artificial Sequence
  Description of Artificial Sequence: Synthetic oligonucleotide
gataccagtgctagcctcaacatcaaaggcac

SEQ ID NO: 226893 - DNA, 33 bp, Artificial Sequence
  Description of Artificial Sequence: Synthetic oligonucleotide
ataccagtgctagcctcaacatcaaaggcactg

SEQ ID NO: 226894 - DNA, 32 bp, Artificial Sequence
  Description of Artificial Sequence: Synthetic oligonucleotide
taccagtgctagcctcaacatcaaaggcactg

SEQ ID NO: 226895 - DNA, 31 bp, Artificial Sequence
  Description of Artificial Sequence: Synthetic oligonucleotide
accagtgctagcctcaacatcaaaggcactg

SEQ ID NO: 226896 - DNA, 30 bp, Artificial Sequence
  Description of Artificial Sequence: Synthetic oligonucleotide
ccagtgctagcctcaacatcaaaggcactg

SEQ ID NO: 226897 - DNA, 30 bp, Artificial Sequence
  Description of Artificial Sequence: Synthetic oligonucleotide
cagtgctagcctcaacatcaaaggcactgg

SEQ ID NO: 226898 - DNA, 30 bp, Artificial Sequence
  Description of Artificial Sequence: Synthetic oligonucleotide
agtgctagcctcaacatcaaaggcactggg

SEQ ID NO: 226899 - DNA, 29 bp, Artificial Sequence
  Description of Artificial Sequence: Synthetic oligonucleotide
gtgctagcctcaacatcaaaggcactggg

SEQ ID NO: 226900 - DNA, 30 bp, Artificial Sequence
  Description of Artificial Sequence: Synthetic oligonucleotide
tgctagcctcaacatcaaaggcactgggac

SEQ ID NO: 226901 - DNA, 29 bp, Artificial Sequence
  Description of Artificial Sequence: Synthetic oligonucleotide
gctagcctcaacatcaaaggcactgggac

SEQ ID NO: 226902 - DNA, 29 bp, Artificial Sequence
  Description of Artificial Sequence: Synthetic oligonucleotide
ctagcctcaacatcaaaggcactgggacc

SEQ ID NO: 226903 - DNA, 29 bp, Artificial Sequence
  Description of Artificial Sequence: Synthetic oligonucleotide
tagcctcaacatcaaaggcactgggaccc

SEQ ID NO: 226904 - DNA, 28 bp, Artificial Sequence
  Description of Artificial Sequence: Synthetic oligonucleotide
agcctcaacatcaaaggcactgggaccc

SEQ ID NO: 226905 - DNA, 27 bp, Artificial Sequence
  Description of Artificial Sequence: Synthetic oligonucleotide
gcctcaacatcaaaggcactgggaccc

SEQ ID NO: 226906 - DNA, 28 bp, Artificial Sequence
  Description of Artificial Sequence: Synthetic oligonucleotide
cctcaacatcaaaggcactgggacccag

SEQ ID NO: 226907 - DNA, 28 bp, Artificial Sequence
  Description of Artificial Sequence: Synthetic oligonucleotide
ctcaacatcaaaggcactgggacccagc

SEQ ID NO: 226908 - DNA, 28 bp, Artificial Sequence
  Description of Artificial Sequence: Synthetic oligonucleotide
tcaacatcaaaggcactgggacccagcc

SEQ ID NO: 226909 - DNA, 27 bp, Artificial Sequence
  Description of Artificial Sequence: Synthetic oligonucleotide
caacatcaaaggcactgggacccagcc

SEQ ID NO: 226910 - DNA, 28 bp, Artificial Sequence
  Description of Artificial Sequence: Synthetic oligonucleotide
aacatcaaaggcactgggacccagccag

SEQ ID NO: 226911 - DNA, 27 bp, Artificial Sequence
  Description of Artificial Sequence: Synthetic oligonucleotide
acatcaaaggcactgggacccagccag

SEQ ID NO: 226912 - DNA, 26 bp, Artificial Sequence
  Description of Artificial Sequence: Synthetic oligonucleotide
catcaaaggcactgggacccagccag

SEQ ID NO: 226913 - DNA, 27 bp, Artificial Sequence
  Description of Artificial Sequence: Synthetic oligonucleotide
atcaaaggcactgggacccagccagct

SEQ ID NO: 226914 - DNA, 26 bp, Artificial Sequence
  Description of Artificial Sequence: Synthetic oligonucleotide
tcaaaggcactgggacccagccagct

SEQ ID NO: 226915 - DNA, 25 bp, Artificial Sequence
  Description of Artificial Sequence: Synthetic oligonucleotide
caaaggcactgggacccagccagct

SEQ ID NO: 226916 - DNA, 26 bp, Artificial Sequence
  Description of Artificial Sequence: Synthetic oligonucleotide
aaaggcactgggacccagccagctca

SEQ ID NO: 226917 - DNA, 25 bp, Artificial Sequence
  Description of Artificial Sequence: Synthetic oligonucleotide
aaggcactgggacccagccagctca

SEQ ID NO: 226918 - DNA, 24 bp, Artificial Sequence
  Description of Artificial Sequence: Synthetic oligonucleotide
aggcactgggacccagccagctca

SEQ ID NO: 226919 - DNA, 23 bp, Artificial Sequence
  Description of Artificial Sequence: Synthetic oligonucleotide
ggcactgggacccagccagctca

SEQ ID NO: 226920 - DNA, 23 bp, Artificial Sequence
  Description of Artificial Sequence: Synthetic oligonucleotide
gcactgggacccagccagctcag

SEQ ID NO: 226921 - DNA, 23 bp, Artificial Sequence
  Description of Artificial Sequence: Synthetic oligonucleotide
cactgggacccagccagctcagg

SEQ ID NO: 226922 - DNA, 23 bp, Artificial Sequence
  Description of Artificial Sequence: Synthetic oligonucleotide
actgggacccagccagctcaggg

SEQ ID NO: 226923 - DNA, 22 bp, Artificial Sequence
  Description of Artificial Sequence: Synthetic oligonucleotide
ctgggacccagccagctcaggg

SEQ ID NO: 226924 - DNA, 22 bp, Artificial Sequence
  Description of Artificial Sequence: Synthetic oligonucleotide
tgggacccagccagctcagggg

SEQ ID NO: 226925 - DNA, 21 bp, Artificial Sequence
  Description of Artificial Sequence: Synthetic oligonucleotide
gggacccagccagctcagggg

SEQ ID NO: 226926 - DNA, 23 bp, Artificial Sequence
  Description of Artificial Sequence: Synthetic oligonucleotide
ggacccagccagctcagggggat

SEQ ID NO: 226927 - DNA, 24 bp, Artificial Sequence
  Description of Artificial Sequence: Synthetic oligonucleotide
gacccagccagctcagggggatgt

SEQ ID NO: 226928 - DNA, 24 bp, Artificial Sequence
  Description of Artificial Sequence: Synthetic oligonucleotide
acccagccagctcagggggatgtg

SEQ ID NO: 226929 - DNA, 23 bp, Artificial Sequence
  Description of Artificial Sequence: Synthetic oligonucleotide
cccagccagctcagggggatgtg

SEQ ID NO: 226930 - DNA, 24 bp, Artificial Sequence
  Description of Artificial Sequence: Synthetic oligonucleotide
ccagccagctcagggggatgtgga

SEQ ID NO: 226931 - DNA, 24 bp, Artificial Sequence
  Description of Artificial Sequence: Synthetic oligonucleotide
cagccagctcagggggatgtggac

SEQ ID NO: 226932 - DNA, 26 bp, Artificial Sequence
  Description of Artificial Sequence: Synthetic oligonucleotide
agccagctcagggggatgtggacgat

SEQ ID NO: 226933 - DNA, 25 bp, Artificial Sequence
  Description of Artificial Sequence: Synthetic oligonucleotide
gccagctcagggggatgtggacgat

SEQ ID NO: 226934 - DNA, 27 bp, Artificial Sequence
  Description of Artificial Sequence: Synthetic oligonucleotide
ccagctcagggggatgtggacgatcaa

SEQ ID NO: 226935 - DNA, 28 bp, Artificial Sequence
  Description of Artificial Sequence: Synthetic oligonucleotide
cagctcagggggatgtggacgatcaatg

SEQ ID NO: 226936 - DNA, 28 bp, Artificial Sequence
  Description of Artificial Sequence: Synthetic oligonucleotide
agctcagggggatgtggacgatcaatgc

SEQ ID NO: 226937 - DNA, 27 bp, Artificial Sequence
  Description of Artificial Sequence: Synthetic oligonucleotide
gctcagggggatgtggacgatcaatgc

SEQ ID NO: 226938 - DNA, 31 bp, Artificial Sequence
  Description of Artificial Sequence: Synthetic oligonucleotide
ctcagggggatgtggacgatcaatgcaatag

SEQ ID NO: 226939 - DNA, 31 bp, Artificial Sequence
  Description of Artificial Sequence: Synthetic oligonucleotide
tcagggggatgtggacgatcaatgcaatagg

SEQ ID NO: 226940 - DNA, 30 bp, Artificial Sequence
  Description of Artificial Sequence: Synthetic oligonucleotide
cagggggatgtggacgatcaatgcaatagg

SEQ ID NO: 226941 - DNA, 30 bp, Artificial Sequence
  Description of Artificial Sequence: Synthetic oligonucleotide
agggggatgtggacgatcaatgcaataggc

SEQ ID NO: 226942 - DNA, 29 bp, Artificial Sequence
  Description of Artificial Sequence: Synthetic oligonucleotide
gggggatgtggacgatcaatgcaataggc

SEQ ID NO: 226943 - DNA, 29 bp, Artificial Sequence
  Description of Artificial Sequence: Synthetic oligonucleotide
ggggatgtggacgatcaatgcaataggcc

SEQ ID NO: 226944 - DNA, 29 bp, Artificial Sequence
  Description of Artificial Sequence: Synthetic oligonucleotide
gggatgtggacgatcaatgcaataggccg

SEQ ID NO: 226945 - DNA, 29 bp, Artificial Sequence
  Description of Artificial Sequence: Synthetic oligonucleotide
ggatgtggacgatcaatgcaataggccgc

SEQ ID NO: 226946 - DNA, 29 bp, Artificial Sequence
  Description of Artificial Sequence: Synthetic oligonucleotide
gatgtggacgatcaatgcaataggccgcc

SEQ ID NO: 226947 - DNA, 30 bp, Artificial Sequence
  Description of Artificial Sequence: Synthetic oligonucleotide
atgtggacgatcaatgcaataggccgcctg

SEQ ID NO: 226948 - DNA, 29 bp, Artificial Sequence
  Description of Artificial Sequence: Synthetic oligonucleotide
tgtggacgatcaatgcaataggccgcctg

SEQ ID NO: 226949 - DNA, 28 bp, Artificial Sequence
  Description of Artificial Sequence: Synthetic oligonucleotide
gtggacgatcaatgcaataggccgcctg

SEQ ID NO: 226950 - DNA, 28 bp, Artificial Sequence
  Description of Artificial Sequence: Synthetic oligonucleotide
tggacgatcaatgcaataggccgcctgg

SEQ ID NO: 226951 - DNA, 27 bp, Artificial Sequence
  Description of Artificial Sequence: Synthetic oligonucleotide
ggacgatcaatgcaataggccgcctgg

SEQ ID NO: 226952 - DNA, 27 bp, Artificial Sequence
  Description of Artificial Sequence: Synthetic oligonucleotide
gacgatcaatgcaataggccgcctggg

SEQ ID NO: 226953 - DNA, 27 bp, Artificial Sequence
  Description of Artificial Sequence: Synthetic oligonucleotide
acgatcaatgcaataggccgcctgggg

SEQ ID NO: 226954 - DNA, 27 bp, Artificial Sequence
  Description of Artificial Sequence: Synthetic oligonucleotide
cgatcaatgcaataggccgcctgggga

SEQ ID NO: 226955 - DNA, 28 bp, Artificial Sequence
  Description of Artificial Sequence: Synthetic oligonucleotide
gatcaatgcaataggccgcctggggaac

SEQ ID NO: 226956 - DNA, 28 bp, Artificial Sequence
  Description of Artificial Sequence: Synthetic oligonucleotide
atcaatgcaataggccgcctggggaacc

SEQ ID NO: 226957 - DNA, 27 bp, Artificial Sequence
  Description of Artificial Sequence: Synthetic oligonucleotide
tcaatgcaataggccgcctggggaacc

SEQ ID NO: 226958 - DNA, 27 bp, Artificial Sequence
  Description of Artificial Sequence: Synthetic oligonucleotide
caatgcaataggccgcctggggaacca

SEQ ID NO: 226959 - DNA, 27 bp, Artificial Sequence
  Description of Artificial Sequence: Synthetic oligonucleotide
aatgcaataggccgcctggggaaccag

SEQ ID NO: 226960 - DNA, 27 bp, Artificial Sequence
  Description of Artificial Sequence: Synthetic oligonucleotide
atgcaataggccgcctggggaaccaga

SEQ ID NO: 226961 - DNA, 27 bp, Artificial Sequence
  Description of Artificial Sequence: Synthetic oligonucleotide
tgcaataggccgcctggggaaccagat

SEQ ID NO: 226962 - DNA, 26 bp, Artificial Sequence
  Description of Artificial Sequence: Synthetic oligonucleotide
gcaataggccgcctggggaaccagat

SEQ ID NO: 226963 - DNA, 26 bp, Artificial Sequence
  Description of Artificial Sequence: Synthetic oligonucleotide
caataggccgcctggggaaccagatg

SEQ ID NO: 226964 - DNA, 26 bp, Artificial Sequence
  Description of Artificial Sequence: Synthetic oligonucleotide
aataggccgcctggggaaccagatgg

SEQ ID NO: 226965 - DNA, 25 bp, Artificial Sequence
  Description of Artificial Sequence: Synthetic oligonucleotide
ataggccgcctggggaaccagatgg

SEQ ID NO: 226966 - DNA, 24 bp, Artificial Sequence
  Description of Artificial Sequence: Synthetic oligonucleotide
taggccgcctggggaaccagatgg

SEQ ID NO: 226967 - DNA, 23 bp, Artificial Sequence
  Description of Artificial Sequence: Synthetic oligonucleotide
aggccgcctggggaaccagatgg

SEQ ID NO: 226968 - DNA, 22 bp, Artificial Sequence
  Description of Artificial Sequence: Synthetic oligonucleotide
ggccgcctggggaaccagatgg

SEQ ID NO: 226969 - DNA, 22 bp, Artificial Sequence
  Description of Artificial Sequence: Synthetic oligonucleotide
gccgcctggggaaccagatggg

SEQ ID NO: 226970 - DNA, 22 bp, Artificial Sequence
  Description of Artificial Sequence: Synthetic oligonucleotide
ccgcctggggaaccagatgggc

SEQ ID NO: 226971 - DNA, 23 bp, Artificial Sequence
  Description of Artificial Sequence: Synthetic oligonucleotide
cgcctggggaaccagatgggcga

SEQ ID NO: 226972 - DNA, 25 bp, Artificial Sequence
  Description of Artificial Sequence: Synthetic oligonucleotide
gcctggggaaccagatgggcgagta

SEQ ID NO: 226973 - DNA, 25 bp, Artificial Sequence
  Description of Artificial Sequence: Synthetic oligonucleotide
cctggggaaccagatgggcgagtac

SEQ ID NO: 226974 - DNA, 25 bp, Artificial Sequence
  Description of Artificial Sequence: Synthetic oligonucleotide
ctggggaaccagatgggcgagtacg

SEQ ID NO: 226975 - DNA, 25 bp, Artificial Sequence
  Description of Artificial Sequence: Synthetic oligonucleotide
tggggaaccagatgggcgagtacgc

SEQ ID NO: 226976 - DNA, 24 bp, Artificial Sequence
  Description of Artificial Sequence: Synthetic oligonucleotide
ggggaaccagatgggcgagtacgc

SEQ ID NO: 226977 - DNA, 25 bp, Artificial Sequence
  Description of Artificial Sequence: Synthetic oligonucleotide
gggaaccagatgggcgagtacgcca

SEQ ID NO: 226978 - DNA, 26 bp, Artificial Sequence
  Description of Artificial Sequence: Synthetic oligonucleotide
ggaaccagatgggcgagtacgccaca

SEQ ID NO: 226979 - DNA, 27 bp, Artificial Sequence
  Description of Artificial Sequence: Synthetic oligonucleotide
gaaccagatgggcgagtacgccacact

SEQ ID NO: 226980 - DNA, 27 bp, Artificial Sequence
  Description of Artificial Sequence: Synthetic oligonucleotide
aaccagatgggcgagtacgccacactg

SEQ ID NO: 226981 - DNA, 27 bp, Artificial Sequence
  Description of Artificial Sequence: Synthetic oligonucleotide
accagatgggcgagtacgccacactgt

SEQ ID NO: 226982 - DNA, 27 bp, Artificial Sequence
  Description of Artificial Sequence: Synthetic oligonucleotide
ccagatgggcgagtacgccacactgta

SEQ ID NO: 226983 - DNA, 27 bp, Artificial Sequence
  Description of Artificial Sequence: Synthetic oligonucleotide
cagatgggcgagtacgccacactgtac

SEQ ID NO: 226984 - DNA, 27 bp, Artificial Sequence
  Description of Artificial Sequence: Synthetic oligonucleotide
agatgggcgagtacgccacactgtacg

SEQ ID NO: 226985 - DNA, 26 bp, Artificial Sequence
  Description of Artificial Sequence: Synthetic oligonucleotide
gatgggcgagtacgccacactgtacg

SEQ ID NO: 226986 - DNA, 26 bp, Artificial Sequence
  Description of Artificial Sequence: Synthetic oligonucleotide
atgggcgagtacgccacactgtacgc

SEQ ID NO: 226987 - DNA, 25 bp, Artificial Sequence
  Description of Artificial Sequence: Synthetic oligonucleotide
tgggcgagtacgccacactgtacgc

SEQ ID NO: 226988 - DNA, 24 bp, Artificial Sequence
  Description of Artificial Sequence: Synthetic oligonucleotide
gggcgagtacgccacactgtacgc

SEQ ID NO: 226989 - DNA, 24 bp, Artificial Sequence
  Description of Artificial Sequence: Synthetic oligonucleotide
ggcgagtacgccacactgtacgcc

SEQ ID NO: 226990 - DNA, 25 bp, Artificial Sequence
  Description of Artificial Sequence: Synthetic oligonucleotide
gcgagtacgccacactgtacgccct

SEQ ID NO: 226991 - DNA, 25 bp, Artificial Sequence
  Description of Artificial Sequence: Synthetic oligonucleotide
cgagtacgccacactgtacgccctg

SEQ ID NO: 226992 - DNA, 25 bp, Artificial Sequence
  Description of Artificial Sequence: Synthetic oligonucleotide
gagtacgccacactgtacgccctgg

SEQ ID NO: 226993 - DNA, 25 bp, Artificial Sequence
  Description of Artificial Sequence: Synthetic oligonucleotide
agtacgccacactgtacgccctggc

SEQ ID NO: 226994 - DNA, 24 bp, Artificial Sequence
  Description of Artificial Sequence: Synthetic oligonucleotide
gtacgccacactgtacgccctggc

SEQ ID NO: 226995 - DNA, 26 bp, Artificial Sequence
  Description of Artificial Sequence: Synthetic oligonucleotide
tacgccacactgtacgccctggccaa

SEQ ID NO: 226996 - DNA, 25 bp, Artificial Sequence
  Description of Artificial Sequence: Synthetic oligonucleotide
acgccacactgtacgccctggccaa

SEQ ID NO: 226997 - DNA, 24 bp, Artificial Sequence
  Description of Artificial Sequence: Synthetic oligonucleotide
cgccacactgtacgccctggccaa

SEQ ID NO: 226998 - DNA, 26 bp, Artificial Sequence
  Description of Artificial Sequence: Synthetic oligonucleotide
gccacactgtacgccctggccaagat

SEQ ID NO: 226999 - DNA, 27 bp, Artificial Sequence
  Description of Artificial Sequence: Synthetic oligonucleotide
ccacactgtacgccctggccaagatga

SEQ ID NO: 227000 - DNA, 28 bp, Artificial Sequence
  Description of Artificial Sequence: Synthetic oligonucleotide
cacactgtacgccctggccaagatgaac

SEQ ID NO: 227001 - DNA, 28 bp, Artificial Sequence
  Description of Artificial Sequence: Synthetic oligonucleotide
acactgtacgccctggccaagatgaacg

SEQ ID NO: 227002 - DNA, 27 bp, Artificial Sequence
  Description of Artificial Sequence: Synthetic oligonucleotide
cactgtacgccctggccaagatgaacg

SEQ ID NO: 227003 - DNA, 27 bp, Artificial Sequence
  Description of Artificial Sequence: Synthetic oligonucleotide
actgtacgccctggccaagatgaacgg

SEQ ID NO: 227004 - DNA, 26 bp, Artificial Sequence
  Description of Artificial Sequence: Synthetic oligonucleotide
ctgtacgccctggccaagatgaacgg

SEQ ID NO: 227005 - DNA, 26 bp, Artificial Sequence
  Description of Artificial Sequence: Synthetic oligonucleotide
tgtacgccctggccaagatgaacggg

SEQ ID NO: 227006 - DNA, 25 bp, Artificial Sequence
  Description of Artificial Sequence: Synthetic oligonucleotide
gtacgccctggccaagatgaacggg

SEQ ID NO: 227007 - DNA, 25 bp, Artificial Sequence
  Description of Artificial Sequence: Synthetic oligonucleotide
tacgccctggccaagatgaacgggc

SEQ ID NO: 227008 - DNA, 24 bp, Artificial Sequence
  Description of Artificial Sequence: Synthetic oligonucleotide
acgccctggccaagatgaacgggc

SEQ ID NO: 227009 - DNA, 23 bp, Artificial Sequence
  Description of Artificial Sequence: Synthetic oligonucleotide
cgccctggccaagatgaacgggc

SEQ ID NO: 227010 - DNA, 23 bp, Artificial Sequence
  Description of Artificial Sequence: Synthetic oligonucleotide
gccctggccaagatgaacgggcg

SEQ ID NO: 227011 - DNA, 23 bp, Artificial Sequence
  Description of Artificial Sequence: Synthetic oligonucleotide
ccctggccaagatgaacgggcgg

SEQ ID NO: 227012 - DNA, 23 bp, Artificial Sequence
  Description of Artificial Sequence: Synthetic oligonucleotide
cctggccaagatgaacgggcggc

SEQ ID NO: 227013 - DNA, 23 bp, Artificial Sequence
  Description of Artificial Sequence: Synthetic oligonucleotide
ctggccaagatgaacgggcggcc

SEQ ID NO: 227014 - DNA, 23 bp, Artificial Sequence
  Description of Artificial Sequence: Synthetic oligonucleotide
tggccaagatgaacgggcggccc

SEQ ID NO: 227015 - DNA, 22 bp, Artificial Sequence
  Description of Artificial Sequence: Synthetic oligonucleotide
ggccaagatgaacgggcggccc

SEQ ID NO: 227016 - DNA, 22 bp, Artificial Sequence
  Description of Artificial Sequence: Synthetic oligonucleotide
gccaagatgaacgggcggcccg

SEQ ID NO: 227017 - DNA, 22 bp, Artificial Sequence
  Description of Artificial Sequence: Synthetic oligonucleotide
ccaagatgaacgggcggcccgc

SEQ ID NO: 227018 - DNA, 24 bp, Artificial Sequence
  Description of Artificial Sequence: Synthetic oligonucleotide
caagatgaacgggcggcccgcctt

SEQ ID NO: 227019 - DNA, 26 bp, Artificial Sequence
  Description of Artificial Sequence: Synthetic oligonucleotide
aagatgaacgggcggcccgccttcat

SEQ ID NO: 227020 - DNA, 25 bp, Artificial Sequence
  Description of Artificial Sequence: Synthetic oligonucleotide
agatgaacgggcggcccgccttcat

SEQ ID NO: 227021 - DNA, 24 bp, Artificial Sequence
  Description of Artificial Sequence: Synthetic oligonucleotide
gatgaacgggcggcccgccttcat

SEQ ID NO: 227022 - DNA, 24 bp, Artificial Sequence
  Description of Artificial Sequence: Synthetic oligonucleotide
atgaacgggcggcccgccttcatc

SEQ ID NO: 227023 - DNA, 23 bp, Artificial Sequence
  Description of Artificial Sequence: Synthetic oligonucleotide
tgaacgggcggcccgccttcatc

SEQ ID NO: 227024 - DNA, 22 bp, Artificial Sequence
  Description of Artificial Sequence: Synthetic oligonucleotide
gaacgggcggcccgccttcatc

SEQ ID NO: 227025 - DNA, 22 bp, Artificial Sequence
  Description of Artificial Sequence: Synthetic oligonucleotide
aacgggcggcccgccttcatcc

SEQ ID NO: 227026 - DNA, 21 bp, Artificial Sequence
  Description of Artificial Sequence: Synthetic oligonucleotide
acgggcggcccgccttcatcc

SEQ ID NO: 227027 - DNA, 20 bp, Artificial Sequence
  Description of Artificial Sequence: Synthetic oligonucleotide
cgggcggcccgccttcatcc

SEQ ID NO: 227028 - DNA, 20 bp, Artificial Sequence
  Description of Artificial Sequence: Synthetic oligonucleotide
gggcggcccgccttcatccc

SEQ ID NO: 227029 - DNA, 20 bp, Artificial Sequence
  Description of Artificial Sequence: Synthetic oligonucleotide
ggcggcccgccttcatcccg

SEQ ID NO: 227030 - DNA, 20 bp, Artificial Sequence
  Description of Artificial Sequence: Synthetic oligonucleotide
gcggcccgccttcatcccgg

SEQ ID NO: 227031 - DNA, 20 bp, Artificial Sequence
  Description of Artificial Sequence: Synthetic oligonucleotide
cggcccgccttcatcccggc

SEQ ID NO: 227032 - DNA, 20 bp, Artificial Sequence
  Description of Artificial Sequence: Synthetic oligonucleotide
ggcccgccttcatcccggcc

SEQ ID NO: 227033 - DNA, 21 bp, Artificial Sequence
  Description of Artificial Sequence: Synthetic oligonucleotide
gcccgccttcatcccggccca

SEQ ID NO: 227034 - DNA, 23 bp, Artificial Sequence
  Description of Artificial Sequence: Synthetic oligonucleotide
cccgccttcatcccggcccagat

SEQ ID NO: 227035 - DNA, 23 bp, Artificial Sequence
  Description of Artificial Sequence: Synthetic oligonucleotide
ccgccttcatcccggcccagatg

SEQ ID NO: 227036 - DNA, 24 bp, Artificial Sequence
  Description of Artificial Sequence: Synthetic oligonucleotide
cgccttcatcccggcccagatgca

SEQ ID NO: 227037 - DNA, 25 bp, Artificial Sequence
  Description of Artificial Sequence: Synthetic oligonucleotide
gccttcatcccggcccagatgcaca

SEQ ID NO: 227038 - DNA, 25 bp, Artificial Sequence
  Description of Artificial Sequence: Synthetic oligonucleotide
ccttcatcccggcccagatgcacag

SEQ ID NO: 227039 - DNA, 26 bp, Artificial Sequence
  Description of Artificial Sequence: Synthetic oligonucleotide
cttcatcccggcccagatgcacagca

SEQ ID NO: 227040 - DNA, 26 bp, Artificial Sequence
  Description of Artificial Sequence: Synthetic oligonucleotide
ttcatcccggcccagatgcacagcac

SEQ ID NO: 227041 - DNA, 25 bp, Artificial Sequence
  Description of Artificial Sequence: Synthetic oligonucleotide
tcatcccggcccagatgcacagcac

SEQ ID NO: 227042 - DNA, 24 bp, Artificial Sequence
  Description of Artificial Sequence: Synthetic oligonucleotide
catcccggcccagatgcacagcac

SEQ ID NO: 227043 - DNA, 24 bp, Artificial Sequence
  Description of Artificial Sequence: Synthetic oligonucleotide
atcccggcccagatgcacagcacc

SEQ ID NO: 227044 - DNA, 23 bp, Artificial Sequence
  Description of Artificial Sequence: Synthetic oligonucleotide
tcccggcccagatgcacagcacc

SEQ ID NO: 227045 - DNA, 22 bp, Artificial Sequence
  Description of Artificial Sequence: Synthetic oligonucleotide
cccggcccagatgcacagcacc

SEQ ID NO: 227046 - DNA, 23 bp, Artificial Sequence
  Description of Artificial Sequence: Synthetic oligonucleotide
ccggcccagatgcacagcaccct

SEQ ID NO: 227047 - DNA, 23 bp, Artificial Sequence
  Description of Artificial Sequence: Synthetic oligonucleotide
cggcccagatgcacagcaccctg

SEQ ID NO: 227048 - DNA, 23 bp, Artificial Sequence
  Description of Artificial Sequence: Synthetic oligonucleotide
ggcccagatgcacagcaccctgg

SEQ ID NO: 227049 - DNA, 23 bp, Artificial Sequence
  Description of Artificial Sequence: Synthetic oligonucleotide
gcccagatgcacagcaccctggc

SEQ ID NO: 227050 - DNA, 23 bp, Artificial Sequence
  Description of Artificial Sequence: Synthetic oligonucleotide
cccagatgcacagcaccctggcc

SEQ ID NO: 227051 - DNA, 23 bp, Artificial Sequence
  Description of Artificial Sequence: Synthetic oligonucleotide
ccagatgcacagcaccctggccc

SEQ ID NO: 227052 - DNA, 23 bp, Artificial Sequence
  Description of Artificial Sequence: Synthetic oligonucleotide
cagatgcacagcaccctggcccc

SEQ ID NO: 227053 - DNA, 25 bp, Artificial Sequence
  Description of Artificial Sequence: Synthetic oligonucleotide
agatgcacagcaccctggcccccat

SEQ ID NO: 227054 - DNA, 24 bp, Artificial Sequence
  Description of Artificial Sequence: Synthetic oligonucleotide
gatgcacagcaccctggcccccat

SEQ ID NO: 227055 - DNA, 26 bp, Artificial Sequence
  Description of Artificial Sequence: Synthetic oligonucleotide
atgcacagcaccctggcccccatctt

SEQ ID NO: 227056 - DNA, 25 bp, Artificial Sequence
  Description of Artificial Sequence: Synthetic oligonucleotide
tgcacagcaccctggcccccatctt

SEQ ID NO: 227057 - DNA, 24 bp, Artificial Sequence
  Description of Artificial Sequence: Synthetic oligonucleotide
gcacagcaccctggcccccatctt

SEQ ID NO: 227058 - DNA, 25 bp, Artificial Sequence
  Description of Artificial Sequence: Synthetic oligonucleotide
cacagcaccctggcccccatcttca

SEQ ID NO: 227059 - DNA, 27 bp, Artificial Sequence
  Description of Artificial Sequence: Synthetic oligonucleotide
acagcaccctggcccccatcttcagaa

SEQ ID NO: 227060 - DNA, 27 bp, Artificial Sequence
  Description of Artificial Sequence: Synthetic oligonucleotide
cagcaccctggcccccatcttcagaat

SEQ ID NO: 227061 - DNA, 27 bp, Artificial Sequence
  Description of Artificial Sequence: Synthetic oligonucleotide
agcaccctggcccccatcttcagaatc

SEQ ID NO: 227062 - DNA, 27 bp, Artificial Sequence
  Description of Artificial Sequence: Synthetic oligonucleotide
gcaccctggcccccatcttcagaatca

SEQ ID NO: 227063 - DNA, 27 bp, Artificial Sequence
  Description of Artificial Sequence: Synthetic oligonucleotide
caccctggcccccatcttcagaatcac

SEQ ID NO: 227064 - DNA, 27 bp, Artificial Sequence
  Description of Artificial Sequence: Synthetic oligonucleotide
accctggcccccatcttcagaatcacc

SEQ ID NO: 227065 - DNA, 26 bp, Artificial Sequence
  Description of Artificial Sequence: Synthetic oligonucleotide
ccctggcccccatcttcagaatcacc

SEQ ID NO: 227066 - DNA, 27 bp, Artificial Sequence
  Description of Artificial Sequence: Synthetic oligonucleotide
cctggcccccatcttcagaatcaccct

SEQ ID NO: 227067 - DNA, 27 bp, Artificial Sequence
  Description of Artificial Sequence: Synthetic oligonucleotide
ctggcccccatcttcagaatcaccctg

SEQ ID NO: 227068 - DNA, 27 bp, Artificial Sequence
  Description of Artificial Sequence: Synthetic oligonucleotide
tggcccccatcttcagaatcaccctgc

SEQ ID NO: 227069 - DNA, 26 bp, Artificial Sequence
  Description of Artificial Sequence: Synthetic oligonucleotide
ggcccccatcttcagaatcaccctgc

SEQ ID NO: 227070 - DNA, 26 bp, Artificial Sequence
  Description of Artificial Sequence: Synthetic oligonucleotide
gcccccatcttcagaatcaccctgcc

SEQ ID NO: 227071 - DNA, 26 bp, Artificial Sequence
  Description of Artificial Sequence: Synthetic oligonucleotide
cccccatcttcagaatcaccctgccg

SEQ ID NO: 227072 - DNA, 27 bp, Artificial Sequence
  Description of Artificial Sequence: Synthetic oligonucleotide
ccccatcttcagaatcaccctgccggt

SEQ ID NO: 227073 - DNA, 27 bp, Artificial Sequence
  Description of Artificial Sequence: Synthetic oligonucleotide
cccatcttcagaatcaccctgccggtg

SEQ ID NO: 227074 - DNA, 27 bp, Artificial Sequence
  Description of Artificial Sequence: Synthetic oligonucleotide
ccatcttcagaatcaccctgccggtgc

SEQ ID NO: 227075 - DNA, 28 bp, Artificial Sequence
  Description of Artificial Sequence: Synthetic oligonucleotide
catcttcagaatcaccctgccggtgctg

SEQ ID NO: 227076 - DNA, 28 bp, Artificial Sequence
  Description of Artificial Sequence: Synthetic oligonucleotide
atcttcagaatcaccctgccggtgctgc

SEQ ID NO: 227077 - DNA, 27 bp, Artificial Sequence
  Description of Artificial Sequence: Synthetic oligonucleotide
tcttcagaatcaccctgccggtgctgc

SEQ ID NO: 227078 - DNA, 27 bp, Artificial Sequence
  Description of Artificial Sequence: Synthetic oligonucleotide
cttcagaatcaccctgccggtgctgca

SEQ ID NO: 227079 - DNA, 27 bp, Artificial Sequence
  Description of Artificial Sequence: Synthetic oligonucleotide
ttcagaatcaccctgccggtgctgcac

SEQ ID NO: 227080 - DNA, 27 bp, Artificial Sequence
  Description of Artificial Sequence: Synthetic oligonucleotide
tcagaatcaccctgccggtgctgcaca

SEQ ID NO: 227081 - DNA, 26 bp, Artificial Sequence
  Description of Artificial Sequence: Synthetic oligonucleotide
cagaatcaccctgccggtgctgcaca

SEQ ID NO: 227082 - DNA, 26 bp, Artificial Sequence
  Description of Artificial Sequence: Synthetic oligonucleotide
agaatcaccctgccggtgctgcacag

SEQ ID NO: 227083 - DNA, 25 bp, Artificial Sequence
  Description of Artificial Sequence: Synthetic oligonucleotide
gaatcaccctgccggtgctgcacag

SEQ ID NO: 227084 - DNA, 25 bp, Artificial Sequence
  Description of Artificial Sequence: Synthetic oligonucleotide
aatcaccctgccggtgctgcacagc

SEQ ID NO: 227085 - DNA, 24 bp, Artificial Sequence
  Description of Artificial Sequence: Synthetic oligonucleotide
atcaccctgccggtgctgcacagc

SEQ ID NO: 227086 - DNA, 23 bp, Artificial Sequence
  Description of Artificial Sequence: Synthetic oligonucleotide
tcaccctgccggtgctgcacagc

SEQ ID NO: 227087 - DNA, 22 bp, Artificial Sequence
  Description of Artificial Sequence: Synthetic oligonucleotide
caccctgccggtgctgcacagc

SEQ ID NO: 227088 - DNA, 22 bp, Artificial Sequence
  Description of Artificial Sequence: Synthetic oligonucleotide
accctgccggtgctgcacagcg

SEQ ID NO: 227089 - DNA, 21 bp, Artificial Sequence
  Description of Artificial Sequence: Synthetic oligonucleotide
ccctgccggtgctgcacagcg

SEQ ID NO: 227090 - DNA, 21 bp, Artificial Sequence
  Description of Artificial Sequence: Synthetic oligonucleotide
cctgccggtgctgcacagcgc

SEQ ID NO: 227091 - DNA, 22 bp, Artificial Sequence
  Description of Artificial Sequence: Synthetic oligonucleotide
ctgccggtgctgcacagcgcca

SEQ ID NO: 227092 - DNA, 22 bp, Artificial Sequence
  Description of Artificial Sequence: Synthetic oligonucleotide
tgccggtgctgcacagcgccac

SEQ ID NO: 227093 - DNA, 21 bp, Artificial Sequence
  Description of Artificial Sequence: Synthetic oligonucleotide
gccggtgctgcacagcgccac

SEQ ID NO: 227094 - DNA, 21 bp, Artificial Sequence
  Description of Artificial Sequence: Synthetic oligonucleotide
ccggtgctgcacagcgccacg

SEQ ID NO: 227095 - DNA, 21 bp, Artificial Sequence
  Description of Artificial Sequence: Synthetic oligonucleotide
cggtgctgcacagcgccacgg

SEQ ID NO: 227096 - DNA, 21 bp, Artificial Sequence
  Description of Artificial Sequence: Synthetic oligonucleotide
ggtgctgcacagcgccacggc

SEQ ID NO: 227097 - DNA, 22 bp, Artificial Sequence
  Description of Artificial Sequence: Synthetic oligonucleotide
gtgctgcacagcgccacggcca

SEQ ID NO: 227098 - DNA, 22 bp, Artificial Sequence
  Description of Artificial Sequence: Synthetic oligonucleotide
tgctgcacagcgccacggccag

SEQ ID NO: 227099 - DNA, 21 bp, Artificial Sequence
  Description of Artificial Sequence: Synthetic oligonucleotide
gctgcacagcgccacggccag

SEQ ID NO: 227100 - DNA, 22 bp, Artificial Sequence
  Description of Artificial Sequence: Synthetic oligonucleotide
ctgcacagcgccacggccagca

SEQ ID NO: 227101 - DNA, 22 bp, Artificial Sequence
  Description of Artificial Sequence: Synthetic oligonucleotide
tgcacagcgccacggccagcag

SEQ ID NO: 227102 - DNA, 21 bp, Artificial Sequence
  Description of Artificial Sequence: Synthetic oligonucleotide
gcacagcgccacggccagcag

SEQ ID NO: 227103 - DNA, 23 bp, Artificial Sequence
  Description of Artificial Sequence: Synthetic oligonucleotide
cacagcgccacggccagcaggat

SEQ ID NO: 227104 - DNA, 23 bp, Artificial Sequence
  Description of Artificial Sequence: Synthetic oligonucleotide
acagcgccacggccagcaggatc

SEQ ID NO: 227105 - DNA, 22 bp, Artificial Sequence
  Description of Artificial Sequence: Synthetic oligonucleotide
cagcgccacggccagcaggatc

SEQ ID NO: 227106 - DNA, 22 bp, Artificial Sequence
  Description of Artificial Sequence: Synthetic oligonucleotide
agcgccacggccagcaggatcc

SEQ ID NO: 227107 - DNA, 21 bp, Artificial Sequence
  Description of Artificial Sequence: Synthetic oligonucleotide
gcgccacggccagcaggatcc

SEQ ID NO: 227108 - DNA, 21 bp, Artificial Sequence
  Description of Artificial Sequence: Synthetic oligonucleotide
cgccacggccagcaggatccc

SEQ ID NO: 227109 - DNA, 22 bp, Artificial Sequence
  Description of Artificial Sequence: Synthetic oligonucleotide
gccacggccagcaggatcccct

SEQ ID NO: 227110 - DNA, 22 bp, Artificial Sequence
  Description of Artificial Sequence: Synthetic oligonucleotide
ccacggccagcaggatcccctg

SEQ ID NO: 227111 - DNA, 22 bp, Artificial Sequence
  Description of Artificial Sequence: Synthetic oligonucleotide
cacggccagcaggatcccctgg

SEQ ID NO: 227112 - DNA, 23 bp, Artificial Sequence
  Description of Artificial Sequence: Synthetic oligonucleotide
acggccagcaggatcccctggca

SEQ ID NO: 227113 - DNA, 22 bp, Artificial Sequence
  Description of Artificial Sequence: Synthetic oligonucleotide
cggccagcaggatcccctggca

SEQ ID NO: 227114 - DNA, 24 bp, Artificial Sequence
  Description of Artificial Sequence: Synthetic oligonucleotide
ggccagcaggatcccctggcagaa

SEQ ID NO: 227115 - DNA, 26 bp, Artificial Sequence
  Description of Artificial Sequence: Synthetic oligonucleotide
gccagcaggatcccctggcagaacta

SEQ ID NO: 227116 - DNA, 26 bp, Artificial Sequence
  Description of Artificial Sequence: Synthetic oligonucleotide
ccagcaggatcccctggcagaactac

SEQ ID NO: 227117 - DNA, 27 bp, Artificial Sequence
  Description of Artificial Sequence: Synthetic oligonucleotide
cagcaggatcccctggcagaactacca

SEQ ID NO: 227118 - DNA, 27 bp, Artificial Sequence
  Description of Artificial Sequence: Synthetic oligonucleotide
agcaggatcccctggcagaactaccac

SEQ ID NO: 227119 - DNA, 26 bp, Artificial Sequence
  Description of Artificial Sequence: Synthetic oligonucleotide
gcaggatcccctggcagaactaccac

SEQ ID NO: 227120 - DNA, 27 bp, Artificial Sequence
  Description of Artificial Sequence: Synthetic oligonucleotide
caggatcccctggcagaactaccacct

SEQ ID NO: 227121 - DNA, 27 bp, Artificial Sequence
  Description of Artificial Sequence: Synthetic oligonucleotide
aggatcccctggcagaactaccacctg

SEQ ID NO: 227122 - DNA, 27 bp, Artificial Sequence
  Description of Artificial Sequence: Synthetic oligonucleotide
ggatcccctggcagaactaccacctga

SEQ ID NO: 227123 - DNA, 28 bp, Artificial Sequence
  Description of Artificial Sequence: Synthetic oligonucleotide
gatcccctggcagaactaccacctgaac

SEQ ID NO: 227124 - DNA, 28 bp, Artificial Sequence
  Description of Artificial Sequence: Synthetic oligonucleotide
atcccctggcagaactaccacctgaacg

SEQ ID NO: 227125 - DNA, 27 bp, Artificial Sequence
  Description of Artificial Sequence: Synthetic oligonucleotide
tcccctggcagaactaccacctgaacg

SEQ ID NO: 227126 - DNA, 27 bp, Artificial Sequence
  Description of Artificial Sequence: Synthetic oligonucleotide
cccctggcagaactaccacctgaacga

SEQ ID NO: 227127 - DNA, 27 bp, Artificial Sequence
  Description of Artificial Sequence: Synthetic oligonucleotide
ccctggcagaactaccacctgaacgac

SEQ ID NO: 227128 - DNA, 28 bp, Artificial Sequence
  Description of Artificial Sequence: Synthetic oligonucleotide
cctggcagaactaccacctgaacgactg

SEQ ID NO: 227129 - DNA, 28 bp, Artificial Sequence
  Description of Artificial Sequence: Synthetic oligonucleotide
ctggcagaactaccacctgaacgactgg

SEQ ID NO: 227130 - DNA, 30 bp, Artificial Sequence
  Description of Artificial Sequence: Synthetic oligonucleotide
tggcagaactaccacctgaacgactggatg

SEQ ID NO: 227131 - DNA, 29 bp, Artificial Sequence
  Description of Artificial Sequence: Synthetic oligonucleotide
ggcagaactaccacctgaacgactggatg

SEQ ID NO: 227132 - DNA, 29 bp, Artificial Sequence
  Description of Artificial Sequence: Synthetic oligonucleotide
gcagaactaccacctgaacgactggatgg

SEQ ID NO: 227133 - DNA, 30 bp, Artificial Sequence
  Description of Artificial Sequence: Synthetic oligonucleotide
cagaactaccacctgaacgactggatggag

SEQ ID NO: 227134 - DNA, 30 bp, Artificial Sequence
  Description of Artificial Sequence: Synthetic oligonucleotide
agaactaccacctgaacgactggatggagg

SEQ ID NO: 227135 - DNA, 29 bp, Artificial Sequence
  Description of Artificial Sequence: Synthetic oligonucleotide
gaactaccacctgaacgactggatggagg

SEQ ID NO: 227136 - DNA, 30 bp, Artificial Sequence
  Description of Artificial Sequence: Synthetic oligonucleotide
aactaccacctgaacgactggatggaggag

SEQ ID NO: 227137 - DNA, 29 bp, Artificial Sequence
  Description of Artificial Sequence: Synthetic oligonucleotide
actaccacctgaacgactggatggaggag

SEQ ID NO: 227138 - DNA, 28 bp, Artificial Sequence
  Description of Artificial Sequence: Synthetic oligonucleotide
ctaccacctgaacgactggatggaggag

SEQ ID NO: 227139 - DNA, 28 bp, Artificial Sequence
  Description of Artificial Sequence: Synthetic oligonucleotide
taccacctgaacgactggatggaggagg

SEQ ID NO: 227140 - DNA, 27 bp, Artificial Sequence
  Description of Artificial Sequence: Synthetic oligonucleotide
accacctgaacgactggatggaggagg

SEQ ID NO: 227141 - DNA, 27 bp, Artificial Sequence
  Description of Artificial Sequence: Synthetic oligonucleotide
ccacctgaacgactggatggaggagga

SEQ ID NO: 227142 - DNA, 30 bp, Artificial Sequence
  Description of Artificial Sequence: Synthetic oligonucleotide
cacctgaacgactggatggaggaggaatac

SEQ ID NO: 227143 - DNA, 30 bp, Artificial Sequence
  Description of Artificial Sequence: Synthetic oligonucleotide
acctgaacgactggatggaggaggaatacc

SEQ ID NO: 227144 - DNA, 29 bp, Artificial Sequence
  Description of Artificial Sequence: Synthetic oligonucleotide
cctgaacgactggatggaggaggaatacc

SEQ ID NO: 227145 - DNA, 29 bp, Artificial Sequence
  Description of Artificial Sequence: Synthetic oligonucleotide
ctgaacgactggatggaggaggaataccg

SEQ ID NO: 227146 - DNA, 29 bp, Artificial Sequence
  Description of Artificial Sequence: Synthetic oligonucleotide
tgaacgactggatggaggaggaataccgc

SEQ ID NO: 227147 - DNA, 28 bp, Artificial Sequence
  Description of Artificial Sequence: Synthetic oligonucleotide
gaacgactggatggaggaggaataccgc

SEQ ID NO: 227148 - DNA, 28 bp, Artificial Sequence
  Description of Artificial Sequence: Synthetic oligonucleotide
aacgactggatggaggaggaataccgcc

SEQ ID NO: 227149 - DNA, 27 bp, Artificial Sequence
  Description of Artificial Sequence: Synthetic oligonucleotide
acgactggatggaggaggaataccgcc

SEQ ID NO: 227150 - DNA, 27 bp, Artificial Sequence
  Description of Artificial Sequence: Synthetic oligonucleotide
cgactggatggaggaggaataccgcca

SEQ ID NO: 227151 - DNA, 27 bp, Artificial Sequence
  Description of Artificial Sequence: Synthetic oligonucleotide
gactggatggaggaggaataccgccac

SEQ ID NO: 227152 - DNA, 29 bp, Artificial Sequence
  Description of Artificial Sequence: Synthetic oligonucleotide
actggatggaggaggaataccgccacatc

SEQ ID NO: 227153 - DNA, 28 bp, Artificial Sequence
  Description of Artificial Sequence: Synthetic oligonucleotide
ctggatggaggaggaataccgccacatc

SEQ ID NO: 227154 - DNA, 28 bp, Artificial Sequence
  Description of Artificial Sequence: Synthetic oligonucleotide
tggatggaggaggaataccgccacatcc

SEQ ID NO: 227155 - DNA, 27 bp, Artificial Sequence
  Description of Artificial Sequence: Synthetic oligonucleotide
ggatggaggaggaataccgccacatcc

SEQ ID NO: 227156 - DNA, 27 bp, Artificial Sequence
  Description of Artificial Sequence: Synthetic oligonucleotide
gatggaggaggaataccgccacatccc

SEQ ID NO: 227157 - DNA, 27 bp, Artificial Sequence
  Description of Artificial Sequence: Synthetic oligonucleotide
atggaggaggaataccgccacatcccg

SEQ ID NO: 227158 - DNA, 26 bp, Artificial Sequence
  Description of Artificial Sequence: Synthetic oligonucleotide
tggaggaggaataccgccacatcccg

SEQ ID NO: 227159 - DNA, 25 bp, Artificial Sequence
  Description of Artificial Sequence: Synthetic oligonucleotide
ggaggaggaataccgccacatcccg

SEQ ID NO: 227160 - DNA, 25 bp, Artificial Sequence
  Description of Artificial Sequence: Synthetic oligonucleotide
gaggaggaataccgccacatcccgg

SEQ ID NO: 227161 - DNA, 25 bp, Artificial Sequence
  Description of Artificial Sequence: Synthetic oligonucleotide
aggaggaataccgccacatcccggg

SEQ ID NO: 227162 - DNA, 24 bp, Artificial Sequence
  Description of Artificial Sequence: Synthetic oligonucleotide
ggaggaataccgccacatcccggg

SEQ ID NO: 227163 - DNA, 24 bp, Artificial Sequence
  Description of Artificial Sequence: Synthetic oligonucleotide
gaggaataccgccacatcccgggg

SEQ ID NO: 227164 - DNA, 25 bp, Artificial Sequence
  Description of Artificial Sequence: Synthetic oligonucleotide
aggaataccgccacatcccggggga

SEQ ID NO: 227165 - DNA, 24 bp, Artificial Sequence
  Description of Artificial Sequence: Synthetic oligonucleotide
ggaataccgccacatcccggggga

SEQ ID NO: 227166 - DNA, 26 bp, Artificial Sequence
  Description of Artificial Sequence: Synthetic oligonucleotide
gaataccgccacatcccgggggagta

SEQ ID NO: 227167 - DNA, 26 bp, Artificial Sequence
  Description of Artificial Sequence: Synthetic oligonucleotide
aataccgccacatcccgggggagtac

SEQ ID NO: 227168 - DNA, 25 bp, Artificial Sequence
  Description of Artificial Sequence: Synthetic oligonucleotide
ataccgccacatcccgggggagtac

SEQ ID NO: 227169 - DNA, 24 bp, Artificial Sequence
  Description of Artificial Sequence: Synthetic oligonucleotide
taccgccacatcccgggggagtac

SEQ ID NO: 227170 - DNA, 23 bp, Artificial Sequence
  Description of Artificial Sequence: Synthetic oligonucleotide
accgccacatcccgggggagtac

SEQ ID NO: 227171 - DNA, 22 bp, Artificial Sequence
  Description of Artificial Sequence: Synthetic oligonucleotide
ccgccacatcccgggggagtac

SEQ ID NO: 227172 - DNA, 23 bp, Artificial Sequence
  Description of Artificial Sequence: Synthetic oligonucleotide
cgccacatcccgggggagtacgt

SEQ ID NO: 227173 - DNA, 23 bp, Artificial Sequence
  Description of Artificial Sequence: Synthetic oligonucleotide
gccacatcccgggggagtacgtc

SEQ ID NO: 227174 - DNA, 23 bp, Artificial Sequence
  Description of Artificial Sequence: Synthetic oligonucleotide
ccacatcccgggggagtacgtcc

SEQ ID NO: 227175 - DNA, 23 bp, Artificial Sequence
  Description of Artificial Sequence: Synthetic oligonucleotide
cacatcccgggggagtacgtccg

SEQ ID NO: 227176 - DNA, 25 bp, Artificial Sequence
  Description of Artificial Sequence: Synthetic oligonucleotide
acatcccgggggagtacgtccgctt

SEQ ID NO: 227177 - DNA, 24 bp, Artificial Sequence
  Description of Artificial Sequence: Synthetic oligonucleotide
catcccgggggagtacgtccgctt

SEQ ID NO: 227178 - DNA, 25 bp, Artificial Sequence
  Description of Artificial Sequence: Synthetic oligonucleotide
atcccgggggagtacgtccgcttca

SEQ ID NO: 227179 - DNA, 24 bp, Artificial Sequence
  Description of Artificial Sequence: Synthetic oligonucleotide
tcccgggggagtacgtccgcttca

SEQ ID NO: 227180 - DNA, 23 bp, Artificial Sequence
  Description of Artificial Sequence: Synthetic oligonucleotide
cccgggggagtacgtccgcttca

SEQ ID NO: 227181 - DNA, 23 bp, Artificial Sequence
  Description of Artificial Sequence: Synthetic oligonucleotide
ccgggggagtacgtccgcttcac

SEQ ID NO: 227182 - DNA, 23 bp, Artificial Sequence
  Description of Artificial Sequence: Synthetic oligonucleotide
cgggggagtacgtccgcttcacc

SEQ ID NO: 227183 - DNA, 23 bp, Artificial Sequence
  Description of Artificial Sequence: Synthetic oligonucleotide
gggggagtacgtccgcttcaccg

SEQ ID NO: 227184 - DNA, 23 bp, Artificial Sequence
  Description of Artificial Sequence: Synthetic oligonucleotide
ggggagtacgtccgcttcaccgg

SEQ ID NO: 227185 - DNA, 25 bp, Artificial Sequence
  Description of Artificial Sequence: Synthetic oligonucleotide
gggagtacgtccgcttcaccggcta

SEQ ID NO: 227186 - DNA, 25 bp, Artificial Sequence
  Description of Artificial Sequence: Synthetic oligonucleotide
ggagtacgtccgcttcaccggctac

SEQ ID NO: 227187 - DNA, 25 bp, Artificial Sequence
  Description of Artificial Sequence: Synthetic oligonucleotide
gagtacgtccgcttcaccggctacc

SEQ ID NO: 227188 - DNA, 25 bp, Artificial Sequence
  Description of Artificial Sequence: Synthetic oligonucleotide
agtacgtccgcttcaccggctaccc

SEQ ID NO: 227189 - DNA, 24 bp, Artificial Sequence
  Description of Artificial Sequence: Synthetic oligonucleotide
gtacgtccgcttcaccggctaccc

SEQ ID NO: 227190 - DNA, 25 bp, Artificial Sequence
  Description of Artificial Sequence: Synthetic oligonucleotide
tacgtccgcttcaccggctacccct

SEQ ID NO: 227191 - DNA, 24 bp, Artificial Sequence
  Description of Artificial Sequence: Synthetic oligonucleotide
acgtccgcttcaccggctacccct

SEQ ID NO: 227192 - DNA, 23 bp, Artificial Sequence
  Description of Artificial Sequence: Synthetic oligonucleotide
cgtccgcttcaccggctacccct

SEQ ID NO: 227193 - DNA, 23 bp, Artificial Sequence
  Description of Artificial Sequence: Synthetic oligonucleotide
gtccgcttcaccggctacccctg

SEQ ID NO: 227194 - DNA, 24 bp, Artificial Sequence
  Description of Artificial Sequence: Synthetic oligonucleotide
tccgcttcaccggctacccctgct

SEQ ID NO: 227195 - DNA, 23 bp, Artificial Sequence
  Description of Artificial Sequence: Synthetic oligonucleotide
ccgcttcaccggctacccctgct

SEQ ID NO: 227196 - DNA, 23 bp, Artificial Sequence
  Description of Artificial Sequence: Synthetic oligonucleotide
cgcttcaccggctacccctgctc

SEQ ID NO: 227197 - DNA, 24 bp, Artificial Sequence
  Description of Artificial Sequence: Synthetic oligonucleotide
gcttcaccggctacccctgctcct

SEQ ID NO: 227198 - DNA, 24 bp, Artificial Sequence
  Description of Artificial Sequence: Synthetic oligonucleotide
cttcaccggctacccctgctcctg

SEQ ID NO: 227199 - DNA, 25 bp, Artificial Sequence
  Description of Artificial Sequence: Synthetic oligonucleotide
ttcaccggctacccctgctcctgga

SEQ ID NO: 227200 - DNA, 24 bp, Artificial Sequence
  Description of Artificial Sequence: Synthetic oligonucleotide
tcaccggctacccctgctcctgga

SEQ ID NO: 227201 - DNA, 23 bp, Artificial Sequence
  Description of Artificial Sequence: Synthetic oligonucleotide
caccggctacccctgctcctgga

SEQ ID NO: 227202 - DNA, 23 bp, Artificial Sequence
  Description of Artificial Sequence: Synthetic oligonucleotide
accggctacccctgctcctggac

SEQ ID NO: 227203 - DNA, 22 bp, Artificial Sequence
  Description of Artificial Sequence: Synthetic oligonucleotide
ccggctacccctgctcctggac

SEQ ID NO: 227204 - DNA, 24 bp, Artificial Sequence
  Description of Artificial Sequence: Synthetic oligonucleotide
cggctacccctgctcctggacctt

SEQ ID NO: 227205 - DNA, 26 bp, Artificial Sequence
  Description of Artificial Sequence: Synthetic oligonucleotide
ggctacccctgctcctggaccttcta

SEQ ID NO: 227206 - DNA, 26 bp, Artificial Sequence
  Description of Artificial Sequence: Synthetic oligonucleotide
gctacccctgctcctggaccttctac

SEQ ID NO: 227207 - DNA, 27 bp, Artificial Sequence
  Description of Artificial Sequence: Synthetic oligonucleotide
ctacccctgctcctggaccttctacca

SEQ ID NO: 227208 - DNA, 27 bp, Artificial Sequence
  Description of Artificial Sequence: Synthetic oligonucleotide
tacccctgctcctggaccttctaccac

SEQ ID NO: 227209 - DNA, 26 bp, Artificial Sequence
  Description of Artificial Sequence: Synthetic oligonucleotide
acccctgctcctggaccttctaccac

SEQ ID NO: 227210 - DNA, 25 bp, Artificial Sequence
  Description of Artificial Sequence: Synthetic oligonucleotide
cccctgctcctggaccttctaccac

SEQ ID NO: 227211 - DNA, 26 bp, Artificial Sequence
  Description of Artificial Sequence: Synthetic oligonucleotide
ccctgctcctggaccttctaccacca

SEQ ID NO: 227212 - DNA, 26 bp, Artificial Sequence
  Description of Artificial Sequence: Synthetic oligonucleotide
cctgctcctggaccttctaccaccac

SEQ ID NO: 227213 - DNA, 27 bp, Artificial Sequence
  Description of Artificial Sequence: Synthetic oligonucleotide
ctgctcctggaccttctaccaccacct

SEQ ID NO: 227214 - DNA, 27 bp, Artificial Sequence
  Description of Artificial Sequence: Synthetic oligonucleotide
tgctcctggaccttctaccaccacctc

SEQ ID NO: 227215 - DNA, 26 bp, Artificial Sequence
  Description of Artificial Sequence: Synthetic oligonucleotide
gctcctggaccttctaccaccacctc

SEQ ID NO: 227216 - DNA, 26 bp, Artificial Sequence
  Description of Artificial Sequence: Synthetic oligonucleotide
ctcctggaccttctaccaccacctcc

SEQ ID NO: 227217 - DNA, 26 bp, Artificial Sequence
  Description of Artificial Sequence: Synthetic oligonucleotide
tcctggaccttctaccaccacctccg

SEQ ID NO: 227218 - DNA, 25 bp, Artificial Sequence
  Description of Artificial Sequence: Synthetic oligonucleotide
cctggaccttctaccaccacctccg

SEQ ID NO: 227219 - DNA, 25 bp, Artificial Sequence
  Description of Artificial Sequence: Synthetic oligonucleotide
ctggaccttctaccaccacctccgc

SEQ ID NO: 227220 - DNA, 26 bp, Artificial Sequence
  Description of Artificial Sequence: Synthetic oligonucleotide
tggaccttctaccaccacctccgcca

SEQ ID NO: 227221 - DNA, 25 bp, Artificial Sequence
  Description of Artificial Sequence: Synthetic oligonucleotide
ggaccttctaccaccacctccgcca

SEQ ID NO: 227222 - DNA, 25 bp, Artificial Sequence
  Description of Artificial Sequence: Synthetic oligonucleotide
gaccttctaccaccacctccgccag

SEQ ID NO: 227223 - DNA, 26 bp, Artificial Sequence
  Description of Artificial Sequence: Synthetic oligonucleotide
accttctaccaccacctccgccagga

SEQ ID NO: 227224 - DNA, 25 bp, Artificial Sequence
  Description of Artificial Sequence: Synthetic oligonucleotide
ccttctaccaccacctccgccagga

SEQ ID NO: 227225 - DNA, 27 bp, Artificial Sequence
  Description of Artificial Sequence: Synthetic oligonucleotide
cttctaccaccacctccgccaggagat

SEQ ID NO: 227226 - DNA, 27 bp, Artificial Sequence
  Description of Artificial Sequence: Synthetic oligonucleotide
ttctaccaccacctccgccaggagatc

SEQ ID NO: 227227 - DNA, 26 bp, Artificial Sequence
  Description of Artificial Sequence: Synthetic oligonucleotide
tctaccaccacctccgccaggagatc

SEQ ID NO: 227228 - DNA, 25 bp, Artificial Sequence
  Description of Artificial Sequence: Synthetic oligonucleotide
ctaccaccacctccgccaggagatc

SEQ ID NO: 227229 - DNA, 26 bp, Artificial Sequence
  Description of Artificial Sequence: Synthetic oligonucleotide
taccaccacctccgccaggagatcct

SEQ ID NO: 227230 - DNA, 25 bp, Artificial Sequence
  Description of Artificial Sequence: Synthetic oligonucleotide
accaccacctccgccaggagatcct

SEQ ID NO: 227231 - DNA, 24 bp, Artificial Sequence
  Description of Artificial Sequence: Synthetic oligonucleotide
ccaccacctccgccaggagatcct

SEQ ID NO: 227232 - DNA, 24 bp, Artificial Sequence
  Description of Artificial Sequence: Synthetic oligonucleotide
caccacctccgccaggagatcctc

SEQ ID NO: 227233 - DNA, 25 bp, Artificial Sequence
  Description of Artificial Sequence: Synthetic oligonucleotide
accacctccgccaggagatcctcca

SEQ ID NO: 227234 - DNA, 24 bp, Artificial Sequence
  Description of Artificial Sequence: Synthetic oligonucleotide
ccacctccgccaggagatcctcca

SEQ ID NO: 227235 - DNA, 24 bp, Artificial Sequence
  Description of Artificial Sequence: Synthetic oligonucleotide
cacctccgccaggagatcctccag

SEQ ID NO: 227236 - DNA, 25 bp, Artificial Sequence
  Description of Artificial Sequence: Synthetic oligonucleotide
acctccgccaggagatcctccagga

SEQ ID NO: 227237 - DNA, 24 bp, Artificial Sequence
  Description of Artificial Sequence: Synthetic oligonucleotide
cctccgccaggagatcctccagga

SEQ ID NO: 227238 - DNA, 26 bp, Artificial Sequence
  Description of Artificial Sequence: Synthetic oligonucleotide
ctccgccaggagatcctccaggagtt

SEQ ID NO: 227239 - DNA, 27 bp, Artificial Sequence
  Description of Artificial Sequence: Synthetic oligonucleotide
tccgccaggagatcctccaggagttca

SEQ ID NO: 227240 - DNA, 26 bp, Artificial Sequence
  Description of Artificial Sequence: Synthetic oligonucleotide
ccgccaggagatcctccaggagttca

SEQ ID NO: 227241 - DNA, 26 bp, Artificial Sequence
  Description of Artificial Sequence: Synthetic oligonucleotide
cgccaggagatcctccaggagttcac

SEQ ID NO: 227242 - DNA, 26 bp, Artificial Sequence
  Description of Artificial Sequence: Synthetic oligonucleotide
gccaggagatcctccaggagttcacc

SEQ ID NO: 227243 - DNA, 27 bp, Artificial Sequence
  Description of Artificial Sequence: Synthetic oligonucleotide
ccaggagatcctccaggagttcaccct

SEQ ID NO: 227244 - DNA, 27 bp, Artificial Sequence
  Description of Artificial Sequence: Synthetic oligonucleotide
caggagatcctccaggagttcaccctg

SEQ ID NO: 227245 - DNA, 27 bp, Artificial Sequence
  Description of Artificial Sequence: Synthetic oligonucleotide
aggagatcctccaggagttcaccctgc

SEQ ID NO: 227246 - DNA, 27 bp, Artificial Sequence
  Description of Artificial Sequence: Synthetic oligonucleotide
ggagatcctccaggagttcaccctgca

SEQ ID NO: 227247 - DNA, 27 bp, Artificial Sequence
  Description of Artificial Sequence: Synthetic oligonucleotide
gagatcctccaggagttcaccctgcac

SEQ ID NO: 227248 - DNA, 27 bp, Artificial Sequence
  Description of Artificial Sequence: Synthetic oligonucleotide
agatcctccaggagttcaccctgcacg

SEQ ID NO: 227249 - DNA, 27 bp, Artificial Sequence
  Description of Artificial Sequence: Synthetic oligonucleotide
gatcctccaggagttcaccctgcacga

SEQ ID NO: 227250 - DNA, 27 bp, Artificial Sequence
  Description of Artificial Sequence: Synthetic oligonucleotide
atcctccaggagttcaccctgcacgac

SEQ ID NO: 227251 - DNA, 26 bp, Artificial Sequence
  Description of Artificial Sequence: Synthetic oligonucleotide
tcctccaggagttcaccctgcacgac

SEQ ID NO: 227252 - DNA, 25 bp, Artificial Sequence
  Description of Artificial Sequence: Synthetic oligonucleotide
cctccaggagttcaccctgcacgac

SEQ ID NO: 227253 - DNA, 26 bp, Artificial Sequence
  Description of Artificial Sequence: Synthetic oligonucleotide
ctccaggagttcaccctgcacgacca

SEQ ID NO: 227254 - DNA, 26 bp, Artificial Sequence
  Description of Artificial Sequence: Synthetic oligonucleotide
tccaggagttcaccctgcacgaccac

SEQ ID NO: 227255 - DNA, 25 bp, Artificial Sequence
  Description of Artificial Sequence: Synthetic oligonucleotide
ccaggagttcaccctgcacgaccac

SEQ ID NO: 227256 - DNA, 26 bp, Artificial Sequence
  Description of Artificial Sequence: Synthetic oligonucleotide
caggagttcaccctgcacgaccacgt

SEQ ID NO: 227257 - DNA, 26 bp, Artificial Sequence
  Description of Artificial Sequence: Synthetic oligonucleotide
aggagttcaccctgcacgaccacgtg

SEQ ID NO: 227258 - DNA, 25 bp, Artificial Sequence
  Description of Artificial Sequence: Synthetic oligonucleotide
ggagttcaccctgcacgaccacgtg

SEQ ID NO: 227259 - DNA, 25 bp, Artificial Sequence
  Description of Artificial Sequence: Synthetic oligonucleotide
gagttcaccctgcacgaccacgtgc

SEQ ID NO: 227260 - DNA, 25 bp, Artificial Sequence
  Description of Artificial Sequence: Synthetic oligonucleotide
agttcaccctgcacgaccacgtgcg

SEQ ID NO: 227261 - DNA, 24 bp, Artificial Sequence
  Description of Artificial Sequence: Synthetic oligonucleotide
gttcaccctgcacgaccacgtgcg

SEQ ID NO: 227262 - DNA, 24 bp, Artificial Sequence
  Description of Artificial Sequence: Synthetic oligonucleotide
ttcaccctgcacgaccacgtgcgg

SEQ ID NO: 227263 - DNA, 23 bp, Artificial Sequence
  Description of Artificial Sequence: Synthetic oligonucleotide
tcaccctgcacgaccacgtgcgg

SEQ ID NO: 227264 - DNA, 22 bp, Artificial Sequence
  Description of Artificial Sequence: Synthetic oligonucleotide
caccctgcacgaccacgtgcgg

SEQ ID NO: 227265 - DNA, 23 bp, Artificial Sequence
  Description of Artificial Sequence: Synthetic oligonucleotide
accctgcacgaccacgtgcggga

SEQ ID NO: 227266 - DNA, 22 bp, Artificial Sequence
  Description of Artificial Sequence: Synthetic oligonucleotide
ccctgcacgaccacgtgcggga

SEQ ID NO: 227267 - DNA, 22 bp, Artificial Sequence
  Description of Artificial Sequence: Synthetic oligonucleotide
cctgcacgaccacgtgcgggag

SEQ ID NO: 227268 - DNA, 23 bp, Artificial Sequence
  Description of Artificial Sequence: Synthetic oligonucleotide
ctgcacgaccacgtgcgggagga

SEQ ID NO: 227269 - DNA, 23 bp, Artificial Sequence
  Description of Artificial Sequence: Synthetic oligonucleotide
tgcacgaccacgtgcgggaggag

SEQ ID NO: 227270 - DNA, 22 bp, Artificial Sequence
  Description of Artificial Sequence: Synthetic oligonucleotide
gcacgaccacgtgcgggaggag

SEQ ID NO: 227271 - DNA, 22 bp, Artificial Sequence
  Description of Artificial Sequence: Synthetic oligonucleotide
cacgaccacgtgcgggaggagg

SEQ ID NO: 227272 - DNA, 22 bp, Artificial Sequence
  Description of Artificial Sequence: Synthetic oligonucleotide
acgaccacgtgcgggaggaggc

SEQ ID NO: 227273 - DNA, 21 bp, Artificial Sequence
  Description of Artificial Sequence: Synthetic oligonucleotide
cgaccacgtgcgggaggaggc

SEQ ID NO: 227274 - DNA, 21 bp, Artificial Sequence
  Description of Artificial Sequence: Synthetic oligonucleotide
gaccacgtgcgggaggaggcc

SEQ ID NO: 227275 - DNA, 22 bp, Artificial Sequence
  Description of Artificial Sequence: Synthetic oligonucleotide
accacgtgcgggaggaggccca

SEQ ID NO: 227276 - DNA, 21 bp, Artificial Sequence
  Description of Artificial Sequence: Synthetic oligonucleotide
ccacgtgcgggaggaggccca

SEQ ID NO: 227277 - DNA, 23 bp, Artificial Sequence
  Description of Artificial Sequence: Synthetic oligonucleotide
cacgtgcgggaggaggcccagaa

SEQ ID NO: 227278 - DNA, 25 bp, Artificial Sequence
  Description of Artificial Sequence: Synthetic oligonucleotide
acgtgcgggaggaggcccagaagtt

SEQ ID NO: 227279 - DNA, 24 bp, Artificial Sequence
  Description of Artificial Sequence: Synthetic oligonucleotide
cgtgcgggaggaggcccagaagtt

SEQ ID NO: 227280 - DNA, 24 bp, Artificial Sequence
  Description of Artificial Sequence: Synthetic oligonucleotide
gtgcgggaggaggcccagaagttc

SEQ ID NO: 227281 - DNA, 25 bp, Artificial Sequence
  Description of Artificial Sequence: Synthetic oligonucleotide
tgcgggaggaggcccagaagttcct

SEQ ID NO: 227282 - DNA, 24 bp, Artificial Sequence
  Description of Artificial Sequence: Synthetic oligonucleotide
gcgggaggaggcccagaagttcct

SEQ ID NO: 227283 - DNA, 24 bp, Artificial Sequence
  Description of Artificial Sequence: Synthetic oligonucleotide
cgggaggaggcccagaagttcctg

SEQ ID NO: 227284 - DNA, 24 bp, Artificial Sequence
  Description of Artificial Sequence: Synthetic oligonucleotide
gggaggaggcccagaagttcctgc

SEQ ID NO: 227285 - DNA, 24 bp, Artificial Sequence
  Description of Artificial Sequence: Synthetic oligonucleotide
ggaggaggcccagaagttcctgcg

SEQ ID NO: 227286 - DNA, 24 bp, Artificial Sequence
  Description of Artificial Sequence: Synthetic oligonucleotide
gaggaggcccagaagttcctgcgg

SEQ ID NO: 227287 - DNA, 24 bp, Artificial Sequence
  Description of Artificial Sequence: Synthetic oligonucleotide
aggaggcccagaagttcctgcggg

SEQ ID NO: 227288 - DNA, 23 bp, Artificial Sequence
  Description of Artificial Sequence: Synthetic oligonucleotide
ggaggcccagaagttcctgcggg

SEQ ID NO: 227289 - DNA, 23 bp, Artificial Sequence
  Description of Artificial Sequence: Synthetic oligonucleotide
gaggcccagaagttcctgcgggg

SEQ ID NO: 227290 - DNA, 23 bp, Artificial Sequence
  Description of Artificial Sequence: Synthetic oligonucleotide
aggcccagaagttcctgcggggc

SEQ ID NO: 227291 - DNA, 22 bp, Artificial Sequence
  Description of Artificial Sequence: Synthetic oligonucleotide
ggcccagaagttcctgcggggc

SEQ ID NO: 227292 - DNA, 23 bp, Artificial Sequence
  Description of Artificial Sequence: Synthetic oligonucleotide
gcccagaagttcctgcggggcct

SEQ ID NO: 227293 - DNA, 23 bp, Artificial Sequence
  Description of Artificial Sequence: Synthetic oligonucleotide
cccagaagttcctgcggggcctg

SEQ ID NO: 227294 - DNA, 24 bp, Artificial Sequence
  Description of Artificial Sequence: Synthetic oligonucleotide
ccagaagttcctgcggggcctgca

SEQ ID NO: 227295 - DNA, 24 bp, Artificial Sequence
  Description of Artificial Sequence: Synthetic oligonucleotide
cagaagttcctgcggggcctgcag

SEQ ID NO: 227296 - DNA, 25 bp, Artificial Sequence
  Description of Artificial Sequence: Synthetic oligonucleotide
agaagttcctgcggggcctgcaggt

SEQ ID NO: 227297 - DNA, 24 bp, Artificial Sequence
  Description of Artificial Sequence: Synthetic oligonucleotide
gaagttcctgcggggcctgcaggt

SEQ ID NO: 227298 - DNA, 26 bp, Artificial Sequence
  Description of Artificial Sequence: Synthetic oligonucleotide
aagttcctgcggggcctgcaggtgaa

SEQ ID NO: 227299 - DNA, 25 bp, Artificial Sequence
  Description of Artificial Sequence: Synthetic oligonucleotide
agttcctgcggggcctgcaggtgaa

SEQ ID NO: 227300 - DNA, 24 bp, Artificial Sequence
  Description of Artificial Sequence: Synthetic oligonucleotide
gttcctgcggggcctgcaggtgaa

SEQ ID NO: 227301 - DNA, 24 bp, Artificial Sequence
  Description of Artificial Sequence: Synthetic oligonucleotide
ttcctgcggggcctgcaggtgaac

SEQ ID NO: 227302 - DNA, 23 bp, Artificial Sequence
  Description of Artificial Sequence: Synthetic oligonucleotide
tcctgcggggcctgcaggtgaac

SEQ ID NO: 227303 - DNA, 22 bp, Artificial Sequence
  Description of Artificial Sequence: Synthetic oligonucleotide
cctgcggggcctgcaggtgaac

SEQ ID NO: 227304 - DNA, 22 bp, Artificial Sequence
  Description of Artificial Sequence: Synthetic oligonucleotide
ctgcggggcctgcaggtgaacg

SEQ ID NO: 227305 - DNA, 22 bp, Artificial Sequence
  Description of Artificial Sequence: Synthetic oligonucleotide
tgcggggcctgcaggtgaacgg

SEQ ID NO: 227306 - DNA, 21 bp, Artificial Sequence
  Description of Artificial Sequence: Synthetic oligonucleotide
gcggggcctgcaggtgaacgg

SEQ ID NO: 227307 - DNA, 22 bp, Artificial Sequence
  Description of Artificial Sequence: Synthetic oligonucleotide
cggggcctgcaggtgaacggga

SEQ ID NO: 227308 - DNA, 22 bp, Artificial Sequence
  Description of Artificial Sequence: Synthetic oligonucleotide
ggggcctgcaggtgaacgggag

SEQ ID NO: 227309 - DNA, 22 bp, Artificial Sequence
  Description of Artificial Sequence: Synthetic oligonucleotide
gggcctgcaggtgaacgggagc

SEQ ID NO: 227310 - DNA, 22 bp, Artificial Sequence
  Description of Artificial Sequence: Synthetic oligonucleotide
ggcctgcaggtgaacgggagcc

SEQ ID NO: 227311 - DNA, 22 bp, Artificial Sequence
  Description of Artificial Sequence: Synthetic oligonucleotide
gcctgcaggtgaacgggagccg

SEQ ID NO: 227312 - DNA, 22 bp, Artificial Sequence
  Description of Artificial Sequence: Synthetic oligonucleotide
cctgcaggtgaacgggagccgg

SEQ ID NO: 227313 - DNA, 22 bp, Artificial Sequence
  Description of Artificial Sequence: Synthetic oligonucleotide
ctgcaggtgaacgggagccggc

SEQ ID NO: 227314 - DNA, 22 bp, Artificial Sequence
  Description of Artificial Sequence: Synthetic oligonucleotide
tgcaggtgaacgggagccggcc

SEQ ID NO: 227315 - DNA, 21 bp, Artificial Sequence
  Description of Artificial Sequence: Synthetic oligonucleotide
gcaggtgaacgggagccggcc

SEQ ID NO: 227316 - DNA, 21 bp, Artificial Sequence
  Description of Artificial Sequence: Synthetic oligonucleotide
caggtgaacgggagccggccg

SEQ ID NO: 227317 - DNA, 21 bp, Artificial Sequence
  Description of Artificial Sequence: Synthetic oligonucleotide
aggtgaacgggagccggccgg

SEQ ID NO: 227318 - DNA, 20 bp, Artificial Sequence
  Description of Artificial Sequence: Synthetic oligonucleotide
ggtgaacgggagccggccgg

SEQ ID NO: 227319 - DNA, 20 bp, Artificial Sequence
  Description of Artificial Sequence: Synthetic oligonucleotide
gtgaacgggagccggccggg

SEQ ID NO: 227320 - DNA, 21 bp, Artificial Sequence
  Description of Artificial Sequence: Synthetic oligonucleotide
tgaacgggagccggccgggca

SEQ ID NO: 227321 - DNA, 20 bp, Artificial Sequence
  Description of Artificial Sequence: Synthetic oligonucleotide
gaacgggagccggccgggca

SEQ ID NO: 227322 - DNA, 20 bp, Artificial Sequence
  Description of Artificial Sequence: Synthetic oligonucleotide
aacgggagccggccgggcac

SEQ ID NO: 227323 - DNA, 20 bp, Artificial Sequence
  Description of Artificial Sequence: Synthetic oligonucleotide
acgggagccggccgggcact

SEQ ID NO: 227324 - DNA, 20 bp, Artificial Sequence
  Description of Artificial Sequence: Synthetic oligonucleotide
cgggagccggccgggcactt

SEQ ID NO: 227325 - DNA, 21 bp, Artificial Sequence
  Description of Artificial Sequence: Synthetic oligonucleotide
gggagccggccgggcaccttt

SEQ ID NO: 227326 - DNA, 23 bp, Artificial Sequence
  Description of Artificial Sequence: Synthetic oligonucleotide
ggagccggccgggcacctttgta

SEQ ID NO: 227327 - DNA, 23 bp, Artificial Sequence
  Description of Artificial Sequence: Synthetic oligonucleotide
gagccggccgggcacctttgtag

SEQ ID NO: 227328 - DNA, 23 bp, Artificial Sequence
  Description of Artificial Sequence: Synthetic oligonucleotide
agccggccgggcacctttgtagg

SEQ ID NO: 227329 - DNA, 22 bp, Artificial Sequence
  Description of Artificial Sequence: Synthetic oligonucleotide
gccggccgggcacctttgtagg

SEQ ID NO: 227330 - DNA, 22 bp, Artificial Sequence
  Description of Artificial Sequence: Synthetic oligonucleotide
ccggccgggcacctttgtaggg

SEQ ID NO: 227331 - DNA, 23 bp, Artificial Sequence
  Description of Artificial Sequence: Synthetic oligonucleotide
cggccgggcacctttgtaggggt

SEQ ID NO: 227332 - DNA, 23 bp, Artificial Sequence
  Description of Artificial Sequence: Synthetic oligonucleotide
ggccgggcacctttgtaggggtc

SEQ ID NO: 227333 - DNA, 25 bp, Artificial Sequence
  Description of Artificial Sequence: Synthetic oligonucleotide
gccgggcacctttgtaggggtccat

SEQ ID NO: 227334 - DNA, 27 bp, Artificial Sequence
  Description of Artificial Sequence: Synthetic oligonucleotide
ccgggcacctttgtaggggtccatgtt

SEQ ID NO: 227335 - DNA, 27 bp, Artificial Sequence
  Description of Artificial Sequence: Synthetic oligonucleotide
cgggcacctttgtaggggtccatgttc

SEQ ID NO: 227336 - DNA, 27 bp, Artificial Sequence
  Description of Artificial Sequence: Synthetic oligonucleotide
gggcacctttgtaggggtccatgttcg

SEQ ID NO: 227337 - DNA, 27 bp, Artificial Sequence
  Description of Artificial Sequence: Synthetic oligonucleotide
ggcacctttgtaggggtccatgttcgc

SEQ ID NO: 227338 - DNA, 27 bp, Artificial Sequence
  Description of Artificial Sequence: Synthetic oligonucleotide
gcacctttgtaggggtccatgttcgcc

SEQ ID NO: 227339 - DNA, 27 bp, Artificial Sequence
  Description of Artificial Sequence: Synthetic oligonucleotide
cacctttgtaggggtccatgttcgccg

SEQ ID NO: 227340 - DNA, 28 bp, Artificial Sequence
  Description of Artificial Sequence: Synthetic oligonucleotide
acctttgtaggggtccatgttcgccgag

SEQ ID NO: 227341 - DNA, 27 bp, Artificial Sequence
  Description of Artificial Sequence: Synthetic oligonucleotide
cctttgtaggggtccatgttcgccgag

SEQ ID NO: 227342 - DNA, 27 bp, Artificial Sequence
  Description of Artificial Sequence: Synthetic oligonucleotide
ctttgtaggggtccatgttcgccgagg

SEQ ID NO: 227343 - DNA, 27 bp, Artificial Sequence
  Description of Artificial Sequence: Synthetic oligonucleotide
tttgtaggggtccatgttcgccgaggg

SEQ ID NO: 227344 - DNA, 26 bp, Artificial Sequence
  Description of Artificial Sequence: Synthetic oligonucleotide
ttgtaggggtccatgttcgccgaggg

SEQ ID NO: 227345 - DNA, 25 bp, Artificial Sequence
  Description of Artificial Sequence: Synthetic oligonucleotide
tgtaggggtccatgttcgccgaggg

SEQ ID NO: 227346 - DNA, 24 bp, Artificial Sequence
  Description of Artificial Sequence: Synthetic oligonucleotide
gtaggggtccatgttcgccgaggg

SEQ ID NO: 227347 - DNA, 25 bp, Artificial Sequence
  Description of Artificial Sequence: Synthetic oligonucleotide
taggggtccatgttcgccgagggga

SEQ ID NO: 227348 - DNA, 24 bp, Artificial Sequence
  Description of Artificial Sequence: Synthetic oligonucleotide
aggggtccatgttcgccgagggga

SEQ ID NO: 227349 - DNA, 23 bp, Artificial Sequence
  Description of Artificial Sequence: Synthetic oligonucleotide
ggggtccatgttcgccgagggga

SEQ ID NO: 227350 - DNA, 26 bp, Artificial Sequence
  Description of Artificial Sequence: Synthetic oligonucleotide
gggtccatgttcgccgaggggactat

SEQ ID NO: 227351 - DNA, 27 bp, Artificial Sequence
  Description of Artificial Sequence: Synthetic oligonucleotide
ggtccatgttcgccgaggggactatgt

SEQ ID NO: 227352 - DNA, 27 bp, Artificial Sequence
  Description of Artificial Sequence: Synthetic oligonucleotide
gtccatgttcgccgaggggactatgtc

SEQ ID NO: 227353 - DNA, 27 bp, Artificial Sequence
  Description of Artificial Sequence: Synthetic oligonucleotide
tccatgttcgccgaggggactatgtcc

SEQ ID NO: 227354 - DNA, 27 bp, Artificial Sequence
  Description of Artificial Sequence: Synthetic oligonucleotide
ccatgttcgccgaggggactatgtcca

SEQ ID NO: 227355 - DNA, 28 bp, Artificial Sequence
  Description of Artificial Sequence: Synthetic oligonucleotide
catgttcgccgaggggactatgtccatg

SEQ ID NO: 227356 - DNA, 29 bp, Artificial Sequence
  Description of Artificial Sequence: Synthetic oligonucleotide
atgttcgccgaggggactatgtccatgtc

SEQ ID NO: 227357 - DNA, 28 bp, Artificial Sequence
  Description of Artificial Sequence: Synthetic oligonucleotide
tgttcgccgaggggactatgtccatgtc

SEQ ID NO: 227358 - DNA, 27 bp, Artificial Sequence
  Description of Artificial Sequence: Synthetic oligonucleotide
gttcgccgaggggactatgtccatgtc

SEQ ID NO: 227359 - DNA, 29 bp, Artificial Sequence
  Description of Artificial Sequence: Synthetic oligonucleotide
ttcgccgaggggactatgtccatgtcatg

SEQ ID NO: 227360 - DNA, 28 bp, Artificial Sequence
  Description of Artificial Sequence: Synthetic oligonucleotide
tcgccgaggggactatgtccatgtcatg

SEQ ID NO: 227361 - DNA, 27 bp, Artificial Sequence
  Description of Artificial Sequence: Synthetic oligonucleotide
cgccgaggggactatgtccatgtcatg

SEQ ID NO: 227362 - DNA, 27 bp, Artificial Sequence
  Description of Artificial Sequence: Synthetic oligonucleotide
gccgaggggactatgtccatgtcatgc

SEQ ID NO: 227363 - DNA, 27 bp, Artificial Sequence
  Description of Artificial Sequence: Synthetic oligonucleotide
ccgaggggactatgtccatgtcatgcc

SEQ ID NO: 227364 - DNA, 31 bp, Artificial Sequence
  Description of Artificial Sequence: Synthetic oligonucleotide
cgaggggactatgtccatgtcatgccaaaag

SEQ ID NO: 227365 - DNA, 32 bp, Artificial Sequence
  Description of Artificial Sequence: Synthetic oligonucleotide
gaggggactatgtccatgtcatgccaaaagtg

SEQ ID NO: 227366 - DNA, 33 bp, Artificial Sequence
  Description of Artificial Sequence: Synthetic oligonucleotide
aggggactatgtccatgtcatgccaaaagtgtg

SEQ ID NO: 227367 - DNA, 32 bp, Artificial Sequence
  Description of Artificial Sequence: Synthetic oligonucleotide
ggggactatgtccatgtcatgccaaaagtgtg

SEQ ID NO: 227368 - DNA, 32 bp, Artificial Sequence
  Description of Artificial Sequence: Synthetic oligonucleotide
gggactatgtccatgtcatgccaaaagtgtgg

SEQ ID NO: 227369 - DNA, 34 bp, Artificial Sequence
  Description of Artificial Sequence: Synthetic oligonucleotide
ggactatgtccatgtcatgccaaaagtgtggaag

SEQ ID NO: 227370 - DNA, 34 bp, Artificial Sequence
  Description of Artificial Sequence: Synthetic oligonucleotide
gactatgtccatgtcatgccaaaagtgtggaagg

SEQ ID NO: 227371 - DNA, 34 bp, Artificial Sequence
  Description of Artificial Sequence: Synthetic oligonucleotide
actatgtccatgtcatgccaaaagtgtggaaggg

SEQ ID NO: 227372 - DNA, 33 bp, Artificial Sequence
  Description of Artificial Sequence: Synthetic oligonucleotide
ctatgtccatgtcatgccaaaagtgtggaaggg

SEQ ID NO: 227373 - DNA, 33 bp, Artificial Sequence
  Description of Artificial Sequence: Synthetic oligonucleotide
tatgtccatgtcatgccaaaagtgtggaagggg

SEQ ID NO: 227374 - DNA, 32 bp, Artificial Sequence
  Description of Artificial Sequence: Synthetic oligonucleotide
atgtccatgtcatgccaaaagtgtggaagggg

SEQ ID NO: 227375 - DNA, 31 bp, Artificial Sequence
  Description of Artificial Sequence: Synthetic oligonucleotide
tgtccatgtcatgccaaaagtgtggaagggg

SEQ ID NO: 227376 - DNA, 30 bp, Artificial Sequence
  Description of Artificial Sequence: Synthetic oligonucleotide
gtccatgtcatgccaaaagtgtggaagggg

SEQ ID NO: 227377 - DNA, 30 bp, Artificial Sequence
  Description of Artificial Sequence: Synthetic oligonucleotide
tccatgtcatgccaaaagtgtggaaggggg

SEQ ID NO: 227378 - DNA, 29 bp, Artificial Sequence
  Description of Artificial Sequence: Synthetic oligonucleotide
ccatgtcatgccaaaagtgtggaaggggg

SEQ ID NO: 227379 - DNA, 30 bp, Artificial Sequence
  Description of Artificial Sequence: Synthetic oligonucleotide
catgtcatgccaaaagtgtggaagggggtg

SEQ ID NO: 227380 - DNA, 30 bp, Artificial Sequence
  Description of Artificial Sequence: Synthetic oligonucleotide
atgtcatgccaaaagtgtggaagggggtgg

SEQ ID NO: 227381 - DNA, 29 bp, Artificial Sequence
  Description of Artificial Sequence: Synthetic oligonucleotide
tgtcatgccaaaagtgtggaagggggtgg

SEQ ID NO: 227382 - DNA, 28 bp, Artificial Sequence
  Description of Artificial Sequence: Synthetic oligonucleotide
gtcatgccaaaagtgtggaagggggtgg

SEQ ID NO: 227383 - DNA, 29 bp, Artificial Sequence
  Description of Artificial Sequence: Synthetic oligonucleotide
tcatgccaaaagtgtggaagggggtggtg

SEQ ID NO: 227384 - DNA, 28 bp, Artificial Sequence
  Description of Artificial Sequence: Synthetic oligonucleotide
catgccaaaagtgtggaagggggtggtg

SEQ ID NO: 227385 - DNA, 28 bp, Artificial Sequence
  Description of Artificial Sequence: Synthetic oligonucleotide
atgccaaaagtgtggaagggggtggtgg

SEQ ID NO: 227386 - DNA, 27 bp, Artificial Sequence
  Description of Artificial Sequence: Synthetic oligonucleotide
tgccaaaagtgtggaagggggtggtgg

SEQ ID NO: 227387 - DNA, 26 bp, Artificial Sequence
  Description of Artificial Sequence: Synthetic oligonucleotide
gccaaaagtgtggaagggggtggtgg

SEQ ID NO: 227388 - DNA, 26 bp, Artificial Sequence
  Description of Artificial Sequence: Synthetic oligonucleotide
ccaaaagtgtggaagggggtggtggc

SEQ ID NO: 227389 - DNA, 26 bp, Artificial Sequence
  Description of Artificial Sequence: Synthetic oligonucleotide
caaaagtgtggaagggggtggtggcc

SEQ ID NO: 227390 - DNA, 27 bp, Artificial Sequence
  Description of Artificial Sequence: Synthetic oligonucleotide
aaaagtgtggaagggggtggtggccga

SEQ ID NO: 227391 - DNA, 26 bp, Artificial Sequence
  Description of Artificial Sequence: Synthetic oligonucleotide
aaagtgtggaagggggtggtggccga

SEQ ID NO: 227392 - DNA, 25 bp, Artificial Sequence
  Description of Artificial Sequence: Synthetic oligonucleotide
aagtgtggaagggggtggtggccga

SEQ ID NO: 227393 - DNA, 24 bp, Artificial Sequence
  Description of Artificial Sequence: Synthetic oligonucleotide
agtgtggaagggggtggtggccga

SEQ ID NO: 227394 - DNA, 23 bp, Artificial Sequence
  Description of Artificial Sequence: Synthetic oligonucleotide
gtgtggaagggggtggtggccga

SEQ ID NO: 227395 - DNA, 23 bp, Artificial Sequence
  Description of Artificial Sequence: Synthetic oligonucleotide
tgtggaagggggtggtggccgac

SEQ ID NO: 227396 - DNA, 22 bp, Artificial Sequence
  Description of Artificial Sequence: Synthetic oligonucleotide
gtggaagggggtggtggccgac

SEQ ID NO: 227397 - DNA, 22 bp, Artificial Sequence
  Description of Artificial Sequence: Synthetic oligonucleotide
tggaagggggtggtggccgacc

SEQ ID NO: 227398 - DNA, 21 bp, Artificial Sequence
  Description of Artificial Sequence: Synthetic oligonucleotide
ggaagggggtggtggccgacc

SEQ ID NO: 227399 - DNA, 21 bp, Artificial Sequence
  Description of Artificial Sequence: Synthetic oligonucleotide
gaagggggtggtggccgaccg

SEQ ID NO: 227400 - DNA, 21 bp, Artificial Sequence
  Description of Artificial Sequence: Synthetic oligonucleotide
aagggggtggtggccgaccgg

SEQ ID NO: 227401 - DNA, 20 bp, Artificial Sequence
  Description of Artificial Sequence: Synthetic oligonucleotide
agggggtggtggccgaccgg

SEQ ID NO: 227402 - DNA, 20 bp, Artificial Sequence
  Description of Artificial Sequence: Synthetic oligonucleotide
gggggtggtggccgaccggt

SEQ ID NO: 227403 - DNA, 20 bp, Artificial Sequence
  Description of Artificial Sequence: Synthetic oligonucleotide
ggggtggtggccgaccggct

SEQ ID NO: 227404 - DNA, 22 bp, Artificial Sequence
  Description of Artificial Sequence: Synthetic oligonucleotide
gggtggtggccgaccggcgata

SEQ ID NO: 227405 - DNA, 22 bp, Artificial Sequence
  Description of Artificial Sequence: Synthetic oligonucleotide
ggtggtggccgaccggcgatac

SEQ ID NO: 227406 - DNA, 24 bp, Artificial Sequence
  Description of Artificial Sequence: Synthetic oligonucleotide
gtggtggccgaccggcgataccta

SEQ ID NO: 227407 - DNA, 25 bp, Artificial Sequence
  Description of Artificial Sequence: Synthetic oligonucleotide
tggtggccgaccggcgatacctaca

SEQ ID NO: 227408 - DNA, 24 bp, Artificial Sequence
  Description of Artificial Sequence: Synthetic oligonucleotide
ggtggccgaccggcgatacctaca

SEQ ID NO: 227409 - DNA, 24 bp, Artificial Sequence
  Description of Artificial Sequence: Synthetic oligonucleotide
gtggccgaccggcgatacctacag

SEQ ID NO: 227410 - DNA, 25 bp, Artificial Sequence
  Description of Artificial Sequence: Synthetic oligonucleotide
tggccgaccggcgatacctacagca

SEQ ID NO: 227411 - DNA, 24 bp, Artificial Sequence
  Description of Artificial Sequence: Synthetic oligonucleotide
ggccgaccggcgatacctacagca

SEQ ID NO: 227412 - DNA, 24 bp, Artificial Sequence
  Description of Artificial Sequence: Synthetic oligonucleotide
gccgaccggcgatacctacagcag

SEQ ID NO: 227413 - DNA, 24 bp, Artificial Sequence
  Description of Artificial Sequence: Synthetic oligonucleotide
ccgaccggcgatacctacagcagg

SEQ ID NO: 227414 - DNA, 24 bp, Artificial Sequence
  Description of Artificial Sequence: Synthetic oligonucleotide
cgaccggcgatacctacagcaggc

SEQ ID NO: 227415 - DNA, 24 bp, Artificial Sequence
  Description of Artificial Sequence: Synthetic oligonucleotide
gaccggcgatacctacagcaggcc

SEQ ID NO: 227416 - DNA, 25 bp, Artificial Sequence
  Description of Artificial Sequence: Synthetic oligonucleotide
accggcgatacctacagcaggccct

SEQ ID NO: 227417 - DNA, 24 bp, Artificial Sequence
  Description of Artificial Sequence: Synthetic oligonucleotide
ccggcgatacctacagcaggccct

SEQ ID NO: 227418 - DNA, 24 bp, Artificial Sequence
  Description of Artificial Sequence: Synthetic oligonucleotide
cggcgatacctacagcaggccctg

SEQ ID NO: 227419 - DNA, 25 bp, Artificial Sequence
  Description of Artificial Sequence: Synthetic oligonucleotide
ggcgatacctacagcaggccctgga

SEQ ID NO: 227420 - DNA, 26 bp, Artificial Sequence
  Description of Artificial Sequence: Synthetic oligonucleotide
gcgatacctacagcaggccctggact

SEQ ID NO: 227421 - DNA, 26 bp, Artificial Sequence
  Description of Artificial Sequence: Synthetic oligonucleotide
cgatacctacagcaggccctggactg

SEQ ID NO: 227422 - DNA, 27 bp, Artificial Sequence
  Description of Artificial Sequence: Synthetic oligonucleotide
gatacctacagcaggccctggactggt

SEQ ID NO: 227423 - DNA, 28 bp, Artificial Sequence
  Description of Artificial Sequence: Synthetic oligonucleotide
atacctacagcaggccctggactggttc

SEQ ID NO: 227424 - DNA, 27 bp, Artificial Sequence
  Description of Artificial Sequence: Synthetic oligonucleotide
tacctacagcaggccctggactggttc

SEQ ID NO: 227425 - DNA, 26 bp, Artificial Sequence
  Description of Artificial Sequence: Synthetic oligonucleotide
acctacagcaggccctggactggttc

SEQ ID NO: 227426 - DNA, 25 bp, Artificial Sequence
  Description of Artificial Sequence: Synthetic oligonucleotide
cctacagcaggccctggactggttc

SEQ ID NO: 227427 - DNA, 25 bp, Artificial Sequence
  Description of Artificial Sequence: Synthetic oligonucleotide
ctacagcaggccctggactggttcc

SEQ ID NO: 227428 - DNA, 26 bp, Artificial Sequence
  Description of Artificial Sequence: Synthetic oligonucleotide
tacagcaggccctggactggttccga

SEQ ID NO: 227429 - DNA, 25 bp, Artificial Sequence
  Description of Artificial Sequence: Synthetic oligonucleotide
acagcaggccctggactggttccga

SEQ ID NO: 227430 - DNA, 24 bp, Artificial Sequence
  Description of Artificial Sequence: Synthetic oligonucleotide
cagcaggccctggactggttccga

SEQ ID NO: 227431 - DNA, 24 bp, Artificial Sequence
  Description of Artificial Sequence: Synthetic oligonucleotide
agcaggccctggactggttccgag

SEQ ID NO: 227432 - DNA, 23 bp, Artificial Sequence
  Description of Artificial Sequence: Synthetic oligonucleotide
gcaggccctggactggttccgag

SEQ ID NO: 227433 - DNA, 24 bp, Artificial Sequence
  Description of Artificial Sequence: Synthetic oligonucleotide
caggccctggactggttccgagct

SEQ ID NO: 227434 - DNA, 24 bp, Artificial Sequence
  Description of Artificial Sequence: Synthetic oligonucleotide
aggccctggactggttccgagctc

SEQ ID NO: 227435 - DNA, 23 bp, Artificial Sequence
  Description of Artificial Sequence: Synthetic oligonucleotide
ggccctggactggttccgagctc

SEQ ID NO: 227436 - DNA, 23 bp, Artificial Sequence
  Description of Artificial Sequence: Synthetic oligonucleotide
gccctggactggttccgagctcg

SEQ ID NO: 227437 - DNA, 25 bp, Artificial Sequence
  Description of Artificial Sequence: Synthetic oligonucleotide
ccctggactggttccgagctcgcta

SEQ ID NO: 227438 - DNA, 26 bp, Artificial Sequence
  Description of Artificial Sequence: Synthetic oligonucleotide
cctggactggttccgagctcgctaca

SEQ ID NO: 227439 - DNA, 26 bp, Artificial Sequence
  Description of Artificial Sequence: Synthetic oligonucleotide
ctggactggttccgagctcgctacag

SEQ ID NO: 227440 - DNA, 27 bp, Artificial Sequence
  Description of Artificial Sequence: Synthetic oligonucleotide
tggactggttccgagctcgctacagct

SEQ ID NO: 227441 - DNA, 26 bp, Artificial Sequence
  Description of Artificial Sequence: Synthetic oligonucleotide
ggactggttccgagctcgctacagct

SEQ ID NO: 227442 - DNA, 26 bp, Artificial Sequence
  Description of Artificial Sequence: Synthetic oligonucleotide
gactggttccgagctcgctacagctc

SEQ ID NO: 227443 - DNA, 26 bp, Artificial Sequence
  Description of Artificial Sequence: Synthetic oligonucleotide
actggttccgagctcgctacagctcc

SEQ ID NO: 227444 - DNA, 25 bp, Artificial Sequence
  Description of Artificial Sequence: Synthetic oligonucleotide
ctggttccgagctcgctacagctcc

SEQ ID NO: 227445 - DNA, 26 bp, Artificial Sequence
  Description of Artificial Sequence: Synthetic oligonucleotide
tggttccgagctcgctacagctccct

SEQ ID NO: 227446 - DNA, 25 bp, Artificial Sequence
  Description of Artificial Sequence: Synthetic oligonucleotide
ggttccgagctcgctacagctccct

SEQ ID NO: 227447 - DNA, 27 bp, Artificial Sequence
  Description of Artificial Sequence: Synthetic oligonucleotide
gttccgagctcgctacagctccctcat

SEQ ID NO: 227448 - DNA, 27 bp, Artificial Sequence
  Description of Artificial Sequence: Synthetic oligonucleotide
ttccgagctcgctacagctccctcatc

SEQ ID NO: 227449 - DNA, 27 bp, Artificial Sequence
  Description of Artificial Sequence: Synthetic oligonucleotide
tccgagctcgctacagctccctcatct

SEQ ID NO: 227450 - DNA, 27 bp, Artificial Sequence
  Description of Artificial Sequence: Synthetic oligonucleotide
ccgagctcgctacagctccctcatctt

SEQ ID NO: 227451 - DNA, 27 bp, Artificial Sequence
  Description of Artificial Sequence: Synthetic oligonucleotide
cgagctcgctacagctccctcatcttc

SEQ ID NO: 227452 - DNA, 27 bp, Artificial Sequence
  Description of Artificial Sequence: Synthetic oligonucleotide
gagctcgctacagctccctcatcttcg

SEQ ID NO: 227453 - DNA, 28 bp, Artificial Sequence
  Description of Artificial Sequence: Synthetic oligonucleotide
agctcgctacagctccctcatcttcgtg

SEQ ID NO: 227454 - DNA, 27 bp, Artificial Sequence
  Description of Artificial Sequence: Synthetic oligonucleotide
gctcgctacagctccctcatcttcgtg

SEQ ID NO: 227455 - DNA, 27 bp, Artificial Sequence
  Description of Artificial Sequence: Synthetic oligonucleotide
ctcgctacagctccctcatcttcgtgg

SEQ ID NO: 227456 - DNA, 28 bp, Artificial Sequence
  Description of Artificial Sequence: Synthetic oligonucleotide
tcgctacagctccctcatcttcgtggtc

SEQ ID NO: 227457 - DNA, 27 bp, Artificial Sequence
  Description of Artificial Sequence: Synthetic oligonucleotide
cgctacagctccctcatcttcgtggtc

SEQ ID NO: 227458 - DNA, 28 bp, Artificial Sequence
  Description of Artificial Sequence: Synthetic oligonucleotide
gctacagctccctcatcttcgtggtcac

SEQ ID NO: 227459 - DNA, 28 bp, Artificial Sequence
  Description of Artificial Sequence: Synthetic oligonucleotide
ctacagctccctcatcttcgtggtcacc

SEQ ID NO: 227460 - DNA, 29 bp, Artificial Sequence
  Description of Artificial Sequence: Synthetic oligonucleotide
tacagctccctcatcttcgtggtcaccag

SEQ ID NO: 227461 - DNA, 28 bp, Artificial Sequence
  Description of Artificial Sequence: Synthetic oligonucleotide
acagctccctcatcttcgtggtcaccag

SEQ ID NO: 227462 - DNA, 27 bp, Artificial Sequence
  Description of Artificial Sequence: Synthetic oligonucleotide
cagctccctcatcttcgtggtcaccag

SEQ ID NO: 227463 - DNA, 31 bp, Artificial Sequence
  Description of Artificial Sequence: Synthetic oligonucleotide
agctccctcatcttcgtggtcaccagtaatg

SEQ ID NO: 227464 - DNA, 30 bp, Artificial Sequence
  Description of Artificial Sequence: Synthetic oligonucleotide
gctccctcatcttcgtggtcaccagtaatg

SEQ ID NO: 227465 - DNA, 30 bp, Artificial Sequence
  Description of Artificial Sequence: Synthetic oligonucleotide
ctccctcatcttcgtggtcaccagtaatgg

SEQ ID NO: 227466 - DNA, 30 bp, Artificial Sequence
  Description of Artificial Sequence: Synthetic oligonucleotide
tccctcatcttcgtggtcaccagtaatggc

SEQ ID NO: 227467 - DNA, 29 bp, Artificial Sequence
  Description of Artificial Sequence: Synthetic oligonucleotide
ccctcatcttcgtggtcaccagtaatggc

SEQ ID NO: 227468 - DNA, 31 bp, Artificial Sequence
  Description of Artificial Sequence: Synthetic oligonucleotide
cctcatcttcgtggtcaccagtaatggcatg

SEQ ID NO: 227469 - DNA, 31 bp, Artificial Sequence
  Description of Artificial Sequence: Synthetic oligonucleotide
ctcatcttcgtggtcaccagtaatggcatgg

SEQ ID NO: 227470 - DNA, 31 bp, Artificial Sequence
  Description of Artificial Sequence: Synthetic oligonucleotide
tcatcttcgtggtcaccagtaatggcatggc

SEQ ID NO: 227471 - DNA, 30 bp, Artificial Sequence
  Description of Artificial Sequence: Synthetic oligonucleotide
catcttcgtggtcaccagtaatggcatggc

SEQ ID NO: 227472 - DNA, 30 bp, Artificial Sequence
  Description of Artificial Sequence: Synthetic oligonucleotide
atcttcgtggtcaccagtaatggcatggcc

SEQ ID NO: 227473 - DNA, 29 bp, Artificial Sequence
  Description of Artificial Sequence: Synthetic oligonucleotide
tcttcgtggtcaccagtaatggcatggcc

SEQ ID NO: 227474 - DNA, 28 bp, Artificial Sequence
  Description of Artificial Sequence: Synthetic oligonucleotide
cttcgtggtcaccagtaatggcatggcc

SEQ ID NO: 227475 - DNA, 29 bp, Artificial Sequence
  Description of Artificial Sequence: Synthetic oligonucleotide
ttcgtggtcaccagtaatggcatggcctg

SEQ ID NO: 227476 - DNA, 28 bp, Artificial Sequence
  Description of Artificial Sequence: Synthetic oligonucleotide
tcgtggtcaccagtaatggcatggcctg

SEQ ID NO: 227477 - DNA, 27 bp, Artificial Sequence
  Description of Artificial Sequence: Synthetic oligonucleotide
cgtggtcaccagtaatggcatggcctg

SEQ ID NO: 227478 - DNA, 27 bp, Artificial Sequence
  Description of Artificial Sequence: Synthetic oligonucleotide
gtggtcaccagtaatggcatggcctgg

SEQ ID NO: 227479 - DNA, 28 bp, Artificial Sequence
  Description of Artificial Sequence: Synthetic oligonucleotide
tggtcaccagtaatggcatggcctggtg

SEQ ID NO: 227480 - DNA, 27 bp, Artificial Sequence
  Description of Artificial Sequence: Synthetic oligonucleotide
ggtcaccagtaatggcatggcctggtg

SEQ ID NO: 227481 - DNA, 28 bp, Artificial Sequence
  Description of Artificial Sequence: Synthetic oligonucleotide
gtcaccagtaatggcatggcctggtgtc

SEQ ID NO: 227482 - DNA, 28 bp, Artificial Sequence
  Description of Artificial Sequence: Synthetic oligonucleotide
tcaccagtaatggcatggcctggtgtcg

SEQ ID NO: 227483 - DNA, 27 bp, Artificial Sequence
  Description of Artificial Sequence: Synthetic oligonucleotide
caccagtaatggcatggcctggtgtcg

SEQ ID NO: 227484 - DNA, 27 bp, Artificial Sequence
  Description of Artificial Sequence: Synthetic oligonucleotide
accagtaatggcatggcctggtgtcgg

SEQ ID NO: 227485 - DNA, 26 bp, Artificial Sequence
  Description of Artificial Sequence: Synthetic oligonucleotide
ccagtaatggcatggcctggtgtcgg

SEQ ID NO: 227486 - DNA, 27 bp, Artificial Sequence
  Description of Artificial Sequence: Synthetic oligonucleotide
cagtaatggcatggcctggtgtcggga

SEQ ID NO: 227487 - DNA, 27 bp, Artificial Sequence
  Description of Artificial Sequence: Synthetic oligonucleotide
agtaatggcatggcctggtgtcgggag

SEQ ID NO: 227488 - DNA, 27 bp, Artificial Sequence
  Description of Artificial Sequence: Synthetic oligonucleotide
gtaatggcatggcctggtgtcgggaga

SEQ ID NO: 227489 - DNA, 28 bp, Artificial Sequence
  Description of Artificial Sequence: Synthetic oligonucleotide
taatggcatggcctggtgtcgggagaac

SEQ ID NO: 227490 - DNA, 27 bp, Artificial Sequence
  Description of Artificial Sequence: Synthetic oligonucleotide
aatggcatggcctggtgtcgggagaac

SEQ ID NO: 227491 - DNA, 27 bp, Artificial Sequence
  Description of Artificial Sequence: Synthetic oligonucleotide
atggcatggcctggtgtcgggagaaca

SEQ ID NO: 227492 - DNA, 27 bp, Artificial Sequence
  Description of Artificial Sequence: Synthetic oligonucleotide
tggcatggcctggtgtcgggagaacat

SEQ ID NO: 227493 - DNA, 27 bp, Artificial Sequence
  Description of Artificial Sequence: Synthetic oligonucleotide
ggcatggcctggtgtcgggagaacatt

SEQ ID NO: 227494 - DNA, 27 bp, Artificial Sequence
  Description of Artificial Sequence: Synthetic oligonucleotide
gcatggcctggtgtcgggagaacattg

SEQ ID NO: 227495 - DNA, 28 bp, Artificial Sequence
  Description of Artificial Sequence: Synthetic oligonucleotide
catggcctggtgtcgggagaacattgac

SEQ ID NO: 227496 - DNA, 29 bp, Artificial Sequence
  Description of Artificial Sequence: Synthetic oligonucleotide
atggcctggtgtcgggagaacattgacac

SEQ ID NO: 227497 - DNA, 28 bp, Artificial Sequence
  Description of Artificial Sequence: Synthetic oligonucleotide
tggcctggtgtcgggagaacattgacac

SEQ ID NO: 227498 - DNA, 27 bp, Artificial Sequence
  Description of Artificial Sequence: Synthetic oligonucleotide
ggcctggtgtcgggagaacattgacac

SEQ ID NO: 227499 - DNA, 27 bp, Artificial Sequence
  Description of Artificial Sequence: Synthetic oligonucleotide
gcctggtgtcgggagaacattgacacc

SEQ ID NO: 227500 - DNA, 28 bp, Artificial Sequence
  Description of Artificial Sequence: Synthetic oligonucleotide
cctggtgtcgggagaacattgacacctc

SEQ ID NO: 227501 - DNA, 28 bp, Artificial Sequence
  Description of Artificial Sequence: Synthetic oligonucleotide
ctggtgtcgggagaacattgacacctcc

SEQ ID NO: 227502 - DNA, 28 bp, Artificial Sequence
  Description of Artificial Sequence: Synthetic oligonucleotide
tggtgtcgggagaacattgacacctccc

SEQ ID NO: 227503 - DNA, 27 bp, Artificial Sequence
  Description of Artificial Sequence: Synthetic oligonucleotide
ggtgtcgggagaacattgacacctccc

SEQ ID NO: 227504 - DNA, 28 bp, Artificial Sequence
  Description of Artificial Sequence: Synthetic oligonucleotide
gtgtcgggagaacattgacacctcccac

SEQ ID NO: 227505 - DNA, 28 bp, Artificial Sequence
  Description of Artificial Sequence: Synthetic oligonucleotide
tgtcgggagaacattgacacctcccacg

SEQ ID NO: 227506 - DNA, 27 bp, Artificial Sequence
  Description of Artificial Sequence: Synthetic oligonucleotide
gtcgggagaacattgacacctcccacg

SEQ ID NO: 227507 - DNA, 27 bp, Artificial Sequence
  Description of Artificial Sequence: Synthetic oligonucleotide
tcgggagaacattgacacctcccacgg

SEQ ID NO: 227508 - DNA, 27 bp, Artificial Sequence
  Description of Artificial Sequence: Synthetic oligonucleotide
cgggagaacattgacacctcccacggt

SEQ ID NO: 227509 - DNA, 27 bp, Artificial Sequence
  Description of Artificial Sequence: Synthetic oligonucleotide
gggagaacattgacacctcccacggtg

SEQ ID NO: 227510 - DNA, 29 bp, Artificial Sequence
  Description of Artificial Sequence: Synthetic oligonucleotide
ggagaacattgacacctcccacggtgatg

SEQ ID NO: 227511 - DNA, 30 bp, Artificial Sequence
  Description of Artificial Sequence: Synthetic oligonucleotide
gagaacattgacacctcccacggtgatgtg

SEQ ID NO: 227512 - DNA, 30 bp, Artificial Sequence
  Description of Artificial Sequence: Synthetic oligonucleotide
agaacattgacacctcccacggtgatgtgg

SEQ ID NO: 227513 - DNA, 29 bp, Artificial Sequence
  Description of Artificial Sequence: Synthetic oligonucleotide
gaacattgacacctcccacggtgatgtgg

SEQ ID NO: 227514 - DNA, 30 bp, Artificial Sequence
  Description of Artificial Sequence: Synthetic oligonucleotide
aacattgacacctcccacggtgatgtggtg

SEQ ID NO: 227515 - DNA, 29 bp, Artificial Sequence
  Description of Artificial Sequence: Synthetic oligonucleotide
acattgacacctcccacggtgatgtggtg

SEQ ID NO: 227516 - DNA, 28 bp, Artificial Sequence
  Description of Artificial Sequence: Synthetic oligonucleotide
cattgacacctcccacggtgatgtggtg

SEQ ID NO: 227517 - DNA, 31 bp, Artificial Sequence
  Description of Artificial Sequence: Synthetic oligonucleotide
attgacacctcccacggtgatgtggtgtttg

SEQ ID NO: 227518 - DNA, 30 bp, Artificial Sequence
  Description of Artificial Sequence: Synthetic oligonucleotide
ttgacacctcccacggtgatgtggtgtttg

SEQ ID NO: 227519 - DNA, 29 bp, Artificial Sequence
  Description of Artificial Sequence: Synthetic oligonucleotide
tgacacctcccacggtgatgtggtgtttg

SEQ ID NO: 227520 - DNA, 28 bp, Artificial Sequence
  Description of Artificial Sequence: Synthetic oligonucleotide
gacacctcccacggtgatgtggtgtttg

SEQ ID NO: 227521 - DNA, 28 bp, Artificial Sequence
  Description of Artificial Sequence: Synthetic oligonucleotide
acacctcccacggtgatgtggtgtttgc

SEQ ID NO: 227522 - DNA, 27 bp, Artificial Sequence
  Description of Artificial Sequence: Synthetic oligonucleotide
cacctcccacggtgatgtggtgtttgc

SEQ ID NO: 227523 - DNA, 28 bp, Artificial Sequence
  Description of Artificial Sequence: Synthetic oligonucleotide
acctcccacggtgatgtggtgtttgctg

SEQ ID NO: 227524 - DNA, 27 bp, Artificial Sequence
  Description of Artificial Sequence: Synthetic oligonucleotide
cctcccacggtgatgtggtgtttgctg

SEQ ID NO: 227525 - DNA, 27 bp, Artificial Sequence
  Description of Artificial Sequence: Synthetic oligonucleotide
ctcccacggtgatgtggtgtttgctgg

SEQ ID NO: 227526 - DNA, 27 bp, Artificial Sequence
  Description of Artificial Sequence: Synthetic oligonucleotide
tcccacggtgatgtggtgtttgctggc

SEQ ID NO: 227527 - DNA, 26 bp, Artificial Sequence
  Description of Artificial Sequence: Synthetic oligonucleotide
cccacggtgatgtggtgtttgctggc

SEQ ID NO: 227528 - DNA, 27 bp, Artificial Sequence
  Description of Artificial Sequence: Synthetic oligonucleotide
ccacggtgatgtggtgtttgctggcga

SEQ ID NO: 227529 - DNA, 28 bp, Artificial Sequence
  Description of Artificial Sequence: Synthetic oligonucleotide
cacggtgatgtggtgtttgctggcgatg

SEQ ID NO: 227530 - DNA, 28 bp, Artificial Sequence
  Description of Artificial Sequence: Synthetic oligonucleotide
acggtgatgtggtgtttgctggcgatgg

SEQ ID NO: 227531 - DNA, 27 bp, Artificial Sequence
  Description of Artificial Sequence: Synthetic oligonucleotide
cggtgatgtggtgtttgctggcgatgg

SEQ ID NO: 227532 - DNA, 27 bp, Artificial Sequence
  Description of Artificial Sequence: Synthetic oligonucleotide
ggtgatgtggtgtttgctggcgatggc

SEQ ID NO: 227533 - DNA, 30 bp, Artificial Sequence
  Description of Artificial Sequence: Synthetic oligonucleotide
gtgatgtggtgtttgctggcgatggcattg

SEQ ID NO: 227534 - DNA, 31 bp, Artificial Sequence
  Description of Artificial Sequence: Synthetic oligonucleotide
tgatgtggtgtttgctggcgatggcattgag

SEQ ID NO: 227535 - DNA, 30 bp, Artificial Sequence
  Description of Artificial Sequence: Synthetic oligonucleotide
gatgtggtgtttgctggcgatggcattgag

SEQ ID NO: 227536 - DNA, 30 bp, Artificial Sequence
  Description of Artificial Sequence: Synthetic oligonucleotide
atgtggtgtttgctggcgatggcattgagg

SEQ ID NO: 227537 - DNA, 29 bp, Artificial Sequence
  Description of Artificial Sequence: Synthetic oligonucleotide
tgtggtgtttgctggcgatggcattgagg

SEQ ID NO: 227538 - DNA, 28 bp, Artificial Sequence
  Description of Artificial Sequence: Synthetic oligonucleotide
gtggtgtttgctggcgatggcattgagg

SEQ ID NO: 227539 - DNA, 28 bp, Artificial Sequence
  Description of Artificial Sequence: Synthetic oligonucleotide
tggtgtttgctggcgatggcattgaggg

SEQ ID NO: 227540 - DNA, 27 bp, Artificial Sequence
  Description of Artificial Sequence: Synthetic oligonucleotide
ggtgtttgctggcgatggcattgaggg

SEQ ID NO: 227541 - DNA, 27 bp, Artificial Sequence
  Description of Artificial Sequence: Synthetic oligonucleotide
gtgtttgctggcgatggcattgagggc

SEQ ID NO: 227542 - DNA, 28 bp, Artificial Sequence
  Description of Artificial Sequence: Synthetic oligonucleotide
tgtttgctggcgatggcattgagggctc

SEQ ID NO: 227543 - DNA, 27 bp, Artificial Sequence
  Description of Artificial Sequence: Synthetic oligonucleotide
gtttgctggcgatggcattgagggctc

SEQ ID NO: 227544 - DNA, 28 bp, Artificial Sequence
  Description of Artificial Sequence: Synthetic oligonucleotide
tttgctggcgatggcattgagggctcac

SEQ ID NO: 227545 - DNA, 27 bp, Artificial Sequence
  Description of Artificial Sequence: Synthetic oligonucleotide
ttgctggcgatggcattgagggctcac

SEQ ID NO: 227546 - DNA, 26 bp, Artificial Sequence
  Description of Artificial Sequence: Synthetic oligonucleotide
tgctggcgatggcattgagggctcac

SEQ ID NO: 227547 - DNA, 25 bp, Artificial Sequence
  Description of Artificial Sequence: Synthetic oligonucleotide
gctggcgatggcattgagggctcac

SEQ ID NO: 227548 - DNA, 26 bp, Artificial Sequence
  Description of Artificial Sequence: Synthetic oligonucleotide
ctggcgatggcattgagggctcacct

SEQ ID NO: 227549 - DNA, 26 bp, Artificial Sequence
  Description of Artificial Sequence: Synthetic oligonucleotide
tggcgatggcattgagggctcacctg

SEQ ID NO: 227550 - DNA, 25 bp, Artificial Sequence
  Description of Artificial Sequence: Synthetic oligonucleotide
ggcgatggcattgagggctcacctg

SEQ ID NO: 227551 - DNA, 25 bp, Artificial Sequence
  Description of Artificial Sequence: Synthetic oligonucleotide
gcgatggcattgagggctcacctgc

SEQ ID NO: 227552 - DNA, 27 bp, Artificial Sequence
  Description of Artificial Sequence: Synthetic oligonucleotide
cgatggcattgagggctcacctgccaa

SEQ ID NO: 227553 - DNA, 28 bp, Artificial Sequence
  Description of Artificial Sequence: Synthetic oligonucleotide
gatggcattgagggctcacctgccaaag

SEQ ID NO: 227554 - DNA, 33 bp, Artificial Sequence
  Description of Artificial Sequence: Synthetic oligonucleotide
atggcattgagggctcacctgccaaagattttg

SEQ ID NO: 227555 - DNA, 32 bp, Artificial Sequence
  Description of Artificial Sequence: Synthetic oligonucleotide
tggcattgagggctcacctgccaaagattttg

SEQ ID NO: 227556 - DNA, 31 bp, Artificial Sequence
  Description of Artificial Sequence: Synthetic oligonucleotide
ggcattgagggctcacctgccaaagattttg

SEQ ID NO: 227557 - DNA, 31 bp, Artificial Sequence
  Description of Artificial Sequence: Synthetic oligonucleotide
gcattgagggctcacctgccaaagattttgc

SEQ ID NO: 227558 - DNA, 32 bp, Artificial Sequence
  Description of Artificial Sequence: Synthetic oligonucleotide
cattgagggctcacctgccaaagattttgctc

SEQ ID NO: 227559 - DNA, 34 bp, Artificial Sequence
  Description of Artificial Sequence: Synthetic oligonucleotide
attgagggctcacctgccaaagattttgctctac

SEQ ID NO: 227560 - DNA, 33 bp, Artificial Sequence
  Description of Artificial Sequence: Synthetic oligonucleotide
ttgagggctcacctgccaaagattttgctctac

SEQ ID NO: 227561 - DNA, 32 bp, Artificial Sequence
  Description of Artificial Sequence: Synthetic oligonucleotide
tgagggctcacctgccaaagattttgctctac

SEQ ID NO: 227562 - DNA, 31 bp, Artificial Sequence
  Description of Artificial Sequence: Synthetic oligonucleotide
gagggctcacctgccaaagattttgctctac

SEQ ID NO: 227563 - DNA, 32 bp, Artificial Sequence
  Description of Artificial Sequence: Synthetic oligonucleotide
agggctcacctgccaaagattttgctctactc

SEQ ID NO: 227564 - DNA, 31 bp, Artificial Sequence
  Description of Artificial Sequence: Synthetic oligonucleotide
gggctcacctgccaaagattttgctctactc

SEQ ID NO: 227565 - DNA, 32 bp, Artificial Sequence
  Description of Artificial Sequence: Synthetic oligonucleotide
ggctcacctgccaaagattttgctctactcac

SEQ ID NO: 227566 - DNA, 33 bp, Artificial Sequence
  Description of Artificial Sequence: Synthetic oligonucleotide
gctcacctgccaaagattttgctctactcacac

SEQ ID NO: 227567 - DNA, 34 bp, Artificial Sequence
  Description of Artificial Sequence: Synthetic oligonucleotide
ctcacctgccaaagattttgctctactcacacag

SEQ ID NO: 227568 - DNA, 35 bp, Artificial Sequence
  Description of Artificial Sequence: Synthetic oligonucleotide
tcacctgccaaagattttgctctactcacacagtg

SEQ ID NO: 227569 - DNA, 34 bp, Artificial Sequence
  Description of Artificial Sequence: Synthetic oligonucleotide
cacctgccaaagattttgctctactcacacagtg

SEQ ID NO: 227570 - DNA, 37 bp, Artificial Sequence
  Description of Artificial Sequence: Synthetic oligonucleotide
acctgccaaagattttgctctactcacacagtgtaac

SEQ ID NO: 227571 - DNA, 36 bp, Artificial Sequence
  Description of Artificial Sequence: Synthetic oligonucleotide
cctgccaaagattttgctctactcacacagtgtaac

SEQ ID NO: 227572 - DNA, 36 bp, Artificial Sequence
  Description of Artificial Sequence: Synthetic oligonucleotide
ctgccaaagattttgctctactcacacagtgtaacc

SEQ ID NO: 227573 - DNA, 37 bp, Artificial Sequence
  Description of Artificial Sequence: Synthetic oligonucleotide
tgccaaagattttgctctactcacacagtgtaaccac

SEQ ID NO: 227574 - DNA, 36 bp, Artificial Sequence
  Description of Artificial Sequence: Synthetic oligonucleotide
gccaaagattttgctctactcacacagtgtaaccac

SEQ ID NO: 227575 - DNA, 37 bp, Artificial Sequence
  Description of Artificial Sequence: Synthetic oligonucleotide
ccaaagattttgctctactcacacagtgtaaccacac

SEQ ID NO: 227576 - DNA, 37 bp, Artificial Sequence
  Description of Artificial Sequence: Synthetic oligonucleotide
caaagattttgctctactcacacagtgtaaccacacc

SEQ ID NO: 227577 - DNA, 39 bp, Artificial Sequence
  Description of Artificial Sequence: Synthetic oligonucleotide
aaagattttgctctactcacacagtgtaaccacaccatc

SEQ ID NO: 227578 - DNA, 38 bp, Artificial Sequence
  Description of Artificial Sequence: Synthetic oligonucleotide
aagattttgctctactcacacagtgtaaccacaccatc

SEQ ID NO: 227579 - DNA, 37 bp, Artificial Sequence
  Description of Artificial Sequence: Synthetic oligonucleotide
agattttgctctactcacacagtgtaaccacaccatc

SEQ ID NO: 227580 - DNA, 36 bp, Artificial Sequence
  Description of Artificial Sequence: Synthetic oligonucleotide
gattttgctctactcacacagtgtaaccacaccatc

SEQ ID NO: 227581 - DNA, 38 bp, Artificial Sequence
  Description of Artificial Sequence: Synthetic oligonucleotide
attttgctctactcacacagtgtaaccacaccatcatg

SEQ ID NO: 227582 - DNA, 37 bp, Artificial Sequence
  Description of Artificial Sequence: Synthetic oligonucleotide
ttttgctctactcacacagtgtaaccacaccatcatg

SEQ ID NO: 227583 - DNA, 36 bp, Artificial Sequence
  Description of Artificial Sequence: Synthetic oligonucleotide
tttgctctactcacacagtgtaaccacaccatcatg

SEQ ID NO: 227584 - DNA, 35 bp, Artificial Sequence
  Description of Artificial Sequence: Synthetic oligonucleotide
ttgctctactcacacagtgtaaccacaccatcatg

SEQ ID NO: 227585 - DNA, 34 bp, Artificial Sequence
  Description of Artificial Sequence: Synthetic oligonucleotide
tgctctactcacacagtgtaaccacaccatcatg

SEQ ID NO: 227586 - DNA, 33 bp, Artificial Sequence
  Description of Artificial Sequence: Synthetic oligonucleotide
gctctactcacacagtgtaaccacaccatcatg

SEQ ID NO: 227587 - DNA, 34 bp, Artificial Sequence
  Description of Artificial Sequence: Synthetic oligonucleotide
ctctactcacacagtgtaaccacaccatcatgac

SEQ ID NO: 227588 - DNA, 34 bp, Artificial Sequence
  Description of Artificial Sequence: Synthetic oligonucleotide
tctactcacacagtgtaaccacaccatcatgacc

SEQ ID NO: 227589 - DNA, 33 bp, Artificial Sequence
  Description of Artificial Sequence: Synthetic oligonucleotide
ctactcacacagtgtaaccacaccatcatgacc

SEQ ID NO: 227590 - DNA, 36 bp, Artificial Sequence
  Description of Artificial Sequence: Synthetic oligonucleotide
tactcacacagtgtaaccacaccatcatgaccattg

SEQ ID NO: 227591 - DNA, 35 bp, Artificial Sequence
  Description of Artificial Sequence: Synthetic oligonucleotide
actcacacagtgtaaccacaccatcatgaccattg

SEQ ID NO: 227592 - DNA, 34 bp, Artificial Sequence
  Description of Artificial Sequence: Synthetic oligonucleotide
ctcacacagtgtaaccacaccatcatgaccattg

SEQ ID NO: 227593 - DNA, 34 bp, Artificial Sequence
  Description of Artificial Sequence: Synthetic oligonucleotide
tcacacagtgtaaccacaccatcatgaccattgg

SEQ ID NO: 227594 - DNA, 33 bp, Artificial Sequence
  Description of Artificial Sequence: Synthetic oligonucleotide
cacacagtgtaaccacaccatcatgaccattgg

SEQ ID NO: 227595 - DNA, 33 bp, Artificial Sequence
  Description of Artificial Sequence: Synthetic oligonucleotide
acacagtgtaaccacaccatcatgaccattggg

SEQ ID NO: 227596 - DNA, 32 bp, Artificial Sequence
  Description of Artificial Sequence: Synthetic oligonucleotide
cacagtgtaaccacaccatcatgaccattggg

SEQ ID NO: 227597 - DNA, 33 bp, Artificial Sequence
  Description of Artificial Sequence: Synthetic oligonucleotide
acagtgtaaccacaccatcatgaccattgggac

SEQ ID NO: 227598 - DNA, 32 bp, Artificial Sequence
  Description of Artificial Sequence: Synthetic oligonucleotide
cagtgtaaccacaccatcatgaccattgggac

SEQ ID NO: 227599 - DNA, 32 bp, Artificial Sequence
  Description of Artificial Sequence: Synthetic oligonucleotide
agtgtaaccacaccatcatgaccattgggacg

SEQ ID NO: 227600 - DNA, 31 bp, Artificial Sequence
  Description of Artificial Sequence: Synthetic oligonucleotide
gtgtaaccacaccatcatgaccattgggacg

SEQ ID NO: 227601 - DNA, 33 bp, Artificial Sequence
  Description of Artificial Sequence: Synthetic oligonucleotide
tgtaaccacaccatcatgaccattgggacgttc

SEQ ID NO: 227602 - DNA, 32 bp, Artificial Sequence
  Description of Artificial Sequence: Synthetic oligonucleotide
gtaaccacaccatcatgaccattgggacgttc

SEQ ID NO: 227603 - DNA, 32 bp, Artificial Sequence
  Description of Artificial Sequence: Synthetic oligonucleotide
taaccacaccatcatgaccattgggacgttcg

SEQ ID NO: 227604 - DNA, 31 bp, Artificial Sequence
  Description of Artificial Sequence: Synthetic oligonucleotide
aaccacaccatcatgaccattgggacgttcg

SEQ ID NO: 227605 - DNA, 30 bp, Artificial Sequence
  Description of Artificial Sequence: Synthetic oligonucleotide
accacaccatcatgaccattgggacgttcg

SEQ ID NO: 227606 - DNA, 29 bp, Artificial Sequence
  Description of Artificial Sequence: Synthetic oligonucleotide
ccacaccatcatgaccattgggacgttcg

SEQ ID NO: 227607 - DNA, 29 bp, Artificial Sequence
  Description of Artificial Sequence: Synthetic oligonucleotide
cacaccatcatgaccattgggacgttcgg

SEQ ID NO: 227608 - DNA, 29 bp, Artificial Sequence
  Description of Artificial Sequence: Synthetic oligonucleotide
acaccatcatgaccattgggacgttcggg

SEQ ID NO: 227609 - DNA, 28 bp, Artificial Sequence
  Description of Artificial Sequence: Synthetic oligonucleotide
caccatcatgaccattgggacgttcggg

SEQ ID NO: 227610 - DNA, 30 bp, Artificial Sequence
  Description of Artificial Sequence: Synthetic oligonucleotide
accatcatgaccattgggacgttcgggatc

SEQ ID NO: 227611 - DNA, 29 bp, Artificial Sequence
  Description of Artificial Sequence: Synthetic oligonucleotide
ccatcatgaccattgggacgttcgggatc

SEQ ID NO: 227612 - DNA, 30 bp, Artificial Sequence
  Description of Artificial Sequence: Synthetic oligonucleotide
catcatgaccattgggacgttcgggatctg

SEQ ID NO: 227613 - DNA, 30 bp, Artificial Sequence
  Description of Artificial Sequence: Synthetic oligonucleotide
atcatgaccattgggacgttcgggatctgg

SEQ ID NO: 227614 - DNA, 29 bp, Artificial Sequence
  Description of Artificial Sequence: Synthetic oligonucleotide
tcatgaccattgggacgttcgggatctgg

SEQ ID NO: 227615 - DNA, 28 bp, Artificial Sequence
  Description of Artificial Sequence: Synthetic oligonucleotide
catgaccattgggacgttcgggatctgg

SEQ ID NO: 227616 - DNA, 28 bp, Artificial Sequence
  Description of Artificial Sequence: Synthetic oligonucleotide
atgaccattgggacgttcgggatctggg

SEQ ID NO: 227617 - DNA, 27 bp, Artificial Sequence
  Description of Artificial Sequence: Synthetic oligonucleotide
tgaccattgggacgttcgggatctggg

SEQ ID NO: 227618 - DNA, 26 bp, Artificial Sequence
  Description of Artificial Sequence: Synthetic oligonucleotide
gaccattgggacgttcgggatctggg

SEQ ID NO: 227619 - DNA, 26 bp, Artificial Sequence
  Description of Artificial Sequence: Synthetic oligonucleotide
accattgggacgttcgggatctgggc

SEQ ID NO: 227620 - DNA, 25 bp, Artificial Sequence
  Description of Artificial Sequence: Synthetic oligonucleotide
ccattgggacgttcgggatctgggc

SEQ ID NO: 227621 - DNA, 25 bp, Artificial Sequence
  Description of Artificial Sequence: Synthetic oligonucleotide
cattgggacgttcgggatctgggcc

SEQ ID NO: 227622 - DNA, 25 bp, Artificial Sequence
  Description of Artificial Sequence: Synthetic oligonucleotide
attgggacgttcgggatctgggccg

SEQ ID NO: 227623 - DNA, 24 bp, Artificial Sequence
  Description of Artificial Sequence: Synthetic oligonucleotide
ttgggacgttcgggatctgggccg

SEQ ID NO: 227624 - DNA, 23 bp, Artificial Sequence
  Description of Artificial Sequence: Synthetic oligonucleotide
tgggacgttcgggatctgggccg

SEQ ID NO: 227625 - DNA, 22 bp, Artificial Sequence
  Description of Artificial Sequence: Synthetic oligonucleotide
gggacgttcgggatctgggccg

SEQ ID NO: 227626 - DNA, 25 bp, Artificial Sequence
  Description of Artificial Sequence: Synthetic oligonucleotide
ggacgttcgggatctgggccgcata

SEQ ID NO: 227627 - DNA, 25 bp, Artificial Sequence
  Description of Artificial Sequence: Synthetic oligonucleotide
gacgttcgggatctgggccgcatac

SEQ ID NO: 227628 - DNA, 26 bp, Artificial Sequence
  Description of Artificial Sequence: Synthetic oligonucleotide
acgttcgggatctgggccgcatacct

SEQ ID NO: 227629 - DNA, 25 bp, Artificial Sequence
  Description of Artificial Sequence: Synthetic oligonucleotide
cgttcgggatctgggccgcatacct

SEQ ID NO: 227630 - DNA, 26 bp, Artificial Sequence
  Description of Artificial Sequence: Synthetic oligonucleotide
gttcgggatctgggccgcatacctca

SEQ ID NO: 227631 - DNA, 26 bp, Artificial Sequence
  Description of Artificial Sequence: Synthetic oligonucleotide
ttcgggatctgggccgcatacctcac

SEQ ID NO: 227632 - DNA, 25 bp, Artificial Sequence
  Description of Artificial Sequence: Synthetic oligonucleotide
tcgggatctgggccgcatacctcac

SEQ ID NO: 227633 - DNA, 24 bp, Artificial Sequence
  Description of Artificial Sequence: Synthetic oligonucleotide
cgggatctgggccgcatacctcac

SEQ ID NO: 227634 - DNA, 24 bp, Artificial Sequence
  Description of Artificial Sequence: Synthetic oligonucleotide
gggatctgggccgcatacctcacg

SEQ ID NO: 227635 - DNA, 24 bp, Artificial Sequence
  Description of Artificial Sequence: Synthetic oligonucleotide
ggatctgggccgcatacctcacgg

SEQ ID NO: 227636 - DNA, 24 bp, Artificial Sequence
  Description of Artificial Sequence: Synthetic oligonucleotide
gatctgggccgcatacctcacggg

SEQ ID NO: 227637 - DNA, 24 bp, Artificial Sequence
  Description of Artificial Sequence: Synthetic oligonucleotide
atctgggccgcatacctcacgggc

SEQ ID NO: 227638 - DNA, 23 bp, Artificial Sequence
  Description of Artificial Sequence: Synthetic oligonucleotide
tctgggccgcatacctcacgggc

SEQ ID NO: 227639 - DNA, 22 bp, Artificial Sequence
  Description of Artificial Sequence: Synthetic oligonucleotide
ctgggccgcatacctcacgggc

SEQ ID NO: 227640 - DNA, 22 bp, Artificial Sequence
  Description of Artificial Sequence: Synthetic oligonucleotide
tgggccgcatacctcacgggcg

SEQ ID NO: 227641 - DNA, 21 bp, Artificial Sequence
  Description of Artificial Sequence: Synthetic oligonucleotide
gggccgcatacctcacgggcg

SEQ ID NO: 227642 - DNA, 22 bp, Artificial Sequence
  Description of Artificial Sequence: Synthetic oligonucleotide
ggccgcatacctcacgggcgga

SEQ ID NO: 227643 - DNA, 23 bp, Artificial Sequence
  Description of Artificial Sequence: Synthetic oligonucleotide
gccgcatacctcacgggcggaga

SEQ ID NO: 227644 - DNA, 24 bp, Artificial Sequence
  Description of Artificial Sequence: Synthetic oligonucleotide
ccgcatacctcacgggcggagaca

SEQ ID NO: 227645 - DNA, 24 bp, Artificial Sequence
  Description of Artificial Sequence: Synthetic oligonucleotide
cgcatacctcacgggcggagacac

SEQ ID NO: 227646 - DNA, 26 bp, Artificial Sequence
  Description of Artificial Sequence: Synthetic oligonucleotide
gcatacctcacgggcggagacaccat

SEQ ID NO: 227647 - DNA, 27 bp, Artificial Sequence
  Description of Artificial Sequence: Synthetic oligonucleotide
catacctcacgggcggagacaccatct

SEQ ID NO: 227648 - DNA, 28 bp, Artificial Sequence
  Description of Artificial Sequence: Synthetic oligonucleotide
atacctcacgggcggagacaccatctac

SEQ ID NO: 227649 - DNA, 27 bp, Artificial Sequence
  Description of Artificial Sequence: Synthetic oligonucleotide
tacctcacgggcggagacaccatctac

SEQ ID NO: 227650 - DNA, 26 bp, Artificial Sequence
  Description of Artificial Sequence: Synthetic oligonucleotide
acctcacgggcggagacaccatctac

SEQ ID NO: 227651 - DNA, 25 bp, Artificial Sequence
  Description of Artificial Sequence: Synthetic oligonucleotide
cctcacgggcggagacaccatctac

SEQ ID NO: 227652 - DNA, 26 bp, Artificial Sequence
  Description of Artificial Sequence: Synthetic oligonucleotide
ctcacgggcggagacaccatctacct

SEQ ID NO: 227653 - DNA, 26 bp, Artificial Sequence
  Description of Artificial Sequence: Synthetic oligonucleotide
tcacgggcggagacaccatctacctg

SEQ ID NO: 227654 - DNA, 25 bp, Artificial Sequence
  Description of Artificial Sequence: Synthetic oligonucleotide
cacgggcggagacaccatctacctg

SEQ ID NO: 227655 - DNA, 25 bp, Artificial Sequence
  Description of Artificial Sequence: Synthetic oligonucleotide
acgggcggagacaccatctacctgg

SEQ ID NO: 227656 - DNA, 24 bp, Artificial Sequence
  Description of Artificial Sequence: Synthetic oligonucleotide
cgggcggagacaccatctacctgg

SEQ ID NO: 227657 - DNA, 24 bp, Artificial Sequence
  Description of Artificial Sequence: Synthetic oligonucleotide
gggcggagacaccatctacctggc

SEQ ID NO: 227658 - DNA, 27 bp, Artificial Sequence
  Description of Artificial Sequence: Synthetic oligonucleotide
ggcggagacaccatctacctggccaat

SEQ ID NO: 227659 - DNA, 29 bp, Artificial Sequence
  Description of Artificial Sequence: Synthetic oligonucleotide
gcggagacaccatctacctggccaattac

SEQ ID NO: 227660 - DNA, 30 bp, Artificial Sequence
  Description of Artificial Sequence: Synthetic oligonucleotide
cggagacaccatctacctggccaattacac

SEQ ID NO: 227661 - DNA, 30 bp, Artificial Sequence
  Description of Artificial Sequence: Synthetic oligonucleotide
ggagacaccatctacctggccaattacacc

SEQ ID NO: 227662 - DNA, 30 bp, Artificial Sequence
  Description of Artificial Sequence: Synthetic oligonucleotide
gagacaccatctacctggccaattacaccc

SEQ ID NO: 227663 - DNA, 31 bp, Artificial Sequence
  Description of Artificial Sequence: Synthetic oligonucleotide
agacaccatctacctggccaattacaccctc

SEQ ID NO: 227664 - DNA, 30 bp, Artificial Sequence
  Description of Artificial Sequence: Synthetic oligonucleotide
gacaccatctacctggccaattacaccctc

SEQ ID NO: 227665 - DNA, 30 bp, Artificial Sequence
  Description of Artificial Sequence: Synthetic oligonucleotide
acaccatctacctggccaattacaccctcc

SEQ ID NO: 227666 - DNA, 29 bp, Artificial Sequence
  Description of Artificial Sequence: Synthetic oligonucleotide
caccatctacctggccaattacaccctcc

SEQ ID NO: 227667 - DNA, 29 bp, Artificial Sequence
  Description of Artificial Sequence: Synthetic oligonucleotide
accatctacctggccaattacaccctccc

SEQ ID NO: 227668 - DNA, 28 bp, Artificial Sequence
  Description of Artificial Sequence: Synthetic oligonucleotide
ccatctacctggccaattacaccctccc

SEQ ID NO: 227669 - DNA, 28 bp, Artificial Sequence
  Description of Artificial Sequence: Synthetic oligonucleotide
catctacctggccaattacaccctcccc

SEQ ID NO: 227670 - DNA, 28 bp, Artificial Sequence
  Description of Artificial Sequence: Synthetic oligonucleotide
atctacctggccaattacaccctccccg

SEQ ID NO: 227671 - DNA, 27 bp, Artificial Sequence
  Description of Artificial Sequence: Synthetic oligonucleotide
tctacctggccaattacaccctccccg

SEQ ID NO: 227672 - DNA, 27 bp, Artificial Sequence
  Description of Artificial Sequence: Synthetic oligonucleotide
ctacctggccaattacaccctccccga

SEQ ID NO: 227673 - DNA, 27 bp, Artificial Sequence
  Description of Artificial Sequence: Synthetic oligonucleotide
tacctggccaattacaccctccccgac

SEQ ID NO: 227674 - DNA, 27 bp, Artificial Sequence
  Description of Artificial Sequence: Synthetic oligonucleotide
acctggccaattacaccctccccgact

SEQ ID NO: 227675 - DNA, 26 bp, Artificial Sequence
  Description of Artificial Sequence: Synthetic oligonucleotide
cctggccaattacaccctccccgact

SEQ ID NO: 227676 - DNA, 26 bp, Artificial Sequence
  Description of Artificial Sequence: Synthetic oligonucleotide
ctggccaattacaccctccccgactc

SEQ ID NO: 227677 - DNA, 26 bp, Artificial Sequence
  Description of Artificial Sequence: Synthetic oligonucleotide
tggccaattacaccctccccgactcc

SEQ ID NO: 227678 - DNA, 25 bp, Artificial Sequence
  Description of Artificial Sequence: Synthetic oligonucleotide
ggccaattacaccctccccgactcc

SEQ ID NO: 227679 - DNA, 25 bp, Artificial Sequence
  Description of Artificial Sequence: Synthetic oligonucleotide
gccaattacaccctccccgactccc

SEQ ID NO: 227680 - DNA, 27 bp, Artificial Sequence
  Description of Artificial Sequence: Synthetic oligonucleotide
ccaattacaccctccccgactcccctt

SEQ ID NO: 227681 - DNA, 28 bp, Artificial Sequence
  Description of Artificial Sequence: Synthetic oligonucleotide
caattacaccctccccgactcccctttc

SEQ ID NO: 227682 - DNA, 28 bp, Artificial Sequence
  Description of Artificial Sequence: Synthetic oligonucleotide
aattacaccctccccgactcccctttcc

SEQ ID NO: 227683 - DNA, 27 bp, Artificial Sequence
  Description of Artificial Sequence: Synthetic oligonucleotide
attacaccctccccgactcccctttcc

SEQ ID NO: 227684 - DNA, 27 bp, Artificial Sequence
  Description of Artificial Sequence: Synthetic oligonucleotide
ttacaccctccccgactcccctttcct

SEQ ID NO: 227685 - DNA, 26 bp, Artificial Sequence
  Description of Artificial Sequence: Synthetic oligonucleotide
tacaccctccccgactcccctttcct

SEQ ID NO: 227686 - DNA, 25 bp, Artificial Sequence
  Description of Artificial Sequence: Synthetic oligonucleotide
acaccctccccgactcccctttcct

SEQ ID NO: 227687 - DNA, 24 bp, Artificial Sequence
  Description of Artificial Sequence: Synthetic oligonucleotide
caccctccccgactcccctttcct

SEQ ID NO: 227688 - DNA, 27 bp, Artificial Sequence
  Description of Artificial Sequence: Synthetic oligonucleotide
accctccccgactcccctttcctcaaa

SEQ ID NO: 227689 - DNA, 27 bp, Artificial Sequence
  Description of Artificial Sequence: Synthetic oligonucleotide
ccctccccgactcccctttcctcaaaa

SEQ ID NO: 227690 - DNA, 28 bp, Artificial Sequence
  Description of Artificial Sequence: Synthetic oligonucleotide
cctccccgactcccctttcctcaaaatc

SEQ ID NO: 227691 - DNA, 33 bp, Artificial Sequence
  Description of Artificial Sequence: Synthetic oligonucleotide
ctccccgactcccctttcctcaaaatctttaag

SEQ ID NO: 227692 - DNA, 33 bp, Artificial Sequence
  Description of Artificial Sequence: Synthetic oligonucleotide
tccccgactcccctttcctcaaaatctttaagc

SEQ ID NO: 227693 - DNA, 32 bp, Artificial Sequence
  Description of Artificial Sequence: Synthetic oligonucleotide
ccccgactcccctttcctcaaaatctttaagc

SEQ ID NO: 227694 - DNA, 32 bp, Artificial Sequence
  Description of Artificial Sequence: Synthetic oligonucleotide
cccgactcccctttcctcaaaatctttaagcc

SEQ ID NO: 227695 - DNA, 33 bp, Artificial Sequence
  Description of Artificial Sequence: Synthetic oligonucleotide
ccgactcccctttcctcaaaatctttaagccag

SEQ ID NO: 227696 - DNA, 34 bp, Artificial Sequence
  Description of Artificial Sequence: Synthetic oligonucleotide
cgactcccctttcctcaaaatctttaagccagag

SEQ ID NO: 227697 - DNA, 34 bp, Artificial Sequence
  Description of Artificial Sequence: Synthetic oligonucleotide
gactcccctttcctcaaaatctttaagccagagg

SEQ ID NO: 227698 - DNA, 34 bp, Artificial Sequence
  Description of Artificial Sequence: Synthetic oligonucleotide
actcccctttcctcaaaatctttaagccagaggc

SEQ ID NO: 227699 - DNA, 33 bp, Artificial Sequence
  Description of Artificial Sequence: Synthetic oligonucleotide
ctcccctttcctcaaaatctttaagccagaggc

SEQ ID NO: 227700 - DNA, 34 bp, Artificial Sequence
  Description of Artificial Sequence: Synthetic oligonucleotide
tcccctttcctcaaaatctttaagccagaggcag

SEQ ID NO: 227701 - DNA, 33 bp, Artificial Sequence
  Description of Artificial Sequence: Synthetic oligonucleotide
cccctttcctcaaaatctttaagccagaggcag

SEQ ID NO: 227702 - DNA, 33 bp, Artificial Sequence
  Description of Artificial Sequence: Synthetic oligonucleotide
ccctttcctcaaaatctttaagccagaggcagc

SEQ ID NO: 227703 - DNA, 33 bp, Artificial Sequence
  Description of Artificial Sequence: Synthetic oligonucleotide
cctttcctcaaaatctttaagccagaggcagcc

SEQ ID NO: 227704 - DNA, 35 bp, Artificial Sequence
  Description of Artificial Sequence: Synthetic oligonucleotide
ctttcctcaaaatctttaagccagaggcagccttc

SEQ ID NO: 227705 - DNA, 35 bp, Artificial Sequence
  Description of Artificial Sequence: Synthetic oligonucleotide
tttcctcaaaatctttaagccagaggcagccttcc

SEQ ID NO: 227706 - DNA, 34 bp, Artificial Sequence
  Description of Artificial Sequence: Synthetic oligonucleotide
ttcctcaaaatctttaagccagaggcagccttcc

SEQ ID NO: 227707 - DNA, 33 bp, Artificial Sequence
  Description of Artificial Sequence: Synthetic oligonucleotide
tcctcaaaatctttaagccagaggcagccttcc

SEQ ID NO: 227708 - DNA, 32 bp, Artificial Sequence
  Description of Artificial Sequence: Synthetic oligonucleotide
cctcaaaatctttaagccagaggcagccttcc

SEQ ID NO: 227709 - DNA, 33 bp, Artificial Sequence
  Description of Artificial Sequence: Synthetic oligonucleotide
ctcaaaatctttaagccagaggcagccttcctg

SEQ ID NO: 227710 - DNA, 33 bp, Artificial Sequence
  Description of Artificial Sequence: Synthetic oligonucleotide
tcaaaatctttaagccagaggcagccttcctgc

SEQ ID NO: 227711 - DNA, 32 bp, Artificial Sequence
  Description of Artificial Sequence: Synthetic oligonucleotide
caaaatctttaagccagaggcagccttcctgc

SEQ ID NO: 227712 - DNA, 32 bp, Artificial Sequence
  Description of Artificial Sequence: Synthetic oligonucleotide
aaaatctttaagccagaggcagccttcctgcc

SEQ ID NO: 227713 - DNA, 31 bp, Artificial Sequence
  Description of Artificial Sequence: Synthetic oligonucleotide
aaatctttaagccagaggcagccttcctgcc

SEQ ID NO: 227714 - DNA, 30 bp, Artificial Sequence
  Description of Artificial Sequence: Synthetic oligonucleotide
aatctttaagccagaggcagccttcctgcc

SEQ ID NO: 227715 - DNA, 29 bp, Artificial Sequence
  Description of Artificial Sequence: Synthetic oligonucleotide
atctttaagccagaggcagccttcctgcc

SEQ ID NO: 227716 - DNA, 28 bp, Artificial Sequence
  Description of Artificial Sequence: Synthetic oligonucleotide
tctttaagccagaggcagccttcctgcc

SEQ ID NO: 227717 - DNA, 27 bp, Artificial Sequence
  Description of Artificial Sequence: Synthetic oligonucleotide
ctttaagccagaggcagccttcctgcc

SEQ ID NO: 227718 - DNA, 27 bp, Artificial Sequence
  Description of Artificial Sequence: Synthetic oligonucleotide
tttaagccagaggcagccttcctgccg

SEQ ID NO: 227719 - DNA, 26 bp, Artificial Sequence
  Description of Artificial Sequence: Synthetic oligonucleotide
ttaagccagaggcagccttcctgccg

SEQ ID NO: 227720 - DNA, 25 bp, Artificial Sequence
  Description of Artificial Sequence: Synthetic oligonucleotide
taagccagaggcagccttcctgccg

SEQ ID NO: 227721 - DNA, 24 bp, Artificial Sequence
  Description of Artificial Sequence: Synthetic oligonucleotide
aagccagaggcagccttcctgccg

SEQ ID NO: 227722 - DNA, 23 bp, Artificial Sequence
  Description of Artificial Sequence: Synthetic oligonucleotide
agccagaggcagccttcctgccg

SEQ ID NO: 227723 - DNA, 22 bp, Artificial Sequence
  Description of Artificial Sequence: Synthetic oligonucleotide
gccagaggcagccttcctgccg

SEQ ID NO: 227724 - DNA, 23 bp, Artificial Sequence
  Description of Artificial Sequence: Synthetic oligonucleotide
ccagaggcagccttcctgccgga

SEQ ID NO: 227725 - DNA, 24 bp, Artificial Sequence
  Description of Artificial Sequence: Synthetic oligonucleotide
cagaggcagccttcctgccggagt

SEQ ID NO: 227726 - DNA, 24 bp, Artificial Sequence
  Description of Artificial Sequence: Synthetic oligonucleotide
agaggcagccttcctgccggagtg

SEQ ID NO: 227727 - DNA, 23 bp, Artificial Sequence
  Description of Artificial Sequence: Synthetic oligonucleotide
gaggcagccttcctgccggagtg

SEQ ID NO: 227728 - DNA, 24 bp, Artificial Sequence
  Description of Artificial Sequence: Synthetic oligonucleotide
aggcagccttcctgccggagtgga

SEQ ID NO: 227729 - DNA, 23 bp, Artificial Sequence
  Description of Artificial Sequence: Synthetic oligonucleotide
ggcagccttcctgccggagtgga

SEQ ID NO: 227730 - DNA, 24 bp, Artificial Sequence
  Description of Artificial Sequence: Synthetic oligonucleotide
gcagccttcctgccggagtggaca

SEQ ID NO: 227731 - DNA, 24 bp, Artificial Sequence
  Description of Artificial Sequence: Synthetic oligonucleotide
cagccttcctgccggagtggacag

SEQ ID NO: 227732 - DNA, 24 bp, Artificial Sequence
  Description of Artificial Sequence: Synthetic oligonucleotide
agccttcctgccggagtggacagg

SEQ ID NO: 227733 - DNA, 23 bp, Artificial Sequence
  Description of Artificial Sequence: Synthetic oligonucleotide
gccttcctgccggagtggacagg

SEQ ID NO: 227734 - DNA, 26 bp, Artificial Sequence
  Description of Artificial Sequence: Synthetic oligonucleotide
ccttcctgccggagtggacagggatt

SEQ ID NO: 227735 - DNA, 26 bp, Artificial Sequence
  Description of Artificial Sequence: Synthetic oligonucleotide
cttcctgccggagtggacagggattg

SEQ ID NO: 227736 - DNA, 26 bp, Artificial Sequence
  Description of Artificial Sequence: Synthetic oligonucleotide
ttcctgccggagtggacagggattgc

SEQ ID NO: 227737 - DNA, 25 bp, Artificial Sequence
  Description of Artificial Sequence: Synthetic oligonucleotide
tcctgccggagtggacagggattgc

SEQ ID NO: 227738 - DNA, 24 bp, Artificial Sequence
  Description of Artificial Sequence: Synthetic oligonucleotide
cctgccggagtggacagggattgc

SEQ ID NO: 227739 - DNA, 24 bp, Artificial Sequence
  Description of Artificial Sequence: Synthetic oligonucleotide
ctgccggagtggacagggattgcc

SEQ ID NO: 227740 - DNA, 24 bp, Artificial Sequence
  Description of Artificial Sequence: Synthetic oligonucleotide
tgccggagtggacagggattgccg

SEQ ID NO: 227741 - DNA, 23 bp, Artificial Sequence
  Description of Artificial Sequence: Synthetic oligonucleotide
gccggagtggacagggattgccg

SEQ ID NO: 227742 - DNA, 24 bp, Artificial Sequence
  Description of Artificial Sequence: Synthetic oligonucleotide
ccggagtggacagggattgccgca

SEQ ID NO: 227743 - DNA, 25 bp, Artificial Sequence
  Description of Artificial Sequence: Synthetic oligonucleotide
cggagtggacagggattgccgcaga

SEQ ID NO: 227744 - DNA, 25 bp, Artificial Sequence
  Description of Artificial Sequence: Synthetic oligonucleotide
ggagtggacagggattgccgcagac

SEQ ID NO: 227745 - DNA, 26 bp, Artificial Sequence
  Description of Artificial Sequence: Synthetic oligonucleotide
gagtggacagggattgccgcagacct

SEQ ID NO: 227746 - DNA, 27 bp, Artificial Sequence
  Description of Artificial Sequence: Synthetic oligonucleotide
agtggacagggattgccgcagacctgt

SEQ ID NO: 227747 - DNA, 26 bp, Artificial Sequence
  Description of Artificial Sequence: Synthetic oligonucleotide
gtggacagggattgccgcagacctgt

SEQ ID NO: 227748 - DNA, 26 bp, Artificial Sequence
  Description of Artificial Sequence: Synthetic oligonucleotide
tggacagggattgccgcagacctgtc

SEQ ID NO: 227749 - DNA, 25 bp, Artificial Sequence
  Description of Artificial Sequence: Synthetic oligonucleotide
ggacagggattgccgcagacctgtc

SEQ ID NO: 227750 - DNA, 25 bp, Artificial Sequence
  Description of Artificial Sequence: Synthetic oligonucleotide
gacagggattgccgcagacctgtcc

SEQ ID NO: 227751 - DNA, 25 bp, Artificial Sequence
  Description of Artificial Sequence: Synthetic oligonucleotide
acagggattgccgcagacctgtccc

SEQ ID NO: 227752 - DNA, 24 bp, Artificial Sequence
  Description of Artificial Sequence: Synthetic oligonucleotide
cagggattgccgcagacctgtccc

SEQ ID NO: 227753 - DNA, 24 bp, Artificial Sequence
  Description of Artificial Sequence: Synthetic oligonucleotide
agggattgccgcagacctgtcccc

SEQ ID NO: 227754 - DNA, 23 bp, Artificial Sequence
  Description of Artificial Sequence: Synthetic oligonucleotide
gggattgccgcagacctgtcccc

SEQ ID NO: 227755 - DNA, 26 bp, Artificial Sequence
  Description of Artificial Sequence: Synthetic oligonucleotide
ggattgccgcagacctgtccccctta

SEQ ID NO: 227756 - DNA, 27 bp, Artificial Sequence
  Description of Artificial Sequence: Synthetic oligonucleotide
gattgccgcagacctgtcccccttact

SEQ ID NO: 227757 - DNA, 27 bp, Artificial Sequence
  Description of Artificial Sequence: Synthetic oligonucleotide
attgccgcagacctgtcccccttactc

SEQ ID NO: 227758 - DNA, 27 bp, Artificial Sequence
  Description of Artificial Sequence: Synthetic oligonucleotide
ttgccgcagacctgtcccccttactca

SEQ ID NO: 227759 - DNA, 27 bp, Artificial Sequence
  Description of Artificial Sequence: Synthetic oligonucleotide
tgccgcagacctgtcccccttactcaa

SEQ ID NO: 227760 - DNA, 26 bp, Artificial Sequence
  Description of Artificial Sequence: Synthetic oligonucleotide
gccgcagacctgtcccccttactcaa

SEQ ID NO: 227761 - DNA, 26 bp, Artificial Sequence
  Description of Artificial Sequence: Synthetic oligonucleotide
ccgcagacctgtcccccttactcaag

SEQ ID NO: 227762 - DNA, 27 bp, Artificial Sequence
  Description of Artificial Sequence: Synthetic oligonucleotide
cgcagacctgtcccccttactcaagca

SEQ ID NO: 227763 - DNA, 27 bp, Artificial Sequence
  Description of Artificial Sequence: Synthetic oligonucleotide
gcagacctgtcccccttactcaagcac

SEQ ID NO: 227764 - DNA, 25 bp, Artificial Sequence
  Description of Artificial Sequence: Synthetic oligonucleotide
ggaaccagatgggcgagtacgccac

SEQ ID NO: 227765 - DNA, 25 bp, Artificial Sequence
  Description of Artificial Sequence: Synthetic oligonucleotide
gaaccagatgggcgagtacgccacg

SEQ ID NO: 227766 - DNA, 26 bp, Artificial Sequence
  Description of Artificial Sequence: Synthetic oligonucleotide
aaccagatgggcgagtacgccacgct

SEQ ID NO: 227767 - DNA, 25 bp, Artificial Sequence
  Description of Artificial Sequence: Synthetic oligonucleotide
accagatgggcgagtacgccacgct

SEQ ID NO: 227768 - DNA, 24 bp, Artificial Sequence
  Description of Artificial Sequence: Synthetic oligonucleotide
ccagatgggcgagtacgccacgct

SEQ ID NO: 227769 - DNA, 26 bp, Artificial Sequence
  Description of Artificial Sequence: Synthetic oligonucleotide
cagatgggcgagtacgccacgctgta

SEQ ID NO: 227770 - DNA, 26 bp, Artificial Sequence
  Description of Artificial Sequence: Synthetic oligonucleotide
agatgggcgagtacgccacgctgtac

SEQ ID NO: 227771 - DNA, 25 bp, Artificial Sequence
  Description of Artificial Sequence: Synthetic oligonucleotide
gatgggcgagtacgccacgctgtac

SEQ ID NO: 227772 - DNA, 25 bp, Artificial Sequence
  Description of Artificial Sequence: Synthetic oligonucleotide
atgggcgagtacgccacgctgtacg

SEQ ID NO: 227773 - DNA, 24 bp, Artificial Sequence
  Description of Artificial Sequence: Synthetic oligonucleotide
tgggcgagtacgccacgctgtacg

SEQ ID NO: 227774 - DNA, 23 bp, Artificial Sequence
  Description of Artificial Sequence: Synthetic oligonucleotide
gggcgagtacgccacgctgtacg

SEQ ID NO: 227775 - DNA, 23 bp, Artificial Sequence
  Description of Artificial Sequence: Synthetic oligonucleotide
ggcgagtacgccacgctgtacgc

SEQ ID NO: 227776 - DNA, 23 bp, Artificial Sequence
  Description of Artificial Sequence: Synthetic oligonucleotide
gcgagtacgccacgctgtacgcc

SEQ ID NO: 227777 - DNA, 24 bp, Artificial Sequence
  Description of Artificial Sequence: Synthetic oligonucleotide
cgagtacgccacgctgtacgccct

SEQ ID NO: 227778 - DNA, 24 bp, Artificial Sequence
  Description of Artificial Sequence: Synthetic oligonucleotide
gagtacgccacgctgtacgccctg

SEQ ID NO: 227779 - DNA, 24 bp, Artificial Sequence
  Description of Artificial Sequence: Synthetic oligonucleotide
agtacgccacgctgtacgccctgg

SEQ ID NO: 227780 - DNA, 23 bp, Artificial Sequence
  Description of Artificial Sequence: Synthetic oligonucleotide
gtacgccacgctgtacgccctgg

SEQ ID NO: 227781 - DNA, 23 bp, Artificial Sequence
  Description of Artificial Sequence: Synthetic oligonucleotide
tacgccacgctgtacgccctggc

SEQ ID NO: 227782 - DNA, 22 bp, Artificial Sequence
  Description of Artificial Sequence: Synthetic oligonucleotide
acgccacgctgtacgccctggc

SEQ ID NO: 227783 - DNA, 21 bp, Artificial Sequence
  Description of Artificial Sequence: Synthetic oligonucleotide
cgccacgctgtacgccctggc

SEQ ID NO: 227784 - DNA, 23 bp, Artificial Sequence
  Description of Artificial Sequence: Synthetic oligonucleotide
gccacgctgtacgccctggccaa

SEQ ID NO: 227785 - DNA, 25 bp, Artificial Sequence
  Description of Artificial Sequence: Synthetic oligonucleotide
ccacgctgtacgccctggccaagat

SEQ ID NO: 227786 - DNA, 27 bp, Artificial Sequence
  Description of Artificial Sequence: Synthetic oligonucleotide
cacgctgtacgccctggccaagatgaa

SEQ ID NO: 227787 - DNA, 27 bp, Artificial Sequence
  Description of Artificial Sequence: Synthetic oligonucleotide
acgctgtacgccctggccaagatgaac

SEQ ID NO: 227788 - DNA, 26 bp, Artificial Sequence
  Description of Artificial Sequence: Synthetic oligonucleotide
cgctgtacgccctggccaagatgaac

SEQ ID NO: 227789 - DNA, 26 bp, Artificial Sequence
  Description of Artificial Sequence: Synthetic oligonucleotide
gctgtacgccctggccaagatgaacg

SEQ ID NO: 227790 - DNA, 29 bp, Artificial Sequence
  Description of Artificial Sequence: Synthetic oligonucleotide
gatcccctggcagaactaccacctgaatg

SEQ ID NO: 227791 - DNA, 30 bp, Artificial Sequence
  Description of Artificial Sequence: Synthetic oligonucleotide
atcccctggcagaactaccacctgaatgac

SEQ ID NO: 227792 - DNA, 29 bp, Artificial Sequence
  Description of Artificial Sequence: Synthetic oligonucleotide
tcccctggcagaactaccacctgaatgac

SEQ ID NO: 227793 - DNA, 28 bp, Artificial Sequence
  Description of Artificial Sequence: Synthetic oligonucleotide
cccctggcagaactaccacctgaatgac

SEQ ID NO: 227794 - DNA, 29 bp, Artificial Sequence
  Description of Artificial Sequence: Synthetic oligonucleotide
ccctggcagaactaccacctgaatgactg

SEQ ID NO: 227795 - DNA, 29 bp, Artificial Sequence
  Description of Artificial Sequence: Synthetic oligonucleotide
cctggcagaactaccacctgaatgactgg

SEQ ID NO: 227796 - DNA, 31 bp, Artificial Sequence
  Description of Artificial Sequence: Synthetic oligonucleotide
ctggcagaactaccacctgaatgactggatg

SEQ ID NO: 227797 - DNA, 31 bp, Artificial Sequence
  Description of Artificial Sequence: Synthetic oligonucleotide
tggcagaactaccacctgaatgactggatgg

SEQ ID NO: 227798 - DNA, 30 bp, Artificial Sequence
  Description of Artificial Sequence: Synthetic oligonucleotide
ggcagaactaccacctgaatgactggatgg

SEQ ID NO: 227799 - DNA, 31 bp, Artificial Sequence
  Description of Artificial Sequence: Synthetic oligonucleotide
gcagaactaccacctgaatgactggatggag

SEQ ID NO: 227800 - DNA, 31 bp, Artificial Sequence
  Description of Artificial Sequence: Synthetic oligonucleotide
cagaactaccacctgaatgactggatggagg

SEQ ID NO: 227801 - DNA, 32 bp, Artificial Sequence
  Description of Artificial Sequence: Synthetic oligonucleotide
agaactaccacctgaatgactggatggaggag

SEQ ID NO: 227802 - DNA, 31 bp, Artificial Sequence
  Description of Artificial Sequence: Synthetic oligonucleotide
gaactaccacctgaatgactggatggaggag

SEQ ID NO: 227803 - DNA, 31 bp, Artificial Sequence
  Description of Artificial Sequence: Synthetic oligonucleotide
aactaccacctgaatgactggatggaggagg

SEQ ID NO: 227804 - DNA, 30 bp, Artificial Sequence
  Description of Artificial Sequence: Synthetic oligonucleotide
actaccacctgaatgactggatggaggagg

SEQ ID NO: 227805 - DNA, 29 bp, Artificial Sequence
  Description of Artificial Sequence: Synthetic oligonucleotide
ctaccacctgaatgactggatggaggagg

SEQ ID NO: 227806 - DNA, 33 bp, Artificial Sequence
  Description of Artificial Sequence: Synthetic oligonucleotide
taccacctgaatgactggatggaggaggaatac

SEQ ID NO: 227807 - DNA, 32 bp, Artificial Sequence
  Description of Artificial Sequence: Synthetic oligonucleotide
accacctgaatgactggatggaggaggaatac

SEQ ID NO: 227808 - DNA, 31 bp, Artificial Sequence
  Description of Artificial Sequence: Synthetic oligonucleotide
ccacctgaatgactggatggaggaggaatac

SEQ ID NO: 227809 - DNA, 31 bp, Artificial Sequence
  Description of Artificial Sequence: Synthetic oligonucleotide
cacctgaatgactggatggaggaggaatacc

SEQ ID NO: 227810 - DNA, 31 bp, Artificial Sequence
  Description of Artificial Sequence: Synthetic oligonucleotide
acctgaatgactggatggaggaggaataccg

SEQ ID NO: 227811 - DNA, 30 bp, Artificial Sequence
  Description of Artificial Sequence: Synthetic oligonucleotide
cctgaatgactggatggaggaggaataccg

SEQ ID NO: 227812 - DNA, 30 bp, Artificial Sequence
  Description of Artificial Sequence: Synthetic oligonucleotide
ctgaatgactggatggaggaggaataccgc

SEQ ID NO: 227813 - DNA, 30 bp, Artificial Sequence
  Description of Artificial Sequence: Synthetic oligonucleotide
tgaatgactggatggaggaggaataccgcc

SEQ ID NO: 227814 - DNA, 29 bp, Artificial Sequence
  Description of Artificial Sequence: Synthetic oligonucleotide
gaatgactggatggaggaggaataccgcc

SEQ ID NO: 227815 - DNA, 30 bp, Artificial Sequence
  Description of Artificial Sequence: Synthetic oligonucleotide
aatgactggatggaggaggaataccgccac

SEQ ID NO: 227816 - DNA, 29 bp, Artificial Sequence
  Description of Artificial Sequence: Synthetic oligonucleotide
atgactggatggaggaggaataccgccac

SEQ ID NO: 227817 - DNA, 28 bp, Artificial Sequence
  Description of Artificial Sequence: Synthetic oligonucleotide
tgactggatggaggaggaataccgccac

SEQ ID NO: 227818 - DNA, 22 bp, Artificial Sequence
  Description of Artificial Sequence: Synthetic oligonucleotide
ggacgttcgggatctgggccgc

SEQ ID NO: 227819 - DNA, 24 bp, Artificial Sequence
  Description of Artificial Sequence: Synthetic oligonucleotide
gacgttcgggatctgggccgccta

SEQ ID NO: 227820 - DNA, 24 bp, Artificial Sequence
  Description of Artificial Sequence: Synthetic oligonucleotide
acgttcgggatctgggccgcctac

SEQ ID NO: 227821 - DNA, 23 bp, Artificial Sequence
  Description of Artificial Sequence: Synthetic oligonucleotide
cgttcgggatctgggccgcctac

SEQ ID NO: 227822 - DNA, 24 bp, Artificial Sequence
  Description of Artificial Sequence: Synthetic oligonucleotide
gttcgggatctgggccgcctacct

SEQ ID NO: 227823 - DNA, 25 bp, Artificial Sequence
  Description of Artificial Sequence: Synthetic oligonucleotide
ttcgggatctgggccgcctacctca

SEQ ID NO: 227824 - DNA, 24 bp, Artificial Sequence
  Description of Artificial Sequence: Synthetic oligonucleotide
tcgggatctgggccgcctacctca

SEQ ID NO: 227825 - DNA, 23 bp, Artificial Sequence
  Description of Artificial Sequence: Synthetic oligonucleotide
cgggatctgggccgcctacctca

SEQ ID NO: 227826 - DNA, 23 bp, Artificial Sequence
  Description of Artificial Sequence: Synthetic oligonucleotide
gggatctgggccgcctacctcac

SEQ ID NO: 227827 - DNA, 23 bp, Artificial Sequence
  Description of Artificial Sequence: Synthetic oligonucleotide
ggatctgggccgcctacctcacg

SEQ ID NO: 227828 - DNA, 23 bp, Artificial Sequence
  Description of Artificial Sequence: Synthetic oligonucleotide
gatctgggccgcctacctcacgg

SEQ ID NO: 227829 - DNA, 23 bp, Artificial Sequence
  Description of Artificial Sequence: Synthetic oligonucleotide
atctgggccgcctacctcacggg

SEQ ID NO: 227830 - DNA, 22 bp, Artificial Sequence
  Description of Artificial Sequence: Synthetic oligonucleotide
tctgggccgcctacctcacggg

SEQ ID NO: 227831 - DNA, 21 bp, Artificial Sequence
  Description of Artificial Sequence: Synthetic oligonucleotide
ctgggccgcctacctcacggg

SEQ ID NO: 227832 - DNA, 21 bp, Artificial Sequence
  Description of Artificial Sequence: Synthetic oligonucleotide
tgggccgcctacctcacgggc

SEQ ID NO: 227833 - DNA, 20 bp, Artificial Sequence
  Description of Artificial Sequence: Synthetic oligonucleotide
gggccgcctacctcacgggc

SEQ ID NO: 227834 - DNA, 20 bp, Artificial Sequence
  Description of Artificial Sequence: Synthetic oligonucleotide
ggccgcctacctcacgggcg

SEQ ID NO: 227835 - DNA, 21 bp, Artificial Sequence
  Description of Artificial Sequence: Synthetic oligonucleotide
gccgcctacctcacgggcgga

SEQ ID NO: 227836 - DNA, 22 bp, Artificial Sequence
  Description of Artificial Sequence: Synthetic oligonucleotide
ccgcctacctcacgggcggaga

SEQ ID NO: 227837 - DNA, 23 bp, Artificial Sequence
  Description of Artificial Sequence: Synthetic oligonucleotide
cgcctacctcacgggcggagaca

SEQ ID NO: 227838 - DNA, 23 bp, Artificial Sequence
  Description of Artificial Sequence: Synthetic oligonucleotide
gcctacctcacgggcggagacac

SEQ ID NO: 227839 - DNA, 25 bp, Artificial Sequence
  Description of Artificial Sequence: Synthetic oligonucleotide
cctacctcacgggcggagacaccat

SEQ ID NO: 227840 - DNA, 27 bp, Artificial Sequence
  Description of Artificial Sequence: Synthetic oligonucleotide
ctacctcacgggcggagacaccatcta

SEQ ID NO: 227841 - DNA, 28 bp, Artificial Sequence
  Description of Artificial Sequence: Synthetic oligonucleotide
gagatcctccaggagttcaccctgcatg

SEQ ID NO: 227842 - DNA, 29 bp, Artificial Sequence
  Description of Artificial Sequence: Synthetic oligonucleotide
agatcctccaggagttcaccctgcatgac

SEQ ID NO: 227843 - DNA, 28 bp, Artificial Sequence
  Description of Artificial Sequence: Synthetic oligonucleotide
gatcctccaggagttcaccctgcatgac

SEQ ID NO: 227844 - DNA, 28 bp, Artificial Sequence
  Description of Artificial Sequence: Synthetic oligonucleotide
atcctccaggagttcaccctgcatgacc

SEQ ID NO: 227845 - DNA, 27 bp, Artificial Sequence
  Description of Artificial Sequence: Synthetic oligonucleotide
tcctccaggagttcaccctgcatgacc

SEQ ID NO: 227846 - DNA, 27 bp, Artificial Sequence
  Description of Artificial Sequence: Synthetic oligonucleotide
cctccaggagttcaccctgcatgacca

SEQ ID NO: 227847 - DNA, 27 bp, Artificial Sequence
  Description of Artificial Sequence: Synthetic oligonucleotide
ctccaggagttcaccctgcatgaccac

SEQ ID NO: 227848 - DNA, 27 bp, Artificial Sequence
  Description of Artificial Sequence: Synthetic oligonucleotide
tccaggagttcaccctgcatgaccacg

SEQ ID NO: 227849 - DNA, 27 bp, Artificial Sequence
  Description of Artificial Sequence: Synthetic oligonucleotide
ccaggagttcaccctgcatgaccacgt

SEQ ID NO: 227850 - DNA, 27 bp, Artificial Sequence
  Description of Artificial Sequence: Synthetic oligonucleotide
caggagttcaccctgcatgaccacgtg

SEQ ID NO: 227851 - DNA, 27 bp, Artificial Sequence
  Description of Artificial Sequence: Synthetic oligonucleotide
aggagttcaccctgcatgaccacgtgc

SEQ ID NO: 227852 - DNA, 26 bp, Artificial Sequence
  Description of Artificial Sequence: Synthetic oligonucleotide
ggagttcaccctgcatgaccacgtgc

SEQ ID NO: 227853 - DNA, 26 bp, Artificial Sequence
  Description of Artificial Sequence: Synthetic oligonucleotide
gagttcaccctgcatgaccacgtgcg

SEQ ID NO: 227854 - DNA, 26 bp, Artificial Sequence
  Description of Artificial Sequence: Synthetic oligonucleotide
agttcaccctgcatgaccacgtgcgg

SEQ ID NO: 227855 - DNA, 25 bp, Artificial Sequence
  Description of Artificial Sequence: Synthetic oligonucleotide
gttcaccctgcatgaccacgtgcgg

SEQ ID NO: 227856 - DNA, 26 bp, Artificial Sequence
  Description of Artificial Sequence: Synthetic oligonucleotide
ttcaccctgcatgaccacgtgcggga

SEQ ID NO: 227857 - DNA, 25 bp, Artificial Sequence
  Description of Artificial Sequence: Synthetic oligonucleotide
tcaccctgcatgaccacgtgcggga

SEQ ID NO: 227858 - DNA, 24 bp, Artificial Sequence
  Description of Artificial Sequence: Synthetic oligonucleotide
caccctgcatgaccacgtgcggga

SEQ ID NO: 227859 - DNA, 24 bp, Artificial Sequence
  Description of Artificial Sequence: Synthetic oligonucleotide
accctgcatgaccacgtgcgggag

SEQ ID NO: 227860 - DNA, 23 bp, Artificial Sequence
  Description of Artificial Sequence: Synthetic oligonucleotide
ccctgcatgaccacgtgcgggag

SEQ ID NO: 227861 - DNA, 24 bp, Artificial Sequence
  Description of Artificial Sequence: Synthetic oligonucleotide
cctgcatgaccacgtgcgggagga

SEQ ID NO: 227862 - DNA, 24 bp, Artificial Sequence
  Description of Artificial Sequence: Synthetic oligonucleotide
ctgcatgaccacgtgcgggaggag

SEQ ID NO: 227863 - DNA, 24 bp, Artificial Sequence
  Description of Artificial Sequence: Synthetic oligonucleotide
tgcatgaccacgtgcgggaggagg

SEQ ID NO: 227864 - DNA, 23 bp, Artificial Sequence
  Description of Artificial Sequence: Synthetic oligonucleotide
gcatgaccacgtgcgggaggagg

SEQ ID NO: 227865 - DNA, 23 bp, Artificial Sequence
  Description of Artificial Sequence: Synthetic oligonucleotide
catgaccacgtgcgggaggaggc

SEQ ID NO: 227866 - DNA, 23 bp, Artificial Sequence
  Description of Artificial Sequence: Synthetic oligonucleotide
atgaccacgtgcgggaggaggcc

SEQ ID NO: 227867 - DNA, 22 bp, Artificial Sequence
  Description of Artificial Sequence: Synthetic oligonucleotide
tgaccacgtgcgggaggaggcc

SEQ ID NO: 227868 - DNA, 27 bp, Artificial Sequence
  Description of Artificial Sequence: Synthetic oligonucleotide
cacctgaacgactggatggaggaggag

SEQ ID NO: 227869 - DNA, 29 bp, Artificial Sequence
  Description of Artificial Sequence: Synthetic oligonucleotide
acctgaacgactggatggaggaggagtac

SEQ ID NO: 227870 - DNA, 28 bp, Artificial Sequence
  Description of Artificial Sequence: Synthetic oligonucleotide
cctgaacgactggatggaggaggagtac

SEQ ID NO: 227871 - DNA, 28 bp, Artificial Sequence
  Description of Artificial Sequence: Synthetic oligonucleotide
ctgaacgactggatggaggaggagtacc

SEQ ID NO: 227872 - DNA, 28 bp, Artificial Sequence
  Description of Artificial Sequence: Synthetic oligonucleotide
tgaacgactggatggaggaggagtaccg

SEQ ID NO: 227873 - DNA, 27 bp, Artificial Sequence
  Description of Artificial Sequence: Synthetic oligonucleotide
gaacgactggatggaggaggagtaccg

SEQ ID NO: 227874 - DNA, 27 bp, Artificial Sequence
  Description of Artificial Sequence: Synthetic oligonucleotide
aacgactggatggaggaggagtaccgc

SEQ ID NO: 227875 - DNA, 26 bp, Artificial Sequence
  Description of Artificial Sequence: Synthetic oligonucleotide
acgactggatggaggaggagtaccgc

SEQ ID NO: 227876 - DNA, 25 bp, Artificial Sequence
  Description of Artificial Sequence: Synthetic oligonucleotide
cgactggatggaggaggagtaccgc

SEQ ID NO: 227877 - DNA, 26 bp, Artificial Sequence
  Description of Artificial Sequence: Synthetic oligonucleotide
gactggatggaggaggagtaccgcca

SEQ ID NO: 227878 - DNA, 27 bp, Artificial Sequence
  Description of Artificial Sequence: Synthetic oligonucleotide
actggatggaggaggagtaccgccaca

SEQ ID NO: 227879 - DNA, 27 bp, Artificial Sequence
  Description of Artificial Sequence: Synthetic oligonucleotide
ctggatggaggaggagtaccgccacat

SEQ ID NO: 227880 - DNA, 27 bp, Artificial Sequence
  Description of Artificial Sequence: Synthetic oligonucleotide
tggatggaggaggagtaccgccacatc

SEQ ID NO: 227881 - DNA, 26 bp, Artificial Sequence
  Description of Artificial Sequence: Synthetic oligonucleotide
ggatggaggaggagtaccgccacatc

SEQ ID NO: 227882 - DNA, 26 bp, Artificial Sequence
  Description of Artificial Sequence: Synthetic oligonucleotide
gatggaggaggagtaccgccacatcc

SEQ ID NO: 227883 - DNA, 26 bp, Artificial Sequence
  Description of Artificial Sequence: Synthetic oligonucleotide
atggaggaggagtaccgccacatccc

SEQ ID NO: 227884 - DNA, 25 bp, Artificial Sequence
  Description of Artificial Sequence: Synthetic oligonucleotide
tggaggaggagtaccgccacatccc

SEQ ID NO: 227885 - DNA, 24 bp, Artificial Sequence
  Description of Artificial Sequence: Synthetic oligonucleotide
ggaggaggagtaccgccacatccc

SEQ ID NO: 227886 - DNA, 24 bp, Artificial Sequence
  Description of Artificial Sequence: Synthetic oligonucleotide
gaggaggagtaccgccacatcccg

SEQ ID NO: 227887 - DNA, 24 bp, Artificial Sequence
  Description of Artificial Sequence: Synthetic oligonucleotide
aggaggagtaccgccacatcccgg

SEQ ID NO: 227888 - DNA, 23 bp, Artificial Sequence
  Description of Artificial Sequence: Synthetic oligonucleotide
ggaggagtaccgccacatcccgg

SEQ ID NO: 227889 - DNA, 23 bp, Artificial Sequence
  Description of Artificial Sequence: Synthetic oligonucleotide
gaggagtaccgccacatcccggg

SEQ ID NO: 227890 - DNA, 23 bp, Artificial Sequence
  Description of Artificial Sequence: Synthetic oligonucleotide
aggagtaccgccacatcccgggg

SEQ ID NO: 227891 - DNA, 22 bp, Artificial Sequence
  Description of Artificial Sequence: Synthetic oligonucleotide
ggagtaccgccacatcccgggg

SEQ ID NO: 227892 - DNA, 23 bp, Artificial Sequence
  Description of Artificial Sequence: Synthetic oligonucleotide
gagtaccgccacatcccggggga

SEQ ID NO: 227893 - DNA, 25 bp, Artificial Sequence
  Description of Artificial Sequence: Synthetic oligonucleotide
agtaccgccacatcccgggggagta

SEQ ID NO: 227894 - DNA, 24 bp, Artificial Sequence
  Description of Artificial Sequence: Synthetic oligonucleotide
gtaccgccacatcccgggggagta

SEQ ID NO: 227895 - DNA, 27 bp, Artificial Sequence
  Description of Artificial Sequence: Synthetic oligonucleotide
acctacagcaggccctggactggttct

SEQ ID NO: 227896 - DNA, 26 bp, Artificial Sequence
  Description of Artificial Sequence: Synthetic oligonucleotide
cctacagcaggccctggactggttct

SEQ ID NO: 227897 - DNA, 27 bp, Artificial Sequence
  Description of Artificial Sequence: Synthetic oligonucleotide
ctacagcaggccctggactggttctga

SEQ ID NO: 227898 - DNA, 27 bp, Artificial Sequence
  Description of Artificial Sequence: Synthetic oligonucleotide
tacagcaggccctggactggttctgag

SEQ ID NO: 227899 - DNA, 26 bp, Artificial Sequence
  Description of Artificial Sequence: Synthetic oligonucleotide
acagcaggccctggactggttctgag

SEQ ID NO: 227900 - DNA, 25 bp, Artificial Sequence
  Description of Artificial Sequence: Synthetic oligonucleotide
cagcaggccctggactggttctgag

SEQ ID NO: 227901 - DNA, 26 bp, Artificial Sequence
  Description of Artificial Sequence: Synthetic oligonucleotide
agcaggccctggactggttctgagct

SEQ ID NO: 227902 - DNA, 25 bp, Artificial Sequence
  Description of Artificial Sequence: Synthetic oligonucleotide
gcaggccctggactggttctgagct

SEQ ID NO: 227903 - DNA, 25 bp, Artificial Sequence
  Description of Artificial Sequence: Synthetic oligonucleotide
caggccctggactggttctgagctc

SEQ ID NO: 227904 - DNA, 25 bp, Artificial Sequence
  Description of Artificial Sequence: Synthetic oligonucleotide
aggccctggactggttctgagctcg

SEQ ID NO: 227905 - DNA, 24 bp, Artificial Sequence
  Description of Artificial Sequence: Synthetic oligonucleotide
ggccctggactggttctgagctcg

SEQ ID NO: 227906 - DNA, 26 bp, Artificial Sequence
  Description of Artificial Sequence: Synthetic oligonucleotide
gccctggactggttctgagctcgcta

SEQ ID NO: 227907 - DNA, 27 bp, Artificial Sequence
  Description of Artificial Sequence: Synthetic oligonucleotide
ccctggactggttctgagctcgctaca

SEQ ID NO: 227908 - DNA, 27 bp, Artificial Sequence
  Description of Artificial Sequence: Synthetic oligonucleotide
cctggactggttctgagctcgctacag

SEQ ID NO: 227909 - DNA, 27 bp, Artificial Sequence
  Description of Artificial Sequence: Synthetic oligonucleotide
ctggactggttctgagctcgctacagc

SEQ ID NO: 227910 - DNA, 28 bp, Artificial Sequence
  Description of Artificial Sequence: Synthetic oligonucleotide
tggactggttctgagctcgctacagctc

SEQ ID NO: 227911 - DNA, 27 bp, Artificial Sequence
  Description of Artificial Sequence: Synthetic oligonucleotide
ggactggttctgagctcgctacagctc

SEQ ID NO: 227912 - DNA, 27 bp, Artificial Sequence
  Description of Artificial Sequence: Synthetic oligonucleotide
gactggttctgagctcgctacagctcc

SEQ ID NO: 227913 - DNA, 27 bp, Artificial Sequence
  Description of Artificial Sequence: Synthetic oligonucleotide
actggttctgagctcgctacagctccc

SEQ ID NO: 227914 - DNA, 27 bp, Artificial Sequence
  Description of Artificial Sequence: Synthetic oligonucleotide
ctggttctgagctcgctacagctccct

SEQ ID NO: 227915 - DNA, 27 bp, Artificial Sequence
  Description of Artificial Sequence: Synthetic oligonucleotide
tggttctgagctcgctacagctccctc

SEQ ID NO: 227916 - DNA, 27 bp, Artificial Sequence
  Description of Artificial Sequence: Synthetic oligonucleotide
ggttctgagctcgctacagctccctca

SEQ ID NO: 227917 - DNA, 28 bp, Artificial Sequence
  Description of Artificial Sequence: Synthetic oligonucleotide
gttctgagctcgctacagctccctcatc

SEQ ID NO: 227918 - DNA, 30 bp, Artificial Sequence
  Description of Artificial Sequence: Synthetic oligonucleotide
ttctgagctcgctacagctccctcatcttc

SEQ ID NO: 227919 - DNA, 29 bp, Artificial Sequence
  Description of Artificial Sequence: Synthetic oligonucleotide
tctgagctcgctacagctccctcatcttc

SEQ ID NO: 227920 - DNA, 28 bp, Artificial Sequence
  Description of Artificial Sequence: Synthetic oligonucleotide
ctgagctcgctacagctccctcatcttc

SEQ ID NO: 227921 - DNA, 28 bp, Artificial Sequence
  Description of Artificial Sequence: Synthetic oligonucleotide
tgagctcgctacagctccctcatcttcg

SEQ ID NO: 227922 - DNA, 27 bp, Artificial Sequence
  Description of Artificial Sequence: Synthetic oligonucleotide
ctcagggggatgtggacgatcaatgcg

SEQ ID NO: 227923 - DNA, 30 bp, Artificial Sequence
  Description of Artificial Sequence: Synthetic oligonucleotide
tcagggggatgtggacgatcaatgcgatag

SEQ ID NO: 227924 - DNA, 29 bp, Artificial Sequence
  Description of Artificial Sequence: Synthetic oligonucleotide
cagggggatgtggacgatcaatgcgatag

SEQ ID NO: 227925 - DNA, 29 bp, Artificial Sequence
  Description of Artificial Sequence: Synthetic oligonucleotide
agggggatgtggacgatcaatgcgatagg

SEQ ID NO: 227926 - DNA, 28 bp, Artificial Sequence
  Description of Artificial Sequence: Synthetic oligonucleotide
gggggatgtggacgatcaatgcgatagg

SEQ ID NO: 227927 - DNA, 28 bp, Artificial Sequence
  Description of Artificial Sequence: Synthetic oligonucleotide
ggggatgtggacgatcaatgcgataggc

SEQ ID NO: 227928 - DNA, 28 bp, Artificial Sequence
  Description of Artificial Sequence: Synthetic oligonucleotide
gggatgtggacgatcaatgcgataggcc

SEQ ID NO: 227929 - DNA, 28 bp, Artificial Sequence
  Description of Artificial Sequence: Synthetic oligonucleotide
ggatgtggacgatcaatgcgataggccg

SEQ ID NO: 227930 - DNA, 28 bp, Artificial Sequence
  Description of Artificial Sequence: Synthetic oligonucleotide
gatgtggacgatcaatgcgataggccgc

SEQ ID NO: 227931 - DNA, 28 bp, Artificial Sequence
  Description of Artificial Sequence: Synthetic oligonucleotide
atgtggacgatcaatgcgataggccgcc

SEQ ID NO: 227932 - DNA, 27 bp, Artificial Sequence
  Description of Artificial Sequence: Synthetic oligonucleotide
tgtggacgatcaatgcgataggccgcc

SEQ ID NO: 227933 - DNA, 27 bp, Artificial Sequence
  Description of Artificial Sequence: Synthetic oligonucleotide
gtggacgatcaatgcgataggccgcct

SEQ ID NO: 227934 - DNA, 27 bp, Artificial Sequence
  Description of Artificial Sequence: Synthetic oligonucleotide
tggacgatcaatgcgataggccgcctg

SEQ ID NO: 227935 - DNA, 26 bp, Artificial Sequence
  Description of Artificial Sequence: Synthetic oligonucleotide
ggacgatcaatgcgataggccgcctg

SEQ ID NO: 227936 - DNA, 26 bp, Artificial Sequence
  Description of Artificial Sequence: Synthetic oligonucleotide
gacgatcaatgcgataggccgcctgg

SEQ ID NO: 227937 - DNA, 26 bp, Artificial Sequence
  Description of Artificial Sequence: Synthetic oligonucleotide
acgatcaatgcgataggccgcctggg

SEQ ID NO: 227938 - DNA, 25 bp, Artificial Sequence
  Description of Artificial Sequence: Synthetic oligonucleotide
cgatcaatgcgataggccgcctggg

SEQ ID NO: 227939 - DNA, 27 bp, Artificial Sequence
  Description of Artificial Sequence: Synthetic oligonucleotide
gatcaatgcgataggccgcctggggaa

SEQ ID NO: 227940 - DNA, 27 bp, Artificial Sequence
  Description of Artificial Sequence: Synthetic oligonucleotide
atcaatgcgataggccgcctggggaac

SEQ ID NO: 227941 - DNA, 26 bp, Artificial Sequence
  Description of Artificial Sequence: Synthetic oligonucleotide
tcaatgcgataggccgcctggggaac

SEQ ID NO: 227942 - DNA, 25 bp, Artificial Sequence
  Description of Artificial Sequence: Synthetic oligonucleotide
caatgcgataggccgcctggggaac

SEQ ID NO: 227943 - DNA, 26 bp, Artificial Sequence
  Description of Artificial Sequence: Synthetic oligonucleotide
aatgcgataggccgcctggggaacca

SEQ ID NO: 227944 - DNA, 25 bp, Artificial Sequence
  Description of Artificial Sequence: Synthetic oligonucleotide
atgcgataggccgcctggggaacca

SEQ ID NO: 227945 - DNA, 24 bp, Artificial Sequence
  Description of Artificial Sequence: Synthetic oligonucleotide
tgcgataggccgcctggggaacca

SEQ ID NO: 227946 - DNA, 23 bp, Artificial Sequence
  Description of Artificial Sequence: Synthetic oligonucleotide
gcgataggccgcctggggaacca

SEQ ID NO: 227947 - DNA, 25 bp, Artificial Sequence
  Description of Artificial Sequence: Synthetic oligonucleotide
cgataggccgcctggggaaccagat

SEQ ID NO: 227948 - DNA, 25 bp, Artificial Sequence
  Description of Artificial Sequence: Synthetic oligonucleotide
gataggccgcctggggaaccagatg

SEQ ID NO: 227949 - DNA, 28 bp, Artificial Sequence
  Description of Artificial Sequence: Synthetic oligonucleotide
cagatgggcgagtacgccacactgtatg

SEQ ID NO: 227950 - DNA, 28 bp, Artificial Sequence
  Description of Artificial Sequence: Synthetic oligonucleotide
agatgggcgagtacgccacactgtatgc

SEQ ID NO: 227951 - DNA, 27 bp, Artificial Sequence
  Description of Artificial Sequence: Synthetic oligonucleotide
gatgggcgagtacgccacactgtatgc

SEQ ID NO: 227952 - DNA, 27 bp, Artificial Sequence
  Description of Artificial Sequence: Synthetic oligonucleotide
atgggcgagtacgccacactgtatgcc

SEQ ID NO: 227953 - DNA, 26 bp, Artificial Sequence
  Description of Artificial Sequence: Synthetic oligonucleotide
tgggcgagtacgccacactgtatgcc

SEQ ID NO: 227954 - DNA, 25 bp, Artificial Sequence
  Description of Artificial Sequence: Synthetic oligonucleotide
gggcgagtacgccacactgtatgcc

SEQ ID NO: 227955 - DNA, 26 bp, Artificial Sequence
  Description of Artificial Sequence: Synthetic oligonucleotide
ggcgagtacgccacactgtatgccct

SEQ ID NO: 227956 - DNA, 26 bp, Artificial Sequence
  Description of Artificial Sequence: Synthetic oligonucleotide
gcgagtacgccacactgtatgccctg

SEQ ID NO: 227957 - DNA, 26 bp, Artificial Sequence
  Description of Artificial Sequence: Synthetic oligonucleotide
cgagtacgccacactgtatgccctgg

SEQ ID NO: 227958 - DNA, 26 bp, Artificial Sequence
  Description of Artificial Sequence: Synthetic oligonucleotide
gagtacgccacactgtatgccctggc

SEQ ID NO: 227959 - DNA, 27 bp, Artificial Sequence
  Description of Artificial Sequence: Synthetic oligonucleotide
agtacgccacactgtatgccctggcca

SEQ ID NO: 227960 - DNA, 27 bp, Artificial Sequence
  Description of Artificial Sequence: Synthetic oligonucleotide
gtacgccacactgtatgccctggccaa

SEQ ID NO: 227961 - DNA, 27 bp, Artificial Sequence
  Description of Artificial Sequence: Synthetic oligonucleotide
tacgccacactgtatgccctggccaag

SEQ ID NO: 227962 - DNA, 27 bp, Artificial Sequence
  Description of Artificial Sequence: Synthetic oligonucleotide
acgccacactgtatgccctggccaaga

SEQ ID NO: 227963 - DNA, 27 bp, Artificial Sequence
  Description of Artificial Sequence: Synthetic oligonucleotide
cgccacactgtatgccctggccaagat

SEQ ID NO: 227964 - DNA, 27 bp, Artificial Sequence
  Description of Artificial Sequence: Synthetic oligonucleotide
gccacactgtatgccctggccaagatg

SEQ ID NO: 227965 - DNA, 29 bp, Artificial Sequence
  Description of Artificial Sequence: Synthetic oligonucleotide
ccacactgtatgccctggccaagatgaac

SEQ ID NO: 227966 - DNA, 29 bp, Artificial Sequence
  Description of Artificial Sequence: Synthetic oligonucleotide
cacactgtatgccctggccaagatgaacg

SEQ ID NO: 227967 - DNA, 29 bp, Artificial Sequence
  Description of Artificial Sequence: Synthetic oligonucleotide
acactgtatgccctggccaagatgaacgg

SEQ ID NO: 227968 - DNA, 28 bp, Artificial Sequence
  Description of Artificial Sequence: Synthetic oligonucleotide
cactgtatgccctggccaagatgaacgg

SEQ ID NO: 227969 - DNA, 28 bp, Artificial Sequence
  Description of Artificial Sequence: Synthetic oligonucleotide
actgtatgccctggccaagatgaacggg

SEQ ID NO: 227970 - DNA, 27 bp, Artificial Sequence
  Description of Artificial Sequence: Synthetic oligonucleotide
ctgtatgccctggccaagatgaacggg

SEQ ID NO: 227971 - DNA, 27 bp, Artificial Sequence
  Description of Artificial Sequence: Synthetic oligonucleotide
tgtatgccctggccaagatgaacgggc

SEQ ID NO: 227972 - DNA, 26 bp, Artificial Sequence
  Description of Artificial Sequence: Synthetic oligonucleotide
gtatgccctggccaagatgaacgggc

SEQ ID NO: 227973 - DNA, 26 bp, Artificial Sequence
  Description of Artificial Sequence: Synthetic oligonucleotide
tatgccctggccaagatgaacgggcg

SEQ ID NO: 227974 - DNA, 25 bp, Artificial Sequence
  Description of Artificial Sequence: Synthetic oligonucleotide
atgccctggccaagatgaacgggcg

SEQ ID NO: 227975 - DNA, 24 bp, Artificial Sequence
  Description of Artificial Sequence: Synthetic oligonucleotide
tgccctggccaagatgaacgggcg

SEQ ID NO: 227976 - DNA, 25 bp, Artificial Sequence
  Description of Artificial Sequence: Synthetic oligonucleotide
gcttcaccggctacccctgctccta

SEQ ID NO: 227977 - DNA, 26 bp, Artificial Sequence
  Description of Artificial Sequence: Synthetic oligonucleotide
cttcaccggctacccctgctcctaga

SEQ ID NO: 227978 - DNA, 26 bp, Artificial Sequence
  Description of Artificial Sequence: Synthetic oligonucleotide
ttcaccggctacccctgctcctagac

SEQ ID NO: 227979 - DNA, 25 bp, Artificial Sequence
  Description of Artificial Sequence: Synthetic oligonucleotide
tcaccggctacccctgctcctagac

SEQ ID NO: 227980 - DNA, 24 bp, Artificial Sequence
  Description of Artificial Sequence: Synthetic oligonucleotide
caccggctacccctgctcctagac

SEQ ID NO: 227981 - DNA, 26 bp, Artificial Sequence
  Description of Artificial Sequence: Synthetic oligonucleotide
accggctacccctgctcctagacctt

SEQ ID NO: 227982 - DNA, 25 bp, Artificial Sequence
  Description of Artificial Sequence: Synthetic oligonucleotide
ccggctacccctgctcctagacctt

SEQ ID NO: 227983 - DNA, 27 bp, Artificial Sequence
  Description of Artificial Sequence: Synthetic oligonucleotide
cggctacccctgctcctagaccttcta

SEQ ID NO: 227984 - DNA, 27 bp, Artificial Sequence
  Description of Artificial Sequence: Synthetic oligonucleotide
ggctacccctgctcctagaccttctac

SEQ ID NO: 227985 - DNA, 27 bp, Artificial Sequence
  Description of Artificial Sequence: Synthetic oligonucleotide
gctacccctgctcctagaccttctacc

SEQ ID NO: 227986 - DNA, 28 bp, Artificial Sequence
  Description of Artificial Sequence: Synthetic oligonucleotide
ctacccctgctcctagaccttctaccac

SEQ ID NO: 227987 - DNA, 28 bp, Artificial Sequence
  Description of Artificial Sequence: Synthetic oligonucleotide
tacccctgctcctagaccttctaccacc

SEQ ID NO: 227988 - DNA, 27 bp, Artificial Sequence
  Description of Artificial Sequence: Synthetic oligonucleotide
acccctgctcctagaccttctaccacc

SEQ ID NO: 227989 - DNA, 27 bp, Artificial Sequence
  Description of Artificial Sequence: Synthetic oligonucleotide
cccctgctcctagaccttctaccacca

SEQ ID NO: 227990 - DNA, 27 bp, Artificial Sequence
  Description of Artificial Sequence: Synthetic oligonucleotide
ccctgctcctagaccttctaccaccac

SEQ ID NO: 227991 - DNA, 27 bp, Artificial Sequence
  Description of Artificial Sequence: Synthetic oligonucleotide
cctgctcctagaccttctaccaccacc

SEQ ID NO: 227992 - DNA, 28 bp, Artificial Sequence
  Description of Artificial Sequence: Synthetic oligonucleotide
ctgctcctagaccttctaccaccacctc

SEQ ID NO: 227993 - DNA, 28 bp, Artificial Sequence
  Description of Artificial Sequence: Synthetic oligonucleotide
tgctcctagaccttctaccaccacctcc

SEQ ID NO: 227994 - DNA, 27 bp, Artificial Sequence
  Description of Artificial Sequence: Synthetic oligonucleotide
gctcctagaccttctaccaccacctcc

SEQ ID NO: 227995 - DNA, 27 bp, Artificial Sequence
  Description of Artificial Sequence: Synthetic oligonucleotide
ctcctagaccttctaccaccacctccg

SEQ ID NO: 227996 - DNA, 27 bp, Artificial Sequence
  Description of Artificial Sequence: Synthetic oligonucleotide
tcctagaccttctaccaccacctccgc

SEQ ID NO: 227997 - DNA, 26 bp, Artificial Sequence
  Description of Artificial Sequence: Synthetic oligonucleotide
cctagaccttctaccaccacctccgc

SEQ ID NO: 227998 - DNA, 27 bp, Artificial Sequence
  Description of Artificial Sequence: Synthetic oligonucleotide
ctagaccttctaccaccacctccgcca

SEQ ID NO: 227999 - DNA, 27 bp, Artificial Sequence
  Description of Artificial Sequence: Synthetic oligonucleotide
tagaccttctaccaccacctccgccag

SEQ ID NO: 228000 - DNA, 26 bp, Artificial Sequence
  Description of Artificial Sequence: Synthetic oligonucleotide
agaccttctaccaccacctccgccag

SEQ ID NO: 228001 - DNA, 29 bp, Artificial Sequence
  Description of Artificial Sequence: Synthetic oligonucleotide
cacctttgtaggggtccatgttcgccaag

SEQ ID NO: 228002 - DNA, 29 bp, Artificial Sequence
  Description of Artificial Sequence: Synthetic oligonucleotide
acctttgtaggggtccatgttcgccaagg

SEQ ID NO: 228003 - DNA, 28 bp, Artificial Sequence
  Description of Artificial Sequence: Synthetic oligonucleotide
cctttgtaggggtccatgttcgccaagg

SEQ ID NO: 228004 - DNA, 28 bp, Artificial Sequence
  Description of Artificial Sequence: Synthetic oligonucleotide
ctttgtaggggtccatgttcgccaaggg

SEQ ID NO: 228005 - DNA, 28 bp, Artificial Sequence
  Description of Artificial Sequence: Synthetic oligonucleotide
tttgtaggggtccatgttcgccaagggg

SEQ ID NO: 228006 - DNA, 27 bp, Artificial Sequence
  Description of Artificial Sequence: Synthetic oligonucleotide
ttgtaggggtccatgttcgccaagggg

SEQ ID NO: 228007 - DNA, 27 bp, Artificial Sequence
  Description of Artificial Sequence: Synthetic oligonucleotide
tgtaggggtccatgttcgccaagggga

SEQ ID NO: 228008 - DNA, 26 bp, Artificial Sequence
  Description of Artificial Sequence: Synthetic oligonucleotide
gtaggggtccatgttcgccaagggga

SEQ ID NO: 228009 - DNA, 27 bp, Artificial Sequence
  Description of Artificial Sequence: Synthetic oligonucleotide
taggggtccatgttcgccaaggggact

SEQ ID NO: 228010 - DNA, 27 bp, Artificial Sequence
  Description of Artificial Sequence: Synthetic oligonucleotide
aggggtccatgttcgccaaggggacta

SEQ ID NO: 228011 - DNA, 27 bp, Artificial Sequence
  Description of Artificial Sequence: Synthetic oligonucleotide
ggggtccatgttcgccaaggggactat

SEQ ID NO: 228012 - DNA, 27 bp, Artificial Sequence
  Description of Artificial Sequence: Synthetic oligonucleotide
gggtccatgttcgccaaggggactatg

SEQ ID NO: 228013 - DNA, 28 bp, Artificial Sequence
  Description of Artificial Sequence: Synthetic oligonucleotide
ggtccatgttcgccaaggggactatgtc

SEQ ID NO: 228014 - DNA, 28 bp, Artificial Sequence
  Description of Artificial Sequence: Synthetic oligonucleotide
gtccatgttcgccaaggggactatgtcc

SEQ ID NO: 228015 - DNA, 30 bp, Artificial Sequence
  Description of Artificial Sequence: Synthetic oligonucleotide
tccatgttcgccaaggggactatgtccatg

SEQ ID NO: 228016 - DNA, 29 bp, Artificial Sequence
  Description of Artificial Sequence: Synthetic oligonucleotide
ccatgttcgccaaggggactatgtccatg

SEQ ID NO: 228017 - DNA, 30 bp, Artificial Sequence
  Description of Artificial Sequence: Synthetic oligonucleotide
catgttcgccaaggggactatgtccatgtc

SEQ ID NO: 228018 - DNA, 32 bp, Artificial Sequence
  Description of Artificial Sequence: Synthetic oligonucleotide
atgttcgccaaggggactatgtccatgtcatg

SEQ ID NO: 228019 - DNA, 31 bp, Artificial Sequence
  Description of Artificial Sequence: Synthetic oligonucleotide
tgttcgccaaggggactatgtccatgtcatg

SEQ ID NO: 228020 - DNA, 30 bp, Artificial Sequence
  Description of Artificial Sequence: Synthetic oligonucleotide
gttcgccaaggggactatgtccatgtcatg

SEQ ID NO: 228021 - DNA, 30 bp, Artificial Sequence
  Description of Artificial Sequence: Synthetic oligonucleotide
ttcgccaaggggactatgtccatgtcatgc

SEQ ID NO: 228022 - DNA, 29 bp, Artificial Sequence
  Description of Artificial Sequence: Synthetic oligonucleotide
tcgccaaggggactatgtccatgtcatgc

SEQ ID NO: 228023 - DNA, 28 bp, Artificial Sequence
  Description of Artificial Sequence: Synthetic oligonucleotide
cgccaaggggactatgtccatgtcatgc

SEQ ID NO: 228024 - DNA, 28 bp, Artificial Sequence
  Description of Artificial Sequence: Synthetic oligonucleotide
gccaaggggactatgtccatgtcatgcc

SEQ ID NO: 228025 - DNA, 32 bp, Artificial Sequence
  Description of Artificial Sequence: Synthetic oligonucleotide
ccaaggggactatgtccatgtcatgccaaaag

SEQ ID NO: 228026 - DNA, 33 bp, Artificial Sequence
  Description of Artificial Sequence: Synthetic oligonucleotide
caaggggactatgtccatgtcatgccaaaagtg

SEQ ID NO: 228027 - DNA, 34 bp, Artificial Sequence
  Description of Artificial Sequence: Synthetic oligonucleotide
aaggggactatgtccatgtcatgccaaaagtgtg

SEQ ID NO: 228028 - DNA, 29 bp, Artificial Sequence
  Description of Artificial Sequence: Synthetic oligonucleotide
tgtcgggagaacattgacacctcccacag

SEQ ID NO: 228029 - DNA, 28 bp, Artificial Sequence
  Description of Artificial Sequence: Synthetic oligonucleotide
gtcgggagaacattgacacctcccacag

SEQ ID NO: 228030 - DNA, 29 bp, Artificial Sequence
  Description of Artificial Sequence: Synthetic oligonucleotide
tcgggagaacattgacacctcccacagtg

SEQ ID NO: 228031 - DNA, 28 bp, Artificial Sequence
  Description of Artificial Sequence: Synthetic oligonucleotide
cgggagaacattgacacctcccacagtg

SEQ ID NO: 228032 - DNA, 30 bp, Artificial Sequence
  Description of Artificial Sequence: Synthetic oligonucleotide
gggagaacattgacacctcccacagtgatg

SEQ ID NO: 228033 - DNA, 31 bp, Artificial Sequence
  Description of Artificial Sequence: Synthetic oligonucleotide
ggagaacattgacacctcccacagtgatgtg

SEQ ID NO: 228034 - DNA, 31 bp, Artificial Sequence
  Description of Artificial Sequence: Synthetic oligonucleotide
gagaacattgacacctcccacagtgatgtgg

SEQ ID NO: 228035 - DNA, 32 bp, Artificial Sequence
  Description of Artificial Sequence: Synthetic oligonucleotide
agaacattgacacctcccacagtgatgtggtg

SEQ ID NO: 228036 - DNA, 31 bp, Artificial Sequence
  Description of Artificial Sequence: Synthetic oligonucleotide
gaacattgacacctcccacagtgatgtggtg

SEQ ID NO: 228037 - DNA, 34 bp, Artificial Sequence
  Description of Artificial Sequence: Synthetic oligonucleotide
aacattgacacctcccacagtgatgtggtgtttg

SEQ ID NO: 228038 - DNA, 33 bp, Artificial Sequence
  Description of Artificial Sequence: Synthetic oligonucleotide
acattgacacctcccacagtgatgtggtgtttg

SEQ ID NO: 228039 - DNA, 32 bp, Artificial Sequence
  Description of Artificial Sequence: Synthetic oligonucleotide
cattgacacctcccacagtgatgtggtgtttg

SEQ ID NO: 228040 - DNA, 32 bp, Artificial Sequence
  Description of Artificial Sequence: Synthetic oligonucleotide
attgacacctcccacagtgatgtggtgtttgc

SEQ ID NO: 228041 - DNA, 31 bp, Artificial Sequence
  Description of Artificial Sequence: Synthetic oligonucleotide
ttgacacctcccacagtgatgtggtgtttgc

SEQ ID NO: 228042 - DNA, 30 bp, Artificial Sequence
  Description of Artificial Sequence: Synthetic oligonucleotide
tgacacctcccacagtgatgtggtgtttgc

SEQ ID NO: 228043 - DNA, 29 bp, Artificial Sequence
  Description of Artificial Sequence: Synthetic oligonucleotide
gacacctcccacagtgatgtggtgtttgc

SEQ ID NO: 228044 - DNA, 30 bp, Artificial Sequence
  Description of Artificial Sequence: Synthetic oligonucleotide
acacctcccacagtgatgtggtgtttgctg

SEQ ID NO: 228045 - DNA, 29 bp, Artificial Sequence
  Description of Artificial Sequence: Synthetic oligonucleotide
cacctcccacagtgatgtggtgtttgctg

SEQ ID NO: 228046 - DNA, 29 bp, Artificial Sequence
  Description of Artificial Sequence: Synthetic oligonucleotide
acctcccacagtgatgtggtgtttgctgg

SEQ ID NO: 228047 - DNA, 28 bp, Artificial Sequence
  Description of Artificial Sequence: Synthetic oligonucleotide
cctcccacagtgatgtggtgtttgctgg

SEQ ID NO: 228048 - DNA, 28 bp, Artificial Sequence
  Description of Artificial Sequence: Synthetic oligonucleotide
ctcccacagtgatgtggtgtttgctggc

SEQ ID NO: 228049 - DNA, 28 bp, Artificial Sequence
  Description of Artificial Sequence: Synthetic oligonucleotide
tcccacagtgatgtggtgtttgctggcg

SEQ ID NO: 228050 - DNA, 27 bp, Artificial Sequence
  Description of Artificial Sequence: Synthetic oligonucleotide
cccacagtgatgtggtgtttgctggcg

SEQ ID NO: 228051 - DNA, 29 bp, Artificial Sequence
  Description of Artificial Sequence: Synthetic oligonucleotide
ccacagtgatgtggtgtttgctggcgatg

SEQ ID NO: 228052 - DNA, 29 bp, Artificial Sequence
  Description of Artificial Sequence: Synthetic oligonucleotide
cacagtgatgtggtgtttgctggcgatgg

SEQ ID NO: 228053 - DNA, 29 bp, Artificial Sequence
  Description of Artificial Sequence: Synthetic oligonucleotide
acagtgatgtggtgtttgctggcgatggc

SEQ ID NO: 228054 - DNA, 28 bp, Artificial Sequence
  Description of Artificial Sequence: Synthetic oligonucleotide
cagtgatgtggtgtttgctggcgatggc

SEQ ID NO: 228055 - DNA, 31 bp, Artificial Sequence
  Description of Artificial Sequence: Synthetic oligonucleotide
agtgatgtggtgtttgctggcgatggcattg

SEQ ID NO: 228056 - DNA, 23 bp, Artificial Sequence
  Description of Artificial Sequence: Synthetic oligonucleotide
gcagccttcctgccggagtggac

SEQ ID NO: 228057 - DNA, 23 bp, Artificial Sequence
  Description of Artificial Sequence: Synthetic oligonucleotide
cagccttcctgccggagtggacg

SEQ ID NO: 228058 - DNA, 23 bp, Artificial Sequence
  Description of Artificial Sequence: Synthetic oligonucleotide
agccttcctgccggagtggacgg

SEQ ID NO: 228059 - DNA, 22 bp, Artificial Sequence
  Description of Artificial Sequence: Synthetic oligonucleotide
gccttcctgccggagtggacgg

SEQ ID NO: 228060 - DNA, 22 bp, Artificial Sequence
  Description of Artificial Sequence: Synthetic oligonucleotide
ccttcctgccggagtggacggg

SEQ ID NO: 228061 - DNA, 25 bp, Artificial Sequence
  Description of Artificial Sequence: Synthetic oligonucleotide
cttcctgccggagtggacggggatt

SEQ ID NO: 228062 - DNA, 25 bp, Artificial Sequence
  Description of Artificial Sequence: Synthetic oligonucleotide
ttcctgccggagtggacggggattg

SEQ ID NO: 228063 - DNA, 24 bp, Artificial Sequence
  Description of Artificial Sequence: Synthetic oligonucleotide
tcctgccggagtggacggggattg

SEQ ID NO: 228064 - DNA, 23 bp, Artificial Sequence
  Description of Artificial Sequence: Synthetic oligonucleotide
cctgccggagtggacggggattg

SEQ ID NO: 228065 - DNA, 23 bp, Artificial Sequence
  Description of Artificial Sequence: Synthetic oligonucleotide
ctgccggagtggacggggattgc

SEQ ID NO: 228066 - DNA, 23 bp, Artificial Sequence
  Description of Artificial Sequence: Synthetic oligonucleotide
tgccggagtggacggggattgcc

SEQ ID NO: 228067 - DNA, 22 bp, Artificial Sequence
  Description of Artificial Sequence: Synthetic oligonucleotide
gccggagtggacggggattgcc

SEQ ID NO: 228068 - DNA, 22 bp, Artificial Sequence
  Description of Artificial Sequence: Synthetic oligonucleotide
ccggagtggacggggattgccg

SEQ ID NO: 228069 - DNA, 23 bp, Artificial Sequence
  Description of Artificial Sequence: Synthetic oligonucleotide
cggagtggacggggattgccgca

SEQ ID NO: 228070 - DNA, 24 bp, Artificial Sequence
  Description of Artificial Sequence: Synthetic oligonucleotide
ggagtggacggggattgccgcaga

SEQ ID NO: 228071 - DNA, 24 bp, Artificial Sequence
  Description of Artificial Sequence: Synthetic oligonucleotide
gagtggacggggattgccgcagac

SEQ ID NO: 228072 - DNA, 25 bp, Artificial Sequence
  Description of Artificial Sequence: Synthetic oligonucleotide
agtggacggggattgccgcagacct

SEQ ID NO: 228073 - DNA, 24 bp, Artificial Sequence
  Description of Artificial Sequence: Synthetic oligonucleotide
gtggacggggattgccgcagacct

SEQ ID NO: 228074 - DNA, 25 bp, Artificial Sequence
  Description of Artificial Sequence: Synthetic oligonucleotide
tggacggggattgccgcagacctgt

SEQ ID NO: 228075 - DNA, 24 bp, Artificial Sequence
  Description of Artificial Sequence: Synthetic oligonucleotide
ggacggggattgccgcagacctgt

SEQ ID NO: 228076 - DNA, 24 bp, Artificial Sequence
  Description of Artificial Sequence: Synthetic oligonucleotide
gacggggattgccgcagacctgtc

SEQ ID NO: 228077 - DNA, 24 bp, Artificial Sequence
  Description of Artificial Sequence: Synthetic oligonucleotide
acggggattgccgcagacctgtcc

SEQ ID NO: 228078 - DNA, 23 bp, Artificial Sequence
  Description of Artificial Sequence: Synthetic oligonucleotide
cggggattgccgcagacctgtcc

SEQ ID NO: 228079 - DNA, 23 bp, Artificial Sequence
  Description of Artificial Sequence: Synthetic oligonucleotide
ggggattgccgcagacctgtccc

SEQ ID NO: 228080 - DNA, 24 bp, Artificial Sequence
  Description of Artificial Sequence: Synthetic oligonucleotide
tggccaagatgaacgggcggccca

SEQ ID NO: 228081 - DNA, 23 bp, Artificial Sequence
  Description of Artificial Sequence: Synthetic oligonucleotide
ggccaagatgaacgggcggccca

SEQ ID NO: 228082 - DNA, 23 bp, Artificial Sequence
  Description of Artificial Sequence: Synthetic oligonucleotide
gccaagatgaacgggcggcccac

SEQ ID NO: 228083 - DNA, 25 bp, Artificial Sequence
  Description of Artificial Sequence: Synthetic oligonucleotide
ccaagatgaacgggcggcccacctt

SEQ ID NO: 228084 - DNA, 27 bp, Artificial Sequence
  Description of Artificial Sequence: Synthetic oligonucleotide
caagatgaacgggcggcccaccttcat

SEQ ID NO: 228085 - DNA, 27 bp, Artificial Sequence
  Description of Artificial Sequence: Synthetic oligonucleotide
aagatgaacgggcggcccaccttcatc

SEQ ID NO: 228086 - DNA, 26 bp, Artificial Sequence
  Description of Artificial Sequence: Synthetic oligonucleotide
agatgaacgggcggcccaccttcatc

SEQ ID NO: 228087 - DNA, 25 bp, Artificial Sequence
  Description of Artificial Sequence: Synthetic oligonucleotide
gatgaacgggcggcccaccttcatc

SEQ ID NO: 228088 - DNA, 25 bp, Artificial Sequence
  Description of Artificial Sequence: Synthetic oligonucleotide
atgaacgggcggcccaccttcatcc

SEQ ID NO: 228089 - DNA, 24 bp, Artificial Sequence
  Description of Artificial Sequence: Synthetic oligonucleotide
tgaacgggcggcccaccttcatcc

SEQ ID NO: 228090 - DNA, 23 bp, Artificial Sequence
  Description of Artificial Sequence: Synthetic oligonucleotide
gaacgggcggcccaccttcatcc

SEQ ID NO: 228091 - DNA, 23 bp, Artificial Sequence
  Description of Artificial Sequence: Synthetic oligonucleotide
aacgggcggcccaccttcatccc

SEQ ID NO: 228092 - DNA, 22 bp, Artificial Sequence
  Description of Artificial Sequence: Synthetic oligonucleotide
acgggcggcccaccttcatccc

SEQ ID NO: 228093 - DNA, 21 bp, Artificial Sequence
  Description of Artificial Sequence: Synthetic oligonucleotide
cgggcggcccaccttcatccc

SEQ ID NO: 228094 - DNA, 21 bp, Artificial Sequence
  Description of Artificial Sequence: Synthetic oligonucleotide
gggcggcccaccttcatcccg

SEQ ID NO: 228095 - DNA, 21 bp, Artificial Sequence
  Description of Artificial Sequence: Synthetic oligonucleotide
ggcggcccaccttcatcccgg

SEQ ID NO: 228096 - DNA, 21 bp, Artificial Sequence
  Description of Artificial Sequence: Synthetic oligonucleotide
gcggcccaccttcatcccggc

SEQ ID NO: 228097 - DNA, 21 bp, Artificial Sequence
  Description of Artificial Sequence: Synthetic oligonucleotide
cggcccaccttcatcccggcc

SEQ ID NO: 228098 - DNA, 22 bp, Artificial Sequence
  Description of Artificial Sequence: Synthetic oligonucleotide
ggcccaccttcatcccggccca

SEQ ID NO: 228099 - DNA, 24 bp, Artificial Sequence
  Description of Artificial Sequence: Synthetic oligonucleotide
gcccaccttcatcccggcccagat

SEQ ID NO: 228100 - DNA, 24 bp, Artificial Sequence
  Description of Artificial Sequence: Synthetic oligonucleotide
cccaccttcatcccggcccagatg

SEQ ID NO: 228101 - DNA, 25 bp, Artificial Sequence
  Description of Artificial Sequence: Synthetic oligonucleotide
ccaccttcatcccggcccagatgca

SEQ ID NO: 228102 - DNA, 26 bp, Artificial Sequence
  Description of Artificial Sequence: Synthetic oligonucleotide
caccttcatcccggcccagatgcaca

SEQ ID NO: 228103 - DNA, 26 bp, Artificial Sequence
  Description of Artificial Sequence: Synthetic oligonucleotide
accttcatcccggcccagatgcacag

SEQ ID NO: 228104 - DNA, 29 bp, Artificial Sequence
  Description of Artificial Sequence: Synthetic oligonucleotide
actggatggaggaggaataccgccacttc

SEQ ID NO: 228105 - DNA, 28 bp, Artificial Sequence
  Description of Artificial Sequence: Synthetic oligonucleotide
ctggatggaggaggaataccgccacttc

SEQ ID NO: 228106 - DNA, 28 bp, Artificial Sequence
  Description of Artificial Sequence: Synthetic oligonucleotide
tggatggaggaggaataccgccacttcc

SEQ ID NO: 228107 - DNA, 27 bp, Artificial Sequence
  Description of Artificial Sequence: Synthetic oligonucleotide
ggatggaggaggaataccgccacttcc

SEQ ID NO: 228108 - DNA, 27 bp, Artificial Sequence
  Description of Artificial Sequence: Synthetic oligonucleotide
gatggaggaggaataccgccacttccc

SEQ ID NO: 228109 - DNA, 27 bp, Artificial Sequence
  Description of Artificial Sequence: Synthetic oligonucleotide
atggaggaggaataccgccacttcccg

SEQ ID NO: 228110 - DNA, 26 bp, Artificial Sequence
  Description of Artificial Sequence: Synthetic oligonucleotide
tggaggaggaataccgccacttcccg

SEQ ID NO: 228111 - DNA, 25 bp, Artificial Sequence
  Description of Artificial Sequence: Synthetic oligonucleotide
ggaggaggaataccgccacttcccg

SEQ ID NO: 228112 - DNA, 25 bp, Artificial Sequence
  Description of Artificial Sequence: Synthetic oligonucleotide
gaggaggaataccgccacttcccgg

SEQ ID NO: 228113 - DNA, 25 bp, Artificial Sequence
  Description of Artificial Sequence: Synthetic oligonucleotide
aggaggaataccgccacttcccggg

SEQ ID NO: 228114 - DNA, 24 bp, Artificial Sequence
  Description of Artificial Sequence: Synthetic oligonucleotide
ggaggaataccgccacttcccggg

SEQ ID NO: 228115 - DNA, 24 bp, Artificial Sequence
  Description of Artificial Sequence: Synthetic oligonucleotide
gaggaataccgccacttcccgggg

SEQ ID NO: 228116 - DNA, 25 bp, Artificial Sequence
  Description of Artificial Sequence: Synthetic oligonucleotide
aggaataccgccacttcccggggga

SEQ ID NO: 228117 - DNA, 24 bp, Artificial Sequence
  Description of Artificial Sequence: Synthetic oligonucleotide
ggaataccgccacttcccggggga

SEQ ID NO: 228118 - DNA, 26 bp, Artificial Sequence
  Description of Artificial Sequence: Synthetic oligonucleotide
gaataccgccacttcccgggggagta

SEQ ID NO: 228119 - DNA, 26 bp, Artificial Sequence
  Description of Artificial Sequence: Synthetic oligonucleotide
aataccgccacttcccgggggagtac

SEQ ID NO: 228120 - DNA, 25 bp, Artificial Sequence
  Description of Artificial Sequence: Synthetic oligonucleotide
ataccgccacttcccgggggagtac

SEQ ID NO: 228121 - DNA, 24 bp, Artificial Sequence
  Description of Artificial Sequence: Synthetic oligonucleotide
taccgccacttcccgggggagtac

SEQ ID NO: 228122 - DNA, 23 bp, Artificial Sequence
  Description of Artificial Sequence: Synthetic oligonucleotide
accgccacttcccgggggagtac

SEQ ID NO: 228123 - DNA, 22 bp, Artificial Sequence
  Description of Artificial Sequence: Synthetic oligonucleotide
ccgccacttcccgggggagtac

SEQ ID NO: 228124 - DNA, 23 bp, Artificial Sequence
  Description of Artificial Sequence: Synthetic oligonucleotide
cgccacttcccgggggagtacgt

SEQ ID NO: 228125 - DNA, 23 bp, Artificial Sequence
  Description of Artificial Sequence: Synthetic oligonucleotide
gccacttcccgggggagtacgtc

SEQ ID NO: 228126 - DNA, 23 bp, Artificial Sequence
  Description of Artificial Sequence: Synthetic oligonucleotide
ccacttcccgggggagtacgtcc

SEQ ID NO: 228127 - DNA, 23 bp, Artificial Sequence
  Description of Artificial Sequence: Synthetic oligonucleotide
cacttcccgggggagtacgtccg

SEQ ID NO: 228128 - DNA, 25 bp, Artificial Sequence
  Description of Artificial Sequence: Synthetic oligonucleotide
acttcccgggggagtacgtccgctt

SEQ ID NO: 228129 - DNA, 24 bp, Artificial Sequence
  Description of Artificial Sequence: Synthetic oligonucleotide
cttcccgggggagtacgtccgctt

SEQ ID NO: 228130 - DNA, 25 bp, Artificial Sequence
  Description of Artificial Sequence: Synthetic oligonucleotide
ttcccgggggagtacgtccgcttca

SEQ ID NO: 228131 - DNA, 24 bp, Artificial Sequence
  Description of Artificial Sequence: Synthetic oligonucleotide
ggcccagatgcacagcaccctggt

SEQ ID NO: 228132 - DNA, 24 bp, Artificial Sequence
  Description of Artificial Sequence: Synthetic oligonucleotide
gcccagatgcacagcaccctggtc

SEQ ID NO: 228133 - DNA, 24 bp, Artificial Sequence
  Description of Artificial Sequence: Synthetic oligonucleotide
cccagatgcacagcaccctggtcc

SEQ ID NO: 228134 - DNA, 24 bp, Artificial Sequence
  Description of Artificial Sequence: Synthetic oligonucleotide
ccagatgcacagcaccctggtccc

SEQ ID NO: 228135 - DNA, 26 bp, Artificial Sequence
  Description of Artificial Sequence: Synthetic oligonucleotide
cagatgcacagcaccctggtccccat

SEQ ID NO: 228136 - DNA, 27 bp, Artificial Sequence
  Description of Artificial Sequence: Synthetic oligonucleotide
agatgcacagcaccctggtccccatct

SEQ ID NO: 228137 - DNA, 27 bp, Artificial Sequence
  Description of Artificial Sequence: Synthetic oligonucleotide
gatgcacagcaccctggtccccatctt

SEQ ID NO: 228138 - DNA, 27 bp, Artificial Sequence
  Description of Artificial Sequence: Synthetic oligonucleotide
atgcacagcaccctggtccccatcttc

SEQ ID NO: 228139 - DNA, 27 bp, Artificial Sequence
  Description of Artificial Sequence: Synthetic oligonucleotide
tgcacagcaccctggtccccatcttca

SEQ ID NO: 228140 - DNA, 26 bp, Artificial Sequence
  Description of Artificial Sequence: Synthetic oligonucleotide
gcacagcaccctggtccccatcttca

SEQ ID NO: 228141 - DNA, 27 bp, Artificial Sequence
  Description of Artificial Sequence: Synthetic oligonucleotide
cacagcaccctggtccccatcttcaga

SEQ ID NO: 228142 - DNA, 29 bp, Artificial Sequence
  Description of Artificial Sequence: Synthetic oligonucleotide
acagcaccctggtccccatcttcagaatc

SEQ ID NO: 228143 - DNA, 28 bp, Artificial Sequence
  Description of Artificial Sequence: Synthetic oligonucleotide
cagcaccctggtccccatcttcagaatc

SEQ ID NO: 228144 - DNA, 29 bp, Artificial Sequence
  Description of Artificial Sequence: Synthetic oligonucleotide
agcaccctggtccccatcttcagaatcac

SEQ ID NO: 228145 - DNA, 28 bp, Artificial Sequence
  Description of Artificial Sequence: Synthetic oligonucleotide
gcaccctggtccccatcttcagaatcac

SEQ ID NO: 228146 - DNA, 28 bp, Artificial Sequence
  Description of Artificial Sequence: Synthetic oligonucleotide
caccctggtccccatcttcagaatcacc

SEQ ID NO: 228147 - DNA, 28 bp, Artificial Sequence
  Description of Artificial Sequence: Synthetic oligonucleotide
accctggtccccatcttcagaatcaccc

SEQ ID NO: 228148 - DNA, 27 bp, Artificial Sequence
  Description of Artificial Sequence: Synthetic oligonucleotide
ccctggtccccatcttcagaatcaccc

SEQ ID NO: 228149 - DNA, 28 bp, Artificial Sequence
  Description of Artificial Sequence: Synthetic oligonucleotide
cctggtccccatcttcagaatcaccctg

SEQ ID NO: 228150 - DNA, 28 bp, Artificial Sequence
  Description of Artificial Sequence: Synthetic oligonucleotide
ctggtccccatcttcagaatcaccctgc

SEQ ID NO: 228151 - DNA, 28 bp, Artificial Sequence
  Description of Artificial Sequence: Synthetic oligonucleotide
tggtccccatcttcagaatcaccctgcc

SEQ ID NO: 228152 - DNA, 27 bp, Artificial Sequence
  Description of Artificial Sequence: Synthetic oligonucleotide
ggtccccatcttcagaatcaccctgcc

SEQ ID NO: 228153 - DNA, 27 bp, Artificial Sequence
  Description of Artificial Sequence: Synthetic oligonucleotide
gtccccatcttcagaatcaccctgccg

SEQ ID NO: 228154 - DNA, 27 bp, Artificial Sequence
  Description of Artificial Sequence: Synthetic oligonucleotide
tccccatcttcagaatcaccctgccgg

SEQ ID NO: 228155 - DNA, 32 bp, Artificial Sequence
  Description of Artificial Sequence: Synthetic oligonucleotide
acctgaatgactggatggaggaggaataccac

SEQ ID NO: 228156 - DNA, 31 bp, Artificial Sequence
  Description of Artificial Sequence: Synthetic oligonucleotide
cctgaatgactggatggaggaggaataccac

SEQ ID NO: 228157 - DNA, 31 bp, Artificial Sequence
  Description of Artificial Sequence: Synthetic oligonucleotide
ctgaatgactggatggaggaggaataccacc

SEQ ID NO: 228158 - DNA, 32 bp, Artificial Sequence
  Description of Artificial Sequence: Synthetic oligonucleotide
tgaatgactggatggaggaggaataccaccac

SEQ ID NO: 228159 - DNA, 31 bp, Artificial Sequence
  Description of Artificial Sequence: Synthetic oligonucleotide
gaatgactggatggaggaggaataccaccac

SEQ ID NO: 228160 - DNA, 33 bp, Artificial Sequence
  Description of Artificial Sequence: Synthetic oligonucleotide
aatgactggatggaggaggaataccaccacttc

SEQ ID NO: 228161 - DNA, 32 bp, Artificial Sequence
  Description of Artificial Sequence: Synthetic oligonucleotide
atgactggatggaggaggaataccaccacttc

SEQ ID NO: 228162 - DNA, 31 bp, Artificial Sequence
  Description of Artificial Sequence: Synthetic oligonucleotide
tgactggatggaggaggaataccaccacttc

SEQ ID NO: 228163 - DNA, 30 bp, Artificial Sequence
  Description of Artificial Sequence: Synthetic oligonucleotide
gactggatggaggaggaataccaccacttc

SEQ ID NO: 228164 - DNA, 30 bp, Artificial Sequence
  Description of Artificial Sequence: Synthetic oligonucleotide
actggatggaggaggaataccaccacttcc

SEQ ID NO: 228165 - DNA, 29 bp, Artificial Sequence
  Description of Artificial Sequence: Synthetic oligonucleotide
ctggatggaggaggaataccaccacttcc

SEQ ID NO: 228166 - DNA, 29 bp, Artificial Sequence
  Description of Artificial Sequence: Synthetic oligonucleotide
tggatggaggaggaataccaccacttccc

SEQ ID NO: 228167 - DNA, 28 bp, Artificial Sequence
  Description of Artificial Sequence: Synthetic oligonucleotide
ggatggaggaggaataccaccacttccc

SEQ ID NO: 228168 - DNA, 28 bp, Artificial Sequence
  Description of Artificial Sequence: Synthetic oligonucleotide
gatggaggaggaataccaccacttcccg

SEQ ID NO: 228169 - DNA, 28 bp, Artificial Sequence
  Description of Artificial Sequence: Synthetic oligonucleotide
atggaggaggaataccaccacttcccgg

SEQ ID NO: 228170 - DNA, 27 bp, Artificial Sequence
  Description of Artificial Sequence: Synthetic oligonucleotide
tggaggaggaataccaccacttcccgg

SEQ ID NO: 228171 - DNA, 26 bp, Artificial Sequence
  Description of Artificial Sequence: Synthetic oligonucleotide
ggaggaggaataccaccacttcccgg

SEQ ID NO: 228172 - DNA, 26 bp, Artificial Sequence
  Description of Artificial Sequence: Synthetic oligonucleotide
gaggaggaataccaccacttcccggg

SEQ ID NO: 228173 - DNA, 26 bp, Artificial Sequence
  Description of Artificial Sequence: Synthetic oligonucleotide
aggaggaataccaccacttcccgggg

SEQ ID NO: 228174 - DNA, 25 bp, Artificial Sequence
  Description of Artificial Sequence: Synthetic oligonucleotide
ggaggaataccaccacttcccgggg

SEQ ID NO: 228175 - DNA, 26 bp, Artificial Sequence
  Description of Artificial Sequence: Synthetic oligonucleotide
gaggaataccaccacttcccggggga

SEQ ID NO: 228176 - DNA, 27 bp, Artificial Sequence
  Description of Artificial Sequence: Synthetic oligonucleotide
aggaataccaccacttcccgggggagt

SEQ ID NO: 228177 - DNA, 27 bp, Artificial Sequence
  Description of Artificial Sequence: Synthetic oligonucleotide
ggaataccaccacttcccgggggagta

SEQ ID NO: 228178 - DNA, 27 bp, Artificial Sequence
  Description of Artificial Sequence: Synthetic oligonucleotide
gaataccaccacttcccgggggagtac

SEQ ID NO: 228179 - DNA, 27 bp, Artificial Sequence
  Description of Artificial Sequence: Synthetic oligonucleotide
aataccaccacttcccgggggagtacg

SEQ ID NO: 228180 - DNA, 27 bp, Artificial Sequence
  Description of Artificial Sequence: Synthetic oligonucleotide
ataccaccacttcccgggggagtacgt

SEQ ID NO: 228181 - DNA, 26 bp, Artificial Sequence
  Description of Artificial Sequence: Synthetic oligonucleotide
taccaccacttcccgggggagtacgt

SEQ ID NO: 228182 - DNA, 25 bp, Artificial Sequence
  Description of Artificial Sequence: Synthetic oligonucleotide
accaccacttcccgggggagtacgt

SEQ ID NO: 228183 - DNA, 24 bp, Artificial Sequence
  Description of Artificial Sequence: Synthetic oligonucleotide
ccaccacttcccgggggagtacgt

SEQ ID NO: 228184 - DNA, 24 bp, Artificial Sequence
  Description of Artificial Sequence: Synthetic oligonucleotide
caccacttcccgggggagtacgtc

SEQ ID NO: 228185 - DNA, 24 bp, Artificial Sequence
  Description of Artificial Sequence: Synthetic oligonucleotide
accacttcccgggggagtacgtcc

SEQ ID NO: 228186 - DNA, 29 bp, Artificial Sequence
  Description of Artificial Sequence: Synthetic oligonucleotide
tcaccagtaatggcatggcctggtgtcag

SEQ ID NO: 228187 - DNA, 28 bp, Artificial Sequence
  Description of Artificial Sequence: Synthetic oligonucleotide
caccagtaatggcatggcctggtgtcag

SEQ ID NO: 228188 - DNA, 28 bp, Artificial Sequence
  Description of Artificial Sequence: Synthetic oligonucleotide
accagtaatggcatggcctggtgtcagg

SEQ ID NO: 228189 - DNA, 27 bp, Artificial Sequence
  Description of Artificial Sequence: Synthetic oligonucleotide
ccagtaatggcatggcctggtgtcagg

SEQ ID NO: 228190 - DNA, 28 bp, Artificial Sequence
  Description of Artificial Sequence: Synthetic oligonucleotide
cagtaatggcatggcctggtgtcaggag

SEQ ID NO: 228191 - DNA, 30 bp, Artificial Sequence
  Description of Artificial Sequence: Synthetic oligonucleotide
agtaatggcatggcctggtgtcaggagaac

SEQ ID NO: 228192 - DNA, 29 bp, Artificial Sequence
  Description of Artificial Sequence: Synthetic oligonucleotide
gtaatggcatggcctggtgtcaggagaac

SEQ ID NO: 228193 - DNA, 32 bp, Artificial Sequence
  Description of Artificial Sequence: Synthetic oligonucleotide
taatggcatggcctggtgtcaggagaacattg

SEQ ID NO: 228194 - DNA, 31 bp, Artificial Sequence
  Description of Artificial Sequence: Synthetic oligonucleotide
aatggcatggcctggtgtcaggagaacattg

SEQ ID NO: 228195 - DNA, 30 bp, Artificial Sequence
  Description of Artificial Sequence: Synthetic oligonucleotide
atggcatggcctggtgtcaggagaacattg

SEQ ID NO: 228196 - DNA, 29 bp, Artificial Sequence
  Description of Artificial Sequence: Synthetic oligonucleotide
tggcatggcctggtgtcaggagaacattg

SEQ ID NO: 228197 - DNA, 28 bp, Artificial Sequence
  Description of Artificial Sequence: Synthetic oligonucleotide
ggcatggcctggtgtcaggagaacattg

SEQ ID NO: 228198 - DNA, 29 bp, Artificial Sequence
  Description of Artificial Sequence: Synthetic oligonucleotide
gcatggcctggtgtcaggagaacattgac

SEQ ID NO: 228199 - DNA, 30 bp, Artificial Sequence
  Description of Artificial Sequence: Synthetic oligonucleotide
catggcctggtgtcaggagaacattgacac

SEQ ID NO: 228200 - DNA, 30 bp, Artificial Sequence
  Description of Artificial Sequence: Synthetic oligonucleotide
atggcctggtgtcaggagaacattgacacc

SEQ ID NO: 228201 - DNA, 29 bp, Artificial Sequence
  Description of Artificial Sequence: Synthetic oligonucleotide
tggcctggtgtcaggagaacattgacacc

SEQ ID NO: 228202 - DNA, 28 bp, Artificial Sequence
  Description of Artificial Sequence: Synthetic oligonucleotide
ggcctggtgtcaggagaacattgacacc

SEQ ID NO: 228203 - DNA, 29 bp, Artificial Sequence
  Description of Artificial Sequence: Synthetic oligonucleotide
gcctggtgtcaggagaacattgacacctc

SEQ ID NO: 228204 - DNA, 29 bp, Artificial Sequence
  Description of Artificial Sequence: Synthetic oligonucleotide
cctggtgtcaggagaacattgacacctcc

SEQ ID NO: 228205 - DNA, 29 bp, Artificial Sequence
  Description of Artificial Sequence: Synthetic oligonucleotide
ctggtgtcaggagaacattgacacctccc

SEQ ID NO: 228206 - DNA, 30 bp, Artificial Sequence
  Description of Artificial Sequence: Synthetic oligonucleotide
tggtgtcaggagaacattgacacctcccac

SEQ ID NO: 228207 - DNA, 29 bp, Artificial Sequence
  Description of Artificial Sequence: Synthetic oligonucleotide
ggtgtcaggagaacattgacacctcccac

SEQ ID NO: 228208 - DNA, 29 bp, Artificial Sequence
  Description of Artificial Sequence: Synthetic oligonucleotide
gtgtcaggagaacattgacacctcccacg

SEQ ID NO: 228209 - DNA, 29 bp, Artificial Sequence
  Description of Artificial Sequence: Synthetic oligonucleotide
tgtcaggagaacattgacacctcccacgg

SEQ ID NO: 228210 - DNA, 28 bp, Artificial Sequence
  Description of Artificial Sequence: Synthetic oligonucleotide
gtcaggagaacattgacacctcccacgg

SEQ ID NO: 228211 - DNA, 29 bp, Artificial Sequence
  Description of Artificial Sequence: Synthetic oligonucleotide
tcaggagaacattgacacctcccacggtg

SEQ ID NO: 228212 - DNA, 28 bp, Artificial Sequence
  Description of Artificial Sequence: Synthetic oligonucleotide
caggagaacattgacacctcccacggtg

SEQ ID NO: 228213 - DNA, 30 bp, Artificial Sequence
  Description of Artificial Sequence: Synthetic oligonucleotide
aggagaacattgacacctcccacggtgatg

SEQ ID NO: 228214 - DNA, 28 bp, Artificial Sequence
  Description of Artificial Sequence: Synthetic oligonucleotide
attgacacctcccacggtgatgtggtgg

SEQ ID NO: 228215 - DNA, 27 bp, Artificial Sequence
  Description of Artificial Sequence: Synthetic oligonucleotide
ttgacacctcccacggtgatgtggtgg

SEQ ID NO: 228216 - DNA, 27 bp, Artificial Sequence
  Description of Artificial Sequence: Synthetic oligonucleotide
tgacacctcccacggtgatgtggtggt

SEQ ID NO: 228217 - DNA, 26 bp, Artificial Sequence
  Description of Artificial Sequence: Synthetic oligonucleotide
gacacctcccacggtgatgtggtggt

SEQ ID NO: 228218 - DNA, 27 bp, Artificial Sequence
  Description of Artificial Sequence: Synthetic oligonucleotide
acacctcccacggtgatgtggtggtgt

SEQ ID NO: 228219 - DNA, 27 bp, Artificial Sequence
  Description of Artificial Sequence: Synthetic oligonucleotide
cacctcccacggtgatgtggtggtgtt

SEQ ID NO: 228220 - DNA, 28 bp, Artificial Sequence
  Description of Artificial Sequence: Synthetic oligonucleotide
acctcccacggtgatgtggtggtgtttg

SEQ ID NO: 228221 - DNA, 27 bp, Artificial Sequence
  Description of Artificial Sequence: Synthetic oligonucleotide
cctcccacggtgatgtggtggtgtttg

SEQ ID NO: 228222 - DNA, 27 bp, Artificial Sequence
  Description of Artificial Sequence: Synthetic oligonucleotide
ctcccacggtgatgtggtggtgtttgc

SEQ ID NO: 228223 - DNA, 28 bp, Artificial Sequence
  Description of Artificial Sequence: Synthetic oligonucleotide
tcccacggtgatgtggtggtgtttgctg

SEQ ID NO: 228224 - DNA, 27 bp, Artificial Sequence
  Description of Artificial Sequence: Synthetic oligonucleotide
cccacggtgatgtggtggtgtttgctg

SEQ ID NO: 228225 - DNA, 27 bp, Artificial Sequence
  Description of Artificial Sequence: Synthetic oligonucleotide
ccacggtgatgtggtggtgtttgctgg

SEQ ID NO: 228226 - DNA, 27 bp, Artificial Sequence
  Description of Artificial Sequence: Synthetic oligonucleotide
cacggtgatgtggtggtgtttgctggc

SEQ ID NO: 228227 - DNA, 27 bp, Artificial Sequence
  Description of Artificial Sequence: Synthetic oligonucleotide
acggtgatgtggtggtgtttgctggcg

SEQ ID NO: 228228 - DNA, 27 bp, Artificial Sequence
  Description of Artificial Sequence: Synthetic oligonucleotide
cggtgatgtggtggtgtttgctggcga

SEQ ID NO: 228229 - DNA, 28 bp, Artificial Sequence
  Description of Artificial Sequence: Synthetic oligonucleotide
ggtgatgtggtggtgtttgctggcgatg

SEQ ID NO: 228230 - DNA, 28 bp, Artificial Sequence
  Description of Artificial Sequence: Synthetic oligonucleotide
gtgatgtggtggtgtttgctggcgatgg

SEQ ID NO: 228231 - DNA, 28 bp, Artificial Sequence
  Description of Artificial Sequence: Synthetic oligonucleotide
tgatgtggtggtgtttgctggcgatggc

SEQ ID NO: 228232 - DNA, 27 bp, Artificial Sequence
  Description of Artificial Sequence: Synthetic oligonucleotide
gatgtggtggtgtttgctggcgatggc

SEQ ID NO: 228233 - DNA, 30 bp, Artificial Sequence
  Description of Artificial Sequence: Synthetic oligonucleotide
atgtggtggtgtttgctggcgatggcattg

SEQ ID NO: 228234 - DNA, 29 bp, Artificial Sequence
  Description of Artificial Sequence: Synthetic oligonucleotide
tgtggtggtgtttgctggcgatggcattg

SEQ ID NO: 228235 - DNA, 28 bp, Artificial Sequence
  Description of Artificial Sequence: Synthetic oligonucleotide
gtggtggtgtttgctggcgatggcattg

SEQ ID NO: 228236 - DNA, 29 bp, Artificial Sequence
  Description of Artificial Sequence: Synthetic oligonucleotide
tggtggtgtttgctggcgatggcattgag

SEQ ID NO: 228237 - DNA, 28 bp, Artificial Sequence
  Description of Artificial Sequence: Synthetic oligonucleotide
ggtggtgtttgctggcgatggcattgag

SEQ ID NO: 228238 - DNA, 25 bp, Artificial Sequence
  Description of Artificial Sequence: Synthetic oligonucleotide
aggccctggactggttccgagctca

SEQ ID NO: 228239 - DNA, 24 bp, Artificial Sequence
  Description of Artificial Sequence: Synthetic oligonucleotide
ggccctggactggttccgagctca

SEQ ID NO: 228240 - DNA, 26 bp, Artificial Sequence
  Description of Artificial Sequence: Synthetic oligonucleotide
gccctggactggttccgagctcacta

SEQ ID NO: 228241 - DNA, 27 bp, Artificial Sequence
  Description of Artificial Sequence: Synthetic oligonucleotide
ccctggactggttccgagctcactaca

SEQ ID NO: 228242 - DNA, 27 bp, Artificial Sequence
  Description of Artificial Sequence: Synthetic oligonucleotide
cctggactggttccgagctcactacag

SEQ ID NO: 228243 - DNA, 27 bp, Artificial Sequence
  Description of Artificial Sequence: Synthetic oligonucleotide
ctggactggttccgagctcactacagc

SEQ ID NO: 228244 - DNA, 28 bp, Artificial Sequence
  Description of Artificial Sequence: Synthetic oligonucleotide
tggactggttccgagctcactacagctc

SEQ ID NO: 228245 - DNA, 27 bp, Artificial Sequence
  Description of Artificial Sequence: Synthetic oligonucleotide
ggactggttccgagctcactacagctc

SEQ ID NO: 228246 - DNA, 27 bp, Artificial Sequence
  Description of Artificial Sequence: Synthetic oligonucleotide
gactggttccgagctcactacagctcc

SEQ ID NO: 228247 - DNA, 27 bp, Artificial Sequence
  Description of Artificial Sequence: Synthetic oligonucleotide
actggttccgagctcactacagctccc

SEQ ID NO: 228248 - DNA, 27 bp, Artificial Sequence
  Description of Artificial Sequence: Synthetic oligonucleotide
ctggttccgagctcactacagctccct

SEQ ID NO: 228249 - DNA, 27 bp, Artificial Sequence
  Description of Artificial Sequence: Synthetic oligonucleotide
tggttccgagctcactacagctccctc

SEQ ID NO: 228250 - DNA, 27 bp, Artificial Sequence
  Description of Artificial Sequence: Synthetic oligonucleotide
ggttccgagctcactacagctccctca

SEQ ID NO: 228251 - DNA, 28 bp, Artificial Sequence
  Description of Artificial Sequence: Synthetic oligonucleotide
gttccgagctcactacagctccctcatc

SEQ ID NO: 228252 - DNA, 30 bp, Artificial Sequence
  Description of Artificial Sequence: Synthetic oligonucleotide
ttccgagctcactacagctccctcatcttc

SEQ ID NO: 228253 - DNA, 29 bp, Artificial Sequence
  Description of Artificial Sequence: Synthetic oligonucleotide
tccgagctcactacagctccctcatcttc

SEQ ID NO: 228254 - DNA, 28 bp, Artificial Sequence
  Description of Artificial Sequence: Synthetic oligonucleotide
ccgagctcactacagctccctcatcttc

SEQ ID NO: 228255 - DNA, 28 bp, Artificial Sequence
  Description of Artificial Sequence: Synthetic oligonucleotide
cgagctcactacagctccctcatcttcg

SEQ ID NO: 228256 - DNA, 29 bp, Artificial Sequence
  Description of Artificial Sequence: Synthetic oligonucleotide
gagctcactacagctccctcatcttcgtg

SEQ ID NO: 228257 - DNA, 29 bp, Artificial Sequence
  Description of Artificial Sequence: Synthetic oligonucleotide
agctcactacagctccctcatcttcgtgg

SEQ ID NO: 228258 - DNA, 28 bp, Artificial Sequence
  Description of Artificial Sequence: Synthetic oligonucleotide
gctcactacagctccctcatcttcgtgg

SEQ ID NO: 228259 - DNA, 29 bp, Artificial Sequence
  Description of Artificial Sequence: Synthetic oligonucleotide
ctcactacagctccctcatcttcgtggtc

SEQ ID NO: 228260 - DNA, 30 bp, Artificial Sequence
  Description of Artificial Sequence: Synthetic oligonucleotide
tcactacagctccctcatcttcgtggtcac

SEQ ID NO: 228261 - DNA, 29 bp, Artificial Sequence
  Description of Artificial Sequence: Synthetic oligonucleotide
cactacagctccctcatcttcgtggtcac

SEQ ID NO: 228262 - DNA, 29 bp, Artificial Sequence
  Description of Artificial Sequence: Synthetic oligonucleotide
actacagctccctcatcttcgtggtcacc

SEQ ID NO: 228263 - DNA, 26 bp, Artificial Sequence
  Description of Artificial Sequence: Synthetic oligonucleotide
cattgggacgttcgggatctgggcca

SEQ ID NO: 228264 - DNA, 27 bp, Artificial Sequence
  Description of Artificial Sequence: Synthetic oligonucleotide
attgggacgttcgggatctgggccaca

SEQ ID NO: 228265 - DNA, 27 bp, Artificial Sequence
  Description of Artificial Sequence: Synthetic oligonucleotide
ttgggacgttcgggatctgggccacat

SEQ ID NO: 228266 - DNA, 27 bp, Artificial Sequence
  Description of Artificial Sequence: Synthetic oligonucleotide
tgggacgttcgggatctgggccacata

SEQ ID NO: 228267 - DNA, 26 bp, Artificial Sequence
  Description of Artificial Sequence: Synthetic oligonucleotide
gggacgttcgggatctgggccacata

SEQ ID NO: 228268 - DNA, 26 bp, Artificial Sequence
  Description of Artificial Sequence: Synthetic oligonucleotide
ggacgttcgggatctgggccacatac

SEQ ID NO: 228269 - DNA, 27 bp, Artificial Sequence
  Description of Artificial Sequence: Synthetic oligonucleotide
gacgttcgggatctgggccacatacct

SEQ ID NO: 228270 - DNA, 27 bp, Artificial Sequence
  Description of Artificial Sequence: Synthetic oligonucleotide
acgttcgggatctgggccacatacctc

SEQ ID NO: 228271 - DNA, 27 bp, Artificial Sequence
  Description of Artificial Sequence: Synthetic oligonucleotide
cgttcgggatctgggccacatacctca

SEQ ID NO: 228272 - DNA, 27 bp, Artificial Sequence
  Description of Artificial Sequence: Synthetic oligonucleotide
gttcgggatctgggccacatacctcac

SEQ ID NO: 228273 - DNA, 27 bp, Artificial Sequence
  Description of Artificial Sequence: Synthetic oligonucleotide
ttcgggatctgggccacatacctcacg

SEQ ID NO: 228274 - DNA, 26 bp, Artificial Sequence
  Description of Artificial Sequence: Synthetic oligonucleotide
tcgggatctgggccacatacctcacg

SEQ ID NO: 228275 - DNA, 25 bp, Artificial Sequence
  Description of Artificial Sequence: Synthetic oligonucleotide
cgggatctgggccacatacctcacg

SEQ ID NO: 228276 - DNA, 25 bp, Artificial Sequence
  Description of Artificial Sequence: Synthetic oligonucleotide
gggatctgggccacatacctcacgg

SEQ ID NO: 228277 - DNA, 25 bp, Artificial Sequence
  Description of Artificial Sequence: Synthetic oligonucleotide
ggatctgggccacatacctcacggg

SEQ ID NO: 228278 - DNA, 25 bp, Artificial Sequence
  Description of Artificial Sequence: Synthetic oligonucleotide
gatctgggccacatacctcacgggc

SEQ ID NO: 228279 - DNA, 25 bp, Artificial Sequence
  Description of Artificial Sequence: Synthetic oligonucleotide
atctgggccacatacctcacgggcg

SEQ ID NO: 228280 - DNA, 24 bp, Artificial Sequence
  Description of Artificial Sequence: Synthetic oligonucleotide
tctgggccacatacctcacgggcg

SEQ ID NO: 228281 - DNA, 23 bp, Artificial Sequence
  Description of Artificial Sequence: Synthetic oligonucleotide
ctgggccacatacctcacgggcg

SEQ ID NO: 228282 - DNA, 24 bp, Artificial Sequence
  Description of Artificial Sequence: Synthetic oligonucleotide
tgggccacatacctcacgggcgga

SEQ ID NO: 228283 - DNA, 23 bp, Artificial Sequence
  Description of Artificial Sequence: Synthetic oligonucleotide
gggccacatacctcacgggcgga

SEQ ID NO: 228284 - DNA, 24 bp, Artificial Sequence
  Description of Artificial Sequence: Synthetic oligonucleotide
ggccacatacctcacgggcggaga

SEQ ID NO: 228285 - DNA, 25 bp, Artificial Sequence
  Description of Artificial Sequence: Synthetic oligonucleotide
gccacatacctcacgggcggagaca

SEQ ID NO: 228286 - DNA, 25 bp, Artificial Sequence
  Description of Artificial Sequence: Synthetic oligonucleotide
ccacatacctcacgggcggagacac

SEQ ID NO: 228287 - DNA, 27 bp, Artificial Sequence
  Description of Artificial Sequence: Synthetic oligonucleotide
cacatacctcacgggcggagacaccat

SEQ ID NO: 228288 - DNA, 27 bp, Artificial Sequence
  Description of Artificial Sequence: Synthetic oligonucleotide
acatacctcacgggcggagacaccatc

SEQ ID NO: 228289 - DNA, 27 bp, Artificial Sequence
  Description of Artificial Sequence: Synthetic oligonucleotide
tgctggcgatggcattgagggctcact

SEQ ID NO: 228290 - DNA, 26 bp, Artificial Sequence
  Description of Artificial Sequence: Synthetic oligonucleotide
gctggcgatggcattgagggctcact

SEQ ID NO: 228291 - DNA, 26 bp, Artificial Sequence
  Description of Artificial Sequence: Synthetic oligonucleotide
ctggcgatggcattgagggctcactg

SEQ ID NO: 228292 - DNA, 26 bp, Artificial Sequence
  Description of Artificial Sequence: Synthetic oligonucleotide
tggcgatggcattgagggctcactgc

SEQ ID NO: 228293 - DNA, 25 bp, Artificial Sequence
  Description of Artificial Sequence: Synthetic oligonucleotide
ggcgatggcattgagggctcactgc

SEQ ID NO: 228294 - DNA, 27 bp, Artificial Sequence
  Description of Artificial Sequence: Synthetic oligonucleotide
gcgatggcattgagggctcactgccaa

SEQ ID NO: 228295 - DNA, 28 bp, Artificial Sequence
  Description of Artificial Sequence: Synthetic oligonucleotide
cgatggcattgagggctcactgccaaag

SEQ ID NO: 228296 - DNA, 33 bp, Artificial Sequence
  Description of Artificial Sequence: Synthetic oligonucleotide
gatggcattgagggctcactgccaaagattttg

SEQ ID NO: 228297 - DNA, 33 bp, Artificial Sequence
  Description of Artificial Sequence: Synthetic oligonucleotide
atggcattgagggctcactgccaaagattttgc

SEQ ID NO: 228298 - DNA, 32 bp, Artificial Sequence
  Description of Artificial Sequence: Synthetic oligonucleotide
tggcattgagggctcactgccaaagattttgc

SEQ ID NO: 228299 - DNA, 31 bp, Artificial Sequence
  Description of Artificial Sequence: Synthetic oligonucleotide
ggcattgagggctcactgccaaagattttgc

SEQ ID NO: 228300 - DNA, 32 bp, Artificial Sequence
  Description of Artificial Sequence: Synthetic oligonucleotide
gcattgagggctcactgccaaagattttgctc

SEQ ID NO: 228301 - DNA, 34 bp, Artificial Sequence
  Description of Artificial Sequence: Synthetic oligonucleotide
cattgagggctcactgccaaagattttgctctac

SEQ ID NO: 228302 - DNA, 35 bp, Artificial Sequence
  Description of Artificial Sequence: Synthetic oligonucleotide
attgagggctcactgccaaagattttgctctactc

SEQ ID NO: 228303 - DNA, 34 bp, Artificial Sequence
  Description of Artificial Sequence: Synthetic oligonucleotide
ttgagggctcactgccaaagattttgctctactc

SEQ ID NO: 228304 - DNA, 33 bp, Artificial Sequence
  Description of Artificial Sequence: Synthetic oligonucleotide
tgagggctcactgccaaagattttgctctactc

SEQ ID NO: 228305 - DNA, 32 bp, Artificial Sequence
  Description of Artificial Sequence: Synthetic oligonucleotide
gagggctcactgccaaagattttgctctactc

SEQ ID NO: 228306 - DNA, 33 bp, Artificial Sequence
  Description of Artificial Sequence: Synthetic oligonucleotide
agggctcactgccaaagattttgctctactcac

SEQ ID NO: 228307 - DNA, 32 bp, Artificial Sequence
  Description of Artificial Sequence: Synthetic oligonucleotide
gggctcactgccaaagattttgctctactcac

SEQ ID NO: 228308 - DNA, 33 bp, Artificial Sequence
  Description of Artificial Sequence: Synthetic oligonucleotide
ggctcactgccaaagattttgctctactcacac

SEQ ID NO: 228309 - DNA, 34 bp, Artificial Sequence
  Description of Artificial Sequence: Synthetic oligonucleotide
gctcactgccaaagattttgctctactcacacag

SEQ ID NO: 228310 - DNA, 35 bp, Artificial Sequence
  Description of Artificial Sequence: Synthetic oligonucleotide
ctcactgccaaagattttgctctactcacacagtg

SEQ ID NO: 228311 - DNA, 38 bp, Artificial Sequence
  Description of Artificial Sequence: Synthetic oligonucleotide
tcactgccaaagattttgctctactcacacagtgtaac

SEQ ID NO: 228312 - DNA, 37 bp, Artificial Sequence
  Description of Artificial Sequence: Synthetic oligonucleotide
cactgccaaagattttgctctactcacacagtgtaac

SEQ ID NO: 228313 - DNA, 37 bp, Artificial Sequence
  Description of Artificial Sequence: Synthetic oligonucleotide
actgccaaagattttgctctactcacacagtgtaacc

SEQ ID NO: 228314 - DNA, 29 bp, Artificial Sequence
  Description of Artificial Sequence: Synthetic oligonucleotide
gagctcgctacagctccctcatcttcatg

SEQ ID NO: 228315 - DNA, 29 bp, Artificial Sequence
  Description of Artificial Sequence: Synthetic oligonucleotide
agctcgctacagctccctcatcttcatgg

SEQ ID NO: 228316 - DNA, 28 bp, Artificial Sequence
  Description of Artificial Sequence: Synthetic oligonucleotide
gctcgctacagctccctcatcttcatgg

SEQ ID NO: 228317 - DNA, 29 bp, Artificial Sequence
  Description of Artificial Sequence: Synthetic oligonucleotide
ctcgctacagctccctcatcttcatggtc

SEQ ID NO: 228318 - DNA, 30 bp, Artificial Sequence
  Description of Artificial Sequence: Synthetic oligonucleotide
tcgctacagctccctcatcttcatggtcac

SEQ ID NO: 228319 - DNA, 29 bp, Artificial Sequence
  Description of Artificial Sequence: Synthetic oligonucleotide
cgctacagctccctcatcttcatggtcac

SEQ ID NO: 228320 - DNA, 29 bp, Artificial Sequence
  Description of Artificial Sequence: Synthetic oligonucleotide
gctacagctccctcatcttcatggtcacc

SEQ ID NO: 228321 - DNA, 30 bp, Artificial Sequence
  Description of Artificial Sequence: Synthetic oligonucleotide
ctacagctccctcatcttcatggtcaccag

SEQ ID NO: 228322 - DNA, 34 bp, Artificial Sequence
  Description of Artificial Sequence: Synthetic oligonucleotide
tacagctccctcatcttcatggtcaccagtaatg

SEQ ID NO: 228323 - DNA, 33 bp, Artificial Sequence
  Description of Artificial Sequence: Synthetic oligonucleotide
acagctccctcatcttcatggtcaccagtaatg

SEQ ID NO: 228324 - DNA, 32 bp, Artificial Sequence
  Description of Artificial Sequence: Synthetic oligonucleotide
cagctccctcatcttcatggtcaccagtaatg

SEQ ID NO: 228325 - DNA, 32 bp, Artificial Sequence
  Description of Artificial Sequence: Synthetic oligonucleotide
agctccctcatcttcatggtcaccagtaatgg

SEQ ID NO: 228326 - DNA, 31 bp, Artificial Sequence
  Description of Artificial Sequence: Synthetic oligonucleotide
gctccctcatcttcatggtcaccagtaatgg

SEQ ID NO: 228327 - DNA, 31 bp, Artificial Sequence
  Description of Artificial Sequence: Synthetic oligonucleotide
ctccctcatcttcatggtcaccagtaatggc

SEQ ID NO: 228328 - DNA, 33 bp, Artificial Sequence
  Description of Artificial Sequence: Synthetic oligonucleotide
tccctcatcttcatggtcaccagtaatggcatg

SEQ ID NO: 228329 - DNA, 32 bp, Artificial Sequence
  Description of Artificial Sequence: Synthetic oligonucleotide
ccctcatcttcatggtcaccagtaatggcatg

SEQ ID NO: 228330 - DNA, 32 bp, Artificial Sequence
  Description of Artificial Sequence: Synthetic oligonucleotide
cctcatcttcatggtcaccagtaatggcatgg

SEQ ID NO: 228331 - DNA, 32 bp, Artificial Sequence
  Description of Artificial Sequence: Synthetic oligonucleotide
ctcatcttcatggtcaccagtaatggcatggc

SEQ ID NO: 228332 - DNA, 32 bp, Artificial Sequence
  Description of Artificial Sequence: Synthetic oligonucleotide
tcatcttcatggtcaccagtaatggcatggcc

SEQ ID NO: 228333 - DNA, 31 bp, Artificial Sequence
  Description of Artificial Sequence: Synthetic oligonucleotide
catcttcatggtcaccagtaatggcatggcc

SEQ ID NO: 228334 - DNA, 32 bp, Artificial Sequence
  Description of Artificial Sequence: Synthetic oligonucleotide
atcttcatggtcaccagtaatggcatggcctg

SEQ ID NO: 228335 - DNA, 31 bp, Artificial Sequence
  Description of Artificial Sequence: Synthetic oligonucleotide
tcttcatggtcaccagtaatggcatggcctg

SEQ ID NO: 228336 - DNA, 30 bp, Artificial Sequence
  Description of Artificial Sequence: Synthetic oligonucleotide
cttcatggtcaccagtaatggcatggcctg

SEQ ID NO: 228337 - DNA, 30 bp, Artificial Sequence
  Description of Artificial Sequence: Synthetic oligonucleotide
ttcatggtcaccagtaatggcatggcctgg

SEQ ID NO: 228338 - DNA, 29 bp, Artificial Sequence
  Description of Artificial Sequence: Synthetic oligonucleotide
tcatggtcaccagtaatggcatggcctgg

SEQ ID NO: 228339 - DNA, 28 bp, Artificial Sequence
  Description of Artificial Sequence: Synthetic oligonucleotide
catggtcaccagtaatggcatggcctgg

SEQ ID NO: 228340 - DNA, 29 bp, Artificial Sequence
  Description of Artificial Sequence: Synthetic oligonucleotide
atggtcaccagtaatggcatggcctggtg

SEQ ID NO: 228341 - DNA, 27 bp, Artificial Sequence
  Description of Artificial Sequence: Synthetic oligonucleotide
aataccgccacatcccgggggagtaca

SEQ ID NO: 228342 - DNA, 27 bp, Artificial Sequence
  Description of Artificial Sequence: Synthetic oligonucleotide
ataccgccacatcccgggggagtacat

SEQ ID NO: 228343 - DNA, 26 bp, Artificial Sequence
  Description of Artificial Sequence: Synthetic oligonucleotide
taccgccacatcccgggggagtacat

SEQ ID NO: 228344 - DNA, 25 bp, Artificial Sequence
  Description of Artificial Sequence: Synthetic oligonucleotide
accgccacatcccgggggagtacat

SEQ ID NO: 228345 - DNA, 24 bp, Artificial Sequence
  Description of Artificial Sequence: Synthetic oligonucleotide
ccgccacatcccgggggagtacat

SEQ ID NO: 228346 - DNA, 24 bp, Artificial Sequence
  Description of Artificial Sequence: Synthetic oligonucleotide
cgccacatcccgggggagtacatc

SEQ ID NO: 228347 - DNA, 24 bp, Artificial Sequence
  Description of Artificial Sequence: Synthetic oligonucleotide
gccacatcccgggggagtacatcc

SEQ ID NO: 228348 - DNA, 24 bp, Artificial Sequence
  Description of Artificial Sequence: Synthetic oligonucleotide
ccacatcccgggggagtacatccg

SEQ ID NO: 228349 - DNA, 26 bp, Artificial Sequence
  Description of Artificial Sequence: Synthetic oligonucleotide
cacatcccgggggagtacatccgctt

SEQ ID NO: 228350 - DNA, 27 bp, Artificial Sequence
  Description of Artificial Sequence: Synthetic oligonucleotide
acatcccgggggagtacatccgcttca

SEQ ID NO: 228351 - DNA, 26 bp, Artificial Sequence
  Description of Artificial Sequence: Synthetic oligonucleotide
catcccgggggagtacatccgcttca

SEQ ID NO: 228352 - DNA, 26 bp, Artificial Sequence
  Description of Artificial Sequence: Synthetic oligonucleotide
atcccgggggagtacatccgcttcac

SEQ ID NO: 228353 - DNA, 25 bp, Artificial Sequence
  Description of Artificial Sequence: Synthetic oligonucleotide
tcccgggggagtacatccgcttcac

SEQ ID NO: 228354 - DNA, 24 bp, Artificial Sequence
  Description of Artificial Sequence: Synthetic oligonucleotide
cccgggggagtacatccgcttcac

SEQ ID NO: 228355 - DNA, 24 bp, Artificial Sequence
  Description of Artificial Sequence: Synthetic oligonucleotide
ccgggggagtacatccgcttcacc

SEQ ID NO: 228356 - DNA, 24 bp, Artificial Sequence
  Description of Artificial Sequence: Synthetic oligonucleotide
cgggggagtacatccgcttcaccg

SEQ ID NO: 228357 - DNA, 24 bp, Artificial Sequence
  Description of Artificial Sequence: Synthetic oligonucleotide
gggggagtacatccgcttcaccgg

SEQ ID NO: 228358 - DNA, 26 bp, Artificial Sequence
  Description of Artificial Sequence: Synthetic oligonucleotide
ggggagtacatccgcttcaccggcta

SEQ ID NO: 228359 - DNA, 26 bp, Artificial Sequence
  Description of Artificial Sequence: Synthetic oligonucleotide
gggagtacatccgcttcaccggctac

SEQ ID NO: 228360 - DNA, 26 bp, Artificial Sequence
  Description of Artificial Sequence: Synthetic oligonucleotide
ggagtacatccgcttcaccggctacc

SEQ ID NO: 228361 - DNA, 26 bp, Artificial Sequence
  Description of Artificial Sequence: Synthetic oligonucleotide
gagtacatccgcttcaccggctaccc

SEQ ID NO: 228362 - DNA, 27 bp, Artificial Sequence
  Description of Artificial Sequence: Synthetic oligonucleotide
agtacatccgcttcaccggctacccct

SEQ ID NO: 228363 - DNA, 26 bp, Artificial Sequence
  Description of Artificial Sequence: Synthetic oligonucleotide
gtacatccgcttcaccggctacccct

SEQ ID NO: 228364 - DNA, 26 bp, Artificial Sequence
  Description of Artificial Sequence: Synthetic oligonucleotide
tacatccgcttcaccggctacccctg

SEQ ID NO: 228365 - DNA, 25 bp, Artificial Sequence
  Description of Artificial Sequence: Synthetic oligonucleotide
acatccgcttcaccggctacccctg

SEQ ID NO: 228366 - DNA, 24 bp, Artificial Sequence
  Description of Artificial Sequence: Synthetic oligonucleotide
catccgcttcaccggctacccctg

SEQ ID NO: 228367 - DNA, 25 bp, Artificial Sequence
  Description of Artificial Sequence: Synthetic oligonucleotide
atccgcttcaccggctacccctgct

SEQ ID NO: 228368 - DNA, 32 bp, Artificial Sequence
  Description of Artificial Sequence: Synthetic oligonucleotide
cacctgaatgactggatggaggaggaatactg

SEQ ID NO: 228369 - DNA, 32 bp, Artificial Sequence
  Description of Artificial Sequence: Synthetic oligonucleotide
acctgaatgactggatggaggaggaatactgc

SEQ ID NO: 228370 - DNA, 31 bp, Artificial Sequence
  Description of Artificial Sequence: Synthetic oligonucleotide
cctgaatgactggatggaggaggaatactgc

SEQ ID NO: 228371 - DNA, 31 bp, Artificial Sequence
  Description of Artificial Sequence: Synthetic oligonucleotide
ctgaatgactggatggaggaggaatactgcc

SEQ ID NO: 228372 - DNA, 32 bp, Artificial Sequence
  Description of Artificial Sequence: Synthetic oligonucleotide
tgaatgactggatggaggaggaatactgccac

SEQ ID NO: 228373 - DNA, 31 bp, Artificial Sequence
  Description of Artificial Sequence: Synthetic oligonucleotide
gaatgactggatggaggaggaatactgccac

SEQ ID NO: 228374 - DNA, 33 bp, Artificial Sequence
  Description of Artificial Sequence: Synthetic oligonucleotide
aatgactggatggaggaggaatactgccacatc

SEQ ID NO: 228375 - DNA, 32 bp, Artificial Sequence
  Description of Artificial Sequence: Synthetic oligonucleotide
atgactggatggaggaggaatactgccacatc

SEQ ID NO: 228376 - DNA, 31 bp, Artificial Sequence
  Description of Artificial Sequence: Synthetic oligonucleotide
tgactggatggaggaggaatactgccacatc

SEQ ID NO: 228377 - DNA, 30 bp, Artificial Sequence
  Description of Artificial Sequence: Synthetic oligonucleotide
gactggatggaggaggaatactgccacatc

SEQ ID NO: 228378 - DNA, 30 bp, Artificial Sequence
  Description of Artificial Sequence: Synthetic oligonucleotide
actggatggaggaggaatactgccacatcc

SEQ ID NO: 228379 - DNA, 29 bp, Artificial Sequence
  Description of Artificial Sequence: Synthetic oligonucleotide
ctggatggaggaggaatactgccacatcc

SEQ ID NO: 228380 - DNA, 29 bp, Artificial Sequence
  Description of Artificial Sequence: Synthetic oligonucleotide
tggatggaggaggaatactgccacatccc

SEQ ID NO: 228381 - DNA, 28 bp, Artificial Sequence
  Description of Artificial Sequence: Synthetic oligonucleotide
ggatggaggaggaatactgccacatccc

SEQ ID NO: 228382 - DNA, 28 bp, Artificial Sequence
  Description of Artificial Sequence: Synthetic oligonucleotide
gatggaggaggaatactgccacatcccg

SEQ ID NO: 228383 - DNA, 28 bp, Artificial Sequence
  Description of Artificial Sequence: Synthetic oligonucleotide
atggaggaggaatactgccacatcccgg

SEQ ID NO: 228384 - DNA, 27 bp, Artificial Sequence
  Description of Artificial Sequence: Synthetic oligonucleotide
tggaggaggaatactgccacatcccgg

SEQ ID NO: 228385 - DNA, 26 bp, Artificial Sequence
  Description of Artificial Sequence: Synthetic oligonucleotide
ggaggaggaatactgccacatcccgg

SEQ ID NO: 228386 - DNA, 26 bp, Artificial Sequence
  Description of Artificial Sequence: Synthetic oligonucleotide
gaggaggaatactgccacatcccggg

SEQ ID NO: 228387 - DNA, 26 bp, Artificial Sequence
  Description of Artificial Sequence: Synthetic oligonucleotide
aggaggaatactgccacatcccgggg

SEQ ID NO: 228388 - DNA, 25 bp, Artificial Sequence
  Description of Artificial Sequence: Synthetic oligonucleotide
ggaggaatactgccacatcccgggg

SEQ ID NO: 228389 - DNA, 26 bp, Artificial Sequence
  Description of Artificial Sequence: Synthetic oligonucleotide
gaggaatactgccacatcccggggga

SEQ ID NO: 228390 - DNA, 27 bp, Artificial Sequence
  Description of Artificial Sequence: Synthetic oligonucleotide
aggaatactgccacatcccgggggagt

SEQ ID NO: 228391 - DNA, 27 bp, Artificial Sequence
  Description of Artificial Sequence: Synthetic oligonucleotide
ggaatactgccacatcccgggggagta

SEQ ID NO: 228392 - DNA, 27 bp, Artificial Sequence
  Description of Artificial Sequence: Synthetic oligonucleotide
gaatactgccacatcccgggggagtac

SEQ ID NO: 228393 - DNA, 27 bp, Artificial Sequence
  Description of Artificial Sequence: Synthetic oligonucleotide
aatactgccacatcccgggggagtacg

SEQ ID NO: 228394 - DNA, 27 bp, Artificial Sequence
  Description of Artificial Sequence: Synthetic oligonucleotide
atactgccacatcccgggggagtacgt

SEQ ID NO: 228395 - DNA, 26 bp, Artificial Sequence
  Description of Artificial Sequence: Synthetic oligonucleotide
tactgccacatcccgggggagtacgt

SEQ ID NO: 228396 - DNA, 25 bp, Artificial Sequence
  Description of Artificial Sequence: Synthetic oligonucleotide
actgccacatcccgggggagtacgt

SEQ ID NO: 228397 - DNA, 24 bp, Artificial Sequence
  Description of Artificial Sequence: Synthetic oligonucleotide
ctgccacatcccgggggagtacgt

SEQ ID NO: 228398 - DNA, 24 bp, Artificial Sequence
  Description of Artificial Sequence: Synthetic oligonucleotide
tgccacatcccgggggagtacgtc

SEQ ID NO: 228399 - DNA, 28 bp, Artificial Sequence
  Description of Artificial Sequence: Synthetic oligonucleotide
gggcacctttgtaggggtccatgttcac

SEQ ID NO: 228400 - DNA, 28 bp, Artificial Sequence
  Description of Artificial Sequence: Synthetic oligonucleotide
ggcacctttgtaggggtccatgttcacc

SEQ ID NO: 228401 - DNA, 28 bp, Artificial Sequence
  Description of Artificial Sequence: Synthetic oligonucleotide
gcacctttgtaggggtccatgttcaccg

SEQ ID NO: 228402 - DNA, 29 bp, Artificial Sequence
  Description of Artificial Sequence: Synthetic oligonucleotide
cacctttgtaggggtccatgttcaccgag

SEQ ID NO: 228403 - DNA, 29 bp, Artificial Sequence
  Description of Artificial Sequence: Synthetic oligonucleotide
acctttgtaggggtccatgttcaccgagg

SEQ ID NO: 228404 - DNA, 28 bp, Artificial Sequence
  Description of Artificial Sequence: Synthetic oligonucleotide
cctttgtaggggtccatgttcaccgagg

SEQ ID NO: 228405 - DNA, 28 bp, Artificial Sequence
  Description of Artificial Sequence: Synthetic oligonucleotide
ctttgtaggggtccatgttcaccgaggg

SEQ ID NO: 228406 - DNA, 28 bp, Artificial Sequence
  Description of Artificial Sequence: Synthetic oligonucleotide
tttgtaggggtccatgttcaccgagggg

SEQ ID NO: 228407 - DNA, 27 bp, Artificial Sequence
  Description of Artificial Sequence: Synthetic oligonucleotide
ttgtaggggtccatgttcaccgagggg

SEQ ID NO: 228408 - DNA, 27 bp, Artificial Sequence
  Description of Artificial Sequence: Synthetic oligonucleotide
tgtaggggtccatgttcaccgagggga

SEQ ID NO: 228409 - DNA, 26 bp, Artificial Sequence
  Description of Artificial Sequence: Synthetic oligonucleotide
gtaggggtccatgttcaccgagggga

SEQ ID NO: 228410 - DNA, 27 bp, Artificial Sequence
  Description of Artificial Sequence: Synthetic oligonucleotide
taggggtccatgttcaccgaggggact

SEQ ID NO: 228411 - DNA, 27 bp, Artificial Sequence
  Description of Artificial Sequence: Synthetic oligonucleotide
aggggtccatgttcaccgaggggacta

SEQ ID NO: 228412 - DNA, 27 bp, Artificial Sequence
  Description of Artificial Sequence: Synthetic oligonucleotide
ggggtccatgttcaccgaggggactat

SEQ ID NO: 228413 - DNA, 27 bp, Artificial Sequence
  Description of Artificial Sequence: Synthetic oligonucleotide
gggtccatgttcaccgaggggactatg

SEQ ID NO: 228414 - DNA, 28 bp, Artificial Sequence
  Description of Artificial Sequence: Synthetic oligonucleotide
ggtccatgttcaccgaggggactatgtc

SEQ ID NO: 228415 - DNA, 28 bp, Artificial Sequence
  Description of Artificial Sequence: Synthetic oligonucleotide
gtccatgttcaccgaggggactatgtcc

SEQ ID NO: 228416 - DNA, 30 bp, Artificial Sequence
  Description of Artificial Sequence: Synthetic oligonucleotide
tccatgttcaccgaggggactatgtccatg

SEQ ID NO: 228417 - DNA, 29 bp, Artificial Sequence
  Description of Artificial Sequence: Synthetic oligonucleotide
ccatgttcaccgaggggactatgtccatg

SEQ ID NO: 228418 - DNA, 30 bp, Artificial Sequence
  Description of Artificial Sequence: Synthetic oligonucleotide
catgttcaccgaggggactatgtccatgtc

SEQ ID NO: 228419 - DNA, 32 bp, Artificial Sequence
  Description of Artificial Sequence: Synthetic oligonucleotide
atgttcaccgaggggactatgtccatgtcatg

SEQ ID NO: 228420 - DNA, 31 bp, Artificial Sequence
  Description of Artificial Sequence: Synthetic oligonucleotide
tgttcaccgaggggactatgtccatgtcatg

SEQ ID NO: 228421 - DNA, 30 bp, Artificial Sequence
  Description of Artificial Sequence: Synthetic oligonucleotide
gttcaccgaggggactatgtccatgtcatg

SEQ ID NO: 228422 - DNA, 30 bp, Artificial Sequence
  Description of Artificial Sequence: Synthetic oligonucleotide
ttcaccgaggggactatgtccatgtcatgc

SEQ ID NO: 228423 - DNA, 29 bp, Artificial Sequence
  Description of Artificial Sequence: Synthetic oligonucleotide
tcaccgaggggactatgtccatgtcatgc

SEQ ID NO: 228424 - DNA, 28 bp, Artificial Sequence
  Description of Artificial Sequence: Synthetic oligonucleotide
caccgaggggactatgtccatgtcatgc

SEQ ID NO: 228425 - DNA, 28 bp, Artificial Sequence
  Description of Artificial Sequence: Synthetic oligonucleotide
accgaggggactatgtccatgtcatgcc

SEQ ID NO: 228426 - DNA, 27 bp, Artificial Sequence
  Description of Artificial Sequence: Synthetic oligonucleotide
caggagttcaccctgcacgaccacgta

SEQ ID NO: 228427 - DNA, 27 bp, Artificial Sequence
  Description of Artificial Sequence: Synthetic oligonucleotide
aggagttcaccctgcacgaccacgtac

SEQ ID NO: 228428 - DNA, 26 bp, Artificial Sequence
  Description of Artificial Sequence: Synthetic oligonucleotide
ggagttcaccctgcacgaccacgtac

SEQ ID NO: 228429 - DNA, 26 bp, Artificial Sequence
  Description of Artificial Sequence: Synthetic oligonucleotide
gagttcaccctgcacgaccacgtacg

SEQ ID NO: 228430 - DNA, 26 bp, Artificial Sequence
  Description of Artificial Sequence: Synthetic oligonucleotide
agttcaccctgcacgaccacgtacgg

SEQ ID NO: 228431 - DNA, 25 bp, Artificial Sequence
  Description of Artificial Sequence: Synthetic oligonucleotide
gttcaccctgcacgaccacgtacgg

SEQ ID NO: 228432 - DNA, 26 bp, Artificial Sequence
  Description of Artificial Sequence: Synthetic oligonucleotide
ttcaccctgcacgaccacgtacggga

SEQ ID NO: 228433 - DNA, 25 bp, Artificial Sequence
  Description of Artificial Sequence: Synthetic oligonucleotide
tcaccctgcacgaccacgtacggga

SEQ ID NO: 228434 - DNA, 24 bp, Artificial Sequence
  Description of Artificial Sequence: Synthetic oligonucleotide
caccctgcacgaccacgtacggga

SEQ ID NO: 228435 - DNA, 24 bp, Artificial Sequence
  Description of Artificial Sequence: Synthetic oligonucleotide
accctgcacgaccacgtacgggag

SEQ ID NO: 228436 - DNA, 23 bp, Artificial Sequence
  Description of Artificial Sequence: Synthetic oligonucleotide
ccctgcacgaccacgtacgggag

SEQ ID NO: 228437 - DNA, 24 bp, Artificial Sequence
  Description of Artificial Sequence: Synthetic oligonucleotide
cctgcacgaccacgtacgggagga

SEQ ID NO: 228438 - DNA, 24 bp, Artificial Sequence
  Description of Artificial Sequence: Synthetic oligonucleotide
ctgcacgaccacgtacgggaggag

SEQ ID NO: 228439 - DNA, 24 bp, Artificial Sequence
  Description of Artificial Sequence: Synthetic oligonucleotide
tgcacgaccacgtacgggaggagg

SEQ ID NO: 228440 - DNA, 23 bp, Artificial Sequence
  Description of Artificial Sequence: Synthetic oligonucleotide
gcacgaccacgtacgggaggagg

SEQ ID NO: 228441 - DNA, 23 bp, Artificial Sequence
  Description of Artificial Sequence: Synthetic oligonucleotide
cacgaccacgtacgggaggaggc

SEQ ID NO: 228442 - DNA, 23 bp, Artificial Sequence
  Description of Artificial Sequence: Synthetic oligonucleotide
acgaccacgtacgggaggaggcc

SEQ ID NO: 228443 - DNA, 22 bp, Artificial Sequence
  Description of Artificial Sequence: Synthetic oligonucleotide
cgaccacgtacgggaggaggcc

SEQ ID NO: 228444 - DNA, 23 bp, Artificial Sequence
  Description of Artificial Sequence: Synthetic oligonucleotide
gaccacgtacgggaggaggccca

SEQ ID NO: 228445 - DNA, 25 bp, Artificial Sequence
  Description of Artificial Sequence: Synthetic oligonucleotide
accacgtacgggaggaggcccagaa

SEQ ID NO: 228446 - DNA, 24 bp, Artificial Sequence
  Description of Artificial Sequence: Synthetic oligonucleotide
ccacgtacgggaggaggcccagaa

SEQ ID NO: 228447 - DNA, 26 bp, Artificial Sequence
  Description of Artificial Sequence: Synthetic oligonucleotide
cacgtacgggaggaggcccagaagtt

SEQ ID NO: 228448 - DNA, 26 bp, Artificial Sequence
  Description of Artificial Sequence: Synthetic oligonucleotide
acgtacgggaggaggcccagaagttc

SEQ ID NO: 228449 - DNA, 25 bp, Artificial Sequence
  Description of Artificial Sequence: Synthetic oligonucleotide
cgtacgggaggaggcccagaagttc

SEQ ID NO: 228450 - DNA, 26 bp, Artificial Sequence
  Description of Artificial Sequence: Synthetic oligonucleotide
gtacgggaggaggcccagaagttcct

SEQ ID NO: 228451 - DNA, 26 bp, Artificial Sequence
  Description of Artificial Sequence: Synthetic oligonucleotide
tacgggaggaggcccagaagttcctg

SEQ ID NO: 228452 - DNA, 25 bp, Artificial Sequence
  Description of Artificial Sequence: Synthetic oligonucleotide
acgggaggaggcccagaagttcctg

SEQ ID NO: 228453 - DNA, 30 bp, Artificial Sequence
  Description of Artificial Sequence: Synthetic oligonucleotide
acgatcaatgcaataggccgcctgggaaac

SEQ ID NO: 228454 - DNA, 29 bp, Artificial Sequence
  Description of Artificial Sequence: Synthetic oligonucleotide
cgatcaatgcaataggccgcctgggaaac

SEQ ID NO: 228455 - DNA, 29 bp, Artificial Sequence
  Description of Artificial Sequence: Synthetic oligonucleotide
gatcaatgcaataggccgcctgggaaacc

SEQ ID NO: 228456 - DNA, 30 bp, Artificial Sequence
  Description of Artificial Sequence: Synthetic oligonucleotide
atcaatgcaataggccgcctgggaaaccag

SEQ ID NO: 228457 - DNA, 29 bp, Artificial Sequence
  Description of Artificial Sequence: Synthetic oligonucleotide
tcaatgcaataggccgcctgggaaaccag

SEQ ID NO: 228458 - DNA, 28 bp, Artificial Sequence
  Description of Artificial Sequence: Synthetic oligonucleotide
caatgcaataggccgcctgggaaaccag

SEQ ID NO: 228459 - DNA, 30 bp, Artificial Sequence
  Description of Artificial Sequence: Synthetic oligonucleotide
aatgcaataggccgcctgggaaaccagatg

SEQ ID NO: 228460 - DNA, 29 bp, Artificial Sequence
  Description of Artificial Sequence: Synthetic oligonucleotide
atgcaataggccgcctgggaaaccagatg

SEQ ID NO: 228461 - DNA, 28 bp, Artificial Sequence
  Description of Artificial Sequence: Synthetic oligonucleotide
tgcaataggccgcctgggaaaccagatg

SEQ ID NO: 228462 - DNA, 27 bp, Artificial Sequence
  Description of Artificial Sequence: Synthetic oligonucleotide
gcaataggccgcctgggaaaccagatg

SEQ ID NO: 228463 - DNA, 27 bp, Artificial Sequence
  Description of Artificial Sequence: Synthetic oligonucleotide
caataggccgcctgggaaaccagatgg

SEQ ID NO: 228464 - DNA, 27 bp, Artificial Sequence
  Description of Artificial Sequence: Synthetic oligonucleotide
aataggccgcctgggaaaccagatggg

SEQ ID NO: 228465 - DNA, 26 bp, Artificial Sequence
  Description of Artificial Sequence: Synthetic oligonucleotide
ataggccgcctgggaaaccagatggg

SEQ ID NO: 228466 - DNA, 25 bp, Artificial Sequence
  Description of Artificial Sequence: Synthetic oligonucleotide
taggccgcctgggaaaccagatggg

SEQ ID NO: 228467 - DNA, 24 bp, Artificial Sequence
  Description of Artificial Sequence: Synthetic oligonucleotide
aggccgcctgggaaaccagatggg

SEQ ID NO: 228468 - DNA, 23 bp, Artificial Sequence
  Description of Artificial Sequence: Synthetic oligonucleotide
ggccgcctgggaaaccagatggg

SEQ ID NO: 228469 - DNA, 23 bp, Artificial Sequence
  Description of Artificial Sequence: Synthetic oligonucleotide
gccgcctgggaaaccagatgggc

SEQ ID NO: 228470 - DNA, 24 bp, Artificial Sequence
  Description of Artificial Sequence: Synthetic oligonucleotide
ccgcctgggaaaccagatgggcga

SEQ ID NO: 228471 - DNA, 26 bp, Artificial Sequence
  Description of Artificial Sequence: Synthetic oligonucleotide
cgcctgggaaaccagatgggcgagta

SEQ ID NO: 228472 - DNA, 26 bp, Artificial Sequence
  Description of Artificial Sequence: Synthetic oligonucleotide
gcctgggaaaccagatgggcgagtac

SEQ ID NO: 228473 - DNA, 26 bp, Artificial Sequence
  Description of Artificial Sequence: Synthetic oligonucleotide
cctgggaaaccagatgggcgagtacg

SEQ ID NO: 228474 - DNA, 26 bp, Artificial Sequence
  Description of Artificial Sequence: Synthetic oligonucleotide
ctgggaaaccagatgggcgagtacgc

SEQ ID NO: 228475 - DNA, 27 bp, Artificial Sequence
  Description of Artificial Sequence: Synthetic oligonucleotide
tgggaaaccagatgggcgagtacgcca

SEQ ID NO: 228476 - DNA, 26 bp, Artificial Sequence
  Description of Artificial Sequence: Synthetic oligonucleotide
gggaaaccagatgggcgagtacgcca

SEQ ID NO: 228477 - DNA, 27 bp, Artificial Sequence
  Description of Artificial Sequence: Synthetic oligonucleotide
ggaaaccagatgggcgagtacgccaca

SEQ ID NO: 228478 - DNA, 27 bp, Artificial Sequence
  Description of Artificial Sequence: Synthetic oligonucleotide
gaaaccagatgggcgagtacgccacac

SEQ ID NO: 228479 - DNA, 28 bp, Artificial Sequence
  Description of Artificial Sequence: Synthetic oligonucleotide
aaaccagatgggcgagtacgccacactg

SEQ ID NO: 228480 - DNA, 27 bp, Artificial Sequence
  Description of Artificial Sequence: Synthetic oligonucleotide
agaatcaccctgccggtgctgcacagt

SEQ ID NO: 228481 - DNA, 26 bp, Artificial Sequence
  Description of Artificial Sequence: Synthetic oligonucleotide
gaatcaccctgccggtgctgcacagt

SEQ ID NO: 228482 - DNA, 26 bp, Artificial Sequence
  Description of Artificial Sequence: Synthetic oligonucleotide
aatcaccctgccggtgctgcacagtg

SEQ ID NO: 228483 - DNA, 25 bp, Artificial Sequence
  Description of Artificial Sequence: Synthetic oligonucleotide
atcaccctgccggtgctgcacagtg

SEQ ID NO: 228484 - DNA, 24 bp, Artificial Sequence
  Description of Artificial Sequence: Synthetic oligonucleotide
tcaccctgccggtgctgcacagtg

SEQ ID NO: 228485 - DNA, 23 bp, Artificial Sequence
  Description of Artificial Sequence: Synthetic oligonucleotide
caccctgccggtgctgcacagtg

SEQ ID NO: 228486 - DNA, 23 bp, Artificial Sequence
  Description of Artificial Sequence: Synthetic oligonucleotide
accctgccggtgctgcacagtgc

SEQ ID NO: 228487 - DNA, 22 bp, Artificial Sequence
  Description of Artificial Sequence: Synthetic oligonucleotide
ccctgccggtgctgcacagtgc

SEQ ID NO: 228488 - DNA, 23 bp, Artificial Sequence
  Description of Artificial Sequence: Synthetic oligonucleotide
cctgccggtgctgcacagtgcca

SEQ ID NO: 228489 - DNA, 23 bp, Artificial Sequence
  Description of Artificial Sequence: Synthetic oligonucleotide
ctgccggtgctgcacagtgccac

SEQ ID NO: 228490 - DNA, 23 bp, Artificial Sequence
  Description of Artificial Sequence: Synthetic oligonucleotide
tgccggtgctgcacagtgccacg

SEQ ID NO: 228491 - DNA, 22 bp, Artificial Sequence
  Description of Artificial Sequence: Synthetic oligonucleotide
gccggtgctgcacagtgccacg

SEQ ID NO: 228492 - DNA, 22 bp, Artificial Sequence
  Description of Artificial Sequence: Synthetic oligonucleotide
ccggtgctgcacagtgccacgg

SEQ ID NO: 228493 - DNA, 22 bp, Artificial Sequence
  Description of Artificial Sequence: Synthetic oligonucleotide
cggtgctgcacagtgccacggc

SEQ ID NO: 228494 - DNA, 23 bp, Artificial Sequence
  Description of Artificial Sequence: Synthetic oligonucleotide
ggtgctgcacagtgccacggcca

SEQ ID NO: 228495 - DNA, 23 bp, Artificial Sequence
  Description of Artificial Sequence: Synthetic oligonucleotide
gtgctgcacagtgccacggccag

SEQ ID NO: 228496 - DNA, 24 bp, Artificial Sequence
  Description of Artificial Sequence: Synthetic oligonucleotide
tgctgcacagtgccacggccagca

SEQ ID NO: 228497 - DNA, 23 bp, Artificial Sequence
  Description of Artificial Sequence: Synthetic oligonucleotide
gctgcacagtgccacggccagca

SEQ ID NO: 228498 - DNA, 23 bp, Artificial Sequence
  Description of Artificial Sequence: Synthetic oligonucleotide
ctgcacagtgccacggccagcag

SEQ ID NO: 228499 - DNA, 25 bp, Artificial Sequence
  Description of Artificial Sequence: Synthetic oligonucleotide
tgcacagtgccacggccagcaggat

SEQ ID NO: 228500 - DNA, 24 bp, Artificial Sequence
  Description of Artificial Sequence: Synthetic oligonucleotide
gcacagtgccacggccagcaggat

SEQ ID NO: 228501 - DNA, 24 bp, Artificial Sequence
  Description of Artificial Sequence: Synthetic oligonucleotide
cacagtgccacggccagcaggatc

SEQ ID NO: 228502 - DNA, 24 bp, Artificial Sequence
  Description of Artificial Sequence: Synthetic oligonucleotide
acagtgccacggccagcaggatcc

SEQ ID NO: 228503 - DNA, 23 bp, Artificial Sequence
  Description of Artificial Sequence: Synthetic oligonucleotide
cagtgccacggccagcaggatcc

SEQ ID NO: 228504 - DNA, 23 bp, Artificial Sequence
  Description of Artificial Sequence: Synthetic oligonucleotide
agtgccacggccagcaggatccc

SEQ ID NO: 228505 - DNA, 22 bp, Artificial Sequence
  Description of Artificial Sequence: Synthetic oligonucleotide
gtgccacggccagcaggatccc

SEQ ID NO: 228506 - DNA, 23 bp, Artificial Sequence
  Description of Artificial Sequence: Synthetic oligonucleotide
tgccacggccagcaggatcccct

SEQ ID NO: 228507 - DNA, 28 bp, Artificial Sequence
  Description of Artificial Sequence: Synthetic oligonucleotide
gcacctttgtaggggtccatgttcgctg

SEQ ID NO: 228508 - DNA, 29 bp, Artificial Sequence
  Description of Artificial Sequence: Synthetic oligonucleotide
cacctttgtaggggtccatgttcgctgag

SEQ ID NO: 228509 - DNA, 29 bp, Artificial Sequence
  Description of Artificial Sequence: Synthetic oligonucleotide
acctttgtaggggtccatgttcgctgagg

SEQ ID NO: 228510 - DNA, 28 bp, Artificial Sequence
  Description of Artificial Sequence: Synthetic oligonucleotide
cctttgtaggggtccatgttcgctgagg

SEQ ID NO: 228511 - DNA, 28 bp, Artificial Sequence
  Description of Artificial Sequence: Synthetic oligonucleotide
ctttgtaggggtccatgttcgctgaggg

SEQ ID NO: 228512 - DNA, 28 bp, Artificial Sequence
  Description of Artificial Sequence: Synthetic oligonucleotide
tttgtaggggtccatgttcgctgagggg

SEQ ID NO: 228513 - DNA, 27 bp, Artificial Sequence
  Description of Artificial Sequence: Synthetic oligonucleotide
ttgtaggggtccatgttcgctgagggg

SEQ ID NO: 228514 - DNA, 27 bp, Artificial Sequence
  Description of Artificial Sequence: Synthetic oligonucleotide
tgtaggggtccatgttcgctgagggga

SEQ ID NO: 228515 - DNA, 26 bp, Artificial Sequence
  Description of Artificial Sequence: Synthetic oligonucleotide
gtaggggtccatgttcgctgagggga

SEQ ID NO: 228516 - DNA, 27 bp, Artificial Sequence
  Description of Artificial Sequence: Synthetic oligonucleotide
taggggtccatgttcgctgaggggact

SEQ ID NO: 228517 - DNA, 27 bp, Artificial Sequence
  Description of Artificial Sequence: Synthetic oligonucleotide
aggggtccatgttcgctgaggggacta

SEQ ID NO: 228518 - DNA, 27 bp, Artificial Sequence
  Description of Artificial Sequence: Synthetic oligonucleotide
ggggtccatgttcgctgaggggactat

SEQ ID NO: 228519 - DNA, 27 bp, Artificial Sequence
  Description of Artificial Sequence: Synthetic oligonucleotide
gggtccatgttcgctgaggggactatg

SEQ ID NO: 228520 - DNA, 28 bp, Artificial Sequence
  Description of Artificial Sequence: Synthetic oligonucleotide
ggtccatgttcgctgaggggactatgtc

SEQ ID NO: 228521 - DNA, 28 bp, Artificial Sequence
  Description of Artificial Sequence: Synthetic oligonucleotide
gtccatgttcgctgaggggactatgtcc

SEQ ID NO: 228522 - DNA, 30 bp, Artificial Sequence
  Description of Artificial Sequence: Synthetic oligonucleotide
tccatgttcgctgaggggactatgtccatg

SEQ ID NO: 228523 - DNA, 29 bp, Artificial Sequence
  Description of Artificial Sequence: Synthetic oligonucleotide
ccatgttcgctgaggggactatgtccatg

SEQ ID NO: 228524 - DNA, 30 bp, Artificial Sequence
  Description of Artificial Sequence: Synthetic oligonucleotide
catgttcgctgaggggactatgtccatgtc

SEQ ID NO: 228525 - DNA, 32 bp, Artificial Sequence
  Description of Artificial Sequence: Synthetic oligonucleotide
atgttcgctgaggggactatgtccatgtcatg

SEQ ID NO: 228526 - DNA, 31 bp, Artificial Sequence
  Description of Artificial Sequence: Synthetic oligonucleotide
tgttcgctgaggggactatgtccatgtcatg

SEQ ID NO: 228527 - DNA, 30 bp, Artificial Sequence
  Description of Artificial Sequence: Synthetic oligonucleotide
gttcgctgaggggactatgtccatgtcatg

SEQ ID NO: 228528 - DNA, 30 bp, Artificial Sequence
  Description of Artificial Sequence: Synthetic oligonucleotide
ttcgctgaggggactatgtccatgtcatgc

SEQ ID NO: 228529 - DNA, 29 bp, Artificial Sequence
  Description of Artificial Sequence: Synthetic oligonucleotide
tcgctgaggggactatgtccatgtcatgc

SEQ ID NO: 228530 - DNA, 28 bp, Artificial Sequence
  Description of Artificial Sequence: Synthetic oligonucleotide
cgctgaggggactatgtccatgtcatgc

SEQ ID NO: 228531 - DNA, 28 bp, Artificial Sequence
  Description of Artificial Sequence: Synthetic oligonucleotide
gctgaggggactatgtccatgtcatgcc

SEQ ID NO: 228532 - DNA, 32 bp, Artificial Sequence
  Description of Artificial Sequence: Synthetic oligonucleotide
ctgaggggactatgtccatgtcatgccaaaag

SEQ ID NO: 228533 - DNA, 33 bp, Artificial Sequence
  Description of Artificial Sequence: Synthetic oligonucleotide
tgaggggactatgtccatgtcatgccaaaagtg

SEQ ID NO: 228534 - DNA, 33 bp, Artificial Sequence
  Description of Artificial Sequence: Synthetic oligonucleotide
aaaatctttaagccagaggcagccttcctgctg

SEQ ID NO: 228535 - DNA, 32 bp, Artificial Sequence
  Description of Artificial Sequence: Synthetic oligonucleotide
aaatctttaagccagaggcagccttcctgctg

SEQ ID NO: 228536 - DNA, 31 bp, Artificial Sequence
  Description of Artificial Sequence: Synthetic oligonucleotide
aatctttaagccagaggcagccttcctgctg

SEQ ID NO: 228537 - DNA, 30 bp, Artificial Sequence
  Description of Artificial Sequence: Synthetic oligonucleotide
atctttaagccagaggcagccttcctgctg

SEQ ID NO: 228538 - DNA, 29 bp, Artificial Sequence
  Description of Artificial Sequence: Synthetic oligonucleotide
tctttaagccagaggcagccttcctgctg

SEQ ID NO: 228539 - DNA, 28 bp, Artificial Sequence
  Description of Artificial Sequence: Synthetic oligonucleotide
ctttaagccagaggcagccttcctgctg

SEQ ID NO: 228540 - DNA, 28 bp, Artificial Sequence
  Description of Artificial Sequence: Synthetic oligonucleotide
tttaagccagaggcagccttcctgctgg

SEQ ID NO: 228541 - DNA, 27 bp, Artificial Sequence
  Description of Artificial Sequence: Synthetic oligonucleotide
ttaagccagaggcagccttcctgctgg

SEQ ID NO: 228542 - DNA, 27 bp, Artificial Sequence
  Description of Artificial Sequence: Synthetic oligonucleotide
taagccagaggcagccttcctgctgga

SEQ ID NO: 228543 - DNA, 26 bp, Artificial Sequence
  Description of Artificial Sequence: Synthetic oligonucleotide
aagccagaggcagccttcctgctgga

SEQ ID NO: 228544 - DNA, 25 bp, Artificial Sequence
  Description of Artificial Sequence: Synthetic oligonucleotide
agccagaggcagccttcctgctgga

SEQ ID NO: 228545 - DNA, 24 bp, Artificial Sequence
  Description of Artificial Sequence: Synthetic oligonucleotide
gccagaggcagccttcctgctgga

SEQ ID NO: 228546 - DNA, 25 bp, Artificial Sequence
  Description of Artificial Sequence: Synthetic oligonucleotide
ccagaggcagccttcctgctggagt

SEQ ID NO: 228547 - DNA, 25 bp, Artificial Sequence
  Description of Artificial Sequence: Synthetic oligonucleotide
cagaggcagccttcctgctggagtg

SEQ ID NO: 228548 - DNA, 26 bp, Artificial Sequence
  Description of Artificial Sequence: Synthetic oligonucleotide
agaggcagccttcctgctggagtgga

SEQ ID NO: 228549 - DNA, 25 bp, Artificial Sequence
  Description of Artificial Sequence: Synthetic oligonucleotide
gaggcagccttcctgctggagtgga

SEQ ID NO: 228550 - DNA, 26 bp, Artificial Sequence
  Description of Artificial Sequence: Synthetic oligonucleotide
aggcagccttcctgctggagtggaca

SEQ ID NO: 228551 - DNA, 25 bp, Artificial Sequence
  Description of Artificial Sequence: Synthetic oligonucleotide
ggcagccttcctgctggagtggaca

SEQ ID NO: 228552 - DNA, 25 bp, Artificial Sequence
  Description of Artificial Sequence: Synthetic oligonucleotide
gcagccttcctgctggagtggacag

SEQ ID NO: 228553 - DNA, 25 bp, Artificial Sequence
  Description of Artificial Sequence: Synthetic oligonucleotide
cagccttcctgctggagtggacagg

SEQ ID NO: 228554 - DNA, 27 bp, Artificial Sequence
  Description of Artificial Sequence: Synthetic oligonucleotide
agccttcctgctggagtggacagggat

SEQ ID NO: 228555 - DNA, 27 bp, Artificial Sequence
  Description of Artificial Sequence: Synthetic oligonucleotide
gccttcctgctggagtggacagggatt

SEQ ID NO: 228556 - DNA, 27 bp, Artificial Sequence
  Description of Artificial Sequence: Synthetic oligonucleotide
ccttcctgctggagtggacagggattg

SEQ ID NO: 228557 - DNA, 27 bp, Artificial Sequence
  Description of Artificial Sequence: Synthetic oligonucleotide
cttcctgctggagtggacagggattgc

SEQ ID NO: 228558 - DNA, 27 bp, Artificial Sequence
  Description of Artificial Sequence: Synthetic oligonucleotide
ttcctgctggagtggacagggattgcc

SEQ ID NO: 228559 - DNA, 26 bp, Artificial Sequence
  Description of Artificial Sequence: Synthetic oligonucleotide
tcctgctggagtggacagggattgcc

SEQ ID NO: 228560 - DNA, 25 bp, Artificial Sequence
  Description of Artificial Sequence: Synthetic oligonucleotide
cctgctggagtggacagggattgcc

SEQ ID NO: 228561 - DNA, 25 bp, Artificial Sequence
  Description of Artificial Sequence: Synthetic oligonucleotide
ctgctggagtggacagggattgccg

SEQ ID NO: 228562 - DNA, 26 bp, Artificial Sequence
  Description of Artificial Sequence: Synthetic oligonucleotide
tgctggagtggacagggattgccgca

SEQ ID NO: 228563 - DNA, 25 bp, Artificial Sequence
  Description of Artificial Sequence: Synthetic oligonucleotide
gctggagtggacagggattgccgca

SEQ ID NO: 228564 - DNA, 26 bp, Artificial Sequence
  Description of Artificial Sequence: Synthetic oligonucleotide
ctggagtggacagggattgccgcaga

SEQ ID NO: 228565 - DNA, 26 bp, Artificial Sequence
  Description of Artificial Sequence: Synthetic oligonucleotide
tggagtggacagggattgccgcagac

SEQ ID NO: 228566 - DNA, 36 bp, Artificial Sequence
  Description of Artificial Sequence: Synthetic oligonucleotide
atgacccacttcatcctctttgtctttacggtttcc

SEQ ID NO: 228567 - DNA, 35 bp, Artificial Sequence
  Description of Artificial Sequence: Synthetic oligonucleotide
tgacccacttcatcctctttgtctttacggtttcc

SEQ ID NO: 228568 - DNA, 34 bp, Artificial Sequence
  Description of Artificial Sequence: Synthetic oligonucleotide
gacccacttcatcctctttgtctttacggtttcc

SEQ ID NO: 228569 - DNA, 35 bp, Artificial Sequence
  Description of Artificial Sequence: Synthetic oligonucleotide
acccacttcatcctctttgtctttacggtttccac

SEQ ID NO: 228570 - DNA, 28 bp, Artificial Sequence
  Description of Artificial Sequence: Synthetic oligonucleotide
atggaggaggaataccgccacttccctg

SEQ ID NO: 228571 - DNA, 27 bp, Artificial Sequence
  Description of Artificial Sequence: Synthetic oligonucleotide
tggaggaggaataccgccacttccctg

SEQ ID NO: 228572 - DNA, 26 bp, Artificial Sequence
  Description of Artificial Sequence: Synthetic oligonucleotide
ggaggaggaataccgccacttccctg

SEQ ID NO: 228573 - DNA, 26 bp, Artificial Sequence
  Description of Artificial Sequence: Synthetic oligonucleotide
gaggaggaataccgccacttccctgg

SEQ ID NO: 228574 - DNA, 26 bp, Artificial Sequence
  Description of Artificial Sequence: Synthetic oligonucleotide
aggaggaataccgccacttccctggg

SEQ ID NO: 228575 - DNA, 25 bp, Artificial Sequence
  Description of Artificial Sequence: Synthetic oligonucleotide
ggaggaataccgccacttccctggg

SEQ ID NO: 228576 - DNA, 26 bp, Artificial Sequence
  Description of Artificial Sequence: Synthetic oligonucleotide
gaggaataccgccacttccctgggga

SEQ ID NO: 228577 - DNA, 27 bp, Artificial Sequence
  Description of Artificial Sequence: Synthetic oligonucleotide
aggaataccgccacttccctggggagt

SEQ ID NO: 228578 - DNA, 27 bp, Artificial Sequence
  Description of Artificial Sequence: Synthetic oligonucleotide
ggaataccgccacttccctggggagta

SEQ ID NO: 228579 - DNA, 27 bp, Artificial Sequence
  Description of Artificial Sequence: Synthetic oligonucleotide
gaataccgccacttccctggggagtac

SEQ ID NO: 228580 - DNA, 27 bp, Artificial Sequence
  Description of Artificial Sequence: Synthetic oligonucleotide
aataccgccacttccctggggagtacg

SEQ ID NO: 228581 - DNA, 27 bp, Artificial Sequence
  Description of Artificial Sequence: Synthetic oligonucleotide
ataccgccacttccctggggagtacgt

SEQ ID NO: 228582 - DNA, 26 bp, Artificial Sequence
  Description of Artificial Sequence: Synthetic oligonucleotide
taccgccacttccctggggagtacgt

SEQ ID NO: 228583 - DNA, 25 bp, Artificial Sequence
  Description of Artificial Sequence: Synthetic oligonucleotide
accgccacttccctggggagtacgt

SEQ ID NO: 228584 - DNA, 24 bp, Artificial Sequence
  Description of Artificial Sequence: Synthetic oligonucleotide
ccgccacttccctggggagtacgt

SEQ ID NO: 228585 - DNA, 24 bp, Artificial Sequence
  Description of Artificial Sequence: Synthetic oligonucleotide
cgccacttccctggggagtacgtc

SEQ ID NO: 228586 - DNA, 24 bp, Artificial Sequence
  Description of Artificial Sequence: Synthetic oligonucleotide
gccacttccctggggagtacgtcc

SEQ ID NO: 228587 - DNA, 24 bp, Artificial Sequence
  Description of Artificial Sequence: Synthetic oligonucleotide
ccacttccctggggagtacgtccg

SEQ ID NO: 228588 - DNA, 26 bp, Artificial Sequence
  Description of Artificial Sequence: Synthetic oligonucleotide
cacttccctggggagtacgtccgctt

SEQ ID NO: 228589 - DNA, 27 bp, Artificial Sequence
  Description of Artificial Sequence: Synthetic oligonucleotide
acttccctggggagtacgtccgcttca

SEQ ID NO: 228590 - DNA, 26 bp, Artificial Sequence
  Description of Artificial Sequence: Synthetic oligonucleotide
cttccctggggagtacgtccgcttca

SEQ ID NO: 228591 - DNA, 26 bp, Artificial Sequence
  Description of Artificial Sequence: Synthetic oligonucleotide
ttccctggggagtacgtccgcttcac

SEQ ID NO: 228592 - DNA, 25 bp, Artificial Sequence
  Description of Artificial Sequence: Synthetic oligonucleotide
tccctggggagtacgtccgcttcac

SEQ ID NO: 228593 - DNA, 24 bp, Artificial Sequence
  Description of Artificial Sequence: Synthetic oligonucleotide
ccctggggagtacgtccgcttcac

SEQ ID NO: 228594 - DNA, 24 bp, Artificial Sequence
  Description of Artificial Sequence: Synthetic oligonucleotide
cctggggagtacgtccgcttcacc

SEQ ID NO: 228595 - DNA, 24 bp, Artificial Sequence
  Description of Artificial Sequence: Synthetic oligonucleotide
ctggggagtacgtccgcttcaccg

SEQ ID NO: 228596 - DNA, 24 bp, Artificial Sequence
  Description of Artificial Sequence: Synthetic oligonucleotide
tggggagtacgtccgcttcaccgg

SEQ ID NO: 228597 - DNA, 30 bp, Artificial Sequence
  Description of Artificial Sequence: Synthetic oligonucleotide
tacccctgctcctagaccttctaccacaac

SEQ ID NO: 228598 - DNA, 29 bp, Artificial Sequence
  Description of Artificial Sequence: Synthetic oligonucleotide
acccctgctcctagaccttctaccacaac

SEQ ID NO: 228599 - DNA, 28 bp, Artificial Sequence
  Description of Artificial Sequence: Synthetic oligonucleotide
cccctgctcctagaccttctaccacaac

SEQ ID NO: 228600 - DNA, 28 bp, Artificial Sequence
  Description of Artificial Sequence: Synthetic oligonucleotide
ccctgctcctagaccttctaccacaacc

SEQ ID NO: 228601 - DNA, 29 bp, Artificial Sequence
  Description of Artificial Sequence: Synthetic oligonucleotide
cctgctcctagaccttctaccacaacctc

SEQ ID NO: 228602 - DNA, 29 bp, Artificial Sequence
  Description of Artificial Sequence: Synthetic oligonucleotide
ctgctcctagaccttctaccacaacctcc

SEQ ID NO: 228603 - DNA, 29 bp, Artificial Sequence
  Description of Artificial Sequence: Synthetic oligonucleotide
tgctcctagaccttctaccacaacctccg

SEQ ID NO: 228604 - DNA, 28 bp, Artificial Sequence
  Description of Artificial Sequence: Synthetic oligonucleotide
gctcctagaccttctaccacaacctccg

SEQ ID NO: 228605 - DNA, 28 bp, Artificial Sequence
  Description of Artificial Sequence: Synthetic oligonucleotide
ctcctagaccttctaccacaacctccgc

SEQ ID NO: 228606 - DNA, 28 bp, Artificial Sequence
  Description of Artificial Sequence: Synthetic oligonucleotide
tcctagaccttctaccacaacctccgcc

SEQ ID NO: 228607 - DNA, 27 bp, Artificial Sequence
  Description of Artificial Sequence: Synthetic oligonucleotide
cctagaccttctaccacaacctccgcc

SEQ ID NO: 228608 - DNA, 28 bp, Artificial Sequence
  Description of Artificial Sequence: Synthetic oligonucleotide
ctagaccttctaccacaacctccgccag

SEQ ID NO: 228609 - DNA, 28 bp, Artificial Sequence
  Description of Artificial Sequence: Synthetic oligonucleotide
tagaccttctaccacaacctccgccagg

SEQ ID NO: 228610 - DNA, 27 bp, Artificial Sequence
  Description of Artificial Sequence: Synthetic oligonucleotide
agaccttctaccacaacctccgccagg

SEQ ID NO: 228611 - DNA, 27 bp, Artificial Sequence
  Description of Artificial Sequence: Synthetic oligonucleotide
gaccttctaccacaacctccgccagga

SEQ ID NO: 228612 - DNA, 27 bp, Artificial Sequence
  Description of Artificial Sequence: Synthetic oligonucleotide
accttctaccacaacctccgccaggag

SEQ ID NO: 228613 - DNA, 27 bp, Artificial Sequence
  Description of Artificial Sequence: Synthetic oligonucleotide
ccttctaccacaacctccgccaggaga

SEQ ID NO: 228614 - DNA, 28 bp, Artificial Sequence
  Description of Artificial Sequence: Synthetic oligonucleotide
cttctaccacaacctccgccaggagatc

SEQ ID NO: 228615 - DNA, 28 bp, Artificial Sequence
  Description of Artificial Sequence: Synthetic oligonucleotide
ttctaccacaacctccgccaggagatcc

SEQ ID NO: 228616 - DNA, 27 bp, Artificial Sequence
  Description of Artificial Sequence: Synthetic oligonucleotide
tctaccacaacctccgccaggagatcc

SEQ ID NO: 228617 - DNA, 27 bp, Artificial Sequence
  Description of Artificial Sequence: Synthetic oligonucleotide
ctaccacaacctccgccaggagatcct

SEQ ID NO: 228618 - DNA, 27 bp, Artificial Sequence
  Description of Artificial Sequence: Synthetic oligonucleotide
taccacaacctccgccaggagatcctc

SEQ ID NO: 228619 - DNA, 26 bp, Artificial Sequence
  Description of Artificial Sequence: Synthetic oligonucleotide
accacaacctccgccaggagatcctc

SEQ ID NO: 228620 - DNA, 25 bp, Artificial Sequence
  Description of Artificial Sequence: Synthetic oligonucleotide
ccacaacctccgccaggagatcctc

SEQ ID NO: 228621 - DNA, 26 bp, Artificial Sequence
  Description of Artificial Sequence: Synthetic oligonucleotide
cacaacctccgccaggagatcctcca

SEQ ID NO: 228622 - DNA, 26 bp, Artificial Sequence
  Description of Artificial Sequence: Synthetic oligonucleotide
acaacctccgccaggagatcctccag

SEQ ID NO: 228623 - DNA, 25 bp, Artificial Sequence
  Description of Artificial Sequence: Synthetic oligonucleotide
caacctccgccaggagatcctccag

SEQ ID NO: 228624 - DNA, 26 bp, Artificial Sequence
  Description of Artificial Sequence: Synthetic oligonucleotide
aacctccgccaggagatcctccagga

SEQ ID NO: 228625 - DNA, 31 bp, Artificial Sequence
  Description of Artificial Sequence: Synthetic oligonucleotide
atcatgaccattgggacgttcgggatctgag

SEQ ID NO: 228626 - DNA, 30 bp, Artificial Sequence
  Description of Artificial Sequence: Synthetic oligonucleotide
tcatgaccattgggacgttcgggatctgag

SEQ ID NO: 228627 - DNA, 29 bp, Artificial Sequence
  Description of Artificial Sequence: Synthetic oligonucleotide
catgaccattgggacgttcgggatctgag

SEQ ID NO: 228628 - DNA, 29 bp, Artificial Sequence
  Description of Artificial Sequence: Synthetic oligonucleotide
atgaccattgggacgttcgggatctgagc

SEQ ID NO: 228629 - DNA, 28 bp, Artificial Sequence
  Description of Artificial Sequence: Synthetic oligonucleotide
tgaccattgggacgttcgggatctgagc

SEQ ID NO: 228630 - DNA, 27 bp, Artificial Sequence
  Description of Artificial Sequence: Synthetic oligonucleotide
gaccattgggacgttcgggatctgagc

SEQ ID NO: 228631 - DNA, 27 bp, Artificial Sequence
  Description of Artificial Sequence: Synthetic oligonucleotide
accattgggacgttcgggatctgagcc

SEQ ID NO: 228632 - DNA, 26 bp, Artificial Sequence
  Description of Artificial Sequence: Synthetic oligonucleotide
ccattgggacgttcgggatctgagcc

SEQ ID NO: 228633 - DNA, 26 bp, Artificial Sequence
  Description of Artificial Sequence: Synthetic oligonucleotide
cattgggacgttcgggatctgagccg

SEQ ID NO: 228634 - DNA, 27 bp, Artificial Sequence
  Description of Artificial Sequence: Synthetic oligonucleotide
attgggacgttcgggatctgagccgca

SEQ ID NO: 228635 - DNA, 27 bp, Artificial Sequence
  Description of Artificial Sequence: Synthetic oligonucleotide
ttgggacgttcgggatctgagccgcat

SEQ ID NO: 228636 - DNA, 27 bp, Artificial Sequence
  Description of Artificial Sequence: Synthetic oligonucleotide
tgggacgttcgggatctgagccgcata

SEQ ID NO: 228637 - DNA, 26 bp, Artificial Sequence
  Description of Artificial Sequence: Synthetic oligonucleotide
gggacgttcgggatctgagccgcata

SEQ ID NO: 228638 - DNA, 26 bp, Artificial Sequence
  Description of Artificial Sequence: Synthetic oligonucleotide
ggacgttcgggatctgagccgcatac

SEQ ID NO: 228639 - DNA, 27 bp, Artificial Sequence
  Description of Artificial Sequence: Synthetic oligonucleotide
gacgttcgggatctgagccgcatacct

SEQ ID NO: 228640 - DNA, 27 bp, Artificial Sequence
  Description of Artificial Sequence: Synthetic oligonucleotide
acgttcgggatctgagccgcatacctc

SEQ ID NO: 228641 - DNA, 27 bp, Artificial Sequence
  Description of Artificial Sequence: Synthetic oligonucleotide
cgttcgggatctgagccgcatacctca

SEQ ID NO: 228642 - DNA, 27 bp, Artificial Sequence
  Description of Artificial Sequence: Synthetic oligonucleotide
gttcgggatctgagccgcatacctcac

SEQ ID NO: 228643 - DNA, 27 bp, Artificial Sequence
  Description of Artificial Sequence: Synthetic oligonucleotide
ttcgggatctgagccgcatacctcacg

SEQ ID NO: 228644 - DNA, 26 bp, Artificial Sequence
  Description of Artificial Sequence: Synthetic oligonucleotide
tcgggatctgagccgcatacctcacg

SEQ ID NO: 228645 - DNA, 25 bp, Artificial Sequence
  Description of Artificial Sequence: Synthetic oligonucleotide
cgggatctgagccgcatacctcacg

SEQ ID NO: 228646 - DNA, 25 bp, Artificial Sequence
  Description of Artificial Sequence: Synthetic oligonucleotide
gggatctgagccgcatacctcacgg

SEQ ID NO: 228647 - DNA, 25 bp, Artificial Sequence
  Description of Artificial Sequence: Synthetic oligonucleotide
ggatctgagccgcatacctcacggg

SEQ ID NO: 228648 - DNA, 25 bp, Artificial Sequence
  Description of Artificial Sequence: Synthetic oligonucleotide
gatctgagccgcatacctcacgggc

SEQ ID NO: 228649 - DNA, 25 bp, Artificial Sequence
  Description of Artificial Sequence: Synthetic oligonucleotide
atctgagccgcatacctcacgggcg

SEQ ID NO: 228650 - DNA, 24 bp, Artificial Sequence
  Description of Artificial Sequence: Synthetic oligonucleotide
tctgagccgcatacctcacgggcg

SEQ ID NO: 228651 - DNA, 23 bp, Artificial Sequence
  Description of Artificial Sequence: Synthetic oligonucleotide
ctgagccgcatacctcacgggcg

SEQ ID NO: 228652 - DNA, 24 bp, Artificial Sequence
  Description of Artificial Sequence: Synthetic oligonucleotide
tgagccgcatacctcacgggcgga

SEQ ID NO: 228653 - DNA, 23 bp, Artificial Sequence
  Description of Artificial Sequence: Synthetic oligonucleotide
gagccgcatacctcacgggcgga

SEQ ID NO: 228654 - DNA, 24 bp, Artificial Sequence
  Description of Artificial Sequence: Synthetic oligonucleotide
agccgcatacctcacgggcggaga

SEQ ID NO: 228655 - DNA, 35 bp, Artificial Sequence
  Description of Artificial Sequence: Synthetic oligonucleotide
ccacttcatcctctttgtctttacggtttccactg

SEQ ID NO: 228656 - DNA, 40 bp, Artificial Sequence
  Description of Artificial Sequence: Synthetic oligonucleotide
cacttcatcctctttgtctttacggtttccactgtatttc

SEQ ID NO: 228657 - DNA, 41 bp, Artificial Sequence
  Description of Artificial Sequence: Synthetic oligonucleotide
acttcatcctctttgtctttacggtttccactgtatttcac

SEQ ID NO: 228658 - DNA, 40 bp, Artificial Sequence
  Description of Artificial Sequence: Synthetic oligonucleotide
cttcatcctctttgtctttacggtttccactgtatttcac

SEQ ID NO: 228659 - DNA, 40 bp, Artificial Sequence
  Description of Artificial Sequence: Synthetic oligonucleotide
ttcatcctctttgtctttacggtttccactgtatttcacg

SEQ ID NO: 228660 - DNA, 39 bp, Artificial Sequence
  Description of Artificial Sequence: Synthetic oligonucleotide
tcatcctctttgtctttacggtttccactgtatttcacg

SEQ ID NO: 228661 - DNA, 38 bp, Artificial Sequence
  Description of Artificial Sequence: Synthetic oligonucleotide
catcctctttgtctttacggtttccactgtatttcacg

SEQ ID NO: 228662 - DNA, 40 bp, Artificial Sequence
  Description of Artificial Sequence: Synthetic oligonucleotide
atcctctttgtctttacggtttccactgtatttcacgttc

SEQ ID NO: 228663 - DNA, 39 bp, Artificial Sequence
  Description of Artificial Sequence: Synthetic oligonucleotide
tcctctttgtctttacggtttccactgtatttcacgttc

SEQ ID NO: 228664 - DNA, 38 bp, Artificial Sequence
  Description of Artificial Sequence: Synthetic oligonucleotide
cctctttgtctttacggtttccactgtatttcacgttc

SEQ ID NO: 228665 - DNA, 39 bp, Artificial Sequence
  Description of Artificial Sequence: Synthetic oligonucleotide
ctctttgtctttacggtttccactgtatttcacgttcag

SEQ ID NO: 228666 - DNA, 39 bp, Artificial Sequence
  Description of Artificial Sequence: Synthetic oligonucleotide
tctttgtctttacggtttccactgtatttcacgttcagc

SEQ ID NO: 228667 - DNA, 38 bp, Artificial Sequence
  Description of Artificial Sequence: Synthetic oligonucleotide
ctttgtctttacggtttccactgtatttcacgttcagc

SEQ ID NO: 228668 - DNA, 39 bp, Artificial Sequence
  Description of Artificial Sequence: Synthetic oligonucleotide
tttgtctttacggtttccactgtatttcacgttcagcag

SEQ ID NO: 228669 - DNA, 38 bp, Artificial Sequence
  Description of Artificial Sequence: Synthetic oligonucleotide
ttgtctttacggtttccactgtatttcacgttcagcag

SEQ ID NO: 228670 - DNA, 37 bp, Artificial Sequence
  Description of Artificial Sequence: Synthetic oligonucleotide
tgtctttacggtttccactgtatttcacgttcagcag

SEQ ID NO: 228671 - DNA, 36 bp, Artificial Sequence
  Description of Artificial Sequence: Synthetic oligonucleotide
gtctttacggtttccactgtatttcacgttcagcag

SEQ ID NO: 228672 - DNA, 36 bp, Artificial Sequence
  Description of Artificial Sequence: Synthetic oligonucleotide
tctttacggtttccactgtatttcacgttcagcagc

SEQ ID NO: 228673 - DNA, 35 bp, Artificial Sequence
  Description of Artificial Sequence: Synthetic oligonucleotide
ctttacggtttccactgtatttcacgttcagcagc

SEQ ID NO: 228674 - DNA, 35 bp, Artificial Sequence
  Description of Artificial Sequence: Synthetic oligonucleotide
tttacggtttccactgtatttcacgttcagcagcg

SEQ ID NO: 228675 - DNA, 34 bp, Artificial Sequence
  Description of Artificial Sequence: Synthetic oligonucleotide
ttacggtttccactgtatttcacgttcagcagcg

SEQ ID NO: 228676 - DNA, 33 bp, Artificial Sequence
  Description of Artificial Sequence: Synthetic oligonucleotide
tacggtttccactgtatttcacgttcagcagcg

SEQ ID NO: 228677 - DNA, 32 bp, Artificial Sequence
  Description of Artificial Sequence: Synthetic oligonucleotide
acggtttccactgtatttcacgttcagcagcg

SEQ ID NO: 228678 - DNA, 31 bp, Artificial Sequence
  Description of Artificial Sequence: Synthetic oligonucleotide
cggtttccactgtatttcacgttcagcagcg

SEQ ID NO: 228679 - DNA, 31 bp, Artificial Sequence
  Description of Artificial Sequence: Synthetic oligonucleotide
ggtttccactgtatttcacgttcagcagcgg

SEQ ID NO: 228680 - DNA, 31 bp, Artificial Sequence
  Description of Artificial Sequence: Synthetic oligonucleotide
gtttccactgtatttcacgttcagcagcggc

SEQ ID NO: 228681 - DNA, 33 bp, Artificial Sequence
  Description of Artificial Sequence: Synthetic oligonucleotide
tttccactgtatttcacgttcagcagcggctag

SEQ ID NO: 228682 - DNA, 32 bp, Artificial Sequence
  Description of Artificial Sequence: Synthetic oligonucleotide
ttccactgtatttcacgttcagcagcggctag

SEQ ID NO: 228683 - DNA, 31 bp, Artificial Sequence
  Description of Artificial Sequence: Synthetic oligonucleotide
tccactgtatttcacgttcagcagcggctag

SEQ ID NO: 228684 - DNA, 30 bp, Artificial Sequence
  Description of Artificial Sequence: Synthetic oligonucleotide
ccactgtatttcacgttcagcagcggctag

SEQ ID NO: 228685 - DNA, 30 bp, Artificial Sequence
  Description of Artificial Sequence: Synthetic oligonucleotide
cactgtatttcacgttcagcagcggctagc

SEQ ID NO: 228686 - DNA, 30 bp, Artificial Sequence
  Description of Artificial Sequence: Synthetic oligonucleotide
actgtatttcacgttcagcagcggctagcg

SEQ ID NO: 228687 - DNA, 29 bp, Artificial Sequence
  Description of Artificial Sequence: Synthetic oligonucleotide
ctgtatttcacgttcagcagcggctagcg

SEQ ID NO: 228688 - DNA, 31 bp, Artificial Sequence
  Description of Artificial Sequence: Synthetic oligonucleotide
tgtatttcacgttcagcagcggctagcgaag

SEQ ID NO: 228689 - DNA, 30 bp, Artificial Sequence
  Description of Artificial Sequence: Synthetic oligonucleotide
gtatttcacgttcagcagcggctagcgaag

SEQ ID NO: 228690 - DNA, 29 bp, Artificial Sequence
  Description of Artificial Sequence: Synthetic oligonucleotide
agatcctccaggagttcaccctgcacaac

SEQ ID NO: 228691 - DNA, 28 bp, Artificial Sequence
  Description of Artificial Sequence: Synthetic oligonucleotide
gatcctccaggagttcaccctgcacaac

SEQ ID NO: 228692 - DNA, 28 bp, Artificial Sequence
  Description of Artificial Sequence: Synthetic oligonucleotide
atcctccaggagttcaccctgcacaacc

SEQ ID NO: 228693 - DNA, 27 bp, Artificial Sequence
  Description of Artificial Sequence: Synthetic oligonucleotide
tcctccaggagttcaccctgcacaacc

SEQ ID NO: 228694 - DNA, 27 bp, Artificial Sequence
  Description of Artificial Sequence: Synthetic oligonucleotide
cctccaggagttcaccctgcacaacca

SEQ ID NO: 228695 - DNA, 27 bp, Artificial Sequence
  Description of Artificial Sequence: Synthetic oligonucleotide
ctccaggagttcaccctgcacaaccac

SEQ ID NO: 228696 - DNA, 27 bp, Artificial Sequence
  Description of Artificial Sequence: Synthetic oligonucleotide
tccaggagttcaccctgcacaaccacg

SEQ ID NO: 228697 - DNA, 27 bp, Artificial Sequence
  Description of Artificial Sequence: Synthetic oligonucleotide
ccaggagttcaccctgcacaaccacgt

SEQ ID NO: 228698 - DNA, 27 bp, Artificial Sequence
  Description of Artificial Sequence: Synthetic oligonucleotide
caggagttcaccctgcacaaccacgtg

SEQ ID NO: 228699 - DNA, 27 bp, Artificial Sequence
  Description of Artificial Sequence: Synthetic oligonucleotide
aggagttcaccctgcacaaccacgtgc

SEQ ID NO: 228700 - DNA, 26 bp, Artificial Sequence
  Description of Artificial Sequence: Synthetic oligonucleotide
ggagttcaccctgcacaaccacgtgc

SEQ ID NO: 228701 - DNA, 26 bp, Artificial Sequence
  Description of Artificial Sequence: Synthetic oligonucleotide
gagttcaccctgcacaaccacgtgcg

SEQ ID NO: 228702 - DNA, 26 bp, Artificial Sequence
  Description of Artificial Sequence: Synthetic oligonucleotide
agttcaccctgcacaaccacgtgcgg

SEQ ID NO: 228703 - DNA, 25 bp, Artificial Sequence
  Description of Artificial Sequence: Synthetic oligonucleotide
gttcaccctgcacaaccacgtgcgg

SEQ ID NO: 228704 - DNA, 26 bp, Artificial Sequence
  Description of Artificial Sequence: Synthetic oligonucleotide
ttcaccctgcacaaccacgtgcggga

SEQ ID NO: 228705 - DNA, 25 bp, Artificial Sequence
  Description of Artificial Sequence: Synthetic oligonucleotide
tcaccctgcacaaccacgtgcggga

SEQ ID NO: 228706 - DNA, 24 bp, Artificial Sequence
  Description of Artificial Sequence: Synthetic oligonucleotide
caccctgcacaaccacgtgcggga

SEQ ID NO: 228707 - DNA, 24 bp, Artificial Sequence
  Description of Artificial Sequence: Synthetic oligonucleotide
accctgcacaaccacgtgcgggag

SEQ ID NO: 228708 - DNA, 23 bp, Artificial Sequence
  Description of Artificial Sequence: Synthetic oligonucleotide
ccctgcacaaccacgtgcgggag

SEQ ID NO: 228709 - DNA, 24 bp, Artificial Sequence
  Description of Artificial Sequence: Synthetic oligonucleotide
cctgcacaaccacgtgcgggagga

SEQ ID NO: 228710 - DNA, 24 bp, Artificial Sequence
  Description of Artificial Sequence: Synthetic oligonucleotide
ctgcacaaccacgtgcgggaggag

SEQ ID NO: 228711 - DNA, 24 bp, Artificial Sequence
  Description of Artificial Sequence: Synthetic oligonucleotide
tgcacaaccacgtgcgggaggagg

SEQ ID NO: 228712 - DNA, 23 bp, Artificial Sequence
  Description of Artificial Sequence: Synthetic oligonucleotide
gcacaaccacgtgcgggaggagg

SEQ ID NO: 228713 - DNA, 23 bp, Artificial Sequence
  Description of Artificial Sequence: Synthetic oligonucleotide
cacaaccacgtgcgggaggaggc

SEQ ID NO: 228714 - DNA, 23 bp, Artificial Sequence
  Description of Artificial Sequence: Synthetic oligonucleotide
acaaccacgtgcgggaggaggcc

SEQ ID NO: 228715 - DNA, 22 bp, Artificial Sequence
  Description of Artificial Sequence: Synthetic oligonucleotide
caaccacgtgcgggaggaggcc

SEQ ID NO: 228716 - DNA, 23 bp, Artificial Sequence
  Description of Artificial Sequence: Synthetic oligonucleotide
aaccacgtgcgggaggaggccca

SEQ ID NO: 228717 - DNA, 22 bp, Artificial Sequence
  Description of Artificial Sequence: Synthetic oligonucleotide
aagggggtggtggccgaccggt

SEQ ID NO: 228718 - DNA, 21 bp, Artificial Sequence
  Description of Artificial Sequence: Synthetic oligonucleotide
agggggtggtggccgaccggt

SEQ ID NO: 228719 - DNA, 23 bp, Artificial Sequence
  Description of Artificial Sequence: Synthetic oligonucleotide
ggggtggtggccgaccggtgata

SEQ ID NO: 228720 - DNA, 23 bp, Artificial Sequence
  Description of Artificial Sequence: Synthetic oligonucleotide
gggtggtggccgaccggtgatac

SEQ ID NO: 228721 - DNA, 25 bp, Artificial Sequence
  Description of Artificial Sequence: Synthetic oligonucleotide
ggtggtggccgaccggtgataccta

SEQ ID NO: 228722 - DNA, 26 bp, Artificial Sequence
  Description of Artificial Sequence: Synthetic oligonucleotide
gtggtggccgaccggtgatacctaca

SEQ ID NO: 228723 - DNA, 26 bp, Artificial Sequence
  Description of Artificial Sequence: Synthetic oligonucleotide
tggtggccgaccggtgatacctacag

SEQ ID NO: 228724 - DNA, 25 bp, Artificial Sequence
  Description of Artificial Sequence: Synthetic oligonucleotide
ggtggccgaccggtgatacctacag

SEQ ID NO: 228725 - DNA, 26 bp, Artificial Sequence
  Description of Artificial Sequence: Synthetic oligonucleotide
gtggccgaccggtgatacctacagca

SEQ ID NO: 228726 - DNA, 26 bp, Artificial Sequence
  Description of Artificial Sequence: Synthetic oligonucleotide
tggccgaccggtgatacctacagcag

SEQ ID NO: 228727 - DNA, 25 bp, Artificial Sequence
  Description of Artificial Sequence: Synthetic oligonucleotide
ggccgaccggtgatacctacagcag

SEQ ID NO: 228728 - DNA, 25 bp, Artificial Sequence
  Description of Artificial Sequence: Synthetic oligonucleotide
gccgaccggtgatacctacagcagg

SEQ ID NO: 228729 - DNA, 25 bp, Artificial Sequence
  Description of Artificial Sequence: Synthetic oligonucleotide
ccgaccggtgatacctacagcaggc

SEQ ID NO: 228730 - DNA, 25 bp, Artificial Sequence
  Description of Artificial Sequence: Synthetic oligonucleotide
cgaccggtgatacctacagcaggcc

SEQ ID NO: 228731 - DNA, 26 bp, Artificial Sequence
  Description of Artificial Sequence: Synthetic oligonucleotide
gaccggtgatacctacagcaggccct

SEQ ID NO: 228732 - DNA, 26 bp, Artificial Sequence
  Description of Artificial Sequence: Synthetic oligonucleotide
accggtgatacctacagcaggccctg

SEQ ID NO: 228733 - DNA, 25 bp, Artificial Sequence
  Description of Artificial Sequence: Synthetic oligonucleotide
ccggtgatacctacagcaggccctg

SEQ ID NO: 228734 - DNA, 26 bp, Artificial Sequence
  Description of Artificial Sequence: Synthetic oligonucleotide
cggtgatacctacagcaggccctgga

SEQ ID NO: 228735 - DNA, 27 bp, Artificial Sequence
  Description of Artificial Sequence: Synthetic oligonucleotide
ggtgatacctacagcaggccctggact

SEQ ID NO: 228736 - DNA, 27 bp, Artificial Sequence
  Description of Artificial Sequence: Synthetic oligonucleotide
gtgatacctacagcaggccctggactg

SEQ ID NO: 228737 - DNA, 27 bp, Artificial Sequence
  Description of Artificial Sequence: Synthetic oligonucleotide
tgatacctacagcaggccctggactgg

SEQ ID NO: 228738 - DNA, 25 bp, Artificial Sequence
  Description of Artificial Sequence: Synthetic oligonucleotide
atctgggccgcatacctcacgggca

SEQ ID NO: 228739 - DNA, 24 bp, Artificial Sequence
  Description of Artificial Sequence: Synthetic oligonucleotide
tctgggccgcatacctcacgggca

SEQ ID NO: 228740 - DNA, 23 bp, Artificial Sequence
  Description of Artificial Sequence: Synthetic oligonucleotide
ctgggccgcatacctcacgggca

SEQ ID NO: 228741 - DNA, 24 bp, Artificial Sequence
  Description of Artificial Sequence: Synthetic oligonucleotide
tgggccgcatacctcacgggcaga

SEQ ID NO: 228742 - DNA, 23 bp, Artificial Sequence
  Description of Artificial Sequence: Synthetic oligonucleotide
gggccgcatacctcacgggcaga

SEQ ID NO: 228743 - DNA, 24 bp, Artificial Sequence
  Description of Artificial Sequence: Synthetic oligonucleotide
ggccgcatacctcacgggcagaga

SEQ ID NO: 228744 - DNA, 25 bp, Artificial Sequence
  Description of Artificial Sequence: Synthetic oligonucleotide
gccgcatacctcacgggcagagaca

SEQ ID NO: 228745 - DNA, 25 bp, Artificial Sequence
  Description of Artificial Sequence: Synthetic oligonucleotide
ccgcatacctcacgggcagagacac

SEQ ID NO: 228746 - DNA, 27 bp, Artificial Sequence
  Description of Artificial Sequence: Synthetic oligonucleotide
cgcatacctcacgggcagagacaccat

SEQ ID NO: 228747 - DNA, 27 bp, Artificial Sequence
  Description of Artificial Sequence: Synthetic oligonucleotide
gcatacctcacgggcagagacaccatc

SEQ ID NO: 228748 - DNA, 29 bp, Artificial Sequence
  Description of Artificial Sequence: Synthetic oligonucleotide
catacctcacgggcagagacaccatctac

SEQ ID NO: 228749 - DNA, 29 bp, Artificial Sequence
  Description of Artificial Sequence: Synthetic oligonucleotide
atacctcacgggcagagacaccatctacc

SEQ ID NO: 228750 - DNA, 28 bp, Artificial Sequence
  Description of Artificial Sequence: Synthetic oligonucleotide
tacctcacgggcagagacaccatctacc

SEQ ID NO: 228751 - DNA, 27 bp, Artificial Sequence
  Description of Artificial Sequence: Synthetic oligonucleotide
acctcacgggcagagacaccatctacc

SEQ ID NO: 228752 - DNA, 27 bp, Artificial Sequence
  Description of Artificial Sequence: Synthetic oligonucleotide
cctcacgggcagagacaccatctacct

SEQ ID NO: 228753 - DNA, 27 bp, Artificial Sequence
  Description of Artificial Sequence: Synthetic oligonucleotide
ctcacgggcagagacaccatctacctg

SEQ ID NO: 228754 - DNA, 27 bp, Artificial Sequence
  Description of Artificial Sequence: Synthetic oligonucleotide
tcacgggcagagacaccatctacctgg

SEQ ID NO: 228755 - DNA, 26 bp, Artificial Sequence
  Description of Artificial Sequence: Synthetic oligonucleotide
cacgggcagagacaccatctacctgg

SEQ ID NO: 228756 - DNA, 26 bp, Artificial Sequence
  Description of Artificial Sequence: Synthetic oligonucleotide
acgggcagagacaccatctacctggc

SEQ ID NO: 228757 - DNA, 25 bp, Artificial Sequence
  Description of Artificial Sequence: Synthetic oligonucleotide
cgggcagagacaccatctacctggc

SEQ ID NO: 228758 - DNA, 27 bp, Artificial Sequence
  Description of Artificial Sequence: Synthetic oligonucleotide
gggcagagacaccatctacctggccaa

SEQ ID NO: 228759 - DNA, 30 bp, Artificial Sequence
  Description of Artificial Sequence: Synthetic oligonucleotide
ggcagagacaccatctacctggccaattac

SEQ ID NO: 228760 - DNA, 31 bp, Artificial Sequence
  Description of Artificial Sequence: Synthetic oligonucleotide
gcagagacaccatctacctggccaattacac

SEQ ID NO: 228761 - DNA, 31 bp, Artificial Sequence
  Description of Artificial Sequence: Synthetic oligonucleotide
cagagacaccatctacctggccaattacacc

SEQ ID NO: 228762 - DNA, 31 bp, Artificial Sequence
  Description of Artificial Sequence: Synthetic oligonucleotide
agagacaccatctacctggccaattacaccc

SEQ ID NO: 228763 - DNA, 27 bp, Artificial Sequence
  Description of Artificial Sequence: Synthetic oligonucleotide
agctcgctacagctccctcatcttcgg

SEQ ID NO: 228764 - DNA, 27 bp, Artificial Sequence
  Description of Artificial Sequence: Synthetic oligonucleotide
gctcgctacagctccctcatcttcggt

SEQ ID NO: 228765 - DNA, 27 bp, Artificial Sequence
  Description of Artificial Sequence: Synthetic oligonucleotide
ctcgctacagctccctcatcttcggtc

SEQ ID NO: 228766 - DNA, 28 bp, Artificial Sequence
  Description of Artificial Sequence: Synthetic oligonucleotide
tcgctacagctccctcatcttcggtcac

SEQ ID NO: 228767 - DNA, 27 bp, Artificial Sequence
  Description of Artificial Sequence: Synthetic oligonucleotide
cgctacagctccctcatcttcggtcac

SEQ ID NO: 228768 - DNA, 27 bp, Artificial Sequence
  Description of Artificial Sequence: Synthetic oligonucleotide
gctacagctccctcatcttcggtcacc

SEQ ID NO: 228769 - DNA, 28 bp, Artificial Sequence
  Description of Artificial Sequence: Synthetic oligonucleotide
ctacagctccctcatcttcggtcaccag

SEQ ID NO: 228770 - DNA, 32 bp, Artificial Sequence
  Description of Artificial Sequence: Synthetic oligonucleotide
tacagctccctcatcttcggtcaccagtaatg

SEQ ID NO: 228771 - DNA, 31 bp, Artificial Sequence
  Description of Artificial Sequence: Synthetic oligonucleotide
acagctccctcatcttcggtcaccagtaatg

SEQ ID NO: 228772 - DNA, 30 bp, Artificial Sequence
  Description of Artificial Sequence: Synthetic oligonucleotide
cagctccctcatcttcggtcaccagtaatg

SEQ ID NO: 228773 - DNA, 30 bp, Artificial Sequence
  Description of Artificial Sequence: Synthetic oligonucleotide
agctccctcatcttcggtcaccagtaatgg

SEQ ID NO: 228774 - DNA, 29 bp, Artificial Sequence
  Description of Artificial Sequence: Synthetic oligonucleotide
gctccctcatcttcggtcaccagtaatgg

SEQ ID NO: 228775 - DNA, 29 bp, Artificial Sequence
  Description of Artificial Sequence: Synthetic oligonucleotide
ctccctcatcttcggtcaccagtaatggc

SEQ ID NO: 228776 - DNA, 31 bp, Artificial Sequence
  Description of Artificial Sequence: Synthetic oligonucleotide
tccctcatcttcggtcaccagtaatggcatg

SEQ ID NO: 228777 - DNA, 30 bp, Artificial Sequence
  Description of Artificial Sequence: Synthetic oligonucleotide
ccctcatcttcggtcaccagtaatggcatg

SEQ ID NO: 228778 - DNA, 30 bp, Artificial Sequence
  Description of Artificial Sequence: Synthetic oligonucleotide
cctcatcttcggtcaccagtaatggcatgg

SEQ ID NO: 228779 - DNA, 30 bp, Artificial Sequence
  Description of Artificial Sequence: Synthetic oligonucleotide
ctcatcttcggtcaccagtaatggcatggc

SEQ ID NO: 228780 - DNA, 30 bp, Artificial Sequence
  Description of Artificial Sequence: Synthetic oligonucleotide
tcatcttcggtcaccagtaatggcatggcc

SEQ ID NO: 228781 - DNA, 29 bp, Artificial Sequence
  Description of Artificial Sequence: Synthetic oligonucleotide
catcttcggtcaccagtaatggcatggcc

SEQ ID NO: 228782 - DNA, 30 bp, Artificial Sequence
  Description of Artificial Sequence: Synthetic oligonucleotide
atcttcggtcaccagtaatggcatggcctg

SEQ ID NO: 228783 - DNA, 29 bp, Artificial Sequence
  Description of Artificial Sequence: Synthetic oligonucleotide
tcttcggtcaccagtaatggcatggcctg

SEQ ID NO: 228784 - DNA, 28 bp, Artificial Sequence
  Description of Artificial Sequence: Synthetic oligonucleotide
cttcggtcaccagtaatggcatggcctg

SEQ ID NO: 228785 - DNA, 28 bp, Artificial Sequence
  Description of Artificial Sequence: Synthetic oligonucleotide
ttcggtcaccagtaatggcatggcctgg

SEQ ID NO: 228786 - DNA, 27 bp, Artificial Sequence
  Description of Artificial Sequence: Synthetic oligonucleotide
tcggtcaccagtaatggcatggcctgg

SEQ ID NO: 228787 - DNA, 27 bp, Artificial Sequence
  Description of Artificial Sequence: Synthetic oligonucleotide
cggtcaccagtaatggcatggcctggt

SEQ ID NO: 228788 - DNA, 25 bp, Artificial Sequence
  Description of Artificial Sequence: Synthetic oligonucleotide
caggccctggactggttccgagctt

SEQ ID NO: 228789 - DNA, 25 bp, Artificial Sequence
  Description of Artificial Sequence: Synthetic oligonucleotide
aggccctggactggttccgagcttg

SEQ ID NO: 228790 - DNA, 24 bp, Artificial Sequence
  Description of Artificial Sequence: Synthetic oligonucleotide
ggccctggactggttccgagcttg

SEQ ID NO: 228791 - DNA, 26 bp, Artificial Sequence
  Description of Artificial Sequence: Synthetic oligonucleotide
gccctggactggttccgagcttgcta

SEQ ID NO: 228792 - DNA, 27 bp, Artificial Sequence
  Description of Artificial Sequence: Synthetic oligonucleotide
ccctggactggttccgagcttgctaca

SEQ ID NO: 228793 - DNA, 27 bp, Artificial Sequence
  Description of Artificial Sequence: Synthetic oligonucleotide
cctggactggttccgagcttgctacag

SEQ ID NO: 228794 - DNA, 27 bp, Artificial Sequence
  Description of Artificial Sequence: Synthetic oligonucleotide
ctggactggttccgagcttgctacagc

SEQ ID NO: 228795 - DNA, 28 bp, Artificial Sequence
  Description of Artificial Sequence: Synthetic oligonucleotide
tggactggttccgagcttgctacagctc

SEQ ID NO: 228796 - DNA, 27 bp, Artificial Sequence
  Description of Artificial Sequence: Synthetic oligonucleotide
ggactggttccgagcttgctacagctc

SEQ ID NO: 228797 - DNA, 27 bp, Artificial Sequence
  Description of Artificial Sequence: Synthetic oligonucleotide
gactggttccgagcttgctacagctcc

SEQ ID NO: 228798 - DNA, 27 bp, Artificial Sequence
  Description of Artificial Sequence: Synthetic oligonucleotide
actggttccgagcttgctacagctccc

SEQ ID NO: 228799 - DNA, 27 bp, Artificial Sequence
  Description of Artificial Sequence: Synthetic oligonucleotide
ctggttccgagcttgctacagctccct

SEQ ID NO: 228800 - DNA, 27 bp, Artificial Sequence
  Description of Artificial Sequence: Synthetic oligonucleotide
tggttccgagcttgctacagctccctc

SEQ ID NO: 228801 - DNA, 27 bp, Artificial Sequence
  Description of Artificial Sequence: Synthetic oligonucleotide
ggttccgagcttgctacagctccctca

SEQ ID NO: 228802 - DNA, 28 bp, Artificial Sequence
  Description of Artificial Sequence: Synthetic oligonucleotide
gttccgagcttgctacagctccctcatc

SEQ ID NO: 228803 - DNA, 30 bp, Artificial Sequence
  Description of Artificial Sequence: Synthetic oligonucleotide
ttccgagcttgctacagctccctcatcttc

SEQ ID NO: 228804 - DNA, 29 bp, Artificial Sequence
  Description of Artificial Sequence: Synthetic oligonucleotide
tccgagcttgctacagctccctcatcttc

SEQ ID NO: 228805 - DNA, 28 bp, Artificial Sequence
  Description of Artificial Sequence: Synthetic oligonucleotide
ccgagcttgctacagctccctcatcttc

SEQ ID NO: 228806 - DNA, 28 bp, Artificial Sequence
  Description of Artificial Sequence: Synthetic oligonucleotide
cgagcttgctacagctccctcatcttcg

SEQ ID NO: 228807 - DNA, 29 bp, Artificial Sequence
  Description of Artificial Sequence: Synthetic oligonucleotide
gagcttgctacagctccctcatcttcgtg

SEQ ID NO: 228808 - DNA, 29 bp, Artificial Sequence
  Description of Artificial Sequence: Synthetic oligonucleotide
agcttgctacagctccctcatcttcgtgg

SEQ ID NO: 228809 - DNA, 28 bp, Artificial Sequence
  Description of Artificial Sequence: Synthetic oligonucleotide
gcttgctacagctccctcatcttcgtgg

SEQ ID NO: 228810 - DNA, 29 bp, Artificial Sequence
  Description of Artificial Sequence: Synthetic oligonucleotide
cttgctacagctccctcatcttcgtggtc

SEQ ID NO: 228811 - DNA, 30 bp, Artificial Sequence
  Description of Artificial Sequence: Synthetic oligonucleotide
ttgctacagctccctcatcttcgtggtcac

SEQ ID NO: 228812 - DNA, 29 bp, Artificial Sequence
  Description of Artificial Sequence: Synthetic oligonucleotide
tgctacagctccctcatcttcgtggtcac

SEQ ID NO: 228813 - DNA, 28 bp, Artificial Sequence
  Description of Artificial Sequence: Synthetic oligonucleotide
ctcgctacagctccctcatcttcgtgac

SEQ ID NO: 228814 - DNA, 28 bp, Artificial Sequence
  Description of Artificial Sequence: Synthetic oligonucleotide
tcgctacagctccctcatcttcgtgacc

SEQ ID NO: 228815 - DNA, 27 bp, Artificial Sequence
  Description of Artificial Sequence: Synthetic oligonucleotide
cgctacagctccctcatcttcgtgacc

SEQ ID NO: 228816 - DNA, 28 bp, Artificial Sequence
  Description of Artificial Sequence: Synthetic oligonucleotide
gctacagctccctcatcttcgtgaccag

SEQ ID NO: 228817 - DNA, 32 bp, Artificial Sequence
  Description of Artificial Sequence: Synthetic oligonucleotide
ctacagctccctcatcttcgtgaccagtaatg

SEQ ID NO: 228818 - DNA, 32 bp, Artificial Sequence
  Description of Artificial Sequence: Synthetic oligonucleotide
tacagctccctcatcttcgtgaccagtaatgg

SEQ ID NO: 228819 - DNA, 31 bp, Artificial Sequence
  Description of Artificial Sequence: Synthetic oligonucleotide
acagctccctcatcttcgtgaccagtaatgg

SEQ ID NO: 228820 - DNA, 30 bp, Artificial Sequence
  Description of Artificial Sequence: Synthetic oligonucleotide
cagctccctcatcttcgtgaccagtaatgg

SEQ ID NO: 228821 - DNA, 30 bp, Artificial Sequence
  Description of Artificial Sequence: Synthetic oligonucleotide
agctccctcatcttcgtgaccagtaatggc

SEQ ID NO: 228822 - DNA, 29 bp, Artificial Sequence
  Description of Artificial Sequence: Synthetic oligonucleotide
gctccctcatcttcgtgaccagtaatggc

SEQ ID NO: 228823 - DNA, 31 bp, Artificial Sequence
  Description of Artificial Sequence: Synthetic oligonucleotide
ctccctcatcttcgtgaccagtaatggcatg

SEQ ID NO: 228824 - DNA, 31 bp, Artificial Sequence
  Description of Artificial Sequence: Synthetic oligonucleotide
tccctcatcttcgtgaccagtaatggcatgg

SEQ ID NO: 228825 - DNA, 30 bp, Artificial Sequence
  Description of Artificial Sequence: Synthetic oligonucleotide
ccctcatcttcgtgaccagtaatggcatgg

SEQ ID NO: 228826 - DNA, 30 bp, Artificial Sequence
  Description of Artificial Sequence: Synthetic oligonucleotide
cctcatcttcgtgaccagtaatggcatggc

SEQ ID NO: 228827 - DNA, 30 bp, Artificial Sequence
  Description of Artificial Sequence: Synthetic oligonucleotide
ctcatcttcgtgaccagtaatggcatggcc

SEQ ID NO: 228828 - DNA, 31 bp, Artificial Sequence
  Description of Artificial Sequence: Synthetic oligonucleotide
tcatcttcgtgaccagtaatggcatggcctg

SEQ ID NO: 228829 - DNA, 30 bp, Artificial Sequence
  Description of Artificial Sequence: Synthetic oligonucleotide
catcttcgtgaccagtaatggcatggcctg

SEQ ID NO: 228830 - DNA, 30 bp, Artificial Sequence
  Description of Artificial Sequence: Synthetic oligonucleotide
atcttcgtgaccagtaatggcatggcctgg

SEQ ID NO: 228831 - DNA, 29 bp, Artificial Sequence
  Description of Artificial Sequence: Synthetic oligonucleotide
tcttcgtgaccagtaatggcatggcctgg

SEQ ID NO: 228832 - DNA, 28 bp, Artificial Sequence
  Description of Artificial Sequence: Synthetic oligonucleotide
cttcgtgaccagtaatggcatggcctgg

SEQ ID NO: 228833 - DNA, 29 bp, Artificial Sequence
  Description of Artificial Sequence: Synthetic oligonucleotide
ttcgtgaccagtaatggcatggcctggtg

SEQ ID NO: 228834 - DNA, 28 bp, Artificial Sequence
  Description of Artificial Sequence: Synthetic oligonucleotide
tcgtgaccagtaatggcatggcctggtg

SEQ ID NO: 228835 - DNA, 27 bp, Artificial Sequence
  Description of Artificial Sequence: Synthetic oligonucleotide
cgtgaccagtaatggcatggcctggtg

SEQ ID NO: 228836 - DNA, 28 bp, Artificial Sequence
  Description of Artificial Sequence: Synthetic oligonucleotide
gtgaccagtaatggcatggcctggtgtc

SEQ ID NO: 228837 - DNA, 28 bp, Artificial Sequence
  Description of Artificial Sequence: Synthetic oligonucleotide
tgaccagtaatggcatggcctggtgtcg

SEQ ID NO: 228838 - DNA, 27 bp, Artificial Sequence
  Description of Artificial Sequence: Synthetic oligonucleotide
gaccagtaatggcatggcctggtgtcg

SEQ ID NO: 228839 - DNA, 24 bp, Artificial Sequence
  Description of Artificial Sequence: Synthetic oligonucleotide
cgggggagtacgtccgcttcacca

SEQ ID NO: 228840 - DNA, 24 bp, Artificial Sequence
  Description of Artificial Sequence: Synthetic oligonucleotide
gggggagtacgtccgcttcaccag

SEQ ID NO: 228841 - DNA, 26 bp, Artificial Sequence
  Description of Artificial Sequence: Synthetic oligonucleotide
ggggagtacgtccgcttcaccagcta

SEQ ID NO: 228842 - DNA, 26 bp, Artificial Sequence
  Description of Artificial Sequence: Synthetic oligonucleotide
gggagtacgtccgcttcaccagctac

SEQ ID NO: 228843 - DNA, 26 bp, Artificial Sequence
  Description of Artificial Sequence: Synthetic oligonucleotide
ggagtacgtccgcttcaccagctacc

SEQ ID NO: 228844 - DNA, 26 bp, Artificial Sequence
  Description of Artificial Sequence: Synthetic oligonucleotide
gagtacgtccgcttcaccagctaccc

SEQ ID NO: 228845 - DNA, 27 bp, Artificial Sequence
  Description of Artificial Sequence: Synthetic oligonucleotide
agtacgtccgcttcaccagctacccct

SEQ ID NO: 228846 - DNA, 26 bp, Artificial Sequence
  Description of Artificial Sequence: Synthetic oligonucleotide
gtacgtccgcttcaccagctacccct

SEQ ID NO: 228847 - DNA, 26 bp, Artificial Sequence
  Description of Artificial Sequence: Synthetic oligonucleotide
tacgtccgcttcaccagctacccctg

SEQ ID NO: 228848 - DNA, 25 bp, Artificial Sequence
  Description of Artificial Sequence: Synthetic oligonucleotide
acgtccgcttcaccagctacccctg

SEQ ID NO: 228849 - DNA, 24 bp, Artificial Sequence
  Description of Artificial Sequence: Synthetic oligonucleotide
cgtccgcttcaccagctacccctg

SEQ ID NO: 228850 - DNA, 25 bp, Artificial Sequence
  Description of Artificial Sequence: Synthetic oligonucleotide
gtccgcttcaccagctacccctgct

SEQ ID NO: 228851 - DNA, 25 bp, Artificial Sequence
  Description of Artificial Sequence: Synthetic oligonucleotide
tccgcttcaccagctacccctgctc

SEQ ID NO: 228852 - DNA, 24 bp, Artificial Sequence
  Description of Artificial Sequence: Synthetic oligonucleotide
ccgcttcaccagctacccctgctc

SEQ ID NO: 228853 - DNA, 25 bp, Artificial Sequence
  Description of Artificial Sequence: Synthetic oligonucleotide
cgcttcaccagctacccctgctcct

SEQ ID NO: 228854 - DNA, 25 bp, Artificial Sequence
  Description of Artificial Sequence: Synthetic oligonucleotide
gcttcaccagctacccctgctcctg

SEQ ID NO: 228855 - DNA, 26 bp, Artificial Sequence
  Description of Artificial Sequence: Synthetic oligonucleotide
cttcaccagctacccctgctcctgga

SEQ ID NO: 228856 - DNA, 26 bp, Artificial Sequence
  Description of Artificial Sequence: Synthetic oligonucleotide
ttcaccagctacccctgctcctggac

SEQ ID NO: 228857 - DNA, 25 bp, Artificial Sequence
  Description of Artificial Sequence: Synthetic oligonucleotide
tcaccagctacccctgctcctggac

SEQ ID NO: 228858 - DNA, 24 bp, Artificial Sequence
  Description of Artificial Sequence: Synthetic oligonucleotide
caccagctacccctgctcctggac

SEQ ID NO: 228859 - DNA, 26 bp, Artificial Sequence
  Description of Artificial Sequence: Synthetic oligonucleotide
accagctacccctgctcctggacctt

SEQ ID NO: 228860 - DNA, 25 bp, Artificial Sequence
  Description of Artificial Sequence: Synthetic oligonucleotide
ccagctacccctgctcctggacctt

SEQ ID NO: 228861 - DNA, 27 bp, Artificial Sequence
  Description of Artificial Sequence: Synthetic oligonucleotide
cagctacccctgctcctggaccttcta

SEQ ID NO: 228862 - DNA, 27 bp, Artificial Sequence
  Description of Artificial Sequence: Synthetic oligonucleotide
agctacccctgctcctggaccttctac

SEQ ID NO: 228863 - DNA, 31 bp, Artificial Sequence
  Description of Artificial Sequence: Synthetic oligonucleotide
gatcccctggcagaactaccacctgaattac

SEQ ID NO: 228864 - DNA, 32 bp, Artificial Sequence
  Description of Artificial Sequence: Synthetic oligonucleotide
atcccctggcagaactaccacctgaattactg

SEQ ID NO: 228865 - DNA, 31 bp, Artificial Sequence
  Description of Artificial Sequence: Synthetic oligonucleotide
tcccctggcagaactaccacctgaattactg

SEQ ID NO: 228866 - DNA, 30 bp, Artificial Sequence
  Description of Artificial Sequence: Synthetic oligonucleotide
cccctggcagaactaccacctgaattactg

SEQ ID NO: 228867 - DNA, 30 bp, Artificial Sequence
  Description of Artificial Sequence: Synthetic oligonucleotide
ccctggcagaactaccacctgaattactgg

SEQ ID NO: 228868 - DNA, 32 bp, Artificial Sequence
  Description of Artificial Sequence: Synthetic oligonucleotide
cctggcagaactaccacctgaattactggatg

SEQ ID NO: 228869 - DNA, 32 bp, Artificial Sequence
  Description of Artificial Sequence: Synthetic oligonucleotide
ctggcagaactaccacctgaattactggatgg

SEQ ID NO: 228870 - DNA, 33 bp, Artificial Sequence
  Description of Artificial Sequence: Synthetic oligonucleotide
tggcagaactaccacctgaattactggatggag

SEQ ID NO: 228871 - DNA, 32 bp, Artificial Sequence
  Description of Artificial Sequence: Synthetic oligonucleotide
ggcagaactaccacctgaattactggatggag

SEQ ID NO: 228872 - DNA, 32 bp, Artificial Sequence
  Description of Artificial Sequence: Synthetic oligonucleotide
gcagaactaccacctgaattactggatggagg

SEQ ID NO: 228873 - DNA, 33 bp, Artificial Sequence
  Description of Artificial Sequence: Synthetic oligonucleotide
cagaactaccacctgaattactggatggaggag

SEQ ID NO: 228874 - DNA, 33 bp, Artificial Sequence
  Description of Artificial Sequence: Synthetic oligonucleotide
agaactaccacctgaattactggatggaggagg

SEQ ID NO: 228875 - DNA, 32 bp, Artificial Sequence
  Description of Artificial Sequence: Synthetic oligonucleotide
gaactaccacctgaattactggatggaggagg

SEQ ID NO: 228876 - DNA, 36 bp, Artificial Sequence
  Description of Artificial Sequence: Synthetic oligonucleotide
aactaccacctgaattactggatggaggaggaatac

SEQ ID NO: 228877 - DNA, 35 bp, Artificial Sequence
  Description of Artificial Sequence: Synthetic oligonucleotide
actaccacctgaattactggatggaggaggaatac

SEQ ID NO: 228878 - DNA, 34 bp, Artificial Sequence
  Description of Artificial Sequence: Synthetic oligonucleotide
ctaccacctgaattactggatggaggaggaatac

SEQ ID NO: 228879 - DNA, 34 bp, Artificial Sequence
  Description of Artificial Sequence: Synthetic oligonucleotide
taccacctgaattactggatggaggaggaatacc

SEQ ID NO: 228880 - DNA, 33 bp, Artificial Sequence
  Description of Artificial Sequence: Synthetic oligonucleotide
accacctgaattactggatggaggaggaatacc

SEQ ID NO: 228881 - DNA, 32 bp, Artificial Sequence
  Description of Artificial Sequence: Synthetic oligonucleotide
ccacctgaattactggatggaggaggaatacc

SEQ ID NO: 228882 - DNA, 32 bp, Artificial Sequence
  Description of Artificial Sequence: Synthetic oligonucleotide
cacctgaattactggatggaggaggaataccg

SEQ ID NO: 228883 - DNA, 32 bp, Artificial Sequence
  Description of Artificial Sequence: Synthetic oligonucleotide
acctgaattactggatggaggaggaataccgc

SEQ ID NO: 228884 - DNA, 31 bp, Artificial Sequence
  Description of Artificial Sequence: Synthetic oligonucleotide
cctgaattactggatggaggaggaataccgc

SEQ ID NO: 228885 - DNA, 31 bp, Artificial Sequence
  Description of Artificial Sequence: Synthetic oligonucleotide
ctgaattactggatggaggaggaataccgcc

SEQ ID NO: 228886 - DNA, 32 bp, Artificial Sequence
  Description of Artificial Sequence: Synthetic oligonucleotide
tgaattactggatggaggaggaataccgccac

SEQ ID NO: 228887 - DNA, 31 bp, Artificial Sequence
  Description of Artificial Sequence: Synthetic oligonucleotide
gaattactggatggaggaggaataccgccac

SEQ ID NO: 228888 - DNA, 33 bp, Artificial Sequence
  Description of Artificial Sequence: Synthetic oligonucleotide
aattactggatggaggaggaataccgccacatc

SEQ ID NO: 228889 - DNA, 32 bp, Artificial Sequence
  Description of Artificial Sequence: Synthetic oligonucleotide
attactggatggaggaggaataccgccacatc

SEQ ID NO: 228890 - DNA, 31 bp, Artificial Sequence
  Description of Artificial Sequence: Synthetic oligonucleotide
ttactggatggaggaggaataccgccacatc

SEQ ID NO: 228891 - DNA, 30 bp, Artificial Sequence
  Description of Artificial Sequence: Synthetic oligonucleotide
tactggatggaggaggaataccgccacatc

SEQ ID NO: 228892 - DNA, 30 bp, Artificial Sequence
  Description of Artificial Sequence: Synthetic oligonucleotide
gagttaccggtgcagataccagtgctagtc

SEQ ID NO: 228893 - DNA, 31 bp, Artificial Sequence
  Description of Artificial Sequence: Synthetic oligonucleotide
agttaccggtgcagataccagtgctagtctc

SEQ ID NO: 228894 - DNA, 30 bp, Artificial Sequence
  Description of Artificial Sequence: Synthetic oligonucleotide
gttaccggtgcagataccagtgctagtctc

SEQ ID NO: 228895 - DNA, 32 bp, Artificial Sequence
  Description of Artificial Sequence: Synthetic oligonucleotide
ttaccggtgcagataccagtgctagtctcaac

SEQ ID NO: 228896 - DNA, 31 bp, Artificial Sequence
  Description of Artificial Sequence: Synthetic oligonucleotide
taccggtgcagataccagtgctagtctcaac

SEQ ID NO: 228897 - DNA, 30 bp, Artificial Sequence
  Description of Artificial Sequence: Synthetic oligonucleotide
accggtgcagataccagtgctagtctcaac

SEQ ID NO: 228898 - DNA, 29 bp, Artificial Sequence
  Description of Artificial Sequence: Synthetic oligonucleotide
ccggtgcagataccagtgctagtctcaac

SEQ ID NO: 228899 - DNA, 31 bp, Artificial Sequence
  Description of Artificial Sequence: Synthetic oligonucleotide
cggtgcagataccagtgctagtctcaacatc

SEQ ID NO: 228900 - DNA, 34 bp, Artificial Sequence
  Description of Artificial Sequence: Synthetic oligonucleotide
ggtgcagataccagtgctagtctcaacatcaaag

SEQ ID NO: 228901 - DNA, 34 bp, Artificial Sequence
  Description of Artificial Sequence: Synthetic oligonucleotide
gtgcagataccagtgctagtctcaacatcaaagg

SEQ ID NO: 228902 - DNA, 34 bp, Artificial Sequence
  Description of Artificial Sequence: Synthetic oligonucleotide
tgcagataccagtgctagtctcaacatcaaaggc

SEQ ID NO: 228903 - DNA, 33 bp, Artificial Sequence
  Description of Artificial Sequence: Synthetic oligonucleotide
gcagataccagtgctagtctcaacatcaaaggc

SEQ ID NO: 228904 - DNA, 34 bp, Artificial Sequence
  Description of Artificial Sequence: Synthetic oligonucleotide
cagataccagtgctagtctcaacatcaaaggcac

SEQ ID NO: 228905 - DNA, 35 bp, Artificial Sequence
  Description of Artificial Sequence: Synthetic oligonucleotide
agataccagtgctagtctcaacatcaaaggcactg

SEQ ID NO: 228906 - DNA, 34 bp, Artificial Sequence
  Description of Artificial Sequence: Synthetic oligonucleotide
gataccagtgctagtctcaacatcaaaggcactg

SEQ ID NO: 228907 - DNA, 34 bp, Artificial Sequence
  Description of Artificial Sequence: Synthetic oligonucleotide
ataccagtgctagtctcaacatcaaaggcactgg

SEQ ID NO: 228908 - DNA, 33 bp, Artificial Sequence
  Description of Artificial Sequence: Synthetic oligonucleotide
taccagtgctagtctcaacatcaaaggcactgg

SEQ ID NO: 228909 - DNA, 32 bp, Artificial Sequence
  Description of Artificial Sequence: Synthetic oligonucleotide
accagtgctagtctcaacatcaaaggcactgg

SEQ ID NO: 228910 - DNA, 31 bp, Artificial Sequence
  Description of Artificial Sequence: Synthetic oligonucleotide
ccagtgctagtctcaacatcaaaggcactgg

SEQ ID NO: 228911 - DNA, 31 bp, Artificial Sequence
  Description of Artificial Sequence: Synthetic oligonucleotide
cagtgctagtctcaacatcaaaggcactggg

SEQ ID NO: 228912 - DNA, 32 bp, Artificial Sequence
  Description of Artificial Sequence: Synthetic oligonucleotide
agtgctagtctcaacatcaaaggcactgggac

SEQ ID NO: 228913 - DNA, 31 bp, Artificial Sequence
  Description of Artificial Sequence: Synthetic oligonucleotide
gtgctagtctcaacatcaaaggcactgggac

SEQ ID NO: 228914 - DNA, 31 bp, Artificial Sequence
  Description of Artificial Sequence: Synthetic oligonucleotide
tgctagtctcaacatcaaaggcactgggacc

SEQ ID NO: 228915 - DNA, 30 bp, Artificial Sequence
  Description of Artificial Sequence: Synthetic oligonucleotide
gctagtctcaacatcaaaggcactgggacc

SEQ ID NO: 228916 - DNA, 30 bp, Artificial Sequence
  Description of Artificial Sequence: Synthetic oligonucleotide
ctagtctcaacatcaaaggcactgggaccc

SEQ ID NO: 228917 - DNA, 31 bp, Artificial Sequence
  Description of Artificial Sequence: Synthetic oligonucleotide
tagtctcaacatcaaaggcactgggacccag

SEQ ID NO: 228918 - DNA, 30 bp, Artificial Sequence
  Description of Artificial Sequence: Synthetic oligonucleotide
agtctcaacatcaaaggcactgggacccag

SEQ ID NO: 228919 - DNA, 29 bp, Artificial Sequence
  Description of Artificial Sequence: Synthetic oligonucleotide
gtctcaacatcaaaggcactgggacccag

SEQ ID NO: 228920 - DNA, 29 bp, Artificial Sequence
  Description of Artificial Sequence: Synthetic oligonucleotide
tctcaacatcaaaggcactgggacccagc

SEQ ID NO: 228921 - DNA, 34 bp, Artificial Sequence
  Description of Artificial Sequence: Synthetic oligonucleotide
ccctttcctcaaaatctttaagccagaggcagtc

SEQ ID NO: 228922 - DNA, 36 bp, Artificial Sequence
  Description of Artificial Sequence: Synthetic oligonucleotide
cctttcctcaaaatctttaagccagaggcagtcttc

SEQ ID NO: 228923 - DNA, 36 bp, Artificial Sequence
  Description of Artificial Sequence: Synthetic oligonucleotide
ctttcctcaaaatctttaagccagaggcagtcttcc

SEQ ID NO: 228924 - DNA, 37 bp, Artificial Sequence
  Description of Artificial Sequence: Synthetic oligonucleotide
tttcctcaaaatctttaagccagaggcagtcttcctg

SEQ ID NO: 228925 - DNA, 36 bp, Artificial Sequence
  Description of Artificial Sequence: Synthetic oligonucleotide
ttcctcaaaatctttaagccagaggcagtcttcctg

SEQ ID NO: 228926 - DNA, 35 bp, Artificial Sequence
  Description of Artificial Sequence: Synthetic oligonucleotide
tcctcaaaatctttaagccagaggcagtcttcctg

SEQ ID NO: 228927 - DNA, 34 bp, Artificial Sequence
  Description of Artificial Sequence: Synthetic oligonucleotide
cctcaaaatctttaagccagaggcagtcttcctg

SEQ ID NO: 228928 - DNA, 34 bp, Artificial Sequence
  Description of Artificial Sequence: Synthetic oligonucleotide
ctcaaaatctttaagccagaggcagtcttcctgc

SEQ ID NO: 228929 - DNA, 34 bp, Artificial Sequence
  Description of Artificial Sequence: Synthetic oligonucleotide
tcaaaatctttaagccagaggcagtcttcctgcc

SEQ ID NO: 228930 - DNA, 33 bp, Artificial Sequence
  Description of Artificial Sequence: Synthetic oligonucleotide
caaaatctttaagccagaggcagtcttcctgcc

SEQ ID NO: 228931 - DNA, 33 bp, Artificial Sequence
  Description of Artificial Sequence: Synthetic oligonucleotide
aaaatctttaagccagaggcagtcttcctgccg

SEQ ID NO: 228932 - DNA, 32 bp, Artificial Sequence
  Description of Artificial Sequence: Synthetic oligonucleotide
aaatctttaagccagaggcagtcttcctgccg

SEQ ID NO: 228933 - DNA, 31 bp, Artificial Sequence
  Description of Artificial Sequence: Synthetic oligonucleotide
aatctttaagccagaggcagtcttcctgccg

SEQ ID NO: 228934 - DNA, 30 bp, Artificial Sequence
  Description of Artificial Sequence: Synthetic oligonucleotide
atctttaagccagaggcagtcttcctgccg

SEQ ID NO: 228935 - DNA, 29 bp, Artificial Sequence
  Description of Artificial Sequence: Synthetic oligonucleotide
tctttaagccagaggcagtcttcctgccg

SEQ ID NO: 228936 - DNA, 28 bp, Artificial Sequence
  Description of Artificial Sequence: Synthetic oligonucleotide
ctttaagccagaggcagtcttcctgccg

SEQ ID NO: 228937 - DNA, 28 bp, Artificial Sequence
  Description of Artificial Sequence: Synthetic oligonucleotide
tttaagccagaggcagtcttcctgccgg

SEQ ID NO: 228938 - DNA, 27 bp, Artificial Sequence
  Description of Artificial Sequence: Synthetic oligonucleotide
ttaagccagaggcagtcttcctgccgg

SEQ ID NO: 228939 - DNA, 27 bp, Artificial Sequence
  Description of Artificial Sequence: Synthetic oligonucleotide
taagccagaggcagtcttcctgccgga

SEQ ID NO: 228940 - DNA, 26 bp, Artificial Sequence
  Description of Artificial Sequence: Synthetic oligonucleotide
aagccagaggcagtcttcctgccgga

SEQ ID NO: 228941 - DNA, 25 bp, Artificial Sequence
  Description of Artificial Sequence: Synthetic oligonucleotide
agccagaggcagtcttcctgccgga

SEQ ID NO: 228942 - DNA, 24 bp, Artificial Sequence
  Description of Artificial Sequence: Synthetic oligonucleotide
gccagaggcagtcttcctgccgga

SEQ ID NO: 228943 - DNA, 25 bp, Artificial Sequence
  Description of Artificial Sequence: Synthetic oligonucleotide
ccagaggcagtcttcctgccggagt

SEQ ID NO: 228944 - DNA, 25 bp, Artificial Sequence
  Description of Artificial Sequence: Synthetic oligonucleotide
cagaggcagtcttcctgccggagtg

SEQ ID NO: 228945 - DNA, 26 bp, Artificial Sequence
  Description of Artificial Sequence: Synthetic oligonucleotide
agaggcagtcttcctgccggagtgga

SEQ ID NO: 228946 - DNA, 25 bp, Artificial Sequence
  Description of Artificial Sequence: Synthetic oligonucleotide
gaggcagtcttcctgccggagtgga

SEQ ID NO: 228947 - DNA, 26 bp, Artificial Sequence
  Description of Artificial Sequence: Synthetic oligonucleotide
aggcagtcttcctgccggagtggaca

SEQ ID NO: 228948 - DNA, 25 bp, Artificial Sequence
  Description of Artificial Sequence: Synthetic oligonucleotide
ggcagtcttcctgccggagtggaca

SEQ ID NO: 228949 - DNA, 25 bp, Artificial Sequence
  Description of Artificial Sequence: Synthetic oligonucleotide
gcagtcttcctgccggagtggacag

SEQ ID NO: 228950 - DNA, 25 bp, Artificial Sequence
  Description of Artificial Sequence: Synthetic oligonucleotide
cagtcttcctgccggagtggacagg

SEQ ID NO: 228951 - DNA, 27 bp, Artificial Sequence
  Description of Artificial Sequence: Synthetic oligonucleotide
agtcttcctgccggagtggacagggat

SEQ ID NO: 228952 - DNA, 27 bp, Artificial Sequence
  Description of Artificial Sequence: Synthetic oligonucleotide
gtcttcctgccggagtggacagggatt

SEQ ID NO: 228953 - DNA, 27 bp, Artificial Sequence
  Description of Artificial Sequence: Synthetic oligonucleotide
tcttcctgccggagtggacagggattg

SEQ ID NO: 228954 - DNA, 27 bp, Artificial Sequence
  Description of Artificial Sequence: Synthetic oligonucleotide
cccacggtgatgtggtgtttgctggca

SEQ ID NO: 228955 - DNA, 29 bp, Artificial Sequence
  Description of Artificial Sequence: Synthetic oligonucleotide
ccacggtgatgtggtgtttgctggcaatg

SEQ ID NO: 228956 - DNA, 29 bp, Artificial Sequence
  Description of Artificial Sequence: Synthetic oligonucleotide
cacggtgatgtggtgtttgctggcaatgg

SEQ ID NO: 228957 - DNA, 29 bp, Artificial Sequence
  Description of Artificial Sequence: Synthetic oligonucleotide
acggtgatgtggtgtttgctggcaatggc

SEQ ID NO: 228958 - DNA, 28 bp, Artificial Sequence
  Description of Artificial Sequence: Synthetic oligonucleotide
cggtgatgtggtgtttgctggcaatggc

SEQ ID NO: 228959 - DNA, 31 bp, Artificial Sequence
  Description of Artificial Sequence: Synthetic oligonucleotide
ggtgatgtggtgtttgctggcaatggcattg

SEQ ID NO: 228960 - DNA, 32 bp, Artificial Sequence
  Description of Artificial Sequence: Synthetic oligonucleotide
gtgatgtggtgtttgctggcaatggcattgag

SEQ ID NO: 228961 - DNA, 32 bp, Artificial Sequence
  Description of Artificial Sequence: Synthetic oligonucleotide
tgatgtggtgtttgctggcaatggcattgagg

SEQ ID NO: 228962 - DNA, 31 bp, Artificial Sequence
  Description of Artificial Sequence: Synthetic oligonucleotide
gatgtggtgtttgctggcaatggcattgagg

SEQ ID NO: 228963 - DNA, 31 bp, Artificial Sequence
  Description of Artificial Sequence: Synthetic oligonucleotide
atgtggtgtttgctggcaatggcattgaggg

SEQ ID NO: 228964 - DNA, 30 bp, Artificial Sequence
  Description of Artificial Sequence: Synthetic oligonucleotide
tgtggtgtttgctggcaatggcattgaggg

SEQ ID NO: 228965 - DNA, 29 bp, Artificial Sequence
  Description of Artificial Sequence: Synthetic oligonucleotide
gtggtgtttgctggcaatggcattgaggg

SEQ ID NO: 228966 - DNA, 29 bp, Artificial Sequence
  Description of Artificial Sequence: Synthetic oligonucleotide
tggtgtttgctggcaatggcattgagggc

SEQ ID NO: 228967 - DNA, 28 bp, Artificial Sequence
  Description of Artificial Sequence: Synthetic oligonucleotide
ggtgtttgctggcaatggcattgagggc

SEQ ID NO: 228968 - DNA, 29 bp, Artificial Sequence
  Description of Artificial Sequence: Synthetic oligonucleotide
gtgtttgctggcaatggcattgagggctc

SEQ ID NO: 228969 - DNA, 30 bp, Artificial Sequence
  Description of Artificial Sequence: Synthetic oligonucleotide
tgtttgctggcaatggcattgagggctcac

SEQ ID NO: 228970 - DNA, 29 bp, Artificial Sequence
  Description of Artificial Sequence: Synthetic oligonucleotide
gtttgctggcaatggcattgagggctcac

SEQ ID NO: 228971 - DNA, 29 bp, Artificial Sequence
  Description of Artificial Sequence: Synthetic oligonucleotide
tttgctggcaatggcattgagggctcacc

SEQ ID NO: 228972 - DNA, 28 bp, Artificial Sequence
  Description of Artificial Sequence: Synthetic oligonucleotide
ttgctggcaatggcattgagggctcacc

SEQ ID NO: 228973 - DNA, 27 bp, Artificial Sequence
  Description of Artificial Sequence: Synthetic oligonucleotide
tgctggcaatggcattgagggctcacc

SEQ ID NO: 228974 - DNA, 27 bp, Artificial Sequence
  Description of Artificial Sequence: Synthetic oligonucleotide
gctggcaatggcattgagggctcacct

SEQ ID NO: 228975 - DNA, 27 bp, Artificial Sequence
  Description of Artificial Sequence: Synthetic oligonucleotide
ctggcaatggcattgagggctcacctg

SEQ ID NO: 228976 - DNA, 27 bp, Artificial Sequence
  Description of Artificial Sequence: Synthetic oligonucleotide
tggcaatggcattgagggctcacctgc

SEQ ID NO: 228977 - DNA, 26 bp, Artificial Sequence
  Description of Artificial Sequence: Synthetic oligonucleotide
ggcaatggcattgagggctcacctgc

SEQ ID NO: 228978 - DNA, 27 bp, Artificial Sequence
  Description of Artificial Sequence: Synthetic oligonucleotide
gcaatggcattgagggctcacctgcca

SEQ ID NO: 228979 - DNA, 29 bp, Artificial Sequence
  Description of Artificial Sequence: Synthetic oligonucleotide
caatggcattgagggctcacctgccaaag

SEQ ID NO: 228980 - DNA, 34 bp, Artificial Sequence
  Description of Artificial Sequence: Synthetic oligonucleotide
aatggcattgagggctcacctgccaaagattttg

SEQ ID NO: 228981 - DNA, 36 bp, Artificial Sequence
  Description of Artificial Sequence: Synthetic oligonucleotide
atgctttctgaaagcagctcctttttgaagggtgtg

SEQ ID NO: 228982 - DNA, 35 bp, Artificial Sequence
  Description of Artificial Sequence: Synthetic oligonucleotide
tgctttctgaaagcagctcctttttgaagggtgtg

SEQ ID NO: 228983 - DNA, 34 bp, Artificial Sequence
  Description of Artificial Sequence: Synthetic oligonucleotide
gctttctgaaagcagctcctttttgaagggtgtg

SEQ ID NO: 228984 - DNA, 36 bp, Artificial Sequence
  Description of Artificial Sequence: Synthetic oligonucleotide
ctttctgaaagcagctcctttttgaagggtgtgatg

SEQ ID NO: 228985 - DNA, 36 bp, Artificial Sequence
  Description of Artificial Sequence: Synthetic oligonucleotide
tttctgaaagcagctcctttttgaagggtgtgatgc

SEQ ID NO: 228986 - DNA, 35 bp, Artificial Sequence
  Description of Artificial Sequence: Synthetic oligonucleotide
ttctgaaagcagctcctttttgaagggtgtgatgc

SEQ ID NO: 228987 - DNA, 34 bp, Artificial Sequence
  Description of Artificial Sequence: Synthetic oligonucleotide
tctgaaagcagctcctttttgaagggtgtgatgc

SEQ ID NO: 228988 - DNA, 33 bp, Artificial Sequence
  Description of Artificial Sequence: Synthetic oligonucleotide
ctgaaagcagctcctttttgaagggtgtgatgc

SEQ ID NO: 228989 - DNA, 35 bp, Artificial Sequence
  Description of Artificial Sequence: Synthetic oligonucleotide
tgaaagcagctcctttttgaagggtgtgatgcttg

SEQ ID NO: 228990 - DNA, 34 bp, Artificial Sequence
  Description of Artificial Sequence: Synthetic oligonucleotide
gaaagcagctcctttttgaagggtgtgatgcttg

SEQ ID NO: 228991 - DNA, 34 bp, Artificial Sequence
  Description of Artificial Sequence: Synthetic oligonucleotide
aaagcagctcctttttgaagggtgtgatgcttgg

SEQ ID NO: 228992 - DNA, 33 bp, Artificial Sequence
  Description of Artificial Sequence: Synthetic oligonucleotide
aagcagctcctttttgaagggtgtgatgcttgg

SEQ ID NO: 228993 - DNA, 32 bp, Artificial Sequence
  Description of Artificial Sequence: Synthetic oligonucleotide
agcagctcctttttgaagggtgtgatgcttgg

SEQ ID NO: 228994 - DNA, 31 bp, Artificial Sequence
  Description of Artificial Sequence: Synthetic oligonucleotide
gcagctcctttttgaagggtgtgatgcttgg

SEQ ID NO: 228995 - DNA, 33 bp, Artificial Sequence
  Description of Artificial Sequence: Synthetic oligonucleotide
cagctcctttttgaagggtgtgatgcttggaag

SEQ ID NO: 228996 - DNA, 33 bp, Artificial Sequence
  Description of Artificial Sequence: Synthetic oligonucleotide
agctcctttttgaagggtgtgatgcttggaagc

SEQ ID NO: 228997 - DNA, 32 bp, Artificial Sequence
  Description of Artificial Sequence: Synthetic oligonucleotide
gctcctttttgaagggtgtgatgcttggaagc

SEQ ID NO: 228998 - DNA, 37 bp, Artificial Sequence
  Description of Artificial Sequence: Synthetic oligonucleotide
ctcctttttgaagggtgtgatgcttggaagcattttc

SEQ ID NO: 228999 - DNA, 38 bp, Artificial Sequence
  Description of Artificial Sequence: Synthetic oligonucleotide
tcctttttgaagggtgtgatgcttggaagcattttctg

SEQ ID NO: 229000 - DNA, 37 bp, Artificial Sequence
  Description of Artificial Sequence: Synthetic oligonucleotide
cctttttgaagggtgtgatgcttggaagcattttctg

SEQ ID NO: 229001 - DNA, 38 bp, Artificial Sequence
  Description of Artificial Sequence: Synthetic oligonucleotide
ctttttgaagggtgtgatgcttggaagcattttctgtg

SEQ ID NO: 229002 - DNA, 38 bp, Artificial Sequence
  Description of Artificial Sequence: Synthetic oligonucleotide
tttttgaagggtgtgatgcttggaagcattttctgtgc

SEQ ID NO: 229003 - DNA, 37 bp, Artificial Sequence
  Description of Artificial Sequence: Synthetic oligonucleotide
ttttgaagggtgtgatgcttggaagcattttctgtgc

SEQ ID NO: 229004 - DNA, 36 bp, Artificial Sequence
  Description of Artificial Sequence: Synthetic oligonucleotide
tttgaagggtgtgatgcttggaagcattttctgtgc

SEQ ID NO: 229005 - DNA, 35 bp, Artificial Sequence
  Description of Artificial Sequence: Synthetic oligonucleotide
ttgaagggtgtgatgcttggaagcattttctgtgc

SEQ ID NO: 229006 - DNA, 34 bp, Artificial Sequence
  Description of Artificial Sequence: Synthetic oligonucleotide
tgaagggtgtgatgcttggaagcattttctgtgc

SEQ ID NO: 229007 - DNA, 33 bp, Artificial Sequence
  Description of Artificial Sequence: Synthetic oligonucleotide
gaagggtgtgatgcttggaagcattttctgtgc

SEQ ID NO: 229008 - DNA, 36 bp, Artificial Sequence
  Description of Artificial Sequence: Synthetic oligonucleotide
aagggtgtgatgcttggaagcattttctgtgctttg

SEQ ID NO: 229009 - DNA, 35 bp, Artificial Sequence
  Description of Artificial Sequence: Synthetic oligonucleotide
agggtgtgatgcttggaagcattttctgtgctttg

SEQ ID NO: 229010 - DNA, 34 bp, Artificial Sequence
  Description of Artificial Sequence: Synthetic oligonucleotide
gggtgtgatgcttggaagcattttctgtgctttg

SEQ ID NO: 229011 - DNA, 36 bp, Artificial Sequence
  Description of Artificial Sequence: Synthetic oligonucleotide
ggtgtgatgcttggaagcattttctgtgctttgatc

SEQ ID NO: 229012 - DNA, 37 bp, Artificial Sequence
  Description of Artificial Sequence: Synthetic oligonucleotide
gtgtgatgcttggaagcattttctgtgctttgatcac

SEQ ID NO: 229013 - DNA, 40 bp, Artificial Sequence
  Description of Artificial Sequence: Synthetic oligonucleotide
tgtgatgcttggaagcattttctgtgctttgatcactatg

SEQ ID NO: 229014 - DNA, 39 bp, Artificial Sequence
  Description of Artificial Sequence: Synthetic oligonucleotide
gtgatgcttggaagcattttctgtgctttgatcactatg

SEQ ID NO: 229015 - DNA, 39 bp, Artificial Sequence
  Description of Artificial Sequence: Synthetic oligonucleotide
tgatgcttggaagcattttctgtgctttgatcactatgc

SEQ ID NO: 229016 - DNA, 38 bp, Artificial Sequence
  Description of Artificial Sequence: Synthetic oligonucleotide
gatgcttggaagcattttctgtgctttgatcactatgc

SEQ ID NO: 229017 - DNA, 40 bp, Artificial Sequence
  Description of Artificial Sequence: Synthetic oligonucleotide
atgcttggaagcattttctgtgctttgatcactatgctag

SEQ ID NO: 229018 - DNA, 39 bp, Artificial Sequence
  Description of Artificial Sequence: Synthetic oligonucleotide
tgcttggaagcattttctgtgctttgatcactatgctag

SEQ ID NO: 229019 - DNA, 38 bp, Artificial Sequence
  Description of Artificial Sequence: Synthetic oligonucleotide
gcttggaagcattttctgtgctttgatcactatgctag

SEQ ID NO: 229020 - DNA, 38 bp, Artificial Sequence
  Description of Artificial Sequence: Synthetic oligonucleotide
cttggaagcattttctgtgctttgatcactatgctagg

SEQ ID NO: 229021 - DNA, 39 bp, Artificial Sequence
  Description of Artificial Sequence: Synthetic oligonucleotide
ttggaagcattttctgtgctttgatcactatgctaggac

SEQ ID NO: 229022 - DNA, 38 bp, Artificial Sequence
  Description of Artificial Sequence: Synthetic oligonucleotide
tggaagcattttctgtgctttgatcactatgctaggac

SEQ ID NO: 229023 - DNA, 37 bp, Artificial Sequence
  Description of Artificial Sequence: Synthetic oligonucleotide
ggaagcattttctgtgctttgatcactatgctaggac

SEQ ID NO: 229024 - DNA, 38 bp, Artificial Sequence
  Description of Artificial Sequence: Synthetic oligonucleotide
gaagcattttctgtgctttgatcactatgctaggacac

SEQ ID NO: 229025 - DNA, 42 bp, Artificial Sequence
  Description of Artificial Sequence: Synthetic oligonucleotide
aagcattttctgtgctttgatcactatgctaggacacattag

SEQ ID NO: 229026 - DNA, 41 bp, Artificial Sequence
  Description of Artificial Sequence: Synthetic oligonucleotide
agcattttctgtgctttgatcactatgctaggacacattag

SEQ ID NO: 229027 - DNA, 40 bp, Artificial Sequence
  Description of Artificial Sequence: Synthetic oligonucleotide
gcattttctgtgctttgatcactatgctaggacacattag

SEQ ID NO: 229028 - DNA, 40 bp, Artificial Sequence
  Description of Artificial Sequence: Synthetic oligonucleotide
cattttctgtgctttgatcactatgctaggacacattagg

SEQ ID NO: 229029 - DNA, 43 bp, Artificial Sequence
  Description of Artificial Sequence: Synthetic oligonucleotide
attttctgtgctttgatcactatgctaggacacattaggattg

SEQ ID NO: 229030 - DNA, 42 bp, Artificial Sequence
  Description of Artificial Sequence: Synthetic oligonucleotide
ttttctgtgctttgatcactatgctaggacacattaggattg

SEQ ID NO: 229031 - DNA, 41 bp, Artificial Sequence
  Description of Artificial Sequence: Synthetic oligonucleotide
tttctgtgctttgatcactatgctaggacacattaggattg

SEQ ID NO: 229032 - DNA, 40 bp, Artificial Sequence
  Description of Artificial Sequence: Synthetic oligonucleotide
ttctgtgctttgatcactatgctaggacacattaggattg

SEQ ID NO: 229033 - DNA, 39 bp, Artificial Sequence
  Description of Artificial Sequence: Synthetic oligonucleotide
tctgtgctttgatcactatgctaggacacattaggattg

SEQ ID NO: 229034 - DNA, 38 bp, Artificial Sequence
  Description of Artificial Sequence: Synthetic oligonucleotide
ctgtgctttgatcactatgctaggacacattaggattg

SEQ ID NO: 229035 - DNA, 38 bp, Artificial Sequence
  Description of Artificial Sequence: Synthetic oligonucleotide
tgtgctttgatcactatgctaggacacattaggattgg

SEQ ID NO: 229036 - DNA, 37 bp, Artificial Sequence
  Description of Artificial Sequence: Synthetic oligonucleotide
gtgctttgatcactatgctaggacacattaggattgg

SEQ ID NO: 229037 - DNA, 38 bp, Artificial Sequence
  Description of Artificial Sequence: Synthetic oligonucleotide
tgctttgatcactatgctaggacacattaggattggtc

SEQ ID NO: 229038 - DNA, 37 bp, Artificial Sequence
  Description of Artificial Sequence: Synthetic oligonucleotide
gctttgatcactatgctaggacacattaggattggtc

SEQ ID NO: 229039 - DNA, 39 bp, Artificial Sequence
  Description of Artificial Sequence: Synthetic oligonucleotide
ctttgatcactatgctaggacacattaggattggtcatg

SEQ ID NO: 229040 - DNA, 39 bp, Artificial Sequence
  Description of Artificial Sequence: Synthetic oligonucleotide
tttgatcactatgctaggacacattaggattggtcatgg

SEQ ID NO: 229041 - DNA, 38 bp, Artificial Sequence
  Description of Artificial Sequence: Synthetic oligonucleotide
ttgatcactatgctaggacacattaggattggtcatgg

SEQ ID NO: 229042 - DNA, 37 bp, Artificial Sequence
  Description of Artificial Sequence: Synthetic oligonucleotide
tgatcactatgctaggacacattaggattggtcatgg

SEQ ID NO: 229043 - DNA, 36 bp, Artificial Sequence
  Description of Artificial Sequence: Synthetic oligonucleotide
gatcactatgctaggacacattaggattggtcatgg

SEQ ID NO: 229044 - DNA, 41 bp, Artificial Sequence
  Description of Artificial Sequence: Synthetic oligonucleotide
atcactatgctaggacacattaggattggtcatggaaatag

SEQ ID NO: 229045 - DNA, 40 bp, Artificial Sequence
  Description of Artificial Sequence: Synthetic oligonucleotide
tcactatgctaggacacattaggattggtcatggaaatag

SEQ ID NO: 229046 - DNA, 39 bp, Artificial Sequence
  Description of Artificial Sequence: Synthetic oligonucleotide
cactatgctaggacacattaggattggtcatggaaatag

SEQ ID NO: 229047 - DNA, 42 bp, Artificial Sequence
  Description of Artificial Sequence: Synthetic oligonucleotide
actatgctaggacacattaggattggtcatggaaatagaatg

SEQ ID NO: 229048 - DNA, 41 bp, Artificial Sequence
  Description of Artificial Sequence: Synthetic oligonucleotide
ctatgctaggacacattaggattggtcatggaaatagaatg

SEQ ID NO: 229049 - DNA, 41 bp, Artificial Sequence
  Description of Artificial Sequence: Synthetic oligonucleotide
tatgctaggacacattaggattggtcatggaaatagaatgc

SEQ ID NO: 229050 - DNA, 40 bp, Artificial Sequence
  Description of Artificial Sequence: Synthetic oligonucleotide
atgctaggacacattaggattggtcatggaaatagaatgc

SEQ ID NO: 229051 - DNA, 39 bp, Artificial Sequence
  Description of Artificial Sequence: Synthetic oligonucleotide
tgctaggacacattaggattggtcatggaaatagaatgc

SEQ ID NO: 229052 - DNA, 38 bp, Artificial Sequence
  Description of Artificial Sequence: Synthetic oligonucleotide
gctaggacacattaggattggtcatggaaatagaatgc

SEQ ID NO: 229053 - DNA, 39 bp, Artificial Sequence
  Description of Artificial Sequence: Synthetic oligonucleotide
ctaggacacattaggattggtcatggaaatagaatgcac

SEQ ID NO: 229054 - DNA, 39 bp, Artificial Sequence
  Description of Artificial Sequence: Synthetic oligonucleotide
taggacacattaggattggtcatggaaatagaatgcacc

SEQ ID NO: 229055 - DNA, 38 bp, Artificial Sequence
  Description of Artificial Sequence: Synthetic oligonucleotide
aggacacattaggattggtcatggaaatagaatgcacc

SEQ ID NO: 229056 - DNA, 37 bp, Artificial Sequence
  Description of Artificial Sequence: Synthetic oligonucleotide
ggacacattaggattggtcatggaaatagaatgcacc

SEQ ID NO: 229057 - DNA, 38 bp, Artificial Sequence
  Description of Artificial Sequence: Synthetic oligonucleotide
gacacattaggattggtcatggaaatagaatgcaccac

SEQ ID NO: 229058 - DNA, 38 bp, Artificial Sequence
  Description of Artificial Sequence: Synthetic oligonucleotide
acacattaggattggtcatggaaatagaatgcaccacc

SEQ ID NO: 229059 - DNA, 37 bp, Artificial Sequence
  Description of Artificial Sequence: Synthetic oligonucleotide
cacattaggattggtcatggaaatagaatgcaccacc

SEQ ID NO: 229060 - DNA, 39 bp, Artificial Sequence
  Description of Artificial Sequence: Synthetic oligonucleotide
acattaggattggtcatggaaatagaatgcaccaccatg

SEQ ID NO: 229061 - DNA, 38 bp, Artificial Sequence
  Description of Artificial Sequence: Synthetic oligonucleotide
cattaggattggtcatggaaatagaatgcaccaccatg

SEQ ID NO: 229062 - DNA, 39 bp, Artificial Sequence
  Description of Artificial Sequence: Synthetic oligonucleotide
attaggattggtcatggaaatagaatgcaccaccatgag

SEQ ID NO: 229063 - DNA, 38 bp, Artificial Sequence
  Description of Artificial Sequence: Synthetic oligonucleotide
ttaggattggtcatggaaatagaatgcaccaccatgag

SEQ ID NO: 229064 - DNA, 37 bp, Artificial Sequence
  Description of Artificial Sequence: Synthetic oligonucleotide
taggattggtcatggaaatagaatgcaccaccatgag

SEQ ID NO: 229065 - DNA, 36 bp, Artificial Sequence
  Description of Artificial Sequence: Synthetic oligonucleotide
aggattggtcatggaaatagaatgcaccaccatgag

SEQ ID NO: 229066 - DNA, 35 bp, Artificial Sequence
  Description of Artificial Sequence: Synthetic oligonucleotide
ggattggtcatggaaatagaatgcaccaccatgag

SEQ ID NO: 229067 - DNA, 35 bp, Artificial Sequence
  Description of Artificial Sequence: Synthetic oligonucleotide
gattggtcatggaaatagaatgcaccaccatgagc

SEQ ID NO: 229068 - DNA, 37 bp, Artificial Sequence
  Description of Artificial Sequence: Synthetic oligonucleotide
attggtcatggaaatagaatgcaccaccatgagcatc

SEQ ID NO: 229069 - DNA, 36 bp, Artificial Sequence
  Description of Artificial Sequence: Synthetic oligonucleotide
ttggtcatggaaatagaatgcaccaccatgagcatc

SEQ ID NO: 229070 - DNA, 35 bp, Artificial Sequence
  Description of Artificial Sequence: Synthetic oligonucleotide
tggtcatggaaatagaatgcaccaccatgagcatc

SEQ ID NO: 229071 - DNA, 34 bp, Artificial Sequence
  Description of Artificial Sequence: Synthetic oligonucleotide
ggtcatggaaatagaatgcaccaccatgagcatc

SEQ ID NO: 229072 - DNA, 36 bp, Artificial Sequence
  Description of Artificial Sequence: Synthetic oligonucleotide
gtcatggaaatagaatgcaccaccatgagcatcatc

SEQ ID NO: 229073 - DNA, 37 bp, Artificial Sequence
  Description of Artificial Sequence: Synthetic oligonucleotide
tcatggaaatagaatgcaccaccatgagcatcatcac

SEQ ID NO: 229074 - DNA, 36 bp, Artificial Sequence
  Description of Artificial Sequence: Synthetic oligonucleotide
catggaaatagaatgcaccaccatgagcatcatcac

SEQ ID NO: 229075 - DNA, 36 bp, Artificial Sequence
  Description of Artificial Sequence: Synthetic oligonucleotide
atggaaatagaatgcaccaccatgagcatcatcacc

SEQ ID NO: 229076 - DNA, 35 bp, Artificial Sequence
  Description of Artificial Sequence: Synthetic oligonucleotide
tggaaatagaatgcaccaccatgagcatcatcacc

SEQ ID NO: 229077 - DNA, 34 bp, Artificial Sequence
  Description of Artificial Sequence: Synthetic oligonucleotide
ggaaatagaatgcaccaccatgagcatcatcacc

SEQ ID NO: 229078 - DNA, 36 bp, Artificial Sequence
  Description of Artificial Sequence: Synthetic oligonucleotide
gaaatagaatgcaccaccatgagcatcatcacctac

SEQ ID NO: 229079 - DNA, 38 bp, Artificial Sequence
  Description of Artificial Sequence: Synthetic oligonucleotide
aaatagaatgcaccaccatgagcatcatcacctacaag

SEQ ID NO: 229080 - DNA, 37 bp, Artificial Sequence
  Description of Artificial Sequence: Synthetic oligonucleotide
aatagaatgcaccaccatgagcatcatcacctacaag

SEQ ID NO: 229081 - DNA, 36 bp, Artificial Sequence
  Description of Artificial Sequence: Synthetic oligonucleotide
atagaatgcaccaccatgagcatcatcacctacaag

SEQ ID NO: 229082 - DNA, 35 bp, Artificial Sequence
  Description of Artificial Sequence: Synthetic oligonucleotide
tagaatgcaccaccatgagcatcatcacctacaag

SEQ ID NO: 229083 - DNA, 34 bp, Artificial Sequence
  Description of Artificial Sequence: Synthetic oligonucleotide
agaatgcaccaccatgagcatcatcacctacaag

SEQ ID NO: 229084 - DNA, 33 bp, Artificial Sequence
  Description of Artificial Sequence: Synthetic oligonucleotide
gaatgcaccaccatgagcatcatcacctacaag

SEQ ID NO: 229085 - DNA, 33 bp, Artificial Sequence
  Description of Artificial Sequence: Synthetic oligonucleotide
aatgcaccaccatgagcatcatcacctacaagc

SEQ ID NO: 229086 - DNA, 32 bp, Artificial Sequence
  Description of Artificial Sequence: Synthetic oligonucleotide
atgcaccaccatgagcatcatcacctacaagc

SEQ ID NO: 229087 - DNA, 31 bp, Artificial Sequence
  Description of Artificial Sequence: Synthetic oligonucleotide
tgcaccaccatgagcatcatcacctacaagc

SEQ ID NO: 229088 - DNA, 30 bp, Artificial Sequence
  Description of Artificial Sequence: Synthetic oligonucleotide
gcaccaccatgagcatcatcacctacaagc

SEQ ID NO: 229089 - DNA, 31 bp, Artificial Sequence
  Description of Artificial Sequence: Synthetic oligonucleotide
caccaccatgagcatcatcacctacaagctc

SEQ ID NO: 229090 - DNA, 31 bp, Artificial Sequence
  Description of Artificial Sequence: Synthetic oligonucleotide
accaccatgagcatcatcacctacaagctcc

SEQ ID NO: 229091 - DNA, 30 bp, Artificial Sequence
  Description of Artificial Sequence: Synthetic oligonucleotide
ccaccatgagcatcatcacctacaagctcc

SEQ ID NO: 229092 - DNA, 33 bp, Artificial Sequence
  Description of Artificial Sequence: Synthetic oligonucleotide
caccatgagcatcatcacctacaagctcctaac

SEQ ID NO: 229093 - DNA, 36 bp, Artificial Sequence
  Description of Artificial Sequence: Synthetic oligonucleotide
accatgagcatcatcacctacaagctcctaacaaag

SEQ ID NO: 229094 - DNA, 35 bp, Artificial Sequence
  Description of Artificial Sequence: Synthetic oligonucleotide
ccatgagcatcatcacctacaagctcctaacaaag

SEQ ID NO: 229095 - DNA, 37 bp, Artificial Sequence
  Description of Artificial Sequence: Synthetic oligonucleotide
catgagcatcatcacctacaagctcctaacaaagaag

SEQ ID NO: 229096 - DNA, 41 bp, Artificial Sequence
  Description of Artificial Sequence: Synthetic oligonucleotide
atgagcatcatcacctacaagctcctaacaaagaagatatc

SEQ ID NO: 229097 - DNA, 40 bp, Artificial Sequence
  Description of Artificial Sequence: Synthetic oligonucleotide
tgagcatcatcacctacaagctcctaacaaagaagatatc

SEQ ID NO: 229098 - DNA, 39 bp, Artificial Sequence
  Description of Artificial Sequence: Synthetic oligonucleotide
gagcatcatcacctacaagctcctaacaaagaagatatc

SEQ ID NO: 229099 - DNA, 41 bp, Artificial Sequence
  Description of Artificial Sequence: Synthetic oligonucleotide
agcatcatcacctacaagctcctaacaaagaagatatcttg

SEQ ID NO: 229100 - DNA, 40 bp, Artificial Sequence
  Description of Artificial Sequence: Synthetic oligonucleotide
gcatcatcacctacaagctcctaacaaagaagatatcttg

SEQ ID NO: 229101 - DNA, 47 bp, Artificial Sequence
  Description of Artificial Sequence: Synthetic oligonucleotide
catcatcacctacaagctcctaacaaagaagatatcttgaaaatttc

SEQ ID NO: 229102 - DNA, 48 bp, Artificial Sequence
  Description of Artificial Sequence: Synthetic oligonucleotide
atcatcacctacaagctcctaacaaagaagatatcttgaaaatttcag

SEQ ID NO: 229103 - DNA, 47 bp, Artificial Sequence
  Description of Artificial Sequence: Synthetic oligonucleotide
tcatcacctacaagctcctaacaaagaagatatcttgaaaatttcag

SEQ ID NO: 229104 - DNA, 46 bp, Artificial Sequence
  Description of Artificial Sequence: Synthetic oligonucleotide
catcacctacaagctcctaacaaagaagatatcttgaaaatttcag

SEQ ID NO: 229105 - DNA, 47 bp, Artificial Sequence
  Description of Artificial Sequence: Synthetic oligonucleotide
atcacctacaagctcctaacaaagaagatatcttgaaaatttcagag

SEQ ID NO: 229106 - DNA, 46 bp, Artificial Sequence
  Description of Artificial Sequence: Synthetic oligonucleotide
tcacctacaagctcctaacaaagaagatatcttgaaaatttcagag

SEQ ID NO: 229107 - DNA, 45 bp, Artificial Sequence
  Description of Artificial Sequence: Synthetic oligonucleotide
cacctacaagctcctaacaaagaagatatcttgaaaatttcagag

SEQ ID NO: 229108 - DNA, 45 bp, Artificial Sequence
  Description of Artificial Sequence: Synthetic oligonucleotide
acctacaagctcctaacaaagaagatatcttgaaaatttcagagg

SEQ ID NO: 229109 - DNA, 44 bp, Artificial Sequence
  Description of Artificial Sequence: Synthetic oligonucleotide
cctacaagctcctaacaaagaagatatcttgaaaatttcagagg

SEQ ID NO: 229110 - DNA, 46 bp, Artificial Sequence
  Description of Artificial Sequence: Synthetic oligonucleotide
ctacaagctcctaacaaagaagatatcttgaaaatttcagaggatg

SEQ ID NO: 229111 - DNA, 47 bp, Artificial Sequence
  Description of Artificial Sequence: Synthetic oligonucleotide
tacaagctcctaacaaagaagatatcttgaaaatttcagaggatgag

SEQ ID NO: 229112 - DNA, 46 bp, Artificial Sequence
  Description of Artificial Sequence: Synthetic oligonucleotide
acaagctcctaacaaagaagatatcttgaaaatttcagaggatgag

SEQ ID NO: 229113 - DNA, 45 bp, Artificial Sequence
  Description of Artificial Sequence: Synthetic oligonucleotide
caagctcctaacaaagaagatatcttgaaaatttcagaggatgag

SEQ ID NO: 229114 - DNA, 45 bp, Artificial Sequence
  Description of Artificial Sequence: Synthetic oligonucleotide
aagctcctaacaaagaagatatcttgaaaatttcagaggatgagc

SEQ ID NO: 229115 - DNA, 44 bp, Artificial Sequence
  Description of Artificial Sequence: Synthetic oligonucleotide
agctcctaacaaagaagatatcttgaaaatttcagaggatgagc

SEQ ID NO: 229116 - DNA, 43 bp, Artificial Sequence
  Description of Artificial Sequence: Synthetic oligonucleotide
gctcctaacaaagaagatatcttgaaaatttcagaggatgagc

SEQ ID NO: 229117 - DNA, 43 bp, Artificial Sequence
  Description of Artificial Sequence: Synthetic oligonucleotide
ctcctaacaaagaagatatcttgaaaatttcagaggatgagcg

SEQ ID NO: 229118 - DNA, 43 bp, Artificial Sequence
  Description of Artificial Sequence: Synthetic oligonucleotide
tcctaacaaagaagatatcttgaaaatttcagaggatgagcgc

SEQ ID NO: 229119 - DNA, 42 bp, Artificial Sequence
  Description of Artificial Sequence: Synthetic oligonucleotide
cctaacaaagaagatatcttgaaaatttcagaggatgagcgc

SEQ ID NO: 229120 - DNA, 44 bp, Artificial Sequence
  Description of Artificial Sequence: Synthetic oligonucleotide
ctaacaaagaagatatcttgaaaatttcagaggatgagcgcatg

SEQ ID NO: 229121 - DNA, 44 bp, Artificial Sequence
  Description of Artificial Sequence: Synthetic oligonucleotide
taacaaagaagatatcttgaaaatttcagaggatgagcgcatgg

SEQ ID NO: 229122 - DNA, 43 bp, Artificial Sequence
  Description of Artificial Sequence: Synthetic oligonucleotide
aacaaagaagatatcttgaaaatttcagaggatgagcgcatgg

SEQ ID NO: 229123 - DNA, 42 bp, Artificial Sequence
  Description of Artificial Sequence: Synthetic oligonucleotide
acaaagaagatatcttgaaaatttcagaggatgagcgcatgg

SEQ ID NO: 229124 - DNA, 41 bp, Artificial Sequence
  Description of Artificial Sequence: Synthetic oligonucleotide
caaagaagatatcttgaaaatttcagaggatgagcgcatgg

SEQ ID NO: 229125 - DNA, 42 bp, Artificial Sequence
  Description of Artificial Sequence: Synthetic oligonucleotide
aaagaagatatcttgaaaatttcagaggatgagcgcatggag

SEQ ID NO: 229126 - DNA, 41 bp, Artificial Sequence
  Description of Artificial Sequence: Synthetic oligonucleotide
aagaagatatcttgaaaatttcagaggatgagcgcatggag

SEQ ID NO: 229127 - DNA, 40 bp, Artificial Sequence
  Description of Artificial Sequence: Synthetic oligonucleotide
agaagatatcttgaaaatttcagaggatgagcgcatggag

SEQ ID NO: 229128 - DNA, 39 bp, Artificial Sequence
  Description of Artificial Sequence: Synthetic oligonucleotide
gaagatatcttgaaaatttcagaggatgagcgcatggag

SEQ ID NO: 229129 - DNA, 39 bp, Artificial Sequence
  Description of Artificial Sequence: Synthetic oligonucleotide
aagatatcttgaaaatttcagaggatgagcgcatggagc

SEQ ID NO: 229130 - DNA, 38 bp, Artificial Sequence
  Description of Artificial Sequence: Synthetic oligonucleotide
agatatcttgaaaatttcagaggatgagcgcatggagc

SEQ ID NO: 229131 - DNA, 37 bp, Artificial Sequence
  Description of Artificial Sequence: Synthetic oligonucleotide
gatatcttgaaaatttcagaggatgagcgcatggagc

SEQ ID NO: 229132 - DNA, 38 bp, Artificial Sequence
  Description of Artificial Sequence: Synthetic oligonucleotide
atatcttgaaaatttcagaggatgagcgcatggagctc

SEQ ID NO: 229133 - DNA, 37 bp, Artificial Sequence
  Description of Artificial Sequence: Synthetic oligonucleotide
tatcttgaaaatttcagaggatgagcgcatggagctc

SEQ ID NO: 229134 - DNA, 36 bp, Artificial Sequence
  Description of Artificial Sequence: Synthetic oligonucleotide
atcttgaaaatttcagaggatgagcgcatggagctc

SEQ ID NO: 229135 - DNA, 35 bp, Artificial Sequence
  Description of Artificial Sequence: Synthetic oligonucleotide
tcttgaaaatttcagaggatgagcgcatggagctc

SEQ ID NO: 229136 - DNA, 34 bp, Artificial Sequence
  Description of Artificial Sequence: Synthetic oligonucleotide
cttgaaaatttcagaggatgagcgcatggagctc

SEQ ID NO: 229137 - DNA, 35 bp, Artificial Sequence
  Description of Artificial Sequence: Synthetic oligonucleotide
ttgaaaatttcagaggatgagcgcatggagctcag

SEQ ID NO: 229138 - DNA, 34 bp, Artificial Sequence
  Description of Artificial Sequence: Synthetic oligonucleotide
tgaaaatttcagaggatgagcgcatggagctcag

SEQ ID NO: 229139 - DNA, 33 bp, Artificial Sequence
  Description of Artificial Sequence: Synthetic oligonucleotide
gaaaatttcagaggatgagcgcatggagctcag

SEQ ID NO: 229140 - DNA, 36 bp, Artificial Sequence
  Description of Artificial Sequence: Synthetic oligonucleotide
aaaatttcagaggatgagcgcatggagctcagtaag

SEQ ID NO: 229141 - DNA, 35 bp, Artificial Sequence
  Description of Artificial Sequence: Synthetic oligonucleotide
aaatttcagaggatgagcgcatggagctcagtaag

SEQ ID NO: 229142 - DNA, 34 bp, Artificial Sequence
  Description of Artificial Sequence: Synthetic oligonucleotide
aatttcagaggatgagcgcatggagctcagtaag

SEQ ID NO: 229143 - DNA, 33 bp, Artificial Sequence
  Description of Artificial Sequence: Synthetic oligonucleotide
atttcagaggatgagcgcatggagctcagtaag

SEQ ID NO: 229144 - DNA, 32 bp, Artificial Sequence
  Description of Artificial Sequence: Synthetic oligonucleotide
tttcagaggatgagcgcatggagctcagtaag

SEQ ID NO: 229145 - DNA, 31 bp, Artificial Sequence
  Description of Artificial Sequence: Synthetic oligonucleotide
ttcagaggatgagcgcatggagctcagtaag

SEQ ID NO: 229146 - DNA, 30 bp, Artificial Sequence
  Description of Artificial Sequence: Synthetic oligonucleotide
tcagaggatgagcgcatggagctcagtaag

SEQ ID NO: 229147 - DNA, 29 bp, Artificial Sequence
  Description of Artificial Sequence: Synthetic oligonucleotide
cagaggatgagcgcatggagctcagtaag

SEQ ID NO: 229148 - DNA, 30 bp, Artificial Sequence
  Description of Artificial Sequence: Synthetic oligonucleotide
agaggatgagcgcatggagctcagtaagag

SEQ ID NO: 229149 - DNA, 29 bp, Artificial Sequence
  Description of Artificial Sequence: Synthetic oligonucleotide
gaggatgagcgcatggagctcagtaagag

SEQ ID NO: 229150 - DNA, 29 bp, Artificial Sequence
  Description of Artificial Sequence: Synthetic oligonucleotide
aggatgagcgcatggagctcagtaagagc

SEQ ID NO: 229151 - DNA, 28 bp, Artificial Sequence
  Description of Artificial Sequence: Synthetic oligonucleotide
ggatgagcgcatggagctcagtaagagc

SEQ ID NO: 229152 - DNA, 31 bp, Artificial Sequence
  Description of Artificial Sequence: Synthetic oligonucleotide
gatgagcgcatggagctcagtaagagctttc

SEQ ID NO: 229153 - DNA, 31 bp, Artificial Sequence
  Description of Artificial Sequence: Synthetic oligonucleotide
atgagcgcatggagctcagtaagagctttcg

SEQ ID NO: 229154 - DNA, 30 bp, Artificial Sequence
  Description of Artificial Sequence: Synthetic oligonucleotide
tgagcgcatggagctcagtaagagctttcg

SEQ ID NO: 229155 - DNA, 29 bp, Artificial Sequence
  Description of Artificial Sequence: Synthetic oligonucleotide
gagcgcatggagctcagtaagagctttcg

SEQ ID NO: 229156 - DNA, 30 bp, Artificial Sequence
  Description of Artificial Sequence: Synthetic oligonucleotide
agcgcatggagctcagtaagagctttcgag

SEQ ID NO: 229157 - DNA, 29 bp, Artificial Sequence
  Description of Artificial Sequence: Synthetic oligonucleotide
gcgcatggagctcagtaagagctttcgag

SEQ ID NO: 229158 - DNA, 33 bp, Artificial Sequence
  Description of Artificial Sequence: Synthetic oligonucleotide
cgcatggagctcagtaagagctttcgagtatac

SEQ ID NO: 229159 - DNA, 34 bp, Artificial Sequence
  Description of Artificial Sequence: Synthetic oligonucleotide
gcatggagctcagtaagagctttcgagtatactg

SEQ ID NO: 229160 - DNA, 40 bp, Artificial Sequence
  Description of Artificial Sequence: Synthetic oligonucleotide
catggagctcagtaagagctttcgagtatactgtattatc

SEQ ID NO: 229161 - DNA, 40 bp, Artificial Sequence
  Description of Artificial Sequence: Synthetic oligonucleotide
atggagctcagtaagagctttcgagtatactgtattatcc

SEQ ID NO: 229162 - DNA, 39 bp, Artificial Sequence
  Description of Artificial Sequence: Synthetic oligonucleotide
tggagctcagtaagagctttcgagtatactgtattatcc

SEQ ID NO: 229163 - DNA, 38 bp, Artificial Sequence
  Description of Artificial Sequence: Synthetic oligonucleotide
ggagctcagtaagagctttcgagtatactgtattatcc

SEQ ID NO: 229164 - DNA, 40 bp, Artificial Sequence
  Description of Artificial Sequence: Synthetic oligonucleotide
gagctcagtaagagctttcgagtatactgtattatccttg

SEQ ID NO: 229165 - DNA, 45 bp, Artificial Sequence
  Description of Artificial Sequence: Synthetic oligonucleotide
agctcagtaagagctttcgagtatactgtattatccttgtaaaac

SEQ ID NO: 229166 - DNA, 44 bp, Artificial Sequence
  Description of Artificial Sequence: Synthetic oligonucleotide
gctcagtaagagctttcgagtatactgtattatccttgtaaaac

SEQ ID NO: 229167 - DNA, 44 bp, Artificial Sequence
  Description of Artificial Sequence: Synthetic oligonucleotide
ctcagtaagagctttcgagtatactgtattatccttgtaaaacc

SEQ ID NO: 229168 - DNA, 44 bp, Artificial Sequence
  Description of Artificial Sequence: Synthetic oligonucleotide
tcagtaagagctttcgagtatactgtattatccttgtaaaaccc

SEQ ID NO: 229169 - DNA, 43 bp, Artificial Sequence
  Description of Artificial Sequence: Synthetic oligonucleotide
cagtaagagctttcgagtatactgtattatccttgtaaaaccc

SEQ ID NO: 229170 - DNA, 46 bp, Artificial Sequence
  Description of Artificial Sequence: Synthetic oligonucleotide
agtaagagctttcgagtatactgtattatccttgtaaaacccaaag

SEQ ID NO: 229171 - DNA, 45 bp, Artificial Sequence
  Description of Artificial Sequence: Synthetic oligonucleotide
gtaagagctttcgagtatactgtattatccttgtaaaacccaaag

SEQ ID NO: 229172 - DNA, 47 bp, Artificial Sequence
  Description of Artificial Sequence: Synthetic oligonucleotide
taagagctttcgagtatactgtattatccttgtaaaacccaaagatg

SEQ ID NO: 229173 - DNA, 46 bp, Artificial Sequence
  Description of Artificial Sequence: Synthetic oligonucleotide
aagagctttcgagtatactgtattatccttgtaaaacccaaagatg

SEQ ID NO: 229174 - DNA, 45 bp, Artificial Sequence
  Description of Artificial Sequence: Synthetic oligonucleotide
agagctttcgagtatactgtattatccttgtaaaacccaaagatg

SEQ ID NO: 229175 - DNA, 44 bp, Artificial Sequence
  Description of Artificial Sequence: Synthetic oligonucleotide
gagctttcgagtatactgtattatccttgtaaaacccaaagatg

SEQ ID NO: 229176 - DNA, 45 bp, Artificial Sequence
  Description of Artificial Sequence: Synthetic oligonucleotide
agctttcgagtatactgtattatccttgtaaaacccaaagatgtg

SEQ ID NO: 229177 - DNA, 44 bp, Artificial Sequence
  Description of Artificial Sequence: Synthetic oligonucleotide
gctttcgagtatactgtattatccttgtaaaacccaaagatgtg

SEQ ID NO: 229178 - DNA, 45 bp, Artificial Sequence
  Description of Artificial Sequence: Synthetic oligonucleotide
ctttcgagtatactgtattatccttgtaaaacccaaagatgtgag

SEQ ID NO: 229179 - DNA, 46 bp, Artificial Sequence
  Description of Artificial Sequence: Synthetic oligonucleotide
tttcgagtatactgtattatccttgtaaaacccaaagatgtgagtc

SEQ ID NO: 229180 - DNA, 45 bp, Artificial Sequence
  Description of Artificial Sequence: Synthetic oligonucleotide
ttcgagtatactgtattatccttgtaaaacccaaagatgtgagtc

SEQ ID NO: 229181 - DNA, 44 bp, Artificial Sequence
  Description of Artificial Sequence: Synthetic oligonucleotide
tcgagtatactgtattatccttgtaaaacccaaagatgtgagtc

SEQ ID NO: 229182 - DNA, 43 bp, Artificial Sequence
  Description of Artificial Sequence: Synthetic oligonucleotide
cgagtatactgtattatccttgtaaaacccaaagatgtgagtc

SEQ ID NO: 229183 - DNA, 46 bp, Artificial Sequence
  Description of Artificial Sequence: Synthetic oligonucleotide
gagtatactgtattatccttgtaaaacccaaagatgtgagtctttg

SEQ ID NO: 229184 - DNA, 46 bp, Artificial Sequence
  Description of Artificial Sequence: Synthetic oligonucleotide
agtatactgtattatccttgtaaaacccaaagatgtgagtctttgg

SEQ ID NO: 229185 - DNA, 45 bp, Artificial Sequence
  Description of Artificial Sequence: Synthetic oligonucleotide
gtatactgtattatccttgtaaaacccaaagatgtgagtctttgg

SEQ ID NO: 229186 - DNA, 45 bp, Artificial Sequence
  Description of Artificial Sequence: Synthetic oligonucleotide
tatactgtattatccttgtaaaacccaaagatgtgagtctttggg

SEQ ID NO: 229187 - DNA, 44 bp, Artificial Sequence
  Description of Artificial Sequence: Synthetic oligonucleotide
atactgtattatccttgtaaaacccaaagatgtgagtctttggg

SEQ ID NO: 229188 - DNA, 43 bp, Artificial Sequence
  Description of Artificial Sequence: Synthetic oligonucleotide
tactgtattatccttgtaaaacccaaagatgtgagtctttggg

SEQ ID NO: 229189 - DNA, 42 bp, Artificial Sequence
  Description of Artificial Sequence: Synthetic oligonucleotide
actgtattatccttgtaaaacccaaagatgtgagtctttggg

SEQ ID NO: 229190 - DNA, 41 bp, Artificial Sequence
  Description of Artificial Sequence: Synthetic oligonucleotide
ctgtattatccttgtaaaacccaaagatgtgagtctttggg

SEQ ID NO: 229191 - DNA, 41 bp, Artificial Sequence
  Description of Artificial Sequence: Synthetic oligonucleotide
tgtattatccttgtaaaacccaaagatgtgagtctttgggc

SEQ ID NO: 229192 - DNA, 40 bp, Artificial Sequence
  Description of Artificial Sequence: Synthetic oligonucleotide
gtattatccttgtaaaacccaaagatgtgagtctttgggc

SEQ ID NO: 229193 - DNA, 41 bp, Artificial Sequence
  Description of Artificial Sequence: Synthetic oligonucleotide
tattatccttgtaaaacccaaagatgtgagtctttgggctg

SEQ ID NO: 229194 - DNA, 40 bp, Artificial Sequence
  Description of Artificial Sequence: Synthetic oligonucleotide
attatccttgtaaaacccaaagatgtgagtctttgggctg

SEQ ID NO: 229195 - DNA, 39 bp, Artificial Sequence
  Description of Artificial Sequence: Synthetic oligonucleotide
ttatccttgtaaaacccaaagatgtgagtctttgggctg

SEQ ID NO: 229196 - DNA, 38 bp, Artificial Sequence
  Description of Artificial Sequence: Synthetic oligonucleotide
tatccttgtaaaacccaaagatgtgagtctttgggctg

SEQ ID NO: 229197 - DNA, 37 bp, Artificial Sequence
  Description of Artificial Sequence: Synthetic oligonucleotide
atccttgtaaaacccaaagatgtgagtctttgggctg

SEQ ID NO: 229198 - DNA, 36 bp, Artificial Sequence
  Description of Artificial Sequence: Synthetic oligonucleotide
tccttgtaaaacccaaagatgtgagtctttgggctg

SEQ ID NO: 229199 - DNA, 35 bp, Artificial Sequence
  Description of Artificial Sequence: Synthetic oligonucleotide
ccttgtaaaacccaaagatgtgagtctttgggctg

SEQ ID NO: 229200 - DNA, 35 bp, Artificial Sequence
  Description of Artificial Sequence: Synthetic oligonucleotide
cttgtaaaacccaaagatgtgagtctttgggctgc

SEQ ID NO: 229201 - DNA, 36 bp, Artificial Sequence
  Description of Artificial Sequence: Synthetic oligonucleotide
ttgtaaaacccaaagatgtgagtctttgggctgcag

SEQ ID NO: 229202 - DNA, 35 bp, Artificial Sequence
  Description of Artificial Sequence: Synthetic oligonucleotide
tgtaaaacccaaagatgtgagtctttgggctgcag

SEQ ID NO: 229203 - DNA, 34 bp, Artificial Sequence
  Description of Artificial Sequence: Synthetic oligonucleotide
gtaaaacccaaagatgtgagtctttgggctgcag

SEQ ID NO: 229204 - DNA, 38 bp, Artificial Sequence
  Description of Artificial Sequence: Synthetic oligonucleotide
taaaacccaaagatgtgagtctttgggctgcagtaaag

SEQ ID NO: 229205 - DNA, 37 bp, Artificial Sequence
  Description of Artificial Sequence: Synthetic oligonucleotide
aaaacccaaagatgtgagtctttgggctgcagtaaag

SEQ ID NO: 229206 - DNA, 36 bp, Artificial Sequence
  Description of Artificial Sequence: Synthetic oligonucleotide
aaacccaaagatgtgagtctttgggctgcagtaaag

SEQ ID NO: 229207 - DNA, 35 bp, Artificial Sequence
  Description of Artificial Sequence: Synthetic oligonucleotide
aacccaaagatgtgagtctttgggctgcagtaaag

SEQ ID NO: 229208 - DNA, 34 bp, Artificial Sequence
  Description of Artificial Sequence: Synthetic oligonucleotide
acccaaagatgtgagtctttgggctgcagtaaag

SEQ ID NO: 229209 - DNA, 33 bp, Artificial Sequence
  Description of Artificial Sequence: Synthetic oligonucleotide
cccaaagatgtgagtctttgggctgcagtaaag

SEQ ID NO: 229210 - DNA, 33 bp, Artificial Sequence
  Description of Artificial Sequence: Synthetic oligonucleotide
ccaaagatgtgagtctttgggctgcagtaaagg

SEQ ID NO: 229211 - DNA, 34 bp, Artificial Sequence
  Description of Artificial Sequence: Synthetic oligonucleotide
caaagatgtgagtctttgggctgcagtaaaggag

SEQ ID NO: 229212 - DNA, 35 bp, Artificial Sequence
  Description of Artificial Sequence: Synthetic oligonucleotide
aaagatgtgagtctttgggctgcagtaaaggagac

SEQ ID NO: 229213 - DNA, 34 bp, Artificial Sequence
  Description of Artificial Sequence: Synthetic oligonucleotide
aagatgtgagtctttgggctgcagtaaaggagac

SEQ ID NO: 229214 - DNA, 33 bp, Artificial Sequence
  Description of Artificial Sequence: Synthetic oligonucleotide
agatgtgagtctttgggctgcagtaaaggagac

SEQ ID NO: 229215 - DNA, 32 bp, Artificial Sequence
  Description of Artificial Sequence: Synthetic oligonucleotide
gatgtgagtctttgggctgcagtaaaggagac

SEQ ID NO: 229216 - DNA, 34 bp, Artificial Sequence
  Description of Artificial Sequence: Synthetic oligonucleotide
atgtgagtctttgggctgcagtaaaggagacttg

SEQ ID NO: 229217 - DNA, 33 bp, Artificial Sequence
  Description of Artificial Sequence: Synthetic oligonucleotide
tgtgagtctttgggctgcagtaaaggagacttg

SEQ ID NO: 229218 - DNA, 32 bp, Artificial Sequence
  Description of Artificial Sequence: Synthetic oligonucleotide
gtgagtctttgggctgcagtaaaggagacttg

SEQ ID NO: 229219 - DNA, 32 bp, Artificial Sequence
  Description of Artificial Sequence: Synthetic oligonucleotide
tgagtctttgggctgcagtaaaggagacttgg

SEQ ID NO: 229220 - DNA, 31 bp, Artificial Sequence
  Description of Artificial Sequence: Synthetic oligonucleotide
gagtctttgggctgcagtaaaggagacttgg

SEQ ID NO: 229221 - DNA, 32 bp, Artificial Sequence
  Description of Artificial Sequence: Synthetic oligonucleotide
agtctttgggctgcagtaaaggagacttggac

SEQ ID NO: 229222 - DNA, 31 bp, Artificial Sequence
  Description of Artificial Sequence: Synthetic oligonucleotide
gtctttgggctgcagtaaaggagacttggac

SEQ ID NO: 229223 - DNA, 31 bp, Artificial Sequence
  Description of Artificial Sequence: Synthetic oligonucleotide
tctttgggctgcagtaaaggagacttggacc

SEQ ID NO: 229224 - DNA, 30 bp, Artificial Sequence
  Description of Artificial Sequence: Synthetic oligonucleotide
ctttgggctgcagtaaaggagacttggacc

SEQ ID NO: 229225 - DNA, 33 bp, Artificial Sequence
  Description of Artificial Sequence: Synthetic oligonucleotide
tttgggctgcagtaaaggagacttggaccaaac

SEQ ID NO: 229226 - DNA, 32 bp, Artificial Sequence
  Description of Artificial Sequence: Synthetic oligonucleotide
ttgggctgcagtaaaggagacttggaccaaac

SEQ ID NO: 229227 - DNA, 31 bp, Artificial Sequence
  Description of Artificial Sequence: Synthetic oligonucleotide
tgggctgcagtaaaggagacttggaccaaac

SEQ ID NO: 229228 - DNA, 30 bp, Artificial Sequence
  Description of Artificial Sequence: Synthetic oligonucleotide
gggctgcagtaaaggagacttggaccaaac

SEQ ID NO: 229229 - DNA, 31 bp, Artificial Sequence
  Description of Artificial Sequence: Synthetic oligonucleotide
ggctgcagtaaaggagacttggaccaaacac

SEQ ID NO: 229230 - DNA, 32 bp, Artificial Sequence
  Description of Artificial Sequence: Synthetic oligonucleotide
gctgcagtaaaggagacttggaccaaacactg

SEQ ID NO: 229231 - DNA, 33 bp, Artificial Sequence
  Description of Artificial Sequence: Synthetic oligonucleotide
ctgcagtaaaggagacttggaccaaacactgtg

SEQ ID NO: 229232 - DNA, 34 bp, Artificial Sequence
  Description of Artificial Sequence: Synthetic oligonucleotide
tgcagtaaaggagacttggaccaaacactgtgac

SEQ ID NO: 229233 - DNA, 33 bp, Artificial Sequence
  Description of Artificial Sequence: Synthetic oligonucleotide
gcagtaaaggagacttggaccaaacactgtgac

SEQ ID NO: 229234 - DNA, 36 bp, Artificial Sequence
  Description of Artificial Sequence: Synthetic oligonucleotide
cagtaaaggagacttggaccaaacactgtgacaaag

SEQ ID NO: 229235 - DNA, 36 bp, Artificial Sequence
  Description of Artificial Sequence: Synthetic oligonucleotide
agtaaaggagacttggaccaaacactgtgacaaagc

SEQ ID NO: 229236 - DNA, 35 bp, Artificial Sequence
  Description of Artificial Sequence: Synthetic oligonucleotide
gtaaaggagacttggaccaaacactgtgacaaagc

SEQ ID NO: 229237 - DNA, 36 bp, Artificial Sequence
  Description of Artificial Sequence: Synthetic oligonucleotide
taaaggagacttggaccaaacactgtgacaaagcag

SEQ ID NO: 229238 - DNA, 35 bp, Artificial Sequence
  Description of Artificial Sequence: Synthetic oligonucleotide
aaaggagacttggaccaaacactgtgacaaagcag

SEQ ID NO: 229239 - DNA, 34 bp, Artificial Sequence
  Description of Artificial Sequence: Synthetic oligonucleotide
aaggagacttggaccaaacactgtgacaaagcag

SEQ ID NO: 229240 - DNA, 33 bp, Artificial Sequence
  Description of Artificial Sequence: Synthetic oligonucleotide
aggagacttggaccaaacactgtgacaaagcag

SEQ ID NO: 229241 - DNA, 32 bp, Artificial Sequence
  Description of Artificial Sequence: Synthetic oligonucleotide
ggagacttggaccaaacactgtgacaaagcag

SEQ ID NO: 229242 - DNA, 33 bp, Artificial Sequence
  Description of Artificial Sequence: Synthetic oligonucleotide
gagacttggaccaaacactgtgacaaagcagag

SEQ ID NO: 229243 - DNA, 35 bp, Artificial Sequence
  Description of Artificial Sequence: Synthetic oligonucleotide
agacttggaccaaacactgtgacaaagcagagttc

SEQ ID NO: 229244 - DNA, 34 bp, Artificial Sequence
  Description of Artificial Sequence: Synthetic oligonucleotide
gacttggaccaaacactgtgacaaagcagagttc

SEQ ID NO: 229245 - DNA, 36 bp, Artificial Sequence
  Description of Artificial Sequence: Synthetic oligonucleotide
acttggaccaaacactgtgacaaagcagagttcttc

SEQ ID NO: 229246 - DNA, 35 bp, Artificial Sequence
  Description of Artificial Sequence: Synthetic oligonucleotide
cttggaccaaacactgtgacaaagcagagttcttc

SEQ ID NO: 229247 - DNA, 36 bp, Artificial Sequence
  Description of Artificial Sequence: Synthetic oligonucleotide
ttggaccaaacactgtgacaaagcagagttcttcag

SEQ ID NO: 229248 - DNA, 35 bp, Artificial Sequence
  Description of Artificial Sequence: Synthetic oligonucleotide
tggaccaaacactgtgacaaagcagagttcttcag

SEQ ID NO: 229249 - DNA, 34 bp, Artificial Sequence
  Description of Artificial Sequence: Synthetic oligonucleotide
ggaccaaacactgtgacaaagcagagttcttcag

SEQ ID NO: 229250 - DNA, 36 bp, Artificial Sequence
  Description of Artificial Sequence: Synthetic oligonucleotide
gaccaaacactgtgacaaagcagagttcttcagttc

SEQ ID NO: 229251 - DNA, 37 bp, Artificial Sequence
  Description of Artificial Sequence: Synthetic oligonucleotide
accaaacactgtgacaaagcagagttcttcagttctg

SEQ ID NO: 229252 - DNA, 36 bp, Artificial Sequence
  Description of Artificial Sequence: Synthetic oligonucleotide
ccaaacactgtgacaaagcagagttcttcagttctg

SEQ ID NO: 229253 - DNA, 41 bp, Artificial Sequence
  Description of Artificial Sequence: Synthetic oligonucleotide
caaacactgtgacaaagcagagttcttcagttctgaaaatg

SEQ ID NO: 229254 - DNA, 46 bp, Artificial Sequence
  Description of Artificial Sequence: Synthetic oligonucleotide
aaacactgtgacaaagcagagttcttcagttctgaaaatgttaaag

SEQ ID NO: 229255 - DNA, 45 bp, Artificial Sequence
  Description of Artificial Sequence: Synthetic oligonucleotide
aacactgtgacaaagcagagttcttcagttctgaaaatgttaaag

SEQ ID NO: 229256 - DNA, 44 bp, Artificial Sequence
  Description of Artificial Sequence: Synthetic oligonucleotide
acactgtgacaaagcagagttcttcagttctgaaaatgttaaag

SEQ ID NO: 229257 - DNA, 43 bp, Artificial Sequence
  Description of Artificial Sequence: Synthetic oligonucleotide
cactgtgacaaagcagagttcttcagttctgaaaatgttaaag

SEQ ID NO: 229258 - DNA, 44 bp, Artificial Sequence
  Description of Artificial Sequence: Synthetic oligonucleotide
actgtgacaaagcagagttcttcagttctgaaaatgttaaagtg

SEQ ID NO: 229259 - DNA, 43 bp, Artificial Sequence
  Description of Artificial Sequence: Synthetic oligonucleotide
ctgtgacaaagcagagttcttcagttctgaaaatgttaaagtg

SEQ ID NO: 229260 - DNA, 46 bp, Artificial Sequence
  Description of Artificial Sequence: Synthetic oligonucleotide
tgtgacaaagcagagttcttcagttctgaaaatgttaaagtgtttg

SEQ ID NO: 229261 - DNA, 45 bp, Artificial Sequence
  Description of Artificial Sequence: Synthetic oligonucleotide
gtgacaaagcagagttcttcagttctgaaaatgttaaagtgtttg

SEQ ID NO: 229262 - DNA, 46 bp, Artificial Sequence
  Description of Artificial Sequence: Synthetic oligonucleotide
tgacaaagcagagttcttcagttctgaaaatgttaaagtgtttgag

SEQ ID NO: 229263 - DNA, 45 bp, Artificial Sequence
  Description of Artificial Sequence: Synthetic oligonucleotide
gacaaagcagagttcttcagttctgaaaatgttaaagtgtttgag

SEQ ID NO: 229264 - DNA, 46 bp, Artificial Sequence
  Description of Artificial Sequence: Synthetic oligonucleotide
acaaagcagagttcttcagttctgaaaatgttaaagtgtttgagtc

SEQ ID NO: 229265 - DNA, 45 bp, Artificial Sequence
  Description of Artificial Sequence: Synthetic oligonucleotide
caaagcagagttcttcagttctgaaaatgttaaagtgtttgagtc

SEQ ID NO: 229266 - DNA, 54 bp, Artificial Sequence
  Description of Artificial Sequence: Synthetic oligonucleotide
aaagcagagttcttcagttctgaaaatgttaaagtgtttgagtcaattaatatg

SEQ ID NO: 229267 - DNA, 53 bp, Artificial Sequence
  Description of Artificial Sequence: Synthetic oligonucleotide
aagcagagttcttcagttctgaaaatgttaaagtgtttgagtcaattaatatg

SEQ ID NO: 229268 - DNA, 52 bp, Artificial Sequence
  Description of Artificial Sequence: Synthetic oligonucleotide
agcagagttcttcagttctgaaaatgttaaagtgtttgagtcaattaatatg

SEQ ID NO: 229269 - DNA, 51 bp, Artificial Sequence
  Description of Artificial Sequence: Synthetic oligonucleotide
gcagagttcttcagttctgaaaatgttaaagtgtttgagtcaattaatatg

SEQ ID NO: 229270 - DNA, 51 bp, Artificial Sequence
  Description of Artificial Sequence: Synthetic oligonucleotide
cagagttcttcagttctgaaaatgttaaagtgtttgagtcaattaatatgg

SEQ ID NO: 229271 - DNA, 52 bp, Artificial Sequence
  Description of Artificial Sequence: Synthetic oligonucleotide
agagttcttcagttctgaaaatgttaaagtgtttgagtcaattaatatggac

SEQ ID NO: 229272 - DNA, 51 bp, Artificial Sequence
  Description of Artificial Sequence: Synthetic oligonucleotide
gagttcttcagttctgaaaatgttaaagtgtttgagtcaattaatatggac

SEQ ID NO: 229273 - DNA, 52 bp, Artificial Sequence
  Description of Artificial Sequence: Synthetic oligonucleotide
agttcttcagttctgaaaatgttaaagtgtttgagtcaattaatatggacac

SEQ ID NO: 229274 - DNA, 51 bp, Artificial Sequence
  Description of Artificial Sequence: Synthetic oligonucleotide
gttcttcagttctgaaaatgttaaagtgtttgagtcaattaatatggacac

SEQ ID NO: 229275 - DNA, 55 bp, Artificial Sequence
  Description of Artificial Sequence: Synthetic oligonucleotide
ttcttcagttctgaaaatgttaaagtgtttgagtcaattaatatggacacaaatg

SEQ ID NO: 229276 - DNA, 54 bp, Artificial Sequence
  Description of Artificial Sequence: Synthetic oligonucleotide
tcttcagttctgaaaatgttaaagtgtttgagtcaattaatatggacacaaatg

SEQ ID NO: 229277 - DNA, 53 bp, Artificial Sequence
  Description of Artificial Sequence: Synthetic oligonucleotide
cttcagttctgaaaatgttaaagtgtttgagtcaattaatatggacacaaatg

SEQ ID NO: 229278 - DNA, 54 bp, Artificial Sequence
  Description of Artificial Sequence: Synthetic oligonucleotide
ttcagttctgaaaatgttaaagtgtttgagtcaattaatatggacacaaatgac

SEQ ID NO: 229279 - DNA, 53 bp, Artificial Sequence
  Description of Artificial Sequence: Synthetic oligonucleotide
tcagttctgaaaatgttaaagtgtttgagtcaattaatatggacacaaatgac

SEQ ID NO: 229280 - DNA, 52 bp, Artificial Sequence
  Description of Artificial Sequence: Synthetic oligonucleotide
cagttctgaaaatgttaaagtgtttgagtcaattaatatggacacaaatgac

SEQ ID NO: 229281 - DNA, 54 bp, Artificial Sequence
  Description of Artificial Sequence: Synthetic oligonucleotide
agttctgaaaatgttaaagtgtttgagtcaattaatatggacacaaatgacatg

SEQ ID NO: 229282 - DNA, 53 bp, Artificial Sequence
  Description of Artificial Sequence: Synthetic oligonucleotide
gttctgaaaatgttaaagtgtttgagtcaattaatatggacacaaatgacatg

SEQ ID NO: 229283 - DNA, 54 bp, Artificial Sequence
  Description of Artificial Sequence: Synthetic oligonucleotide
ttctgaaaatgttaaagtgtttgagtcaattaatatggacacaaatgacatgtg

SEQ ID NO: 229284 - DNA, 53 bp, Artificial Sequence
  Description of Artificial Sequence: Synthetic oligonucleotide
tctgaaaatgttaaagtgtttgagtcaattaatatggacacaaatgacatgtg

SEQ ID NO: 229285 - DNA, 52 bp, Artificial Sequence
  Description of Artificial Sequence: Synthetic oligonucleotide
ctgaaaatgttaaagtgtttgagtcaattaatatggacacaaatgacatgtg

SEQ ID NO: 229286 - DNA, 52 bp, Artificial Sequence
  Description of Artificial Sequence: Synthetic oligonucleotide
tgaaaatgttaaagtgtttgagtcaattaatatggacacaaatgacatgtgg

SEQ ID NO: 229287 - DNA, 51 bp, Artificial Sequence
  Description of Artificial Sequence: Synthetic oligonucleotide
gaaaatgttaaagtgtttgagtcaattaatatggacacaaatgacatgtgg

SEQ ID NO: 229288 - DNA, 56 bp, Artificial Sequence
  Description of Artificial Sequence: Synthetic oligonucleotide
aaaatgttaaagtgtttgagtcaattaatatggacacaaatgacatgtggttaatg

SEQ ID NO: 229289 - DNA, 55 bp, Artificial Sequence
  Description of Artificial Sequence: Synthetic oligonucleotide
aaatgttaaagtgtttgagtcaattaatatggacacaaatgacatgtggttaatg

SEQ ID NO: 229290 - DNA, 54 bp, Artificial Sequence
  Description of Artificial Sequence: Synthetic oligonucleotide
aatgttaaagtgtttgagtcaattaatatggacacaaatgacatgtggttaatg

SEQ ID NO: 229291 - DNA, 53 bp, Artificial Sequence
  Description of Artificial Sequence: Synthetic oligonucleotide
atgttaaagtgtttgagtcaattaatatggacacaaatgacatgtggttaatg

SEQ ID NO: 229292 - DNA, 52 bp, Artificial Sequence
  Description of Artificial Sequence: Synthetic oligonucleotide
tgttaaagtgtttgagtcaattaatatggacacaaatgacatgtggttaatg

SEQ ID NO: 229293 - DNA, 51 bp, Artificial Sequence
  Description of Artificial Sequence: Synthetic oligonucleotide
gttaaagtgtttgagtcaattaatatggacacaaatgacatgtggttaatg

SEQ ID NO: 229294 - DNA, 53 bp, Artificial Sequence
  Description of Artificial Sequence: Synthetic oligonucleotide
ttaaagtgtttgagtcaattaatatggacacaaatgacatgtggttaatgatg

SEQ ID NO: 229295 - DNA, 52 bp, Artificial Sequence
  Description of Artificial Sequence: Synthetic oligonucleotide
taaagtgtttgagtcaattaatatggacacaaatgacatgtggttaatgatg

SEQ ID NO: 229296 - DNA, 51 bp, Artificial Sequence
  Description of Artificial Sequence: Synthetic oligonucleotide
aaagtgtttgagtcaattaatatggacacaaatgacatgtggttaatgatg

SEQ ID NO: 229297 - DNA, 50 bp, Artificial Sequence
  Description of Artificial Sequence: Synthetic oligonucleotide
aagtgtttgagtcaattaatatggacacaaatgacatgtggttaatgatg

SEQ ID NO: 229298 - DNA, 49 bp, Artificial Sequence
  Description of Artificial Sequence: Synthetic oligonucleotide
agtgtttgagtcaattaatatggacacaaatgacatgtggttaatgatg

SEQ ID NO: 229299 - DNA, 48 bp, Artificial Sequence
  Description of Artificial Sequence: Synthetic oligonucleotide
gtgtttgagtcaattaatatggacacaaatgacatgtggttaatgatg

SEQ ID NO: 229300 - DNA, 49 bp, Artificial Sequence
  Description of Artificial Sequence: Synthetic oligonucleotide
tgtttgagtcaattaatatggacacaaatgacatgtggttaatgatgag

SEQ ID NO: 229301 - DNA, 48 bp, Artificial Sequence
  Description of Artificial Sequence: Synthetic oligonucleotide
gtttgagtcaattaatatggacacaaatgacatgtggttaatgatgag

SEQ ID NO: 229302 - DNA, 52 bp, Artificial Sequence
  Description of Artificial Sequence: Synthetic oligonucleotide
tttgagtcaattaatatggacacaaatgacatgtggttaatgatgagaaaag

SEQ ID NO: 229303 - DNA, 51 bp, Artificial Sequence
  Description of Artificial Sequence: Synthetic oligonucleotide
ttgagtcaattaatatggacacaaatgacatgtggttaatgatgagaaaag

SEQ ID NO: 229304 - DNA, 50 bp, Artificial Sequence
  Description of Artificial Sequence: Synthetic oligonucleotide
tgagtcaattaatatggacacaaatgacatgtggttaatgatgagaaaag

SEQ ID NO: 229305 - DNA, 49 bp, Artificial Sequence
  Description of Artificial Sequence: Synthetic oligonucleotide
gagtcaattaatatggacacaaatgacatgtggttaatgatgagaaaag

SEQ ID NO: 229306 - DNA, 49 bp, Artificial Sequence
  Description of Artificial Sequence: Synthetic oligonucleotide
agtcaattaatatggacacaaatgacatgtggttaatgatgagaaaagc

SEQ ID NO: 229307 - DNA, 48 bp, Artificial Sequence
  Description of Artificial Sequence: Synthetic oligonucleotide
gtcaattaatatggacacaaatgacatgtggttaatgatgagaaaagc

SEQ ID NO: 229308 - DNA, 51 bp, Artificial Sequence
  Description of Artificial Sequence: Synthetic oligonucleotide
tcaattaatatggacacaaatgacatgtggttaatgatgagaaaagcttac

SEQ ID NO: 229309 - DNA, 50 bp, Artificial Sequence
  Description of Artificial Sequence: Synthetic oligonucleotide
caattaatatggacacaaatgacatgtggttaatgatgagaaaagcttac

SEQ ID NO: 229310 - DNA, 55 bp, Artificial Sequence
  Description of Artificial Sequence: Synthetic oligonucleotide
aattaatatggacacaaatgacatgtggttaatgatgagaaaagcttacaaatac

SEQ ID NO: 229311 - DNA, 54 bp, Artificial Sequence
  Description of Artificial Sequence: Synthetic oligonucleotide
attaatatggacacaaatgacatgtggttaatgatgagaaaagcttacaaatac

SEQ ID NO: 229312 - DNA, 53 bp, Artificial Sequence
  Description of Artificial Sequence: Synthetic oligonucleotide
ttaatatggacacaaatgacatgtggttaatgatgagaaaagcttacaaatac

SEQ ID NO: 229313 - DNA, 52 bp, Artificial Sequence
  Description of Artificial Sequence: Synthetic oligonucleotide
taatatggacacaaatgacatgtggttaatgatgagaaaagcttacaaatac

SEQ ID NO: 229314 - DNA, 51 bp, Artificial Sequence
  Description of Artificial Sequence: Synthetic oligonucleotide
aatatggacacaaatgacatgtggttaatgatgagaaaagcttacaaatac

SEQ ID NO: 229315 - DNA, 50 bp, Artificial Sequence
  Description of Artificial Sequence: Synthetic oligonucleotide
atatggacacaaatgacatgtggttaatgatgagaaaagcttacaaatac

SEQ ID NO: 229316 - DNA, 49 bp, Artificial Sequence
  Description of Artificial Sequence: Synthetic oligonucleotide
tatggacacaaatgacatgtggttaatgatgagaaaagcttacaaatac

SEQ ID NO: 229317 - DNA, 48 bp, Artificial Sequence
  Description of Artificial Sequence: Synthetic oligonucleotide
atggacacaaatgacatgtggttaatgatgagaaaagcttacaaatac

SEQ ID NO: 229318 - DNA, 47 bp, Artificial Sequence
  Description of Artificial Sequence: Synthetic oligonucleotide
tggacacaaatgacatgtggttaatgatgagaaaagcttacaaatac

SEQ ID NO: 229319 - DNA, 46 bp, Artificial Sequence
  Description of Artificial Sequence: Synthetic oligonucleotide
ggacacaaatgacatgtggttaatgatgagaaaagcttacaaatac

SEQ ID NO: 229320 - DNA, 46 bp, Artificial Sequence
  Description of Artificial Sequence: Synthetic oligonucleotide
gacacaaatgacatgtggttaatgatgagaaaagcttacaaatacg

SEQ ID NO: 229321 - DNA, 46 bp, Artificial Sequence
  Description of Artificial Sequence: Synthetic oligonucleotide
acacaaatgacatgtggttaatgatgagaaaagcttacaaatacgc

SEQ ID NO: 229322 - DNA, 45 bp, Artificial Sequence
  Description of Artificial Sequence: Synthetic oligonucleotide
cacaaatgacatgtggttaatgatgagaaaagcttacaaatacgc

SEQ ID NO: 229323 - DNA, 45 bp, Artificial Sequence
  Description of Artificial Sequence: Synthetic oligonucleotide
acaaatgacatgtggttaatgatgagaaaagcttacaaatacgcc

SEQ ID NO: 229324 - DNA, 44 bp, Artificial Sequence
  Description of Artificial Sequence: Synthetic oligonucleotide
caaatgacatgtggttaatgatgagaaaagcttacaaatacgcc

SEQ ID NO: 229325 - DNA, 47 bp, Artificial Sequence
  Description of Artificial Sequence: Synthetic oligonucleotide
aaatgacatgtggttaatgatgagaaaagcttacaaatacgcctttg

SEQ ID NO: 229326 - DNA, 46 bp, Artificial Sequence
  Description of Artificial Sequence: Synthetic oligonucleotide
aatgacatgtggttaatgatgagaaaagcttacaaatacgcctttg

SEQ ID NO: 229327 - DNA, 45 bp, Artificial Sequence
  Description of Artificial Sequence: Synthetic oligonucleotide
atgacatgtggttaatgatgagaaaagcttacaaatacgcctttg

SEQ ID NO: 229328 - DNA, 44 bp, Artificial Sequence
  Description of Artificial Sequence: Synthetic oligonucleotide
tgacatgtggttaatgatgagaaaagcttacaaatacgcctttg

SEQ ID NO: 229329 - DNA, 43 bp, Artificial Sequence
  Description of Artificial Sequence: Synthetic oligonucleotide
gacatgtggttaatgatgagaaaagcttacaaatacgcctttg

SEQ ID NO: 229330 - DNA, 47 bp, Artificial Sequence
  Description of Artificial Sequence: Synthetic oligonucleotide
acatgtggttaatgatgagaaaagcttacaaatacgcctttgataag

SEQ ID NO: 229331 - DNA, 46 bp, Artificial Sequence
  Description of Artificial Sequence: Synthetic oligonucleotide
catgtggttaatgatgagaaaagcttacaaatacgcctttgataag

SEQ ID NO: 229332 - DNA, 50 bp, Artificial Sequence
  Description of Artificial Sequence: Synthetic oligonucleotide
atgtggttaatgatgagaaaagcttacaaatacgcctttgataagtatag

SEQ ID NO: 229333 - DNA, 49 bp, Artificial Sequence
  Description of Artificial Sequence: Synthetic oligonucleotide
tgtggttaatgatgagaaaagcttacaaatacgcctttgataagtatag

SEQ ID NO: 229334 - DNA, 48 bp, Artificial Sequence
  Description of Artificial Sequence: Synthetic oligonucleotide
gtggttaatgatgagaaaagcttacaaatacgcctttgataagtatag

SEQ ID NO: 229335 - DNA, 49 bp, Artificial Sequence
  Description of Artificial Sequence: Synthetic oligonucleotide
tggttaatgatgagaaaagcttacaaatacgcctttgataagtatagag

SEQ ID NO: 229336 - DNA, 48 bp, Artificial Sequence
  Description of Artificial Sequence: Synthetic oligonucleotide
ggttaatgatgagaaaagcttacaaatacgcctttgataagtatagag

SEQ ID NO: 229337 - DNA, 49 bp, Artificial Sequence
  Description of Artificial Sequence: Synthetic oligonucleotide
gttaatgatgagaaaagcttacaaatacgcctttgataagtatagagac

SEQ ID NO: 229338 - DNA, 49 bp, Artificial Sequence
  Description of Artificial Sequence: Synthetic oligonucleotide
ttaatgatgagaaaagcttacaaatacgcctttgataagtatagagacc

SEQ ID NO: 229339 - DNA, 48 bp, Artificial Sequence
  Description of Artificial Sequence: Synthetic oligonucleotide
taatgatgagaaaagcttacaaatacgcctttgataagtatagagacc

SEQ ID NO: 229340 - DNA, 47 bp, Artificial Sequence
  Description of Artificial Sequence: Synthetic oligonucleotide
aatgatgagaaaagcttacaaatacgcctttgataagtatagagacc

SEQ ID NO: 229341 - DNA, 46 bp, Artificial Sequence
  Description of Artificial Sequence: Synthetic oligonucleotide
atgatgagaaaagcttacaaatacgcctttgataagtatagagacc

SEQ ID NO: 229342 - DNA, 45 bp, Artificial Sequence
  Description of Artificial Sequence: Synthetic oligonucleotide
tgatgagaaaagcttacaaatacgcctttgataagtatagagacc

SEQ ID NO: 229343 - DNA, 44 bp, Artificial Sequence
  Description of Artificial Sequence: Synthetic oligonucleotide
gatgagaaaagcttacaaatacgcctttgataagtatagagacc

SEQ ID NO: 229344 - DNA, 48 bp, Artificial Sequence
  Description of Artificial Sequence: Synthetic oligonucleotide
atgagaaaagcttacaaatacgcctttgataagtatagagaccaatac

SEQ ID NO: 229345 - DNA, 47 bp, Artificial Sequence
  Description of Artificial Sequence: Synthetic oligonucleotide
tgagaaaagcttacaaatacgcctttgataagtatagagaccaatac

SEQ ID NO: 229346 - DNA, 46 bp, Artificial Sequence
  Description of Artificial Sequence: Synthetic oligonucleotide
gagaaaagcttacaaatacgcctttgataagtatagagaccaatac

SEQ ID NO: 229347 - DNA, 48 bp, Artificial Sequence
  Description of Artificial Sequence: Synthetic oligonucleotide
agaaaagcttacaaatacgcctttgataagtatagagaccaatacaac

SEQ ID NO: 229348 - DNA, 47 bp, Artificial Sequence
  Description of Artificial Sequence: Synthetic oligonucleotide
gaaaagcttacaaatacgcctttgataagtatagagaccaatacaac

SEQ ID NO: 229349 - DNA, 48 bp, Artificial Sequence
  Description of Artificial Sequence: Synthetic oligonucleotide
aaaagcttacaaatacgcctttgataagtatagagaccaatacaactg

SEQ ID NO: 229350 - DNA, 47 bp, Artificial Sequence
  Description of Artificial Sequence: Synthetic oligonucleotide
aaagcttacaaatacgcctttgataagtatagagaccaatacaactg

SEQ ID NO: 229351 - DNA, 46 bp, Artificial Sequence
  Description of Artificial Sequence: Synthetic oligonucleotide
aagcttacaaatacgcctttgataagtatagagaccaatacaactg

SEQ ID NO: 229352 - DNA, 45 bp, Artificial Sequence
  Description of Artificial Sequence: Synthetic oligonucleotide
agcttacaaatacgcctttgataagtatagagaccaatacaactg

SEQ ID NO: 229353 - DNA, 44 bp, Artificial Sequence
  Description of Artificial Sequence: Synthetic oligonucleotide
gcttacaaatacgcctttgataagtatagagaccaatacaactg

SEQ ID NO: 229354 - DNA, 44 bp, Artificial Sequence
  Description of Artificial Sequence: Synthetic oligonucleotide
cttacaaatacgcctttgataagtatagagaccaatacaactgg

SEQ ID NO: 229355 - DNA, 46 bp, Artificial Sequence
  Description of Artificial Sequence: Synthetic oligonucleotide
ttacaaatacgcctttgataagtatagagaccaatacaactggttc

SEQ ID NO: 229356 - DNA, 45 bp, Artificial Sequence
  Description of Artificial Sequence: Synthetic oligonucleotide
tacaaatacgcctttgataagtatagagaccaatacaactggttc

SEQ ID NO: 229357 - DNA, 44 bp, Artificial Sequence
  Description of Artificial Sequence: Synthetic oligonucleotide
acaaatacgcctttgataagtatagagaccaatacaactggttc

SEQ ID NO: 229358 - DNA, 43 bp, Artificial Sequence
  Description of Artificial Sequence: Synthetic oligonucleotide
caaatacgcctttgataagtatagagaccaatacaactggttc

SEQ ID NO: 229359 - DNA, 45 bp, Artificial Sequence
  Description of Artificial Sequence: Synthetic oligonucleotide
aaatacgcctttgataagtatagagaccaatacaactggttcttc

SEQ ID NO: 229360 - DNA, 44 bp, Artificial Sequence
  Description of Artificial Sequence: Synthetic oligonucleotide
aatacgcctttgataagtatagagaccaatacaactggttcttc

SEQ ID NO: 229361 - DNA, 43 bp, Artificial Sequence
  Description of Artificial Sequence: Synthetic oligonucleotide
atacgcctttgataagtatagagaccaatacaactggttcttc

SEQ ID NO: 229362 - DNA, 42 bp, Artificial Sequence
  Description of Artificial Sequence: Synthetic oligonucleotide
tacgcctttgataagtatagagaccaatacaactggttcttc

SEQ ID NO: 229363 - DNA, 41 bp, Artificial Sequence
  Description of Artificial Sequence: Synthetic oligonucleotide
acgcctttgataagtatagagaccaatacaactggttcttc

SEQ ID NO: 229364 - DNA, 40 bp, Artificial Sequence
  Description of Artificial Sequence: Synthetic oligonucleotide
cgcctttgataagtatagagaccaatacaactggttcttc

SEQ ID NO: 229365 - DNA, 40 bp, Artificial Sequence
  Description of Artificial Sequence: Synthetic oligonucleotide
gcctttgataagtatagagaccaatacaactggttcttcc

SEQ ID NO: 229366 - DNA, 42 bp, Artificial Sequence
  Description of Artificial Sequence: Synthetic oligonucleotide
cctttgataagtatagagaccaatacaactggttcttccttg

SEQ ID NO: 229367 - DNA, 42 bp, Artificial Sequence
  Description of Artificial Sequence: Synthetic oligonucleotide
ctttgataagtatagagaccaatacaactggttcttccttgc

SEQ ID NO: 229368 - DNA, 43 bp, Artificial Sequence
  Description of Artificial Sequence: Synthetic oligonucleotide
tttgataagtatagagaccaatacaactggttcttccttgcac

SEQ ID NO: 229369 - DNA, 42 bp, Artificial Sequence
  Description of Artificial Sequence: Synthetic oligonucleotide
ttgataagtatagagaccaatacaactggttcttccttgcac

SEQ ID NO: 229370 - DNA, 41 bp, Artificial Sequence
  Description of Artificial Sequence: Synthetic oligonucleotide
tgataagtatagagaccaatacaactggttcttccttgcac

SEQ ID NO: 229371 - DNA, 40 bp, Artificial Sequence
  Description of Artificial Sequence: Synthetic oligonucleotide
gataagtatagagaccaatacaactggttcttccttgcac

SEQ ID NO: 229372 - DNA, 40 bp, Artificial Sequence
  Description of Artificial Sequence: Synthetic oligonucleotide
ataagtatagagaccaatacaactggttcttccttgcacg

SEQ ID NO: 229373 - DNA, 39 bp, Artificial Sequence
  Description of Artificial Sequence: Synthetic oligonucleotide
taagtatagagaccaatacaactggttcttccttgcacg

SEQ ID NO: 229374 - DNA, 38 bp, Artificial Sequence
  Description of Artificial Sequence: Synthetic oligonucleotide
aagtatagagaccaatacaactggttcttccttgcacg

SEQ ID NO: 229375 - DNA, 37 bp, Artificial Sequence
  Description of Artificial Sequence: Synthetic oligonucleotide
agtatagagaccaatacaactggttcttccttgcacg

SEQ ID NO: 229376 - DNA, 36 bp, Artificial Sequence
  Description of Artificial Sequence: Synthetic oligonucleotide
gtatagagaccaatacaactggttcttccttgcacg

SEQ ID NO: 229377 - DNA, 36 bp, Artificial Sequence
  Description of Artificial Sequence: Synthetic oligonucleotide
tatagagaccaatacaactggttcttccttgcacgc

SEQ ID NO: 229378 - DNA, 35 bp, Artificial Sequence
  Description of Artificial Sequence: Synthetic oligonucleotide
atagagaccaatacaactggttcttccttgcacgc

SEQ ID NO: 229379 - DNA, 34 bp, Artificial Sequence
  Description of Artificial Sequence: Synthetic oligonucleotide
tagagaccaatacaactggttcttccttgcacgc

SEQ ID NO: 229380 - DNA, 33 bp, Artificial Sequence
  Description of Artificial Sequence: Synthetic oligonucleotide
agagaccaatacaactggttcttccttgcacgc

SEQ ID NO: 229381 - DNA, 32 bp, Artificial Sequence
  Description of Artificial Sequence: Synthetic oligonucleotide
gagaccaatacaactggttcttccttgcacgc

SEQ ID NO: 229382 - DNA, 32 bp, Artificial Sequence
  Description of Artificial Sequence: Synthetic oligonucleotide
agaccaatacaactggttcttccttgcacgcc

SEQ ID NO: 229383 - DNA, 31 bp, Artificial Sequence
  Description of Artificial Sequence: Synthetic oligonucleotide
gaccaatacaactggttcttccttgcacgcc

SEQ ID NO: 229384 - DNA, 31 bp, Artificial Sequence
  Description of Artificial Sequence: Synthetic oligonucleotide
accaatacaactggttcttccttgcacgccc

SEQ ID NO: 229385 - DNA, 30 bp, Artificial Sequence
  Description of Artificial Sequence: Synthetic oligonucleotide
ccaatacaactggttcttccttgcacgccc

SEQ ID NO: 229386 - DNA, 30 bp, Artificial Sequence
  Description of Artificial Sequence: Synthetic oligonucleotide
caatacaactggttcttccttgcacgcccc

SEQ ID NO: 229387 - DNA, 31 bp, Artificial Sequence
  Description of Artificial Sequence: Synthetic oligonucleotide
aatacaactggttcttccttgcacgccccac

SEQ ID NO: 229388 - DNA, 30 bp, Artificial Sequence
  Description of Artificial Sequence: Synthetic oligonucleotide
atacaactggttcttccttgcacgccccac

SEQ ID NO: 229389 - DNA, 29 bp, Artificial Sequence
  Description of Artificial Sequence: Synthetic oligonucleotide
tacaactggttcttccttgcacgccccac

SEQ ID NO: 229390 - DNA, 28 bp, Artificial Sequence
  Description of Artificial Sequence: Synthetic oligonucleotide
acaactggttcttccttgcacgccccac

SEQ ID NO: 229391 - DNA, 27 bp, Artificial Sequence
  Description of Artificial Sequence: Synthetic oligonucleotide
caactggttcttccttgcacgccccac

SEQ ID NO: 229392 - DNA, 29 bp, Artificial Sequence
  Description of Artificial Sequence: Synthetic oligonucleotide
aactggttcttccttgcacgccccactac

SEQ ID NO: 229393 - DNA, 28 bp, Artificial Sequence
  Description of Artificial Sequence: Synthetic oligonucleotide
actggttcttccttgcacgccccactac

SEQ ID NO: 229394 - DNA, 27 bp, Artificial Sequence
  Description of Artificial Sequence: Synthetic oligonucleotide
ctggttcttccttgcacgccccactac

SEQ ID NO: 229395 - DNA, 27 bp, Artificial Sequence
  Description of Artificial Sequence: Synthetic oligonucleotide
tggttcttccttgcacgccccactacg

SEQ ID NO: 229396 - DNA, 27 bp, Artificial Sequence
  Description of Artificial Sequence: Synthetic oligonucleotide
ggttcttccttgcacgccccactacgt

SEQ ID NO: 229397 - DNA, 29 bp, Artificial Sequence
  Description of Artificial Sequence: Synthetic oligonucleotide
gttcttccttgcacgccccactacgtttg

SEQ ID NO: 229398 - DNA, 29 bp, Artificial Sequence
  Description of Artificial Sequence: Synthetic oligonucleotide
ttcttccttgcacgccccactacgtttgc

SEQ ID NO: 229399 - DNA, 28 bp, Artificial Sequence
  Description of Artificial Sequence: Synthetic oligonucleotide
tcttccttgcacgccccactacgtttgc

SEQ ID NO: 229400 - DNA, 27 bp, Artificial Sequence
  Description of Artificial Sequence: Synthetic oligonucleotide
cttccttgcacgccccactacgtttgc

SEQ ID NO: 229401 - DNA, 30 bp, Artificial Sequence
  Description of Artificial Sequence: Synthetic oligonucleotide
ttccttgcacgccccactacgtttgctatc

SEQ ID NO: 229402 - DNA, 29 bp, Artificial Sequence
  Description of Artificial Sequence: Synthetic oligonucleotide
tccttgcacgccccactacgtttgctatc

SEQ ID NO: 229403 - DNA, 28 bp, Artificial Sequence
  Description of Artificial Sequence: Synthetic oligonucleotide
ccttgcacgccccactacgtttgctatc

SEQ ID NO: 229404 - DNA, 31 bp, Artificial Sequence
  Description of Artificial Sequence: Synthetic oligonucleotide
cttgcacgccccactacgtttgctatcattg

SEQ ID NO: 229405 - DNA, 35 bp, Artificial Sequence
  Description of Artificial Sequence: Synthetic oligonucleotide
ttgcacgccccactacgtttgctatcattgaaaac

SEQ ID NO: 229406 - DNA, 34 bp, Artificial Sequence
  Description of Artificial Sequence: Synthetic oligonucleotide
tgcacgccccactacgtttgctatcattgaaaac

SEQ ID NO: 229407 - DNA, 33 bp, Artificial Sequence
  Description of Artificial Sequence: Synthetic oligonucleotide
gcacgccccactacgtttgctatcattgaaaac

SEQ ID NO: 229408 - DNA, 33 bp, Artificial Sequence
  Description of Artificial Sequence: Synthetic oligonucleotide
cacgccccactacgtttgctatcattgaaaacc

SEQ ID NO: 229409 - DNA, 37 bp, Artificial Sequence
  Description of Artificial Sequence: Synthetic oligonucleotide
acgccccactacgtttgctatcattgaaaacctaaag

SEQ ID NO: 229410 - DNA, 36 bp, Artificial Sequence
  Description of Artificial Sequence: Synthetic oligonucleotide
cgccccactacgtttgctatcattgaaaacctaaag

SEQ ID NO: 229411 - DNA, 44 bp, Artificial Sequence
  Description of Artificial Sequence: Synthetic oligonucleotide
gccccactacgtttgctatcattgaaaacctaaagtattttttg

SEQ ID NO: 229412 - DNA, 52 bp, Artificial Sequence
  Description of Artificial Sequence: Synthetic oligonucleotide
ccccactacgtttgctatcattgaaaacctaaagtattttttgttaaaaaag

SEQ ID NO: 229413 - DNA, 52 bp, Artificial Sequence
  Description of Artificial Sequence: Synthetic oligonucleotide
cccactacgtttgctatcattgaaaacctaaagtattttttgttaaaaaagg

SEQ ID NO: 229414 - DNA, 54 bp, Artificial Sequence
  Description of Artificial Sequence: Synthetic oligonucleotide
ccactacgtttgctatcattgaaaacctaaagtattttttgttaaaaaaggatc

SEQ ID NO: 229415 - DNA, 54 bp, Artificial Sequence
  Description of Artificial Sequence: Synthetic oligonucleotide
cactacgtttgctatcattgaaaacctaaagtattttttgttaaaaaaggatcc

SEQ ID NO: 229416 - DNA, 56 bp, Artificial Sequence
  Description of Artificial Sequence: Synthetic oligonucleotide
actacgtttgctatcattgaaaacctaaagtattttttgttaaaaaaggatccatc

SEQ ID NO: 229417 - DNA, 55 bp, Artificial Sequence
  Description of Artificial Sequence: Synthetic oligonucleotide
ctacgtttgctatcattgaaaacctaaagtattttttgttaaaaaaggatccatc

SEQ ID NO: 229418 - DNA, 56 bp, Artificial Sequence
  Description of Artificial Sequence: Synthetic oligonucleotide
tacgtttgctatcattgaaaacctaaagtattttttgttaaaaaaggatccatcac

SEQ ID NO: 229419 - DNA, 55 bp, Artificial Sequence
  Description of Artificial Sequence: Synthetic oligonucleotide
acgtttgctatcattgaaaacctaaagtattttttgttaaaaaaggatccatcac

SEQ ID NO: 229420 - DNA, 54 bp, Artificial Sequence
  Description of Artificial Sequence: Synthetic oligonucleotide
cgtttgctatcattgaaaacctaaagtattttttgttaaaaaaggatccatcac

SEQ ID NO: 229421 - DNA, 55 bp, Artificial Sequence
  Description of Artificial Sequence: Synthetic oligonucleotide
gtttgctatcattgaaaacctaaagtattttttgttaaaaaaggatccatcacag

SEQ ID NO: 229422 - DNA, 55 bp, Artificial Sequence
  Description of Artificial Sequence: Synthetic oligonucleotide
tttgctatcattgaaaacctaaagtattttttgttaaaaaaggatccatcacagc

SEQ ID NO: 229423 - DNA, 54 bp, Artificial Sequence
  Description of Artificial Sequence: Synthetic oligonucleotide
ttgctatcattgaaaacctaaagtattttttgttaaaaaaggatccatcacagc

SEQ ID NO: 229424 - DNA, 53 bp, Artificial Sequence
  Description of Artificial Sequence: Synthetic oligonucleotide
tgctatcattgaaaacctaaagtattttttgttaaaaaaggatccatcacagc

SEQ ID NO: 229425 - DNA, 52 bp, Artificial Sequence
  Description of Artificial Sequence: Synthetic oligonucleotide
gctatcattgaaaacctaaagtattttttgttaaaaaaggatccatcacagc

SEQ ID NO: 229426 - DNA, 52 bp, Artificial Sequence
  Description of Artificial Sequence: Synthetic oligonucleotide
ctatcattgaaaacctaaagtattttttgttaaaaaaggatccatcacagcc

SEQ ID NO: 229427 - DNA, 55 bp, Artificial Sequence
  Description of Artificial Sequence: Synthetic oligonucleotide
tatcattgaaaacctaaagtattttttgttaaaaaaggatccatcacagcctttc

SEQ ID NO: 229428 - DNA, 54 bp, Artificial Sequence
  Description of Artificial Sequence: Synthetic oligonucleotide
atcattgaaaacctaaagtattttttgttaaaaaaggatccatcacagcctttc

SEQ ID NO: 229429 - DNA, 53 bp, Artificial Sequence
  Description of Artificial Sequence: Synthetic oligonucleotide
tcattgaaaacctaaagtattttttgttaaaaaaggatccatcacagcctttc

SEQ ID NO: 229430 - DNA, 52 bp, Artificial Sequence
  Description of Artificial Sequence: Synthetic oligonucleotide
cattgaaaacctaaagtattttttgttaaaaaaggatccatcacagcctttc

SEQ ID NO: 229431 - DNA, 55 bp, Artificial Sequence
  Description of Artificial Sequence: Synthetic oligonucleotide
attgaaaacctaaagtattttttgttaaaaaaggatccatcacagcctttctatc

SEQ ID NO: 229432 - DNA, 54 bp, Artificial Sequence
  Description of Artificial Sequence: Synthetic oligonucleotide
ttgaaaacctaaagtattttttgttaaaaaaggatccatcacagcctttctatc

SEQ ID NO: 229433 - DNA, 53 bp, Artificial Sequence
  Description of Artificial Sequence: Synthetic oligonucleotide
tgaaaacctaaagtattttttgttaaaaaaggatccatcacagcctttctatc

SEQ ID NO: 229434 - DNA, 52 bp, Artificial Sequence
  Description of Artificial Sequence: Synthetic oligonucleotide
gaaaacctaaagtattttttgttaaaaaaggatccatcacagcctttctatc

SEQ ID NO: 229435 - DNA, 54 bp, Artificial Sequence
  Description of Artificial Sequence: Synthetic oligonucleotide
aaaacctaaagtattttttgttaaaaaaggatccatcacagcctttctatctag

SEQ ID NO: 229436 - DNA, 53 bp, Artificial Sequence
  Description of Artificial Sequence: Synthetic oligonucleotide
aaacctaaagtattttttgttaaaaaaggatccatcacagcctttctatctag

SEQ ID NO: 229437 - DNA, 52 bp, Artificial Sequence
  Description of Artificial Sequence: Synthetic oligonucleotide
aacctaaagtattttttgttaaaaaaggatccatcacagcctttctatctag

SEQ ID NO: 229438 - DNA, 51 bp, Artificial Sequence
  Description of Artificial Sequence: Synthetic oligonucleotide
acctaaagtattttttgttaaaaaaggatccatcacagcctttctatctag

SEQ ID NO: 229439 - DNA, 50 bp, Artificial Sequence
  Description of Artificial Sequence: Synthetic oligonucleotide
cctaaagtattttttgttaaaaaaggatccatcacagcctttctatctag

SEQ ID NO: 229440 - DNA, 50 bp, Artificial Sequence
  Description of Artificial Sequence: Synthetic oligonucleotide
ctaaagtattttttgttaaaaaaggatccatcacagcctttctatctagg

SEQ ID NO: 229441 - DNA, 50 bp, Artificial Sequence
  Description of Artificial Sequence: Synthetic oligonucleotide
taaagtattttttgttaaaaaaggatccatcacagcctttctatctaggc

SEQ ID NO: 229442 - DNA, 49 bp, Artificial Sequence
  Description of Artificial Sequence: Synthetic oligonucleotide
aaagtattttttgttaaaaaaggatccatcacagcctttctatctaggc

SEQ ID NO: 229443 - DNA, 48 bp, Artificial Sequence
  Description of Artificial Sequence: Synthetic oligonucleotide
aagtattttttgttaaaaaaggatccatcacagcctttctatctaggc

SEQ ID NO: 229444 - DNA, 47 bp, Artificial Sequence
  Description of Artificial Sequence: Synthetic oligonucleotide
agtattttttgttaaaaaaggatccatcacagcctttctatctaggc

SEQ ID NO: 229445 - DNA, 46 bp, Artificial Sequence
  Description of Artificial Sequence: Synthetic oligonucleotide
gtattttttgttaaaaaaggatccatcacagcctttctatctaggc

SEQ ID NO: 229446 - DNA, 46 bp, Artificial Sequence
  Description of Artificial Sequence: Synthetic oligonucleotide
tattttttgttaaaaaaggatccatcacagcctttctatctaggcc

SEQ ID NO: 229447 - DNA, 45 bp, Artificial Sequence
  Description of Artificial Sequence: Synthetic oligonucleotide
attttttgttaaaaaaggatccatcacagcctttctatctaggcc

SEQ ID NO: 229448 - DNA, 44 bp, Artificial Sequence
  Description of Artificial Sequence: Synthetic oligonucleotide
ttttttgttaaaaaaggatccatcacagcctttctatctaggcc

SEQ ID NO: 229449 - DNA, 43 bp, Artificial Sequence
  Description of Artificial Sequence: Synthetic oligonucleotide
tttttgttaaaaaaggatccatcacagcctttctatctaggcc

SEQ ID NO: 229450 - DNA, 42 bp, Artificial Sequence
  Description of Artificial Sequence: Synthetic oligonucleotide
ttttgttaaaaaaggatccatcacagcctttctatctaggcc

SEQ ID NO: 229451 - DNA, 41 bp, Artificial Sequence
  Description of Artificial Sequence: Synthetic oligonucleotide
tttgttaaaaaaggatccatcacagcctttctatctaggcc

SEQ ID NO: 229452 - DNA, 40 bp, Artificial Sequence
  Description of Artificial Sequence: Synthetic oligonucleotide
ttgttaaaaaaggatccatcacagcctttctatctaggcc

SEQ ID NO: 229453 - DNA, 39 bp, Artificial Sequence
  Description of Artificial Sequence: Synthetic oligonucleotide
tgttaaaaaaggatccatcacagcctttctatctaggcc

SEQ ID NO: 229454 - DNA, 38 bp, Artificial Sequence
  Description of Artificial Sequence: Synthetic oligonucleotide
gttaaaaaaggatccatcacagcctttctatctaggcc

SEQ ID NO: 229455 - DNA, 39 bp, Artificial Sequence
  Description of Artificial Sequence: Synthetic oligonucleotide
ttaaaaaaggatccatcacagcctttctatctaggccac

SEQ ID NO: 229456 - DNA, 38 bp, Artificial Sequence
  Description of Artificial Sequence: Synthetic oligonucleotide
taaaaaaggatccatcacagcctttctatctaggccac

SEQ ID NO: 229457 - DNA, 37 bp, Artificial Sequence
  Description of Artificial Sequence: Synthetic oligonucleotide
aaaaaaggatccatcacagcctttctatctaggccac

SEQ ID NO: 229458 - DNA, 36 bp, Artificial Sequence
  Description of Artificial Sequence: Synthetic oligonucleotide
aaaaaggatccatcacagcctttctatctaggccac

SEQ ID NO: 229459 - DNA, 35 bp, Artificial Sequence
  Description of Artificial Sequence: Synthetic oligonucleotide
aaaaggatccatcacagcctttctatctaggccac

SEQ ID NO: 229460 - DNA, 34 bp, Artificial Sequence
  Description of Artificial Sequence: Synthetic oligonucleotide
aaaggatccatcacagcctttctatctaggccac

SEQ ID NO: 229461 - DNA, 33 bp, Artificial Sequence
  Description of Artificial Sequence: Synthetic oligonucleotide
aaggatccatcacagcctttctatctaggccac

SEQ ID NO: 229462 - DNA, 32 bp, Artificial Sequence
  Description of Artificial Sequence: Synthetic oligonucleotide
aggatccatcacagcctttctatctaggccac

SEQ ID NO: 229463 - DNA, 31 bp, Artificial Sequence
  Description of Artificial Sequence: Synthetic oligonucleotide
ggatccatcacagcctttctatctaggccac

SEQ ID NO: 229464 - DNA, 32 bp, Artificial Sequence
  Description of Artificial Sequence: Synthetic oligonucleotide
gatccatcacagcctttctatctaggccacac

SEQ ID NO: 229465 - DNA, 40 bp, Artificial Sequence
  Description of Artificial Sequence: Synthetic oligonucleotide
atccatcacagcctttctatctaggccacactataaaatc

SEQ ID NO: 229466 - DNA, 39 bp, Artificial Sequence
  Description of Artificial Sequence: Synthetic oligonucleotide
tccatcacagcctttctatctaggccacactataaaatc

SEQ ID NO: 229467 - DNA, 38 bp, Artificial Sequence
  Description of Artificial Sequence: Synthetic oligonucleotide
ccatcacagcctttctatctaggccacactataaaatc

SEQ ID NO: 229468 - DNA, 39 bp, Artificial Sequence
  Description of Artificial Sequence: Synthetic oligonucleotide
catcacagcctttctatctaggccacactataaaatctg

SEQ ID NO: 229469 - DNA, 39 bp, Artificial Sequence
  Description of Artificial Sequence: Synthetic oligonucleotide
atcacagcctttctatctaggccacactataaaatctgg

SEQ ID NO: 229470 - DNA, 38 bp, Artificial Sequence
  Description of Artificial Sequence: Synthetic oligonucleotide
tcacagcctttctatctaggccacactataaaatctgg

SEQ ID NO: 229471 - DNA, 37 bp, Artificial Sequence
  Description of Artificial Sequence: Synthetic oligonucleotide
cacagcctttctatctaggccacactataaaatctgg

SEQ ID NO: 229472 - DNA, 38 bp, Artificial Sequence
  Description of Artificial Sequence: Synthetic oligonucleotide
acagcctttctatctaggccacactataaaatctggag

SEQ ID NO: 229473 - DNA, 37 bp, Artificial Sequence
  Description of Artificial Sequence: Synthetic oligonucleotide
cagcctttctatctaggccacactataaaatctggag

SEQ ID NO: 229474 - DNA, 38 bp, Artificial Sequence
  Description of Artificial Sequence: Synthetic oligonucleotide
agcctttctatctaggccacactataaaatctggagac

SEQ ID NO: 229475 - DNA, 37 bp, Artificial Sequence
  Description of Artificial Sequence: Synthetic oligonucleotide
gcctttctatctaggccacactataaaatctggagac

SEQ ID NO: 229476 - DNA, 37 bp, Artificial Sequence
  Description of Artificial Sequence: Synthetic oligonucleotide
cctttctatctaggccacactataaaatctggagacc

SEQ ID NO: 229477 - DNA, 39 bp, Artificial Sequence
  Description of Artificial Sequence: Synthetic oligonucleotide
ctttctatctaggccacactataaaatctggagaccttg

SEQ ID NO: 229478 - DNA, 44 bp, Artificial Sequence
  Description of Artificial Sequence: Synthetic oligonucleotide
tttctatctaggccacactataaaatctggagaccttgaatatg

SEQ ID NO: 229479 - DNA, 43 bp, Artificial Sequence
  Description of Artificial Sequence: Synthetic oligonucleotide
ttctatctaggccacactataaaatctggagaccttgaatatg

SEQ ID NO: 229480 - DNA, 42 bp, Artificial Sequence
  Description of Artificial Sequence: Synthetic oligonucleotide
tctatctaggccacactataaaatctggagaccttgaatatg

SEQ ID NO: 229481 - DNA, 41 bp, Artificial Sequence
  Description of Artificial Sequence: Synthetic oligonucleotide
ctatctaggccacactataaaatctggagaccttgaatatg

SEQ ID NO: 229482 - DNA, 42 bp, Artificial Sequence
  Description of Artificial Sequence: Synthetic oligonucleotide
tatctaggccacactataaaatctggagaccttgaatatgtg

SEQ ID NO: 229483 - DNA, 41 bp, Artificial Sequence
  Description of Artificial Sequence: Synthetic oligonucleotide
atctaggccacactataaaatctggagaccttgaatatgtg

SEQ ID NO: 229484 - DNA, 40 bp, Artificial Sequence
  Description of Artificial Sequence: Synthetic oligonucleotide
tctaggccacactataaaatctggagaccttgaatatgtg

SEQ ID NO: 229485 - DNA, 39 bp, Artificial Sequence
  Description of Artificial Sequence: Synthetic oligonucleotide
ctaggccacactataaaatctggagaccttgaatatgtg

SEQ ID NO: 229486 - DNA, 39 bp, Artificial Sequence
  Description of Artificial Sequence: Synthetic oligonucleotide
taggccacactataaaatctggagaccttgaatatgtgg

SEQ ID NO: 229487 - DNA, 38 bp, Artificial Sequence
  Description of Artificial Sequence: Synthetic oligonucleotide
aggccacactataaaatctggagaccttgaatatgtgg

SEQ ID NO: 229488 - DNA, 37 bp, Artificial Sequence
  Description of Artificial Sequence: Synthetic oligonucleotide
ggccacactataaaatctggagaccttgaatatgtgg

SEQ ID NO: 229489 - DNA, 37 bp, Artificial Sequence
  Description of Artificial Sequence: Synthetic oligonucleotide
gccacactataaaatctggagaccttgaatatgtggg

SEQ ID NO: 229490 - DNA, 40 bp, Artificial Sequence
  Description of Artificial Sequence: Synthetic oligonucleotide
ccacactataaaatctggagaccttgaatatgtgggtatg

SEQ ID NO: 229491 - DNA, 40 bp, Artificial Sequence
  Description of Artificial Sequence: Synthetic oligonucleotide
cacactataaaatctggagaccttgaatatgtgggtatgg

SEQ ID NO: 229492 - DNA, 42 bp, Artificial Sequence
  Description of Artificial Sequence: Synthetic oligonucleotide
acactataaaatctggagaccttgaatatgtgggtatggaag

SEQ ID NO: 229493 - DNA, 41 bp, Artificial Sequence
  Description of Artificial Sequence: Synthetic oligonucleotide
cactataaaatctggagaccttgaatatgtgggtatggaag

SEQ ID NO: 229494 - DNA, 41 bp, Artificial Sequence
  Description of Artificial Sequence: Synthetic oligonucleotide
actataaaatctggagaccttgaatatgtgggtatggaagg

SEQ ID NO: 229495 - DNA, 40 bp, Artificial Sequence
  Description of Artificial Sequence: Synthetic oligonucleotide
ctataaaatctggagaccttgaatatgtgggtatggaagg

SEQ ID NO: 229496 - DNA, 41 bp, Artificial Sequence
  Description of Artificial Sequence: Synthetic oligonucleotide
tataaaatctggagaccttgaatatgtgggtatggaaggag

SEQ ID NO: 229497 - DNA, 40 bp, Artificial Sequence
  Description of Artificial Sequence: Synthetic oligonucleotide
ataaaatctggagaccttgaatatgtgggtatggaaggag

SEQ ID NO: 229498 - DNA, 39 bp, Artificial Sequence
  Description of Artificial Sequence: Synthetic oligonucleotide
taaaatctggagaccttgaatatgtgggtatggaaggag

SEQ ID NO: 229499 - DNA, 38 bp, Artificial Sequence
  Description of Artificial Sequence: Synthetic oligonucleotide
aaaatctggagaccttgaatatgtgggtatggaaggag

SEQ ID NO: 229500 - DNA, 37 bp, Artificial Sequence
  Description of Artificial Sequence: Synthetic oligonucleotide
aaatctggagaccttgaatatgtgggtatggaaggag

SEQ ID NO: 229501 - DNA, 36 bp, Artificial Sequence
  Description of Artificial Sequence: Synthetic oligonucleotide
aatctggagaccttgaatatgtgggtatggaaggag

SEQ ID NO: 229502 - DNA, 35 bp, Artificial Sequence
  Description of Artificial Sequence: Synthetic oligonucleotide
atctggagaccttgaatatgtgggtatggaaggag

SEQ ID NO: 229503 - DNA, 34 bp, Artificial Sequence
  Description of Artificial Sequence: Synthetic oligonucleotide
tctggagaccttgaatatgtgggtatggaaggag

SEQ ID NO: 229504 - DNA, 33 bp, Artificial Sequence
  Description of Artificial Sequence: Synthetic oligonucleotide
ctggagaccttgaatatgtgggtatggaaggag

SEQ ID NO: 229505 - DNA, 33 bp, Artificial Sequence
  Description of Artificial Sequence: Synthetic oligonucleotide
tggagaccttgaatatgtgggtatggaaggagg

SEQ ID NO: 229506 - DNA, 32 bp, Artificial Sequence
  Description of Artificial Sequence: Synthetic oligonucleotide
ggagaccttgaatatgtgggtatggaaggagg

SEQ ID NO: 229507 - DNA, 36 bp, Artificial Sequence
  Description of Artificial Sequence: Synthetic oligonucleotide
gagaccttgaatatgtgggtatggaaggaggaattg

SEQ ID NO: 229508 - DNA, 37 bp, Artificial Sequence
  Description of Artificial Sequence: Synthetic oligonucleotide
agaccttgaatatgtgggtatggaaggaggaattgtc

SEQ ID NO: 229509 - DNA, 36 bp, Artificial Sequence
  Description of Artificial Sequence: Synthetic oligonucleotide
gaccttgaatatgtgggtatggaaggaggaattgtc

SEQ ID NO: 229510 - DNA, 40 bp, Artificial Sequence
  Description of Artificial Sequence: Synthetic oligonucleotide
accttgaatatgtgggtatggaaggaggaattgtcttaag

SEQ ID NO: 229511 - DNA, 39 bp, Artificial Sequence
  Description of Artificial Sequence: Synthetic oligonucleotide
ccttgaatatgtgggtatggaaggaggaattgtcttaag

SEQ ID NO: 229512 - DNA, 40 bp, Artificial Sequence
  Description of Artificial Sequence: Synthetic oligonucleotide
cttgaatatgtgggtatggaaggaggaattgtcttaagtg

SEQ ID NO: 229513 - DNA, 42 bp, Artificial Sequence
  Description of Artificial Sequence: Synthetic oligonucleotide
ttgaatatgtgggtatggaaggaggaattgtcttaagtgtag

SEQ ID NO: 229514 - DNA, 41 bp, Artificial Sequence
  Description of Artificial Sequence: Synthetic oligonucleotide
tgaatatgtgggtatggaaggaggaattgtcttaagtgtag

SEQ ID NO: 229515 - DNA, 40 bp, Artificial Sequence
  Description of Artificial Sequence: Synthetic oligonucleotide
gaatatgtgggtatggaaggaggaattgtcttaagtgtag

SEQ ID NO: 229516 - DNA, 43 bp, Artificial Sequence
  Description of Artificial Sequence: Synthetic oligonucleotide
aatatgtgggtatggaaggaggaattgtcttaagtgtagaatc

SEQ ID NO: 229517 - DNA, 42 bp, Artificial Sequence
  Description of Artificial Sequence: Synthetic oligonucleotide
atatgtgggtatggaaggaggaattgtcttaagtgtagaatc

SEQ ID NO: 229518 - DNA, 41 bp, Artificial Sequence
  Description of Artificial Sequence: Synthetic oligonucleotide
tatgtgggtatggaaggaggaattgtcttaagtgtagaatc

SEQ ID NO: 229519 - DNA, 40 bp, Artificial Sequence
  Description of Artificial Sequence: Synthetic oligonucleotide
atgtgggtatggaaggaggaattgtcttaagtgtagaatc

SEQ ID NO: 229520 - DNA, 39 bp, Artificial Sequence
  Description of Artificial Sequence: Synthetic oligonucleotide
tgtgggtatggaaggaggaattgtcttaagtgtagaatc

SEQ ID NO: 229521 - DNA, 38 bp, Artificial Sequence
  Description of Artificial Sequence: Synthetic oligonucleotide
gtgggtatggaaggaggaattgtcttaagtgtagaatc

SEQ ID NO: 229522 - DNA, 41 bp, Artificial Sequence
  Description of Artificial Sequence: Synthetic oligonucleotide
tgggtatggaaggaggaattgtcttaagtgtagaatcaatg

SEQ ID NO: 229523 - DNA, 40 bp, Artificial Sequence
  Description of Artificial Sequence: Synthetic oligonucleotide
gggtatggaaggaggaattgtcttaagtgtagaatcaatg

SEQ ID NO: 229524 - DNA, 44 bp, Artificial Sequence
  Description of Artificial Sequence: Synthetic oligonucleotide
ggtatggaaggaggaattgtcttaagtgtagaatcaatgaaaag

SEQ ID NO: 229525 - DNA, 45 bp, Artificial Sequence
  Description of Artificial Sequence: Synthetic oligonucleotide
gtatggaaggaggaattgtcttaagtgtagaatcaatgaaaagac

SEQ ID NO: 229526 - DNA, 49 bp, Artificial Sequence
  Description of Artificial Sequence: Synthetic oligonucleotide
tatggaaggaggaattgtcttaagtgtagaatcaatgaaaagacttaac

SEQ ID NO: 229527 - DNA, 48 bp, Artificial Sequence
  Description of Artificial Sequence: Synthetic oligonucleotide
atggaaggaggaattgtcttaagtgtagaatcaatgaaaagacttaac

SEQ ID NO: 229528 - DNA, 47 bp, Artificial Sequence
  Description of Artificial Sequence: Synthetic oligonucleotide
tggaaggaggaattgtcttaagtgtagaatcaatgaaaagacttaac

SEQ ID NO: 229529 - DNA, 46 bp, Artificial Sequence
  Description of Artificial Sequence: Synthetic oligonucleotide
ggaaggaggaattgtcttaagtgtagaatcaatgaaaagacttaac

SEQ ID NO: 229530 - DNA, 47 bp, Artificial Sequence
  Description of Artificial Sequence: Synthetic oligonucleotide
gaaggaggaattgtcttaagtgtagaatcaatgaaaagacttaacag

SEQ ID NO: 229531 - DNA, 47 bp, Artificial Sequence
  Description of Artificial Sequence: Synthetic oligonucleotide
aaggaggaattgtcttaagtgtagaatcaatgaaaagacttaacagc

SEQ ID NO: 229532 - DNA, 46 bp, Artificial Sequence
  Description of Artificial Sequence: Synthetic oligonucleotide
aggaggaattgtcttaagtgtagaatcaatgaaaagacttaacagc

SEQ ID NO: 229533 - DNA, 45 bp, Artificial Sequence
  Description of Artificial Sequence: Synthetic oligonucleotide
ggaggaattgtcttaagtgtagaatcaatgaaaagacttaacagc

SEQ ID NO: 229534 - DNA, 45 bp, Artificial Sequence
  Description of Artificial Sequence: Synthetic oligonucleotide
gaggaattgtcttaagtgtagaatcaatgaaaagacttaacagcc

SEQ ID NO: 229535 - DNA, 47 bp, Artificial Sequence
  Description of Artificial Sequence: Synthetic oligonucleotide
aggaattgtcttaagtgtagaatcaatgaaaagacttaacagccttc

SEQ ID NO: 229536 - DNA, 46 bp, Artificial Sequence
  Description of Artificial Sequence: Synthetic oligonucleotide
ggaattgtcttaagtgtagaatcaatgaaaagacttaacagccttc

SEQ ID NO: 229537 - DNA, 47 bp, Artificial Sequence
  Description of Artificial Sequence: Synthetic oligonucleotide
gaattgtcttaagtgtagaatcaatgaaaagacttaacagccttctc

SEQ ID NO: 229538 - DNA, 52 bp, Artificial Sequence
  Description of Artificial Sequence: Synthetic oligonucleotide
aattgtcttaagtgtagaatcaatgaaaagacttaacagccttctcaatatc

SEQ ID NO: 229539 - DNA, 51 bp, Artificial Sequence
  Description of Artificial Sequence: Synthetic oligonucleotide
attgtcttaagtgtagaatcaatgaaaagacttaacagccttctcaatatc

SEQ ID NO: 229540 - DNA, 50 bp, Artificial Sequence
  Description of Artificial Sequence: Synthetic oligonucleotide
ttgtcttaagtgtagaatcaatgaaaagacttaacagccttctcaatatc

SEQ ID NO: 229541 - DNA, 49 bp, Artificial Sequence
  Description of Artificial Sequence: Synthetic oligonucleotide
tgtcttaagtgtagaatcaatgaaaagacttaacagccttctcaatatc

SEQ ID NO: 229542 - DNA, 48 bp, Artificial Sequence
  Description of Artificial Sequence: Synthetic oligonucleotide
gtcttaagtgtagaatcaatgaaaagacttaacagccttctcaatatc

SEQ ID NO: 229543 - DNA, 48 bp, Artificial Sequence
  Description of Artificial Sequence: Synthetic oligonucleotide
tcttaagtgtagaatcaatgaaaagacttaacagccttctcaatatcc

SEQ ID NO: 229544 - DNA, 47 bp, Artificial Sequence
  Description of Artificial Sequence: Synthetic oligonucleotide
cttaagtgtagaatcaatgaaaagacttaacagccttctcaatatcc

SEQ ID NO: 229545 - DNA, 47 bp, Artificial Sequence
  Description of Artificial Sequence: Synthetic oligonucleotide
ttaagtgtagaatcaatgaaaagacttaacagccttctcaatatccc

SEQ ID NO: 229546 - DNA, 46 bp, Artificial Sequence
  Description of Artificial Sequence: Synthetic oligonucleotide
taagtgtagaatcaatgaaaagacttaacagccttctcaatatccc

SEQ ID NO: 229547 - DNA, 45 bp, Artificial Sequence
  Description of Artificial Sequence: Synthetic oligonucleotide
aagtgtagaatcaatgaaaagacttaacagccttctcaatatccc

SEQ ID NO: 229548 - DNA, 44 bp, Artificial Sequence
  Description of Artificial Sequence: Synthetic oligonucleotide
agtgtagaatcaatgaaaagacttaacagccttctcaatatccc

SEQ ID NO: 229549 - DNA, 43 bp, Artificial Sequence
  Description of Artificial Sequence: Synthetic oligonucleotide
gtgtagaatcaatgaaaagacttaacagccttctcaatatccc

SEQ ID NO: 229550 - DNA, 44 bp, Artificial Sequence
  Description of Artificial Sequence: Synthetic oligonucleotide
tgtagaatcaatgaaaagacttaacagccttctcaatatcccag

SEQ ID NO: 229551 - DNA, 43 bp, Artificial Sequence
  Description of Artificial Sequence: Synthetic oligonucleotide
gtagaatcaatgaaaagacttaacagccttctcaatatcccag

SEQ ID NO: 229552 - DNA, 47 bp, Artificial Sequence
  Description of Artificial Sequence: Synthetic oligonucleotide
tagaatcaatgaaaagacttaacagccttctcaatatcccagaaaag

SEQ ID NO: 229553 - DNA, 46 bp, Artificial Sequence
  Description of Artificial Sequence: Synthetic oligonucleotide
agaatcaatgaaaagacttaacagccttctcaatatcccagaaaag

SEQ ID NO: 229554 - DNA, 45 bp, Artificial Sequence
  Description of Artificial Sequence: Synthetic oligonucleotide
gaatcaatgaaaagacttaacagccttctcaatatcccagaaaag

SEQ ID NO: 229555 - DNA, 46 bp, Artificial Sequence
  Description of Artificial Sequence: Synthetic oligonucleotide
aatcaatgaaaagacttaacagccttctcaatatcccagaaaagtg

SEQ ID NO: 229556 - DNA, 45 bp, Artificial Sequence
  Description of Artificial Sequence: Synthetic oligonucleotide
atcaatgaaaagacttaacagccttctcaatatcccagaaaagtg

SEQ ID NO: 229557 - DNA, 44 bp, Artificial Sequence
  Description of Artificial Sequence: Synthetic oligonucleotide
tcaatgaaaagacttaacagccttctcaatatcccagaaaagtg

SEQ ID NO: 229558 - DNA, 43 bp, Artificial Sequence
  Description of Artificial Sequence: Synthetic oligonucleotide
caatgaaaagacttaacagccttctcaatatcccagaaaagtg

SEQ ID NO: 229559 - DNA, 44 bp, Artificial Sequence
  Description of Artificial Sequence: Synthetic oligonucleotide
aatgaaaagacttaacagccttctcaatatcccagaaaagtgtc

SEQ ID NO: 229560 - DNA, 43 bp, Artificial Sequence
  Description of Artificial Sequence: Synthetic oligonucleotide
atgaaaagacttaacagccttctcaatatcccagaaaagtgtc

SEQ ID NO: 229561 - DNA, 42 bp, Artificial Sequence
  Description of Artificial Sequence: Synthetic oligonucleotide
tgaaaagacttaacagccttctcaatatcccagaaaagtgtc

SEQ ID NO: 229562 - DNA, 41 bp, Artificial Sequence
  Description of Artificial Sequence: Synthetic oligonucleotide
gaaaagacttaacagccttctcaatatcccagaaaagtgtc

SEQ ID NO: 229563 - DNA, 41 bp, Artificial Sequence
  Description of Artificial Sequence: Synthetic oligonucleotide
aaaagacttaacagccttctcaatatcccagaaaagtgtcc

SEQ ID NO: 229564 - DNA, 40 bp, Artificial Sequence
  Description of Artificial Sequence: Synthetic oligonucleotide
aaagacttaacagccttctcaatatcccagaaaagtgtcc

SEQ ID NO: 229565 - DNA, 39 bp, Artificial Sequence
  Description of Artificial Sequence: Synthetic oligonucleotide
aagacttaacagccttctcaatatcccagaaaagtgtcc

SEQ ID NO: 229566 - DNA, 38 bp, Artificial Sequence
  Description of Artificial Sequence: Synthetic oligonucleotide
agacttaacagccttctcaatatcccagaaaagtgtcc

SEQ ID NO: 229567 - DNA, 37 bp, Artificial Sequence
  Description of Artificial Sequence: Synthetic oligonucleotide
gacttaacagccttctcaatatcccagaaaagtgtcc

SEQ ID NO: 229568 - DNA, 38 bp, Artificial Sequence
  Description of Artificial Sequence: Synthetic oligonucleotide
acttaacagccttctcaatatcccagaaaagtgtcctg

SEQ ID NO: 229569 - DNA, 37 bp, Artificial Sequence
  Description of Artificial Sequence: Synthetic oligonucleotide
cttaacagccttctcaatatcccagaaaagtgtcctg

SEQ ID NO: 229570 - DNA, 39 bp, Artificial Sequence
  Description of Artificial Sequence: Synthetic oligonucleotide
ttaacagccttctcaatatcccagaaaagtgtcctgaac

SEQ ID NO: 229571 - DNA, 38 bp, Artificial Sequence
  Description of Artificial Sequence: Synthetic oligonucleotide
taacagccttctcaatatcccagaaaagtgtcctgaac

SEQ ID NO: 229572 - DNA, 37 bp, Artificial Sequence
  Description of Artificial Sequence: Synthetic oligonucleotide
aacagccttctcaatatcccagaaaagtgtcctgaac

SEQ ID NO: 229573 - DNA, 36 bp, Artificial Sequence
  Description of Artificial Sequence: Synthetic oligonucleotide
acagccttctcaatatcccagaaaagtgtcctgaac

SEQ ID NO: 229574 - DNA, 35 bp, Artificial Sequence
  Description of Artificial Sequence: Synthetic oligonucleotide
cagccttctcaatatcccagaaaagtgtcctgaac

SEQ ID NO: 229575 - DNA, 36 bp, Artificial Sequence
  Description of Artificial Sequence: Synthetic oligonucleotide
agccttctcaatatcccagaaaagtgtcctgaacag

SEQ ID NO: 229576 - DNA, 35 bp, Artificial Sequence
  Description of Artificial Sequence: Synthetic oligonucleotide
gccttctcaatatcccagaaaagtgtcctgaacag

SEQ ID NO: 229577 - DNA, 35 bp, Artificial Sequence
  Description of Artificial Sequence: Synthetic oligonucleotide
ccttctcaatatcccagaaaagtgtcctgaacagg

SEQ ID NO: 229578 - DNA, 35 bp, Artificial Sequence
  Description of Artificial Sequence: Synthetic oligonucleotide
cttctcaatatcccagaaaagtgtcctgaacaggg

SEQ ID NO: 229579 - DNA, 36 bp, Artificial Sequence
  Description of Artificial Sequence: Synthetic oligonucleotide
ttctcaatatcccagaaaagtgtcctgaacagggag

SEQ ID NO: 229580 - DNA, 35 bp, Artificial Sequence
  Description of Artificial Sequence: Synthetic oligonucleotide
tctcaatatcccagaaaagtgtcctgaacagggag

SEQ ID NO: 229581 - DNA, 34 bp, Artificial Sequence
  Description of Artificial Sequence: Synthetic oligonucleotide
ctcaatatcccagaaaagtgtcctgaacagggag

SEQ ID NO: 229582 - DNA, 34 bp, Artificial Sequence
  Description of Artificial Sequence: Synthetic oligonucleotide
tcaatatcccagaaaagtgtcctgaacagggagg

SEQ ID NO: 229583 - DNA, 33 bp, Artificial Sequence
  Description of Artificial Sequence: Synthetic oligonucleotide
caatatcccagaaaagtgtcctgaacagggagg

SEQ ID NO: 229584 - DNA, 33 bp, Artificial Sequence
  Description of Artificial Sequence: Synthetic oligonucleotide
aatatcccagaaaagtgtcctgaacagggaggg

SEQ ID NO: 229585 - DNA, 32 bp, Artificial Sequence
  Description of Artificial Sequence: Synthetic oligonucleotide
atatcccagaaaagtgtcctgaacagggaggg

SEQ ID NO: 229586 - DNA, 31 bp, Artificial Sequence
  Description of Artificial Sequence: Synthetic oligonucleotide
tatcccagaaaagtgtcctgaacagggaggg

SEQ ID NO: 229587 - DNA, 30 bp, Artificial Sequence
  Description of Artificial Sequence: Synthetic oligonucleotide
atcccagaaaagtgtcctgaacagggaggg

SEQ ID NO: 229588 - DNA, 29 bp, Artificial Sequence
  Description of Artificial Sequence: Synthetic oligonucleotide
tcccagaaaagtgtcctgaacagggaggg

SEQ ID NO: 229589 - DNA, 28 bp, Artificial Sequence
  Description of Artificial Sequence: Synthetic oligonucleotide
cccagaaaagtgtcctgaacagggaggg

SEQ ID NO: 229590 - DNA, 30 bp, Artificial Sequence
  Description of Artificial Sequence: Synthetic oligonucleotide
ccagaaaagtgtcctgaacagggagggatg

SEQ ID NO: 229591 - DNA, 34 bp, Artificial Sequence
  Description of Artificial Sequence: Synthetic oligonucleotide
cagaaaagtgtcctgaacagggagggatgatttg

SEQ ID NO: 229592 - DNA, 34 bp, Artificial Sequence
  Description of Artificial Sequence: Synthetic oligonucleotide
agaaaagtgtcctgaacagggagggatgatttgg

SEQ ID NO: 229593 - DNA, 33 bp, Artificial Sequence
  Description of Artificial Sequence: Synthetic oligonucleotide
gaaaagtgtcctgaacagggagggatgatttgg

SEQ ID NO: 229594 - DNA, 35 bp, Artificial Sequence
  Description of Artificial Sequence: Synthetic oligonucleotide
aaaagtgtcctgaacagggagggatgatttggaag

SEQ ID NO: 229595 - DNA, 34 bp, Artificial Sequence
  Description of Artificial Sequence: Synthetic oligonucleotide
aaagtgtcctgaacagggagggatgatttggaag

SEQ ID NO: 229596 - DNA, 33 bp, Artificial Sequence
  Description of Artificial Sequence: Synthetic oligonucleotide
aagtgtcctgaacagggagggatgatttggaag

SEQ ID NO: 229597 - DNA, 32 bp, Artificial Sequence
  Description of Artificial Sequence: Synthetic oligonucleotide
agtgtcctgaacagggagggatgatttggaag

SEQ ID NO: 229598 - DNA, 31 bp, Artificial Sequence
  Description of Artificial Sequence: Synthetic oligonucleotide
gtgtcctgaacagggagggatgatttggaag

SEQ ID NO: 229599 - DNA, 35 bp, Artificial Sequence
  Description of Artificial Sequence: Synthetic oligonucleotide
tgtcctgaacagggagggatgatttggaagatatc

SEQ ID NO: 229600 - DNA, 34 bp, Artificial Sequence
  Description of Artificial Sequence: Synthetic oligonucleotide
gtcctgaacagggagggatgatttggaagatatc

SEQ ID NO: 229601 - DNA, 35 bp, Artificial Sequence
  Description of Artificial Sequence: Synthetic oligonucleotide
tcctgaacagggagggatgatttggaagatatctg

SEQ ID NO: 229602 - DNA, 34 bp, Artificial Sequence
  Description of Artificial Sequence: Synthetic oligonucleotide
cctgaacagggagggatgatttggaagatatctg

SEQ ID NO: 229603 - DNA, 36 bp, Artificial Sequence
  Description of Artificial Sequence: Synthetic oligonucleotide
ctgaacagggagggatgatttggaagatatctgaag

SEQ ID NO: 229604 - DNA, 41 bp, Artificial Sequence
  Description of Artificial Sequence: Synthetic oligonucleotide
tgaacagggagggatgatttggaagatatctgaagataaac

SEQ ID NO: 229605 - DNA, 40 bp, Artificial Sequence
  Description of Artificial Sequence: Synthetic oligonucleotide
gaacagggagggatgatttggaagatatctgaagataaac

SEQ ID NO: 229606 - DNA, 41 bp, Artificial Sequence
  Description of Artificial Sequence: Synthetic oligonucleotide
aacagggagggatgatttggaagatatctgaagataaacag

SEQ ID NO: 229607 - DNA, 40 bp, Artificial Sequence
  Description of Artificial Sequence: Synthetic oligonucleotide
acagggagggatgatttggaagatatctgaagataaacag

SEQ ID NO: 229608 - DNA, 39 bp, Artificial Sequence
  Description of Artificial Sequence: Synthetic oligonucleotide
cagggagggatgatttggaagatatctgaagataaacag

SEQ ID NO: 229609 - DNA, 39 bp, Artificial Sequence
  Description of Artificial Sequence: Synthetic oligonucleotide
agggagggatgatttggaagatatctgaagataaacagc

SEQ ID NO: 229610 - DNA, 38 bp, Artificial Sequence
  Description of Artificial Sequence: Synthetic oligonucleotide
gggagggatgatttggaagatatctgaagataaacagc

SEQ ID NO: 229611 - DNA, 40 bp, Artificial Sequence
  Description of Artificial Sequence: Synthetic oligonucleotide
ggagggatgatttggaagatatctgaagataaacagctag

SEQ ID NO: 229612 - DNA, 40 bp, Artificial Sequence
  Description of Artificial Sequence: Synthetic oligonucleotide
gagggatgatttggaagatatctgaagataaacagctagc

SEQ ID NO: 229613 - DNA, 41 bp, Artificial Sequence
  Description of Artificial Sequence: Synthetic oligonucleotide
agggatgatttggaagatatctgaagataaacagctagcag

SEQ ID NO: 229614 - DNA, 40 bp, Artificial Sequence
  Description of Artificial Sequence: Synthetic oligonucleotide
gggatgatttggaagatatctgaagataaacagctagcag

SEQ ID NO: 229615 - DNA, 43 bp, Artificial Sequence
  Description of Artificial Sequence: Synthetic oligonucleotide
ggatgatttggaagatatctgaagataaacagctagcagtttg

SEQ ID NO: 229616 - DNA, 43 bp, Artificial Sequence
  Description of Artificial Sequence: Synthetic oligonucleotide
gatgatttggaagatatctgaagataaacagctagcagtttgc

SEQ ID NO: 229617 - DNA, 43 bp, Artificial Sequence
  Description of Artificial Sequence: Synthetic oligonucleotide
atgatttggaagatatctgaagataaacagctagcagtttgcc

SEQ ID NO: 229618 - DNA, 42 bp, Artificial Sequence
  Description of Artificial Sequence: Synthetic oligonucleotide
tgatttggaagatatctgaagataaacagctagcagtttgcc

SEQ ID NO: 229619 - DNA, 41 bp, Artificial Sequence
  Description of Artificial Sequence: Synthetic oligonucleotide
gatttggaagatatctgaagataaacagctagcagtttgcc

SEQ ID NO: 229620 - DNA, 42 bp, Artificial Sequence
  Description of Artificial Sequence: Synthetic oligonucleotide
atttggaagatatctgaagataaacagctagcagtttgcctg

SEQ ID NO: 229621 - DNA, 41 bp, Artificial Sequence
  Description of Artificial Sequence: Synthetic oligonucleotide
tttggaagatatctgaagataaacagctagcagtttgcctg

SEQ ID NO: 229622 - DNA, 40 bp, Artificial Sequence
  Description of Artificial Sequence: Synthetic oligonucleotide
ttggaagatatctgaagataaacagctagcagtttgcctg

SEQ ID NO: 229623 - DNA, 39 bp, Artificial Sequence
  Description of Artificial Sequence: Synthetic oligonucleotide
tggaagatatctgaagataaacagctagcagtttgcctg

SEQ ID NO: 229624 - DNA, 38 bp, Artificial Sequence
  Description of Artificial Sequence: Synthetic oligonucleotide
ggaagatatctgaagataaacagctagcagtttgcctg

SEQ ID NO: 229625 - DNA, 44 bp, Artificial Sequence
  Description of Artificial Sequence: Synthetic oligonucleotide
gaagatatctgaagataaacagctagcagtttgcctgaaatatg

SEQ ID NO: 229626 - DNA, 44 bp, Artificial Sequence
  Description of Artificial Sequence: Synthetic oligonucleotide
aagatatctgaagataaacagctagcagtttgcctgaaatatgc

SEQ ID NO: 229627 - DNA, 43 bp, Artificial Sequence
  Description of Artificial Sequence: Synthetic oligonucleotide
agatatctgaagataaacagctagcagtttgcctgaaatatgc

SEQ ID NO: 229628 - DNA, 42 bp, Artificial Sequence
  Description of Artificial Sequence: Synthetic oligonucleotide
gatatctgaagataaacagctagcagtttgcctgaaatatgc

SEQ ID NO: 229629 - DNA, 43 bp, Artificial Sequence
  Description of Artificial Sequence: Synthetic oligonucleotide
atatctgaagataaacagctagcagtttgcctgaaatatgctg

SEQ ID NO: 229630 - DNA, 42 bp, Artificial Sequence
  Description of Artificial Sequence: Synthetic oligonucleotide
tatctgaagataaacagctagcagtttgcctgaaatatgctg

SEQ ID NO: 229631 - DNA, 41 bp, Artificial Sequence
  Description of Artificial Sequence: Synthetic oligonucleotide
atctgaagataaacagctagcagtttgcctgaaatatgctg

SEQ ID NO: 229632 - DNA, 40 bp, Artificial Sequence
  Description of Artificial Sequence: Synthetic oligonucleotide
tctgaagataaacagctagcagtttgcctgaaatatgctg

SEQ ID NO: 229633 - DNA, 39 bp, Artificial Sequence
  Description of Artificial Sequence: Synthetic oligonucleotide
ctgaagataaacagctagcagtttgcctgaaatatgctg

SEQ ID NO: 229634 - DNA, 39 bp, Artificial Sequence
  Description of Artificial Sequence: Synthetic oligonucleotide
tgaagataaacagctagcagtttgcctgaaatatgctgg

SEQ ID NO: 229635 - DNA, 38 bp, Artificial Sequence
  Description of Artificial Sequence: Synthetic oligonucleotide
gaagataaacagctagcagtttgcctgaaatatgctgg

SEQ ID NO: 229636 - DNA, 39 bp, Artificial Sequence
  Description of Artificial Sequence: Synthetic oligonucleotide
aagataaacagctagcagtttgcctgaaatatgctggag

SEQ ID NO: 229637 - DNA, 38 bp, Artificial Sequence
  Description of Artificial Sequence: Synthetic oligonucleotide
agataaacagctagcagtttgcctgaaatatgctggag

SEQ ID NO: 229638 - DNA, 37 bp, Artificial Sequence
  Description of Artificial Sequence: Synthetic oligonucleotide
gataaacagctagcagtttgcctgaaatatgctggag

SEQ ID NO: 229639 - DNA, 42 bp, Artificial Sequence
  Description of Artificial Sequence: Synthetic oligonucleotide
ataaacagctagcagtttgcctgaaatatgctggagtatttg

SEQ ID NO: 229640 - DNA, 41 bp, Artificial Sequence
  Description of Artificial Sequence: Synthetic oligonucleotide
taaacagctagcagtttgcctgaaatatgctggagtatttg

SEQ ID NO: 229641 - DNA, 40 bp, Artificial Sequence
  Description of Artificial Sequence: Synthetic oligonucleotide
aaacagctagcagtttgcctgaaatatgctggagtatttg

SEQ ID NO: 229642 - DNA, 39 bp, Artificial Sequence
  Description of Artificial Sequence: Synthetic oligonucleotide
aacagctagcagtttgcctgaaatatgctggagtatttg

SEQ ID NO: 229643 - DNA, 38 bp, Artificial Sequence
  Description of Artificial Sequence: Synthetic oligonucleotide
acagctagcagtttgcctgaaatatgctggagtatttg

SEQ ID NO: 229644 - DNA, 37 bp, Artificial Sequence
  Description of Artificial Sequence: Synthetic oligonucleotide
cagctagcagtttgcctgaaatatgctggagtatttg

SEQ ID NO: 229645 - DNA, 37 bp, Artificial Sequence
  Description of Artificial Sequence: Synthetic oligonucleotide
agctagcagtttgcctgaaatatgctggagtatttgc

SEQ ID NO: 229646 - DNA, 36 bp, Artificial Sequence
  Description of Artificial Sequence: Synthetic oligonucleotide
gctagcagtttgcctgaaatatgctggagtatttgc

SEQ ID NO: 229647 - DNA, 37 bp, Artificial Sequence
  Description of Artificial Sequence: Synthetic oligonucleotide
ctagcagtttgcctgaaatatgctggagtatttgcag

SEQ ID NO: 229648 - DNA, 42 bp, Artificial Sequence
  Description of Artificial Sequence: Synthetic oligonucleotide
tagcagtttgcctgaaatatgctggagtatttgcagaaaatg

SEQ ID NO: 229649 - DNA, 41 bp, Artificial Sequence
  Description of Artificial Sequence: Synthetic oligonucleotide
agcagtttgcctgaaatatgctggagtatttgcagaaaatg

SEQ ID NO: 229650 - DNA, 40 bp, Artificial Sequence
  Description of Artificial Sequence: Synthetic oligonucleotide
gcagtttgcctgaaatatgctggagtatttgcagaaaatg

SEQ ID NO: 229651 - DNA, 40 bp, Artificial Sequence
  Description of Artificial Sequence: Synthetic oligonucleotide
cagtttgcctgaaatatgctggagtatttgcagaaaatgc

SEQ ID NO: 229652 - DNA, 41 bp, Artificial Sequence
  Description of Artificial Sequence: Synthetic oligonucleotide
agtttgcctgaaatatgctggagtatttgcagaaaatgcag

SEQ ID NO: 229653 - DNA, 40 bp, Artificial Sequence
  Description of Artificial Sequence: Synthetic oligonucleotide
gtttgcctgaaatatgctggagtatttgcagaaaatgcag

SEQ ID NO: 229654 - DNA, 42 bp, Artificial Sequence
  Description of Artificial Sequence: Synthetic oligonucleotide
tttgcctgaaatatgctggagtatttgcagaaaatgcagaag

SEQ ID NO: 229655 - DNA, 41 bp, Artificial Sequence
  Description of Artificial Sequence: Synthetic oligonucleotide
ttgcctgaaatatgctggagtatttgcagaaaatgcagaag

SEQ ID NO: 229656 - DNA, 40 bp, Artificial Sequence
  Description of Artificial Sequence: Synthetic oligonucleotide
tgcctgaaatatgctggagtatttgcagaaaatgcagaag

SEQ ID NO: 229657 - DNA, 39 bp, Artificial Sequence
  Description of Artificial Sequence: Synthetic oligonucleotide
gcctgaaatatgctggagtatttgcagaaaatgcagaag

SEQ ID NO: 229658 - DNA, 41 bp, Artificial Sequence
  Description of Artificial Sequence: Synthetic oligonucleotide
cctgaaatatgctggagtatttgcagaaaatgcagaagatg

SEQ ID NO: 229659 - DNA, 41 bp, Artificial Sequence
  Description of Artificial Sequence: Synthetic oligonucleotide
ctgaaatatgctggagtatttgcagaaaatgcagaagatgc

SEQ ID NO: 229660 - DNA, 42 bp, Artificial Sequence
  Description of Artificial Sequence: Synthetic oligonucleotide
tgaaatatgctggagtatttgcagaaaatgcagaagatgctg

SEQ ID NO: 229661 - DNA, 41 bp, Artificial Sequence
  Description of Artificial Sequence: Synthetic oligonucleotide
gaaatatgctggagtatttgcagaaaatgcagaagatgctg

SEQ ID NO: 229662 - DNA, 43 bp, Artificial Sequence
  Description of Artificial Sequence: Synthetic oligonucleotide
aaatatgctggagtatttgcagaaaatgcagaagatgctgatg

SEQ ID NO: 229663 - DNA, 42 bp, Artificial Sequence
  Description of Artificial Sequence: Synthetic oligonucleotide
aatatgctggagtatttgcagaaaatgcagaagatgctgatg

SEQ ID NO: 229664 - DNA, 41 bp, Artificial Sequence
  Description of Artificial Sequence: Synthetic oligonucleotide
atatgctggagtatttgcagaaaatgcagaagatgctgatg

SEQ ID NO: 229665 - DNA, 40 bp, Artificial Sequence
  Description of Artificial Sequence: Synthetic oligonucleotide
tatgctggagtatttgcagaaaatgcagaagatgctgatg

SEQ ID NO: 229666 - DNA, 39 bp, Artificial Sequence
  Description of Artificial Sequence: Synthetic oligonucleotide
atgctggagtatttgcagaaaatgcagaagatgctgatg

SEQ ID NO: 229667 - DNA, 38 bp, Artificial Sequence
  Description of Artificial Sequence: Synthetic oligonucleotide
tgctggagtatttgcagaaaatgcagaagatgctgatg

SEQ ID NO: 229668 - DNA, 37 bp, Artificial Sequence
  Description of Artificial Sequence: Synthetic oligonucleotide
gctggagtatttgcagaaaatgcagaagatgctgatg

SEQ ID NO: 229669 - DNA, 37 bp, Artificial Sequence
  Description of Artificial Sequence: Synthetic oligonucleotide
ctggagtatttgcagaaaatgcagaagatgctgatgg

SEQ ID NO: 229670 - DNA, 41 bp, Artificial Sequence
  Description of Artificial Sequence: Synthetic oligonucleotide
tggagtatttgcagaaaatgcagaagatgctgatggaaaag

SEQ ID NO: 229671 - DNA, 40 bp, Artificial Sequence
  Description of Artificial Sequence: Synthetic oligonucleotide
ggagtatttgcagaaaatgcagaagatgctgatggaaaag

SEQ ID NO: 229672 - DNA, 42 bp, Artificial Sequence
  Description of Artificial Sequence: Synthetic oligonucleotide
gagtatttgcagaaaatgcagaagatgctgatggaaaagatg

SEQ ID NO: 229673 - DNA, 51 bp, Artificial Sequence
  Description of Artificial Sequence: Synthetic oligonucleotide
agtatttgcagaaaatgcagaagatgctgatggaaaagatgtatttaatac

SEQ ID NO: 229674 - DNA, 50 bp, Artificial Sequence
  Description of Artificial Sequence: Synthetic oligonucleotide
gtatttgcagaaaatgcagaagatgctgatggaaaagatgtatttaatac

SEQ ID NO: 229675 - DNA, 50 bp, Artificial Sequence
  Description of Artificial Sequence: Synthetic oligonucleotide
tatttgcagaaaatgcagaagatgctgatggaaaagatgtatttaatacc

SEQ ID NO: 229676 - DNA, 49 bp, Artificial Sequence
  Description of Artificial Sequence: Synthetic oligonucleotide
atttgcagaaaatgcagaagatgctgatggaaaagatgtatttaatacc

SEQ ID NO: 229677 - DNA, 48 bp, Artificial Sequence
  Description of Artificial Sequence: Synthetic oligonucleotide
tttgcagaaaatgcagaagatgctgatggaaaagatgtatttaatacc

SEQ ID NO: 229678 - DNA, 47 bp, Artificial Sequence
  Description of Artificial Sequence: Synthetic oligonucleotide
ttgcagaaaatgcagaagatgctgatggaaaagatgtatttaatacc

SEQ ID NO: 229679 - DNA, 46 bp, Artificial Sequence
  Description of Artificial Sequence: Synthetic oligonucleotide
tgcagaaaatgcagaagatgctgatggaaaagatgtatttaatacc

SEQ ID NO: 229680 - DNA, 45 bp, Artificial Sequence
  Description of Artificial Sequence: Synthetic oligonucleotide
gcagaaaatgcagaagatgctgatggaaaagatgtatttaatacc

SEQ ID NO: 229681 - DNA, 49 bp, Artificial Sequence
  Description of Artificial Sequence: Synthetic oligonucleotide
cagaaaatgcagaagatgctgatggaaaagatgtatttaataccaaatc

SEQ ID NO: 229682 - DNA, 50 bp, Artificial Sequence
  Description of Artificial Sequence: Synthetic oligonucleotide
agaaaatgcagaagatgctgatggaaaagatgtatttaataccaaatctg

SEQ ID NO: 229683 - DNA, 49 bp, Artificial Sequence
  Description of Artificial Sequence: Synthetic oligonucleotide
gaaaatgcagaagatgctgatggaaaagatgtatttaataccaaatctg

SEQ ID NO: 229684 - DNA, 51 bp, Artificial Sequence
  Description of Artificial Sequence: Synthetic oligonucleotide
aaaatgcagaagatgctgatggaaaagatgtatttaataccaaatctgttg

SEQ ID NO: 229685 - DNA, 50 bp, Artificial Sequence
  Description of Artificial Sequence: Synthetic oligonucleotide
aaatgcagaagatgctgatggaaaagatgtatttaataccaaatctgttg

SEQ ID NO: 229686 - DNA, 49 bp, Artificial Sequence
  Description of Artificial Sequence: Synthetic oligonucleotide
aatgcagaagatgctgatggaaaagatgtatttaataccaaatctgttg

SEQ ID NO: 229687 - DNA, 48 bp, Artificial Sequence
  Description of Artificial Sequence: Synthetic oligonucleotide
atgcagaagatgctgatggaaaagatgtatttaataccaaatctgttg

SEQ ID NO: 229688 - DNA, 47 bp, Artificial Sequence
  Description of Artificial Sequence: Synthetic oligonucleotide
tgcagaagatgctgatggaaaagatgtatttaataccaaatctgttg

SEQ ID NO: 229689 - DNA, 46 bp, Artificial Sequence
  Description of Artificial Sequence: Synthetic oligonucleotide
gcagaagatgctgatggaaaagatgtatttaataccaaatctgttg

SEQ ID NO: 229690 - DNA, 46 bp, Artificial Sequence
  Description of Artificial Sequence: Synthetic oligonucleotide
cagaagatgctgatggaaaagatgtatttaataccaaatctgttgg

SEQ ID NO: 229691 - DNA, 46 bp, Artificial Sequence
  Description of Artificial Sequence: Synthetic oligonucleotide
agaagatgctgatggaaaagatgtatttaataccaaatctgttggg

SEQ ID NO: 229692 - DNA, 45 bp, Artificial Sequence
  Description of Artificial Sequence: Synthetic oligonucleotide
gaagatgctgatggaaaagatgtatttaataccaaatctgttggg

SEQ ID NO: 229693 - DNA, 45 bp, Artificial Sequence
  Description of Artificial Sequence: Synthetic oligonucleotide
aagatgctgatggaaaagatgtatttaataccaaatctgttgggc

SEQ ID NO: 229694 - DNA, 44 bp, Artificial Sequence
  Description of Artificial Sequence: Synthetic oligonucleotide
agatgctgatggaaaagatgtatttaataccaaatctgttgggc

SEQ ID NO: 229695 - DNA, 43 bp, Artificial Sequence
  Description of Artificial Sequence: Synthetic oligonucleotide
gatgctgatggaaaagatgtatttaataccaaatctgttgggc

SEQ ID NO: 229696 - DNA, 46 bp, Artificial Sequence
  Description of Artificial Sequence: Synthetic oligonucleotide
atgctgatggaaaagatgtatttaataccaaatctgttgggctttc

SEQ ID NO: 229697 - DNA, 45 bp, Artificial Sequence
  Description of Artificial Sequence: Synthetic oligonucleotide
tgctgatggaaaagatgtatttaataccaaatctgttgggctttc

SEQ ID NO: 229698 - DNA, 44 bp, Artificial Sequence
  Description of Artificial Sequence: Synthetic oligonucleotide
gctgatggaaaagatgtatttaataccaaatctgttgggctttc

SEQ ID NO: 229699 - DNA, 51 bp, Artificial Sequence
  Description of Artificial Sequence: Synthetic oligonucleotide
ctgatggaaaagatgtatttaataccaaatctgttgggctttctattaaag

SEQ ID NO: 229700 - DNA, 52 bp, Artificial Sequence
  Description of Artificial Sequence: Synthetic oligonucleotide
tgatggaaaagatgtatttaataccaaatctgttgggctttctattaaagag

SEQ ID NO: 229701 - skipped

SEQ ID NO: 229702 - DNA, 51 bp, Artificial Sequence
  Description of Artificial Sequence: Synthetic oligonucleotide
gatggaaaagatgtatttaataccaaatctgttgggctttctattaaagag

SEQ ID NO: 229703 - DNA, 51 bp, Artificial Sequence
  Description of Artificial Sequence: Synthetic oligonucleotide
atggaaaagatgtatttaataccaaatctgttgggctttctattaaagagg

SEQ ID NO: 229704 - DNA, 50 bp, Artificial Sequence
  Description of Artificial Sequence: Synthetic oligonucleotide
tggaaaagatgtatttaataccaaatctgttgggctttctattaaagagg

SEQ ID NO: 229705 - DNA, 49 bp, Artificial Sequence
  Description of Artificial Sequence: Synthetic oligonucleotide
ggaaaagatgtatttaataccaaatctgttgggctttctattaaagagg

SEQ ID NO: 229706 - DNA, 49 bp, Artificial Sequence
  Description of Artificial Sequence: Synthetic oligonucleotide
gaaaagatgtatttaataccaaatctgttgggctttctattaaagaggc

SEQ ID NO: 229707 - DNA, 52 bp, Artificial Sequence
  Description of Artificial Sequence: Synthetic oligonucleotide
aaaagatgtatttaataccaaatctgttgggctttctattaaagaggcaatg

SEQ ID NO: 229708 - DNA, 51 bp, Artificial Sequence
  Description of Artificial Sequence: Synthetic oligonucleotide
aaagatgtatttaataccaaatctgttgggctttctattaaagaggcaatg

SEQ ID NO: 229709 - DNA, 50 bp, Artificial Sequence
  Description of Artificial Sequence: Synthetic oligonucleotide
aagatgtatttaataccaaatctgttgggctttctattaaagaggcaatg

SEQ ID NO: 229710 - DNA, 49 bp, Artificial Sequence
  Description of Artificial Sequence: Synthetic oligonucleotide
agatgtatttaataccaaatctgttgggctttctattaaagaggcaatg

SEQ ID NO: 229711 - DNA, 48 bp, Artificial Sequence
  Description of Artificial Sequence: Synthetic oligonucleotide
gatgtatttaataccaaatctgttgggctttctattaaagaggcaatg

SEQ ID NO: 229712 - DNA, 49 bp, Artificial Sequence
  Description of Artificial Sequence: Synthetic oligonucleotide
atgtatttaataccaaatctgttgggctttctattaaagaggcaatgac

SEQ ID NO: 229713 - DNA, 48 bp, Artificial Sequence
  Description of Artificial Sequence: Synthetic oligonucleotide
tgtatttaataccaaatctgttgggctttctattaaagaggcaatgac

SEQ ID NO: 229714 - DNA, 47 bp, Artificial Sequence
  Description of Artificial Sequence: Synthetic oligonucleotide
gtatttaataccaaatctgttgggctttctattaaagaggcaatgac

SEQ ID NO: 229715 - DNA, 51 bp, Artificial Sequence
  Description of Artificial Sequence: Synthetic oligonucleotide
tatttaataccaaatctgttgggctttctattaaagaggcaatgacttatc

SEQ ID NO: 229716 - DNA, 50 bp, Artificial Sequence
  Description of Artificial Sequence: Synthetic oligonucleotide
atttaataccaaatctgttgggctttctattaaagaggcaatgacttatc

SEQ ID NO: 229717 - DNA, 49 bp, Artificial Sequence
  Description of Artificial Sequence: Synthetic oligonucleotide
tttaataccaaatctgttgggctttctattaaagaggcaatgacttatc

SEQ ID NO: 229718 - DNA, 48 bp, Artificial Sequence
  Description of Artificial Sequence: Synthetic oligonucleotide
ttaataccaaatctgttgggctttctattaaagaggcaatgacttatc

SEQ ID NO: 229719 - DNA, 47 bp, Artificial Sequence
  Description of Artificial Sequence: Synthetic oligonucleotide
taataccaaatctgttgggctttctattaaagaggcaatgacttatc

SEQ ID NO: 229720 - DNA, 46 bp, Artificial Sequence
  Description of Artificial Sequence: Synthetic oligonucleotide
aataccaaatctgttgggctttctattaaagaggcaatgacttatc

SEQ ID NO: 229721 - DNA, 45 bp, Artificial Sequence
  Description of Artificial Sequence: Synthetic oligonucleotide
ataccaaatctgttgggctttctattaaagaggcaatgacttatc

SEQ ID NO: 229722 - DNA, 44 bp, Artificial Sequence
  Description of Artificial Sequence: Synthetic oligonucleotide
taccaaatctgttgggctttctattaaagaggcaatgacttatc

SEQ ID NO: 229723 - DNA, 43 bp, Artificial Sequence
  Description of Artificial Sequence: Synthetic oligonucleotide
accaaatctgttgggctttctattaaagaggcaatgacttatc

SEQ ID NO: 229724 - DNA, 42 bp, Artificial Sequence
  Description of Artificial Sequence: Synthetic oligonucleotide
ccaaatctgttgggctttctattaaagaggcaatgacttatc

SEQ ID NO: 229725 - DNA, 43 bp, Artificial Sequence
  Description of Artificial Sequence: Synthetic oligonucleotide
caaatctgttgggctttctattaaagaggcaatgacttatcac

SEQ ID NO: 229726 - DNA, 43 bp, Artificial Sequence
  Description of Artificial Sequence: Synthetic oligonucleotide
aaatctgttgggctttctattaaagaggcaatgacttatcacc

SEQ ID NO: 229727 - DNA, 42 bp, Artificial Sequence
  Description of Artificial Sequence: Synthetic oligonucleotide
aatctgttgggctttctattaaagaggcaatgacttatcacc

SEQ ID NO: 229728 - DNA, 41 bp, Artificial Sequence
  Description of Artificial Sequence: Synthetic oligonucleotide
atctgttgggctttctattaaagaggcaatgacttatcacc

SEQ ID NO: 229729 - DNA, 40 bp, Artificial Sequence
  Description of Artificial Sequence: Synthetic oligonucleotide
tctgttgggctttctattaaagaggcaatgacttatcacc

SEQ ID NO: 229730 - DNA, 39 bp, Artificial Sequence
  Description of Artificial Sequence: Synthetic oligonucleotide
ctgttgggctttctattaaagaggcaatgacttatcacc

SEQ ID NO: 229731 - DNA, 39 bp, Artificial Sequence
  Description of Artificial Sequence: Synthetic oligonucleotide
tgttgggctttctattaaagaggcaatgacttatcaccc

SEQ ID NO: 229732 - DNA, 38 bp, Artificial Sequence
  Description of Artificial Sequence: Synthetic oligonucleotide
gttgggctttctattaaagaggcaatgacttatcaccc

SEQ ID NO: 229733 - DNA, 38 bp, Artificial Sequence
  Description of Artificial Sequence: Synthetic oligonucleotide
ttgggctttctattaaagaggcaatgacttatcacccc

SEQ ID NO: 229734 - DNA, 37 bp, Artificial Sequence
  Description of Artificial Sequence: Synthetic oligonucleotide
tgggctttctattaaagaggcaatgacttatcacccc

SEQ ID NO: 229735 - DNA, 36 bp, Artificial Sequence
  Description of Artificial Sequence: Synthetic oligonucleotide
gggctttctattaaagaggcaatgacttatcacccc

SEQ ID NO: 229736 - DNA, 38 bp, Artificial Sequence
  Description of Artificial Sequence: Synthetic oligonucleotide
ggctttctattaaagaggcaatgacttatcaccccaac

SEQ ID NO: 229737 - DNA, 38 bp, Artificial Sequence
  Description of Artificial Sequence: Synthetic oligonucleotide
gctttctattaaagaggcaatgacttatcaccccaacc

SEQ ID NO: 229738 - DNA, 39 bp, Artificial Sequence
  Description of Artificial Sequence: Synthetic oligonucleotide
ctttctattaaagaggcaatgacttatcaccccaaccag

SEQ ID NO: 229739 - DNA, 39 bp, Artificial Sequence
  Description of Artificial Sequence: Synthetic oligonucleotide
tttctattaaagaggcaatgacttatcaccccaaccagg

SEQ ID NO: 229740 - DNA, 38 bp, Artificial Sequence
  Description of Artificial Sequence: Synthetic oligonucleotide
ttctattaaagaggcaatgacttatcaccccaaccagg

SEQ ID NO: 229741 - DNA, 37 bp, Artificial Sequence
  Description of Artificial Sequence: Synthetic oligonucleotide
tctattaaagaggcaatgacttatcaccccaaccagg

SEQ ID NO: 229742 - DNA, 36 bp, Artificial Sequence
  Description of Artificial Sequence: Synthetic oligonucleotide
ctattaaagaggcaatgacttatcaccccaaccagg

SEQ ID NO: 229743 - DNA, 38 bp, Artificial Sequence
  Description of Artificial Sequence: Synthetic oligonucleotide
tattaaagaggcaatgacttatcaccccaaccaggtag

SEQ ID NO: 229744 - DNA, 37 bp, Artificial Sequence
  Description of Artificial Sequence: Synthetic oligonucleotide
attaaagaggcaatgacttatcaccccaaccaggtag

SEQ ID NO: 229745 - DNA, 36 bp, Artificial Sequence
  Description of Artificial Sequence: Synthetic oligonucleotide
ttaaagaggcaatgacttatcaccccaaccaggtag

SEQ ID NO: 229746 - DNA, 35 bp, Artificial Sequence
  Description of Artificial Sequence: Synthetic oligonucleotide
taaagaggcaatgacttatcaccccaaccaggtag

SEQ ID NO: 229747 - DNA, 34 bp, Artificial Sequence
  Description of Artificial Sequence: Synthetic oligonucleotide
aaagaggcaatgacttatcaccccaaccaggtag

SEQ ID NO: 229748 - DNA, 33 bp, Artificial Sequence
  Description of Artificial Sequence: Synthetic oligonucleotide
aagaggcaatgacttatcaccccaaccaggtag

SEQ ID NO: 229749 - DNA, 32 bp, Artificial Sequence
  Description of Artificial Sequence: Synthetic oligonucleotide
agaggcaatgacttatcaccccaaccaggtag

SEQ ID NO: 229750 - DNA, 31 bp, Artificial Sequence
  Description of Artificial Sequence: Synthetic oligonucleotide
gaggcaatgacttatcaccccaaccaggtag

SEQ ID NO: 229751 - DNA, 33 bp, Artificial Sequence
  Description of Artificial Sequence: Synthetic oligonucleotide
aggcaatgacttatcaccccaaccaggtagtag

SEQ ID NO: 229752 - DNA, 32 bp, Artificial Sequence
  Description of Artificial Sequence: Synthetic oligonucleotide
ggcaatgacttatcaccccaaccaggtagtag

SEQ ID NO: 229753 - DNA, 34 bp, Artificial Sequence
  Description of Artificial Sequence: Synthetic oligonucleotide
gcaatgacttatcaccccaaccaggtagtagaag

SEQ ID NO: 229754 - DNA, 34 bp, Artificial Sequence
  Description of Artificial Sequence: Synthetic oligonucleotide
caatgacttatcaccccaaccaggtagtagaagg

SEQ ID NO: 229755 - DNA, 34 bp, Artificial Sequence
  Description of Artificial Sequence: Synthetic oligonucleotide
aatgacttatcaccccaaccaggtagtagaaggc

SEQ ID NO: 229756 - DNA, 33 bp, Artificial Sequence
  Description of Artificial Sequence: Synthetic oligonucleotide
atgacttatcaccccaaccaggtagtagaaggc

SEQ ID NO: 229757 - DNA, 32 bp, Artificial Sequence
  Description of Artificial Sequence: Synthetic oligonucleotide
tgacttatcaccccaaccaggtagtagaaggc

SEQ ID NO: 229758 - DNA, 31 bp, Artificial Sequence
  Description of Artificial Sequence: Synthetic oligonucleotide
gacttatcaccccaaccaggtagtagaaggc

SEQ ID NO: 229759 - DNA, 32 bp, Artificial Sequence
  Description of Artificial Sequence: Synthetic oligonucleotide
acttatcaccccaaccaggtagtagaaggctg

SEQ ID NO: 229760 - DNA, 31 bp, Artificial Sequence
  Description of Artificial Sequence: Synthetic oligonucleotide
cttatcaccccaaccaggtagtagaaggctg

SEQ ID NO: 229761 - DNA, 33 bp, Artificial Sequence
  Description of Artificial Sequence: Synthetic oligonucleotide
ttatcaccccaaccaggtagtagaaggctgttg

SEQ ID NO: 229762 - DNA, 32 bp, Artificial Sequence
  Description of Artificial Sequence: Synthetic oligonucleotide
tatcaccccaaccaggtagtagaaggctgttg

SEQ ID NO: 229763 - DNA, 31 bp, Artificial Sequence
  Description of Artificial Sequence: Synthetic oligonucleotide
atcaccccaaccaggtagtagaaggctgttg

SEQ ID NO: 229764 - DNA, 30 bp, Artificial Sequence
  Description of Artificial Sequence: Synthetic oligonucleotide
tcaccccaaccaggtagtagaaggctgttg

SEQ ID NO: 229765 - DNA, 29 bp, Artificial Sequence
  Description of Artificial Sequence: Synthetic oligonucleotide
caccccaaccaggtagtagaaggctgttg

SEQ ID NO: 229766 - DNA, 31 bp, Artificial Sequence
  Description of Artificial Sequence: Synthetic oligonucleotide
accccaaccaggtagtagaaggctgttgttc

SEQ ID NO: 229767 - DNA, 30 bp, Artificial Sequence
  Description of Artificial Sequence: Synthetic oligonucleotide
ccccaaccaggtagtagaaggctgttgttc

SEQ ID NO: 229768 - DNA, 31 bp, Artificial Sequence
  Description of Artificial Sequence: Synthetic oligonucleotide
cccaaccaggtagtagaaggctgttgttcag

SEQ ID NO: 229769 - DNA, 35 bp, Artificial Sequence
  Description of Artificial Sequence: Synthetic oligonucleotide
ccaaccaggtagtagaaggctgttgttcagatatg

SEQ ID NO: 229770 - DNA, 35 bp, Artificial Sequence
  Description of Artificial Sequence: Synthetic oligonucleotide
caaccaggtagtagaaggctgttgttcagatatgg

SEQ ID NO: 229771 - DNA, 35 bp, Artificial Sequence
  Description of Artificial Sequence: Synthetic oligonucleotide
aaccaggtagtagaaggctgttgttcagatatggc

SEQ ID NO: 229772 - DNA, 34 bp, Artificial Sequence
  Description of Artificial Sequence: Synthetic oligonucleotide
accaggtagtagaaggctgttgttcagatatggc

SEQ ID NO: 229773 - DNA, 33 bp, Artificial Sequence
  Description of Artificial Sequence: Synthetic oligonucleotide
ccaggtagtagaaggctgttgttcagatatggc

SEQ ID NO: 229774 - DNA, 34 bp, Artificial Sequence
  Description of Artificial Sequence: Synthetic oligonucleotide
caggtagtagaaggctgttgttcagatatggctg

SEQ ID NO: 229775 - DNA, 37 bp, Artificial Sequence
  Description of Artificial Sequence: Synthetic oligonucleotide
aggtagtagaaggctgttgttcagatatggctgttac

SEQ ID NO: 229776 - DNA, 36 bp, Artificial Sequence
  Description of Artificial Sequence: Synthetic oligonucleotide
ggtagtagaaggctgttgttcagatatggctgttac

SEQ ID NO: 229777 - DNA, 43 bp, Artificial Sequence
  Description of Artificial Sequence: Synthetic oligonucleotide
gtagtagaaggctgttgttcagatatggctgttacttttaatg

SEQ ID NO: 229778 - DNA, 43 bp, Artificial Sequence
  Description of Artificial Sequence: Synthetic oligonucleotide
tagtagaaggctgttgttcagatatggctgttacttttaatgg

SEQ ID NO: 229779 - DNA, 42 bp, Artificial Sequence
  Description of Artificial Sequence: Synthetic oligonucleotide
agtagaaggctgttgttcagatatggctgttacttttaatgg

SEQ ID NO: 229780 - DNA, 41 bp, Artificial Sequence
  Description of Artificial Sequence: Synthetic oligonucleotide
gtagaaggctgttgttcagatatggctgttacttttaatgg

SEQ ID NO: 229781 - DNA, 42 bp, Artificial Sequence
  Description of Artificial Sequence: Synthetic oligonucleotide
tagaaggctgttgttcagatatggctgttacttttaatggac

SEQ ID NO: 229782 - DNA, 41 bp, Artificial Sequence
  Description of Artificial Sequence: Synthetic oligonucleotide
agaaggctgttgttcagatatggctgttacttttaatggac

SEQ ID NO: 229783 - DNA, 40 bp, Artificial Sequence
  Description of Artificial Sequence: Synthetic oligonucleotide
gaaggctgttgttcagatatggctgttacttttaatggac

SEQ ID NO: 229784 - DNA, 41 bp, Artificial Sequence
  Description of Artificial Sequence: Synthetic oligonucleotide
aaggctgttgttcagatatggctgttacttttaatggactg

SEQ ID NO: 229785 - DNA, 40 bp, Artificial Sequence
  Description of Artificial Sequence: Synthetic oligonucleotide
aggctgttgttcagatatggctgttacttttaatggactg

SEQ ID NO: 229786 - DNA, 39 bp, Artificial Sequence
  Description of Artificial Sequence: Synthetic oligonucleotide
ggctgttgttcagatatggctgttacttttaatggactg

SEQ ID NO: 229787 - DNA, 40 bp, Artificial Sequence
  Description of Artificial Sequence: Synthetic oligonucleotide
gctgttgttcagatatggctgttacttttaatggactgac

SEQ ID NO: 229788 - DNA, 41 bp, Artificial Sequence
  Description of Artificial Sequence: Synthetic oligonucleotide
ctgttgttcagatatggctgttacttttaatggactgactc

SEQ ID NO: 229789 - DNA, 41 bp, Artificial Sequence
  Description of Artificial Sequence: Synthetic oligonucleotide
tgttgttcagatatggctgttacttttaatggactgactcc

SEQ ID NO: 229790 - DNA, 40 bp, Artificial Sequence
  Description of Artificial Sequence: Synthetic oligonucleotide
gttgttcagatatggctgttacttttaatggactgactcc

SEQ ID NO: 229791 - DNA, 44 bp, Artificial Sequence
  Description of Artificial Sequence: Synthetic oligonucleotide
ttgttcagatatggctgttacttttaatggactgactccaaatc

SEQ ID NO: 229792 - DNA, 43 bp, Artificial Sequence
  Description of Artificial Sequence: Synthetic oligonucleotide
tgttcagatatggctgttacttttaatggactgactccaaatc

SEQ ID NO: 229793 - DNA, 42 bp, Artificial Sequence
  Description of Artificial Sequence: Synthetic oligonucleotide
gttcagatatggctgttacttttaatggactgactccaaatc

SEQ ID NO: 229794 - DNA, 43 bp, Artificial Sequence
  Description of Artificial Sequence: Synthetic oligonucleotide
ttcagatatggctgttacttttaatggactgactccaaatcag

SEQ ID NO: 229795 - DNA, 42 bp, Artificial Sequence
  Description of Artificial Sequence: Synthetic oligonucleotide
tcagatatggctgttacttttaatggactgactccaaatcag

SEQ ID NO: 229796 - DNA, 41 bp, Artificial Sequence
  Description of Artificial Sequence: Synthetic oligonucleotide
cagatatggctgttacttttaatggactgactccaaatcag

SEQ ID NO: 229797 - DNA, 43 bp, Artificial Sequence
  Description of Artificial Sequence: Synthetic oligonucleotide
agatatggctgttacttttaatggactgactccaaatcagatg

SEQ ID NO: 229798 - DNA, 42 bp, Artificial Sequence
  Description of Artificial Sequence: Synthetic oligonucleotide
gatatggctgttacttttaatggactgactccaaatcagatg

SEQ ID NO: 229799 - DNA, 42 bp, Artificial Sequence
  Description of Artificial Sequence: Synthetic oligonucleotide
atatggctgttacttttaatggactgactccaaatcagatgc

SEQ ID NO: 229800 - DNA, 41 bp, Artificial Sequence
  Description of Artificial Sequence: Synthetic oligonucleotide
tatggctgttacttttaatggactgactccaaatcagatgc

SEQ ID NO: 229801 - DNA, 40 bp, Artificial Sequence
  Description of Artificial Sequence: Synthetic oligonucleotide
atggctgttacttttaatggactgactccaaatcagatgc

SEQ ID NO: 229802 - DNA, 39 bp, Artificial Sequence
  Description of Artificial Sequence: Synthetic oligonucleotide
tggctgttacttttaatggactgactccaaatcagatgc

SEQ ID NO: 229803 - DNA, 38 bp, Artificial Sequence
  Description of Artificial Sequence: Synthetic oligonucleotide
ggctgttacttttaatggactgactccaaatcagatgc

SEQ ID NO: 229804 - DNA, 40 bp, Artificial Sequence
  Description of Artificial Sequence: Synthetic oligonucleotide
gctgttacttttaatggactgactccaaatcagatgcatg

SEQ ID NO: 229805 - DNA, 41 bp, Artificial Sequence
  Description of Artificial Sequence: Synthetic oligonucleotide
ctgttacttttaatggactgactccaaatcagatgcatgtg

SEQ ID NO: 229806 - DNA, 43 bp, Artificial Sequence
  Description of Artificial Sequence: Synthetic oligonucleotide
tgttacttttaatggactgactccaaatcagatgcatgtgatg

SEQ ID NO: 229807 - DNA, 42 bp, Artificial Sequence
  Description of Artificial Sequence: Synthetic oligonucleotide
gttacttttaatggactgactccaaatcagatgcatgtgatg

SEQ ID NO: 229808 - DNA, 44 bp, Artificial Sequence
  Description of Artificial Sequence: Synthetic oligonucleotide
ttacttttaatggactgactccaaatcagatgcatgtgatgatg

SEQ ID NO: 229809 - DNA, 43 bp, Artificial Sequence
  Description of Artificial Sequence: Synthetic oligonucleotide
tacttttaatggactgactccaaatcagatgcatgtgatgatg

SEQ ID NO: 229810 - DNA, 42 bp, Artificial Sequence
  Description of Artificial Sequence: Synthetic oligonucleotide
acttttaatggactgactccaaatcagatgcatgtgatgatg

SEQ ID NO: 229811 - DNA, 41 bp, Artificial Sequence
  Description of Artificial Sequence: Synthetic oligonucleotide
cttttaatggactgactccaaatcagatgcatgtgatgatg

SEQ ID NO: 229812 - DNA, 44 bp, Artificial Sequence
  Description of Artificial Sequence: Synthetic oligonucleotide
ttttaatggactgactccaaatcagatgcatgtgatgatgtatg

SEQ ID NO: 229813 - DNA, 43 bp, Artificial Sequence
  Description of Artificial Sequence: Synthetic oligonucleotide
tttaatggactgactccaaatcagatgcatgtgatgatgtatg

SEQ ID NO: 229814 - DNA, 42 bp, Artificial Sequence
  Description of Artificial Sequence: Synthetic oligonucleotide
ttaatggactgactccaaatcagatgcatgtgatgatgtatg

SEQ ID NO: 229815 - DNA, 41 bp, Artificial Sequence
  Description of Artificial Sequence: Synthetic oligonucleotide
taatggactgactccaaatcagatgcatgtgatgatgtatg

SEQ ID NO: 229816 - DNA, 40 bp, Artificial Sequence
  Description of Artificial Sequence: Synthetic oligonucleotide
aatggactgactccaaatcagatgcatgtgatgatgtatg

SEQ ID NO: 229817 - DNA, 39 bp, Artificial Sequence
  Description of Artificial Sequence: Synthetic oligonucleotide
atggactgactccaaatcagatgcatgtgatgatgtatg

SEQ ID NO: 229818 - DNA, 38 bp, Artificial Sequence
  Description of Artificial Sequence: Synthetic oligonucleotide
tggactgactccaaatcagatgcatgtgatgatgtatg

SEQ ID NO: 229819 - DNA, 37 bp, Artificial Sequence
  Description of Artificial Sequence: Synthetic oligonucleotide
ggactgactccaaatcagatgcatgtgatgatgtatg

SEQ ID NO: 229820 - DNA, 37 bp, Artificial Sequence
  Description of Artificial Sequence: Synthetic oligonucleotide
gactgactccaaatcagatgcatgtgatgatgtatgg

SEQ ID NO: 229821 - DNA, 37 bp, Artificial Sequence
  Description of Artificial Sequence: Synthetic oligonucleotide
actgactccaaatcagatgcatgtgatgatgtatggg

SEQ ID NO: 229822 - DNA, 36 bp, Artificial Sequence
  Description of Artificial Sequence: Synthetic oligonucleotide
ctgactccaaatcagatgcatgtgatgatgtatggg

SEQ ID NO: 229823 - DNA, 36 bp, Artificial Sequence
  Description of Artificial Sequence: Synthetic oligonucleotide
tgactccaaatcagatgcatgtgatgatgtatgggg

SEQ ID NO: 229824 - DNA, 35 bp, Artificial Sequence
  Description of Artificial Sequence: Synthetic oligonucleotide
gactccaaatcagatgcatgtgatgatgtatgggg

SEQ ID NO: 229825 - DNA, 39 bp, Artificial Sequence
  Description of Artificial Sequence: Synthetic oligonucleotide
actccaaatcagatgcatgtgatgatgtatggggtatac

SEQ ID NO: 229826 - DNA, 38 bp, Artificial Sequence
  Description of Artificial Sequence: Synthetic oligonucleotide
ctccaaatcagatgcatgtgatgatgtatggggtatac

SEQ ID NO: 229827 - DNA, 38 bp, Artificial Sequence
  Description of Artificial Sequence: Synthetic oligonucleotide
tccaaatcagatgcatgtgatgatgtatggggtatacc

SEQ ID NO: 229828 - DNA, 37 bp, Artificial Sequence
  Description of Artificial Sequence: Synthetic oligonucleotide
ccaaatcagatgcatgtgatgatgtatggggtatacc

SEQ ID NO: 229829 - DNA, 37 bp, Artificial Sequence
  Description of Artificial Sequence: Synthetic oligonucleotide
caaatcagatgcatgtgatgatgtatggggtataccg

SEQ ID NO: 229830 - DNA, 37 bp, Artificial Sequence
  Description of Artificial Sequence: Synthetic oligonucleotide
aaatcagatgcatgtgatgatgtatggggtataccgc

SEQ ID NO: 229831 - DNA, 36 bp, Artificial Sequence
  Description of Artificial Sequence: Synthetic oligonucleotide
aatcagatgcatgtgatgatgtatggggtataccgc

SEQ ID NO: 229832 - DNA, 35 bp, Artificial Sequence
  Description of Artificial Sequence: Synthetic oligonucleotide
atcagatgcatgtgatgatgtatggggtataccgc

SEQ ID NO: 229833 - DNA, 34 bp, Artificial Sequence
  Description of Artificial Sequence: Synthetic oligonucleotide
tcagatgcatgtgatgatgtatggggtataccgc

SEQ ID NO: 229834 - DNA, 33 bp, Artificial Sequence
  Description of Artificial Sequence: Synthetic oligonucleotide
cagatgcatgtgatgatgtatggggtataccgc

SEQ ID NO: 229835 - DNA, 33 bp, Artificial Sequence
  Description of Artificial Sequence: Synthetic oligonucleotide
agatgcatgtgatgatgtatggggtataccgcc

SEQ ID NO: 229836 - DNA, 32 bp, Artificial Sequence
  Description of Artificial Sequence: Synthetic oligonucleotide
gatgcatgtgatgatgtatggggtataccgcc

SEQ ID NO: 229837 - DNA, 35 bp, Artificial Sequence
  Description of Artificial Sequence: Synthetic oligonucleotide
atgcatgtgatgatgtatggggtataccgccttag

SEQ ID NO: 229838 - DNA, 34 bp, Artificial Sequence
  Description of Artificial Sequence: Synthetic oligonucleotide
tgcatgtgatgatgtatggggtataccgccttag

SEQ ID NO: 229839 - DNA, 33 bp, Artificial Sequence
  Description of Artificial Sequence: Synthetic oligonucleotide
gcatgtgatgatgtatggggtataccgccttag

SEQ ID NO: 229840 - DNA, 33 bp, Artificial Sequence
  Description of Artificial Sequence: Synthetic oligonucleotide
catgtgatgatgtatggggtataccgccttagg

SEQ ID NO: 229841 - DNA, 33 bp, Artificial Sequence
  Description of Artificial Sequence: Synthetic oligonucleotide
atgtgatgatgtatggggtataccgccttaggg

SEQ ID NO: 229842 - DNA, 32 bp, Artificial Sequence
  Description of Artificial Sequence: Synthetic oligonucleotide
tgtgatgatgtatggggtataccgccttaggg

SEQ ID NO: 229843 - DNA, 31 bp, Artificial Sequence
  Description of Artificial Sequence: Synthetic oligonucleotide
gtgatgatgtatggggtataccgccttaggg

SEQ ID NO: 229844 - DNA, 31 bp, Artificial Sequence
  Description of Artificial Sequence: Synthetic oligonucleotide
tgatgatgtatggggtataccgccttagggc

SEQ ID NO: 229845 - DNA, 30 bp, Artificial Sequence
  Description of Artificial Sequence: Synthetic oligonucleotide
gatgatgtatggggtataccgccttagggc

SEQ ID NO: 229846 - DNA, 34 bp, Artificial Sequence
  Description of Artificial Sequence: Synthetic oligonucleotide
atgatgtatggggtataccgccttagggcatttg

SEQ ID NO: 229847 - DNA, 33 bp, Artificial Sequence
  Description of Artificial Sequence: Synthetic oligonucleotide
tgatgtatggggtataccgccttagggcatttg

SEQ ID NO: 229848 - DNA, 32 bp, Artificial Sequence
  Description of Artificial Sequence: Synthetic oligonucleotide
gatgtatggggtataccgccttagggcatttg

SEQ ID NO: 229849 - DNA, 32 bp, Artificial Sequence
  Description of Artificial Sequence: Synthetic oligonucleotide
atgtatggggtataccgccttagggcatttgg

SEQ ID NO: 229850 - DNA, 31 bp, Artificial Sequence
  Description of Artificial Sequence: Synthetic oligonucleotide
tgtatggggtataccgccttagggcatttgg

SEQ ID NO: 229851 - DNA, 30 bp, Artificial Sequence
  Description of Artificial Sequence: Synthetic oligonucleotide
gtatggggtataccgccttagggcatttgg

SEQ ID NO: 229852 - DNA, 30 bp, Artificial Sequence
  Description of Artificial Sequence: Synthetic oligonucleotide
tatggggtataccgccttagggcatttggg

SEQ ID NO: 229853 - DNA, 29 bp, Artificial Sequence
  Description of Artificial Sequence: Synthetic oligonucleotide
atggggtataccgccttagggcatttggg

SEQ ID NO: 229854 - DNA, 28 bp, Artificial Sequence
  Description of Artificial Sequence: Synthetic oligonucleotide
tggggtataccgccttagggcatttggg

SEQ ID NO: 229855 - DNA, 27 bp, Artificial Sequence
  Description of Artificial Sequence: Synthetic oligonucleotide
ggggtataccgccttagggcatttggg

SEQ ID NO: 229856 - DNA, 27 bp, Artificial Sequence
  Description of Artificial Sequence: Synthetic oligonucleotide
gggtataccgccttagggcatttgggc

SEQ ID NO: 229857 - DNA, 34 bp, Artificial Sequence
  Description of Artificial Sequence: Synthetic oligonucleotide
ggtataccgccttagggcatttgggcatattttc

SEQ ID NO: 229858 - DNA, 37 bp, Artificial Sequence
  Description of Artificial Sequence: Synthetic oligonucleotide
gtataccgccttagggcatttgggcatattttcaatg

SEQ ID NO: 229859 - DNA, 39 bp, Artificial Sequence
  Description of Artificial Sequence: Synthetic oligonucleotide
tataccgccttagggcatttgggcatattttcaatgatg

SEQ ID NO: 229860 - DNA, 38 bp, Artificial Sequence
  Description of Artificial Sequence: Synthetic oligonucleotide
ataccgccttagggcatttgggcatattttcaatgatg

SEQ ID NO: 229861 - DNA, 37 bp, Artificial Sequence
  Description of Artificial Sequence: Synthetic oligonucleotide
taccgccttagggcatttgggcatattttcaatgatg

SEQ ID NO: 229862 - DNA, 36 bp, Artificial Sequence
  Description of Artificial Sequence: Synthetic oligonucleotide
accgccttagggcatttgggcatattttcaatgatg

SEQ ID NO: 229863 - DNA, 35 bp, Artificial Sequence
  Description of Artificial Sequence: Synthetic oligonucleotide
ccgccttagggcatttgggcatattttcaatgatg

SEQ ID NO: 229864 - DNA, 35 bp, Artificial Sequence
  Description of Artificial Sequence: Synthetic oligonucleotide
cgccttagggcatttgggcatattttcaatgatgc

SEQ ID NO: 229865 - DNA, 38 bp, Artificial Sequence
  Description of Artificial Sequence: Synthetic oligonucleotide
gccttagggcatttgggcatattttcaatgatgcattg

SEQ ID NO: 229866 - DNA, 38 bp, Artificial Sequence
  Description of Artificial Sequence: Synthetic oligonucleotide
ccttagggcatttgggcatattttcaatgatgcattgg

SEQ ID NO: 229867 - DNA, 42 bp, Artificial Sequence
  Description of Artificial Sequence: Synthetic oligonucleotide
cttagggcatttgggcatattttcaatgatgcattggttttc

SEQ ID NO: 229868 - DNA, 45 bp, Artificial Sequence
  Description of Artificial Sequence: Synthetic oligonucleotide
ttagggcatttgggcatattttcaatgatgcattggttttcttac

SEQ ID NO: 229869 - DNA, 44 bp, Artificial Sequence
  Description of Artificial Sequence: Synthetic oligonucleotide
tagggcatttgggcatattttcaatgatgcattggttttcttac

SEQ ID NO: 229870 - DNA, 43 bp, Artificial Sequence
  Description of Artificial Sequence: Synthetic oligonucleotide
agggcatttgggcatattttcaatgatgcattggttttcttac

SEQ ID NO: 229871 - DNA, 42 bp, Artificial Sequence
  Description of Artificial Sequence: Synthetic oligonucleotide
gggcatttgggcatattttcaatgatgcattggttttcttac

SEQ ID NO: 229872 - DNA, 42 bp, Artificial Sequence
  Description of Artificial Sequence: Synthetic oligonucleotide
ggcatttgggcatattttcaatgatgcattggttttcttacc

SEQ ID NO: 229873 - DNA, 43 bp, Artificial Sequence
  Description of Artificial Sequence: Synthetic oligonucleotide
gcatttgggcatattttcaatgatgcattggttttcttacctc

SEQ ID NO: 229874 - DNA, 43 bp, Artificial Sequence
  Description of Artificial Sequence: Synthetic oligonucleotide
catttgggcatattttcaatgatgcattggttttcttacctcc

SEQ ID NO: 229875 - DNA, 47 bp, Artificial Sequence
  Description of Artificial Sequence: Synthetic oligonucleotide
atttgggcatattttcaatgatgcattggttttcttacctccaaatg

SEQ ID NO: 229876 - DNA, 46 bp, Artificial Sequence
  Description of Artificial Sequence: Synthetic oligonucleotide
tttgggcatattttcaatgatgcattggttttcttacctccaaatg

SEQ ID NO: 229877 - DNA, 45 bp, Artificial Sequence
  Description of Artificial Sequence: Synthetic oligonucleotide
ttgggcatattttcaatgatgcattggttttcttacctccaaatg

SEQ ID NO: 229878 - DNA, 44 bp, Artificial Sequence
  Description of Artificial Sequence: Synthetic oligonucleotide
tgggcatattttcaatgatgcattggttttcttacctccaaatg

SEQ ID NO: 229879 - DNA, 43 bp, Artificial Sequence
  Description of Artificial Sequence: Synthetic oligonucleotide
gggcatattttcaatgatgcattggttttcttacctccaaatg

SEQ ID NO: 229880 - DNA, 43 bp, Artificial Sequence
  Description of Artificial Sequence: Synthetic oligonucleotide
ggcatattttcaatgatgcattggttttcttacctccaaatgg

SEQ ID NO: 229881 - DNA, 45 bp, Artificial Sequence
  Description of Artificial Sequence: Synthetic oligonucleotide
gcatattttcaatgatgcattggttttcttacctccaaatggttc

SEQ ID NO: 229882 - DNA, 46 bp, Artificial Sequence
  Description of Artificial Sequence: Synthetic oligonucleotide
catattttcaatgatgcattggttttcttacctccaaatggttctg

SEQ ID NO: 229883 - DNA, 47 bp, Artificial Sequence
  Description of Artificial Sequence: Synthetic oligonucleotide
atattttcaatgatgcattggttttcttacctccaaatggttctgac

SEQ ID NO: 229884 - DNA, 46 bp, Artificial Sequence
  Description of Artificial Sequence: Synthetic oligonucleotide
tattttcaatgatgcattggttttcttacctccaaatggttctgac

SEQ ID NO: 229885 - DNA, 45 bp, Artificial Sequence
  Description of Artificial Sequence: Synthetic oligonucleotide
attttcaatgatgcattggttttcttacctccaaatggttctgac

SEQ ID NO: 229886 - DNA, 44 bp, Artificial Sequence
  Description of Artificial Sequence: Synthetic oligonucleotide
ttttcaatgatgcattggttttcttacctccaaatggttctgac

SEQ ID NO: 229887 - DNA, 43 bp, Artificial Sequence
  Description of Artificial Sequence: Synthetic oligonucleotide
tttcaatgatgcattggttttcttacctccaaatggttctgac

SEQ ID NO: 229888 - DNA, 42 bp, Artificial Sequence
  Description of Artificial Sequence: Synthetic oligonucleotide
ttcaatgatgcattggttttcttacctccaaatggttctgac

SEQ ID NO: 229889 - DNA, 41 bp, Artificial Sequence
  Description of Artificial Sequence: Synthetic oligonucleotide
tcaatgatgcattggttttcttacctccaaatggttctgac

SEQ ID NO: 229890 - DNA, 40 bp, Artificial Sequence
  Description of Artificial Sequence: Synthetic oligonucleotide
caatgatgcattggttttcttacctccaaatggttctgac

SEQ ID NO: 229891 - DNA, 43 bp, Artificial Sequence
  Description of Artificial Sequence: Synthetic oligonucleotide
aatgatgcattggttttcttacctccaaatggttctgacaatg

SEQ ID NO: 229892 - DNA, 42 bp, Artificial Sequence
  Description of Artificial Sequence: Synthetic oligonucleotide
atgatgcattggttttcttacctccaaatggttctgacaatg

SEQ ID NO: 229893 - DNA, 41 bp, Artificial Sequence
  Description of Artificial Sequence: Synthetic oligonucleotide
tgatgcattggttttcttacctccaaatggttctgacaatg

SEQ ID NO: 229894 - DNA, 40 bp, Artificial Sequence
  Description of Artificial Sequence: Synthetic oligonucleotide
gatgcattggttttcttacctccaaatggttctgacaatg

SEQ ID NO: 229895 - DNA, 41 bp, Artificial Sequence
  Description of Artificial Sequence: Synthetic oligonucleotide
atgcattggttttcttacctccaaatggttctgacaatgac

SEQ ID NO: 229896 - DNA, 40 bp, Artificial Sequence
  Description of Artificial Sequence: Synthetic oligonucleotide
tgcattggttttcttacctccaaatggttctgacaatgac

SEQ ID NO: 229897 - DNA, 39 bp, Artificial Sequence
  Description of Artificial Sequence: Synthetic oligonucleotide
gcattggttttcttacctccaaatggttctgacaatgac

SEQ ID NO: 229898 - DNA, 40 bp, Artificial Sequence
  Description of Artificial Sequence: Synthetic oligonucleotide
cattggttttcttacctccaaatggttctgacaatgactg

SEQ ID NO: 229899 - DNA, 42 bp, Artificial Sequence
  Description of Artificial Sequence: Synthetic oligonucleotide
agctcagtaagagctttcgagtatactgtattatccttgtag

SEQ ID NO: 229900 - DNA, 41 bp, Artificial Sequence
  Description of Artificial Sequence: Synthetic oligonucleotide
gctcagtaagagctttcgagtatactgtattatccttgtag

SEQ ID NO: 229901 - DNA, 43 bp, Artificial Sequence
  Description of Artificial Sequence: Synthetic oligonucleotide
ctcagtaagagctttcgagtatactgtattatccttgtagaac

SEQ ID NO: 229902 - DNA, 43 bp, Artificial Sequence
  Description of Artificial Sequence: Synthetic oligonucleotide
tcagtaagagctttcgagtatactgtattatccttgtagaacc

SEQ ID NO: 229903 - DNA, 42 bp, Artificial Sequence
  Description of Artificial Sequence: Synthetic oligonucleotide
cagtaagagctttcgagtatactgtattatccttgtagaacc

SEQ ID NO: 229904 - DNA, 42 bp, Artificial Sequence
  Description of Artificial Sequence: Synthetic oligonucleotide
agtaagagctttcgagtatactgtattatccttgtagaaccc

SEQ ID NO: 229905 - DNA, 41 bp, Artificial Sequence
  Description of Artificial Sequence: Synthetic oligonucleotide
gtaagagctttcgagtatactgtattatccttgtagaaccc

SEQ ID NO: 229906 - DNA, 44 bp, Artificial Sequence
  Description of Artificial Sequence: Synthetic oligonucleotide
taagagctttcgagtatactgtattatccttgtagaacccaaag

SEQ ID NO: 229907 - DNA, 43 bp, Artificial Sequence
  Description of Artificial Sequence: Synthetic oligonucleotide
aagagctttcgagtatactgtattatccttgtagaacccaaag

SEQ ID NO: 229908 - DNA, 42 bp, Artificial Sequence
  Description of Artificial Sequence: Synthetic oligonucleotide
agagctttcgagtatactgtattatccttgtagaacccaaag

SEQ ID NO: 229909 - DNA, 41 bp, Artificial Sequence
  Description of Artificial Sequence: Synthetic oligonucleotide
gagctttcgagtatactgtattatccttgtagaacccaaag

SEQ ID NO: 229910 - DNA, 43 bp, Artificial Sequence
  Description of Artificial Sequence: Synthetic oligonucleotide
agctttcgagtatactgtattatccttgtagaacccaaagatg

SEQ ID NO: 229911 - DNA, 42 bp, Artificial Sequence
  Description of Artificial Sequence: Synthetic oligonucleotide
gctttcgagtatactgtattatccttgtagaacccaaagatg

SEQ ID NO: 229912 - DNA, 43 bp, Artificial Sequence
  Description of Artificial Sequence: Synthetic oligonucleotide
ctttcgagtatactgtattatccttgtagaacccaaagatgtg

SEQ ID NO: 229913 - DNA, 44 bp, Artificial Sequence
  Description of Artificial Sequence: Synthetic oligonucleotide
tttcgagtatactgtattatccttgtagaacccaaagatgtgag

SEQ ID NO: 229914 - DNA, 43 bp, Artificial Sequence
  Description of Artificial Sequence: Synthetic oligonucleotide
ttcgagtatactgtattatccttgtagaacccaaagatgtgag

SEQ ID NO: 229915 - DNA, 42 bp, Artificial Sequence
  Description of Artificial Sequence: Synthetic oligonucleotide
tcgagtatactgtattatccttgtagaacccaaagatgtgag

SEQ ID NO: 229916 - DNA, 41 bp, Artificial Sequence
  Description of Artificial Sequence: Synthetic oligonucleotide
cgagtatactgtattatccttgtagaacccaaagatgtgag

SEQ ID NO: 229917 - DNA, 42 bp, Artificial Sequence
  Description of Artificial Sequence: Synthetic oligonucleotide
gagtatactgtattatccttgtagaacccaaagatgtgagtc

SEQ ID NO: 229918 - DNA, 45 bp, Artificial Sequence
  Description of Artificial Sequence: Synthetic oligonucleotide
agtatactgtattatccttgtagaacccaaagatgtgagtctttg

SEQ ID NO: 229919 - DNA, 44 bp, Artificial Sequence
  Description of Artificial Sequence: Synthetic oligonucleotide
gtatactgtattatccttgtagaacccaaagatgtgagtctttg

SEQ ID NO: 229920 - DNA, 44 bp, Artificial Sequence
  Description of Artificial Sequence: Synthetic oligonucleotide
tatactgtattatccttgtagaacccaaagatgtgagtctttgg

SEQ ID NO: 229921 - DNA, 43 bp, Artificial Sequence
  Description of Artificial Sequence: Synthetic oligonucleotide
atactgtattatccttgtagaacccaaagatgtgagtctttgg

SEQ ID NO: 229922 - DNA, 42 bp, Artificial Sequence
  Description of Artificial Sequence: Synthetic oligonucleotide
tactgtattatccttgtagaacccaaagatgtgagtctttgg

SEQ ID NO: 229923 - DNA, 41 bp, Artificial Sequence
  Description of Artificial Sequence: Synthetic oligonucleotide
actgtattatccttgtagaacccaaagatgtgagtctttgg

SEQ ID NO: 229924 - DNA, 40 bp, Artificial Sequence
  Description of Artificial Sequence: Synthetic oligonucleotide
ctgtattatccttgtagaacccaaagatgtgagtctttgg

SEQ ID NO: 229925 - DNA, 40 bp, Artificial Sequence
  Description of Artificial Sequence: Synthetic oligonucleotide
tgtattatccttgtagaacccaaagatgtgagtctttggg

SEQ ID NO: 229926 - DNA, 39 bp, Artificial Sequence
  Description of Artificial Sequence: Synthetic oligonucleotide
gtattatccttgtagaacccaaagatgtgagtctttggg

SEQ ID NO: 229927 - DNA, 39 bp, Artificial Sequence
  Description of Artificial Sequence: Synthetic oligonucleotide
tattatccttgtagaacccaaagatgtgagtctttgggc

SEQ ID NO: 229928 - DNA, 38 bp, Artificial Sequence
  Description of Artificial Sequence: Synthetic oligonucleotide
attatccttgtagaacccaaagatgtgagtctttgggc

SEQ ID NO: 229929 - DNA, 37 bp, Artificial Sequence
  Description of Artificial Sequence: Synthetic oligonucleotide
ttatccttgtagaacccaaagatgtgagtctttgggc

SEQ ID NO: 229930 - DNA, 36 bp, Artificial Sequence
  Description of Artificial Sequence: Synthetic oligonucleotide
tatccttgtagaacccaaagatgtgagtctttgggc

SEQ ID NO: 229931 - DNA, 35 bp, Artificial Sequence
  Description of Artificial Sequence: Synthetic oligonucleotide
atccttgtagaacccaaagatgtgagtctttgggc

SEQ ID NO: 229932 - DNA, 34 bp, Artificial Sequence
  Description of Artificial Sequence: Synthetic oligonucleotide
tccttgtagaacccaaagatgtgagtctttgggc

SEQ ID NO: 229933 - DNA, 33 bp, Artificial Sequence
  Description of Artificial Sequence: Synthetic oligonucleotide
ccttgtagaacccaaagatgtgagtctttgggc

SEQ ID NO: 229934 - DNA, 34 bp, Artificial Sequence
  Description of Artificial Sequence: Synthetic oligonucleotide
cttgtagaacccaaagatgtgagtctttgggctg

SEQ ID NO: 229935 - DNA, 34 bp, Artificial Sequence
  Description of Artificial Sequence: Synthetic oligonucleotide
ttgtagaacccaaagatgtgagtctttgggctgc

SEQ ID NO: 229936 - DNA, 33 bp, Artificial Sequence
  Description of Artificial Sequence: Synthetic oligonucleotide
tgtagaacccaaagatgtgagtctttgggctgc

SEQ ID NO: 229937 - DNA, 32 bp, Artificial Sequence
  Description of Artificial Sequence: Synthetic oligonucleotide
gtagaacccaaagatgtgagtctttgggctgc

SEQ ID NO: 229938 - DNA, 33 bp, Artificial Sequence
  Description of Artificial Sequence: Synthetic oligonucleotide
tagaacccaaagatgtgagtctttgggctgcag

SEQ ID NO: 229939 - DNA, 32 bp, Artificial Sequence
  Description of Artificial Sequence: Synthetic oligonucleotide
agaacccaaagatgtgagtctttgggctgcag

SEQ ID NO: 229940 - DNA, 31 bp, Artificial Sequence
  Description of Artificial Sequence: Synthetic oligonucleotide
gaacccaaagatgtgagtctttgggctgcag

SEQ ID NO: 229941 - DNA, 43 bp, Artificial Sequence
  Description of Artificial Sequence: Synthetic oligonucleotide
tgtgacaaagcagagttcttcagttctgaaaatgttaaagtgc

SEQ ID NO: 229942 - DNA, 42 bp, Artificial Sequence
  Description of Artificial Sequence: Synthetic oligonucleotide
gtgacaaagcagagttcttcagttctgaaaatgttaaagtgc

SEQ ID NO: 229943 - DNA, 44 bp, Artificial Sequence
  Description of Artificial Sequence: Synthetic oligonucleotide
tgacaaagcagagttcttcagttctgaaaatgttaaagtgcttg

SEQ ID NO: 229944 - DNA, 43 bp, Artificial Sequence
  Description of Artificial Sequence: Synthetic oligonucleotide
gacaaagcagagttcttcagttctgaaaatgttaaagtgcttg

SEQ ID NO: 229945 - DNA, 44 bp, Artificial Sequence
  Description of Artificial Sequence: Synthetic oligonucleotide
acaaagcagagttcttcagttctgaaaatgttaaagtgcttgag

SEQ ID NO: 229946 - DNA, 43 bp, Artificial Sequence
  Description of Artificial Sequence: Synthetic oligonucleotide
caaagcagagttcttcagttctgaaaatgttaaagtgcttgag

SEQ ID NO: 229947 - DNA, 44 bp, Artificial Sequence
  Description of Artificial Sequence: Synthetic oligonucleotide
aaagcagagttcttcagttctgaaaatgttaaagtgcttgagtc

SEQ ID NO: 229948 - DNA, 43 bp, Artificial Sequence
  Description of Artificial Sequence: Synthetic oligonucleotide
aagcagagttcttcagttctgaaaatgttaaagtgcttgagtc

SEQ ID NO: 229949 - DNA, 42 bp, Artificial Sequence
  Description of Artificial Sequence: Synthetic oligonucleotide
agcagagttcttcagttctgaaaatgttaaagtgcttgagtc

SEQ ID NO: 229950 - DNA, 41 bp, Artificial Sequence
  Description of Artificial Sequence: Synthetic oligonucleotide
gcagagttcttcagttctgaaaatgttaaagtgcttgagtc

SEQ ID NO: 229951 - DNA, 50 bp, Artificial Sequence
  Description of Artificial Sequence: Synthetic oligonucleotide
cagagttcttcagttctgaaaatgttaaagtgcttgagtcaattaatatg

SEQ ID NO: 229952 - DNA, 50 bp, Artificial Sequence
  Description of Artificial Sequence: Synthetic oligonucleotide
agagttcttcagttctgaaaatgttaaagtgcttgagtcaattaatatgg

SEQ ID NO: 229953 - DNA, 49 bp, Artificial Sequence
  Description of Artificial Sequence: Synthetic oligonucleotide
gagttcttcagttctgaaaatgttaaagtgcttgagtcaattaatatgg

SEQ ID NO: 229954 - DNA, 50 bp, Artificial Sequence
  Description of Artificial Sequence: Synthetic oligonucleotide
agttcttcagttctgaaaatgttaaagtgcttgagtcaattaatatggac

SEQ ID NO: 229955 - DNA, 49 bp, Artificial Sequence
  Description of Artificial Sequence: Synthetic oligonucleotide
gttcttcagttctgaaaatgttaaagtgcttgagtcaattaatatggac

SEQ ID NO: 229956 - DNA, 50 bp, Artificial Sequence
  Description of Artificial Sequence: Synthetic oligonucleotide
ttcttcagttctgaaaatgttaaagtgcttgagtcaattaatatggacac

SEQ ID NO: 229957 - DNA, 49 bp, Artificial Sequence
  Description of Artificial Sequence: Synthetic oligonucleotide
tcttcagttctgaaaatgttaaagtgcttgagtcaattaatatggacac

SEQ ID NO: 229958 - DNA, 48 bp, Artificial Sequence
  Description of Artificial Sequence: Synthetic oligonucleotide
cttcagttctgaaaatgttaaagtgcttgagtcaattaatatggacac

SEQ ID NO: 229959 - DNA, 52 bp, Artificial Sequence
  Description of Artificial Sequence: Synthetic oligonucleotide
ttcagttctgaaaatgttaaagtgcttgagtcaattaatatggacacaaatg

SEQ ID NO: 229960 - DNA, 51 bp, Artificial Sequence
  Description of Artificial Sequence: Synthetic oligonucleotide
tcagttctgaaaatgttaaagtgcttgagtcaattaatatggacacaaatg

SEQ ID NO: 229961 - DNA, 50 bp, Artificial Sequence
  Description of Artificial Sequence: Synthetic oligonucleotide
cagttctgaaaatgttaaagtgcttgagtcaattaatatggacacaaatg

SEQ ID NO: 229962 - DNA, 51 bp, Artificial Sequence
  Description of Artificial Sequence: Synthetic oligonucleotide
agttctgaaaatgttaaagtgcttgagtcaattaatatggacacaaatgac

SEQ ID NO: 229963 - DNA, 50 bp, Artificial Sequence
  Description of Artificial Sequence: Synthetic oligonucleotide
gttctgaaaatgttaaagtgcttgagtcaattaatatggacacaaatgac

SEQ ID NO: 229964 - DNA, 52 bp, Artificial Sequence
  Description of Artificial Sequence: Synthetic oligonucleotide
ttctgaaaatgttaaagtgcttgagtcaattaatatggacacaaatgacatg

SEQ ID NO: 229965 - DNA, 51 bp, Artificial Sequence
  Description of Artificial Sequence: Synthetic oligonucleotide
tctgaaaatgttaaagtgcttgagtcaattaatatggacacaaatgacatg

SEQ ID NO: 229966 - DNA, 50 bp, Artificial Sequence
  Description of Artificial Sequence: Synthetic oligonucleotide
ctgaaaatgttaaagtgcttgagtcaattaatatggacacaaatgacatg

SEQ ID NO: 229967 - DNA, 51 bp, Artificial Sequence
  Description of Artificial Sequence: Synthetic oligonucleotide
tgaaaatgttaaagtgcttgagtcaattaatatggacacaaatgacatgtg

SEQ ID NO: 229968 - DNA, 50 bp, Artificial Sequence
  Description of Artificial Sequence: Synthetic oligonucleotide
gaaaatgttaaagtgcttgagtcaattaatatggacacaaatgacatgtg

SEQ ID NO: 229969 - DNA, 50 bp, Artificial Sequence
  Description of Artificial Sequence: Synthetic oligonucleotide
aaaatgttaaagtgcttgagtcaattaatatggacacaaatgacatgtgg

SEQ ID NO: 229970 - DNA, 49 bp, Artificial Sequence
  Description of Artificial Sequence: Synthetic oligonucleotide
aaatgttaaagtgcttgagtcaattaatatggacacaaatgacatgtgg

SEQ ID NO: 229971 - DNA, 48 bp, Artificial Sequence
  Description of Artificial Sequence: Synthetic oligonucleotide
aatgttaaagtgcttgagtcaattaatatggacacaaatgacatgtgg

SEQ ID NO: 229972 - DNA, 47 bp, Artificial Sequence
  Description of Artificial Sequence: Synthetic oligonucleotide
atgttaaagtgcttgagtcaattaatatggacacaaatgacatgtgg

SEQ ID NO: 229973 - DNA, 46 bp, Artificial Sequence
  Description of Artificial Sequence: Synthetic oligonucleotide
tgttaaagtgcttgagtcaattaatatggacacaaatgacatgtgg

SEQ ID NO: 229974 - DNA, 45 bp, Artificial Sequence
  Description of Artificial Sequence: Synthetic oligonucleotide
gttaaagtgcttgagtcaattaatatggacacaaatgacatgtgg

SEQ ID NO: 229975 - DNA, 50 bp, Artificial Sequence
  Description of Artificial Sequence: Synthetic oligonucleotide
ttaaagtgcttgagtcaattaatatggacacaaatgacatgtggttaatg

SEQ ID NO: 229976 - DNA, 49 bp, Artificial Sequence
  Description of Artificial Sequence: Synthetic oligonucleotide
taaagtgcttgagtcaattaatatggacacaaatgacatgtggttaatg

SEQ ID NO: 229977 - DNA, 48 bp, Artificial Sequence
  Description of Artificial Sequence: Synthetic oligonucleotide
aaagtgcttgagtcaattaatatggacacaaatgacatgtggttaatg

SEQ ID NO: 229978 - DNA, 47 bp, Artificial Sequence
  Description of Artificial Sequence: Synthetic oligonucleotide
aagtgcttgagtcaattaatatggacacaaatgacatgtggttaatg

SEQ ID NO: 229979 - DNA, 46 bp, Artificial Sequence
  Description of Artificial Sequence: Synthetic oligonucleotide
agtgcttgagtcaattaatatggacacaaatgacatgtggttaatg

SEQ ID NO: 229980 - DNA, 45 bp, Artificial Sequence
  Description of Artificial Sequence: Synthetic oligonucleotide
gtgcttgagtcaattaatatggacacaaatgacatgtggttaatg

SEQ ID NO: 229981 - DNA, 47 bp, Artificial Sequence
  Description of Artificial Sequence: Synthetic oligonucleotide
tgcttgagtcaattaatatggacacaaatgacatgtggttaatgatg

SEQ ID NO: 229982 - DNA, 46 bp, Artificial Sequence
  Description of Artificial Sequence: Synthetic oligonucleotide
gcttgagtcaattaatatggacacaaatgacatgtggttaatgatg

SEQ ID NO: 229983 - DNA, 47 bp, Artificial Sequence
  Description of Artificial Sequence: Synthetic oligonucleotide
cttgagtcaattaatatggacacaaatgacatgtggttaatgatgag

SEQ ID NO: 229984 - DNA, 24 bp, Artificial Sequence
  Description of Artificial Sequence: Synthetic oligonucleotide
atgaggcccccgcagtgtctgctg

SEQ ID NO: 229985 - DNA, 23 bp, Artificial Sequence
  Description of Artificial Sequence: Synthetic oligonucleotide
tgaggcccccgcagtgtctgctg

SEQ ID NO: 229986 - DNA, 22 bp, Artificial Sequence
  Description of Artificial Sequence: Synthetic oligonucleotide
gaggcccccgcagtgtctgctg

SEQ ID NO: 229987 - DNA, 23 bp, Artificial Sequence
  Description of Artificial Sequence: Synthetic oligonucleotide
aggcccccgcagtgtctgctgca

SEQ ID NO: 229988 - DNA, 22 bp, Artificial Sequence
  Description of Artificial Sequence: Synthetic oligonucleotide
ggcccccgcagtgtctgctgca

SEQ ID NO: 229989 - DNA, 23 bp, Artificial Sequence
  Description of Artificial Sequence: Synthetic oligonucleotide
gcccccgcagtgtctgctgcaca

SEQ ID NO: 229990 - DNA, 23 bp, Artificial Sequence
  Description of Artificial Sequence: Synthetic oligonucleotide
cccccgcagtgtctgctgcacac

SEQ ID NO: 229991 - DNA, 23 bp, Artificial Sequence
  Description of Artificial Sequence: Synthetic oligonucleotide
ccccgcagtgtctgctgcacacg

SEQ ID NO: 229992 - DNA, 23 bp, Artificial Sequence
  Description of Artificial Sequence: Synthetic oligonucleotide
cccgcagtgtctgctgcacacgc

SEQ ID NO: 229993 - DNA, 25 bp, Artificial Sequence
  Description of Artificial Sequence: Synthetic oligonucleotide
ccgcagtgtctgctgcacacgcctt

SEQ ID NO: 229994 - DNA, 25 bp, Artificial Sequence
  Description of Artificial Sequence: Synthetic oligonucleotide
cgcagtgtctgctgcacacgccttc

SEQ ID NO: 229995 - DNA, 25 bp, Artificial Sequence
  Description of Artificial Sequence: Synthetic oligonucleotide
gcagtgtctgctgcacacgccttcc

SEQ ID NO: 229996 - DNA, 26 bp, Artificial Sequence
  Description of Artificial Sequence: Synthetic oligonucleotide
cagtgtctgctgcacacgccttccct

SEQ ID NO: 229997 - DNA, 26 bp, Artificial Sequence
  Description of Artificial Sequence: Synthetic oligonucleotide
agtgtctgctgcacacgccttccctg

SEQ ID NO: 229998 - DNA, 25 bp, Artificial Sequence
  Description of Artificial Sequence: Synthetic oligonucleotide
gtgtctgctgcacacgccttccctg

SEQ ID NO: 229999 - DNA, 25 bp, Artificial Sequence
  Description of Artificial Sequence: Synthetic oligonucleotide
tgtctgctgcacacgccttccctgg

SEQ ID NO: 230000 - DNA, 24 bp, Artificial Sequence
  Description of Artificial Sequence: Synthetic oligonucleotide
gtctgctgcacacgccttccctgg

SEQ ID NO: 230001 - DNA, 26 bp, Artificial Sequence
  Description of Artificial Sequence: Synthetic oligonucleotide
tctgctgcacacgccttccctggctt

SEQ ID NO: 230002 - DNA, 25 bp, Artificial Sequence
  Description of Artificial Sequence: Synthetic oligonucleotide
ctgctgcacacgccttccctggctt

SEQ ID NO: 230003 - DNA, 25 bp, Artificial Sequence
  Description of Artificial Sequence: Synthetic oligonucleotide
tgctgcacacgccttccctggcttc

SEQ ID NO: 230004 - DNA, 24 bp, Artificial Sequence
  Description of Artificial Sequence: Synthetic oligonucleotide
gctgcacacgccttccctggcttc

SEQ ID NO: 230005 - DNA, 24 bp, Artificial Sequence
  Description of Artificial Sequence: Synthetic oligonucleotide
ctgcacacgccttccctggcttcc

SEQ ID NO: 230006 - DNA, 24 bp, Artificial Sequence
  Description of Artificial Sequence: Synthetic oligonucleotide
tgcacacgccttccctggcttccc

SEQ ID NO: 230007 - DNA, 23 bp, Artificial Sequence
  Description of Artificial Sequence: Synthetic oligonucleotide
gcacacgccttccctggcttccc

SEQ ID NO: 230008 - DNA, 24 bp, Artificial Sequence
  Description of Artificial Sequence: Synthetic oligonucleotide
cacacgccttccctggcttcccca

SEQ ID NO: 230009 - DNA, 25 bp, Artificial Sequence
  Description of Artificial Sequence: Synthetic oligonucleotide
acacgccttccctggcttccccact

SEQ ID NO: 230010 - DNA, 24 bp, Artificial Sequence
  Description of Artificial Sequence: Synthetic oligonucleotide
cacgccttccctggcttccccact

SEQ ID NO: 230011 - DNA, 24 bp, Artificial Sequence
  Description of Artificial Sequence: Synthetic oligonucleotide
acgccttccctggcttccccactc

SEQ ID NO: 230012 - DNA, 23 bp, Artificial Sequence
  Description of Artificial Sequence: Synthetic oligonucleotide
cgccttccctggcttccccactc

SEQ ID NO: 230013 - DNA, 25 bp, Artificial Sequence
  Description of Artificial Sequence: Synthetic oligonucleotide
gccttccctggcttccccactcctt

SEQ ID NO: 230014 - DNA, 26 bp, Artificial Sequence
  Description of Artificial Sequence: Synthetic oligonucleotide
ccttccctggcttccccactccttct

SEQ ID NO: 230015 - DNA, 26 bp, Artificial Sequence
  Description of Artificial Sequence: Synthetic oligonucleotide
cttccctggcttccccactccttctc

SEQ ID NO: 230016 - DNA, 27 bp, Artificial Sequence
  Description of Artificial Sequence: Synthetic oligonucleotide
ttccctggcttccccactccttctcct

SEQ ID NO: 230017 - DNA, 26 bp, Artificial Sequence
  Description of Artificial Sequence: Synthetic oligonucleotide
tccctggcttccccactccttctcct

SEQ ID NO: 230018 - DNA, 25 bp, Artificial Sequence
  Description of Artificial Sequence: Synthetic oligonucleotide
ccctggcttccccactccttctcct

SEQ ID NO: 230019 - DNA, 25 bp, Artificial Sequence
  Description of Artificial Sequence: Synthetic oligonucleotide
cctggcttccccactccttctcctc

SEQ ID NO: 230020 - DNA, 26 bp, Artificial Sequence
  Description of Artificial Sequence: Synthetic oligonucleotide
ctggcttccccactccttctcctcct

SEQ ID NO: 230021 - DNA, 26 bp, Artificial Sequence
  Description of Artificial Sequence: Synthetic oligonucleotide
tggcttccccactccttctcctcctc

SEQ ID NO: 230022 - DNA, 25 bp, Artificial Sequence
  Description of Artificial Sequence: Synthetic oligonucleotide
ggcttccccactccttctcctcctc

SEQ ID NO: 230023 - DNA, 26 bp, Artificial Sequence
  Description of Artificial Sequence: Synthetic oligonucleotide
gcttccccactccttctcctcctcct

SEQ ID NO: 230024 - DNA, 27 bp, Artificial Sequence
  Description of Artificial Sequence: Synthetic oligonucleotide
cttccccactccttctcctcctcctct

SEQ ID NO: 230025 - DNA, 27 bp, Artificial Sequence
  Description of Artificial Sequence: Synthetic oligonucleotide
ttccccactccttctcctcctcctctg

SEQ ID NO: 230026 - DNA, 26 bp, Artificial Sequence
  Description of Artificial Sequence: Synthetic oligonucleotide
tccccactccttctcctcctcctctg

SEQ ID NO: 230027 - DNA, 25 bp, Artificial Sequence
  Description of Artificial Sequence: Synthetic oligonucleotide
ccccactccttctcctcctcctctg

SEQ ID NO: 230028 - DNA, 25 bp, Artificial Sequence
  Description of Artificial Sequence: Synthetic oligonucleotide
cccactccttctcctcctcctctgg

SEQ ID NO: 230029 - DNA, 26 bp, Artificial Sequence
  Description of Artificial Sequence: Synthetic oligonucleotide
ccactccttctcctcctcctctggct

SEQ ID NO: 230030 - DNA, 26 bp, Artificial Sequence
  Description of Artificial Sequence: Synthetic oligonucleotide
cactccttctcctcctcctctggctc

SEQ ID NO: 230031 - DNA, 27 bp, Artificial Sequence
  Description of Artificial Sequence: Synthetic oligonucleotide
actccttctcctcctcctctggctcct

SEQ ID NO: 230032 - DNA, 26 bp, Artificial Sequence
  Description of Artificial Sequence: Synthetic oligonucleotide
ctccttctcctcctcctctggctcct

SEQ ID NO: 230033 - DNA, 26 bp, Artificial Sequence
  Description of Artificial Sequence: Synthetic oligonucleotide
tccttctcctcctcctctggctcctg

SEQ ID NO: 230034 - DNA, 25 bp, Artificial Sequence
  Description of Artificial Sequence: Synthetic oligonucleotide
ccttctcctcctcctctggctcctg

SEQ ID NO: 230035 - DNA, 25 bp, Artificial Sequence
  Description of Artificial Sequence: Synthetic oligonucleotide
cttctcctcctcctctggctcctgg

SEQ ID NO: 230036 - DNA, 26 bp, Artificial Sequence
  Description of Artificial Sequence: Synthetic oligonucleotide
ttctcctcctcctctggctcctgggt

SEQ ID NO: 230037 - DNA, 25 bp, Artificial Sequence
  Description of Artificial Sequence: Synthetic oligonucleotide
tctcctcctcctctggctcctgggt

SEQ ID NO: 230038 - DNA, 24 bp, Artificial Sequence
  Description of Artificial Sequence: Synthetic oligonucleotide
ctcctcctcctctggctcctgggt

SEQ ID NO: 230039 - DNA, 24 bp, Artificial Sequence
  Description of Artificial Sequence: Synthetic oligonucleotide
tcctcctcctctggctcctgggtg

SEQ ID NO: 230040 - DNA, 23 bp, Artificial Sequence
  Description of Artificial Sequence: Synthetic oligonucleotide
cctcctcctctggctcctgggtg

SEQ ID NO: 230041 - DNA, 24 bp, Artificial Sequence
  Description of Artificial Sequence: Synthetic oligonucleotide
ctcctcctctggctcctgggtgga

SEQ ID NO: 230042 - DNA, 24 bp, Artificial Sequence
  Description of Artificial Sequence: Synthetic oligonucleotide
tcctcctctggctcctgggtggag

SEQ ID NO: 230043 - DNA, 23 bp, Artificial Sequence
  Description of Artificial Sequence: Synthetic oligonucleotide
cctcctctggctcctgggtggag

SEQ ID NO: 230044 - DNA, 24 bp, Artificial Sequence
  Description of Artificial Sequence: Synthetic oligonucleotide
ctcctctggctcctgggtggagga

SEQ ID NO: 230045 - DNA, 25 bp, Artificial Sequence
  Description of Artificial Sequence: Synthetic oligonucleotide
tcctctggctcctgggtggaggagt

SEQ ID NO: 230046 - DNA, 24 bp, Artificial Sequence
  Description of Artificial Sequence: Synthetic oligonucleotide
cctctggctcctgggtggaggagt

SEQ ID NO: 230047 - DNA, 24 bp, Artificial Sequence
  Description of Artificial Sequence: Synthetic oligonucleotide
ctctggctcctgggtggaggagtg

SEQ ID NO: 230048 - DNA, 24 bp, Artificial Sequence
  Description of Artificial Sequence: Synthetic oligonucleotide
tctggctcctgggtggaggagtgg

SEQ ID NO: 230049 - DNA, 23 bp, Artificial Sequence
  Description of Artificial Sequence: Synthetic oligonucleotide
ctggctcctgggtggaggagtgg

SEQ ID NO: 230050 - DNA, 23 bp, Artificial Sequence
  Description of Artificial Sequence: Synthetic oligonucleotide
tggctcctgggtggaggagtggg

SEQ ID NO: 230051 - DNA, 22 bp, Artificial Sequence
  Description of Artificial Sequence: Synthetic oligonucleotide
ggctcctgggtggaggagtggg

SEQ ID NO: 230052 - DNA, 22 bp, Artificial Sequence
  Description of Artificial Sequence: Synthetic oligonucleotide
gctcctgggtggaggagtgggg

SEQ ID NO: 230053 - DNA, 22 bp, Artificial Sequence
  Description of Artificial Sequence: Synthetic oligonucleotide
ctcctgggtggaggagtggggg

SEQ ID NO: 230054 - DNA, 23 bp, Artificial Sequence
  Description of Artificial Sequence: Synthetic oligonucleotide
tcctgggtggaggagtgggggct

SEQ ID NO: 230055 - DNA, 22 bp, Artificial Sequence
  Description of Artificial Sequence: Synthetic oligonucleotide
cctgggtggaggagtgggggct

SEQ ID NO: 230056 - DNA, 23 bp, Artificial Sequence
  Description of Artificial Sequence: Synthetic oligonucleotide
ctgggtggaggagtgggggctga

SEQ ID NO: 230057 - DNA, 23 bp, Artificial Sequence
  Description of Artificial Sequence: Synthetic oligonucleotide
tgggtggaggagtgggggctgag

SEQ ID NO: 230058 - DNA, 22 bp, Artificial Sequence
  Description of Artificial Sequence: Synthetic oligonucleotide
gggtggaggagtgggggctgag

SEQ ID NO: 230059 - DNA, 22 bp, Artificial Sequence
  Description of Artificial Sequence: Synthetic oligonucleotide
ggtggaggagtgggggctgagg

SEQ ID NO: 230060 - DNA, 22 bp, Artificial Sequence
  Description of Artificial Sequence: Synthetic oligonucleotide
gtggaggagtgggggctgaggg

SEQ ID NO: 230061 - DNA, 22 bp, Artificial Sequence
  Description of Artificial Sequence: Synthetic oligonucleotide
tggaggagtgggggctgagggc

SEQ ID NO: 230062 - DNA, 21 bp, Artificial Sequence
  Description of Artificial Sequence: Synthetic oligonucleotide
ggaggagtgggggctgagggc

SEQ ID NO: 230063 - DNA, 21 bp, Artificial Sequence
  Description of Artificial Sequence: Synthetic oligonucleotide
gaggagtgggggctgagggcc

SEQ ID NO: 230064 - DNA, 21 bp, Artificial Sequence
  Description of Artificial Sequence: Synthetic oligonucleotide
aggagtgggggctgagggccg

SEQ ID NO: 230065 - DNA, 20 bp, Artificial Sequence
  Description of Artificial Sequence: Synthetic oligonucleotide
ggagtgggggctgagggccg

SEQ ID NO: 230066 - DNA, 20 bp, Artificial Sequence
  Description of Artificial Sequence: Synthetic oligonucleotide
gagtgggggctgagggccgg

SEQ ID NO: 230067 - DNA, 21 bp, Artificial Sequence
  Description of Artificial Sequence: Synthetic oligonucleotide
agtgggggctgagggccggga

SEQ ID NO: 230068 - DNA, 20 bp, Artificial Sequence
  Description of Artificial Sequence: Synthetic oligonucleotide
gtgggggctgagggccggga

SEQ ID NO: 230069 - DNA, 20 bp, Artificial Sequence
  Description of Artificial Sequence: Synthetic oligonucleotide
tgggggctgagggccgggag

SEQ ID NO: 230070 - DNA, 20 bp, Artificial Sequence
  Description of Artificial Sequence: Synthetic oligonucleotide
gggggctgagggccgggagt

SEQ ID NO: 230071 - DNA, 21 bp, Artificial Sequence
  Description of Artificial Sequence: Synthetic oligonucleotide
ggggctgagggccgggaggat

SEQ ID NO: 230072 - DNA, 21 bp, Artificial Sequence
  Description of Artificial Sequence: Synthetic oligonucleotide
gggctgagggccgggaggatg

SEQ ID NO: 230073 - DNA, 22 bp, Artificial Sequence
  Description of Artificial Sequence: Synthetic oligonucleotide
ggctgagggccgggaggatgca

SEQ ID NO: 230074 - DNA, 23 bp, Artificial Sequence
  Description of Artificial Sequence: Synthetic oligonucleotide
gctgagggccgggaggatgcaga

SEQ ID NO: 230075 - DNA, 23 bp, Artificial Sequence
  Description of Artificial Sequence: Synthetic oligonucleotide
ctgagggccgggaggatgcagag

SEQ ID NO: 230076 - DNA, 24 bp, Artificial Sequence
  Description of Artificial Sequence: Synthetic oligonucleotide
tgagggccgggaggatgcagagct

SEQ ID NO: 230077 - DNA, 23 bp, Artificial Sequence
  Description of Artificial Sequence: Synthetic oligonucleotide
gagggccgggaggatgcagagct

SEQ ID NO: 230078 - DNA, 23 bp, Artificial Sequence
  Description of Artificial Sequence: Synthetic oligonucleotide
agggccgggaggatgcagagctg

SEQ ID NO: 230079 - DNA, 22 bp, Artificial Sequence
  Description of Artificial Sequence: Synthetic oligonucleotide
gggccgggaggatgcagagctg

SEQ ID NO: 230080 - DNA, 23 bp, Artificial Sequence
  Description of Artificial Sequence: Synthetic oligonucleotide
ggccgggaggatgcagagctgct

SEQ ID NO: 230081 - DNA, 23 bp, Artificial Sequence
  Description of Artificial Sequence: Synthetic oligonucleotide
gccgggaggatgcagagctgctg

SEQ ID NO: 230082 - DNA, 24 bp, Artificial Sequence
  Description of Artificial Sequence: Synthetic oligonucleotide
ccgggaggatgcagagctgctggt

SEQ ID NO: 230083 - DNA, 25 bp, Artificial Sequence
  Description of Artificial Sequence: Synthetic oligonucleotide
cgggaggatgcagagctgctggtga

SEQ ID NO: 230084 - DNA, 25 bp, Artificial Sequence
  Description of Artificial Sequence: Synthetic oligonucleotide
gggaggatgcagagctgctggtgac

SEQ ID NO: 230085 - DNA, 25 bp, Artificial Sequence
  Description of Artificial Sequence: Synthetic oligonucleotide
ggaggatgcagagctgctggtgacg

SEQ ID NO: 230086 - DNA, 26 bp, Artificial Sequence
  Description of Artificial Sequence: Synthetic oligonucleotide
gaggatgcagagctgctggtgacggt

SEQ ID NO: 230087 - DNA, 26 bp, Artificial Sequence
  Description of Artificial Sequence: Synthetic oligonucleotide
aggatgcagagctgctggtgacggtg

SEQ ID NO: 230088 - DNA, 25 bp, Artificial Sequence
  Description of Artificial Sequence: Synthetic oligonucleotide
ggatgcagagctgctggtgacggtg

SEQ ID NO: 230089 - DNA, 25 bp, Artificial Sequence
  Description of Artificial Sequence: Synthetic oligonucleotide
gatgcagagctgctggtgacggtgc

SEQ ID NO: 230090 - DNA, 26 bp, Artificial Sequence
  Description of Artificial Sequence: Synthetic oligonucleotide
atgcagagctgctggtgacggtgcgt

SEQ ID NO: 230091 - DNA, 25 bp, Artificial Sequence
  Description of Artificial Sequence: Synthetic oligonucleotide
tgcagagctgctggtgacggtgcgt

SEQ ID NO: 230092 - DNA, 24 bp, Artificial Sequence
  Description of Artificial Sequence: Synthetic oligonucleotide
gcagagctgctggtgacggtgcgt

SEQ ID NO: 230093 - DNA, 24 bp, Artificial Sequence
  Description of Artificial Sequence: Synthetic oligonucleotide
cagagctgctggtgacggtgcgtg

SEQ ID NO: 230094 - DNA, 24 bp, Artificial Sequence
  Description of Artificial Sequence: Synthetic oligonucleotide
agagctgctggtgacggtgcgtgg

SEQ ID NO: 230095 - DNA, 23 bp, Artificial Sequence
  Description of Artificial Sequence: Synthetic oligonucleotide
gagctgctggtgacggtgcgtgg

SEQ ID NO: 230096 - DNA, 23 bp, Artificial Sequence
  Description of Artificial Sequence: Synthetic oligonucleotide
agctgctggtgacggtgcgtggg

SEQ ID NO: 230097 - DNA, 22 bp, Artificial Sequence
  Description of Artificial Sequence: Synthetic oligonucleotide
gctgctggtgacggtgcgtggg

SEQ ID NO: 230098 - DNA, 22 bp, Artificial Sequence
  Description of Artificial Sequence: Synthetic oligonucleotide
ctgctggtgacggtgcgtgggg

SEQ ID NO: 230099 - DNA, 22 bp, Artificial Sequence
  Description of Artificial Sequence: Synthetic oligonucleotide
tgctggtgacggtgcgtggggg

SEQ ID NO: 230100 - DNA, 21 bp, Artificial Sequence
  Description of Artificial Sequence: Synthetic oligonucleotide
gctggtgacggtgcgtggggg

SEQ ID NO: 230101 - DNA, 21 bp, Artificial Sequence
  Description of Artificial Sequence: Synthetic oligonucleotide
ctggtgacggtgcgtgggggc

SEQ ID NO: 230102 - DNA, 21 bp, Artificial Sequence
  Description of Artificial Sequence: Synthetic oligonucleotide
tggtgacggtgcgtgggggcc

SEQ ID NO: 230103 - DNA, 20 bp, Artificial Sequence
  Description of Artificial Sequence: Synthetic oligonucleotide
ggtgacggtgcgtgggggcc

SEQ ID NO: 230104 - DNA, 20 bp, Artificial Sequence
  Description of Artificial Sequence: Synthetic oligonucleotide
gtgacggtgcgtgggggccg

SEQ ID NO: 230105 - DNA, 20 bp, Artificial Sequence
  Description of Artificial Sequence: Synthetic oligonucleotide
tgacggtgcgtgggggccgg

SEQ ID NO: 230106 - DNA, 20 bp, Artificial Sequence
  Description of Artificial Sequence: Synthetic oligonucleotide
gacggtgcgtgggggccggt

SEQ ID NO: 230107 - DNA, 20 bp, Artificial Sequence
  Description of Artificial Sequence: Synthetic oligonucleotide
acggtgcgtgggggccggct

SEQ ID NO: 230108 - DNA, 20 bp, Artificial Sequence
  Description of Artificial Sequence: Synthetic oligonucleotide
cggtgcgtgggggccggctt

SEQ ID NO: 230109 - DNA, 20 bp, Artificial Sequence
  Description of Artificial Sequence: Synthetic oligonucleotide
ggtgcgtgggggccggctgt

SEQ ID NO: 230110 - DNA, 20 bp, Artificial Sequence
  Description of Artificial Sequence: Synthetic oligonucleotide
gtgcgtgggggccggctgct

SEQ ID NO: 230111 - DNA, 20 bp, Artificial Sequence
  Description of Artificial Sequence: Synthetic oligonucleotide
tgcgtgggggccggctgcgt

SEQ ID NO: 230112 - DNA, 20 bp, Artificial Sequence
  Description of Artificial Sequence: Synthetic oligonucleotide
gcgtgggggccggctgcgtt

SEQ ID NO: 230113 - DNA, 20 bp, Artificial Sequence
  Description of Artificial Sequence: Synthetic oligonucleotide
cgtgggggccggctgcggtt

SEQ ID NO: 230114 - DNA, 20 bp, Artificial Sequence
  Description of Artificial Sequence: Synthetic oligonucleotide
gtgggggccggctgcgggtt

SEQ ID NO: 230115 - DNA, 20 bp, Artificial Sequence
  Description of Artificial Sequence: Synthetic oligonucleotide
tgggggccggctgcggggtt

SEQ ID NO: 230116 - DNA, 20 bp, Artificial Sequence
  Description of Artificial Sequence: Synthetic oligonucleotide
gggggccggctgcggggttt

SEQ ID NO: 230117 - DNA, 20 bp, Artificial Sequence
  Description of Artificial Sequence: Synthetic oligonucleotide
ggggccggctgcggggcatt

SEQ ID NO: 230118 - DNA, 20 bp, Artificial Sequence
  Description of Artificial Sequence: Synthetic oligonucleotide
gggccggctgcggggcattc

SEQ ID NO: 230119 - DNA, 20 bp, Artificial Sequence
  Description of Artificial Sequence: Synthetic oligonucleotide
ggccggctgcggggcattcg

SEQ ID NO: 230120 - DNA, 20 bp, Artificial Sequence
  Description of Artificial Sequence: Synthetic oligonucleotide
gccggctgcggggcattcgc

SEQ ID NO: 230121 - DNA, 21 bp, Artificial Sequence
  Description of Artificial Sequence: Synthetic oligonucleotide
ccggctgcggggcattcgcct

SEQ ID NO: 230122 - DNA, 23 bp, Artificial Sequence
  Description of Artificial Sequence: Synthetic oligonucleotide
cggctgcggggcattcgcctgaa

SEQ ID NO: 230123 - DNA, 24 bp, Artificial Sequence
  Description of Artificial Sequence: Synthetic oligonucleotide
ggctgcggggcattcgcctgaaga

SEQ ID NO: 230124 - DNA, 24 bp, Artificial Sequence
  Description of Artificial Sequence: Synthetic oligonucleotide
gctgcggggcattcgcctgaagac

SEQ ID NO: 230125 - DNA, 24 bp, Artificial Sequence
  Description of Artificial Sequence: Synthetic oligonucleotide
ctgcggggcattcgcctgaagacc

SEQ ID NO: 230126 - DNA, 24 bp, Artificial Sequence
  Description of Artificial Sequence: Synthetic oligonucleotide
tgcggggcattcgcctgaagaccc

SEQ ID NO: 230127 - DNA, 23 bp, Artificial Sequence
  Description of Artificial Sequence: Synthetic oligonucleotide
gcggggcattcgcctgaagaccc

SEQ ID NO: 230128 - DNA, 23 bp, Artificial Sequence
  Description of Artificial Sequence: Synthetic oligonucleotide
cggggcattcgcctgaagacccc

SEQ ID NO: 230129 - DNA, 23 bp, Artificial Sequence
  Description of Artificial Sequence: Synthetic oligonucleotide
ggggcattcgcctgaagaccccc

SEQ ID NO: 230130 - DNA, 23 bp, Artificial Sequence
  Description of Artificial Sequence: Synthetic oligonucleotide
gggcattcgcctgaagacccccg

SEQ ID NO: 230131 - DNA, 23 bp, Artificial Sequence
  Description of Artificial Sequence: Synthetic oligonucleotide
ggcattcgcctgaagacccccgg

SEQ ID NO: 230132 - DNA, 23 bp, Artificial Sequence
  Description of Artificial Sequence: Synthetic oligonucleotide
gcattcgcctgaagacccccggg

SEQ ID NO: 230133 - DNA, 23 bp, Artificial Sequence
  Description of Artificial Sequence: Synthetic oligonucleotide
cattcgcctgaagacccccgggg

SEQ ID NO: 230134 - DNA, 23 bp, Artificial Sequence
  Description of Artificial Sequence: Synthetic oligonucleotide
attcgcctgaagacccccggggg

SEQ ID NO: 230135 - DNA, 22 bp, Artificial Sequence
  Description of Artificial Sequence: Synthetic oligonucleotide
ttcgcctgaagacccccggggg

SEQ ID NO: 230136 - DNA, 21 bp, Artificial Sequence
  Description of Artificial Sequence: Synthetic oligonucleotide
tcgcctgaagacccccggggg

SEQ ID NO: 230137 - DNA, 20 bp, Artificial Sequence
  Description of Artificial Sequence: Synthetic oligonucleotide
cgcctgaagacccccggggg

SEQ ID NO: 230138 - DNA, 20 bp, Artificial Sequence
  Description of Artificial Sequence: Synthetic oligonucleotide
gcctgaagacccccgggggc

SEQ ID NO: 230139 - DNA, 20 bp, Artificial Sequence
  Description of Artificial Sequence: Synthetic oligonucleotide
cctgaagacccccgggggcc

SEQ ID NO: 230140 - DNA, 21 bp, Artificial Sequence
  Description of Artificial Sequence: Synthetic oligonucleotide
ctgaagacccccgggggccct

SEQ ID NO: 230141 - DNA, 22 bp, Artificial Sequence
  Description of Artificial Sequence: Synthetic oligonucleotide
tgaagacccccgggggccctgt

SEQ ID NO: 230142 - DNA, 21 bp, Artificial Sequence
  Description of Artificial Sequence: Synthetic oligonucleotide
gaagacccccgggggccctgt

SEQ ID NO: 230143 - DNA, 22 bp, Artificial Sequence
  Description of Artificial Sequence: Synthetic oligonucleotide
aagacccccgggggccctgtct

SEQ ID NO: 230144 - DNA, 21 bp, Artificial Sequence
  Description of Artificial Sequence: Synthetic oligonucleotide
agacccccgggggccctgtct

SEQ ID NO: 230145 - DNA, 20 bp, Artificial Sequence
  Description of Artificial Sequence: Synthetic oligonucleotide
gacccccgggggccctgtct

SEQ ID NO: 230146 - DNA, 21 bp, Artificial Sequence
  Description of Artificial Sequence: Synthetic oligonucleotide
acccccgggggccctgtctct

SEQ ID NO: 230147 - DNA, 20 bp, Artificial Sequence
  Description of Artificial Sequence: Synthetic oligonucleotide
cccccgggggccctgtctct

SEQ ID NO: 230148 - DNA, 20 bp, Artificial Sequence
  Description of Artificial Sequence: Synthetic oligonucleotide
ccccgggggccctgtctctg

SEQ ID NO: 230149 - DNA, 23 bp, Artificial Sequence
  Description of Artificial Sequence: Synthetic oligonucleotide
cccgggggccctgtctctgcttt

SEQ ID NO: 230150 - DNA, 23 bp, Artificial Sequence
  Description of Artificial Sequence: Synthetic oligonucleotide
ccgggggccctgtctctgctttc

SEQ ID NO: 230151 - DNA, 24 bp, Artificial Sequence
  Description of Artificial Sequence: Synthetic oligonucleotide
cgggggccctgtctctgctttcct

SEQ ID NO: 230152 - DNA, 24 bp, Artificial Sequence
  Description of Artificial Sequence: Synthetic oligonucleotide
gggggccctgtctctgctttcctg

SEQ ID NO: 230153 - DNA, 24 bp, Artificial Sequence
  Description of Artificial Sequence: Synthetic oligonucleotide
ggggccctgtctctgctttcctgg

SEQ ID NO: 230154 - DNA, 24 bp, Artificial Sequence
  Description of Artificial Sequence: Synthetic oligonucleotide
gggccctgtctctgctttcctggg

SEQ ID NO: 230155 - DNA, 26 bp, Artificial Sequence
  Description of Artificial Sequence: Synthetic oligonucleotide
ggccctgtctctgctttcctgggcat

SEQ ID NO: 230156 - DNA, 26 bp, Artificial Sequence
  Description of Artificial Sequence: Synthetic oligonucleotide
gccctgtctctgctttcctgggcatc

SEQ ID NO: 230157 - DNA, 26 bp, Artificial Sequence
  Description of Artificial Sequence: Synthetic oligonucleotide
ccctgtctctgctttcctgggcatcc

SEQ ID NO: 230158 - DNA, 26 bp, Artificial Sequence
  Description of Artificial Sequence: Synthetic oligonucleotide
cctgtctctgctttcctgggcatccc

SEQ ID NO: 230159 - DNA, 27 bp, Artificial Sequence
  Description of Artificial Sequence: Synthetic oligonucleotide
ctgtctctgctttcctgggcatcccct

SEQ ID NO: 230160 - DNA, 29 bp, Artificial Sequence
  Description of Artificial Sequence: Synthetic oligonucleotide
tgtctctgctttcctgggcatcccctttg

SEQ ID NO: 230161 - DNA, 28 bp, Artificial Sequence
  Description of Artificial Sequence: Synthetic oligonucleotide
gtctctgctttcctgggcatcccctttg

SEQ ID NO: 230162 - DNA, 28 bp, Artificial Sequence
  Description of Artificial Sequence: Synthetic oligonucleotide
tctctgctttcctgggcatcccctttgc

SEQ ID NO: 230163 - DNA, 27 bp, Artificial Sequence
  Description of Artificial Sequence: Synthetic oligonucleotide
ctctgctttcctgggcatcccctttgc

SEQ ID NO: 230164 - DNA, 27 bp, Artificial Sequence
  Description of Artificial Sequence: Synthetic oligonucleotide
tctgctttcctgggcatcccctttgcg

SEQ ID NO: 230165 - DNA, 26 bp, Artificial Sequence
  Description of Artificial Sequence: Synthetic oligonucleotide
ctgctttcctgggcatcccctttgcg

SEQ ID NO: 230166 - DNA, 27 bp, Artificial Sequence
  Description of Artificial Sequence: Synthetic oligonucleotide
tgctttcctgggcatcccctttgcgga

SEQ ID NO: 230167 - DNA, 26 bp, Artificial Sequence
  Description of Artificial Sequence: Synthetic oligonucleotide
gctttcctgggcatcccctttgcgga

SEQ ID NO: 230168 - DNA, 26 bp, Artificial Sequence
  Description of Artificial Sequence: Synthetic oligonucleotide
ctttcctgggcatcccctttgcggag

SEQ ID NO: 230169 - DNA, 26 bp, Artificial Sequence
  Description of Artificial Sequence: Synthetic oligonucleotide
tttcctgggcatcccctttgcggagc

SEQ ID NO: 230170 - DNA, 25 bp, Artificial Sequence
  Description of Artificial Sequence: Synthetic oligonucleotide
ttcctgggcatcccctttgcggagc

SEQ ID NO: 230171 - DNA, 24 bp, Artificial Sequence
  Description of Artificial Sequence: Synthetic oligonucleotide
tcctgggcatcccctttgcggagc

SEQ ID NO: 230172 - DNA, 23 bp, Artificial Sequence
  Description of Artificial Sequence: Synthetic oligonucleotide
cctgggcatcccctttgcggagc

SEQ ID NO: 230173 - DNA, 24 bp, Artificial Sequence
  Description of Artificial Sequence: Synthetic oligonucleotide
ctgggcatcccctttgcggagcca

SEQ ID NO: 230174 - DNA, 24 bp, Artificial Sequence
  Description of Artificial Sequence: Synthetic oligonucleotide
tgggcatcccctttgcggagccac

SEQ ID NO: 230175 - DNA, 23 bp, Artificial Sequence
  Description of Artificial Sequence: Synthetic oligonucleotide
gggcatcccctttgcggagccac

SEQ ID NO: 230176 - DNA, 23 bp, Artificial Sequence
  Description of Artificial Sequence: Synthetic oligonucleotide
ggcatcccctttgcggagccacc

SEQ ID NO: 230177 - DNA, 25 bp, Artificial Sequence
  Description of Artificial Sequence: Synthetic oligonucleotide
gcatcccctttgcggagccacccat

SEQ ID NO: 230178 - DNA, 25 bp, Artificial Sequence
  Description of Artificial Sequence: Synthetic oligonucleotide
catcccctttgcggagccacccatg

SEQ ID NO: 230179 - DNA, 25 bp, Artificial Sequence
  Description of Artificial Sequence: Synthetic oligonucleotide
atcccctttgcggagccacccatgg

SEQ ID NO: 230180 - DNA, 24 bp, Artificial Sequence
  Description of Artificial Sequence: Synthetic oligonucleotide
tcccctttgcggagccacccatgg

SEQ ID NO: 230181 - DNA, 23 bp, Artificial Sequence
  Description of Artificial Sequence: Synthetic oligonucleotide
cccctttgcggagccacccatgg

SEQ ID NO: 230182 - DNA, 24 bp, Artificial Sequence
  Description of Artificial Sequence: Synthetic oligonucleotide
ccctttgcggagccacccatggga

SEQ ID NO: 230183 - DNA, 24 bp, Artificial Sequence
  Description of Artificial Sequence: Synthetic oligonucleotide
cctttgcggagccacccatgggac

SEQ ID NO: 230184 - DNA, 24 bp, Artificial Sequence
  Description of Artificial Sequence: Synthetic oligonucleotide
ctttgcggagccacccatgggacc

SEQ ID NO: 230185 - DNA, 24 bp, Artificial Sequence
  Description of Artificial Sequence: Synthetic oligonucleotide
tttgcggagccacccatgggaccc

SEQ ID NO: 230186 - DNA, 23 bp, Artificial Sequence
  Description of Artificial Sequence: Synthetic oligonucleotide
ttgcggagccacccatgggaccc

SEQ ID NO: 230187 - DNA, 22 bp, Artificial Sequence
  Description of Artificial Sequence: Synthetic oligonucleotide
tgcggagccacccatgggaccc

SEQ ID NO: 230188 - DNA, 21 bp, Artificial Sequence
  Description of Artificial Sequence: Synthetic oligonucleotide
gcggagccacccatgggaccc

SEQ ID NO: 230189 - DNA, 21 bp, Artificial Sequence
  Description of Artificial Sequence: Synthetic oligonucleotide
cggagccacccatgggacccc

SEQ ID NO: 230190 - DNA, 22 bp, Artificial Sequence
  Description of Artificial Sequence: Synthetic oligonucleotide
ggagccacccatgggaccccgt

SEQ ID NO: 230191 - DNA, 22 bp, Artificial Sequence
  Description of Artificial Sequence: Synthetic oligonucleotide
gagccacccatgggaccccgtc

SEQ ID NO: 230192 - DNA, 22 bp, Artificial Sequence
  Description of Artificial Sequence: Synthetic oligonucleotide
agccacccatgggaccccgtcg

SEQ ID NO: 230193 - DNA, 21 bp, Artificial Sequence
  Description of Artificial Sequence: Synthetic oligonucleotide
gccacccatgggaccccgtcg

SEQ ID NO: 230194 - DNA, 24 bp, Artificial Sequence
  Description of Artificial Sequence: Synthetic oligonucleotide
ccacccatgggaccccgtcgcttt

SEQ ID NO: 230195 - DNA, 25 bp, Artificial Sequence
  Description of Artificial Sequence: Synthetic oligonucleotide
cacccatgggaccccgtcgctttct

SEQ ID NO: 230196 - DNA, 25 bp, Artificial Sequence
  Description of Artificial Sequence: Synthetic oligonucleotide
acccatgggaccccgtcgctttctg

SEQ ID NO: 230197 - DNA, 24 bp, Artificial Sequence
  Description of Artificial Sequence: Synthetic oligonucleotide
cccatgggaccccgtcgctttctg

SEQ ID NO: 230198 - DNA, 24 bp, Artificial Sequence
  Description of Artificial Sequence: Synthetic oligonucleotide
ccatgggaccccgtcgctttctgc

SEQ ID NO: 230199 - DNA, 25 bp, Artificial Sequence
  Description of Artificial Sequence: Synthetic oligonucleotide
catgggaccccgtcgctttctgcca

SEQ ID NO: 230200 - DNA, 25 bp, Artificial Sequence
  Description of Artificial Sequence: Synthetic oligonucleotide
atgggaccccgtcgctttctgccac

SEQ ID NO: 230201 - DNA, 24 bp, Artificial Sequence
  Description of Artificial Sequence: Synthetic oligonucleotide
tgggaccccgtcgctttctgccac

SEQ ID NO: 230202 - DNA, 23 bp, Artificial Sequence
  Description of Artificial Sequence: Synthetic oligonucleotide
gggaccccgtcgctttctgccac

SEQ ID NO: 230203 - DNA, 23 bp, Artificial Sequence
  Description of Artificial Sequence: Synthetic oligonucleotide
ggaccccgtcgctttctgccacc

SEQ ID NO: 230204 - DNA, 23 bp, Artificial Sequence
  Description of Artificial Sequence: Synthetic oligonucleotide
gaccccgtcgctttctgccaccg

SEQ ID NO: 230205 - DNA, 24 bp, Artificial Sequence
  Description of Artificial Sequence: Synthetic oligonucleotide
accccgtcgctttctgccaccgga

SEQ ID NO: 230206 - DNA, 23 bp, Artificial Sequence
  Description of Artificial Sequence: Synthetic oligonucleotide
ccccgtcgctttctgccaccgga

SEQ ID NO: 230207 - DNA, 23 bp, Artificial Sequence
  Description of Artificial Sequence: Synthetic oligonucleotide
cccgtcgctttctgccaccggag

SEQ ID NO: 230208 - DNA, 23 bp, Artificial Sequence
  Description of Artificial Sequence: Synthetic oligonucleotide
ccgtcgctttctgccaccggagc

SEQ ID NO: 230209 - DNA, 23 bp, Artificial Sequence
  Description of Artificial Sequence: Synthetic oligonucleotide
cgtcgctttctgccaccggagcc

SEQ ID NO: 230210 - DNA, 25 bp, Artificial Sequence
  Description of Artificial Sequence: Synthetic oligonucleotide
gtcgctttctgccaccggagcccaa

SEQ ID NO: 230211 - DNA, 25 bp, Artificial Sequence
  Description of Artificial Sequence: Synthetic oligonucleotide
tcgctttctgccaccggagcccaag

SEQ ID NO: 230212 - DNA, 24 bp, Artificial Sequence
  Description of Artificial Sequence: Synthetic oligonucleotide
cgctttctgccaccggagcccaag

SEQ ID NO: 230213 - DNA, 25 bp, Artificial Sequence
  Description of Artificial Sequence: Synthetic oligonucleotide
gctttctgccaccggagcccaagca

SEQ ID NO: 230214 - DNA, 25 bp, Artificial Sequence
  Description of Artificial Sequence: Synthetic oligonucleotide
ctttctgccaccggagcccaagcag

SEQ ID NO: 230215 - DNA, 25 bp, Artificial Sequence
  Description of Artificial Sequence: Synthetic oligonucleotide
tttctgccaccggagcccaagcagc

SEQ ID NO: 230216 - DNA, 24 bp, Artificial Sequence
  Description of Artificial Sequence: Synthetic oligonucleotide
ttctgccaccggagcccaagcagc

SEQ ID NO: 230217 - DNA, 23 bp, Artificial Sequence
  Description of Artificial Sequence: Synthetic oligonucleotide
tctgccaccggagcccaagcagc

SEQ ID NO: 230218 - DNA, 22 bp, Artificial Sequence
  Description of Artificial Sequence: Synthetic oligonucleotide
ctgccaccggagcccaagcagc

SEQ ID NO: 230219 - DNA, 24 bp, Artificial Sequence
  Description of Artificial Sequence: Synthetic oligonucleotide
tgccaccggagcccaagcagcctt

SEQ ID NO: 230220 - DNA, 23 bp, Artificial Sequence
  Description of Artificial Sequence: Synthetic oligonucleotide
gccaccggagcccaagcagcctt

SEQ ID NO: 230221 - DNA, 23 bp, Artificial Sequence
  Description of Artificial Sequence: Synthetic oligonucleotide
ccaccggagcccaagcagccttg

SEQ ID NO: 230222 - DNA, 24 bp, Artificial Sequence
  Description of Artificial Sequence: Synthetic oligonucleotide
caccggagcccaagcagccttggt

SEQ ID NO: 230223 - DNA, 25 bp, Artificial Sequence
  Description of Artificial Sequence: Synthetic oligonucleotide
accggagcccaagcagccttggtca

SEQ ID NO: 230224 - DNA, 24 bp, Artificial Sequence
  Description of Artificial Sequence: Synthetic oligonucleotide
ccggagcccaagcagccttggtca

SEQ ID NO: 230225 - DNA, 24 bp, Artificial Sequence
  Description of Artificial Sequence: Synthetic oligonucleotide
cggagcccaagcagccttggtcag

SEQ ID NO: 230226 - DNA, 24 bp, Artificial Sequence
  Description of Artificial Sequence: Synthetic oligonucleotide
ggagcccaagcagccttggtcagg

SEQ ID NO: 230227 - DNA, 24 bp, Artificial Sequence
  Description of Artificial Sequence: Synthetic oligonucleotide
gagcccaagcagccttggtcaggg

SEQ ID NO: 230228 - DNA, 25 bp, Artificial Sequence
  Description of Artificial Sequence: Synthetic oligonucleotide
agcccaagcagccttggtcaggggt

SEQ ID NO: 230229 - DNA, 24 bp, Artificial Sequence
  Description of Artificial Sequence: Synthetic oligonucleotide
gcccaagcagccttggtcaggggt

SEQ ID NO: 230230 - DNA, 24 bp, Artificial Sequence
  Description of Artificial Sequence: Synthetic oligonucleotide
cccaagcagccttggtcaggggtg

SEQ ID NO: 230231 - DNA, 26 bp, Artificial Sequence
  Description of Artificial Sequence: Synthetic oligonucleotide
ccaagcagccttggtcaggggtggta

SEQ ID NO: 230232 - DNA, 27 bp, Artificial Sequence
  Description of Artificial Sequence: Synthetic oligonucleotide
caagcagccttggtcaggggtggtaga

SEQ ID NO: 230233 - DNA, 27 bp, Artificial Sequence
  Description of Artificial Sequence: Synthetic oligonucleotide
aagcagccttggtcaggggtggtagac

SEQ ID NO: 230234 - DNA, 26 bp, Artificial Sequence
  Description of Artificial Sequence: Synthetic oligonucleotide
agcagccttggtcaggggtggtagac

SEQ ID NO: 230235 - DNA, 25 bp, Artificial Sequence
  Description of Artificial Sequence: Synthetic oligonucleotide
gcagccttggtcaggggtggtagac

SEQ ID NO: 230236 - DNA, 25 bp, Artificial Sequence
  Description of Artificial Sequence: Synthetic oligonucleotide
cagccttggtcaggggtggtagacg

SEQ ID NO: 230237 - DNA, 27 bp, Artificial Sequence
  Description of Artificial Sequence: Synthetic oligonucleotide
agccttggtcaggggtggtagacgcta

SEQ ID NO: 230238 - DNA, 26 bp, Artificial Sequence
  Description of Artificial Sequence: Synthetic oligonucleotide
gccttggtcaggggtggtagacgcta

SEQ ID NO: 230239 - DNA, 27 bp, Artificial Sequence
  Description of Artificial Sequence: Synthetic oligonucleotide
ccttggtcaggggtggtagacgctaca

SEQ ID NO: 230240 - DNA, 28 bp, Artificial Sequence
  Description of Artificial Sequence: Synthetic oligonucleotide
cttggtcaggggtggtagacgctacaac

SEQ ID NO: 230241 - DNA, 28 bp, Artificial Sequence
  Description of Artificial Sequence: Synthetic oligonucleotide
ttggtcaggggtggtagacgctacaacc

SEQ ID NO: 230242 - DNA, 27 bp, Artificial Sequence
  Description of Artificial Sequence: Synthetic oligonucleotide
tggtcaggggtggtagacgctacaacc

SEQ ID NO: 230243 - DNA, 27 bp, Artificial Sequence
  Description of Artificial Sequence: Synthetic oligonucleotide
ggtcaggggtggtagacgctacaacct

SEQ ID NO: 230244 - DNA, 28 bp, Artificial Sequence
  Description of Artificial Sequence: Synthetic oligonucleotide
gtcaggggtggtagacgctacaaccttc

SEQ ID NO: 230245 - DNA, 28 bp, Artificial Sequence
  Description of Artificial Sequence: Synthetic oligonucleotide
tcaggggtggtagacgctacaaccttcc

SEQ ID NO: 230246 - DNA, 27 bp, Artificial Sequence
  Description of Artificial Sequence: Synthetic oligonucleotide
caggggtggtagacgctacaaccttcc

SEQ ID NO: 230247 - DNA, 28 bp, Artificial Sequence
  Description of Artificial Sequence: Synthetic oligonucleotide
aggggtggtagacgctacaaccttccag

SEQ ID NO: 230248 - DNA, 27 bp, Artificial Sequence
  Description of Artificial Sequence: Synthetic oligonucleotide
ggggtggtagacgctacaaccttccag

SEQ ID NO: 230249 - DNA, 28 bp, Artificial Sequence
  Description of Artificial Sequence: Synthetic oligonucleotide
gggtggtagacgctacaaccttccagag

SEQ ID NO: 230250 - DNA, 29 bp, Artificial Sequence
  Description of Artificial Sequence: Synthetic oligonucleotide
ggtggtagacgctacaaccttccagagtg

SEQ ID NO: 230251 - DNA, 30 bp, Artificial Sequence
  Description of Artificial Sequence: Synthetic oligonucleotide
gtggtagacgctacaaccttccagagtgtc

SEQ ID NO: 230252 - DNA, 31 bp, Artificial Sequence
  Description of Artificial Sequence: Synthetic oligonucleotide
tggtagacgctacaaccttccagagtgtctg

SEQ ID NO: 230253 - DNA, 30 bp, Artificial Sequence
  Description of Artificial Sequence: Synthetic oligonucleotide
ggtagacgctacaaccttccagagtgtctg

SEQ ID NO: 230254 - DNA, 30 bp, Artificial Sequence
  Description of Artificial Sequence: Synthetic oligonucleotide
gtagacgctacaaccttccagagtgtctgc

SEQ ID NO: 230255 - DNA, 32 bp, Artificial Sequence
  Description of Artificial Sequence: Synthetic oligonucleotide
tagacgctacaaccttccagagtgtctgctac

SEQ ID NO: 230256 - DNA, 31 bp, Artificial Sequence
  Description of Artificial Sequence: Synthetic oligonucleotide
agacgctacaaccttccagagtgtctgctac

SEQ ID NO: 230257 - DNA, 30 bp, Artificial Sequence
  Description of Artificial Sequence: Synthetic oligonucleotide
gacgctacaaccttccagagtgtctgctac

SEQ ID NO: 230258 - DNA, 30 bp, Artificial Sequence
  Description of Artificial Sequence: Synthetic oligonucleotide
acgctacaaccttccagagtgtctgctacc

SEQ ID NO: 230259 - DNA, 29 bp, Artificial Sequence
  Description of Artificial Sequence: Synthetic oligonucleotide
cgctacaaccttccagagtgtctgctacc

SEQ ID NO: 230260 - DNA, 34 bp, Artificial Sequence
  Description of Artificial Sequence: Synthetic oligonucleotide
gctacaaccttccagagtgtctgctaccaatatg

SEQ ID NO: 230261 - DNA, 35 bp, Artificial Sequence
  Description of Artificial Sequence: Synthetic oligonucleotide
ctacaaccttccagagtgtctgctaccaatatgtg

SEQ ID NO: 230262 - DNA, 35 bp, Artificial Sequence
  Description of Artificial Sequence: Synthetic oligonucleotide
tacaaccttccagagtgtctgctaccaatatgtgg

SEQ ID NO: 230263 - DNA, 34 bp, Artificial Sequence
  Description of Artificial Sequence: Synthetic oligonucleotide
acaaccttccagagtgtctgctaccaatatgtgg

SEQ ID NO: 230264 - DNA, 33 bp, Artificial Sequence
  Description of Artificial Sequence: Synthetic oligonucleotide
caaccttccagagtgtctgctaccaatatgtgg

SEQ ID NO: 230265 - DNA, 34 bp, Artificial Sequence
  Description of Artificial Sequence: Synthetic oligonucleotide
aaccttccagagtgtctgctaccaatatgtggac

SEQ ID NO: 230266 - DNA, 33 bp, Artificial Sequence
  Description of Artificial Sequence: Synthetic oligonucleotide
accttccagagtgtctgctaccaatatgtggac

SEQ ID NO: 230267 - DNA, 32 bp, Artificial Sequence
  Description of Artificial Sequence: Synthetic oligonucleotide
ccttccagagtgtctgctaccaatatgtggac

SEQ ID NO: 230268 - DNA, 33 bp, Artificial Sequence
  Description of Artificial Sequence: Synthetic oligonucleotide
cttccagagtgtctgctaccaatatgtggacac

SEQ ID NO: 230269 - DNA, 33 bp, Artificial Sequence
  Description of Artificial Sequence: Synthetic oligonucleotide
ttccagagtgtctgctaccaatatgtggacacc

SEQ ID NO: 230270 - DNA, 32 bp, Artificial Sequence
  Description of Artificial Sequence: Synthetic oligonucleotide
tccagagtgtctgctaccaatatgtggacacc

SEQ ID NO: 230271 - DNA, 31 bp, Artificial Sequence
  Description of Artificial Sequence: Synthetic oligonucleotide
ccagagtgtctgctaccaatatgtggacacc

SEQ ID NO: 230272 - DNA, 31 bp, Artificial Sequence
  Description of Artificial Sequence: Synthetic oligonucleotide
cagagtgtctgctaccaatatgtggacaccc

SEQ ID NO: 230273 - DNA, 35 bp, Artificial Sequence
  Description of Artificial Sequence: Synthetic oligonucleotide
agagtgtctgctaccaatatgtggacaccctatac

SEQ ID NO: 230274 - DNA, 34 bp, Artificial Sequence
  Description of Artificial Sequence: Synthetic oligonucleotide
gagtgtctgctaccaatatgtggacaccctatac

SEQ ID NO: 230275 - DNA, 34 bp, Artificial Sequence
  Description of Artificial Sequence: Synthetic oligonucleotide
agtgtctgctaccaatatgtggacaccctatacc

SEQ ID NO: 230276 - DNA, 33 bp, Artificial Sequence
  Description of Artificial Sequence: Synthetic oligonucleotide
gtgtctgctaccaatatgtggacaccctatacc

SEQ ID NO: 230277 - DNA, 33 bp, Artificial Sequence
  Description of Artificial Sequence: Synthetic oligonucleotide
tgtctgctaccaatatgtggacaccctataccc

SEQ ID NO: 230278 - DNA, 32 bp, Artificial Sequence
  Description of Artificial Sequence: Synthetic oligonucleotide
gtctgctaccaatatgtggacaccctataccc

SEQ ID NO: 230279 - DNA, 33 bp, Artificial Sequence
  Description of Artificial Sequence: Synthetic oligonucleotide
tctgctaccaatatgtggacaccctatacccag

SEQ ID NO: 230280 - DNA, 32 bp, Artificial Sequence
  Description of Artificial Sequence: Synthetic oligonucleotide
ctgctaccaatatgtggacaccctatacccag

SEQ ID NO: 230281 - DNA, 32 bp, Artificial Sequence
  Description of Artificial Sequence: Synthetic oligonucleotide
tgctaccaatatgtggacaccctatacccagg

SEQ ID NO: 230282 - DNA, 31 bp, Artificial Sequence
  Description of Artificial Sequence: Synthetic oligonucleotide
gctaccaatatgtggacaccctatacccagg

SEQ ID NO: 230283 - DNA, 35 bp, Artificial Sequence
  Description of Artificial Sequence: Synthetic oligonucleotide
ctaccaatatgtggacaccctatacccaggttttg

SEQ ID NO: 230284 - DNA, 36 bp, Artificial Sequence
  Description of Artificial Sequence: Synthetic oligonucleotide
taccaatatgtggacaccctatacccaggttttgag

SEQ ID NO: 230285 - DNA, 35 bp, Artificial Sequence
  Description of Artificial Sequence: Synthetic oligonucleotide
accaatatgtggacaccctatacccaggttttgag

SEQ ID NO: 230286 - DNA, 34 bp, Artificial Sequence
  Description of Artificial Sequence: Synthetic oligonucleotide
ccaatatgtggacaccctatacccaggttttgag

SEQ ID NO: 230287 - DNA, 34 bp, Artificial Sequence
  Description of Artificial Sequence: Synthetic oligonucleotide
caatatgtggacaccctatacccaggttttgagg

SEQ ID NO: 230288 - DNA, 34 bp, Artificial Sequence
  Description of Artificial Sequence: Synthetic oligonucleotide
aatatgtggacaccctatacccaggttttgaggg

SEQ ID NO: 230289 - DNA, 33 bp, Artificial Sequence
  Description of Artificial Sequence: Synthetic oligonucleotide
atatgtggacaccctatacccaggttttgaggg

SEQ ID NO: 230290 - DNA, 32 bp, Artificial Sequence
  Description of Artificial Sequence: Synthetic oligonucleotide
tatgtggacaccctatacccaggttttgaggg

SEQ ID NO: 230291 - DNA, 31 bp, Artificial Sequence
  Description of Artificial Sequence: Synthetic oligonucleotide
atgtggacaccctatacccaggttttgaggg

SEQ ID NO: 230292 - DNA, 30 bp, Artificial Sequence
  Description of Artificial Sequence: Synthetic oligonucleotide
tgtggacaccctatacccaggttttgaggg

SEQ ID NO: 230293 - DNA, 29 bp, Artificial Sequence
  Description of Artificial Sequence: Synthetic oligonucleotide
gtggacaccctatacccaggttttgaggg

SEQ ID NO: 230294 - DNA, 29 bp, Artificial Sequence
  Description of Artificial Sequence: Synthetic oligonucleotide
tggacaccctatacccaggttttgagggc

SEQ ID NO: 230295 - DNA, 28 bp, Artificial Sequence
  Description of Artificial Sequence: Synthetic oligonucleotide
ggacaccctatacccaggttttgagggc

SEQ ID NO: 230296 - DNA, 29 bp, Artificial Sequence
  Description of Artificial Sequence: Synthetic oligonucleotide
gacaccctatacccaggttttgagggcac

SEQ ID NO: 230297 - DNA, 29 bp, Artificial Sequence
  Description of Artificial Sequence: Synthetic oligonucleotide
acaccctatacccaggttttgagggcacc

SEQ ID NO: 230298 - DNA, 28 bp, Artificial Sequence
  Description of Artificial Sequence: Synthetic oligonucleotide
caccctatacccaggttttgagggcacc

SEQ ID NO: 230299 - DNA, 28 bp, Artificial Sequence
  Description of Artificial Sequence: Synthetic oligonucleotide
accctatacccaggttttgagggcaccg

SEQ ID NO: 230300 - DNA, 27 bp, Artificial Sequence
  Description of Artificial Sequence: Synthetic oligonucleotide
ccctatacccaggttttgagggcaccg

SEQ ID NO: 230301 - DNA, 28 bp, Artificial Sequence
  Description of Artificial Sequence: Synthetic oligonucleotide
cctatacccaggttttgagggcaccgag

SEQ ID NO: 230302 - DNA, 30 bp, Artificial Sequence
  Description of Artificial Sequence: Synthetic oligonucleotide
ctatacccaggttttgagggcaccgagatg

SEQ ID NO: 230303 - DNA, 31 bp, Artificial Sequence
  Description of Artificial Sequence: Synthetic oligonucleotide
tatacccaggttttgagggcaccgagatgtg

SEQ ID NO: 230304 - DNA, 30 bp, Artificial Sequence
  Description of Artificial Sequence: Synthetic oligonucleotide
atacccaggttttgagggcaccgagatgtg

SEQ ID NO: 230305 - DNA, 29 bp, Artificial Sequence
  Description of Artificial Sequence: Synthetic oligonucleotide
tacccaggttttgagggcaccgagatgtg

SEQ ID NO: 230306 - DNA, 28 bp, Artificial Sequence
  Description of Artificial Sequence: Synthetic oligonucleotide
acccaggttttgagggcaccgagatgtg

SEQ ID NO: 230307 - DNA, 27 bp, Artificial Sequence
  Description of Artificial Sequence: Synthetic oligonucleotide
cccaggttttgagggcaccgagatgtg

SEQ ID NO: 230308 - DNA, 27 bp, Artificial Sequence
  Description of Artificial Sequence: Synthetic oligonucleotide
ccaggttttgagggcaccgagatgtgg

SEQ ID NO: 230309 - DNA, 29 bp, Artificial Sequence
  Description of Artificial Sequence: Synthetic oligonucleotide
caggttttgagggcaccgagatgtggaac

SEQ ID NO: 230310 - DNA, 29 bp, Artificial Sequence
  Description of Artificial Sequence: Synthetic oligonucleotide
aggttttgagggcaccgagatgtggaacc

SEQ ID NO: 230311 - DNA, 28 bp, Artificial Sequence
  Description of Artificial Sequence: Synthetic oligonucleotide
ggttttgagggcaccgagatgtggaacc

SEQ ID NO: 230312 - DNA, 28 bp, Artificial Sequence
  Description of Artificial Sequence: Synthetic oligonucleotide
gttttgagggcaccgagatgtggaaccc

SEQ ID NO: 230313 - DNA, 28 bp, Artificial Sequence
  Description of Artificial Sequence: Synthetic oligonucleotide
ttttgagggcaccgagatgtggaacccc

SEQ ID NO: 230314 - DNA, 27 bp, Artificial Sequence
  Description of Artificial Sequence: Synthetic oligonucleotide
tttgagggcaccgagatgtggaacccc

SEQ ID NO: 230315 - DNA, 27 bp, Artificial Sequence
  Description of Artificial Sequence: Synthetic oligonucleotide
ttgagggcaccgagatgtggaacccca

SEQ ID NO: 230316 - DNA, 27 bp, Artificial Sequence
  Description of Artificial Sequence: Synthetic oligonucleotide
tgagggcaccgagatgtggaaccccaa

SEQ ID NO: 230317 - DNA, 26 bp, Artificial Sequence
  Description of Artificial Sequence: Synthetic oligonucleotide
gagggcaccgagatgtggaaccccaa

SEQ ID NO: 230318 - DNA, 26 bp, Artificial Sequence
  Description of Artificial Sequence: Synthetic oligonucleotide
agggcaccgagatgtggaaccccaac

SEQ ID NO: 230319 - DNA, 25 bp, Artificial Sequence
  Description of Artificial Sequence: Synthetic oligonucleotide
gggcaccgagatgtggaaccccaac

SEQ ID NO: 230320 - DNA, 25 bp, Artificial Sequence
  Description of Artificial Sequence: Synthetic oligonucleotide
ggcaccgagatgtggaaccccaacc

SEQ ID NO: 230321 - DNA, 26 bp, Artificial Sequence
  Description of Artificial Sequence: Synthetic oligonucleotide
gcaccgagatgtggaaccccaaccgt

SEQ ID NO: 230322 - DNA, 27 bp, Artificial Sequence
  Description of Artificial Sequence: Synthetic oligonucleotide
caccgagatgtggaaccccaaccgtga

SEQ ID NO: 230323 - DNA, 27 bp, Artificial Sequence
  Description of Artificial Sequence: Synthetic oligonucleotide
accgagatgtggaaccccaaccgtgag

SEQ ID NO: 230324 - DNA, 26 bp, Artificial Sequence
  Description of Artificial Sequence: Synthetic oligonucleotide
ccgagatgtggaaccccaaccgtgag

SEQ ID NO: 230325 - DNA, 27 bp, Artificial Sequence
  Description of Artificial Sequence: Synthetic oligonucleotide
cgagatgtggaaccccaaccgtgagct

SEQ ID NO: 230326 - DNA, 27 bp, Artificial Sequence
  Description of Artificial Sequence: Synthetic oligonucleotide
gagatgtggaaccccaaccgtgagctg

SEQ ID NO: 230327 - DNA, 28 bp, Artificial Sequence
  Description of Artificial Sequence: Synthetic oligonucleotide
agatgtggaaccccaaccgtgagctgag

SEQ ID NO: 230328 - DNA, 27 bp, Artificial Sequence
  Description of Artificial Sequence: Synthetic oligonucleotide
gatgtggaaccccaaccgtgagctgag

SEQ ID NO: 230329 - DNA, 27 bp, Artificial Sequence
  Description of Artificial Sequence: Synthetic oligonucleotide
atgtggaaccccaaccgtgagctgagc

SEQ ID NO: 230330 - DNA, 26 bp, Artificial Sequence
  Description of Artificial Sequence: Synthetic oligonucleotide
tgtggaaccccaaccgtgagctgagc

SEQ ID NO: 230331 - DNA, 25 bp, Artificial Sequence
  Description of Artificial Sequence: Synthetic oligonucleotide
gtggaaccccaaccgtgagctgagc

SEQ ID NO: 230332 - DNA, 26 bp, Artificial Sequence
  Description of Artificial Sequence: Synthetic oligonucleotide
tggaaccccaaccgtgagctgagcga

SEQ ID NO: 230333 - DNA, 25 bp, Artificial Sequence
  Description of Artificial Sequence: Synthetic oligonucleotide
ggaaccccaaccgtgagctgagcga

SEQ ID NO: 230334 - DNA, 25 bp, Artificial Sequence
  Description of Artificial Sequence: Synthetic oligonucleotide
gaaccccaaccgtgagctgagcgag

SEQ ID NO: 230335 - DNA, 26 bp, Artificial Sequence
  Description of Artificial Sequence: Synthetic oligonucleotide
aaccccaaccgtgagctgagcgagga

SEQ ID NO: 230336 - DNA, 25 bp, Artificial Sequence
  Description of Artificial Sequence: Synthetic oligonucleotide
accccaaccgtgagctgagcgagga

SEQ ID NO: 230337 - DNA, 24 bp, Artificial Sequence
  Description of Artificial Sequence: Synthetic oligonucleotide
ccccaaccgtgagctgagcgagga

SEQ ID NO: 230338 - DNA, 25 bp, Artificial Sequence
  Description of Artificial Sequence: Synthetic oligonucleotide
cccaaccgtgagctgagcgaggact

SEQ ID NO: 230339 - DNA, 25 bp, Artificial Sequence
  Description of Artificial Sequence: Synthetic oligonucleotide
ccaaccgtgagctgagcgaggactg

SEQ ID NO: 230340 - DNA, 25 bp, Artificial Sequence
  Description of Artificial Sequence: Synthetic oligonucleotide
caaccgtgagctgagcgaggactgc

SEQ ID NO: 230341 - DNA, 26 bp, Artificial Sequence
  Description of Artificial Sequence: Synthetic oligonucleotide
aaccgtgagctgagcgaggactgcct

SEQ ID NO: 230342 - DNA, 25 bp, Artificial Sequence
  Description of Artificial Sequence: Synthetic oligonucleotide
accgtgagctgagcgaggactgcct

SEQ ID NO: 230343 - DNA, 24 bp, Artificial Sequence
  Description of Artificial Sequence: Synthetic oligonucleotide
ccgtgagctgagcgaggactgcct

SEQ ID NO: 230344 - DNA, 26 bp, Artificial Sequence
  Description of Artificial Sequence: Synthetic oligonucleotide
cgtgagctgagcgaggactgcctgta

SEQ ID NO: 230345 - DNA, 26 bp, Artificial Sequence
  Description of Artificial Sequence: Synthetic oligonucleotide
gtgagctgagcgaggactgcctgtac

SEQ ID NO: 230346 - DNA, 27 bp, Artificial Sequence
  Description of Artificial Sequence: Synthetic oligonucleotide
tgagctgagcgaggactgcctgtacct

SEQ ID NO: 230347 - DNA, 26 bp, Artificial Sequence
  Description of Artificial Sequence: Synthetic oligonucleotide
gagctgagcgaggactgcctgtacct

SEQ ID NO: 230348 - DNA, 27 bp, Artificial Sequence
  Description of Artificial Sequence: Synthetic oligonucleotide
agctgagcgaggactgcctgtacctca

SEQ ID NO: 230349 - DNA, 27 bp, Artificial Sequence
  Description of Artificial Sequence: Synthetic oligonucleotide
gctgagcgaggactgcctgtacctcaa

SEQ ID NO: 230350 - DNA, 27 bp, Artificial Sequence
  Description of Artificial Sequence: Synthetic oligonucleotide
ctgagcgaggactgcctgtacctcaac

SEQ ID NO: 230351 - DNA, 27 bp, Artificial Sequence
  Description of Artificial Sequence: Synthetic oligonucleotide
tgagcgaggactgcctgtacctcaacg

SEQ ID NO: 230352 - DNA, 27 bp, Artificial Sequence
  Description of Artificial Sequence: Synthetic oligonucleotide
gagcgaggactgcctgtacctcaacgt

SEQ ID NO: 230353 - DNA, 27 bp, Artificial Sequence
  Description of Artificial Sequence: Synthetic oligonucleotide
agcgaggactgcctgtacctcaacgtg

SEQ ID NO: 230354 - DNA, 27 bp, Artificial Sequence
  Description of Artificial Sequence: Synthetic oligonucleotide
gcgaggactgcctgtacctcaacgtgt

SEQ ID NO: 230355 - DNA, 27 bp, Artificial Sequence
  Description of Artificial Sequence: Synthetic oligonucleotide
cgaggactgcctgtacctcaacgtgtg

SEQ ID NO: 230356 - DNA, 27 bp, Artificial Sequence
  Description of Artificial Sequence: Synthetic oligonucleotide
gaggactgcctgtacctcaacgtgtgg

SEQ ID NO: 230357 - DNA, 28 bp, Artificial Sequence
  Description of Artificial Sequence: Synthetic oligonucleotide
aggactgcctgtacctcaacgtgtggac

SEQ ID NO: 230358 - DNA, 27 bp, Artificial Sequence
  Description of Artificial Sequence: Synthetic oligonucleotide
ggactgcctgtacctcaacgtgtggac

SEQ ID NO: 230359 - DNA, 28 bp, Artificial Sequence
  Description of Artificial Sequence: Synthetic oligonucleotide
gactgcctgtacctcaacgtgtggacac

SEQ ID NO: 230360 - DNA, 28 bp, Artificial Sequence
  Description of Artificial Sequence: Synthetic oligonucleotide
actgcctgtacctcaacgtgtggacacc

SEQ ID NO: 230361 - DNA, 27 bp, Artificial Sequence
  Description of Artificial Sequence: Synthetic oligonucleotide
ctgcctgtacctcaacgtgtggacacc

SEQ ID NO: 230362 - DNA, 30 bp, Artificial Sequence
  Description of Artificial Sequence: Synthetic oligonucleotide
tgcctgtacctcaacgtgtggacaccatac

SEQ ID NO: 230363 - DNA, 29 bp, Artificial Sequence
  Description of Artificial Sequence: Synthetic oligonucleotide
gcctgtacctcaacgtgtggacaccatac

SEQ ID NO: 230364 - DNA, 29 bp, Artificial Sequence
  Description of Artificial Sequence: Synthetic oligonucleotide
cctgtacctcaacgtgtggacaccatacc

SEQ ID NO: 230365 - DNA, 29 bp, Artificial Sequence
  Description of Artificial Sequence: Synthetic oligonucleotide
ctgtacctcaacgtgtggacaccataccc

SEQ ID NO: 230366 - DNA, 29 bp, Artificial Sequence
  Description of Artificial Sequence: Synthetic oligonucleotide
tgtacctcaacgtgtggacaccatacccc

SEQ ID NO: 230367 - DNA, 28 bp, Artificial Sequence
  Description of Artificial Sequence: Synthetic oligonucleotide
gtacctcaacgtgtggacaccatacccc

SEQ ID NO: 230368 - DNA, 28 bp, Artificial Sequence
  Description of Artificial Sequence: Synthetic oligonucleotide
tacctcaacgtgtggacaccataccccc

SEQ ID NO: 230369 - DNA, 27 bp, Artificial Sequence
  Description of Artificial Sequence: Synthetic oligonucleotide
acctcaacgtgtggacaccataccccc

SEQ ID NO: 230370 - DNA, 26 bp, Artificial Sequence
  Description of Artificial Sequence: Synthetic oligonucleotide
cctcaacgtgtggacaccataccccc

SEQ ID NO: 230371 - DNA, 26 bp, Artificial Sequence
  Description of Artificial Sequence: Synthetic oligonucleotide
ctcaacgtgtggacaccatacccccg

SEQ ID NO: 230372 - DNA, 26 bp, Artificial Sequence
  Description of Artificial Sequence: Synthetic oligonucleotide
tcaacgtgtggacaccatacccccgg

SEQ ID NO: 230373 - DNA, 25 bp, Artificial Sequence
  Description of Artificial Sequence: Synthetic oligonucleotide
caacgtgtggacaccatacccccgg

SEQ ID NO: 230374 - DNA, 25 bp, Artificial Sequence
  Description of Artificial Sequence: Synthetic oligonucleotide
aacgtgtggacaccatacccccggc

SEQ ID NO: 230375 - DNA, 24 bp, Artificial Sequence
  Description of Artificial Sequence: Synthetic oligonucleotide
acgtgtggacaccatacccccggc

SEQ ID NO: 230376 - DNA, 23 bp, Artificial Sequence
  Description of Artificial Sequence: Synthetic oligonucleotide
cgtgtggacaccatacccccggc

SEQ ID NO: 230377 - DNA, 25 bp, Artificial Sequence
  Description of Artificial Sequence: Synthetic oligonucleotide
gtgtggacaccatacccccggccta

SEQ ID NO: 230378 - DNA, 27 bp, Artificial Sequence
  Description of Artificial Sequence: Synthetic oligonucleotide
tgtggacaccatacccccggcctacat

SEQ ID NO: 230379 - DNA, 26 bp, Artificial Sequence
  Description of Artificial Sequence: Synthetic oligonucleotide
gtggacaccatacccccggcctacat

SEQ ID NO: 230380 - DNA, 26 bp, Artificial Sequence
  Description of Artificial Sequence: Synthetic oligonucleotide
tggacaccatacccccggcctacatc

SEQ ID NO: 230381 - DNA, 25 bp, Artificial Sequence
  Description of Artificial Sequence: Synthetic oligonucleotide
ggacaccatacccccggcctacatc

SEQ ID NO: 230382 - DNA, 25 bp, Artificial Sequence
  Description of Artificial Sequence: Synthetic oligonucleotide
gacaccatacccccggcctacatcc

SEQ ID NO: 230383 - DNA, 25 bp, Artificial Sequence
  Description of Artificial Sequence: Synthetic oligonucleotide
acaccatacccccggcctacatccc

SEQ ID NO: 230384 - DNA, 24 bp, Artificial Sequence
  Description of Artificial Sequence: Synthetic oligonucleotide
caccatacccccggcctacatccc

SEQ ID NO: 230385 - DNA, 24 bp, Artificial Sequence
  Description of Artificial Sequence: Synthetic oligonucleotide
accatacccccggcctacatcccc

SEQ ID NO: 230386 - DNA, 23 bp, Artificial Sequence
  Description of Artificial Sequence: Synthetic oligonucleotide
ccatacccccggcctacatcccc

SEQ ID NO: 230387 - DNA, 24 bp, Artificial Sequence
  Description of Artificial Sequence: Synthetic oligonucleotide
catacccccggcctacatccccca

SEQ ID NO: 230388 - DNA, 24 bp, Artificial Sequence
  Description of Artificial Sequence: Synthetic oligonucleotide
atacccccggcctacatcccccac

SEQ ID NO: 230389 - DNA, 23 bp, Artificial Sequence
  Description of Artificial Sequence: Synthetic oligonucleotide
tacccccggcctacatcccccac

SEQ ID NO: 230390 - DNA, 22 bp, Artificial Sequence
  Description of Artificial Sequence: Synthetic oligonucleotide
acccccggcctacatcccccac

SEQ ID NO: 230391 - DNA, 21 bp, Artificial Sequence
  Description of Artificial Sequence: Synthetic oligonucleotide
cccccggcctacatcccccac

SEQ ID NO: 230392 - DNA, 21 bp, Artificial Sequence
  Description of Artificial Sequence: Synthetic oligonucleotide
ccccggcctacatcccccacc

SEQ ID NO: 230393 - DNA, 21 bp, Artificial Sequence
  Description of Artificial Sequence: Synthetic oligonucleotide
cccggcctacatcccccaccc

SEQ ID NO: 230394 - DNA, 22 bp, Artificial Sequence
  Description of Artificial Sequence: Synthetic oligonucleotide
ccggcctacatcccccacccct

SEQ ID NO: 230395 - DNA, 23 bp, Artificial Sequence
  Description of Artificial Sequence: Synthetic oligonucleotide
cggcctacatcccccacccctgt

SEQ ID NO: 230396 - DNA, 23 bp, Artificial Sequence
  Description of Artificial Sequence: Synthetic oligonucleotide
ggcctacatcccccacccctgtc

SEQ ID NO: 230397 - DNA, 24 bp, Artificial Sequence
  Description of Artificial Sequence: Synthetic oligonucleotide
gcctacatcccccacccctgtcct

SEQ ID NO: 230398 - DNA, 24 bp, Artificial Sequence
  Description of Artificial Sequence: Synthetic oligonucleotide
cctacatcccccacccctgtcctc

SEQ ID NO: 230399 - DNA, 25 bp, Artificial Sequence
  Description of Artificial Sequence: Synthetic oligonucleotide
ctacatcccccacccctgtcctcgt

SEQ ID NO: 230400 - DNA, 26 bp, Artificial Sequence
  Description of Artificial Sequence: Synthetic oligonucleotide
tacatcccccacccctgtcctcgtct

SEQ ID NO: 230401 - DNA, 25 bp, Artificial Sequence
  Description of Artificial Sequence: Synthetic oligonucleotide
acatcccccacccctgtcctcgtct

SEQ ID NO: 230402 - DNA, 24 bp, Artificial Sequence
  Description of Artificial Sequence: Synthetic oligonucleotide
catcccccacccctgtcctcgtct

SEQ ID NO: 230403 - DNA, 24 bp, Artificial Sequence
  Description of Artificial Sequence: Synthetic oligonucleotide
atcccccacccctgtcctcgtctg

SEQ ID NO: 230404 - DNA, 23 bp, Artificial Sequence
  Description of Artificial Sequence: Synthetic oligonucleotide
tcccccacccctgtcctcgtctg

SEQ ID NO: 230405 - DNA, 22 bp, Artificial Sequence
  Description of Artificial Sequence: Synthetic oligonucleotide
cccccacccctgtcctcgtctg

SEQ ID NO: 230406 - DNA, 24 bp, Artificial Sequence
  Description of Artificial Sequence: Synthetic oligonucleotide
ccccacccctgtcctcgtctggat

SEQ ID NO: 230407 - DNA, 27 bp, Artificial Sequence
  Description of Artificial Sequence: Synthetic oligonucleotide
cccacccctgtcctcgtctggatctat

SEQ ID NO: 230408 - DNA, 27 bp, Artificial Sequence
  Description of Artificial Sequence: Synthetic oligonucleotide
ccacccctgtcctcgtctggatctatg

SEQ ID NO: 230409 - DNA, 27 bp, Artificial Sequence
  Description of Artificial Sequence: Synthetic oligonucleotide
cacccctgtcctcgtctggatctatgg

SEQ ID NO: 230410 - DNA, 27 bp, Artificial Sequence
  Description of Artificial Sequence: Synthetic oligonucleotide
acccctgtcctcgtctggatctatggg

SEQ ID NO: 230411 - DNA, 26 bp, Artificial Sequence
  Description of Artificial Sequence: Synthetic oligonucleotide
cccctgtcctcgtctggatctatggg

SEQ ID NO: 230412 - DNA, 26 bp, Artificial Sequence
  Description of Artificial Sequence: Synthetic oligonucleotide
ccctgtcctcgtctggatctatgggg

SEQ ID NO: 230413 - DNA, 27 bp, Artificial Sequence
  Description of Artificial Sequence: Synthetic oligonucleotide
cctgtcctcgtctggatctatgggggt

SEQ ID NO: 230414 - DNA, 27 bp, Artificial Sequence
  Description of Artificial Sequence: Synthetic oligonucleotide
ctgtcctcgtctggatctatgggggtg

SEQ ID NO: 230415 - DNA, 27 bp, Artificial Sequence
  Description of Artificial Sequence: Synthetic oligonucleotide
tgtcctcgtctggatctatgggggtgg

SEQ ID NO: 230416 - DNA, 26 bp, Artificial Sequence
  Description of Artificial Sequence: Synthetic oligonucleotide
gtcctcgtctggatctatgggggtgg

SEQ ID NO: 230417 - DNA, 27 bp, Artificial Sequence
  Description of Artificial Sequence: Synthetic oligonucleotide
tcctcgtctggatctatgggggtggct

SEQ ID NO: 230418 - DNA, 27 bp, Artificial Sequence
  Description of Artificial Sequence: Synthetic oligonucleotide
cctcgtctggatctatgggggtggctt

SEQ ID NO: 230419 - DNA, 27 bp, Artificial Sequence
  Description of Artificial Sequence: Synthetic oligonucleotide
ctcgtctggatctatgggggtggcttc

SEQ ID NO: 230420 - DNA, 29 bp, Artificial Sequence
  Description of Artificial Sequence: Synthetic oligonucleotide
tcgtctggatctatgggggtggcttctac

SEQ ID NO: 230421 - DNA, 28 bp, Artificial Sequence
  Description of Artificial Sequence: Synthetic oligonucleotide
cgtctggatctatgggggtggcttctac

SEQ ID NO: 230422 - DNA, 29 bp, Artificial Sequence
  Description of Artificial Sequence: Synthetic oligonucleotide
gtctggatctatgggggtggcttctacag

SEQ ID NO: 230423 - DNA, 30 bp, Artificial Sequence
  Description of Artificial Sequence: Synthetic oligonucleotide
tctggatctatgggggtggcttctacagtg

SEQ ID NO: 230424 - DNA, 29 bp, Artificial Sequence
  Description of Artificial Sequence: Synthetic oligonucleotide
ctggatctatgggggtggcttctacagtg

SEQ ID NO: 230425 - DNA, 29 bp, Artificial Sequence
  Description of Artificial Sequence: Synthetic oligonucleotide
tggatctatgggggtggcttctacagtgg

SEQ ID NO: 230426 - DNA, 28 bp, Artificial Sequence
  Description of Artificial Sequence: Synthetic oligonucleotide
ggatctatgggggtggcttctacagtgg

SEQ ID NO: 230427 - DNA, 28 bp, Artificial Sequence
  Description of Artificial Sequence: Synthetic oligonucleotide
gatctatgggggtggcttctacagtggg

SEQ ID NO: 230428 - DNA, 28 bp, Artificial Sequence
  Description of Artificial Sequence: Synthetic oligonucleotide
atctatgggggtggcttctacagtgggg

SEQ ID NO: 230429 - DNA, 27 bp, Artificial Sequence
  Description of Artificial Sequence: Synthetic oligonucleotide
tctatgggggtggcttctacagtgggg

SEQ ID NO: 230430 - DNA, 26 bp, Artificial Sequence
  Description of Artificial Sequence: Synthetic oligonucleotide
ctatgggggtggcttctacagtgggg

SEQ ID NO: 230431 - DNA, 26 bp, Artificial Sequence
  Description of Artificial Sequence: Synthetic oligonucleotide
tatgggggtggcttctacagtggggc

SEQ ID NO: 230432 - DNA, 25 bp, Artificial Sequence
  Description of Artificial Sequence: Synthetic oligonucleotide
atgggggtggcttctacagtggggc

SEQ ID NO: 230433 - DNA, 24 bp, Artificial Sequence
  Description of Artificial Sequence: Synthetic oligonucleotide
tgggggtggcttctacagtggggc

SEQ ID NO: 230434 - DNA, 23 bp, Artificial Sequence
  Description of Artificial Sequence: Synthetic oligonucleotide
gggggtggcttctacagtggggc

SEQ ID NO: 230435 - DNA, 24 bp, Artificial Sequence
  Description of Artificial Sequence: Synthetic oligonucleotide
ggggtggcttctacagtggggcct

SEQ ID NO: 230436 - DNA, 24 bp, Artificial Sequence
  Description of Artificial Sequence: Synthetic oligonucleotide
gggtggcttctacagtggggcctc

SEQ ID NO: 230437 - DNA, 25 bp, Artificial Sequence
  Description of Artificial Sequence: Synthetic oligonucleotide
ggtggcttctacagtggggcctcct

SEQ ID NO: 230438 - DNA, 25 bp, Artificial Sequence
  Description of Artificial Sequence: Synthetic oligonucleotide
gtggcttctacagtggggcctcctc

SEQ ID NO: 230439 - DNA, 27 bp, Artificial Sequence
  Description of Artificial Sequence: Synthetic oligonucleotide
tggcttctacagtggggcctcctcctt

SEQ ID NO: 230440 - DNA, 26 bp, Artificial Sequence
  Description of Artificial Sequence: Synthetic oligonucleotide
ggcttctacagtggggcctcctcctt

SEQ ID NO: 230441 - DNA, 26 bp, Artificial Sequence
  Description of Artificial Sequence: Synthetic oligonucleotide
gcttctacagtggggcctcctccttg

SEQ ID NO: 230442 - DNA, 27 bp, Artificial Sequence
  Description of Artificial Sequence: Synthetic oligonucleotide
cttctacagtggggcctcctccttgga

SEQ ID NO: 230443 - DNA, 27 bp, Artificial Sequence
  Description of Artificial Sequence: Synthetic oligonucleotide
ttctacagtggggcctcctccttggac

SEQ ID NO: 230444 - DNA, 26 bp, Artificial Sequence
  Description of Artificial Sequence: Synthetic oligonucleotide
tctacagtggggcctcctccttggac

SEQ ID NO: 230445 - DNA, 25 bp, Artificial Sequence
  Description of Artificial Sequence: Synthetic oligonucleotide
ctacagtggggcctcctccttggac

SEQ ID NO: 230446 - DNA, 26 bp, Artificial Sequence
  Description of Artificial Sequence: Synthetic oligonucleotide
tacagtggggcctcctccttggacgt

SEQ ID NO: 230447 - DNA, 25 bp, Artificial Sequence
  Description of Artificial Sequence: Synthetic oligonucleotide
acagtggggcctcctccttggacgt

SEQ ID NO: 230448 - DNA, 24 bp, Artificial Sequence
  Description of Artificial Sequence: Synthetic oligonucleotide
cagtggggcctcctccttggacgt

SEQ ID NO: 230449 - DNA, 26 bp, Artificial Sequence
  Description of Artificial Sequence: Synthetic oligonucleotide
agtggggcctcctccttggacgtgta

SEQ ID NO: 230450 - DNA, 25 bp, Artificial Sequence
  Description of Artificial Sequence: Synthetic oligonucleotide
gtggggcctcctccttggacgtgta

SEQ ID NO: 230451 - DNA, 25 bp, Artificial Sequence
  Description of Artificial Sequence: Synthetic oligonucleotide
tggggcctcctccttggacgtgtac

SEQ ID NO: 230452 - DNA, 24 bp, Artificial Sequence
  Description of Artificial Sequence: Synthetic oligonucleotide
ggggcctcctccttggacgtgtac

SEQ ID NO: 230453 - DNA, 26 bp, Artificial Sequence
  Description of Artificial Sequence: Synthetic oligonucleotide
gggcctcctccttggacgtgtacgat

SEQ ID NO: 230454 - DNA, 26 bp, Artificial Sequence
  Description of Artificial Sequence: Synthetic oligonucleotide
ggcctcctccttggacgtgtacgatg

SEQ ID NO: 230455 - DNA, 26 bp, Artificial Sequence
  Description of Artificial Sequence: Synthetic oligonucleotide
gcctcctccttggacgtgtacgatgg

SEQ ID NO: 230456 - DNA, 26 bp, Artificial Sequence
  Description of Artificial Sequence: Synthetic oligonucleotide
cctcctccttggacgtgtacgatggc

SEQ ID NO: 230457 - DNA, 26 bp, Artificial Sequence
  Description of Artificial Sequence: Synthetic oligonucleotide
ctcctccttggacgtgtacgatggcc

SEQ ID NO: 230458 - DNA, 26 bp, Artificial Sequence
  Description of Artificial Sequence: Synthetic oligonucleotide
tcctccttggacgtgtacgatggccg

SEQ ID NO: 230459 - DNA, 25 bp, Artificial Sequence
  Description of Artificial Sequence: Synthetic oligonucleotide
cctccttggacgtgtacgatggccg

SEQ ID NO: 230460 - DNA, 27 bp, Artificial Sequence
  Description of Artificial Sequence: Synthetic oligonucleotide
ctccttggacgtgtacgatggccgctt

SEQ ID NO: 230461 - DNA, 27 bp, Artificial Sequence
  Description of Artificial Sequence: Synthetic oligonucleotide
tccttggacgtgtacgatggccgcttc

SEQ ID NO: 230462 - DNA, 27 bp, Artificial Sequence
  Description of Artificial Sequence: Synthetic oligonucleotide
ccttggacgtgtacgatggccgcttct

SEQ ID NO: 230463 - DNA, 28 bp, Artificial Sequence
  Description of Artificial Sequence: Synthetic oligonucleotide
cttggacgtgtacgatggccgcttcttg

SEQ ID NO: 230464 - DNA, 28 bp, Artificial Sequence
  Description of Artificial Sequence: Synthetic oligonucleotide
ttggacgtgtacgatggccgcttcttgg

SEQ ID NO: 230465 - DNA, 27 bp, Artificial Sequence
  Description of Artificial Sequence: Synthetic oligonucleotide
tggacgtgtacgatggccgcttcttgg

SEQ ID NO: 230466 - DNA, 27 bp, Artificial Sequence
  Description of Artificial Sequence: Synthetic oligonucleotide
ggacgtgtacgatggccgcttcttggt

SEQ ID NO: 230467 - DNA, 28 bp, Artificial Sequence
  Description of Artificial Sequence: Synthetic oligonucleotide
gacgtgtacgatggccgcttcttggtac

SEQ ID NO: 230468 - DNA, 29 bp, Artificial Sequence
  Description of Artificial Sequence: Synthetic oligonucleotide
acgtgtacgatggccgcttcttggtacag

SEQ ID NO: 230469 - DNA, 28 bp, Artificial Sequence
  Description of Artificial Sequence: Synthetic oligonucleotide
cgtgtacgatggccgcttcttggtacag

SEQ ID NO: 230470 - DNA, 28 bp, Artificial Sequence
  Description of Artificial Sequence: Synthetic oligonucleotide
gtgtacgatggccgcttcttggtacagg

SEQ ID NO: 230471 - DNA, 28 bp, Artificial Sequence
  Description of Artificial Sequence: Synthetic oligonucleotide
tgtacgatggccgcttcttggtacaggc

SEQ ID NO: 230472 - DNA, 27 bp, Artificial Sequence
  Description of Artificial Sequence: Synthetic oligonucleotide
gtacgatggccgcttcttggtacaggc

SEQ ID NO: 230473 - DNA, 27 bp, Artificial Sequence
  Description of Artificial Sequence: Synthetic oligonucleotide
tacgatggccgcttcttggtacaggcc

SEQ ID NO: 230474 - DNA, 26 bp, Artificial Sequence
  Description of Artificial Sequence: Synthetic oligonucleotide
acgatggccgcttcttggtacaggcc

SEQ ID NO: 230475 - DNA, 25 bp, Artificial Sequence
  Description of Artificial Sequence: Synthetic oligonucleotide
cgatggccgcttcttggtacaggcc

SEQ ID NO: 230476 - DNA, 26 bp, Artificial Sequence
  Description of Artificial Sequence: Synthetic oligonucleotide
gatggccgcttcttggtacaggccga

SEQ ID NO: 230477 - DNA, 27 bp, Artificial Sequence
  Description of Artificial Sequence: Synthetic oligonucleotide
atggccgcttcttggtacaggccgaga

SEQ ID NO: 230478 - DNA, 26 bp, Artificial Sequence
  Description of Artificial Sequence: Synthetic oligonucleotide
tggccgcttcttggtacaggccgaga

SEQ ID NO: 230479 - DNA, 25 bp, Artificial Sequence
  Description of Artificial Sequence: Synthetic oligonucleotide
ggccgcttcttggtacaggccgaga

SEQ ID NO: 230480 - DNA, 25 bp, Artificial Sequence
  Description of Artificial Sequence: Synthetic oligonucleotide
gccgcttcttggtacaggccgagag

SEQ ID NO: 230481 - DNA, 26 bp, Artificial Sequence
  Description of Artificial Sequence: Synthetic oligonucleotide
ccgcttcttggtacaggccgagagga

SEQ ID NO: 230482 - DNA, 27 bp, Artificial Sequence
  Description of Artificial Sequence: Synthetic oligonucleotide
cgcttcttggtacaggccgagaggact

SEQ ID NO: 230483 - DNA, 27 bp, Artificial Sequence
  Description of Artificial Sequence: Synthetic oligonucleotide
gcttcttggtacaggccgagaggactg

SEQ ID NO: 230484 - DNA, 28 bp, Artificial Sequence
  Description of Artificial Sequence: Synthetic oligonucleotide
cttcttggtacaggccgagaggactgtg

SEQ ID NO: 230485 - DNA, 28 bp, Artificial Sequence
  Description of Artificial Sequence: Synthetic oligonucleotide
ttcttggtacaggccgagaggactgtgc

SEQ ID NO: 230486 - DNA, 27 bp, Artificial Sequence
  Description of Artificial Sequence: Synthetic oligonucleotide
tcttggtacaggccgagaggactgtgc

SEQ ID NO: 230487 - DNA, 27 bp, Artificial Sequence
  Description of Artificial Sequence: Synthetic oligonucleotide
cttggtacaggccgagaggactgtgct

SEQ ID NO: 230488 - DNA, 27 bp, Artificial Sequence
  Description of Artificial Sequence: Synthetic oligonucleotide
ttggtacaggccgagaggactgtgctg

SEQ ID NO: 230489 - DNA, 26 bp, Artificial Sequence
  Description of Artificial Sequence: Synthetic oligonucleotide
tggtacaggccgagaggactgtgctg

SEQ ID NO: 230490 - DNA, 25 bp, Artificial Sequence
  Description of Artificial Sequence: Synthetic oligonucleotide
ggtacaggccgagaggactgtgctg

SEQ ID NO: 230491 - DNA, 26 bp, Artificial Sequence
  Description of Artificial Sequence: Synthetic oligonucleotide
gtacaggccgagaggactgtgctggt

SEQ ID NO: 230492 - DNA, 26 bp, Artificial Sequence
  Description of Artificial Sequence: Synthetic oligonucleotide
tacaggccgagaggactgtgctggtg

SEQ ID NO: 230493 - DNA, 25 bp, Artificial Sequence
  Description of Artificial Sequence: Synthetic oligonucleotide
acaggccgagaggactgtgctggtg

SEQ ID NO: 230494 - DNA, 24 bp, Artificial Sequence
  Description of Artificial Sequence: Synthetic oligonucleotide
caggccgagaggactgtgctggtg

SEQ ID NO: 230495 - DNA, 24 bp, Artificial Sequence
  Description of Artificial Sequence: Synthetic oligonucleotide
aggccgagaggactgtgctggtgg

SEQ ID NO: 230496 - DNA, 23 bp, Artificial Sequence
  Description of Artificial Sequence: Synthetic oligonucleotide
ggccgagaggactgtgctggtgg

SEQ ID NO: 230497 - DNA, 24 bp, Artificial Sequence
  Description of Artificial Sequence: Synthetic oligonucleotide
gccgagaggactgtgctggtgggt

SEQ ID NO: 230498 - DNA, 25 bp, Artificial Sequence
  Description of Artificial Sequence: Synthetic oligonucleotide
ccgagaggactgtgctggtgggtgt

SEQ ID NO: 230499 - DNA, 25 bp, Artificial Sequence
  Description of Artificial Sequence: Synthetic oligonucleotide
cgagaggactgtgctggtgggtgtg

SEQ ID NO: 230500 - DNA, 26 bp, Artificial Sequence
  Description of Artificial Sequence: Synthetic oligonucleotide
gagaggactgtgctggtgggtgtggt

SEQ ID NO: 230501 - DNA, 27 bp, Artificial Sequence
  Description of Artificial Sequence: Synthetic oligonucleotide
agaggactgtgctggtgggtgtggtga

SEQ ID NO: 230502 - DNA, 27 bp, Artificial Sequence
  Description of Artificial Sequence: Synthetic oligonucleotide
gaggactgtgctggtgggtgtggtgaa

SEQ ID NO: 230503 - DNA, 27 bp, Artificial Sequence
  Description of Artificial Sequence: Synthetic oligonucleotide
aggactgtgctggtgggtgtggtgaag

SEQ ID NO: 230504 - DNA, 26 bp, Artificial Sequence
  Description of Artificial Sequence: Synthetic oligonucleotide
ggactgtgctggtgggtgtggtgaag

SEQ ID NO: 230505 - DNA, 27 bp, Artificial Sequence
  Description of Artificial Sequence: Synthetic oligonucleotide
gactgtgctggtgggtgtggtgaagga

SEQ ID NO: 230506 - DNA, 28 bp, Artificial Sequence
  Description of Artificial Sequence: Synthetic oligonucleotide
actgtgctggtgggtgtggtgaaggatg

SEQ ID NO: 230507 - DNA, 27 bp, Artificial Sequence
  Description of Artificial Sequence: Synthetic oligonucleotide
ctgtgctggtgggtgtggtgaaggatg

SEQ ID NO: 230508 - DNA, 28 bp, Artificial Sequence
  Description of Artificial Sequence: Synthetic oligonucleotide
tgtgctggtgggtgtggtgaaggatgag

SEQ ID NO: 230509 - DNA, 27 bp, Artificial Sequence
  Description of Artificial Sequence: Synthetic oligonucleotide
gtgctggtgggtgtggtgaaggatgag

SEQ ID NO: 230510 - DNA, 27 bp, Artificial Sequence
  Description of Artificial Sequence: Synthetic oligonucleotide
tgctggtgggtgtggtgaaggatgagg

SEQ ID NO: 230511 - DNA, 26 bp, Artificial Sequence
  Description of Artificial Sequence: Synthetic oligonucleotide
gctggtgggtgtggtgaaggatgagg

SEQ ID NO: 230512 - DNA, 26 bp, Artificial Sequence
  Description of Artificial Sequence: Synthetic oligonucleotide
ctggtgggtgtggtgaaggatgaggg

SEQ ID NO: 230513 - DNA, 27 bp, Artificial Sequence
  Description of Artificial Sequence: Synthetic oligonucleotide
tggtgggtgtggtgaaggatgagggct

SEQ ID NO: 230514 - DNA, 26 bp, Artificial Sequence
  Description of Artificial Sequence: Synthetic oligonucleotide
ggtgggtgtggtgaaggatgagggct

SEQ ID NO: 230515 - DNA, 26 bp, Artificial Sequence
  Description of Artificial Sequence: Synthetic oligonucleotide
gtgggtgtggtgaaggatgagggctc

SEQ ID NO: 230516 - DNA, 27 bp, Artificial Sequence
  Description of Artificial Sequence: Synthetic oligonucleotide
tgggtgtggtgaaggatgagggctcgt

SEQ ID NO: 230517 - DNA, 27 bp, Artificial Sequence
  Description of Artificial Sequence: Synthetic oligonucleotide
gggtgtggtgaaggatgagggctcgta

SEQ ID NO: 230518 - DNA, 31 bp, Artificial Sequence
  Description of Artificial Sequence: Synthetic oligonucleotide
ggtgtggtgaaggatgagggctcgtattttc

SEQ ID NO: 230519 - DNA, 32 bp, Artificial Sequence
  Description of Artificial Sequence: Synthetic oligonucleotide
gtgtggtgaaggatgagggctcgtattttctg

SEQ ID NO: 230520 - DNA, 32 bp, Artificial Sequence
  Description of Artificial Sequence: Synthetic oligonucleotide
tgtggtgaaggatgagggctcgtattttctgg

SEQ ID NO: 230521 - DNA, 31 bp, Artificial Sequence
  Description of Artificial Sequence: Synthetic oligonucleotide
gtggtgaaggatgagggctcgtattttctgg

SEQ ID NO: 230522 - DNA, 35 bp, Artificial Sequence
  Description of Artificial Sequence: Synthetic oligonucleotide
tggtgaaggatgagggctcgtattttctggtttac

SEQ ID NO: 230523 - DNA, 34 bp, Artificial Sequence
  Description of Artificial Sequence: Synthetic oligonucleotide
ggtgaaggatgagggctcgtattttctggtttac

SEQ ID NO: 230524 - DNA, 34 bp, Artificial Sequence
  Description of Artificial Sequence: Synthetic oligonucleotide
gtgaaggatgagggctcgtattttctggtttacg

SEQ ID NO: 230525 - DNA, 34 bp, Artificial Sequence
  Description of Artificial Sequence: Synthetic oligonucleotide
tgaaggatgagggctcgtattttctggtttacgg

SEQ ID NO: 230526 - DNA, 33 bp, Artificial Sequence
  Description of Artificial Sequence: Synthetic oligonucleotide
gaaggatgagggctcgtattttctggtttacgg

SEQ ID NO: 230527 - DNA, 33 bp, Artificial Sequence
  Description of Artificial Sequence: Synthetic oligonucleotide
aaggatgagggctcgtattttctggtttacggg

SEQ ID NO: 230528 - DNA, 32 bp, Artificial Sequence
  Description of Artificial Sequence: Synthetic oligonucleotide
aggatgagggctcgtattttctggtttacggg

SEQ ID NO: 230529 - DNA, 31 bp, Artificial Sequence
  Description of Artificial Sequence: Synthetic oligonucleotide
ggatgagggctcgtattttctggtttacggg

SEQ ID NO: 230530 - DNA, 31 bp, Artificial Sequence
  Description of Artificial Sequence: Synthetic oligonucleotide
gatgagggctcgtattttctggtttacgggg

SEQ ID NO: 230531 - DNA, 31 bp, Artificial Sequence
  Description of Artificial Sequence: Synthetic oligonucleotide
atgagggctcgtattttctggtttacggggc

SEQ ID NO: 230532 - DNA, 30 bp, Artificial Sequence
  Description of Artificial Sequence: Synthetic oligonucleotide
tgagggctcgtattttctggtttacggggc

SEQ ID NO: 230533 - DNA, 29 bp, Artificial Sequence
  Description of Artificial Sequence: Synthetic oligonucleotide
gagggctcgtattttctggtttacggggc

SEQ ID NO: 230534 - DNA, 29 bp, Artificial Sequence
  Description of Artificial Sequence: Synthetic oligonucleotide
agggctcgtattttctggtttacggggcc

SEQ ID NO: 230535 - DNA, 28 bp, Artificial Sequence
  Description of Artificial Sequence: Synthetic oligonucleotide
gggctcgtattttctggtttacggggcc

SEQ ID NO: 230536 - DNA, 28 bp, Artificial Sequence
  Description of Artificial Sequence: Synthetic oligonucleotide
ggctcgtattttctggtttacggggccc

SEQ ID NO: 230537 - DNA, 28 bp, Artificial Sequence
  Description of Artificial Sequence: Synthetic oligonucleotide
gctcgtattttctggtttacggggcccc

SEQ ID NO: 230538 - DNA, 29 bp, Artificial Sequence
  Description of Artificial Sequence: Synthetic oligonucleotide
ctcgtattttctggtttacggggccccag

SEQ ID NO: 230539 - DNA, 29 bp, Artificial Sequence
  Description of Artificial Sequence: Synthetic oligonucleotide
tcgtattttctggtttacggggccccagg

SEQ ID NO: 230540 - DNA, 28 bp, Artificial Sequence
  Description of Artificial Sequence: Synthetic oligonucleotide
cgtattttctggtttacggggccccagg

SEQ ID NO: 230541 - DNA, 28 bp, Artificial Sequence
  Description of Artificial Sequence: Synthetic oligonucleotide
gtattttctggtttacggggccccaggc

SEQ ID NO: 230542 - DNA, 30 bp, Artificial Sequence
  Description of Artificial Sequence: Synthetic oligonucleotide
tattttctggtttacggggccccaggcttc

SEQ ID NO: 230543 - DNA, 29 bp, Artificial Sequence
  Description of Artificial Sequence: Synthetic oligonucleotide
attttctggtttacggggccccaggcttc

SEQ ID NO: 230544 - DNA, 28 bp, Artificial Sequence
  Description of Artificial Sequence: Synthetic oligonucleotide
ttttctggtttacggggccccaggcttc

SEQ ID NO: 230545 - DNA, 27 bp, Artificial Sequence
  Description of Artificial Sequence: Synthetic oligonucleotide
tttctggtttacggggccccaggcttc

SEQ ID NO: 230546 - DNA, 27 bp, Artificial Sequence
  Description of Artificial Sequence: Synthetic oligonucleotide
ttctggtttacggggccccaggcttca

SEQ ID NO: 230547 - DNA, 26 bp, Artificial Sequence
  Description of Artificial Sequence: Synthetic oligonucleotide
tctggtttacggggccccaggcttca

SEQ ID NO: 230548 - DNA, 25 bp, Artificial Sequence
  Description of Artificial Sequence: Synthetic oligonucleotide
ctggtttacggggccccaggcttca

SEQ ID NO: 230549 - DNA, 25 bp, Artificial Sequence
  Description of Artificial Sequence: Synthetic oligonucleotide
tggtttacggggccccaggcttcag

SEQ ID NO: 230550 - DNA, 24 bp, Artificial Sequence
  Description of Artificial Sequence: Synthetic oligonucleotide
ggtttacggggccccaggcttcag

SEQ ID NO: 230551 - DNA, 27 bp, Artificial Sequence
  Description of Artificial Sequence: Synthetic oligonucleotide
gtttacggggccccaggcttcagcaaa

SEQ ID NO: 230552 - DNA, 27 bp, Artificial Sequence
  Description of Artificial Sequence: Synthetic oligonucleotide
tttacggggccccaggcttcagcaaag

SEQ ID NO: 230553 - DNA, 27 bp, Artificial Sequence
  Description of Artificial Sequence: Synthetic oligonucleotide
ttacggggccccaggcttcagcaaaga

SEQ ID NO: 230554 - DNA, 26 bp, Artificial Sequence
  Description of Artificial Sequence: Synthetic oligonucleotide
tacggggccccaggcttcagcaaaga

SEQ ID NO: 230555 - DNA, 25 bp, Artificial Sequence
  Description of Artificial Sequence: Synthetic oligonucleotide
acggggccccaggcttcagcaaaga

SEQ ID NO: 230556 - DNA, 24 bp, Artificial Sequence
  Description of Artificial Sequence: Synthetic oligonucleotide
cggggccccaggcttcagcaaaga

SEQ ID NO: 230557 - DNA, 26 bp, Artificial Sequence
  Description of Artificial Sequence: Synthetic oligonucleotide
ggggccccaggcttcagcaaagacaa

SEQ ID NO: 230558 - DNA, 26 bp, Artificial Sequence
  Description of Artificial Sequence: Synthetic oligonucleotide
gggccccaggcttcagcaaagacaac

SEQ ID NO: 230559 - DNA, 27 bp, Artificial Sequence
  Description of Artificial Sequence: Synthetic oligonucleotide
ggccccaggcttcagcaaagacaacga

SEQ ID NO: 230560 - DNA, 27 bp, Artificial Sequence
  Description of Artificial Sequence: Synthetic oligonucleotide
gccccaggcttcagcaaagacaacgag

SEQ ID NO: 230561 - DNA, 28 bp, Artificial Sequence
  Description of Artificial Sequence: Synthetic oligonucleotide
ccccaggcttcagcaaagacaacgagtc

SEQ ID NO: 230562 - DNA, 29 bp, Artificial Sequence
  Description of Artificial Sequence: Synthetic oligonucleotide
cccaggcttcagcaaagacaacgagtctc

SEQ ID NO: 230563 - DNA, 30 bp, Artificial Sequence
  Description of Artificial Sequence: Synthetic oligonucleotide
ccaggcttcagcaaagacaacgagtctctc

SEQ ID NO: 230564 - DNA, 32 bp, Artificial Sequence
  Description of Artificial Sequence: Synthetic oligonucleotide
caggcttcagcaaagacaacgagtctctcatc

SEQ ID NO: 230565 - DNA, 33 bp, Artificial Sequence
  Description of Artificial Sequence: Synthetic oligonucleotide
aggcttcagcaaagacaacgagtctctcatcag

SEQ ID NO: 230566 - DNA, 32 bp, Artificial Sequence
  Description of Artificial Sequence: Synthetic oligonucleotide
ggcttcagcaaagacaacgagtctctcatcag

SEQ ID NO: 230567 - DNA, 32 bp, Artificial Sequence
  Description of Artificial Sequence: Synthetic oligonucleotide
gcttcagcaaagacaacgagtctctcatcagc

SEQ ID NO: 230568 - DNA, 32 bp, Artificial Sequence
  Description of Artificial Sequence: Synthetic oligonucleotide
cttcagcaaagacaacgagtctctcatcagcc

SEQ ID NO: 230569 - DNA, 32 bp, Artificial Sequence
  Description of Artificial Sequence: Synthetic oligonucleotide
ttcagcaaagacaacgagtctctcatcagccg

SEQ ID NO: 230570 - DNA, 31 bp, Artificial Sequence
  Description of Artificial Sequence: Synthetic oligonucleotide
tcagcaaagacaacgagtctctcatcagccg

SEQ ID NO: 230571 - DNA, 30 bp, Artificial Sequence
  Description of Artificial Sequence: Synthetic oligonucleotide
cagcaaagacaacgagtctctcatcagccg

SEQ ID NO: 230572 - DNA, 30 bp, Artificial Sequence
  Description of Artificial Sequence: Synthetic oligonucleotide
agcaaagacaacgagtctctcatcagccgg

SEQ ID NO: 230573 - DNA, 29 bp, Artificial Sequence
  Description of Artificial Sequence: Synthetic oligonucleotide
gcaaagacaacgagtctctcatcagccgg

SEQ ID NO: 230574 - DNA, 29 bp, Artificial Sequence
  Description of Artificial Sequence: Synthetic oligonucleotide
caaagacaacgagtctctcatcagccggg

SEQ ID NO: 230575 - DNA, 29 bp, Artificial Sequence
  Description of Artificial Sequence: Synthetic oligonucleotide
aaagacaacgagtctctcatcagccgggc

SEQ ID NO: 230576 - DNA, 28 bp, Artificial Sequence
  Description of Artificial Sequence: Synthetic oligonucleotide
aagacaacgagtctctcatcagccgggc

SEQ ID NO: 230577 - DNA, 27 bp, Artificial Sequence
  Description of Artificial Sequence: Synthetic oligonucleotide
agacaacgagtctctcatcagccgggc

SEQ ID NO: 230578 - DNA, 26 bp, Artificial Sequence
  Description of Artificial Sequence: Synthetic oligonucleotide
gacaacgagtctctcatcagccgggc

SEQ ID NO: 230579 - DNA, 26 bp, Artificial Sequence
  Description of Artificial Sequence: Synthetic oligonucleotide
acaacgagtctctcatcagccgggcc

SEQ ID NO: 230580 - DNA, 25 bp, Artificial Sequence
  Description of Artificial Sequence: Synthetic oligonucleotide
caacgagtctctcatcagccgggcc

SEQ ID NO: 230581 - DNA, 26 bp, Artificial Sequence
  Description of Artificial Sequence: Synthetic oligonucleotide
aacgagtctctcatcagccgggccga

SEQ ID NO: 230582 - DNA, 25 bp, Artificial Sequence
  Description of Artificial Sequence: Synthetic oligonucleotide
acgagtctctcatcagccgggccga

SEQ ID NO: 230583 - DNA, 24 bp, Artificial Sequence
  Description of Artificial Sequence: Synthetic oligonucleotide
cgagtctctcatcagccgggccga

SEQ ID NO: 230584 - DNA, 26 bp, Artificial Sequence
  Description of Artificial Sequence: Synthetic oligonucleotide
gagtctctcatcagccgggccgagtt

SEQ ID NO: 230585 - DNA, 26 bp, Artificial Sequence
  Description of Artificial Sequence: Synthetic oligonucleotide
agtctctcatcagccgggccgagttc

SEQ ID NO: 230586 - DNA, 25 bp, Artificial Sequence
  Description of Artificial Sequence: Synthetic oligonucleotide
gtctctcatcagccgggccgagttc

SEQ ID NO: 230587 - DNA, 26 bp, Artificial Sequence
  Description of Artificial Sequence: Synthetic oligonucleotide
tctctcatcagccgggccgagttcct

SEQ ID NO: 230588 - DNA, 25 bp, Artificial Sequence
  Description of Artificial Sequence: Synthetic oligonucleotide
ctctcatcagccgggccgagttcct

SEQ ID NO: 230589 - DNA, 25 bp, Artificial Sequence
  Description of Artificial Sequence: Synthetic oligonucleotide
tctcatcagccgggccgagttcctg

SEQ ID NO: 230590 - DNA, 24 bp, Artificial Sequence
  Description of Artificial Sequence: Synthetic oligonucleotide
ctcatcagccgggccgagttcctg

SEQ ID NO: 230591 - DNA, 24 bp, Artificial Sequence
  Description of Artificial Sequence: Synthetic oligonucleotide
tcatcagccgggccgagttcctgg

SEQ ID NO: 230592 - DNA, 23 bp, Artificial Sequence
  Description of Artificial Sequence: Synthetic oligonucleotide
catcagccgggccgagttcctgg

SEQ ID NO: 230593 - DNA, 23 bp, Artificial Sequence
  Description of Artificial Sequence: Synthetic oligonucleotide
atcagccgggccgagttcctggc

SEQ ID NO: 230594 - DNA, 22 bp, Artificial Sequence
  Description of Artificial Sequence: Synthetic oligonucleotide
tcagccgggccgagttcctggc

SEQ ID NO: 230595 - DNA, 21 bp, Artificial Sequence
  Description of Artificial Sequence: Synthetic oligonucleotide
cagccgggccgagttcctggc

SEQ ID NO: 230596 - DNA, 21 bp, Artificial Sequence
  Description of Artificial Sequence: Synthetic oligonucleotide
agccgggccgagttcctggcc

SEQ ID NO: 230597 - DNA, 20 bp, Artificial Sequence
  Description of Artificial Sequence: Synthetic oligonucleotide
gccgggccgagttcctggcc

SEQ ID NO: 230598 - DNA, 20 bp, Artificial Sequence
  Description of Artificial Sequence: Synthetic oligonucleotide
ccgggccgagttcctggccg

SEQ ID NO: 230599 - DNA, 20 bp, Artificial Sequence
  Description of Artificial Sequence: Synthetic oligonucleotide
cgggccgagttcctggccgg

SEQ ID NO: 230600 - DNA, 20 bp, Artificial Sequence
  Description of Artificial Sequence: Synthetic oligonucleotide
gggccgagttcctggccggg

SEQ ID NO: 230601 - DNA, 21 bp, Artificial Sequence
  Description of Artificial Sequence: Synthetic oligonucleotide
ggccgagttcctggccggggt

SEQ ID NO: 230602 - DNA, 21 bp, Artificial Sequence
  Description of Artificial Sequence: Synthetic oligonucleotide
gccgagttcctggccggggtg

SEQ ID NO: 230603 - DNA, 21 bp, Artificial Sequence
  Description of Artificial Sequence: Synthetic oligonucleotide
ccgagttcctggccggggtgc

SEQ ID NO: 230604 - DNA, 21 bp, Artificial Sequence
  Description of Artificial Sequence: Synthetic oligonucleotide
cgagttcctggccggggtgcg

SEQ ID NO: 230605 - DNA, 21 bp, Artificial Sequence
  Description of Artificial Sequence: Synthetic oligonucleotide
gagttcctggccggggtgcgg

SEQ ID NO: 230606 - DNA, 22 bp, Artificial Sequence
  Description of Artificial Sequence: Synthetic oligonucleotide
agttcctggccggggtgcgggt

SEQ ID NO: 230607 - DNA, 21 bp, Artificial Sequence
  Description of Artificial Sequence: Synthetic oligonucleotide
gttcctggccggggtgcgggt

SEQ ID NO: 230608 - DNA, 21 bp, Artificial Sequence
  Description of Artificial Sequence: Synthetic oligonucleotide
ttcctggccggggtgcgggtc

SEQ ID NO: 230609 - DNA, 20 bp, Artificial Sequence
  Description of Artificial Sequence: Synthetic oligonucleotide
tcctggccggggtgcgggtc

SEQ ID NO: 230610 - DNA, 20 bp, Artificial Sequence
  Description of Artificial Sequence: Synthetic oligonucleotide
cctggccggggtgcgggtct

SEQ ID NO: 230611 - DNA, 20 bp, Artificial Sequence
  Description of Artificial Sequence: Synthetic oligonucleotide
ctggccggggtgcgggtcgt

SEQ ID NO: 230612 - DNA, 20 bp, Artificial Sequence
  Description of Artificial Sequence: Synthetic oligonucleotide
tggccggggtgcgggtcggt

SEQ ID NO: 230613 - DNA, 20 bp, Artificial Sequence
  Description of Artificial Sequence: Synthetic oligonucleotide
ggccggggtgcgggtcggtt

SEQ ID NO: 230614 - DNA, 20 bp, Artificial Sequence
  Description of Artificial Sequence: Synthetic oligonucleotide
gccggggtgcgggtcgggtt

SEQ ID NO: 230615 - DNA, 20 bp, Artificial Sequence
  Description of Artificial Sequence: Synthetic oligonucleotide
ccggggtgcgggtcggggtt

SEQ ID NO: 230616 - DNA, 20 bp, Artificial Sequence
  Description of Artificial Sequence: Synthetic oligonucleotide
cggggtgcgggtcggggttc

SEQ ID NO: 230617 - DNA, 20 bp, Artificial Sequence
  Description of Artificial Sequence: Synthetic oligonucleotide
ggggtgcgggtcggggttcc

SEQ ID NO: 230618 - DNA, 20 bp, Artificial Sequence
  Description of Artificial Sequence: Synthetic oligonucleotide
gggtgcgggtcggggttccc

SEQ ID NO: 230619 - DNA, 21 bp, Artificial Sequence
  Description of Artificial Sequence: Synthetic oligonucleotide
ggtgcgggtcggggttcccca

SEQ ID NO: 230620 - DNA, 21 bp, Artificial Sequence
  Description of Artificial Sequence: Synthetic oligonucleotide
gtgcgggtcggggttccccag

SEQ ID NO: 230621 - DNA, 24 bp, Artificial Sequence
  Description of Artificial Sequence: Synthetic oligonucleotide
tgcgggtcggggttccccaggtaa

SEQ ID NO: 230622 - DNA, 23 bp, Artificial Sequence
  Description of Artificial Sequence: Synthetic oligonucleotide
gcgggtcggggttccccaggtaa

SEQ ID NO: 230623 - DNA, 24 bp, Artificial Sequence
  Description of Artificial Sequence: Synthetic oligonucleotide
cgggtcggggttccccaggtaagt

SEQ ID NO: 230624 - DNA, 25 bp, Artificial Sequence
  Description of Artificial Sequence: Synthetic oligonucleotide
gggtcggggttccccaggtaagtga

SEQ ID NO: 230625 - DNA, 25 bp, Artificial Sequence
  Description of Artificial Sequence: Synthetic oligonucleotide
ggtcggggttccccaggtaagtgac

SEQ ID NO: 230626 - DNA, 26 bp, Artificial Sequence
  Description of Artificial Sequence: Synthetic oligonucleotide
gtcggggttccccaggtaagtgacct

SEQ ID NO: 230627 - DNA, 26 bp, Artificial Sequence
  Description of Artificial Sequence: Synthetic oligonucleotide
tcggggttccccaggtaagtgacctg

SEQ ID NO: 230628 - DNA, 25 bp, Artificial Sequence
  Description of Artificial Sequence: Synthetic oligonucleotide
cggggttccccaggtaagtgacctg

SEQ ID NO: 230629 - DNA, 25 bp, Artificial Sequence
  Description of Artificial Sequence: Synthetic oligonucleotide
ggggttccccaggtaagtgacctgg

SEQ ID NO: 230630 - DNA, 26 bp, Artificial Sequence
  Description of Artificial Sequence: Synthetic oligonucleotide
gggttccccaggtaagtgacctggca

SEQ ID NO: 230631 - DNA, 26 bp, Artificial Sequence
  Description of Artificial Sequence: Synthetic oligonucleotide
ggttccccaggtaagtgacctggcag

SEQ ID NO: 230632 - DNA, 26 bp, Artificial Sequence
  Description of Artificial Sequence: Synthetic oligonucleotide
gttccccaggtaagtgacctggcagc

SEQ ID NO: 230633 - DNA, 26 bp, Artificial Sequence
  Description of Artificial Sequence: Synthetic oligonucleotide
ttccccaggtaagtgacctggcagcc

SEQ ID NO: 230634 - DNA, 25 bp, Artificial Sequence
  Description of Artificial Sequence: Synthetic oligonucleotide
tccccaggtaagtgacctggcagcc

SEQ ID NO: 230635 - DNA, 24 bp, Artificial Sequence
  Description of Artificial Sequence: Synthetic oligonucleotide
ccccaggtaagtgacctggcagcc

SEQ ID NO: 230636 - DNA, 25 bp, Artificial Sequence
  Description of Artificial Sequence: Synthetic oligonucleotide
cccaggtaagtgacctggcagccga

SEQ ID NO: 230637 - DNA, 25 bp, Artificial Sequence
  Description of Artificial Sequence: Synthetic oligonucleotide
ccaggtaagtgacctggcagccgag

SEQ ID NO: 230638 - DNA, 25 bp, Artificial Sequence
  Description of Artificial Sequence: Synthetic oligonucleotide
caggtaagtgacctggcagccgagg

SEQ ID NO: 230639 - DNA, 26 bp, Artificial Sequence
  Description of Artificial Sequence: Synthetic oligonucleotide
aggtaagtgacctggcagccgaggct

SEQ ID NO: 230640 - DNA, 25 bp, Artificial Sequence
  Description of Artificial Sequence: Synthetic oligonucleotide
ggtaagtgacctggcagccgaggct

SEQ ID NO: 230641 - DNA, 26 bp, Artificial Sequence
  Description of Artificial Sequence: Synthetic oligonucleotide
gtaagtgacctggcagccgaggctgt

SEQ ID NO: 230642 - DNA, 26 bp, Artificial Sequence
  Description of Artificial Sequence: Synthetic oligonucleotide
taagtgacctggcagccgaggctgtg

SEQ ID NO: 230643 - DNA, 25 bp, Artificial Sequence
  Description of Artificial Sequence: Synthetic oligonucleotide
aagtgacctggcagccgaggctgtg

SEQ ID NO: 230644 - DNA, 24 bp, Artificial Sequence
  Description of Artificial Sequence: Synthetic oligonucleotide
agtgacctggcagccgaggctgtg

SEQ ID NO: 230645 - DNA, 23 bp, Artificial Sequence
  Description of Artificial Sequence: Synthetic oligonucleotide
gtgacctggcagccgaggctgtg

SEQ ID NO: 230646 - DNA, 24 bp, Artificial Sequence
  Description of Artificial Sequence: Synthetic oligonucleotide
tgacctggcagccgaggctgtggt

SEQ ID NO: 230647 - DNA, 23 bp, Artificial Sequence
  Description of Artificial Sequence: Synthetic oligonucleotide
gacctggcagccgaggctgtggt

SEQ ID NO: 230648 - DNA, 23 bp, Artificial Sequence
  Description of Artificial Sequence: Synthetic oligonucleotide
acctggcagccgaggctgtggtc

SEQ ID NO: 230649 - DNA, 22 bp, Artificial Sequence
  Description of Artificial Sequence: Synthetic oligonucleotide
cctggcagccgaggctgtggtc

SEQ ID NO: 230650 - DNA, 23 bp, Artificial Sequence
  Description of Artificial Sequence: Synthetic oligonucleotide
ctggcagccgaggctgtggtcct

SEQ ID NO: 230651 - DNA, 23 bp, Artificial Sequence
  Description of Artificial Sequence: Synthetic oligonucleotide
tggcagccgaggctgtggtcctg

SEQ ID NO: 230652 - DNA, 22 bp, Artificial Sequence
  Description of Artificial Sequence: Synthetic oligonucleotide
ggcagccgaggctgtggtcctg

SEQ ID NO: 230653 - DNA, 26 bp, Artificial Sequence
  Description of Artificial Sequence: Synthetic oligonucleotide
gcagccgaggctgtggtcctgcatta

SEQ ID NO: 230654 - DNA, 27 bp, Artificial Sequence
  Description of Artificial Sequence: Synthetic oligonucleotide
cagccgaggctgtggtcctgcattaca

SEQ ID NO: 230655 - DNA, 27 bp, Artificial Sequence
  Description of Artificial Sequence: Synthetic oligonucleotide
agccgaggctgtggtcctgcattacac

SEQ ID NO: 230656 - DNA, 27 bp, Artificial Sequence
  Description of Artificial Sequence: Synthetic oligonucleotide
gccgaggctgtggtcctgcattacaca

SEQ ID NO: 230657 - DNA, 27 bp, Artificial Sequence
  Description of Artificial Sequence: Synthetic oligonucleotide
ccgaggctgtggtcctgcattacacag

SEQ ID NO: 230658 - DNA, 28 bp, Artificial Sequence
  Description of Artificial Sequence: Synthetic oligonucleotide
cgaggctgtggtcctgcattacacagac

SEQ ID NO: 230659 - DNA, 29 bp, Artificial Sequence
  Description of Artificial Sequence: Synthetic oligonucleotide
gaggctgtggtcctgcattacacagactg

SEQ ID NO: 230660 - DNA, 29 bp, Artificial Sequence
  Description of Artificial Sequence: Synthetic oligonucleotide
aggctgtggtcctgcattacacagactgg

SEQ ID NO: 230661 - DNA, 28 bp, Artificial Sequence
  Description of Artificial Sequence: Synthetic oligonucleotide
ggctgtggtcctgcattacacagactgg

SEQ ID NO: 230662 - DNA, 28 bp, Artificial Sequence
  Description of Artificial Sequence: Synthetic oligonucleotide
gctgtggtcctgcattacacagactggc

SEQ ID NO: 230663 - DNA, 29 bp, Artificial Sequence
  Description of Artificial Sequence: Synthetic oligonucleotide
ctgtggtcctgcattacacagactggctg

SEQ ID NO: 230664 - DNA, 29 bp, Artificial Sequence
  Description of Artificial Sequence: Synthetic oligonucleotide
tgtggtcctgcattacacagactggctgc

SEQ ID NO: 230665 - DNA, 28 bp, Artificial Sequence
  Description of Artificial Sequence: Synthetic oligonucleotide
gtggtcctgcattacacagactggctgc

SEQ ID NO: 230666 - DNA, 30 bp, Artificial Sequence
  Description of Artificial Sequence: Synthetic oligonucleotide
tggtcctgcattacacagactggctgcatc

SEQ ID NO: 230667 - DNA, 29 bp, Artificial Sequence
  Description of Artificial Sequence: Synthetic oligonucleotide
ggtcctgcattacacagactggctgcatc

SEQ ID NO: 230668 - DNA, 29 bp, Artificial Sequence
  Description of Artificial Sequence: Synthetic oligonucleotide
gtcctgcattacacagactggctgcatcc

SEQ ID NO: 230669 - DNA, 29 bp, Artificial Sequence
  Description of Artificial Sequence: Synthetic oligonucleotide
tcctgcattacacagactggctgcatccc

SEQ ID NO: 230670 - DNA, 28 bp, Artificial Sequence
  Description of Artificial Sequence: Synthetic oligonucleotide
cctgcattacacagactggctgcatccc

SEQ ID NO: 230671 - DNA, 28 bp, Artificial Sequence
  Description of Artificial Sequence: Synthetic oligonucleotide
ctgcattacacagactggctgcatcccg

SEQ ID NO: 230672 - DNA, 29 bp, Artificial Sequence
  Description of Artificial Sequence: Synthetic oligonucleotide
tgcattacacagactggctgcatcccgag

SEQ ID NO: 230673 - DNA, 28 bp, Artificial Sequence
  Description of Artificial Sequence: Synthetic oligonucleotide
gcattacacagactggctgcatcccgag

SEQ ID NO: 230674 - DNA, 28 bp, Artificial Sequence
  Description of Artificial Sequence: Synthetic oligonucleotide
cattacacagactggctgcatcccgagg

SEQ ID NO: 230675 - DNA, 29 bp, Artificial Sequence
  Description of Artificial Sequence: Synthetic oligonucleotide
attacacagactggctgcatcccgaggac

SEQ ID NO: 230676 - DNA, 28 bp, Artificial Sequence
  Description of Artificial Sequence: Synthetic oligonucleotide
ttacacagactggctgcatcccgaggac

SEQ ID NO: 230677 - DNA, 27 bp, Artificial Sequence
  Description of Artificial Sequence: Synthetic oligonucleotide
tacacagactggctgcatcccgaggac

SEQ ID NO: 230678 - DNA, 26 bp, Artificial Sequence
  Description of Artificial Sequence: Synthetic oligonucleotide
acacagactggctgcatcccgaggac

SEQ ID NO: 230679 - DNA, 25 bp, Artificial Sequence
  Description of Artificial Sequence: Synthetic oligonucleotide
cacagactggctgcatcccgaggac

SEQ ID NO: 230680 - DNA, 25 bp, Artificial Sequence
  Description of Artificial Sequence: Synthetic oligonucleotide
acagactggctgcatcccgaggacc

SEQ ID NO: 230681 - DNA, 24 bp, Artificial Sequence
  Description of Artificial Sequence: Synthetic oligonucleotide
cagactggctgcatcccgaggacc

SEQ ID NO: 230682 - DNA, 24 bp, Artificial Sequence
  Description of Artificial Sequence: Synthetic oligonucleotide
agactggctgcatcccgaggaccc

SEQ ID NO: 230683 - DNA, 23 bp, Artificial Sequence
  Description of Artificial Sequence: Synthetic oligonucleotide
gactggctgcatcccgaggaccc

SEQ ID NO: 230684 - DNA, 23 bp, Artificial Sequence
  Description of Artificial Sequence: Synthetic oligonucleotide
actggctgcatcccgaggacccg

SEQ ID NO: 230685 - DNA, 22 bp, Artificial Sequence
  Description of Artificial Sequence: Synthetic oligonucleotide
ctggctgcatcccgaggacccg

SEQ ID NO: 230686 - DNA, 22 bp, Artificial Sequence
  Description of Artificial Sequence: Synthetic oligonucleotide
tggctgcatcccgaggacccgg

SEQ ID NO: 230687 - DNA, 21 bp, Artificial Sequence
  Description of Artificial Sequence: Synthetic oligonucleotide
ggctgcatcccgaggacccgg

SEQ ID NO: 230688 - DNA, 22 bp, Artificial Sequence
  Description of Artificial Sequence: Synthetic oligonucleotide
gctgcatcccgaggacccggca

SEQ ID NO: 230689 - DNA, 22 bp, Artificial Sequence
  Description of Artificial Sequence: Synthetic oligonucleotide
ctgcatcccgaggacccggcac

SEQ ID NO: 230690 - DNA, 22 bp, Artificial Sequence
  Description of Artificial Sequence: Synthetic oligonucleotide
tgcatcccgaggacccggcacg

SEQ ID NO: 230691 - DNA, 21 bp, Artificial Sequence
  Description of Artificial Sequence: Synthetic oligonucleotide
gcatcccgaggacccggcacg

SEQ ID NO: 230692 - DNA, 21 bp, Artificial Sequence
  Description of Artificial Sequence: Synthetic oligonucleotide
catcccgaggacccggcacgc

SEQ ID NO: 230693 - DNA, 22 bp, Artificial Sequence
  Description of Artificial Sequence: Synthetic oligonucleotide
atcccgaggacccggcacgcct

SEQ ID NO: 230694 - DNA, 21 bp, Artificial Sequence
  Description of Artificial Sequence: Synthetic oligonucleotide
tcccgaggacccggcacgcct

SEQ ID NO: 230695 - DNA, 20 bp, Artificial Sequence
  Description of Artificial Sequence: Synthetic oligonucleotide
cccgaggacccggcacgcct

SEQ ID NO: 230696 - DNA, 21 bp, Artificial Sequence
  Description of Artificial Sequence: Synthetic oligonucleotide
ccgaggacccggcacgcctga

SEQ ID NO: 230697 - DNA, 21 bp, Artificial Sequence
  Description of Artificial Sequence: Synthetic oligonucleotide
cgaggacccggcacgcctgag

SEQ ID NO: 230698 - DNA, 21 bp, Artificial Sequence
  Description of Artificial Sequence: Synthetic oligonucleotide
gaggacccggcacgcctgagg

SEQ ID NO: 230699 - DNA, 22 bp, Artificial Sequence
  Description of Artificial Sequence: Synthetic oligonucleotide
aggacccggcacgcctgaggga

SEQ ID NO: 230700 - DNA, 21 bp, Artificial Sequence
  Description of Artificial Sequence: Synthetic oligonucleotide
ggacccggcacgcctgaggga

SEQ ID NO: 230701 - DNA, 21 bp, Artificial Sequence
  Description of Artificial Sequence: Synthetic oligonucleotide
gacccggcacgcctgagggag

SEQ ID NO: 230702 - DNA, 21 bp, Artificial Sequence
  Description of Artificial Sequence: Synthetic oligonucleotide
acccggcacgcctgagggagg

SEQ ID NO: 230703 - DNA, 20 bp, Artificial Sequence
  Description of Artificial Sequence: Synthetic oligonucleotide
cccggcacgcctgagggagg

SEQ ID NO: 230704 - DNA, 20 bp, Artificial Sequence
  Description of Artificial Sequence: Synthetic oligonucleotide
ccggcacgcctgagggaggc

SEQ ID NO: 230705 - DNA, 20 bp, Artificial Sequence
  Description of Artificial Sequence: Synthetic oligonucleotide
cggcacgcctgagggaggcc

SEQ ID NO: 230706 - DNA, 21 bp, Artificial Sequence
  Description of Artificial Sequence: Synthetic oligonucleotide
ggcacgcctgagggaggccct

SEQ ID NO: 230707 - DNA, 22 bp, Artificial Sequence
  Description of Artificial Sequence: Synthetic oligonucleotide
gcacgcctgagggaggccctga

SEQ ID NO: 230708 - DNA, 22 bp, Artificial Sequence
  Description of Artificial Sequence: Synthetic oligonucleotide
cacgcctgagggaggccctgag

SEQ ID NO: 230709 - DNA, 22 bp, Artificial Sequence
  Description of Artificial Sequence: Synthetic oligonucleotide
acgcctgagggaggccctgagc

SEQ ID NO: 230710 - DNA, 21 bp, Artificial Sequence
  Description of Artificial Sequence: Synthetic oligonucleotide
cgcctgagggaggccctgagc

SEQ ID NO: 230711 - DNA, 23 bp, Artificial Sequence
  Description of Artificial Sequence: Synthetic oligonucleotide
gcctgagggaggccctgagcgat

SEQ ID NO: 230712 - DNA, 24 bp, Artificial Sequence
  Description of Artificial Sequence: Synthetic oligonucleotide
cctgagggaggccctgagcgatgt

SEQ ID NO: 230713 - DNA, 24 bp, Artificial Sequence
  Description of Artificial Sequence: Synthetic oligonucleotide
ctgagggaggccctgagcgatgtg

SEQ ID NO: 230714 - DNA, 25 bp, Artificial Sequence
  Description of Artificial Sequence: Synthetic oligonucleotide
tgagggaggccctgagcgatgtggt

SEQ ID NO: 230715 - DNA, 24 bp, Artificial Sequence
  Description of Artificial Sequence: Synthetic oligonucleotide
gagggaggccctgagcgatgtggt

SEQ ID NO: 230716 - DNA, 24 bp, Artificial Sequence
  Description of Artificial Sequence: Synthetic oligonucleotide
agggaggccctgagcgatgtggtg

SEQ ID NO: 230717 - DNA, 23 bp, Artificial Sequence
  Description of Artificial Sequence: Synthetic oligonucleotide
gggaggccctgagcgatgtggtg

SEQ ID NO: 230718 - DNA, 23 bp, Artificial Sequence
  Description of Artificial Sequence: Synthetic oligonucleotide
ggaggccctgagcgatgtggtgg

SEQ ID NO: 230719 - DNA, 23 bp, Artificial Sequence
  Description of Artificial Sequence: Synthetic oligonucleotide
gaggccctgagcgatgtggtggg

SEQ ID NO: 230720 - DNA, 23 bp, Artificial Sequence
  Description of Artificial Sequence: Synthetic oligonucleotide
aggccctgagcgatgtggtgggc

SEQ ID NO: 230721 - DNA, 22 bp, Artificial Sequence
  Description of Artificial Sequence: Synthetic oligonucleotide
ggccctgagcgatgtggtgggc

SEQ ID NO: 230722 - DNA, 23 bp, Artificial Sequence
  Description of Artificial Sequence: Synthetic oligonucleotide
gccctgagcgatgtggtgggcga

SEQ ID NO: 230723 - DNA, 23 bp, Artificial Sequence
  Description of Artificial Sequence: Synthetic oligonucleotide
ccctgagcgatgtggtgggcgac

SEQ ID NO: 230724 - DNA, 24 bp, Artificial Sequence
  Description of Artificial Sequence: Synthetic oligonucleotide
cctgagcgatgtggtgggcgacca

SEQ ID NO: 230725 - DNA, 27 bp, Artificial Sequence
  Description of Artificial Sequence: Synthetic oligonucleotide
ctgagcgatgtggtgggcgaccacaat

SEQ ID NO: 230726 - DNA, 27 bp, Artificial Sequence
  Description of Artificial Sequence: Synthetic oligonucleotide
tgagcgatgtggtgggcgaccacaatg

SEQ ID NO: 230727 - DNA, 27 bp, Artificial Sequence
  Description of Artificial Sequence: Synthetic oligonucleotide
gagcgatgtggtgggcgaccacaatgt

SEQ ID NO: 230728 - DNA, 27 bp, Artificial Sequence
  Description of Artificial Sequence: Synthetic oligonucleotide
agcgatgtggtgggcgaccacaatgtc

SEQ ID NO: 230729 - DNA, 26 bp, Artificial Sequence
  Description of Artificial Sequence: Synthetic oligonucleotide
gcgatgtggtgggcgaccacaatgtc

SEQ ID NO: 230730 - DNA, 27 bp, Artificial Sequence
  Description of Artificial Sequence: Synthetic oligonucleotide
cgatgtggtgggcgaccacaatgtcgt

SEQ ID NO: 230731 - DNA, 27 bp, Artificial Sequence
  Description of Artificial Sequence: Synthetic oligonucleotide
gatgtggtgggcgaccacaatgtcgtg

SEQ ID NO: 230732 - DNA, 28 bp, Artificial Sequence
  Description of Artificial Sequence: Synthetic oligonucleotide
atgtggtgggcgaccacaatgtcgtgtg

SEQ ID NO: 230733 - DNA, 27 bp, Artificial Sequence
  Description of Artificial Sequence: Synthetic oligonucleotide
tgtggtgggcgaccacaatgtcgtgtg

SEQ ID NO: 230734 - DNA, 26 bp, Artificial Sequence
  Description of Artificial Sequence: Synthetic oligonucleotide
gtggtgggcgaccacaatgtcgtgtg

SEQ ID NO: 230735 - DNA, 26 bp, Artificial Sequence
  Description of Artificial Sequence: Synthetic oligonucleotide
tggtgggcgaccacaatgtcgtgtgc

SEQ ID NO: 230736 - DNA, 25 bp, Artificial Sequence
  Description of Artificial Sequence: Synthetic oligonucleotide
ggtgggcgaccacaatgtcgtgtgc

SEQ ID NO: 230737 - DNA, 25 bp, Artificial Sequence
  Description of Artificial Sequence: Synthetic oligonucleotide
gtgggcgaccacaatgtcgtgtgcc

SEQ ID NO: 230738 - DNA, 25 bp, Artificial Sequence
  Description of Artificial Sequence: Synthetic oligonucleotide
tgggcgaccacaatgtcgtgtgccc

SEQ ID NO: 230739 - DNA, 24 bp, Artificial Sequence
  Description of Artificial Sequence: Synthetic oligonucleotide
gggcgaccacaatgtcgtgtgccc

SEQ ID NO: 230740 - DNA, 24 bp, Artificial Sequence
  Description of Artificial Sequence: Synthetic oligonucleotide
ggcgaccacaatgtcgtgtgcccc

SEQ ID NO: 230741 - DNA, 25 bp, Artificial Sequence
  Description of Artificial Sequence: Synthetic oligonucleotide
gcgaccacaatgtcgtgtgccccgt

SEQ ID NO: 230742 - DNA, 25 bp, Artificial Sequence
  Description of Artificial Sequence: Synthetic oligonucleotide
cgaccacaatgtcgtgtgccccgtg

SEQ ID NO: 230743 - DNA, 25 bp, Artificial Sequence
  Description of Artificial Sequence: Synthetic oligonucleotide
gaccacaatgtcgtgtgccccgtgg

SEQ ID NO: 230744 - DNA, 25 bp, Artificial Sequence
  Description of Artificial Sequence: Synthetic oligonucleotide
accacaatgtcgtgtgccccgtggc

SEQ ID NO: 230745 - DNA, 24 bp, Artificial Sequence
  Description of Artificial Sequence: Synthetic oligonucleotide
ccacaatgtcgtgtgccccgtggc

SEQ ID NO: 230746 - DNA, 24 bp, Artificial Sequence
  Description of Artificial Sequence: Synthetic oligonucleotide
cacaatgtcgtgtgccccgtggcc

SEQ ID NO: 230747 - DNA, 25 bp, Artificial Sequence
  Description of Artificial Sequence: Synthetic oligonucleotide
acaatgtcgtgtgccccgtggccca

SEQ ID NO: 230748 - DNA, 24 bp, Artificial Sequence
  Description of Artificial Sequence: Synthetic oligonucleotide
caatgtcgtgtgccccgtggccca

SEQ ID NO: 230749 - DNA, 24 bp, Artificial Sequence
  Description of Artificial Sequence: Synthetic oligonucleotide
aatgtcgtgtgccccgtggcccag

SEQ ID NO: 230750 - DNA, 23 bp, Artificial Sequence
  Description of Artificial Sequence: Synthetic oligonucleotide
atgtcgtgtgccccgtggcccag

SEQ ID NO: 230751 - DNA, 22 bp, Artificial Sequence
  Description of Artificial Sequence: Synthetic oligonucleotide
tgtcgtgtgccccgtggcccag

SEQ ID NO: 230752 - DNA, 21 bp, Artificial Sequence
  Description of Artificial Sequence: Synthetic oligonucleotide
gtcgtgtgccccgtggcccag

SEQ ID NO: 230753 - DNA, 22 bp, Artificial Sequence
  Description of Artificial Sequence: Synthetic oligonucleotide
tcgtgtgccccgtggcccagct

SEQ ID NO: 230754 - DNA, 21 bp, Artificial Sequence
  Description of Artificial Sequence: Synthetic oligonucleotide
cgtgtgccccgtggcccagct

SEQ ID NO: 230755 - DNA, 21 bp, Artificial Sequence
  Description of Artificial Sequence: Synthetic oligonucleotide
gtgtgccccgtggcccagctg

SEQ ID NO: 230756 - DNA, 21 bp, Artificial Sequence
  Description of Artificial Sequence: Synthetic oligonucleotide
tgtgccccgtggcccagctgg

SEQ ID NO: 230757 - DNA, 20 bp, Artificial Sequence
  Description of Artificial Sequence: Synthetic oligonucleotide
gtgccccgtggcccagctgg

SEQ ID NO: 230758 - DNA, 21 bp, Artificial Sequence
  Description of Artificial Sequence: Synthetic oligonucleotide
tgccccgtggcccagctggct

SEQ ID NO: 230759 - DNA, 20 bp, Artificial Sequence
  Description of Artificial Sequence: Synthetic oligonucleotide
gccccgtggcccagctggct

SEQ ID NO: 230760 - DNA, 20 bp, Artificial Sequence
  Description of Artificial Sequence: Synthetic oligonucleotide
ccccgtggcccagctggctg

SEQ ID NO: 230761 - DNA, 20 bp, Artificial Sequence
  Description of Artificial Sequence: Synthetic oligonucleotide
cccgtggcccagctggctgg

SEQ ID NO: 230762 - DNA, 20 bp, Artificial Sequence
  Description of Artificial Sequence: Synthetic oligonucleotide
ccgtggcccagctggctggg

SEQ ID NO: 230763 - DNA, 20 bp, Artificial Sequence
  Description of Artificial Sequence: Synthetic oligonucleotide
cgtggcccagctggctgggc

SEQ ID NO: 230764 - DNA, 21 bp, Artificial Sequence
  Description of Artificial Sequence: Synthetic oligonucleotide
gtggcccagctggctgggcga

SEQ ID NO: 230765 - DNA, 22 bp, Artificial Sequence
  Description of Artificial Sequence: Synthetic oligonucleotide
tggcccagctggctgggcgact

SEQ ID NO: 230766 - DNA, 21 bp, Artificial Sequence
  Description of Artificial Sequence: Synthetic oligonucleotide
ggcccagctggctgggcgact

SEQ ID NO: 230767 - DNA, 21 bp, Artificial Sequence
  Description of Artificial Sequence: Synthetic oligonucleotide
gcccagctggctgggcgactg

SEQ ID NO: 230768 - DNA, 21 bp, Artificial Sequence
  Description of Artificial Sequence: Synthetic oligonucleotide
cccagctggctgggcgactgg

SEQ ID NO: 230769 - DNA, 22 bp, Artificial Sequence
  Description of Artificial Sequence: Synthetic oligonucleotide
ccagctggctgggcgactggct

SEQ ID NO: 230770 - DNA, 22 bp, Artificial Sequence
  Description of Artificial Sequence: Synthetic oligonucleotide
cagctggctgggcgactggctg

SEQ ID NO: 230771 - DNA, 22 bp, Artificial Sequence
  Description of Artificial Sequence: Synthetic oligonucleotide
agctggctgggcgactggctgc

SEQ ID NO: 230772 - DNA, 21 bp, Artificial Sequence
  Description of Artificial Sequence: Synthetic oligonucleotide
gctggctgggcgactggctgc

SEQ ID NO: 230773 - DNA, 21 bp, Artificial Sequence
  Description of Artificial Sequence: Synthetic oligonucleotide
ctggctgggcgactggctgcc

SEQ ID NO: 230774 - DNA, 22 bp, Artificial Sequence
  Description of Artificial Sequence: Synthetic oligonucleotide
tggctgggcgactggctgccca

SEQ ID NO: 230775 - DNA, 21 bp, Artificial Sequence
  Description of Artificial Sequence: Synthetic oligonucleotide
ggctgggcgactggctgccca

SEQ ID NO: 230776 - DNA, 21 bp, Artificial Sequence
  Description of Artificial Sequence: Synthetic oligonucleotide
gctgggcgactggctgcccag

SEQ ID NO: 230777 - DNA, 21 bp, Artificial Sequence
  Description of Artificial Sequence: Synthetic oligonucleotide
ctgggcgactggctgcccagg

SEQ ID NO: 230778 - DNA, 22 bp, Artificial Sequence
  Description of Artificial Sequence: Synthetic oligonucleotide
tgggcgactggctgcccagggt

SEQ ID NO: 230779 - DNA, 21 bp, Artificial Sequence
  Description of Artificial Sequence: Synthetic oligonucleotide
gggcgactggctgcccagggt

SEQ ID NO: 230780 - DNA, 21 bp, Artificial Sequence
  Description of Artificial Sequence: Synthetic oligonucleotide
ggcgactggctgcccagggtg

SEQ ID NO: 230781 - DNA, 21 bp, Artificial Sequence
  Description of Artificial Sequence: Synthetic oligonucleotide
gcgactggctgcccagggtgc

SEQ ID NO: 230782 - DNA, 21 bp, Artificial Sequence
  Description of Artificial Sequence: Synthetic oligonucleotide
cgactggctgcccagggtgcc

SEQ ID NO: 230783 - DNA, 21 bp, Artificial Sequence
  Description of Artificial Sequence: Synthetic oligonucleotide
gactggctgcccagggtgccc

SEQ ID NO: 230784 - DNA, 21 bp, Artificial Sequence
  Description of Artificial Sequence: Synthetic oligonucleotide
actggctgcccagggtgcccg

SEQ ID NO: 230785 - DNA, 20 bp, Artificial Sequence
  Description of Artificial Sequence: Synthetic oligonucleotide
ctggctgcccagggtgcccg

SEQ ID NO: 230786 - DNA, 20 bp, Artificial Sequence
  Description of Artificial Sequence: Synthetic oligonucleotide
tggctgcccagggtgcccgg

SEQ ID NO: 230787 - DNA, 20 bp, Artificial Sequence
  Description of Artificial Sequence: Synthetic oligonucleotide
ggctgcccagggtgcccggt

SEQ ID NO: 230788 - DNA, 20 bp, Artificial Sequence
  Description of Artificial Sequence: Synthetic oligonucleotide
gctgcccagggtgcccgggt

SEQ ID NO: 230789 - DNA, 22 bp, Artificial Sequence
  Description of Artificial Sequence: Synthetic oligonucleotide
ctgcccagggtgcccgggtcta

SEQ ID NO: 230790 - DNA, 22 bp, Artificial Sequence
  Description of Artificial Sequence: Synthetic oligonucleotide
tgcccagggtgcccgggtctac

SEQ ID NO: 230791 - DNA, 21 bp, Artificial Sequence
  Description of Artificial Sequence: Synthetic oligonucleotide
gcccagggtgcccgggtctac

SEQ ID NO: 230792 - DNA, 21 bp, Artificial Sequence
  Description of Artificial Sequence: Synthetic oligonucleotide
cccagggtgcccgggtctacg

SEQ ID NO: 230793 - DNA, 21 bp, Artificial Sequence
  Description of Artificial Sequence: Synthetic oligonucleotide
ccagggtgcccgggtctacgc

SEQ ID NO: 230794 - DNA, 23 bp, Artificial Sequence
  Description of Artificial Sequence: Synthetic oligonucleotide
cagggtgcccgggtctacgccta

SEQ ID NO: 230795 - DNA, 23 bp, Artificial Sequence
  Description of Artificial Sequence: Synthetic oligonucleotide
agggtgcccgggtctacgcctac

SEQ ID NO: 230796 - DNA, 22 bp, Artificial Sequence
  Description of Artificial Sequence: Synthetic oligonucleotide
gggtgcccgggtctacgcctac

SEQ ID NO: 230797 - DNA, 23 bp, Artificial Sequence
  Description of Artificial Sequence: Synthetic oligonucleotide
ggtgcccgggtctacgcctacgt

SEQ ID NO: 230798 - DNA, 26 bp, Artificial Sequence
  Description of Artificial Sequence: Synthetic oligonucleotide
gtgcccgggtctacgcctacgtcttt

SEQ ID NO: 230799 - DNA, 27 bp, Artificial Sequence
  Description of Artificial Sequence: Synthetic oligonucleotide
tgcccgggtctacgcctacgtctttga

SEQ ID NO: 230800 - DNA, 27 bp, Artificial Sequence
  Description of Artificial Sequence: Synthetic oligonucleotide
gcccgggtctacgcctacgtctttgaa

SEQ ID NO: 230801 - DNA, 27 bp, Artificial Sequence
  Description of Artificial Sequence: Synthetic oligonucleotide
cccgggtctacgcctacgtctttgaac

SEQ ID NO: 230802 - DNA, 28 bp, Artificial Sequence
  Description of Artificial Sequence: Synthetic oligonucleotide
ccgggtctacgcctacgtctttgaacac

SEQ ID NO: 230803 - DNA, 28 bp, Artificial Sequence
  Description of Artificial Sequence: Synthetic oligonucleotide
cgggtctacgcctacgtctttgaacacc

SEQ ID NO: 230804 - DNA, 28 bp, Artificial Sequence
  Description of Artificial Sequence: Synthetic oligonucleotide
gggtctacgcctacgtctttgaacaccg

SEQ ID NO: 230805 - DNA, 29 bp, Artificial Sequence
  Description of Artificial Sequence: Synthetic oligonucleotide
ggtctacgcctacgtctttgaacaccgtg

SEQ ID NO: 230806 - DNA, 29 bp, Artificial Sequence
  Description of Artificial Sequence: Synthetic oligonucleotide
gtctacgcctacgtctttgaacaccgtgc

SEQ ID NO: 230807 - DNA, 31 bp, Artificial Sequence
  Description of Artificial Sequence: Synthetic oligonucleotide
tctacgcctacgtctttgaacaccgtgcttc

SEQ ID NO: 230808 - DNA, 30 bp, Artificial Sequence
  Description of Artificial Sequence: Synthetic oligonucleotide
ctacgcctacgtctttgaacaccgtgcttc

SEQ ID NO: 230809 - DNA, 30 bp, Artificial Sequence
  Description of Artificial Sequence: Synthetic oligonucleotide
tacgcctacgtctttgaacaccgtgcttcc

SEQ ID NO: 230810 - DNA, 29 bp, Artificial Sequence
  Description of Artificial Sequence: Synthetic oligonucleotide
acgcctacgtctttgaacaccgtgcttcc

SEQ ID NO: 230811 - DNA, 28 bp, Artificial Sequence
  Description of Artificial Sequence: Synthetic oligonucleotide
cgcctacgtctttgaacaccgtgcttcc

SEQ ID NO: 230812 - DNA, 29 bp, Artificial Sequence
  Description of Artificial Sequence: Synthetic oligonucleotide
gcctacgtctttgaacaccgtgcttccac

SEQ ID NO: 230813 - DNA, 29 bp, Artificial Sequence
  Description of Artificial Sequence: Synthetic oligonucleotide
cctacgtctttgaacaccgtgcttccacg

SEQ ID NO: 230814 - DNA, 29 bp, Artificial Sequence
  Description of Artificial Sequence: Synthetic oligonucleotide
ctacgtctttgaacaccgtgcttccacgc

SEQ ID NO: 230815 - DNA, 30 bp, Artificial Sequence
  Description of Artificial Sequence: Synthetic oligonucleotide
tacgtctttgaacaccgtgcttccacgctc

SEQ ID NO: 230816 - DNA, 29 bp, Artificial Sequence
  Description of Artificial Sequence: Synthetic oligonucleotide
acgtctttgaacaccgtgcttccacgctc

SEQ ID NO: 230817 - DNA, 28 bp, Artificial Sequence
  Description of Artificial Sequence: Synthetic oligonucleotide
cgtctttgaacaccgtgcttccacgctc

SEQ ID NO: 230818 - DNA, 29 bp, Artificial Sequence
  Description of Artificial Sequence: Synthetic oligonucleotide
gtctttgaacaccgtgcttccacgctctc

SEQ ID NO: 230819 - DNA, 29 bp, Artificial Sequence
  Description of Artificial Sequence: Synthetic oligonucleotide
tctttgaacaccgtgcttccacgctctcc

SEQ ID NO: 230820 - DNA, 28 bp, Artificial Sequence
  Description of Artificial Sequence: Synthetic oligonucleotide
ctttgaacaccgtgcttccacgctctcc

SEQ ID NO: 230821 - DNA, 29 bp, Artificial Sequence
  Description of Artificial Sequence: Synthetic oligonucleotide
tttgaacaccgtgcttccacgctctcctg

SEQ ID NO: 230822 - DNA, 28 bp, Artificial Sequence
  Description of Artificial Sequence: Synthetic oligonucleotide
ttgaacaccgtgcttccacgctctcctg

SEQ ID NO: 230823 - DNA, 27 bp, Artificial Sequence
  Description of Artificial Sequence: Synthetic oligonucleotide
tgaacaccgtgcttccacgctctcctg

SEQ ID NO: 230824 - DNA, 26 bp, Artificial Sequence
  Description of Artificial Sequence: Synthetic oligonucleotide
gaacaccgtgcttccacgctctcctg

SEQ ID NO: 230825 - DNA, 26 bp, Artificial Sequence
  Description of Artificial Sequence: Synthetic oligonucleotide
aacaccgtgcttccacgctctcctgg

SEQ ID NO: 230826 - DNA, 25 bp, Artificial Sequence
  Description of Artificial Sequence: Synthetic oligonucleotide
acaccgtgcttccacgctctcctgg

SEQ ID NO: 230827 - DNA, 24 bp, Artificial Sequence
  Description of Artificial Sequence: Synthetic oligonucleotide
caccgtgcttccacgctctcctgg

SEQ ID NO: 230828 - DNA, 24 bp, Artificial Sequence
  Description of Artificial Sequence: Synthetic oligonucleotide
accgtgcttccacgctctcctggc

SEQ ID NO: 230829 - DNA, 23 bp, Artificial Sequence
  Description of Artificial Sequence: Synthetic oligonucleotide
ccgtgcttccacgctctcctggc

SEQ ID NO: 230830 - DNA, 23 bp, Artificial Sequence
  Description of Artificial Sequence: Synthetic oligonucleotide
cgtgcttccacgctctcctggcc

SEQ ID NO: 230831 - DNA, 23 bp, Artificial Sequence
  Description of Artificial Sequence: Synthetic oligonucleotide
gtgcttccacgctctcctggccc

SEQ ID NO: 230832 - DNA, 24 bp, Artificial Sequence
  Description of Artificial Sequence: Synthetic oligonucleotide
tgcttccacgctctcctggcccct

SEQ ID NO: 230833 - DNA, 23 bp, Artificial Sequence
  Description of Artificial Sequence: Synthetic oligonucleotide
gcttccacgctctcctggcccct

SEQ ID NO: 230834 - DNA, 24 bp, Artificial Sequence
  Description of Artificial Sequence: Synthetic oligonucleotide
cttccacgctctcctggcccctgt

SEQ ID NO: 230835 - DNA, 24 bp, Artificial Sequence
  Description of Artificial Sequence: Synthetic oligonucleotide
ttccacgctctcctggcccctgtg

SEQ ID NO: 230836 - DNA, 23 bp, Artificial Sequence
  Description of Artificial Sequence: Synthetic oligonucleotide
tccacgctctcctggcccctgtg

SEQ ID NO: 230837 - DNA, 22 bp, Artificial Sequence
  Description of Artificial Sequence: Synthetic oligonucleotide
ccacgctctcctggcccctgtg

SEQ ID NO: 230838 - DNA, 24 bp, Artificial Sequence
  Description of Artificial Sequence: Synthetic oligonucleotide
cacgctctcctggcccctgtggat

SEQ ID NO: 230839 - DNA, 24 bp, Artificial Sequence
  Description of Artificial Sequence: Synthetic oligonucleotide
acgctctcctggcccctgtggatg

SEQ ID NO: 230840 - DNA, 23 bp, Artificial Sequence
  Description of Artificial Sequence: Synthetic oligonucleotide
cgctctcctggcccctgtggatg

SEQ ID NO: 230841 - DNA, 23 bp, Artificial Sequence
  Description of Artificial Sequence: Synthetic oligonucleotide
gctctcctggcccctgtggatgg

SEQ ID NO: 230842 - DNA, 23 bp, Artificial Sequence
  Description of Artificial Sequence: Synthetic oligonucleotide
ctctcctggcccctgtggatggg

SEQ ID NO: 230843 - DNA, 23 bp, Artificial Sequence
  Description of Artificial Sequence: Synthetic oligonucleotide
tctcctggcccctgtggatgggg

SEQ ID NO: 230844 - DNA, 22 bp, Artificial Sequence
  Description of Artificial Sequence: Synthetic oligonucleotide
ctcctggcccctgtggatgggg

SEQ ID NO: 230845 - DNA, 23 bp, Artificial Sequence
  Description of Artificial Sequence: Synthetic oligonucleotide
tcctggcccctgtggatgggggt

SEQ ID NO: 230846 - DNA, 22 bp, Artificial Sequence
  Description of Artificial Sequence: Synthetic oligonucleotide
cctggcccctgtggatgggggt

SEQ ID NO: 230847 - DNA, 22 bp, Artificial Sequence
  Description of Artificial Sequence: Synthetic oligonucleotide
ctggcccctgtggatgggggtg

SEQ ID NO: 230848 - DNA, 22 bp, Artificial Sequence
  Description of Artificial Sequence: Synthetic oligonucleotide
tggcccctgtggatgggggtgc

SEQ ID NO: 230849 - DNA, 21 bp, Artificial Sequence
  Description of Artificial Sequence: Synthetic oligonucleotide
ggcccctgtggatgggggtgc

SEQ ID NO: 230850 - DNA, 21 bp, Artificial Sequence
  Description of Artificial Sequence: Synthetic oligonucleotide
gcccctgtggatgggggtgcc

SEQ ID NO: 230851 - DNA, 21 bp, Artificial Sequence
  Description of Artificial Sequence: Synthetic oligonucleotide
cccctgtggatgggggtgccc

SEQ ID NO: 230852 - DNA, 22 bp, Artificial Sequence
  Description of Artificial Sequence: Synthetic oligonucleotide
ccctgtggatgggggtgcccca

SEQ ID NO: 230853 - DNA, 22 bp, Artificial Sequence
  Description of Artificial Sequence: Synthetic oligonucleotide
cctgtggatgggggtgccccac

SEQ ID NO: 230854 - DNA, 22 bp, Artificial Sequence
  Description of Artificial Sequence: Synthetic oligonucleotide
ctgtggatgggggtgccccacg

SEQ ID NO: 230855 - DNA, 22 bp, Artificial Sequence
  Description of Artificial Sequence: Synthetic oligonucleotide
tgtggatgggggtgccccacgg

SEQ ID NO: 230856 - DNA, 21 bp, Artificial Sequence
  Description of Artificial Sequence: Synthetic oligonucleotide
gtggatgggggtgccccacgg

SEQ ID NO: 230857 - DNA, 23 bp, Artificial Sequence
  Description of Artificial Sequence: Synthetic oligonucleotide
tggatgggggtgccccacggcta

SEQ ID NO: 230858 - DNA, 22 bp, Artificial Sequence
  Description of Artificial Sequence: Synthetic oligonucleotide
ggatgggggtgccccacggcta

SEQ ID NO: 230859 - DNA, 22 bp, Artificial Sequence
  Description of Artificial Sequence: Synthetic oligonucleotide
gatgggggtgccccacggctac

SEQ ID NO: 230860 - DNA, 23 bp, Artificial Sequence
  Description of Artificial Sequence: Synthetic oligonucleotide
atgggggtgccccacggctacga

SEQ ID NO: 230861 - DNA, 22 bp, Artificial Sequence
  Description of Artificial Sequence: Synthetic oligonucleotide
tgggggtgccccacggctacga

SEQ ID NO: 230862 - DNA, 21 bp, Artificial Sequence
  Description of Artificial Sequence: Synthetic oligonucleotide
gggggtgccccacggctacga

SEQ ID NO: 230863 - DNA, 23 bp, Artificial Sequence
  Description of Artificial Sequence: Synthetic oligonucleotide
ggggtgccccacggctacgagat

SEQ ID NO: 230864 - DNA, 23 bp, Artificial Sequence
  Description of Artificial Sequence: Synthetic oligonucleotide
gggtgccccacggctacgagatc

SEQ ID NO: 230865 - DNA, 24 bp, Artificial Sequence
  Description of Artificial Sequence: Synthetic oligonucleotide
ggtgccccacggctacgagatcga

SEQ ID NO: 230866 - DNA, 26 bp, Artificial Sequence
  Description of Artificial Sequence: Synthetic oligonucleotide
gtgccccacggctacgagatcgagtt

SEQ ID NO: 230867 - DNA, 27 bp, Artificial Sequence
  Description of Artificial Sequence: Synthetic oligonucleotide
tgccccacggctacgagatcgagttca

SEQ ID NO: 230868 - DNA, 27 bp, Artificial Sequence
  Description of Artificial Sequence: Synthetic oligonucleotide
gccccacggctacgagatcgagttcat

SEQ ID NO: 230869 - DNA, 27 bp, Artificial Sequence
  Description of Artificial Sequence: Synthetic oligonucleotide
ccccacggctacgagatcgagttcatc

SEQ ID NO: 230870 - DNA, 30 bp, Artificial Sequence
  Description of Artificial Sequence: Synthetic oligonucleotide
cccacggctacgagatcgagttcatctttg

SEQ ID NO: 230871 - DNA, 30 bp, Artificial Sequence
  Description of Artificial Sequence: Synthetic oligonucleotide
ccacggctacgagatcgagttcatctttgg

SEQ ID NO: 230872 - DNA, 30 bp, Artificial Sequence
  Description of Artificial Sequence: Synthetic oligonucleotide
cacggctacgagatcgagttcatctttggg

SEQ ID NO: 230873 - DNA, 32 bp, Artificial Sequence
  Description of Artificial Sequence: Synthetic oligonucleotide
acggctacgagatcgagttcatctttgggatc

SEQ ID NO: 230874 - DNA, 31 bp, Artificial Sequence
  Description of Artificial Sequence: Synthetic oligonucleotide
cggctacgagatcgagttcatctttgggatc

SEQ ID NO: 230875 - DNA, 31 bp, Artificial Sequence
  Description of Artificial Sequence: Synthetic oligonucleotide
ggctacgagatcgagttcatctttgggatcc

SEQ ID NO: 230876 - DNA, 31 bp, Artificial Sequence
  Description of Artificial Sequence: Synthetic oligonucleotide
gctacgagatcgagttcatctttgggatccc

SEQ ID NO: 230877 - DNA, 31 bp, Artificial Sequence
  Description of Artificial Sequence: Synthetic oligonucleotide
ctacgagatcgagttcatctttgggatcccc

SEQ ID NO: 230878 - DNA, 31 bp, Artificial Sequence
  Description of Artificial Sequence: Synthetic oligonucleotide
tacgagatcgagttcatctttgggatccccc

SEQ ID NO: 230879 - DNA, 30 bp, Artificial Sequence
  Description of Artificial Sequence: Synthetic oligonucleotide
acgagatcgagttcatctttgggatccccc

SEQ ID NO: 230880 - DNA, 29 bp, Artificial Sequence
  Description of Artificial Sequence: Synthetic oligonucleotide
cgagatcgagttcatctttgggatccccc

SEQ ID NO: 230881 - DNA, 30 bp, Artificial Sequence
  Description of Artificial Sequence: Synthetic oligonucleotide
gagatcgagttcatctttgggatccccctg

SEQ ID NO: 230882 - DNA, 30 bp, Artificial Sequence
  Description of Artificial Sequence: Synthetic oligonucleotide
agatcgagttcatctttgggatccccctgg

SEQ ID NO: 230883 - DNA, 29 bp, Artificial Sequence
  Description of Artificial Sequence: Synthetic oligonucleotide
gatcgagttcatctttgggatccccctgg

SEQ ID NO: 230884 - DNA, 30 bp, Artificial Sequence
  Description of Artificial Sequence: Synthetic oligonucleotide
atcgagttcatctttgggatccccctggac

SEQ ID NO: 230885 - DNA, 29 bp, Artificial Sequence
  Description of Artificial Sequence: Synthetic oligonucleotide
tcgagttcatctttgggatccccctggac

SEQ ID NO: 230886 - DNA, 28 bp, Artificial Sequence
  Description of Artificial Sequence: Synthetic oligonucleotide
cgagttcatctttgggatccccctggac

SEQ ID NO: 230887 - DNA, 28 bp, Artificial Sequence
  Description of Artificial Sequence: Synthetic oligonucleotide
gagttcatctttgggatccccctggacc

SEQ ID NO: 230888 - DNA, 28 bp, Artificial Sequence
  Description of Artificial Sequence: Synthetic oligonucleotide
agttcatctttgggatccccctggaccc

SEQ ID NO: 230889 - DNA, 27 bp, Artificial Sequence
  Description of Artificial Sequence: Synthetic oligonucleotide
gttcatctttgggatccccctggaccc

SEQ ID NO: 230890 - DNA, 27 bp, Artificial Sequence
  Description of Artificial Sequence: Synthetic oligonucleotide
ttcatctttgggatccccctggacccc

SEQ ID NO: 230891 - DNA, 27 bp, Artificial Sequence
  Description of Artificial Sequence: Synthetic oligonucleotide
tcatctttgggatccccctggacccct

SEQ ID NO: 230892 - DNA, 26 bp, Artificial Sequence
  Description of Artificial Sequence: Synthetic oligonucleotide
catctttgggatccccctggacccct

SEQ ID NO: 230893 - DNA, 27 bp, Artificial Sequence
  Description of Artificial Sequence: Synthetic oligonucleotide
atctttgggatccccctggacccctct

SEQ ID NO: 230894 - DNA, 26 bp, Artificial Sequence
  Description of Artificial Sequence: Synthetic oligonucleotide
tctttgggatccccctggacccctct

SEQ ID NO: 230895 - DNA, 25 bp, Artificial Sequence
  Description of Artificial Sequence: Synthetic oligonucleotide
ctttgggatccccctggacccctct

SEQ ID NO: 230896 - DNA, 25 bp, Artificial Sequence
  Description of Artificial Sequence: Synthetic oligonucleotide
tttgggatccccctggacccctctc

SEQ ID NO: 230897 - DNA, 24 bp, Artificial Sequence
  Description of Artificial Sequence: Synthetic oligonucleotide
ttgggatccccctggacccctctc

SEQ ID NO: 230898 - DNA, 23 bp, Artificial Sequence
  Description of Artificial Sequence: Synthetic oligonucleotide
tgggatccccctggacccctctc

SEQ ID NO: 230899 - DNA, 22 bp, Artificial Sequence
  Description of Artificial Sequence: Synthetic oligonucleotide
gggatccccctggacccctctc

SEQ ID NO: 230900 - DNA, 25 bp, Artificial Sequence
  Description of Artificial Sequence: Synthetic oligonucleotide
ggatccccctggacccctctcgaaa

SEQ ID NO: 230901 - DNA, 27 bp, Artificial Sequence
  Description of Artificial Sequence: Synthetic oligonucleotide
gatccccctggacccctctcgaaacta

SEQ ID NO: 230902 - DNA, 27 bp, Artificial Sequence
  Description of Artificial Sequence: Synthetic oligonucleotide
atccccctggacccctctcgaaactac

SEQ ID NO: 230903 - DNA, 27 bp, Artificial Sequence
  Description of Artificial Sequence: Synthetic oligonucleotide
tccccctggacccctctcgaaactaca

SEQ ID NO: 230904 - DNA, 26 bp, Artificial Sequence
  Description of Artificial Sequence: Synthetic oligonucleotide
ccccctggacccctctcgaaactaca

SEQ ID NO: 230905 - DNA, 26 bp, Artificial Sequence
  Description of Artificial Sequence: Synthetic oligonucleotide
cccctggacccctctcgaaactacac

SEQ ID NO: 230906 - DNA, 26 bp, Artificial Sequence
  Description of Artificial Sequence: Synthetic oligonucleotide
ccctggacccctctcgaaactacacg

SEQ ID NO: 230907 - DNA, 26 bp, Artificial Sequence
  Description of Artificial Sequence: Synthetic oligonucleotide
cctggacccctctcgaaactacacgg

SEQ ID NO: 230908 - DNA, 27 bp, Artificial Sequence
  Description of Artificial Sequence: Synthetic oligonucleotide
ctggacccctctcgaaactacacggca

SEQ ID NO: 230909 - DNA, 27 bp, Artificial Sequence
  Description of Artificial Sequence: Synthetic oligonucleotide
tggacccctctcgaaactacacggcag

SEQ ID NO: 230910 - DNA, 27 bp, Artificial Sequence
  Description of Artificial Sequence: Synthetic oligonucleotide
ggacccctctcgaaactacacggcaga

SEQ ID NO: 230911 - DNA, 27 bp, Artificial Sequence
  Description of Artificial Sequence: Synthetic oligonucleotide
gacccctctcgaaactacacggcagag

SEQ ID NO: 230912 - DNA, 27 bp, Artificial Sequence
  Description of Artificial Sequence: Synthetic oligonucleotide
acccctctcgaaactacacggcagagg

SEQ ID NO: 230913 - DNA, 27 bp, Artificial Sequence
  Description of Artificial Sequence: Synthetic oligonucleotide
cccctctcgaaactacacggcagagga

SEQ ID NO: 230914 - DNA, 27 bp, Artificial Sequence
  Description of Artificial Sequence: Synthetic oligonucleotide
ccctctcgaaactacacggcagaggag

SEQ ID NO: 230915 - DNA, 32 bp, Artificial Sequence
  Description of Artificial Sequence: Synthetic oligonucleotide
cctctcgaaactacacggcagaggagaaaatc

SEQ ID NO: 230916 - DNA, 34 bp, Artificial Sequence
  Description of Artificial Sequence: Synthetic oligonucleotide
ctctcgaaactacacggcagaggagaaaatcttc

SEQ ID NO: 230917 - DNA, 34 bp, Artificial Sequence
  Description of Artificial Sequence: Synthetic oligonucleotide
tctcgaaactacacggcagaggagaaaatcttcg

SEQ ID NO: 230918 - DNA, 33 bp, Artificial Sequence
  Description of Artificial Sequence: Synthetic oligonucleotide
ctcgaaactacacggcagaggagaaaatcttcg

SEQ ID NO: 230919 - DNA, 33 bp, Artificial Sequence
  Description of Artificial Sequence: Synthetic oligonucleotide
tcgaaactacacggcagaggagaaaatcttcgc

SEQ ID NO: 230920 - DNA, 32 bp, Artificial Sequence
  Description of Artificial Sequence: Synthetic oligonucleotide
cgaaactacacggcagaggagaaaatcttcgc

SEQ ID NO: 230921 - DNA, 32 bp, Artificial Sequence
  Description of Artificial Sequence: Synthetic oligonucleotide
gaaactacacggcagaggagaaaatcttcgcc

SEQ ID NO: 230922 - DNA, 32 bp, Artificial Sequence
  Description of Artificial Sequence: Synthetic oligonucleotide
aaactacacggcagaggagaaaatcttcgccc

SEQ ID NO: 230923 - DNA, 31 bp, Artificial Sequence
  Description of Artificial Sequence: Synthetic oligonucleotide
aactacacggcagaggagaaaatcttcgccc

SEQ ID NO: 230924 - DNA, 30 bp, Artificial Sequence
  Description of Artificial Sequence: Synthetic oligonucleotide
actacacggcagaggagaaaatcttcgccc

SEQ ID NO: 230925 - DNA, 29 bp, Artificial Sequence
  Description of Artificial Sequence: Synthetic oligonucleotide
ctacacggcagaggagaaaatcttcgccc

SEQ ID NO: 230926 - DNA, 30 bp, Artificial Sequence
  Description of Artificial Sequence: Synthetic oligonucleotide
tacacggcagaggagaaaatcttcgcccag

SEQ ID NO: 230927 - DNA, 29 bp, Artificial Sequence
  Description of Artificial Sequence: Synthetic oligonucleotide
acacggcagaggagaaaatcttcgcccag

SEQ ID NO: 230928 - DNA, 28 bp, Artificial Sequence
  Description of Artificial Sequence: Synthetic oligonucleotide
cacggcagaggagaaaatcttcgcccag

SEQ ID NO: 230929 - DNA, 28 bp, Artificial Sequence
  Description of Artificial Sequence: Synthetic oligonucleotide
acggcagaggagaaaatcttcgcccagc

SEQ ID NO: 230930 - DNA, 27 bp, Artificial Sequence
  Description of Artificial Sequence: Synthetic oligonucleotide
cggcagaggagaaaatcttcgcccagc

SEQ ID NO: 230931 - DNA, 27 bp, Artificial Sequence
  Description of Artificial Sequence: Synthetic oligonucleotide
ggcagaggagaaaatcttcgcccagcg

SEQ ID NO: 230932 - DNA, 28 bp, Artificial Sequence
  Description of Artificial Sequence: Synthetic oligonucleotide
gcagaggagaaaatcttcgcccagcgac

SEQ ID NO: 230933 - DNA, 29 bp, Artificial Sequence
  Description of Artificial Sequence: Synthetic oligonucleotide
cagaggagaaaatcttcgcccagcgactg

SEQ ID NO: 230934 - DNA, 31 bp, Artificial Sequence
  Description of Artificial Sequence: Synthetic oligonucleotide
agaggagaaaatcttcgcccagcgactgatg

SEQ ID NO: 230935 - DNA, 30 bp, Artificial Sequence
  Description of Artificial Sequence: Synthetic oligonucleotide
gaggagaaaatcttcgcccagcgactgatg

SEQ ID NO: 230936 - DNA, 30 bp, Artificial Sequence
  Description of Artificial Sequence: Synthetic oligonucleotide
aggagaaaatcttcgcccagcgactgatgc

SEQ ID NO: 230937 - DNA, 29 bp, Artificial Sequence
  Description of Artificial Sequence: Synthetic oligonucleotide
ggagaaaatcttcgcccagcgactgatgc

SEQ ID NO: 230938 - DNA, 29 bp, Artificial Sequence
  Description of Artificial Sequence: Synthetic oligonucleotide
gagaaaatcttcgcccagcgactgatgcg

SEQ ID NO: 230939 - DNA, 32 bp, Artificial Sequence
  Description of Artificial Sequence: Synthetic oligonucleotide
agaaaatcttcgcccagcgactgatgcgatac

SEQ ID NO: 230940 - DNA, 31 bp, Artificial Sequence
  Description of Artificial Sequence: Synthetic oligonucleotide
gaaaatcttcgcccagcgactgatgcgatac

SEQ ID NO: 230941 - DNA, 32 bp, Artificial Sequence
  Description of Artificial Sequence: Synthetic oligonucleotide
aaaatcttcgcccagcgactgatgcgatactg

SEQ ID NO: 230942 - DNA, 31 bp, Artificial Sequence
  Description of Artificial Sequence: Synthetic oligonucleotide
aaatcttcgcccagcgactgatgcgatactg

SEQ ID NO: 230943 - DNA, 30 bp, Artificial Sequence
  Description of Artificial Sequence: Synthetic oligonucleotide
aatcttcgcccagcgactgatgcgatactg

SEQ ID NO: 230944 - DNA, 29 bp, Artificial Sequence
  Description of Artificial Sequence: Synthetic oligonucleotide
atcttcgcccagcgactgatgcgatactg

SEQ ID NO: 230945 - DNA, 28 bp, Artificial Sequence
  Description of Artificial Sequence: Synthetic oligonucleotide
tcttcgcccagcgactgatgcgatactg

SEQ ID NO: 230946 - DNA, 27 bp, Artificial Sequence
  Description of Artificial Sequence: Synthetic oligonucleotide
cttcgcccagcgactgatgcgatactg

SEQ ID NO: 230947 - DNA, 27 bp, Artificial Sequence
  Description of Artificial Sequence: Synthetic oligonucleotide
ttcgcccagcgactgatgcgatactgg

SEQ ID NO: 230948 - DNA, 26 bp, Artificial Sequence
  Description of Artificial Sequence: Synthetic oligonucleotide
tcgcccagcgactgatgcgatactgg

SEQ ID NO: 230949 - DNA, 25 bp, Artificial Sequence
  Description of Artificial Sequence: Synthetic oligonucleotide
cgcccagcgactgatgcgatactgg

SEQ ID NO: 230950 - DNA, 25 bp, Artificial Sequence
  Description of Artificial Sequence: Synthetic oligonucleotide
gcccagcgactgatgcgatactggg

SEQ ID NO: 230951 - DNA, 25 bp, Artificial Sequence
  Description of Artificial Sequence: Synthetic oligonucleotide
cccagcgactgatgcgatactgggc

SEQ ID NO: 230952 - DNA, 27 bp, Artificial Sequence
  Description of Artificial Sequence: Synthetic oligonucleotide
ccagcgactgatgcgatactgggccaa

SEQ ID NO: 230953 - DNA, 27 bp, Artificial Sequence
  Description of Artificial Sequence: Synthetic oligonucleotide
cagcgactgatgcgatactgggccaac

SEQ ID NO: 230954 - DNA, 30 bp, Artificial Sequence
  Description of Artificial Sequence: Synthetic oligonucleotide
agcgactgatgcgatactgggccaactttg

SEQ ID NO: 230955 - DNA, 29 bp, Artificial Sequence
  Description of Artificial Sequence: Synthetic oligonucleotide
gcgactgatgcgatactgggccaactttg

SEQ ID NO: 230956 - DNA, 29 bp, Artificial Sequence
  Description of Artificial Sequence: Synthetic oligonucleotide
cgactgatgcgatactgggccaactttgc

SEQ ID NO: 230957 - DNA, 29 bp, Artificial Sequence
  Description of Artificial Sequence: Synthetic oligonucleotide
gactgatgcgatactgggccaactttgcc

SEQ ID NO: 230958 - DNA, 29 bp, Artificial Sequence
  Description of Artificial Sequence: Synthetic oligonucleotide
actgatgcgatactgggccaactttgccc

SEQ ID NO: 230959 - DNA, 28 bp, Artificial Sequence
  Description of Artificial Sequence: Synthetic oligonucleotide
ctgatgcgatactgggccaactttgccc

SEQ ID NO: 230960 - DNA, 28 bp, Artificial Sequence
  Description of Artificial Sequence: Synthetic oligonucleotide
tgatgcgatactgggccaactttgcccg

SEQ ID NO: 230961 - DNA, 27 bp, Artificial Sequence
  Description of Artificial Sequence: Synthetic oligonucleotide
gatgcgatactgggccaactttgcccg

SEQ ID NO: 230962 - DNA, 27 bp, Artificial Sequence
  Description of Artificial Sequence: Synthetic oligonucleotide
atgcgatactgggccaactttgcccgc

SEQ ID NO: 230963 - DNA, 27 bp, Artificial Sequence
  Description of Artificial Sequence: Synthetic oligonucleotide
tgcgatactgggccaactttgcccgca

SEQ ID NO: 230964 - DNA, 26 bp, Artificial Sequence
  Description of Artificial Sequence: Synthetic oligonucleotide
gcgatactgggccaactttgcccgca

SEQ ID NO: 230965 - DNA, 27 bp, Artificial Sequence
  Description of Artificial Sequence: Synthetic oligonucleotide
cgatactgggccaactttgcccgcaca

SEQ ID NO: 230966 - DNA, 27 bp, Artificial Sequence
  Description of Artificial Sequence: Synthetic oligonucleotide
gatactgggccaactttgcccgcacag

SEQ ID NO: 230967 - DNA, 27 bp, Artificial Sequence
  Description of Artificial Sequence: Synthetic oligonucleotide
atactgggccaactttgcccgcacagg

SEQ ID NO: 230968 - DNA, 26 bp, Artificial Sequence
  Description of Artificial Sequence: Synthetic oligonucleotide
tactgggccaactttgcccgcacagg

SEQ ID NO: 230969 - DNA, 25 bp, Artificial Sequence
  Description of Artificial Sequence: Synthetic oligonucleotide
actgggccaactttgcccgcacagg

SEQ ID NO: 230970 - DNA, 24 bp, Artificial Sequence
  Description of Artificial Sequence: Synthetic oligonucleotide
ctgggccaactttgcccgcacagg

SEQ ID NO: 230971 - DNA, 24 bp, Artificial Sequence
  Description of Artificial Sequence: Synthetic oligonucleotide
tgggccaactttgcccgcacaggg

SEQ ID NO: 230972 - DNA, 23 bp, Artificial Sequence
  Description of Artificial Sequence: Synthetic oligonucleotide
gggccaactttgcccgcacaggg

SEQ ID NO: 230973 - DNA, 25 bp, Artificial Sequence
  Description of Artificial Sequence: Synthetic oligonucleotide
ggccaactttgcccgcacaggggat

SEQ ID NO: 230974 - DNA, 25 bp, Artificial Sequence
  Description of Artificial Sequence: Synthetic oligonucleotide
gccaactttgcccgcacaggggatc

SEQ ID NO: 230975 - DNA, 25 bp, Artificial Sequence
  Description of Artificial Sequence: Synthetic oligonucleotide
ccaactttgcccgcacaggggatcc

SEQ ID NO: 230976 - DNA, 27 bp, Artificial Sequence
  Description of Artificial Sequence: Synthetic oligonucleotide
caactttgcccgcacaggggatcccaa

SEQ ID NO: 230977 - DNA, 28 bp, Artificial Sequence
  Description of Artificial Sequence: Synthetic oligonucleotide
aactttgcccgcacaggggatcccaatg

SEQ ID NO: 230978 - DNA, 27 bp, Artificial Sequence
  Description of Artificial Sequence: Synthetic oligonucleotide
actttgcccgcacaggggatcccaatg

SEQ ID NO: 230979 - DNA, 27 bp, Artificial Sequence
  Description of Artificial Sequence: Synthetic oligonucleotide
ctttgcccgcacaggggatcccaatga

SEQ ID NO: 230980 - DNA, 27 bp, Artificial Sequence
  Description of Artificial Sequence: Synthetic oligonucleotide
tttgcccgcacaggggatcccaatgag

SEQ ID NO: 230981 - DNA, 26 bp, Artificial Sequence
  Description of Artificial Sequence: Synthetic oligonucleotide
ttgcccgcacaggggatcccaatgag

SEQ ID NO: 230982 - DNA, 25 bp, Artificial Sequence
  Description of Artificial Sequence: Synthetic oligonucleotide
tgcccgcacaggggatcccaatgag

SEQ ID NO: 230983 - DNA, 24 bp, Artificial Sequence
  Description of Artificial Sequence: Synthetic oligonucleotide
gcccgcacaggggatcccaatgag

SEQ ID NO: 230984 - DNA, 24 bp, Artificial Sequence
  Description of Artificial Sequence: Synthetic oligonucleotide
cccgcacaggggatcccaatgagc

SEQ ID NO: 230985 - DNA, 24 bp, Artificial Sequence
  Description of Artificial Sequence: Synthetic oligonucleotide
ccgcacaggggatcccaatgagcc

SEQ ID NO: 230986 - DNA, 24 bp, Artificial Sequence
  Description of Artificial Sequence: Synthetic oligonucleotide
cgcacaggggatcccaatgagccc

SEQ ID NO: 230987 - DNA, 24 bp, Artificial Sequence
  Description of Artificial Sequence: Synthetic oligonucleotide
gcacaggggatcccaatgagcccc

SEQ ID NO: 230988 - DNA, 25 bp, Artificial Sequence
  Description of Artificial Sequence: Synthetic oligonucleotide
cacaggggatcccaatgagccccga

SEQ ID NO: 230989 - DNA, 26 bp, Artificial Sequence
  Description of Artificial Sequence: Synthetic oligonucleotide
acaggggatcccaatgagccccgaga

SEQ ID NO: 230990 - DNA, 25 bp, Artificial Sequence
  Description of Artificial Sequence: Synthetic oligonucleotide
caggggatcccaatgagccccgaga

SEQ ID NO: 230991 - DNA, 25 bp, Artificial Sequence
  Description of Artificial Sequence: Synthetic oligonucleotide
aggggatcccaatgagccccgagac

SEQ ID NO: 230992 - DNA, 24 bp, Artificial Sequence
  Description of Artificial Sequence: Synthetic oligonucleotide
ggggatcccaatgagccccgagac

SEQ ID NO: 230993 - DNA, 24 bp, Artificial Sequence
  Description of Artificial Sequence: Synthetic oligonucleotide
gggatcccaatgagccccgagacc

SEQ ID NO: 230994 - DNA, 24 bp, Artificial Sequence
  Description of Artificial Sequence: Synthetic oligonucleotide
ggatcccaatgagccccgagaccc

SEQ ID NO: 230995 - DNA, 26 bp, Artificial Sequence
  Description of Artificial Sequence: Synthetic oligonucleotide
gatcccaatgagccccgagaccccaa

SEQ ID NO: 230996 - DNA, 26 bp, Artificial Sequence
  Description of Artificial Sequence: Synthetic oligonucleotide
atcccaatgagccccgagaccccaag

SEQ ID NO: 230997 - DNA, 25 bp, Artificial Sequence
  Description of Artificial Sequence: Synthetic oligonucleotide
tcccaatgagccccgagaccccaag

SEQ ID NO: 230998 - DNA, 24 bp, Artificial Sequence
  Description of Artificial Sequence: Synthetic oligonucleotide
cccaatgagccccgagaccccaag

SEQ ID NO: 230999 - DNA, 24 bp, Artificial Sequence
  Description of Artificial Sequence: Synthetic oligonucleotide
ccaatgagccccgagaccccaagg

SEQ ID NO: 231000 - DNA, 24 bp, Artificial Sequence
  Description of Artificial Sequence: Synthetic oligonucleotide
caatgagccccgagaccccaaggc

SEQ ID NO: 231001 - DNA, 24 bp, Artificial Sequence
  Description of Artificial Sequence: Synthetic oligonucleotide
aatgagccccgagaccccaaggcc

SEQ ID NO: 231002 - DNA, 23 bp, Artificial Sequence
  Description of Artificial Sequence: Synthetic oligonucleotide
atgagccccgagaccccaaggcc

SEQ ID NO: 231003 - DNA, 22 bp, Artificial Sequence
  Description of Artificial Sequence: Synthetic oligonucleotide
tgagccccgagaccccaaggcc

SEQ ID NO: 231004 - DNA, 21 bp, Artificial Sequence
  Description of Artificial Sequence: Synthetic oligonucleotide
gagccccgagaccccaaggcc

SEQ ID NO: 231005 - DNA, 21 bp, Artificial Sequence
  Description of Artificial Sequence: Synthetic oligonucleotide
agccccgagaccccaaggccc

SEQ ID NO: 231006 - DNA, 20 bp, Artificial Sequence
  Description of Artificial Sequence: Synthetic oligonucleotide
gccccgagaccccaaggccc

SEQ ID NO: 231007 - DNA, 21 bp, Artificial Sequence
  Description of Artificial Sequence: Synthetic oligonucleotide
ccccgagaccccaaggcccca

SEQ ID NO: 231008 - DNA, 24 bp, Artificial Sequence
  Description of Artificial Sequence: Synthetic oligonucleotide
cccgagaccccaaggccccacaat

SEQ ID NO: 231009 - DNA, 24 bp, Artificial Sequence
  Description of Artificial Sequence: Synthetic oligonucleotide
ccgagaccccaaggccccacaatg

SEQ ID NO: 231010 - DNA, 24 bp, Artificial Sequence
  Description of Artificial Sequence: Synthetic oligonucleotide
cgagaccccaaggccccacaatgg

SEQ ID NO: 231011 - DNA, 24 bp, Artificial Sequence
  Description of Artificial Sequence: Synthetic oligonucleotide
gagaccccaaggccccacaatggc

SEQ ID NO: 231012 - DNA, 24 bp, Artificial Sequence
  Description of Artificial Sequence: Synthetic oligonucleotide
agaccccaaggccccacaatggcc

SEQ ID NO: 231013 - DNA, 23 bp, Artificial Sequence
  Description of Artificial Sequence: Synthetic oligonucleotide
gaccccaaggccccacaatggcc

SEQ ID NO: 231014 - DNA, 23 bp, Artificial Sequence
  Description of Artificial Sequence: Synthetic oligonucleotide
accccaaggccccacaatggccc

SEQ ID NO: 231015 - DNA, 22 bp, Artificial Sequence
  Description of Artificial Sequence: Synthetic oligonucleotide
ccccaaggccccacaatggccc

SEQ ID NO: 231016 - DNA, 22 bp, Artificial Sequence
  Description of Artificial Sequence: Synthetic oligonucleotide
cccaaggccccacaatggcccc

SEQ ID NO: 231017 - DNA, 22 bp, Artificial Sequence
  Description of Artificial Sequence: Synthetic oligonucleotide
ccaaggccccacaatggccccc

SEQ ID NO: 231018 - DNA, 24 bp, Artificial Sequence
  Description of Artificial Sequence: Synthetic oligonucleotide
caaggccccacaatggcccccgta

SEQ ID NO: 231019 - DNA, 25 bp, Artificial Sequence
  Description of Artificial Sequence: Synthetic oligonucleotide
aaggccccacaatggcccccgtaca

SEQ ID NO: 231020 - DNA, 24 bp, Artificial Sequence
  Description of Artificial Sequence: Synthetic oligonucleotide
aggccccacaatggcccccgtaca

SEQ ID NO: 231021 - DNA, 23 bp, Artificial Sequence
  Description of Artificial Sequence: Synthetic oligonucleotide
ggccccacaatggcccccgtaca

SEQ ID NO: 231022 - DNA, 23 bp, Artificial Sequence
  Description of Artificial Sequence: Synthetic oligonucleotide
gccccacaatggcccccgtacac

SEQ ID NO: 231023 - DNA, 23 bp, Artificial Sequence
  Description of Artificial Sequence: Synthetic oligonucleotide
ccccacaatggcccccgtacacg

SEQ ID NO: 231024 - DNA, 23 bp, Artificial Sequence
  Description of Artificial Sequence: Synthetic oligonucleotide
cccacaatggcccccgtacacgg

SEQ ID NO: 231025 - DNA, 23 bp, Artificial Sequence
  Description of Artificial Sequence: Synthetic oligonucleotide
ccacaatggcccccgtacacggc

SEQ ID NO: 231026 - DNA, 23 bp, Artificial Sequence
  Description of Artificial Sequence: Synthetic oligonucleotide
cacaatggcccccgtacacggcg

SEQ ID NO: 231027 - DNA, 23 bp, Artificial Sequence
  Description of Artificial Sequence: Synthetic oligonucleotide
acaatggcccccgtacacggcgg

SEQ ID NO: 231028 - DNA, 22 bp, Artificial Sequence
  Description of Artificial Sequence: Synthetic oligonucleotide
caatggcccccgtacacggcgg

SEQ ID NO: 231029 - DNA, 22 bp, Artificial Sequence
  Description of Artificial Sequence: Synthetic oligonucleotide
aatggcccccgtacacggcggg

SEQ ID NO: 231030 - DNA, 21 bp, Artificial Sequence
  Description of Artificial Sequence: Synthetic oligonucleotide
atggcccccgtacacggcggg

SEQ ID NO: 231031 - DNA, 20 bp, Artificial Sequence
  Description of Artificial Sequence: Synthetic oligonucleotide
tggcccccgtacacggcggg

SEQ ID NO: 231032 - DNA, 20 bp, Artificial Sequence
  Description of Artificial Sequence: Synthetic oligonucleotide
ggcccccgtacacggcgggt

SEQ ID NO: 231033 - DNA, 20 bp, Artificial Sequence
  Description of Artificial Sequence: Synthetic oligonucleotide
gcccccgtacacggcggggt

SEQ ID NO: 231034 - DNA, 20 bp, Artificial Sequence
  Description of Artificial Sequence: Synthetic oligonucleotide
cccccgtacacggcgggggt

SEQ ID NO: 231035 - DNA, 20 bp, Artificial Sequence
  Description of Artificial Sequence: Synthetic oligonucleotide
ccccgtacacggcgggggct

SEQ ID NO: 231036 - DNA, 21 bp, Artificial Sequence
  Description of Artificial Sequence: Synthetic oligonucleotide
cccgtacacggcgggggctca

SEQ ID NO: 231037 - DNA, 21 bp, Artificial Sequence
  Description of Artificial Sequence: Synthetic oligonucleotide
ccgtacacggcgggggctcag

SEQ ID NO: 231038 - DNA, 22 bp, Artificial Sequence
  Description of Artificial Sequence: Synthetic oligonucleotide
cgtacacggcgggggctcagca

SEQ ID NO: 231039 - DNA, 24 bp, Artificial Sequence
  Description of Artificial Sequence: Synthetic oligonucleotide
gtacacggcgggggctcagcagta

SEQ ID NO: 231040 - DNA, 24 bp, Artificial Sequence
  Description of Artificial Sequence: Synthetic oligonucleotide
tacacggcgggggctcagcagtac

SEQ ID NO: 231041 - DNA, 23 bp, Artificial Sequence
  Description of Artificial Sequence: Synthetic oligonucleotide
acacggcgggggctcagcagtac

SEQ ID NO: 231042 - DNA, 22 bp, Artificial Sequence
  Description of Artificial Sequence: Synthetic oligonucleotide
cacggcgggggctcagcagtac

SEQ ID NO: 231043 - DNA, 25 bp, Artificial Sequence
  Description of Artificial Sequence: Synthetic oligonucleotide
acggcgggggctcagcagtacgtta

SEQ ID NO: 231044 - DNA, 24 bp, Artificial Sequence
  Description of Artificial Sequence: Synthetic oligonucleotide
cggcgggggctcagcagtacgtta

SEQ ID NO: 231045 - DNA, 25 bp, Artificial Sequence
  Description of Artificial Sequence: Synthetic oligonucleotide
ggcgggggctcagcagtacgttagt

SEQ ID NO: 231046 - DNA, 26 bp, Artificial Sequence
  Description of Artificial Sequence: Synthetic oligonucleotide
gcgggggctcagcagtacgttagtct

SEQ ID NO: 231047 - DNA, 26 bp, Artificial Sequence
  Description of Artificial Sequence: Synthetic oligonucleotide
cgggggctcagcagtacgttagtctg

SEQ ID NO: 231048 - DNA, 27 bp, Artificial Sequence
  Description of Artificial Sequence: Synthetic oligonucleotide
gggggctcagcagtacgttagtctgga

SEQ ID NO: 231049 - DNA, 27 bp, Artificial Sequence
  Description of Artificial Sequence: Synthetic oligonucleotide
ggggctcagcagtacgttagtctggac

SEQ ID NO: 231050 - DNA, 27 bp, Artificial Sequence
  Description of Artificial Sequence: Synthetic oligonucleotide
gggctcagcagtacgttagtctggacc

SEQ ID NO: 231051 - DNA, 28 bp, Artificial Sequence
  Description of Artificial Sequence: Synthetic oligonucleotide
ggctcagcagtacgttagtctggacctg

SEQ ID NO: 231052 - DNA, 28 bp, Artificial Sequence
  Description of Artificial Sequence: Synthetic oligonucleotide
gctcagcagtacgttagtctggacctgc

SEQ ID NO: 231053 - DNA, 28 bp, Artificial Sequence
  Description of Artificial Sequence: Synthetic oligonucleotide
ctcagcagtacgttagtctggacctgcg

SEQ ID NO: 231054 - DNA, 28 bp, Artificial Sequence
  Description of Artificial Sequence: Synthetic oligonucleotide
tcagcagtacgttagtctggacctgcgg

SEQ ID NO: 231055 - DNA, 27 bp, Artificial Sequence
  Description of Artificial Sequence: Synthetic oligonucleotide
cagcagtacgttagtctggacctgcgg

SEQ ID NO: 231056 - DNA, 27 bp, Artificial Sequence
  Description of Artificial Sequence: Synthetic oligonucleotide
agcagtacgttagtctggacctgcggc

SEQ ID NO: 231057 - DNA, 26 bp, Artificial Sequence
  Description of Artificial Sequence: Synthetic oligonucleotide
gcagtacgttagtctggacctgcggc

SEQ ID NO: 231058 - DNA, 26 bp, Artificial Sequence
  Description of Artificial Sequence: Synthetic oligonucleotide
cagtacgttagtctggacctgcggcc

SEQ ID NO: 231059 - DNA, 26 bp, Artificial Sequence
  Description of Artificial Sequence: Synthetic oligonucleotide
agtacgttagtctggacctgcggccg

SEQ ID NO: 231060 - DNA, 25 bp, Artificial Sequence
  Description of Artificial Sequence: Synthetic oligonucleotide
gtacgttagtctggacctgcggccg

SEQ ID NO: 231061 - DNA, 26 bp, Artificial Sequence
  Description of Artificial Sequence: Synthetic oligonucleotide
tacgttagtctggacctgcggccgct

SEQ ID NO: 231062 - DNA, 25 bp, Artificial Sequence
  Description of Artificial Sequence: Synthetic oligonucleotide
acgttagtctggacctgcggccgct

SEQ ID NO: 231063 - DNA, 24 bp, Artificial Sequence
  Description of Artificial Sequence: Synthetic oligonucleotide
cgttagtctggacctgcggccgct

SEQ ID NO: 231064 - DNA, 24 bp, Artificial Sequence
  Description of Artificial Sequence: Synthetic oligonucleotide
gttagtctggacctgcggccgctg

SEQ ID NO: 231065 - DNA, 25 bp, Artificial Sequence
  Description of Artificial Sequence: Synthetic oligonucleotide
ttagtctggacctgcggccgctgga

SEQ ID NO: 231066 - DNA, 24 bp, Artificial Sequence
  Description of Artificial Sequence: Synthetic oligonucleotide
tagtctggacctgcggccgctgga

SEQ ID NO: 231067 - DNA, 23 bp, Artificial Sequence
  Description of Artificial Sequence: Synthetic oligonucleotide
agtctggacctgcggccgctgga

SEQ ID NO: 231068 - DNA, 22 bp, Artificial Sequence
  Description of Artificial Sequence: Synthetic oligonucleotide
gtctggacctgcggccgctgga

SEQ ID NO: 231069 - DNA, 22 bp, Artificial Sequence
  Description of Artificial Sequence: Synthetic oligonucleotide
tctggacctgcggccgctggag

SEQ ID NO: 231070 - DNA, 21 bp, Artificial Sequence
  Description of Artificial Sequence: Synthetic oligonucleotide
ctggacctgcggccgctggag

SEQ ID NO: 231071 - DNA, 22 bp, Artificial Sequence
  Description of Artificial Sequence: Synthetic oligonucleotide
tggacctgcggccgctggaggt

SEQ ID NO: 231072 - DNA, 21 bp, Artificial Sequence
  Description of Artificial Sequence: Synthetic oligonucleotide
ggacctgcggccgctggaggt

SEQ ID NO: 231073 - DNA, 21 bp, Artificial Sequence
  Description of Artificial Sequence: Synthetic oligonucleotide
gacctgcggccgctggaggtg

SEQ ID NO: 231074 - DNA, 21 bp, Artificial Sequence
  Description of Artificial Sequence: Synthetic oligonucleotide
acctgcggccgctggaggtgc

SEQ ID NO: 231075 - DNA, 20 bp, Artificial Sequence
  Description of Artificial Sequence: Synthetic oligonucleotide
cctgcggccgctggaggtgc

SEQ ID NO: 231076 - DNA, 20 bp, Artificial Sequence
  Description of Artificial Sequence: Synthetic oligonucleotide
ctgcggccgctggaggtgcg

SEQ ID NO: 231077 - DNA, 20 bp, Artificial Sequence
  Description of Artificial Sequence: Synthetic oligonucleotide
tgcggccgctggaggtgcgg

SEQ ID NO: 231078 - DNA, 20 bp, Artificial Sequence
  Description of Artificial Sequence: Synthetic oligonucleotide
gcggccgctggaggtgcggt

SEQ ID NO: 231079 - DNA, 20 bp, Artificial Sequence
  Description of Artificial Sequence: Synthetic oligonucleotide
cggccgctggaggtgcggct

SEQ ID NO: 231080 - DNA, 20 bp, Artificial Sequence
  Description of Artificial Sequence: Synthetic oligonucleotide
ggccgctggaggtgcggcgt

SEQ ID NO: 231081 - DNA, 20 bp, Artificial Sequence
  Description of Artificial Sequence: Synthetic oligonucleotide
gccgctggaggtgcggcggt

SEQ ID NO: 231082 - DNA, 20 bp, Artificial Sequence
  Description of Artificial Sequence: Synthetic oligonucleotide
ccgctggaggtgcggcgggt

SEQ ID NO: 231083 - DNA, 20 bp, Artificial Sequence
  Description of Artificial Sequence: Synthetic oligonucleotide
cgctggaggtgcggcggggt

SEQ ID NO: 231084 - DNA, 20 bp, Artificial Sequence
  Description of Artificial Sequence: Synthetic oligonucleotide
gctggaggtgcggcgggggt

SEQ ID NO: 231085 - DNA, 20 bp, Artificial Sequence
  Description of Artificial Sequence: Synthetic oligonucleotide
ctggaggtgcggcgggggct

SEQ ID NO: 231086 - DNA, 20 bp, Artificial Sequence
  Description of Artificial Sequence: Synthetic oligonucleotide
tggaggtgcggcgggggctg

SEQ ID NO: 231087 - DNA, 20 bp, Artificial Sequence
  Description of Artificial Sequence: Synthetic oligonucleotide
ggaggtgcggcgggggctgt

SEQ ID NO: 231088 - DNA, 20 bp, Artificial Sequence
  Description of Artificial Sequence: Synthetic oligonucleotide
gaggtgcggcgggggctgct

SEQ ID NO: 231089 - DNA, 20 bp, Artificial Sequence
  Description of Artificial Sequence: Synthetic oligonucleotide
aggtgcggcgggggctgcgt

SEQ ID NO: 231090 - DNA, 20 bp, Artificial Sequence
  Description of Artificial Sequence: Synthetic oligonucleotide
ggtgcggcgggggctgcgtt

SEQ ID NO: 231091 - DNA, 20 bp, Artificial Sequence
  Description of Artificial Sequence: Synthetic oligonucleotide
gtgcggcgggggctgcgctt

SEQ ID NO: 231092 - DNA, 20 bp, Artificial Sequence
  Description of Artificial Sequence: Synthetic oligonucleotide
tgcggcgggggctgcgcgtt

SEQ ID NO: 231093 - DNA, 20 bp, Artificial Sequence
  Description of Artificial Sequence: Synthetic oligonucleotide
gcggcgggggctgcgcgttt

SEQ ID NO: 231094 - DNA, 20 bp, Artificial Sequence
  Description of Artificial Sequence: Synthetic oligonucleotide
cggcgggggctgcgcgcttt

SEQ ID NO: 231095 - DNA, 20 bp, Artificial Sequence
  Description of Artificial Sequence: Synthetic oligonucleotide
ggcgggggctgcgcgccttt

SEQ ID NO: 231096 - DNA, 20 bp, Artificial Sequence
  Description of Artificial Sequence: Synthetic oligonucleotide
gcgggggctgcgcgcccatt

SEQ ID NO: 231097 - DNA, 20 bp, Artificial Sequence
  Description of Artificial Sequence: Synthetic oligonucleotide
cgggggctgcgcgcccagtt

SEQ ID NO: 231098 - DNA, 20 bp, Artificial Sequence
  Description of Artificial Sequence: Synthetic oligonucleotide
gggggctgcgcgcccaggtt

SEQ ID NO: 231099 - DNA, 20 bp, Artificial Sequence
  Description of Artificial Sequence: Synthetic oligonucleotide
ggggctgcgcgcccaggctt

SEQ ID NO: 231100 - DNA, 20 bp, Artificial Sequence
  Description of Artificial Sequence: Synthetic oligonucleotide
gggctgcgcgcccaggcctt

SEQ ID NO: 231101 - DNA, 20 bp, Artificial Sequence
  Description of Artificial Sequence: Synthetic oligonucleotide
ggctgcgcgcccaggcctgt

SEQ ID NO: 231102 - DNA, 20 bp, Artificial Sequence
  Description of Artificial Sequence: Synthetic oligonucleotide
gctgcgcgcccaggcctgct

SEQ ID NO: 231103 - DNA, 20 bp, Artificial Sequence
  Description of Artificial Sequence: Synthetic oligonucleotide
ctgcgcgcccaggcctgcgt

SEQ ID NO: 231104 - DNA, 20 bp, Artificial Sequence
  Description of Artificial Sequence: Synthetic oligonucleotide
tgcgcgcccaggcctgcgct

SEQ ID NO: 231105 - DNA, 20 bp, Artificial Sequence
  Description of Artificial Sequence: Synthetic oligonucleotide
gcgcgcccaggcctgcgctt

SEQ ID NO: 231106 - DNA, 20 bp, Artificial Sequence
  Description of Artificial Sequence: Synthetic oligonucleotide
cgcgcccaggcctgcgcctt

SEQ ID NO: 231107 - DNA, 21 bp, Artificial Sequence
  Description of Artificial Sequence: Synthetic oligonucleotide
gcgcccaggcctgcgccttct

SEQ ID NO: 231108 - DNA, 21 bp, Artificial Sequence
  Description of Artificial Sequence: Synthetic oligonucleotide
cgcccaggcctgcgccttctg

SEQ ID NO: 231109 - DNA, 23 bp, Artificial Sequence
  Description of Artificial Sequence: Synthetic oligonucleotide
gcccaggcctgcgccttctggaa

SEQ ID NO: 231110 - DNA, 23 bp, Artificial Sequence
  Description of Artificial Sequence: Synthetic oligonucleotide
cccaggcctgcgccttctggaac

SEQ ID NO: 231111 - DNA, 23 bp, Artificial Sequence
  Description of Artificial Sequence: Synthetic oligonucleotide
ccaggcctgcgccttctggaacc

SEQ ID NO: 231112 - DNA, 23 bp, Artificial Sequence
  Description of Artificial Sequence: Synthetic oligonucleotide
caggcctgcgccttctggaaccg

SEQ ID NO: 231113 - DNA, 25 bp, Artificial Sequence
  Description of Artificial Sequence: Synthetic oligonucleotide
aggcctgcgccttctggaaccgctt

SEQ ID NO: 231114 - DNA, 24 bp, Artificial Sequence
  Description of Artificial Sequence: Synthetic oligonucleotide
ggcctgcgccttctggaaccgctt

SEQ ID NO: 231115 - DNA, 24 bp, Artificial Sequence
  Description of Artificial Sequence: Synthetic oligonucleotide
gcctgcgccttctggaaccgcttc

SEQ ID NO: 231116 - DNA, 25 bp, Artificial Sequence
  Description of Artificial Sequence: Synthetic oligonucleotide
cctgcgccttctggaaccgcttcct

SEQ ID NO: 231117 - DNA, 25 bp, Artificial Sequence
  Description of Artificial Sequence: Synthetic oligonucleotide
ctgcgccttctggaaccgcttcctc

SEQ ID NO: 231118 - DNA, 25 bp, Artificial Sequence
  Description of Artificial Sequence: Synthetic oligonucleotide
tgcgccttctggaaccgcttcctcc

SEQ ID NO: 231119 - DNA, 24 bp, Artificial Sequence
  Description of Artificial Sequence: Synthetic oligonucleotide
gcgccttctggaaccgcttcctcc

SEQ ID NO: 231120 - DNA, 24 bp, Artificial Sequence
  Description of Artificial Sequence: Synthetic oligonucleotide
cgccttctggaaccgcttcctccc

SEQ ID NO: 231121 - DNA, 27 bp, Artificial Sequence
  Description of Artificial Sequence: Synthetic oligonucleotide
gccttctggaaccgcttcctccccaaa

SEQ ID NO: 231122 - DNA, 29 bp, Artificial Sequence
  Description of Artificial Sequence: Synthetic oligonucleotide
ccttctggaaccgcttcctccccaaattg

SEQ ID NO: 231123 - DNA, 29 bp, Artificial Sequence
  Description of Artificial Sequence: Synthetic oligonucleotide
cttctggaaccgcttcctccccaaattgc

SEQ ID NO: 231124 - DNA, 30 bp, Artificial Sequence
  Description of Artificial Sequence: Synthetic oligonucleotide
ttctggaaccgcttcctccccaaattgctc

SEQ ID NO: 231125 - DNA, 29 bp, Artificial Sequence
  Description of Artificial Sequence: Synthetic oligonucleotide
tctggaaccgcttcctccccaaattgctc

SEQ ID NO: 231126 - DNA, 28 bp, Artificial Sequence
  Description of Artificial Sequence: Synthetic oligonucleotide
ctggaaccgcttcctccccaaattgctc

SEQ ID NO: 231127 - DNA, 29 bp, Artificial Sequence
  Description of Artificial Sequence: Synthetic oligonucleotide
tggaaccgcttcctccccaaattgctcag

SEQ ID NO: 231128 - DNA, 28 bp, Artificial Sequence
  Description of Artificial Sequence: Synthetic oligonucleotide
ggaaccgcttcctccccaaattgctcag

SEQ ID NO: 231129 - DNA, 28 bp, Artificial Sequence
  Description of Artificial Sequence: Synthetic oligonucleotide
gaaccgcttcctccccaaattgctcagc

SEQ ID NO: 231130 - DNA, 28 bp, Artificial Sequence
  Description of Artificial Sequence: Synthetic oligonucleotide
aaccgcttcctccccaaattgctcagcg

SEQ ID NO: 231131 - DNA, 27 bp, Artificial Sequence
  Description of Artificial Sequence: Synthetic oligonucleotide
accgcttcctccccaaattgctcagcg

SEQ ID NO: 231132 - DNA, 26 bp, Artificial Sequence
  Description of Artificial Sequence: Synthetic oligonucleotide
ccgcttcctccccaaattgctcagcg

SEQ ID NO: 231133 - DNA, 26 bp, Artificial Sequence
  Description of Artificial Sequence: Synthetic oligonucleotide
cgcttcctccccaaattgctcagcgc

SEQ ID NO: 231134 - DNA, 27 bp, Artificial Sequence
  Description of Artificial Sequence: Synthetic oligonucleotide
gcttcctccccaaattgctcagcgcca

SEQ ID NO: 231135 - DNA, 27 bp, Artificial Sequence
  Description of Artificial Sequence: Synthetic oligonucleotide
cttcctccccaaattgctcagcgccac

SEQ ID NO: 231136 - DNA, 27 bp, Artificial Sequence
  Description of Artificial Sequence: Synthetic oligonucleotide
ttcctccccaaattgctcagcgccacc

SEQ ID NO: 231137 - DNA, 26 bp, Artificial Sequence
  Description of Artificial Sequence: Synthetic oligonucleotide
tcctccccaaattgctcagcgccacc

SEQ ID NO: 231138 - DNA, 25 bp, Artificial Sequence
  Description of Artificial Sequence: Synthetic oligonucleotide
cctccccaaattgctcagcgccacc

SEQ ID NO: 231139 - DNA, 26 bp, Artificial Sequence
  Description of Artificial Sequence: Synthetic oligonucleotide
ctccccaaattgctcagcgccaccga

SEQ ID NO: 231140 - DNA, 27 bp, Artificial Sequence
  Description of Artificial Sequence: Synthetic oligonucleotide
tccccaaattgctcagcgccaccgaca

SEQ ID NO: 231141 - DNA, 26 bp, Artificial Sequence
  Description of Artificial Sequence: Synthetic oligonucleotide
ccccaaattgctcagcgccaccgaca

SEQ ID NO: 231142 - DNA, 26 bp, Artificial Sequence
  Description of Artificial Sequence: Synthetic oligonucleotide
cccaaattgctcagcgccaccgacac

SEQ ID NO: 231143 - DNA, 26 bp, Artificial Sequence
  Description of Artificial Sequence: Synthetic oligonucleotide
ccaaattgctcagcgccaccgacacg

SEQ ID NO: 231144 - DNA, 27 bp, Artificial Sequence
  Description of Artificial Sequence: Synthetic oligonucleotide
caaattgctcagcgccaccgacacgct

SEQ ID NO: 231145 - DNA, 27 bp, Artificial Sequence
  Description of Artificial Sequence: Synthetic oligonucleotide
aaattgctcagcgccaccgacacgctc

SEQ ID NO: 231146 - DNA, 26 bp, Artificial Sequence
  Description of Artificial Sequence: Synthetic oligonucleotide
aattgctcagcgccaccgacacgctc

SEQ ID NO: 231147 - DNA, 25 bp, Artificial Sequence
  Description of Artificial Sequence: Synthetic oligonucleotide
attgctcagcgccaccgacacgctc

SEQ ID NO: 231148 - DNA, 24 bp, Artificial Sequence
  Description of Artificial Sequence: Synthetic oligonucleotide
ttgctcagcgccaccgacacgctc

SEQ ID NO: 231149 - DNA, 23 bp, Artificial Sequence
  Description of Artificial Sequence: Synthetic oligonucleotide
tgctcagcgccaccgacacgctc

SEQ ID NO: 231150 - DNA, 22 bp, Artificial Sequence
  Description of Artificial Sequence: Synthetic oligonucleotide
gctcagcgccaccgacacgctc

SEQ ID NO: 231151 - DNA, 23 bp, Artificial Sequence
  Description of Artificial Sequence: Synthetic oligonucleotide
ctcagcgccaccgacacgctcga

SEQ ID NO: 231152 - DNA, 23 bp, Artificial Sequence
  Description of Artificial Sequence: Synthetic oligonucleotide
tcagcgccaccgacacgctcgac

SEQ ID NO: 231153 - DNA, 22 bp, Artificial Sequence
  Description of Artificial Sequence: Synthetic oligonucleotide
cagcgccaccgacacgctcgac

SEQ ID NO: 231154 - DNA, 23 bp, Artificial Sequence
  Description of Artificial Sequence: Synthetic oligonucleotide
agcgccaccgacacgctcgacga

SEQ ID NO: 231155 - DNA, 22 bp, Artificial Sequence
  Description of Artificial Sequence: Synthetic oligonucleotide
gcgccaccgacacgctcgacga

SEQ ID NO: 231156 - DNA, 22 bp, Artificial Sequence
  Description of Artificial Sequence: Synthetic oligonucleotide
cgccaccgacacgctcgacgag

SEQ ID NO: 231157 - DNA, 22 bp, Artificial Sequence
  Description of Artificial Sequence: Synthetic oligonucleotide
gccaccgacacgctcgacgagg

SEQ ID NO: 231158 - DNA, 22 bp, Artificial Sequence
  Description of Artificial Sequence: Synthetic oligonucleotide
ccaccgacacgctcgacgaggc

SEQ ID NO: 231159 - DNA, 22 bp, Artificial Sequence
  Description of Artificial Sequence: Synthetic oligonucleotide
caccgacacgctcgacgaggcg

SEQ ID NO: 231160 - DNA, 23 bp, Artificial Sequence
  Description of Artificial Sequence: Synthetic oligonucleotide
accgacacgctcgacgaggcgga

SEQ ID NO: 231161 - DNA, 22 bp, Artificial Sequence
  Description of Artificial Sequence: Synthetic oligonucleotide
ccgacacgctcgacgaggcgga

SEQ ID NO: 231162 - DNA, 22 bp, Artificial Sequence
  Description of Artificial Sequence: Synthetic oligonucleotide
cgacacgctcgacgaggcggag

SEQ ID NO: 231163 - DNA, 22 bp, Artificial Sequence
  Description of Artificial Sequence: Synthetic oligonucleotide
gacacgctcgacgaggcggagc

SEQ ID NO: 231164 - DNA, 22 bp, Artificial Sequence
  Description of Artificial Sequence: Synthetic oligonucleotide
acacgctcgacgaggcggagcg

SEQ ID NO: 231165 - DNA, 21 bp, Artificial Sequence
  Description of Artificial Sequence: Synthetic oligonucleotide
cacgctcgacgaggcggagcg

SEQ ID NO: 231166 - DNA, 21 bp, Artificial Sequence
  Description of Artificial Sequence: Synthetic oligonucleotide
acgctcgacgaggcggagcgc

SEQ ID NO: 231167 - DNA, 20 bp, Artificial Sequence
  Description of Artificial Sequence: Synthetic oligonucleotide
cgctcgacgaggcggagcgc

SEQ ID NO: 231168 - DNA, 21 bp, Artificial Sequence
  Description of Artificial Sequence: Synthetic oligonucleotide
gctcgacgaggcggagcgcca

SEQ ID NO: 231169 - DNA, 22 bp, Artificial Sequence
  Description of Artificial Sequence: Synthetic oligonucleotide
ctcgacgaggcggagcgccagt

SEQ ID NO: 231170 - DNA, 22 bp, Artificial Sequence
  Description of Artificial Sequence: Synthetic oligonucleotide
tcgacgaggcggagcgccagtg

SEQ ID NO: 231171 - DNA, 21 bp, Artificial Sequence
  Description of Artificial Sequence: Synthetic oligonucleotide
cgacgaggcggagcgccagtg

SEQ ID NO: 231172 - DNA, 23 bp, Artificial Sequence
  Description of Artificial Sequence: Synthetic oligonucleotide
gacgaggcggagcgccagtggaa

SEQ ID NO: 231173 - DNA, 23 bp, Artificial Sequence
  Description of Artificial Sequence: Synthetic oligonucleotide
acgaggcggagcgccagtggaag

SEQ ID NO: 231174 - DNA, 22 bp, Artificial Sequence
  Description of Artificial Sequence: Synthetic oligonucleotide
cgaggcggagcgccagtggaag

SEQ ID NO: 231175 - DNA, 22 bp, Artificial Sequence
  Description of Artificial Sequence: Synthetic oligonucleotide
gaggcggagcgccagtggaagg

SEQ ID NO: 231176 - DNA, 22 bp, Artificial Sequence
  Description of Artificial Sequence: Synthetic oligonucleotide
aggcggagcgccagtggaaggc

SEQ ID NO: 231177 - DNA, 21 bp, Artificial Sequence
  Description of Artificial Sequence: Synthetic oligonucleotide
ggcggagcgccagtggaaggc

SEQ ID NO: 231178 - DNA, 21 bp, Artificial Sequence
  Description of Artificial Sequence: Synthetic oligonucleotide
gcggagcgccagtggaaggcc

SEQ ID NO: 231179 - DNA, 22 bp, Artificial Sequence
  Description of Artificial Sequence: Synthetic oligonucleotide
cggagcgccagtggaaggccga

SEQ ID NO: 231180 - DNA, 24 bp, Artificial Sequence
  Description of Artificial Sequence: Synthetic oligonucleotide
ggagcgccagtggaaggccgagtt

SEQ ID NO: 231181 - DNA, 24 bp, Artificial Sequence
  Description of Artificial Sequence: Synthetic oligonucleotide
gagcgccagtggaaggccgagttc

SEQ ID NO: 231182 - DNA, 25 bp, Artificial Sequence
  Description of Artificial Sequence: Synthetic oligonucleotide
agcgccagtggaaggccgagttcca

SEQ ID NO: 231183 - DNA, 24 bp, Artificial Sequence
  Description of Artificial Sequence: Synthetic oligonucleotide
gcgccagtggaaggccgagttcca

SEQ ID NO: 231184 - DNA, 24 bp, Artificial Sequence
  Description of Artificial Sequence: Synthetic oligonucleotide
cgccagtggaaggccgagttccac

SEQ ID NO: 231185 - DNA, 24 bp, Artificial Sequence
  Description of Artificial Sequence: Synthetic oligonucleotide
gccagtggaaggccgagttccacc

SEQ ID NO: 231186 - DNA, 24 bp, Artificial Sequence
  Description of Artificial Sequence: Synthetic oligonucleotide
ccagtggaaggccgagttccaccg

SEQ ID NO: 231187 - DNA, 25 bp, Artificial Sequence
  Description of Artificial Sequence: Synthetic oligonucleotide
cagtggaaggccgagttccaccgct

SEQ ID NO: 231188 - DNA, 25 bp, Artificial Sequence
  Description of Artificial Sequence: Synthetic oligonucleotide
agtggaaggccgagttccaccgctg

SEQ ID NO: 231189 - DNA, 24 bp, Artificial Sequence
  Description of Artificial Sequence: Synthetic oligonucleotide
gtggaaggccgagttccaccgctg

SEQ ID NO: 231190 - DNA, 25 bp, Artificial Sequence
  Description of Artificial Sequence: Synthetic oligonucleotide
tggaaggccgagttccaccgctgga

SEQ ID NO: 231191 - DNA, 24 bp, Artificial Sequence
  Description of Artificial Sequence: Synthetic oligonucleotide
ggaaggccgagttccaccgctgga

SEQ ID NO: 231192 - DNA, 24 bp, Artificial Sequence
  Description of Artificial Sequence: Synthetic oligonucleotide
gaaggccgagttccaccgctggag

SEQ ID NO: 231193 - DNA, 25 bp, Artificial Sequence
  Description of Artificial Sequence: Synthetic oligonucleotide
aaggccgagttccaccgctggagct

SEQ ID NO: 231194 - DNA, 24 bp, Artificial Sequence
  Description of Artificial Sequence: Synthetic oligonucleotide
aggccgagttccaccgctggagct

SEQ ID NO: 231195 - DNA, 23 bp, Artificial Sequence
  Description of Artificial Sequence: Synthetic oligonucleotide
ggccgagttccaccgctggagct

SEQ ID NO: 231196 - DNA, 23 bp, Artificial Sequence
  Description of Artificial Sequence: Synthetic oligonucleotide
gccgagttccaccgctggagctc

SEQ ID NO: 231197 - DNA, 25 bp, Artificial Sequence
  Description of Artificial Sequence: Synthetic oligonucleotide
ccgagttccaccgctggagctccta

SEQ ID NO: 231198 - DNA, 27 bp, Artificial Sequence
  Description of Artificial Sequence: Synthetic oligonucleotide
cgagttccaccgctggagctcctacat

SEQ ID NO: 231199 - DNA, 27 bp, Artificial Sequence
  Description of Artificial Sequence: Synthetic oligonucleotide
gagttccaccgctggagctcctacatg

SEQ ID NO: 231200 - DNA, 27 bp, Artificial Sequence
  Description of Artificial Sequence: Synthetic oligonucleotide
agttccaccgctggagctcctacatgg

SEQ ID NO: 231201 - DNA, 27 bp, Artificial Sequence
  Description of Artificial Sequence: Synthetic oligonucleotide
gttccaccgctggagctcctacatggt

SEQ ID NO: 231202 - DNA, 27 bp, Artificial Sequence
  Description of Artificial Sequence: Synthetic oligonucleotide
ttccaccgctggagctcctacatggtg

SEQ ID NO: 231203 - DNA, 26 bp, Artificial Sequence
  Description of Artificial Sequence: Synthetic oligonucleotide
tccaccgctggagctcctacatggtg

SEQ ID NO: 231204 - DNA, 25 bp, Artificial Sequence
  Description of Artificial Sequence: Synthetic oligonucleotide
ccaccgctggagctcctacatggtg

SEQ ID NO: 231205 - DNA, 26 bp, Artificial Sequence
  Description of Artificial Sequence: Synthetic oligonucleotide
caccgctggagctcctacatggtgca

SEQ ID NO: 231206 - DNA, 27 bp, Artificial Sequence
  Description of Artificial Sequence: Synthetic oligonucleotide
accgctggagctcctacatggtgcact

SEQ ID NO: 231207 - DNA, 26 bp, Artificial Sequence
  Description of Artificial Sequence: Synthetic oligonucleotide
ccgctggagctcctacatggtgcact

SEQ ID NO: 231208 - DNA, 26 bp, Artificial Sequence
  Description of Artificial Sequence: Synthetic oligonucleotide
cgctggagctcctacatggtgcactg

SEQ ID NO: 231209 - DNA, 27 bp, Artificial Sequence
  Description of Artificial Sequence: Synthetic oligonucleotide
gctggagctcctacatggtgcactgga

SEQ ID NO: 231210 - DNA, 28 bp, Artificial Sequence
  Description of Artificial Sequence: Synthetic oligonucleotide
ctggagctcctacatggtgcactggaag

SEQ ID NO: 231211 - DNA, 30 bp, Artificial Sequence
  Description of Artificial Sequence: Synthetic oligonucleotide
tggagctcctacatggtgcactggaagaac

SEQ ID NO: 231212 - DNA, 29 bp, Artificial Sequence
  Description of Artificial Sequence: Synthetic oligonucleotide
ggagctcctacatggtgcactggaagaac

SEQ ID NO: 231213 - DNA, 29 bp, Artificial Sequence
  Description of Artificial Sequence: Synthetic oligonucleotide
gagctcctacatggtgcactggaagaacc

SEQ ID NO: 231214 - DNA, 30 bp, Artificial Sequence
  Description of Artificial Sequence: Synthetic oligonucleotide
agctcctacatggtgcactggaagaaccag

SEQ ID NO: 231215 - DNA, 29 bp, Artificial Sequence
  Description of Artificial Sequence: Synthetic oligonucleotide
gctcctacatggtgcactggaagaaccag

SEQ ID NO: 231216 - DNA, 31 bp, Artificial Sequence
  Description of Artificial Sequence: Synthetic oligonucleotide
ctcctacatggtgcactggaagaaccagttc

SEQ ID NO: 231217 - DNA, 31 bp, Artificial Sequence
  Description of Artificial Sequence: Synthetic oligonucleotide
tcctacatggtgcactggaagaaccagttcg

SEQ ID NO: 231218 - DNA, 30 bp, Artificial Sequence
  Description of Artificial Sequence: Synthetic oligonucleotide
cctacatggtgcactggaagaaccagttcg

SEQ ID NO: 231219 - DNA, 31 bp, Artificial Sequence
  Description of Artificial Sequence: Synthetic oligonucleotide
ctacatggtgcactggaagaaccagttcgac

SEQ ID NO: 231220 - DNA, 31 bp, Artificial Sequence
  Description of Artificial Sequence: Synthetic oligonucleotide
tacatggtgcactggaagaaccagttcgacc

SEQ ID NO: 231221 - DNA, 30 bp, Artificial Sequence
  Description of Artificial Sequence: Synthetic oligonucleotide
acatggtgcactggaagaaccagttcgacc

SEQ ID NO: 231222 - DNA, 29 bp, Artificial Sequence
  Description of Artificial Sequence: Synthetic oligonucleotide
catggtgcactggaagaaccagttcgacc

SEQ ID NO: 231223 - DNA, 30 bp, Artificial Sequence
  Description of Artificial Sequence: Synthetic oligonucleotide
atggtgcactggaagaaccagttcgaccac

SEQ ID NO: 231224 - DNA, 29 bp, Artificial Sequence
  Description of Artificial Sequence: Synthetic oligonucleotide
tggtgcactggaagaaccagttcgaccac

SEQ ID NO: 231225 - DNA, 28 bp, Artificial Sequence
  Description of Artificial Sequence: Synthetic oligonucleotide
ggtgcactggaagaaccagttcgaccac

SEQ ID NO: 231226 - DNA, 30 bp, Artificial Sequence
  Description of Artificial Sequence: Synthetic oligonucleotide
gtgcactggaagaaccagttcgaccactac

SEQ ID NO: 231227 - DNA, 31 bp, Artificial Sequence
  Description of Artificial Sequence: Synthetic oligonucleotide
tgcactggaagaaccagttcgaccactacag

SEQ ID NO: 231228 - DNA, 30 bp, Artificial Sequence
  Description of Artificial Sequence: Synthetic oligonucleotide
gcactggaagaaccagttcgaccactacag

SEQ ID NO: 231229 - DNA, 30 bp, Artificial Sequence
  Description of Artificial Sequence: Synthetic oligonucleotide
cactggaagaaccagttcgaccactacagc

SEQ ID NO: 231230 - DNA, 32 bp, Artificial Sequence
  Description of Artificial Sequence: Synthetic oligonucleotide
actggaagaaccagttcgaccactacagcaag

SEQ ID NO: 231231 - DNA, 31 bp, Artificial Sequence
  Description of Artificial Sequence: Synthetic oligonucleotide
ctggaagaaccagttcgaccactacagcaag

SEQ ID NO: 231232 - DNA, 31 bp, Artificial Sequence
  Description of Artificial Sequence: Synthetic oligonucleotide
tggaagaaccagttcgaccactacagcaagc

SEQ ID NO: 231233 - DNA, 30 bp, Artificial Sequence
  Description of Artificial Sequence: Synthetic oligonucleotide
ggaagaaccagttcgaccactacagcaagc

SEQ ID NO: 231234 - DNA, 31 bp, Artificial Sequence
  Description of Artificial Sequence: Synthetic oligonucleotide
gaagaaccagttcgaccactacagcaagcag

SEQ ID NO: 231235 - DNA, 31 bp, Artificial Sequence
  Description of Artificial Sequence: Synthetic oligonucleotide
aagaaccagttcgaccactacagcaagcagg

SEQ ID NO: 231236 - DNA, 30 bp, Artificial Sequence
  Description of Artificial Sequence: Synthetic oligonucleotide
agaaccagttcgaccactacagcaagcagg

SEQ ID NO: 231237 - DNA, 29 bp, Artificial Sequence
  Description of Artificial Sequence: Synthetic oligonucleotide
gaaccagttcgaccactacagcaagcagg

SEQ ID NO: 231238 - DNA, 31 bp, Artificial Sequence
  Description of Artificial Sequence: Synthetic oligonucleotide
aaccagttcgaccactacagcaagcaggatc

SEQ ID NO: 231239 - DNA, 30 bp, Artificial Sequence
  Description of Artificial Sequence: Synthetic oligonucleotide
accagttcgaccactacagcaagcaggatc

SEQ ID NO: 231240 - DNA, 29 bp, Artificial Sequence
  Description of Artificial Sequence: Synthetic oligonucleotide
ccagttcgaccactacagcaagcaggatc

SEQ ID NO: 231241 - DNA, 29 bp, Artificial Sequence
  Description of Artificial Sequence: Synthetic oligonucleotide
cagttcgaccactacagcaagcaggatcg

SEQ ID NO: 231242 - DNA, 29 bp, Artificial Sequence
  Description of Artificial Sequence: Synthetic oligonucleotide
agttcgaccactacagcaagcaggatcgc

SEQ ID NO: 231243 - DNA, 28 bp, Artificial Sequence
  Description of Artificial Sequence: Synthetic oligonucleotide
gttcgaccactacagcaagcaggatcgc

SEQ ID NO: 231244 - DNA, 29 bp, Artificial Sequence
  Description of Artificial Sequence: Synthetic oligonucleotide
ttcgaccactacagcaagcaggatcgctg

SEQ ID NO: 231245 - DNA, 28 bp, Artificial Sequence
  Description of Artificial Sequence: Synthetic oligonucleotide
tcgaccactacagcaagcaggatcgctg

SEQ ID NO: 231246 - DNA, 27 bp, Artificial Sequence
  Description of Artificial Sequence: Synthetic oligonucleotide
cgaccactacagcaagcaggatcgctg

SEQ ID NO: 231247 - DNA, 27 bp, Artificial Sequence
  Description of Artificial Sequence: Synthetic oligonucleotide
gaccactacagcaagcaggatcgctgc

SEQ ID NO: 231248 - DNA, 28 bp, Artificial Sequence
  Description of Artificial Sequence: Synthetic oligonucleotide
accactacagcaagcaggatcgctgctc

SEQ ID NO: 231249 - DNA, 27 bp, Artificial Sequence
  Description of Artificial Sequence: Synthetic oligonucleotide
ccactacagcaagcaggatcgctgctc

SEQ ID NO: 231250 - DNA, 28 bp, Artificial Sequence
  Description of Artificial Sequence: Synthetic oligonucleotide
cactacagcaagcaggatcgctgctcag

SEQ ID NO: 231251 - DNA, 29 bp, Artificial Sequence
  Description of Artificial Sequence: Synthetic oligonucleotide
actacagcaagcaggatcgctgctcagac

SEQ ID NO: 231252 - DNA, 28 bp, Artificial Sequence
  Description of Artificial Sequence: Synthetic oligonucleotide
ctacagcaagcaggatcgctgctcagac

SEQ ID NO: 231253 - DNA, 28 bp, Artificial Sequence
  Description of Artificial Sequence: Synthetic oligonucleotide
tacagcaagcaggatcgctgctcagacc

SEQ ID NO: 231254 - DNA, 27 bp, Artificial Sequence
  Description of Artificial Sequence: Synthetic oligonucleotide
acagcaagcaggatcgctgctcagacc

SEQ ID NO: 231255 - DNA, 27 bp, Artificial Sequence
  Description of Artificial Sequence: Synthetic oligonucleotide
cagcaagcaggatcgctgctcagacct

SEQ ID NO: 231256 - DNA, 27 bp, Artificial Sequence
  Description of Artificial Sequence: Synthetic oligonucleotide
agcaagcaggatcgctgctcagacctg

SEQ ID NO: 231257 - DNA, 27 bp, Artificial Sequence
  Description of Artificial Sequence: Synthetic oligonucleotide
gcaagcaggatcgctgctcagacctgt

SEQ ID NO: 231258 - DNA, 27 bp, Artificial Sequence
  Description of Artificial Sequence: Synthetic oligonucleotide
caagcaggatcgctgctcagacctgtg

SEQ ID NO: 231259 - DNA, 23 bp, Artificial Sequence
  Description of Artificial Sequence: Synthetic oligonucleotide
atgcgggtcatcgcgcccccaac

SEQ ID NO: 231260 - DNA, 22 bp, Artificial Sequence
  Description of Artificial Sequence: Synthetic oligonucleotide
tgcgggtcatcgcgcccccaac

SEQ ID NO: 231261 - DNA, 21 bp, Artificial Sequence
  Description of Artificial Sequence: Synthetic oligonucleotide
gcgggtcatcgcgcccccaac

SEQ ID NO: 231262 - DNA, 21 bp, Artificial Sequence
  Description of Artificial Sequence: Synthetic oligonucleotide
cgggtcatcgcgcccccaacc

SEQ ID NO: 231263 - DNA, 22 bp, Artificial Sequence
  Description of Artificial Sequence: Synthetic oligonucleotide
gggtcatcgcgcccccaaccct

SEQ ID NO: 231264 - DNA, 22 bp, Artificial Sequence
  Description of Artificial Sequence: Synthetic oligonucleotide
ggtcatcgcgcccccaaccctc

SEQ ID NO: 231265 - DNA, 23 bp, Artificial Sequence
  Description of Artificial Sequence: Synthetic oligonucleotide
gtcatcgcgcccccaaccctcct

SEQ ID NO: 231266 - DNA, 23 bp, Artificial Sequence
  Description of Artificial Sequence: Synthetic oligonucleotide
tcatcgcgcccccaaccctcctg

SEQ ID NO: 231267 - DNA, 22 bp, Artificial Sequence
  Description of Artificial Sequence: Synthetic oligonucleotide
catcgcgcccccaaccctcctg

SEQ ID NO: 231268 - DNA, 23 bp, Artificial Sequence
  Description of Artificial Sequence: Synthetic oligonucleotide
atcgcgcccccaaccctcctgct

SEQ ID NO: 231269 - DNA, 22 bp, Artificial Sequence
  Description of Artificial Sequence: Synthetic oligonucleotide
tcgcgcccccaaccctcctgct

SEQ ID NO: 231270 - DNA, 21 bp, Artificial Sequence
  Description of Artificial Sequence: Synthetic oligonucleotide
cgcgcccccaaccctcctgct

SEQ ID NO: 231271 - DNA, 21 bp, Artificial Sequence
  Description of Artificial Sequence: Synthetic oligonucleotide
gcgcccccaaccctcctgctg

SEQ ID NO: 231272 - DNA, 22 bp, Artificial Sequence
  Description of Artificial Sequence: Synthetic oligonucleotide
cgcccccaaccctcctgctgct

SEQ ID NO: 231273 - DNA, 22 bp, Artificial Sequence
  Description of Artificial Sequence: Synthetic oligonucleotide
gcccccaaccctcctgctgctg

SEQ ID NO: 231274 - DNA, 23 bp, Artificial Sequence
  Description of Artificial Sequence: Synthetic oligonucleotide
cccccaaccctcctgctgctgct

SEQ ID NO: 231275 - DNA, 24 bp, Artificial Sequence
  Description of Artificial Sequence: Synthetic oligonucleotide
ccccaaccctcctgctgctgctca

SEQ ID NO: 231276 - DNA, 24 bp, Artificial Sequence
  Description of Artificial Sequence: Synthetic oligonucleotide
cccaaccctcctgctgctgctcac

SEQ ID NO: 231277 - DNA, 24 bp, Artificial Sequence
  Description of Artificial Sequence: Synthetic oligonucleotide
ccaaccctcctgctgctgctcacg

SEQ ID NO: 231278 - DNA, 24 bp, Artificial Sequence
  Description of Artificial Sequence: Synthetic oligonucleotide
caaccctcctgctgctgctcacgg

SEQ ID NO: 231279 - DNA, 24 bp, Artificial Sequence
  Description of Artificial Sequence: Synthetic oligonucleotide
aaccctcctgctgctgctcacggg

SEQ ID NO: 231280 - DNA, 23 bp, Artificial Sequence
  Description of Artificial Sequence: Synthetic oligonucleotide
accctcctgctgctgctcacggg

SEQ ID NO: 231281 - DNA, 22 bp, Artificial Sequence
  Description of Artificial Sequence: Synthetic oligonucleotide
ccctcctgctgctgctcacggg

SEQ ID NO: 231282 - DNA, 22 bp, Artificial Sequence
  Description of Artificial Sequence: Synthetic oligonucleotide
cctcctgctgctgctcacgggg

SEQ ID NO: 231283 - DNA, 22 bp, Artificial Sequence
  Description of Artificial Sequence: Synthetic oligonucleotide
ctcctgctgctgctcacggggg

SEQ ID NO: 231284 - DNA, 22 bp, Artificial Sequence
  Description of Artificial Sequence: Synthetic oligonucleotide
tcctgctgctgctcacgggggc

SEQ ID NO: 231285 - DNA, 21 bp, Artificial Sequence
  Description of Artificial Sequence: Synthetic oligonucleotide
cctgctgctgctcacgggggc

SEQ ID NO: 231286 - DNA, 21 bp, Artificial Sequence
  Description of Artificial Sequence: Synthetic oligonucleotide
ctgctgctgctcacgggggcc

SEQ ID NO: 231287 - DNA, 22 bp, Artificial Sequence
  Description of Artificial Sequence: Synthetic oligonucleotide
tgctgctgctcacgggggccca

SEQ ID NO: 231288 - DNA, 21 bp, Artificial Sequence
  Description of Artificial Sequence: Synthetic oligonucleotide
gctgctgctcacgggggccca

SEQ ID NO: 231289 - DNA, 21 bp, Artificial Sequence
  Description of Artificial Sequence: Synthetic oligonucleotide
ctgctgctcacgggggcccag

SEQ ID NO: 231290 - DNA, 21 bp, Artificial Sequence
  Description of Artificial Sequence: Synthetic oligonucleotide
tgctgctcacgggggcccagg

SEQ ID NO: 231291 - DNA, 20 bp, Artificial Sequence
  Description of Artificial Sequence: Synthetic oligonucleotide
gctgctcacgggggcccagg

SEQ ID NO: 231292 - DNA, 20 bp, Artificial Sequence
  Description of Artificial Sequence: Synthetic oligonucleotide
ctgctcacgggggcccaggc

SEQ ID NO: 231293 - DNA, 20 bp, Artificial Sequence
  Description of Artificial Sequence: Synthetic oligonucleotide
tgctcacgggggcccaggcc

SEQ ID NO: 231294 - DNA, 20 bp, Artificial Sequence
  Description of Artificial Sequence: Synthetic oligonucleotide
gctcacgggggcccaggcct

SEQ ID NO: 231295 - DNA, 20 bp, Artificial Sequence
  Description of Artificial Sequence: Synthetic oligonucleotide
ctcacgggggcccaggccct

SEQ ID NO: 231296 - DNA, 21 bp, Artificial Sequence
  Description of Artificial Sequence: Synthetic oligonucleotide
tcacgggggcccaggccctga

SEQ ID NO: 231297 - DNA, 20 bp, Artificial Sequence
  Description of Artificial Sequence: Synthetic oligonucleotide
cacgggggcccaggccctga

SEQ ID NO: 231298 - DNA, 20 bp, Artificial Sequence
  Description of Artificial Sequence: Synthetic oligonucleotide
acgggggcccaggccctgac

SEQ ID NO: 231299 - DNA, 20 bp, Artificial Sequence
  Description of Artificial Sequence: Synthetic oligonucleotide
cgggggcccaggccctgact

SEQ ID NO: 231300 - DNA, 20 bp, Artificial Sequence
  Description of Artificial Sequence: Synthetic oligonucleotide
gggggcccaggccctgacgt

SEQ ID NO: 231301 - DNA, 20 bp, Artificial Sequence
  Description of Artificial Sequence: Synthetic oligonucleotide
ggggcccaggccctgacgga

SEQ ID NO: 231302 - DNA, 21 bp, Artificial Sequence
  Description of Artificial Sequence: Synthetic oligonucleotide
gggcccaggccctgacggaga

SEQ ID NO: 231303 - DNA, 21 bp, Artificial Sequence
  Description of Artificial Sequence: Synthetic oligonucleotide
ggcccaggccctgacggagac

SEQ ID NO: 231304 - DNA, 22 bp, Artificial Sequence
  Description of Artificial Sequence: Synthetic oligonucleotide
gcccaggccctgacggagacct

SEQ ID NO: 231305 - DNA, 22 bp, Artificial Sequence
  Description of Artificial Sequence: Synthetic oligonucleotide
cccaggccctgacggagacctg

SEQ ID NO: 231306 - DNA, 22 bp, Artificial Sequence
  Description of Artificial Sequence: Synthetic oligonucleotide
ccaggccctgacggagacctgg

SEQ ID NO: 231307 - DNA, 22 bp, Artificial Sequence
  Description of Artificial Sequence: Synthetic oligonucleotide
caggccctgacggagacctggc

SEQ ID NO: 231308 - DNA, 22 bp, Artificial Sequence
  Description of Artificial Sequence: Synthetic oligonucleotide
aggccctgacggagacctggcc

SEQ ID NO: 231309 - DNA, 21 bp, Artificial Sequence
  Description of Artificial Sequence: Synthetic oligonucleotide
ggccctgacggagacctggcc

SEQ ID NO: 231310 - DNA, 21 bp, Artificial Sequence
  Description of Artificial Sequence: Synthetic oligonucleotide
gccctgacggagacctggccc

SEQ ID NO: 231311 - DNA, 21 bp, Artificial Sequence
  Description of Artificial Sequence: Synthetic oligonucleotide
ccctgacggagacctggcccg

SEQ ID NO: 231312 - DNA, 21 bp, Artificial Sequence
  Description of Artificial Sequence: Synthetic oligonucleotide
cctgacggagacctggcccgg

SEQ ID NO: 231313 - DNA, 22 bp, Artificial Sequence
  Description of Artificial Sequence: Synthetic oligonucleotide
ctgacggagacctggcccggct

SEQ ID NO: 231314 - DNA, 22 bp, Artificial Sequence
  Description of Artificial Sequence: Synthetic oligonucleotide
tgacggagacctggcccggctc

SEQ ID NO: 231315 - DNA, 21 bp, Artificial Sequence
  Description of Artificial Sequence: Synthetic oligonucleotide
gacggagacctggcccggctc

SEQ ID NO: 231316 - DNA, 21 bp, Artificial Sequence
  Description of Artificial Sequence: Synthetic oligonucleotide
acggagacctggcccggctcc

SEQ ID NO: 231317 - DNA, 20 bp, Artificial Sequence
  Description of Artificial Sequence: Synthetic oligonucleotide
cggagacctggcccggctcc

SEQ ID NO: 231318 - DNA, 21 bp, Artificial Sequence
  Description of Artificial Sequence: Synthetic oligonucleotide
ggagacctggcccggctccct

SEQ ID NO: 231319 - DNA, 22 bp, Artificial Sequence
  Description of Artificial Sequence: Synthetic oligonucleotide
gagacctggcccggctccctct

SEQ ID NO: 231320 - DNA, 22 bp, Artificial Sequence
  Description of Artificial Sequence: Synthetic oligonucleotide
agacctggcccggctccctctc

SEQ ID NO: 231321 - DNA, 21 bp, Artificial Sequence
  Description of Artificial Sequence: Synthetic oligonucleotide
gacctggcccggctccctctc

SEQ ID NO: 231322 - DNA, 23 bp, Artificial Sequence
  Description of Artificial Sequence: Synthetic oligonucleotide
acctggcccggctccctctccat

SEQ ID NO: 231323 - DNA, 22 bp, Artificial Sequence
  Description of Artificial Sequence: Synthetic oligonucleotide
cctggcccggctccctctccat

SEQ ID NO: 231324 - DNA, 23 bp, Artificial Sequence
  Description of Artificial Sequence: Synthetic oligonucleotide
ctggcccggctccctctccatga

SEQ ID NO: 231325 - DNA, 23 bp, Artificial Sequence
  Description of Artificial Sequence: Synthetic oligonucleotide
tggcccggctccctctccatgag

SEQ ID NO: 231326 - DNA, 22 bp, Artificial Sequence
  Description of Artificial Sequence: Synthetic oligonucleotide
ggcccggctccctctccatgag

SEQ ID NO: 231327 - DNA, 27 bp, Artificial Sequence
  Description of Artificial Sequence: Synthetic oligonucleotide
gcccggctccctctccatgagctattt

SEQ ID NO: 231328 - DNA, 27 bp, Artificial Sequence
  Description of Artificial Sequence: Synthetic oligonucleotide
cccggctccctctccatgagctatttc

SEQ ID NO: 231329 - DNA, 29 bp, Artificial Sequence
  Description of Artificial Sequence: Synthetic oligonucleotide
ccggctccctctccatgagctatttctag

SEQ ID NO: 231330 - DNA, 30 bp, Artificial Sequence
  Description of Artificial Sequence: Synthetic oligonucleotide
cggctccctctccatgagctatttctagac

SEQ ID NO: 231331 - DNA, 30 bp, Artificial Sequence
  Description of Artificial Sequence: Synthetic oligonucleotide
ggctccctctccatgagctatttctagacc

SEQ ID NO: 231332 - DNA, 30 bp, Artificial Sequence
  Description of Artificial Sequence: Synthetic oligonucleotide
gctccctctccatgagctatttctagaccg

SEQ ID NO: 231333 - DNA, 30 bp, Artificial Sequence
  Description of Artificial Sequence: Synthetic oligonucleotide
ctccctctccatgagctatttctagaccgc

SEQ ID NO: 231334 - DNA, 30 bp, Artificial Sequence
  Description of Artificial Sequence: Synthetic oligonucleotide
tccctctccatgagctatttctagaccgcc

SEQ ID NO: 231335 - DNA, 29 bp, Artificial Sequence
  Description of Artificial Sequence: Synthetic oligonucleotide
ccctctccatgagctatttctagaccgcc

SEQ ID NO: 231336 - DNA, 29 bp, Artificial Sequence
  Description of Artificial Sequence: Synthetic oligonucleotide
cctctccatgagctatttctagaccgccg

SEQ ID NO: 231337 - DNA, 30 bp, Artificial Sequence
  Description of Artificial Sequence: Synthetic oligonucleotide
ctctccatgagctatttctagaccgccgtg

SEQ ID NO: 231338 - DNA, 31 bp, Artificial Sequence
  Description of Artificial Sequence: Synthetic oligonucleotide
tctccatgagctatttctagaccgccgtgtg

SEQ ID NO: 231339 - DNA, 30 bp, Artificial Sequence
  Description of Artificial Sequence: Synthetic oligonucleotide
ctccatgagctatttctagaccgccgtgtg

SEQ ID NO: 231340 - DNA, 30 bp, Artificial Sequence
  Description of Artificial Sequence: Synthetic oligonucleotide
tccatgagctatttctagaccgccgtgtgc

SEQ ID NO: 231341 - DNA, 29 bp, Artificial Sequence
  Description of Artificial Sequence: Synthetic oligonucleotide
ccatgagctatttctagaccgccgtgtgc

SEQ ID NO: 231342 - DNA, 29 bp, Artificial Sequence
  Description of Artificial Sequence: Synthetic oligonucleotide
catgagctatttctagaccgccgtgtgcc

SEQ ID NO: 231343 - DNA, 29 bp, Artificial Sequence
  Description of Artificial Sequence: Synthetic oligonucleotide
atgagctatttctagaccgccgtgtgccg

SEQ ID NO: 231344 - DNA, 28 bp, Artificial Sequence
  Description of Artificial Sequence: Synthetic oligonucleotide
tgagctatttctagaccgccgtgtgccg

SEQ ID NO: 231345 - DNA, 27 bp, Artificial Sequence
  Description of Artificial Sequence: Synthetic oligonucleotide
gagctatttctagaccgccgtgtgccg

SEQ ID NO: 231346 - DNA, 27 bp, Artificial Sequence
  Description of Artificial Sequence: Synthetic oligonucleotide
agctatttctagaccgccgtgtgccgg

SEQ ID NO: 231347 - DNA, 26 bp, Artificial Sequence
  Description of Artificial Sequence: Synthetic oligonucleotide
gctatttctagaccgccgtgtgccgg

SEQ ID NO: 231348 - DNA, 26 bp, Artificial Sequence
  Description of Artificial Sequence: Synthetic oligonucleotide
ctatttctagaccgccgtgtgccggc

SEQ ID NO: 231349 - DNA, 26 bp, Artificial Sequence
  Description of Artificial Sequence: Synthetic oligonucleotide
tatttctagaccgccgtgtgccggcc

SEQ ID NO: 231350 - DNA, 25 bp, Artificial Sequence
  Description of Artificial Sequence: Synthetic oligonucleotide
atttctagaccgccgtgtgccggcc

SEQ ID NO: 231351 - DNA, 24 bp, Artificial Sequence
  Description of Artificial Sequence: Synthetic oligonucleotide
tttctagaccgccgtgtgccggcc

SEQ ID NO: 231352 - DNA, 23 bp, Artificial Sequence
  Description of Artificial Sequence: Synthetic oligonucleotide
ttctagaccgccgtgtgccggcc

SEQ ID NO: 231353 - DNA, 22 bp, Artificial Sequence
  Description of Artificial Sequence: Synthetic oligonucleotide
tctagaccgccgtgtgccggcc

SEQ ID NO: 231354 - DNA, 21 bp, Artificial Sequence
  Description of Artificial Sequence: Synthetic oligonucleotide
ctagaccgccgtgtgccggcc

SEQ ID NO: 231355 - DNA, 21 bp, Artificial Sequence
  Description of Artificial Sequence: Synthetic oligonucleotide
tagaccgccgtgtgccggccc

SEQ ID NO: 231356 - DNA, 20 bp, Artificial Sequence
  Description of Artificial Sequence: Synthetic oligonucleotide
agaccgccgtgtgccggccc

SEQ ID NO: 231357 - DNA, 20 bp, Artificial Sequence
  Description of Artificial Sequence: Synthetic oligonucleotide
gaccgccgtgtgccggccct

SEQ ID NO: 231358 - DNA, 20 bp, Artificial Sequence
  Description of Artificial Sequence: Synthetic oligonucleotide
accgccgtgtgccggcccgt

SEQ ID NO: 231359 - DNA, 20 bp, Artificial Sequence
  Description of Artificial Sequence: Synthetic oligonucleotide
ccgccgtgtgccggcccgtt

SEQ ID NO: 231360 - DNA, 20 bp, Artificial Sequence
  Description of Artificial Sequence: Synthetic oligonucleotide
cgccgtgtgccggcccggtt

SEQ ID NO: 231361 - DNA, 20 bp, Artificial Sequence
  Description of Artificial Sequence: Synthetic oligonucleotide
gccgtgtgccggcccgggtt

SEQ ID NO: 231362 - DNA, 20 bp, Artificial Sequence
  Description of Artificial Sequence: Synthetic oligonucleotide
ccgtgtgccggcccgggctt

SEQ ID NO: 231363 - DNA, 20 bp, Artificial Sequence
  Description of Artificial Sequence: Synthetic oligonucleotide
cgtgtgccggcccgggcgtt

SEQ ID NO: 231364 - DNA, 20 bp, Artificial Sequence
  Description of Artificial Sequence: Synthetic oligonucleotide
gtgtgccggcccgggcgctt

SEQ ID NO: 231365 - DNA, 20 bp, Artificial Sequence
  Description of Artificial Sequence: Synthetic oligonucleotide
tgtgccggcccgggcgcgtt

SEQ ID NO: 231366 - DNA, 20 bp, Artificial Sequence
  Description of Artificial Sequence: Synthetic oligonucleotide
gtgccggcccgggcgcgttt

SEQ ID NO: 231367 - DNA, 20 bp, Artificial Sequence
  Description of Artificial Sequence: Synthetic oligonucleotide
tgccggcccgggcgcggttt

SEQ ID NO: 231368 - DNA, 20 bp, Artificial Sequence
  Description of Artificial Sequence: Synthetic oligonucleotide
gccggcccgggcgcggtttt

SEQ ID NO: 231369 - DNA, 20 bp, Artificial Sequence
  Description of Artificial Sequence: Synthetic oligonucleotide
gcccgggcgcggggaggttt

SEQ ID NO: 231370 - DNA, 20 bp, Artificial Sequence
  Description of Artificial Sequence: Synthetic oligonucleotide
cccgggcgcggggaggcttt

SEQ ID NO: 231371 - DNA, 20 bp, Artificial Sequence
  Description of Artificial Sequence: Synthetic oligonucleotide
ccgggcgcggggaggccttt

SEQ ID NO: 231372 - DNA, 20 bp, Artificial Sequence
  Description of Artificial Sequence: Synthetic oligonucleotide
cgggcgcggggaggcccttt

SEQ ID NO: 231373 - DNA, 20 bp, Artificial Sequence
  Description of Artificial Sequence: Synthetic oligonucleotide
gggcgcggggaggcccgttt

SEQ ID NO: 231374 - DNA, 20 bp, Artificial Sequence
  Description of Artificial Sequence: Synthetic oligonucleotide
ggcgcggggaggcccgcttt

SEQ ID NO: 231375 - DNA, 21 bp, Artificial Sequence
  Description of Artificial Sequence: Synthetic oligonucleotide
gcgcggggaggcccgcttcaa

SEQ ID NO: 231376 - DNA, 21 bp, Artificial Sequence
  Description of Artificial Sequence: Synthetic oligonucleotide
cgcggggaggcccgcttcaac

SEQ ID NO: 231377 - DNA, 21 bp, Artificial Sequence
  Description of Artificial Sequence: Synthetic oligonucleotide
gcggggaggcccgcttcaacg

SEQ ID NO: 231378 - DNA, 22 bp, Artificial Sequence
  Description of Artificial Sequence: Synthetic oligonucleotide
cggggaggcccgcttcaacgca

SEQ ID NO: 231379 - DNA, 23 bp, Artificial Sequence
  Description of Artificial Sequence: Synthetic oligonucleotide
ggggaggcccgcttcaacgcagt

SEQ ID NO: 231380 - DNA, 23 bp, Artificial Sequence
  Description of Artificial Sequence: Synthetic oligonucleotide
gggaggcccgcttcaacgcagtg

SEQ ID NO: 231381 - DNA, 23 bp, Artificial Sequence
  Description of Artificial Sequence: Synthetic oligonucleotide
ggaggcccgcttcaacgcagtgg

SEQ ID NO: 231382 - DNA, 23 bp, Artificial Sequence
  Description of Artificial Sequence: Synthetic oligonucleotide
gaggcccgcttcaacgcagtggg

SEQ ID NO: 231383 - DNA, 25 bp, Artificial Sequence
  Description of Artificial Sequence: Synthetic oligonucleotide
aggcccgcttcaacgcagtgggcaa

SEQ ID NO: 231384 - DNA, 24 bp, Artificial Sequence
  Description of Artificial Sequence: Synthetic oligonucleotide
ggcccgcttcaacgcagtgggcaa

SEQ ID NO: 231385 - DNA, 24 bp, Artificial Sequence
  Description of Artificial Sequence: Synthetic oligonucleotide
gcccgcttcaacgcagtgggcaac

SEQ ID NO: 231386 - DNA, 25 bp, Artificial Sequence
  Description of Artificial Sequence: Synthetic oligonucleotide
cccgcttcaacgcagtgggcaacgt

SEQ ID NO: 231387 - DNA, 25 bp, Artificial Sequence
  Description of Artificial Sequence: Synthetic oligonucleotide
ccgcttcaacgcagtgggcaacgtg

SEQ ID NO: 231388 - DNA, 26 bp, Artificial Sequence
  Description of Artificial Sequence: Synthetic oligonucleotide
cgcttcaacgcagtgggcaacgtgga

SEQ ID NO: 231389 - DNA, 26 bp, Artificial Sequence
  Description of Artificial Sequence: Synthetic oligonucleotide
gcttcaacgcagtgggcaacgtggag

SEQ ID NO: 231390 - DNA, 27 bp, Artificial Sequence
  Description of Artificial Sequence: Synthetic oligonucleotide
cttcaacgcagtgggcaacgtggagga

SEQ ID NO: 231391 - DNA, 27 bp, Artificial Sequence
  Description of Artificial Sequence: Synthetic oligonucleotide
ttcaacgcagtgggcaacgtggaggac

SEQ ID NO: 231392 - DNA, 27 bp, Artificial Sequence
  Description of Artificial Sequence: Synthetic oligonucleotide
tcaacgcagtgggcaacgtggaggaca

SEQ ID NO: 231393 - DNA, 26 bp, Artificial Sequence
  Description of Artificial Sequence: Synthetic oligonucleotide
caacgcagtgggcaacgtggaggaca

SEQ ID NO: 231394 - DNA, 26 bp, Artificial Sequence
  Description of Artificial Sequence: Synthetic oligonucleotide
aacgcagtgggcaacgtggaggacac

SEQ ID NO: 231395 - DNA, 25 bp, Artificial Sequence
  Description of Artificial Sequence: Synthetic oligonucleotide
acgcagtgggcaacgtggaggacac

SEQ ID NO: 231396 - DNA, 24 bp, Artificial Sequence
  Description of Artificial Sequence: Synthetic oligonucleotide
cgcagtgggcaacgtggaggacac

SEQ ID NO: 231397 - DNA, 24 bp, Artificial Sequence
  Description of Artificial Sequence: Synthetic oligonucleotide
gcagtgggcaacgtggaggacacg

SEQ ID NO: 231398 - DNA, 25 bp, Artificial Sequence
  Description of Artificial Sequence: Synthetic oligonucleotide
cagtgggcaacgtggaggacacgca

SEQ ID NO: 231399 - DNA, 27 bp, Artificial Sequence
  Description of Artificial Sequence: Synthetic oligonucleotide
agtgggcaacgtggaggacacgcagta

SEQ ID NO: 231400 - DNA, 26 bp, Artificial Sequence
  Description of Artificial Sequence: Synthetic oligonucleotide
gtgggcaacgtggaggacacgcagta

SEQ ID NO: 231401 - DNA, 26 bp, Artificial Sequence
  Description of Artificial Sequence: Synthetic oligonucleotide
tgggcaacgtggaggacacgcagtac

SEQ ID NO: 231402 - DNA, 25 bp, Artificial Sequence
  Description of Artificial Sequence: Synthetic oligonucleotide
gggcaacgtggaggacacgcagtac

SEQ ID NO: 231403 - DNA, 26 bp, Artificial Sequence
  Description of Artificial Sequence: Synthetic oligonucleotide
ggcaacgtggaggacacgcagtacgt

SEQ ID NO: 231404 - DNA, 26 bp, Artificial Sequence
  Description of Artificial Sequence: Synthetic oligonucleotide
gcaacgtggaggacacgcagtacgtg

SEQ ID NO: 231405 - DNA, 26 bp, Artificial Sequence
  Description of Artificial Sequence: Synthetic oligonucleotide
caacgtggaggacacgcagtacgtgc

SEQ ID NO: 231406 - DNA, 26 bp, Artificial Sequence
  Description of Artificial Sequence: Synthetic oligonucleotide
aacgtggaggacacgcagtacgtgcg

SEQ ID NO: 231407 - DNA, 25 bp, Artificial Sequence
  Description of Artificial Sequence: Synthetic oligonucleotide
acgtggaggacacgcagtacgtgcg

SEQ ID NO: 231408 - DNA, 24 bp, Artificial Sequence
  Description of Artificial Sequence: Synthetic oligonucleotide
cgtggaggacacgcagtacgtgcg

SEQ ID NO: 231409 - DNA, 26 bp, Artificial Sequence
  Description of Artificial Sequence: Synthetic oligonucleotide
gtggaggacacgcagtacgtgcggta

SEQ ID NO: 231410 - DNA, 26 bp, Artificial Sequence
  Description of Artificial Sequence: Synthetic oligonucleotide
tggaggacacgcagtacgtgcggtac

SEQ ID NO: 231411 - DNA, 25 bp, Artificial Sequence
  Description of Artificial Sequence: Synthetic oligonucleotide
ggaggacacgcagtacgtgcggtac

SEQ ID NO: 231412 - DNA, 26 bp, Artificial Sequence
  Description of Artificial Sequence: Synthetic oligonucleotide
gaggacacgcagtacgtgcggtacga

SEQ ID NO: 231413 - DNA, 27 bp, Artificial Sequence
  Description of Artificial Sequence: Synthetic oligonucleotide
aggacacgcagtacgtgcggtacgaca

SEQ ID NO: 231414 - DNA, 26 bp, Artificial Sequence
  Description of Artificial Sequence: Synthetic oligonucleotide
ggacacgcagtacgtgcggtacgaca

SEQ ID NO: 231415 - DNA, 26 bp, Artificial Sequence
  Description of Artificial Sequence: Synthetic oligonucleotide
gacacgcagtacgtgcggtacgacag

SEQ ID NO: 231416 - DNA, 26 bp, Artificial Sequence
  Description of Artificial Sequence: Synthetic oligonucleotide
acacgcagtacgtgcggtacgacagc

SEQ ID NO: 231417 - DNA, 25 bp, Artificial Sequence
  Description of Artificial Sequence: Synthetic oligonucleotide
cacgcagtacgtgcggtacgacagc

SEQ ID NO: 231418 - DNA, 26 bp, Artificial Sequence
  Description of Artificial Sequence: Synthetic oligonucleotide
acgcagtacgtgcggtacgacagcga

SEQ ID NO: 231419 - DNA, 25 bp, Artificial Sequence
  Description of Artificial Sequence: Synthetic oligonucleotide
cgcagtacgtgcggtacgacagcga

SEQ ID NO: 231420 - DNA, 25 bp, Artificial Sequence
  Description of Artificial Sequence: Synthetic oligonucleotide
gcagtacgtgcggtacgacagcgag

SEQ ID NO: 231421 - DNA, 25 bp, Artificial Sequence
  Description of Artificial Sequence: Synthetic oligonucleotide
cagtacgtgcggtacgacagcgagg

SEQ ID NO: 231422 - DNA, 25 bp, Artificial Sequence
  Description of Artificial Sequence: Synthetic oligonucleotide
agtacgtgcggtacgacagcgaggc

SEQ ID NO: 231423 - DNA, 24 bp, Artificial Sequence
  Description of Artificial Sequence: Synthetic oligonucleotide
gtacgtgcggtacgacagcgaggc

SEQ ID NO: 231424 - DNA, 24 bp, Artificial Sequence
  Description of Artificial Sequence: Synthetic oligonucleotide
tacgtgcggtacgacagcgaggcc

SEQ ID NO: 231425 - DNA, 23 bp, Artificial Sequence
  Description of Artificial Sequence: Synthetic oligonucleotide
acgtgcggtacgacagcgaggcc

SEQ ID NO: 231426 - DNA, 22 bp, Artificial Sequence
  Description of Artificial Sequence: Synthetic oligonucleotide
cgtgcggtacgacagcgaggcc

SEQ ID NO: 231427 - DNA, 22 bp, Artificial Sequence
  Description of Artificial Sequence: Synthetic oligonucleotide
gtgcggtacgacagcgaggccg

SEQ ID NO: 231428 - DNA, 22 bp, Artificial Sequence
  Description of Artificial Sequence: Synthetic oligonucleotide
tgcggtacgacagcgaggccgc

SEQ ID NO: 231429 - DNA, 21 bp, Artificial Sequence
  Description of Artificial Sequence: Synthetic oligonucleotide
gcggtacgacagcgaggccgc

SEQ ID NO: 231430 - DNA, 22 bp, Artificial Sequence
  Description of Artificial Sequence: Synthetic oligonucleotide
cggtacgacagcgaggccgcga

SEQ ID NO: 231431 - DNA, 23 bp, Artificial Sequence
  Description of Artificial Sequence: Synthetic oligonucleotide
ggtacgacagcgaggccgcgagt

SEQ ID NO: 231432 - DNA, 23 bp, Artificial Sequence
  Description of Artificial Sequence: Synthetic oligonucleotide
gtacgacagcgaggccgcgagtg

SEQ ID NO: 231433 - DNA, 23 bp, Artificial Sequence
  Description of Artificial Sequence: Synthetic oligonucleotide
tacgacagcgaggccgcgagtgc

SEQ ID NO: 231434 - DNA, 22 bp, Artificial Sequence
  Description of Artificial Sequence: Synthetic oligonucleotide
acgacagcgaggccgcgagtgc

SEQ ID NO: 231435 - DNA, 21 bp, Artificial Sequence
  Description of Artificial Sequence: Synthetic oligonucleotide
cgacagcgaggccgcgagtgc

SEQ ID NO: 231436 - DNA, 22 bp, Artificial Sequence
  Description of Artificial Sequence: Synthetic oligonucleotide
gacagcgaggccgcgagtgcga

SEQ ID NO: 231437 - DNA, 22 bp, Artificial Sequence
  Description of Artificial Sequence: Synthetic oligonucleotide
acagcgaggccgcgagtgcgag

SEQ ID NO: 231438 - DNA, 21 bp, Artificial Sequence
  Description of Artificial Sequence: Synthetic oligonucleotide
cagcgaggccgcgagtgcgag

SEQ ID NO: 231439 - DNA, 23 bp, Artificial Sequence
  Description of Artificial Sequence: Synthetic oligonucleotide
agcgaggccgcgagtgcgaggat

SEQ ID NO: 231440 - DNA, 22 bp, Artificial Sequence
  Description of Artificial Sequence: Synthetic oligonucleotide
gcgaggccgcgagtgcgaggat

SEQ ID NO: 231441 - DNA, 22 bp, Artificial Sequence
  Description of Artificial Sequence: Synthetic oligonucleotide
cgaggccgcgagtgcgaggatg

SEQ ID NO: 231442 - DNA, 23 bp, Artificial Sequence
  Description of Artificial Sequence: Synthetic oligonucleotide
gaggccgcgagtgcgaggatgga

SEQ ID NO: 231443 - DNA, 23 bp, Artificial Sequence
  Description of Artificial Sequence: Synthetic oligonucleotide
aggccgcgagtgcgaggatggac

SEQ ID NO: 231444 - DNA, 22 bp, Artificial Sequence
  Description of Artificial Sequence: Synthetic oligonucleotide
ggccgcgagtgcgaggatggac

SEQ ID NO: 231445 - DNA, 22 bp, Artificial Sequence
  Description of Artificial Sequence: Synthetic oligonucleotide
gccgcgagtgcgaggatggacc

SEQ ID NO: 231446 - DNA, 22 bp, Artificial Sequence
  Description of Artificial Sequence: Synthetic oligonucleotide
ccgcgagtgcgaggatggaccc

SEQ ID NO: 231447 - DNA, 22 bp, Artificial Sequence
  Description of Artificial Sequence: Synthetic oligonucleotide
cgcgagtgcgaggatggacccg

SEQ ID NO: 231448 - DNA, 22 bp, Artificial Sequence
  Description of Artificial Sequence: Synthetic oligonucleotide
gcgagtgcgaggatggacccgc

SEQ ID NO: 231449 - DNA, 22 bp, Artificial Sequence
  Description of Artificial Sequence: Synthetic oligonucleotide
cgagtgcgaggatggacccgcg

SEQ ID NO: 231450 - DNA, 22 bp, Artificial Sequence
  Description of Artificial Sequence: Synthetic oligonucleotide
gagtgcgaggatggacccgcgg

SEQ ID NO: 231451 - DNA, 22 bp, Artificial Sequence
  Description of Artificial Sequence: Synthetic oligonucleotide
agtgcgaggatggacccgcggg

SEQ ID NO: 231452 - DNA, 21 bp, Artificial Sequence
  Description of Artificial Sequence: Synthetic oligonucleotide
gtgcgaggatggacccgcggg

SEQ ID NO: 231453 - DNA, 21 bp, Artificial Sequence
  Description of Artificial Sequence: Synthetic oligonucleotide
tgcgaggatggacccgcgggc

SEQ ID NO: 231454 - DNA, 20 bp, Artificial Sequence
  Description of Artificial Sequence: Synthetic oligonucleotide
gcgaggatggacccgcgggc

SEQ ID NO: 231455 - DNA, 20 bp, Artificial Sequence
  Description of Artificial Sequence: Synthetic oligonucleotide
cgaggatggacccgcgggcg

SEQ ID NO: 231456 - DNA, 20 bp, Artificial Sequence
  Description of Artificial Sequence: Synthetic oligonucleotide
gaggatggacccgcgggcgg

SEQ ID NO: 231457 - DNA, 20 bp, Artificial Sequence
  Description of Artificial Sequence: Synthetic oligonucleotide
aggatggacccgcgggcggc

SEQ ID NO: 231458 - DNA, 20 bp, Artificial Sequence
  Description of Artificial Sequence: Synthetic oligonucleotide
ggatggacccgcgggcggct

SEQ ID NO: 231459 - DNA, 20 bp, Artificial Sequence
  Description of Artificial Sequence: Synthetic oligonucleotide
gatggacccgcgggcggcgt

SEQ ID NO: 231460 - DNA, 20 bp, Artificial Sequence
  Description of Artificial Sequence: Synthetic oligonucleotide
atggacccgcgggcggcgtg

SEQ ID NO: 231461 - DNA, 20 bp, Artificial Sequence
  Description of Artificial Sequence: Synthetic oligonucleotide
tggacccgcgggcggcgtgt

SEQ ID NO: 231462 - DNA, 20 bp, Artificial Sequence
  Description of Artificial Sequence: Synthetic oligonucleotide
ggacccgcgggcggcgtgtt

SEQ ID NO: 231463 - DNA, 21 bp, Artificial Sequence
  Description of Artificial Sequence: Synthetic oligonucleotide
gacccgcgggcggcgtggata

SEQ ID NO: 231464 - DNA, 22 bp, Artificial Sequence
  Description of Artificial Sequence: Synthetic oligonucleotide
acccgcgggcggcgtggatagt

SEQ ID NO: 231465 - DNA, 21 bp, Artificial Sequence
  Description of Artificial Sequence: Synthetic oligonucleotide
cccgcgggcggcgtggatagt

SEQ ID NO: 231466 - DNA, 21 bp, Artificial Sequence
  Description of Artificial Sequence: Synthetic oligonucleotide
ccgcgggcggcgtggatagtg

SEQ ID NO: 231467 - DNA, 22 bp, Artificial Sequence
  Description of Artificial Sequence: Synthetic oligonucleotide
cgcgggcggcgtggatagtgca

SEQ ID NO: 231468 - DNA, 22 bp, Artificial Sequence
  Description of Artificial Sequence: Synthetic oligonucleotide
gcgggcggcgtggatagtgcag

SEQ ID NO: 231469 - DNA, 23 bp, Artificial Sequence
  Description of Artificial Sequence: Synthetic oligonucleotide
cgggcggcgtggatagtgcagga

SEQ ID NO: 231470 - DNA, 23 bp, Artificial Sequence
  Description of Artificial Sequence: Synthetic oligonucleotide
gggcggcgtggatagtgcaggag

SEQ ID NO: 231471 - DNA, 23 bp, Artificial Sequence
  Description of Artificial Sequence: Synthetic oligonucleotide
ggcggcgtggatagtgcaggagg

SEQ ID NO: 231472 - DNA, 23 bp, Artificial Sequence
  Description of Artificial Sequence: Synthetic oligonucleotide
gcggcgtggatagtgcaggaggg

SEQ ID NO: 231473 - DNA, 23 bp, Artificial Sequence
  Description of Artificial Sequence: Synthetic oligonucleotide
cggcgtggatagtgcaggagggg

SEQ ID NO: 231474 - DNA, 23 bp, Artificial Sequence
  Description of Artificial Sequence: Synthetic oligonucleotide
ggcgtggatagtgcaggaggggc

SEQ ID NO: 231475 - DNA, 23 bp, Artificial Sequence
  Description of Artificial Sequence: Synthetic oligonucleotide
gcgtggatagtgcaggaggggcg

SEQ ID NO: 231476 - DNA, 23 bp, Artificial Sequence
  Description of Artificial Sequence: Synthetic oligonucleotide
cgtggatagtgcaggaggggcgg

SEQ ID NO: 231477 - DNA, 24 bp, Artificial Sequence
  Description of Artificial Sequence: Synthetic oligonucleotide
gtggatagtgcaggaggggcggga

SEQ ID NO: 231478 - DNA, 27 bp, Artificial Sequence
  Description of Artificial Sequence: Synthetic oligonucleotide
tggatagtgcaggaggggcgggagtat

SEQ ID NO: 231479 - DNA, 27 bp, Artificial Sequence
  Description of Artificial Sequence: Synthetic oligonucleotide
ggatagtgcaggaggggcgggagtata

SEQ ID NO: 231480 - DNA, 27 bp, Artificial Sequence
  Description of Artificial Sequence: Synthetic oligonucleotide
gatagtgcaggaggggcgggagtatag

SEQ ID NO: 231481 - DNA, 27 bp, Artificial Sequence
  Description of Artificial Sequence: Synthetic oligonucleotide
atagtgcaggaggggcgggagtatagg

SEQ ID NO: 231482 - DNA, 26 bp, Artificial Sequence
  Description of Artificial Sequence: Synthetic oligonucleotide
tagtgcaggaggggcgggagtatagg

SEQ ID NO: 231483 - DNA, 25 bp, Artificial Sequence
  Description of Artificial Sequence: Synthetic oligonucleotide
agtgcaggaggggcgggagtatagg

SEQ ID NO: 231484 - DNA, 24 bp, Artificial Sequence
  Description of Artificial Sequence: Synthetic oligonucleotide
gtgcaggaggggcgggagtatagg

SEQ ID NO: 231485 - DNA, 25 bp, Artificial Sequence
  Description of Artificial Sequence: Synthetic oligonucleotide
tgcaggaggggcgggagtataggga

SEQ ID NO: 231486 - DNA, 24 bp, Artificial Sequence
  Description of Artificial Sequence: Synthetic oligonucleotide
gcaggaggggcgggagtataggga

SEQ ID NO: 231487 - DNA, 24 bp, Artificial Sequence
  Description of Artificial Sequence: Synthetic oligonucleotide
caggaggggcgggagtatagggac

SEQ ID NO: 231488 - DNA, 24 bp, Artificial Sequence
  Description of Artificial Sequence: Synthetic oligonucleotide
aggaggggcgggagtatagggacc

SEQ ID NO: 231489 - DNA, 23 bp, Artificial Sequence
  Description of Artificial Sequence: Synthetic oligonucleotide
ggaggggcgggagtatagggacc

SEQ ID NO: 231490 - DNA, 23 bp, Artificial Sequence
  Description of Artificial Sequence: Synthetic oligonucleotide
gaggggcgggagtatagggaccg

SEQ ID NO: 231491 - DNA, 23 bp, Artificial Sequence
  Description of Artificial Sequence: Synthetic oligonucleotide
aggggcgggagtatagggaccgc

SEQ ID NO: 231492 - DNA, 22 bp, Artificial Sequence
  Description of Artificial Sequence: Synthetic oligonucleotide
ggggcgggagtatagggaccgc

SEQ ID NO: 231493 - DNA, 23 bp, Artificial Sequence
  Description of Artificial Sequence: Synthetic oligonucleotide
gggcgggagtatagggaccgcga

SEQ ID NO: 231494 - DNA, 24 bp, Artificial Sequence
  Description of Artificial Sequence: Synthetic oligonucleotide
ggcgggagtatagggaccgcgaga

SEQ ID NO: 231495 - DNA, 25 bp, Artificial Sequence
  Description of Artificial Sequence: Synthetic oligonucleotide
gcgggagtatagggaccgcgagaca

SEQ ID NO: 231496 - DNA, 26 bp, Artificial Sequence
  Description of Artificial Sequence: Synthetic oligonucleotide
cgggagtatagggaccgcgagacaca

SEQ ID NO: 231497 - DNA, 27 bp, Artificial Sequence
  Description of Artificial Sequence: Synthetic oligonucleotide
gggagtatagggaccgcgagacacaca

SEQ ID NO: 231498 - DNA, 28 bp, Artificial Sequence
  Description of Artificial Sequence: Synthetic oligonucleotide
ggagtatagggaccgcgagacacacaac

SEQ ID NO: 231499 - DNA, 30 bp, Artificial Sequence
  Description of Artificial Sequence: Synthetic oligonucleotide
gagtatagggaccgcgagacacacaacttc

SEQ ID NO: 231500 - DNA, 32 bp, Artificial Sequence
  Description of Artificial Sequence: Synthetic oligonucleotide
agtatagggaccgcgagacacacaacttcaag

SEQ ID NO: 231501 - DNA, 31 bp, Artificial Sequence
  Description of Artificial Sequence: Synthetic oligonucleotide
gtatagggaccgcgagacacacaacttcaag

SEQ ID NO: 231502 - DNA, 31 bp, Artificial Sequence
  Description of Artificial Sequence: Synthetic oligonucleotide
tatagggaccgcgagacacacaacttcaagg

SEQ ID NO: 231503 - DNA, 30 bp, Artificial Sequence
  Description of Artificial Sequence: Synthetic oligonucleotide
atagggaccgcgagacacacaacttcaagg

SEQ ID NO: 231504 - DNA, 29 bp, Artificial Sequence
  Description of Artificial Sequence: Synthetic oligonucleotide
tagggaccgcgagacacacaacttcaagg

SEQ ID NO: 231505 - DNA, 28 bp, Artificial Sequence
  Description of Artificial Sequence: Synthetic oligonucleotide
agggaccgcgagacacacaacttcaagg

SEQ ID NO: 231506 - DNA, 27 bp, Artificial Sequence
  Description of Artificial Sequence: Synthetic oligonucleotide
gggaccgcgagacacacaacttcaagg

SEQ ID NO: 231507 - DNA, 27 bp, Artificial Sequence
  Description of Artificial Sequence: Synthetic oligonucleotide
ggaccgcgagacacacaacttcaaggc

SEQ ID NO: 231508 - DNA, 27 bp, Artificial Sequence
  Description of Artificial Sequence: Synthetic oligonucleotide
gaccgcgagacacacaacttcaaggcg

SEQ ID NO: 231509 - DNA, 27 bp, Artificial Sequence
  Description of Artificial Sequence: Synthetic oligonucleotide
accgcgagacacacaacttcaaggcgc

SEQ ID NO: 231510 - DNA, 27 bp, Artificial Sequence
  Description of Artificial Sequence: Synthetic oligonucleotide
ccgcgagacacacaacttcaaggcgca

SEQ ID NO: 231511 - DNA, 27 bp, Artificial Sequence
  Description of Artificial Sequence: Synthetic oligonucleotide
cgcgagacacacaacttcaaggcgcac

SEQ ID NO: 231512 - DNA, 27 bp, Artificial Sequence
  Description of Artificial Sequence: Synthetic oligonucleotide
gcgagacacacaacttcaaggcgcacg

SEQ ID NO: 231513 - DNA, 27 bp, Artificial Sequence
  Description of Artificial Sequence: Synthetic oligonucleotide
cgagacacacaacttcaaggcgcacgc

SEQ ID NO: 231514 - DNA, 28 bp, Artificial Sequence
  Description of Artificial Sequence: Synthetic oligonucleotide
gagacacacaacttcaaggcgcacgcac

SEQ ID NO: 231515 - DNA, 29 bp, Artificial Sequence
  Description of Artificial Sequence: Synthetic oligonucleotide
agacacacaacttcaaggcgcacgcacag

SEQ ID NO: 231516 - DNA, 28 bp, Artificial Sequence
  Description of Artificial Sequence: Synthetic oligonucleotide
gacacacaacttcaaggcgcacgcacag

SEQ ID NO: 231517 - DNA, 29 bp, Artificial Sequence
  Description of Artificial Sequence: Synthetic oligonucleotide
acacacaacttcaaggcgcacgcacagac

SEQ ID NO: 231518 - DNA, 28 bp, Artificial Sequence
  Description of Artificial Sequence: Synthetic oligonucleotide
cacacaacttcaaggcgcacgcacagac

SEQ ID NO: 231519 - DNA, 29 bp, Artificial Sequence
  Description of Artificial Sequence: Synthetic oligonucleotide
acacaacttcaaggcgcacgcacagacag

SEQ ID NO: 231520 - DNA, 28 bp, Artificial Sequence
  Description of Artificial Sequence: Synthetic oligonucleotide
cacaacttcaaggcgcacgcacagacag

SEQ ID NO: 231521 - DNA, 29 bp, Artificial Sequence
  Description of Artificial Sequence: Synthetic oligonucleotide
acaacttcaaggcgcacgcacagacagac

SEQ ID NO: 231522 - DNA, 28 bp, Artificial Sequence
  Description of Artificial Sequence: Synthetic oligonucleotide
caacttcaaggcgcacgcacagacagac

SEQ ID NO: 231523 - DNA, 28 bp, Artificial Sequence
  Description of Artificial Sequence: Synthetic oligonucleotide
aacttcaaggcgcacgcacagacagacc

SEQ ID NO: 231524 - DNA, 27 bp, Artificial Sequence
  Description of Artificial Sequence: Synthetic oligonucleotide
acttcaaggcgcacgcacagacagacc

SEQ ID NO: 231525 - DNA, 26 bp, Artificial Sequence
  Description of Artificial Sequence: Synthetic oligonucleotide
cttcaaggcgcacgcacagacagacc

SEQ ID NO: 231526 - DNA, 27 bp, Artificial Sequence
  Description of Artificial Sequence: Synthetic oligonucleotide
ttcaaggcgcacgcacagacagaccga

SEQ ID NO: 231527 - DNA, 26 bp, Artificial Sequence
  Description of Artificial Sequence: Synthetic oligonucleotide
tcaaggcgcacgcacagacagaccga

SEQ ID NO: 231528 - DNA, 25 bp, Artificial Sequence
  Description of Artificial Sequence: Synthetic oligonucleotide
caaggcgcacgcacagacagaccga

SEQ ID NO: 231529 - DNA, 26 bp, Artificial Sequence
  Description of Artificial Sequence: Synthetic oligonucleotide
aaggcgcacgcacagacagaccgaga

SEQ ID NO: 231530 - DNA, 25 bp, Artificial Sequence
  Description of Artificial Sequence: Synthetic oligonucleotide
aggcgcacgcacagacagaccgaga

SEQ ID NO: 231531 - DNA, 24 bp, Artificial Sequence
  Description of Artificial Sequence: Synthetic oligonucleotide
ggcgcacgcacagacagaccgaga

SEQ ID NO: 231532 - DNA, 26 bp, Artificial Sequence
  Description of Artificial Sequence: Synthetic oligonucleotide
gcgcacgcacagacagaccgagacaa

SEQ ID NO: 231533 - DNA, 26 bp, Artificial Sequence
  Description of Artificial Sequence: Synthetic oligonucleotide
cgcacgcacagacagaccgagacaac

SEQ ID NO: 231534 - DNA, 27 bp, Artificial Sequence
  Description of Artificial Sequence: Synthetic oligonucleotide
gcacgcacagacagaccgagacaacct

SEQ ID NO: 231535 - DNA, 27 bp, Artificial Sequence
  Description of Artificial Sequence: Synthetic oligonucleotide
cacgcacagacagaccgagacaacctg

SEQ ID NO: 231536 - DNA, 27 bp, Artificial Sequence
  Description of Artificial Sequence: Synthetic oligonucleotide
acgcacagacagaccgagacaacctgc

SEQ ID NO: 231537 - DNA, 26 bp, Artificial Sequence
  Description of Artificial Sequence: Synthetic oligonucleotide
cgcacagacagaccgagacaacctgc

SEQ ID NO: 231538 - DNA, 26 bp, Artificial Sequence
  Description of Artificial Sequence: Synthetic oligonucleotide
gcacagacagaccgagacaacctgcg

SEQ ID NO: 231539 - DNA, 27 bp, Artificial Sequence
  Description of Artificial Sequence: Synthetic oligonucleotide
cacagacagaccgagacaacctgcggt

SEQ ID NO: 231540 - DNA, 28 bp, Artificial Sequence
  Description of Artificial Sequence: Synthetic oligonucleotide
acagacagaccgagacaacctgcggtac

SEQ ID NO: 231541 - DNA, 27 bp, Artificial Sequence
  Description of Artificial Sequence: Synthetic oligonucleotide
cagacagaccgagacaacctgcggtac

SEQ ID NO: 231542 - DNA, 27 bp, Artificial Sequence
  Description of Artificial Sequence: Synthetic oligonucleotide
agacagaccgagacaacctgcggtacc

SEQ ID NO: 231543 - DNA, 27 bp, Artificial Sequence
  Description of Artificial Sequence: Synthetic oligonucleotide
gacagaccgagacaacctgcggtacct

SEQ ID NO: 231544 - DNA, 27 bp, Artificial Sequence
  Description of Artificial Sequence: Synthetic oligonucleotide
acagaccgagacaacctgcggtacctg

SEQ ID NO: 231545 - DNA, 26 bp, Artificial Sequence
  Description of Artificial Sequence: Synthetic oligonucleotide
cagaccgagacaacctgcggtacctg

SEQ ID NO: 231546 - DNA, 26 bp, Artificial Sequence
  Description of Artificial Sequence: Synthetic oligonucleotide
agaccgagacaacctgcggtacctgc

SEQ ID NO: 231547 - DNA, 25 bp, Artificial Sequence
  Description of Artificial Sequence: Synthetic oligonucleotide
gaccgagacaacctgcggtacctgc

SEQ ID NO: 231548 - DNA, 25 bp, Artificial Sequence
  Description of Artificial Sequence: Synthetic oligonucleotide
accgagacaacctgcggtacctgcg

SEQ ID NO: 231549 - DNA, 24 bp, Artificial Sequence
  Description of Artificial Sequence: Synthetic oligonucleotide
ccgagacaacctgcggtacctgcg

SEQ ID NO: 231550 - DNA, 24 bp, Artificial Sequence
  Description of Artificial Sequence: Synthetic oligonucleotide
cgagacaacctgcggtacctgcgc

SEQ ID NO: 231551 - DNA, 24 bp, Artificial Sequence
  Description of Artificial Sequence: Synthetic oligonucleotide
gagacaacctgcggtacctgcgcg

SEQ ID NO: 231552 - DNA, 24 bp, Artificial Sequence
  Description of Artificial Sequence: Synthetic oligonucleotide
agacaacctgcggtacctgcgcgc

SEQ ID NO: 231553 - DNA, 23 bp, Artificial Sequence
  Description of Artificial Sequence: Synthetic oligonucleotide
gacaacctgcggtacctgcgcgc

SEQ ID NO: 231554 - DNA, 25 bp, Artificial Sequence
  Description of Artificial Sequence: Synthetic oligonucleotide
acaacctgcggtacctgcgcgccta

SEQ ID NO: 231555 - DNA, 24 bp, Artificial Sequence
  Description of Artificial Sequence: Synthetic oligonucleotide
caacctgcggtacctgcgcgccta

SEQ ID NO: 231556 - DNA, 26 bp, Artificial Sequence
  Description of Artificial Sequence: Synthetic oligonucleotide
aacctgcggtacctgcgcgcctacta

SEQ ID NO: 231557 - DNA, 25 bp, Artificial Sequence
  Description of Artificial Sequence: Synthetic oligonucleotide
acctgcggtacctgcgcgcctacta

SEQ ID NO: 231558 - DNA, 24 bp, Artificial Sequence
  Description of Artificial Sequence: Synthetic oligonucleotide
cctgcggtacctgcgcgcctacta

SEQ ID NO: 231559 - DNA, 26 bp, Artificial Sequence
  Description of Artificial Sequence: Synthetic oligonucleotide
ctgcggtacctgcgcgcctactacat

SEQ ID NO: 231560 - DNA, 26 bp, Artificial Sequence
  Description of Artificial Sequence: Synthetic oligonucleotide
tgcggtacctgcgcgcctactacatc

SEQ ID NO: 231561 - DNA, 25 bp, Artificial Sequence
  Description of Artificial Sequence: Synthetic oligonucleotide
gcggtacctgcgcgcctactacatc

SEQ ID NO: 231562 - DNA, 26 bp, Artificial Sequence
  Description of Artificial Sequence: Synthetic oligonucleotide
cggtacctgcgcgcctactacatcca

SEQ ID NO: 231563 - DNA, 27 bp, Artificial Sequence
  Description of Artificial Sequence: Synthetic oligonucleotide
ggtacctgcgcgcctactacatccaga

SEQ ID NO: 231564 - DNA, 27 bp, Artificial Sequence
  Description of Artificial Sequence: Synthetic oligonucleotide
gtacctgcgcgcctactacatccagag

SEQ ID NO: 231565 - DNA, 27 bp, Artificial Sequence
  Description of Artificial Sequence: Synthetic oligonucleotide
tacctgcgcgcctactacatccagagc

SEQ ID NO: 231566 - DNA, 26 bp, Artificial Sequence
  Description of Artificial Sequence: Synthetic oligonucleotide
acctgcgcgcctactacatccagagc

SEQ ID NO: 231567 - DNA, 25 bp, Artificial Sequence
  Description of Artificial Sequence: Synthetic oligonucleotide
cctgcgcgcctactacatccagagc

SEQ ID NO: 231568 - DNA, 26 bp, Artificial Sequence
  Description of Artificial Sequence: Synthetic oligonucleotide
ctgcgcgcctactacatccagagcga

SEQ ID NO: 231569 - DNA, 26 bp, Artificial Sequence
  Description of Artificial Sequence: Synthetic oligonucleotide
tgcgcgcctactacatccagagcgag

SEQ ID NO: 231570 - DNA, 25 bp, Artificial Sequence
  Description of Artificial Sequence: Synthetic oligonucleotide
gcgcgcctactacatccagagcgag

SEQ ID NO: 231571 - DNA, 25 bp, Artificial Sequence
  Description of Artificial Sequence: Synthetic oligonucleotide
cgcgcctactacatccagagcgagc

SEQ ID NO: 231572 - DNA, 25 bp, Artificial Sequence
  Description of Artificial Sequence: Synthetic oligonucleotide
gcgcctactacatccagagcgagcc

SEQ ID NO: 231573 - DNA, 25 bp, Artificial Sequence
  Description of Artificial Sequence: Synthetic oligonucleotide
cgcctactacatccagagcgagccc

SEQ ID NO: 231574 - DNA, 25 bp, Artificial Sequence
  Description of Artificial Sequence: Synthetic oligonucleotide
gcctactacatccagagcgagcccg

SEQ ID NO: 231575 - DNA, 25 bp, Artificial Sequence
  Description of Artificial Sequence: Synthetic oligonucleotide
cctactacatccagagcgagcccgg

SEQ ID NO: 231576 - DNA, 26 bp, Artificial Sequence
  Description of Artificial Sequence: Synthetic oligonucleotide
ctactacatccagagcgagcccgggt

SEQ ID NO: 231577 - DNA, 27 bp, Artificial Sequence
  Description of Artificial Sequence: Synthetic oligonucleotide
tactacatccagagcgagcccgggtct

SEQ ID NO: 231578 - DNA, 26 bp, Artificial Sequence
  Description of Artificial Sequence: Synthetic oligonucleotide
actacatccagagcgagcccgggtct

SEQ ID NO: 231579 - DNA, 25 bp, Artificial Sequence
  Description of Artificial Sequence: Synthetic oligonucleotide
ctacatccagagcgagcccgggtct

SEQ ID NO: 231580 - DNA, 26 bp, Artificial Sequence
  Description of Artificial Sequence: Synthetic oligonucleotide
tacatccagagcgagcccgggtctct

SEQ ID NO: 231581 - DNA, 25 bp, Artificial Sequence
  Description of Artificial Sequence: Synthetic oligonucleotide
acatccagagcgagcccgggtctct

SEQ ID NO: 231582 - DNA, 24 bp, Artificial Sequence
  Description of Artificial Sequence: Synthetic oligonucleotide
catccagagcgagcccgggtctct

SEQ ID NO: 231583 - DNA, 25 bp, Artificial Sequence
  Description of Artificial Sequence: Synthetic oligonucleotide
atccagagcgagcccgggtctctca

SEQ ID NO: 231584 - DNA, 24 bp, Artificial Sequence
  Description of Artificial Sequence: Synthetic oligonucleotide
tccagagcgagcccgggtctctca

SEQ ID NO: 231585 - DNA, 23 bp, Artificial Sequence
  Description of Artificial Sequence: Synthetic oligonucleotide
ccagagcgagcccgggtctctca

SEQ ID NO: 231586 - DNA, 23 bp, Artificial Sequence
  Description of Artificial Sequence: Synthetic oligonucleotide
cagagcgagcccgggtctctcac

SEQ ID NO: 231587 - DNA, 23 bp, Artificial Sequence
  Description of Artificial Sequence: Synthetic oligonucleotide
agagcgagcccgggtctctcacc

SEQ ID NO: 231588 - DNA, 22 bp, Artificial Sequence
  Description of Artificial Sequence: Synthetic oligonucleotide
gagcgagcccgggtctctcacc

SEQ ID NO: 231589 - DNA, 23 bp, Artificial Sequence
  Description of Artificial Sequence: Synthetic oligonucleotide
agcgagcccgggtctctcaccct

SEQ ID NO: 231590 - DNA, 22 bp, Artificial Sequence
  Description of Artificial Sequence: Synthetic oligonucleotide
gcgagcccgggtctctcaccct

SEQ ID NO: 231591 - DNA, 22 bp, Artificial Sequence
  Description of Artificial Sequence: Synthetic oligonucleotide
cgagcccgggtctctcaccctc

SEQ ID NO: 231592 - DNA, 23 bp, Artificial Sequence
  Description of Artificial Sequence: Synthetic oligonucleotide
gagcccgggtctctcaccctcca

SEQ ID NO: 231593 - DNA, 24 bp, Artificial Sequence
  Description of Artificial Sequence: Synthetic oligonucleotide
agcccgggtctctcaccctccaca

SEQ ID NO: 231594 - DNA, 23 bp, Artificial Sequence
  Description of Artificial Sequence: Synthetic oligonucleotide
gcccgggtctctcaccctccaca

SEQ ID NO: 231595 - DNA, 23 bp, Artificial Sequence
  Description of Artificial Sequence: Synthetic oligonucleotide
cccgggtctctcaccctccacag

SEQ ID NO: 231596 - DNA, 25 bp, Artificial Sequence
  Description of Artificial Sequence: Synthetic oligonucleotide
ccgggtctctcaccctccacaggat

SEQ ID NO: 231597 - DNA, 27 bp, Artificial Sequence
  Description of Artificial Sequence: Synthetic oligonucleotide
cgggtctctcaccctccacaggatgta

SEQ ID NO: 231598 - DNA, 28 bp, Artificial Sequence
  Description of Artificial Sequence: Synthetic oligonucleotide
gggtctctcaccctccacaggatgtatc

SEQ ID NO: 231599 - DNA, 28 bp, Artificial Sequence
  Description of Artificial Sequence: Synthetic oligonucleotide
ggtctctcaccctccacaggatgtatcg

SEQ ID NO: 231600 - DNA, 28 bp, Artificial Sequence
  Description of Artificial Sequence: Synthetic oligonucleotide
gtctctcaccctccacaggatgtatcgc

SEQ ID NO: 231601 - DNA, 29 bp, Artificial Sequence
  Description of Artificial Sequence: Synthetic oligonucleotide
tctctcaccctccacaggatgtatcgctg

SEQ ID NO: 231602 - DNA, 28 bp, Artificial Sequence
  Description of Artificial Sequence: Synthetic oligonucleotide
ctctcaccctccacaggatgtatcgctg

SEQ ID NO: 231603 - DNA, 28 bp, Artificial Sequence
  Description of Artificial Sequence: Synthetic oligonucleotide
tctcaccctccacaggatgtatcgctgc

SEQ ID NO: 231604 - DNA, 27 bp, Artificial Sequence
  Description of Artificial Sequence: Synthetic oligonucleotide
ctcaccctccacaggatgtatcgctgc

SEQ ID NO: 231605 - DNA, 27 bp, Artificial Sequence
  Description of Artificial Sequence: Synthetic oligonucleotide
tcaccctccacaggatgtatcgctgcg

SEQ ID NO: 231606 - DNA, 27 bp, Artificial Sequence
  Description of Artificial Sequence: Synthetic oligonucleotide
caccctccacaggatgtatcgctgcga

SEQ ID NO: 231607 - DNA, 27 bp, Artificial Sequence
  Description of Artificial Sequence: Synthetic oligonucleotide
accctccacaggatgtatcgctgcgac

SEQ ID NO: 231608 - DNA, 26 bp, Artificial Sequence
  Description of Artificial Sequence: Synthetic oligonucleotide
ccctccacaggatgtatcgctgcgac

SEQ ID NO: 231609 - DNA, 27 bp, Artificial Sequence
  Description of Artificial Sequence: Synthetic oligonucleotide
cctccacaggatgtatcgctgcgacga

SEQ ID NO: 231610 - DNA, 27 bp, Artificial Sequence
  Description of Artificial Sequence: Synthetic oligonucleotide
ctccacaggatgtatcgctgcgacgag

SEQ ID NO: 231611 - DNA, 27 bp, Artificial Sequence
  Description of Artificial Sequence: Synthetic oligonucleotide
tccacaggatgtatcgctgcgacgagg

SEQ ID NO: 231612 - DNA, 26 bp, Artificial Sequence
  Description of Artificial Sequence: Synthetic oligonucleotide
ccacaggatgtatcgctgcgacgagg

SEQ ID NO: 231613 - DNA, 26 bp, Artificial Sequence
  Description of Artificial Sequence: Synthetic oligonucleotide
cacaggatgtatcgctgcgacgaggg

SEQ ID NO: 231614 - DNA, 26 bp, Artificial Sequence
  Description of Artificial Sequence: Synthetic oligonucleotide
acaggatgtatcgctgcgacgagggg

SEQ ID NO: 231615 - DNA, 25 bp, Artificial Sequence
  Description of Artificial Sequence: Synthetic oligonucleotide
caggatgtatcgctgcgacgagggg

SEQ ID NO: 231616 - DNA, 25 bp, Artificial Sequence
  Description of Artificial Sequence: Synthetic oligonucleotide
aggatgtatcgctgcgacgaggggc

SEQ ID NO: 231617 - DNA, 24 bp, Artificial Sequence
  Description of Artificial Sequence: Synthetic oligonucleotide
ggatgtatcgctgcgacgaggggc

SEQ ID NO: 231618 - DNA, 24 bp, Artificial Sequence
  Description of Artificial Sequence: Synthetic oligonucleotide
gatgtatcgctgcgacgaggggcc

SEQ ID NO: 231619 - DNA, 24 bp, Artificial Sequence
  Description of Artificial Sequence: Synthetic oligonucleotide
atgtatcgctgcgacgaggggccg

SEQ ID NO: 231620 - DNA, 23 bp, Artificial Sequence
  Description of Artificial Sequence: Synthetic oligonucleotide
tgtatcgctgcgacgaggggccg

SEQ ID NO: 231621 - DNA, 22 bp, Artificial Sequence
  Description of Artificial Sequence: Synthetic oligonucleotide
gtatcgctgcgacgaggggccg

SEQ ID NO: 231622 - DNA, 23 bp, Artificial Sequence
  Description of Artificial Sequence: Synthetic oligonucleotide
tatcgctgcgacgaggggccgga

SEQ ID NO: 231623 - DNA, 22 bp, Artificial Sequence
  Description of Artificial Sequence: Synthetic oligonucleotide
atcgctgcgacgaggggccgga

SEQ ID NO: 231624 - DNA, 21 bp, Artificial Sequence
  Description of Artificial Sequence: Synthetic oligonucleotide
tcgctgcgacgaggggccgga

SEQ ID NO: 231625 - DNA, 20 bp, Artificial Sequence
  Description of Artificial Sequence: Synthetic oligonucleotide
cgctgcgacgaggggccgga

SEQ ID NO: 231626 - DNA, 20 bp, Artificial Sequence
  Description of Artificial Sequence: Synthetic oligonucleotide
gctgcgacgaggggccggag

SEQ ID NO: 231627 - DNA, 20 bp, Artificial Sequence
  Description of Artificial Sequence: Synthetic oligonucleotide
ctgcgacgaggggccggagg

SEQ ID NO: 231628 - DNA, 20 bp, Artificial Sequence
  Description of Artificial Sequence: Synthetic oligonucleotide
tgcgacgaggggccggaggg

SEQ ID NO: 231629 - DNA, 20 bp, Artificial Sequence
  Description of Artificial Sequence: Synthetic oligonucleotide
gcgacgaggggccggagggt

SEQ ID NO: 231630 - DNA, 20 bp, Artificial Sequence
  Description of Artificial Sequence: Synthetic oligonucleotide
cgacgaggggccggaggggt

SEQ ID NO: 231631 - DNA, 20 bp, Artificial Sequence
  Description of Artificial Sequence: Synthetic oligonucleotide
gacgaggggccggaggggct

SEQ ID NO: 231632 - DNA, 20 bp, Artificial Sequence
  Description of Artificial Sequence: Synthetic oligonucleotide
acgaggggccggaggggcgt

SEQ ID NO: 231633 - DNA, 20 bp, Artificial Sequence
  Description of Artificial Sequence: Synthetic oligonucleotide
cgaggggccggaggggcgtt

SEQ ID NO: 231634 - DNA, 20 bp, Artificial Sequence
  Description of Artificial Sequence: Synthetic oligonucleotide
gaggggccggaggggcgctt

SEQ ID NO: 231635 - DNA, 20 bp, Artificial Sequence
  Description of Artificial Sequence: Synthetic oligonucleotide
aggggccggaggggcgcctt

SEQ ID NO: 231636 - DNA, 20 bp, Artificial Sequence
  Description of Artificial Sequence: Synthetic oligonucleotide
ggggccggaggggcgccttt

SEQ ID NO: 231637 - DNA, 20 bp, Artificial Sequence
  Description of Artificial Sequence: Synthetic oligonucleotide
gggccggaggggcgcctctt

SEQ ID NO: 231638 - DNA, 20 bp, Artificial Sequence
  Description of Artificial Sequence: Synthetic oligonucleotide
ggccggaggggcgcctccat

SEQ ID NO: 231639 - DNA, 20 bp, Artificial Sequence
  Description of Artificial Sequence: Synthetic oligonucleotide
gccggaggggcgcctccact

SEQ ID NO: 231640 - DNA, 20 bp, Artificial Sequence
  Description of Artificial Sequence: Synthetic oligonucleotide
ccggaggggcgcctccacct

SEQ ID NO: 231641 - DNA, 20 bp, Artificial Sequence
  Description of Artificial Sequence: Synthetic oligonucleotide
cggaggggcgcctccaccgt

SEQ ID NO: 231642 - DNA, 20 bp, Artificial Sequence
  Description of Artificial Sequence: Synthetic oligonucleotide
ggaggggcgcctccaccgct

SEQ ID NO: 231643 - DNA, 20 bp, Artificial Sequence
  Description of Artificial Sequence: Synthetic oligonucleotide
gaggggcgcctccaccgcgt

SEQ ID NO: 231644 - DNA, 20 bp, Artificial Sequence
  Description of Artificial Sequence: Synthetic oligonucleotide
aggggcgcctccaccgcggt

SEQ ID NO: 231645 - DNA, 20 bp, Artificial Sequence
  Description of Artificial Sequence: Synthetic oligonucleotide
ggggcgcctccaccgcggtt

SEQ ID NO: 231646 - DNA, 21 bp, Artificial Sequence
  Description of Artificial Sequence: Synthetic oligonucleotide
gggcgcctccaccgcggctat

SEQ ID NO: 231647 - DNA, 22 bp, Artificial Sequence
  Description of Artificial Sequence: Synthetic oligonucleotide
ggcgcctccaccgcggctatga

SEQ ID NO: 231648 - DNA, 22 bp, Artificial Sequence
  Description of Artificial Sequence: Synthetic oligonucleotide
gcgcctccaccgcggctatgac

SEQ ID NO: 231649 - DNA, 23 bp, Artificial Sequence
  Description of Artificial Sequence: Synthetic oligonucleotide
cgcctccaccgcggctatgacca

SEQ ID NO: 231650 - DNA, 25 bp, Artificial Sequence
  Description of Artificial Sequence: Synthetic oligonucleotide
gcctccaccgcggctatgaccacta

SEQ ID NO: 231651 - DNA, 25 bp, Artificial Sequence
  Description of Artificial Sequence: Synthetic oligonucleotide
cctccaccgcggctatgaccactac

SEQ ID NO: 231652 - DNA, 25 bp, Artificial Sequence
  Description of Artificial Sequence: Synthetic oligonucleotide
ctccaccgcggctatgaccactacg

SEQ ID NO: 231653 - DNA, 25 bp, Artificial Sequence
  Description of Artificial Sequence: Synthetic oligonucleotide
tccaccgcggctatgaccactacgc

SEQ ID NO: 231654 - DNA, 24 bp, Artificial Sequence
  Description of Artificial Sequence: Synthetic oligonucleotide
ccaccgcggctatgaccactacgc

SEQ ID NO: 231655 - DNA, 26 bp, Artificial Sequence
  Description of Artificial Sequence: Synthetic oligonucleotide
caccgcggctatgaccactacgccta

SEQ ID NO: 231656 - DNA, 26 bp, Artificial Sequence
  Description of Artificial Sequence: Synthetic oligonucleotide
accgcggctatgaccactacgcctac

SEQ ID NO: 231657 - DNA, 25 bp, Artificial Sequence
  Description of Artificial Sequence: Synthetic oligonucleotide
ccgcggctatgaccactacgcctac

SEQ ID NO: 231658 - DNA, 26 bp, Artificial Sequence
  Description of Artificial Sequence: Synthetic oligonucleotide
cgcggctatgaccactacgcctacga

SEQ ID NO: 231659 - DNA, 26 bp, Artificial Sequence
  Description of Artificial Sequence: Synthetic oligonucleotide
gcggctatgaccactacgcctacgac

SEQ ID NO: 231660 - DNA, 26 bp, Artificial Sequence
  Description of Artificial Sequence: Synthetic oligonucleotide
cggctatgaccactacgcctacgacc

SEQ ID NO: 231661 - DNA, 26 bp, Artificial Sequence
  Description of Artificial Sequence: Synthetic oligonucleotide
ggctatgaccactacgcctacgaccg

SEQ ID NO: 231662 - DNA, 27 bp, Artificial Sequence
  Description of Artificial Sequence: Synthetic oligonucleotide
gctatgaccactacgcctacgaccgca

SEQ ID NO: 231663 - DNA, 28 bp, Artificial Sequence
  Description of Artificial Sequence: Synthetic oligonucleotide
ctatgaccactacgcctacgaccgcaag

SEQ ID NO: 231664 - DNA, 28 bp, Artificial Sequence
  Description of Artificial Sequence: Synthetic oligonucleotide
tatgaccactacgcctacgaccgcaagg

SEQ ID NO: 231665 - DNA, 27 bp, Artificial Sequence
  Description of Artificial Sequence: Synthetic oligonucleotide
atgaccactacgcctacgaccgcaagg

SEQ ID NO: 231666 - DNA, 27 bp, Artificial Sequence
  Description of Artificial Sequence: Synthetic oligonucleotide
tgaccactacgcctacgaccgcaagga

SEQ ID NO: 231667 - DNA, 27 bp, Artificial Sequence
  Description of Artificial Sequence: Synthetic oligonucleotide
gaccactacgcctacgaccgcaaggat

SEQ ID NO: 231668 - DNA, 29 bp, Artificial Sequence
  Description of Artificial Sequence: Synthetic oligonucleotide
accactacgcctacgaccgcaaggatttc

SEQ ID NO: 231669 - DNA, 28 bp, Artificial Sequence
  Description of Artificial Sequence: Synthetic oligonucleotide
ccactacgcctacgaccgcaaggatttc

SEQ ID NO: 231670 - DNA, 30 bp, Artificial Sequence
  Description of Artificial Sequence: Synthetic oligonucleotide
cactacgcctacgaccgcaaggatttcatc

SEQ ID NO: 231671 - DNA, 30 bp, Artificial Sequence
  Description of Artificial Sequence: Synthetic oligonucleotide
actacgcctacgaccgcaaggatttcatcg

SEQ ID NO: 231672 - DNA, 29 bp, Artificial Sequence
  Description of Artificial Sequence: Synthetic oligonucleotide
ctacgcctacgaccgcaaggatttcatcg

SEQ ID NO: 231673 - DNA, 29 bp, Artificial Sequence
  Description of Artificial Sequence: Synthetic oligonucleotide
tacgcctacgaccgcaaggatttcatcgc

SEQ ID NO: 231674 - DNA, 28 bp, Artificial Sequence
  Description of Artificial Sequence: Synthetic oligonucleotide
acgcctacgaccgcaaggatttcatcgc

SEQ ID NO: 231675 - DNA, 27 bp, Artificial Sequence
  Description of Artificial Sequence: Synthetic oligonucleotide
cgcctacgaccgcaaggatttcatcgc

SEQ ID NO: 231676 - DNA, 27 bp, Artificial Sequence
  Description of Artificial Sequence: Synthetic oligonucleotide
gcctacgaccgcaaggatttcatcgcc

SEQ ID NO: 231677 - DNA, 27 bp, Artificial Sequence
  Description of Artificial Sequence: Synthetic oligonucleotide
cctacgaccgcaaggatttcatcgccc

SEQ ID NO: 231678 - DNA, 28 bp, Artificial Sequence
  Description of Artificial Sequence: Synthetic oligonucleotide
ctacgaccgcaaggatttcatcgccctc

SEQ ID NO: 231679 - DNA, 30 bp, Artificial Sequence
  Description of Artificial Sequence: Synthetic oligonucleotide
tacgaccgcaaggatttcatcgccctcaac

SEQ ID NO: 231680 - DNA, 29 bp, Artificial Sequence
  Description of Artificial Sequence: Synthetic oligonucleotide
acgaccgcaaggatttcatcgccctcaac

SEQ ID NO: 231681 - DNA, 28 bp, Artificial Sequence
  Description of Artificial Sequence: Synthetic oligonucleotide
cgaccgcaaggatttcatcgccctcaac

SEQ ID NO: 231682 - DNA, 28 bp, Artificial Sequence
  Description of Artificial Sequence: Synthetic oligonucleotide
gaccgcaaggatttcatcgccctcaacg

SEQ ID NO: 231683 - DNA, 29 bp, Artificial Sequence
  Description of Artificial Sequence: Synthetic oligonucleotide
accgcaaggatttcatcgccctcaacgag

SEQ ID NO: 231684 - DNA, 28 bp, Artificial Sequence
  Description of Artificial Sequence: Synthetic oligonucleotide
ccgcaaggatttcatcgccctcaacgag

SEQ ID NO: 231685 - DNA, 28 bp, Artificial Sequence
  Description of Artificial Sequence: Synthetic oligonucleotide
cgcaaggatttcatcgccctcaacgagg

SEQ ID NO: 231686 - DNA, 29 bp, Artificial Sequence
  Description of Artificial Sequence: Synthetic oligonucleotide
gcaaggatttcatcgccctcaacgaggac

SEQ ID NO: 231687 - DNA, 29 bp, Artificial Sequence
  Description of Artificial Sequence: Synthetic oligonucleotide
caaggatttcatcgccctcaacgaggacc

SEQ ID NO: 231688 - DNA, 30 bp, Artificial Sequence
  Description of Artificial Sequence: Synthetic oligonucleotide
aaggatttcatcgccctcaacgaggaccag

SEQ ID NO: 231689 - DNA, 29 bp, Artificial Sequence
  Description of Artificial Sequence: Synthetic oligonucleotide
aggatttcatcgccctcaacgaggaccag

SEQ ID NO: 231690 - DNA, 28 bp, Artificial Sequence
  Description of Artificial Sequence: Synthetic oligonucleotide
ggatttcatcgccctcaacgaggaccag

SEQ ID NO: 231691 - DNA, 28 bp, Artificial Sequence
  Description of Artificial Sequence: Synthetic oligonucleotide
gatttcatcgccctcaacgaggaccagc

SEQ ID NO: 231692 - DNA, 28 bp, Artificial Sequence
  Description of Artificial Sequence: Synthetic oligonucleotide
atttcatcgccctcaacgaggaccagcg

SEQ ID NO: 231693 - DNA, 27 bp, Artificial Sequence
  Description of Artificial Sequence: Synthetic oligonucleotide
tttcatcgccctcaacgaggaccagcg

SEQ ID NO: 231694 - DNA, 26 bp, Artificial Sequence
  Description of Artificial Sequence: Synthetic oligonucleotide
ttcatcgccctcaacgaggaccagcg

SEQ ID NO: 231695 - DNA, 25 bp, Artificial Sequence
  Description of Artificial Sequence: Synthetic oligonucleotide
tcatcgccctcaacgaggaccagcg

SEQ ID NO: 231696 - DNA, 24 bp, Artificial Sequence
  Description of Artificial Sequence: Synthetic oligonucleotide
catcgccctcaacgaggaccagcg

SEQ ID NO: 231697 - DNA, 25 bp, Artificial Sequence
  Description of Artificial Sequence: Synthetic oligonucleotide
atcgccctcaacgaggaccagcgct

SEQ ID NO: 231698 - DNA, 24 bp, Artificial Sequence
  Description of Artificial Sequence: Synthetic oligonucleotide
tcgccctcaacgaggaccagcgct

SEQ ID NO: 231699 - DNA, 23 bp, Artificial Sequence
  Description of Artificial Sequence: Synthetic oligonucleotide
cgccctcaacgaggaccagcgct

SEQ ID NO: 231700 - DNA, 23 bp, Artificial Sequence
  Description of Artificial Sequence: Synthetic oligonucleotide
gccctcaacgaggaccagcgctc

SEQ ID NO: 231701 - DNA, 24 bp, Artificial Sequence
  Description of Artificial Sequence: Synthetic oligonucleotide
ccctcaacgaggaccagcgctcct

SEQ ID NO: 231702 - DNA, 24 bp, Artificial Sequence
  Description of Artificial Sequence: Synthetic oligonucleotide
cctcaacgaggaccagcgctcctc

SEQ ID NO: 231703 - DNA, 25 bp, Artificial Sequence
  Description of Artificial Sequence: Synthetic oligonucleotide
ctcaacgaggaccagcgctcctcga

SEQ ID NO: 231704 - DNA, 25 bp, Artificial Sequence
  Description of Artificial Sequence: Synthetic oligonucleotide
tcaacgaggaccagcgctcctcgac

SEQ ID NO: 231705 - DNA, 24 bp, Artificial Sequence
  Description of Artificial Sequence: Synthetic oligonucleotide
caacgaggaccagcgctcctcgac

SEQ ID NO: 231706 - DNA, 24 bp, Artificial Sequence
  Description of Artificial Sequence: Synthetic oligonucleotide
aacgaggaccagcgctcctcgacc

SEQ ID NO: 231707 - DNA, 23 bp, Artificial Sequence
  Description of Artificial Sequence: Synthetic oligonucleotide
acgaggaccagcgctcctcgacc

SEQ ID NO: 231708 - DNA, 22 bp, Artificial Sequence
  Description of Artificial Sequence: Synthetic oligonucleotide
cgaggaccagcgctcctcgacc

SEQ ID NO: 231709 - DNA, 22 bp, Artificial Sequence
  Description of Artificial Sequence: Synthetic oligonucleotide
gaggaccagcgctcctcgaccg

SEQ ID NO: 231710 - DNA, 22 bp, Artificial Sequence
  Description of Artificial Sequence: Synthetic oligonucleotide
aggaccagcgctcctcgaccgc

SEQ ID NO: 231711 - DNA, 21 bp, Artificial Sequence
  Description of Artificial Sequence: Synthetic oligonucleotide
ggaccagcgctcctcgaccgc

SEQ ID NO: 231712 - DNA, 21 bp, Artificial Sequence
  Description of Artificial Sequence: Synthetic oligonucleotide
gaccagcgctcctcgaccgcg

SEQ ID NO: 231713 - DNA, 21 bp, Artificial Sequence
  Description of Artificial Sequence: Synthetic oligonucleotide
accagcgctcctcgaccgcgg

SEQ ID NO: 231714 - DNA, 20 bp, Artificial Sequence
  Description of Artificial Sequence: Synthetic oligonucleotide
ccagcgctcctcgaccgcgg

SEQ ID NO: 231715 - DNA, 20 bp, Artificial Sequence
  Description of Artificial Sequence: Synthetic oligonucleotide
cagcgctcctcgaccgcggc

SEQ ID NO: 231716 - DNA, 20 bp, Artificial Sequence
  Description of Artificial Sequence: Synthetic oligonucleotide
agcgctcctcgaccgcggcc

SEQ ID NO: 231717 - DNA, 20 bp, Artificial Sequence
  Description of Artificial Sequence: Synthetic oligonucleotide
gcgctcctcgaccgcggcct

SEQ ID NO: 231718 - DNA, 20 bp, Artificial Sequence
  Description of Artificial Sequence: Synthetic oligonucleotide
cgctcctcgaccgcggccga

SEQ ID NO: 231719 - DNA, 21 bp, Artificial Sequence
  Description of Artificial Sequence: Synthetic oligonucleotide
gctcctcgaccgcggccgaca

SEQ ID NO: 231720 - DNA, 21 bp, Artificial Sequence
  Description of Artificial Sequence: Synthetic oligonucleotide
ctcctcgaccgcggccgacac

SEQ ID NO: 231721 - DNA, 21 bp, Artificial Sequence
  Description of Artificial Sequence: Synthetic oligonucleotide
tcctcgaccgcggccgacacg

SEQ ID NO: 231722 - DNA, 20 bp, Artificial Sequence
  Description of Artificial Sequence: Synthetic oligonucleotide
cctcgaccgcggccgacacg

SEQ ID NO: 231723 - DNA, 20 bp, Artificial Sequence
  Description of Artificial Sequence: Synthetic oligonucleotide
ctcgaccgcggccgacacgg

SEQ ID NO: 231724 - DNA, 20 bp, Artificial Sequence
  Description of Artificial Sequence: Synthetic oligonucleotide
tcgaccgcggccgacacggc

SEQ ID NO: 231725 - DNA, 20 bp, Artificial Sequence
  Description of Artificial Sequence: Synthetic oligonucleotide
cgaccgcggccgacacggct

SEQ ID NO: 231726 - DNA, 20 bp, Artificial Sequence
  Description of Artificial Sequence: Synthetic oligonucleotide
gaccgcggccgacacggcgt

SEQ ID NO: 231727 - DNA, 20 bp, Artificial Sequence
  Description of Artificial Sequence: Synthetic oligonucleotide
accgcggccgacacggcgct

SEQ ID NO: 231728 - DNA, 20 bp, Artificial Sequence
  Description of Artificial Sequence: Synthetic oligonucleotide
ccgcggccgacacggcgctt

SEQ ID NO: 231729 - DNA, 20 bp, Artificial Sequence
  Description of Artificial Sequence: Synthetic oligonucleotide
cgcggccgacacggcgcctt

SEQ ID NO: 231730 - DNA, 20 bp, Artificial Sequence
  Description of Artificial Sequence: Synthetic oligonucleotide
gcggccgacacggcgcctca

SEQ ID NO: 231731 - DNA, 22 bp, Artificial Sequence
  Description of Artificial Sequence: Synthetic oligonucleotide
cggccgacacggcgcctcagat

SEQ ID NO: 231732 - DNA, 23 bp, Artificial Sequence
  Description of Artificial Sequence: Synthetic oligonucleotide
ggccgacacggcgcctcagatca

SEQ ID NO: 231733 - DNA, 23 bp, Artificial Sequence
  Description of Artificial Sequence: Synthetic oligonucleotide
gccgacacggcgcctcagatcac

SEQ ID NO: 231734 - DNA, 23 bp, Artificial Sequence
  Description of Artificial Sequence: Synthetic oligonucleotide
ccgacacggcgcctcagatcacc

SEQ ID NO: 231735 - DNA, 24 bp, Artificial Sequence
  Description of Artificial Sequence: Synthetic oligonucleotide
cgacacggcgcctcagatcaccct

SEQ ID NO: 231736 - DNA, 24 bp, Artificial Sequence
  Description of Artificial Sequence: Synthetic oligonucleotide
gacacggcgcctcagatcaccctg

SEQ ID NO: 231737 - DNA, 24 bp, Artificial Sequence
  Description of Artificial Sequence: Synthetic oligonucleotide
acacggcgcctcagatcaccctgc

SEQ ID NO: 231738 - DNA, 23 bp, Artificial Sequence
  Description of Artificial Sequence: Synthetic oligonucleotide
cacggcgcctcagatcaccctgc

SEQ ID NO: 231739 - DNA, 23 bp, Artificial Sequence
  Description of Artificial Sequence: Synthetic oligonucleotide
acggcgcctcagatcaccctgcg

SEQ ID NO: 231740 - DNA, 22 bp, Artificial Sequence
  Description of Artificial Sequence: Synthetic oligonucleotide
cggcgcctcagatcaccctgcg

SEQ ID NO: 231741 - DNA, 24 bp, Artificial Sequence
  Description of Artificial Sequence: Synthetic oligonucleotide
ggcgcctcagatcaccctgcgcaa

SEQ ID NO: 231742 - DNA, 25 bp, Artificial Sequence
  Description of Artificial Sequence: Synthetic oligonucleotide
gcgcctcagatcaccctgcgcaaga

SEQ ID NO: 231743 - DNA, 25 bp, Artificial Sequence
  Description of Artificial Sequence: Synthetic oligonucleotide
cgcctcagatcaccctgcgcaagag

SEQ ID NO: 231744 - DNA, 25 bp, Artificial Sequence
  Description of Artificial Sequence: Synthetic oligonucleotide
gcctcagatcaccctgcgcaagagg

SEQ ID NO: 231745 - DNA, 26 bp, Artificial Sequence
  Description of Artificial Sequence: Synthetic oligonucleotide
cctcagatcaccctgcgcaagaggga

SEQ ID NO: 231746 - DNA, 26 bp, Artificial Sequence
  Description of Artificial Sequence: Synthetic oligonucleotide
ctcagatcaccctgcgcaagagggag

SEQ ID NO: 231747 - DNA, 26 bp, Artificial Sequence
  Description of Artificial Sequence: Synthetic oligonucleotide
tcagatcaccctgcgcaagagggagg

SEQ ID NO: 231748 - DNA, 25 bp, Artificial Sequence
  Description of Artificial Sequence: Synthetic oligonucleotide
cagatcaccctgcgcaagagggagg

SEQ ID NO: 231749 - DNA, 25 bp, Artificial Sequence
  Description of Artificial Sequence: Synthetic oligonucleotide
agatcaccctgcgcaagagggaggc

SEQ ID NO: 231750 - DNA, 24 bp, Artificial Sequence
  Description of Artificial Sequence: Synthetic oligonucleotide
gatcaccctgcgcaagagggaggc

SEQ ID NO: 231751 - DNA, 24 bp, Artificial Sequence
  Description of Artificial Sequence: Synthetic oligonucleotide
atcaccctgcgcaagagggaggcg

SEQ ID NO: 231752 - DNA, 23 bp, Artificial Sequence
  Description of Artificial Sequence: Synthetic oligonucleotide
tcaccctgcgcaagagggaggcg

SEQ ID NO: 231753 - DNA, 22 bp, Artificial Sequence
  Description of Artificial Sequence: Synthetic oligonucleotide
caccctgcgcaagagggaggcg

SEQ ID NO: 231754 - DNA, 22 bp, Artificial Sequence
  Description of Artificial Sequence: Synthetic oligonucleotide
accctgcgcaagagggaggcgc

SEQ ID NO: 231755 - DNA, 21 bp, Artificial Sequence
  Description of Artificial Sequence: Synthetic oligonucleotide
ccctgcgcaagagggaggcgc

SEQ ID NO: 231756 - DNA, 21 bp, Artificial Sequence
  Description of Artificial Sequence: Synthetic oligonucleotide
cctgcgcaagagggaggcgcc

SEQ ID NO: 231757 - DNA, 21 bp, Artificial Sequence
  Description of Artificial Sequence: Synthetic oligonucleotide
ctgcgcaagagggaggcgccc

SEQ ID NO: 231758 - DNA, 21 bp, Artificial Sequence
  Description of Artificial Sequence: Synthetic oligonucleotide
tgcgcaagagggaggcgcccc

SEQ ID NO: 231759 - DNA, 20 bp, Artificial Sequence
  Description of Artificial Sequence: Synthetic oligonucleotide
gcgcaagagggaggcgcccc

SEQ ID NO: 231760 - DNA, 21 bp, Artificial Sequence
  Description of Artificial Sequence: Synthetic oligonucleotide
cgcaagagggaggcgccccgt

SEQ ID NO: 231761 - DNA, 22 bp, Artificial Sequence
  Description of Artificial Sequence: Synthetic oligonucleotide
gcaagagggaggcgccccgtgt

SEQ ID NO: 231762 - DNA, 22 bp, Artificial Sequence
  Description of Artificial Sequence: Synthetic oligonucleotide
caagagggaggcgccccgtgtg

SEQ ID NO: 231763 - DNA, 22 bp, Artificial Sequence
  Description of Artificial Sequence: Synthetic oligonucleotide
aagagggaggcgccccgtgtgc

SEQ ID NO: 231764 - DNA, 21 bp, Artificial Sequence
  Description of Artificial Sequence: Synthetic oligonucleotide
agagggaggcgccccgtgtgc

SEQ ID NO: 231765 - DNA, 20 bp, Artificial Sequence
  Description of Artificial Sequence: Synthetic oligonucleotide
gagggaggcgccccgtgtgc

SEQ ID NO: 231766 - DNA, 20 bp, Artificial Sequence
  Description of Artificial Sequence: Synthetic oligonucleotide
agggaggcgccccgtgtgcc

SEQ ID NO: 231767 - DNA, 20 bp, Artificial Sequence
  Description of Artificial Sequence: Synthetic oligonucleotide
gggaggcgccccgtgtgcct

SEQ ID NO: 231768 - DNA, 20 bp, Artificial Sequence
  Description of Artificial Sequence: Synthetic oligonucleotide
ggaggcgccccgtgtgccgt

SEQ ID NO: 231769 - DNA, 20 bp, Artificial Sequence
  Description of Artificial Sequence: Synthetic oligonucleotide
gaggcgccccgtgtgccgga

SEQ ID NO: 231770 - DNA, 20 bp, Artificial Sequence
  Description of Artificial Sequence: Synthetic oligonucleotide
aggcgccccgtgtgccggag

SEQ ID NO: 231771 - DNA, 20 bp, Artificial Sequence
  Description of Artificial Sequence: Synthetic oligonucleotide
ggcgccccgtgtgccggagt

SEQ ID NO: 231772 - DNA, 20 bp, Artificial Sequence
  Description of Artificial Sequence: Synthetic oligonucleotide
gcgccccgtgtgccggagca

SEQ ID NO: 231773 - DNA, 20 bp, Artificial Sequence
  Description of Artificial Sequence: Synthetic oligonucleotide
cgccccgtgtgccggagcag

SEQ ID NO: 231774 - DNA, 21 bp, Artificial Sequence
  Description of Artificial Sequence: Synthetic oligonucleotide
gccccgtgtgccggagcagct

SEQ ID NO: 231775 - DNA, 22 bp, Artificial Sequence
  Description of Artificial Sequence: Synthetic oligonucleotide
ccccgtgtgccggagcagctgt

SEQ ID NO: 231776 - DNA, 23 bp, Artificial Sequence
  Description of Artificial Sequence: Synthetic oligonucleotide
cccgtgtgccggagcagctgtga

SEQ ID NO: 231777 - DNA, 23 bp, Artificial Sequence
  Description of Artificial Sequence: Synthetic oligonucleotide
ccgtgtgccggagcagctgtgag

SEQ ID NO: 231778 - DNA, 23 bp, Artificial Sequence
  Description of Artificial Sequence: Synthetic oligonucleotide
cgtgtgccggagcagctgtgagc

SEQ ID NO: 231779 - DNA, 25 bp, Artificial Sequence
  Description of Artificial Sequence: Synthetic oligonucleotide
gtgtgccggagcagctgtgagccta

SEQ ID NO: 231780 - DNA, 25 bp, Artificial Sequence
  Description of Artificial Sequence: Synthetic oligonucleotide
tgtgccggagcagctgtgagcctac

SEQ ID NO: 231781 - DNA, 24 bp, Artificial Sequence
  Description of Artificial Sequence: Synthetic oligonucleotide
gtgccggagcagctgtgagcctac

SEQ ID NO: 231782 - DNA, 25 bp, Artificial Sequence
  Description of Artificial Sequence: Synthetic oligonucleotide
tgccggagcagctgtgagcctacgt

SEQ ID NO: 231783 - DNA, 24 bp, Artificial Sequence
  Description of Artificial Sequence: Synthetic oligonucleotide
gccggagcagctgtgagcctacgt

SEQ ID NO: 231784 - DNA, 24 bp, Artificial Sequence
  Description of Artificial Sequence: Synthetic oligonucleotide
ccggagcagctgtgagcctacgtg

SEQ ID NO: 231785 - DNA, 25 bp, Artificial Sequence
  Description of Artificial Sequence: Synthetic oligonucleotide
cggagcagctgtgagcctacgtgga

SEQ ID NO: 231786 - DNA, 25 bp, Artificial Sequence
  Description of Artificial Sequence: Synthetic oligonucleotide
ggagcagctgtgagcctacgtggag

SEQ ID NO: 231787 - DNA, 25 bp, Artificial Sequence
  Description of Artificial Sequence: Synthetic oligonucleotide
gagcagctgtgagcctacgtggagg

SEQ ID NO: 231788 - DNA, 25 bp, Artificial Sequence
  Description of Artificial Sequence: Synthetic oligonucleotide
agcagctgtgagcctacgtggaggg

SEQ ID NO: 231789 - DNA, 24 bp, Artificial Sequence
  Description of Artificial Sequence: Synthetic oligonucleotide
gcagctgtgagcctacgtggaggg

SEQ ID NO: 231790 - DNA, 25 bp, Artificial Sequence
  Description of Artificial Sequence: Synthetic oligonucleotide
cagctgtgagcctacgtggagggca

SEQ ID NO: 231791 - DNA, 25 bp, Artificial Sequence
  Description of Artificial Sequence: Synthetic oligonucleotide
agctgtgagcctacgtggagggcac

SEQ ID NO: 231792 - DNA, 24 bp, Artificial Sequence
  Description of Artificial Sequence: Synthetic oligonucleotide
gctgtgagcctacgtggagggcac

SEQ ID NO: 231793 - DNA, 25 bp, Artificial Sequence
  Description of Artificial Sequence: Synthetic oligonucleotide
ctgtgagcctacgtggagggcacga

SEQ ID NO: 231794 - DNA, 25 bp, Artificial Sequence
  Description of Artificial Sequence: Synthetic oligonucleotide
tgtgagcctacgtggagggcacgag

SEQ ID NO: 231795 - DNA, 24 bp, Artificial Sequence
  Description of Artificial Sequence: Synthetic oligonucleotide
gtgagcctacgtggagggcacgag

SEQ ID NO: 231796 - DNA, 24 bp, Artificial Sequence
  Description of Artificial Sequence: Synthetic oligonucleotide
tgagcctacgtggagggcacgagc

SEQ ID NO: 231797 - DNA, 23 bp, Artificial Sequence
  Description of Artificial Sequence: Synthetic oligonucleotide
gagcctacgtggagggcacgagc

SEQ ID NO: 231798 - DNA, 24 bp, Artificial Sequence
  Description of Artificial Sequence: Synthetic oligonucleotide
agcctacgtggagggcacgagcgt

SEQ ID NO: 231799 - DNA, 23 bp, Artificial Sequence
  Description of Artificial Sequence: Synthetic oligonucleotide
gcctacgtggagggcacgagcgt

SEQ ID NO: 231800 - DNA, 23 bp, Artificial Sequence
  Description of Artificial Sequence: Synthetic oligonucleotide
cctacgtggagggcacgagcgtg

SEQ ID NO: 231801 - DNA, 24 bp, Artificial Sequence
  Description of Artificial Sequence: Synthetic oligonucleotide
ctacgtggagggcacgagcgtgca

SEQ ID NO: 231802 - DNA, 25 bp, Artificial Sequence
  Description of Artificial Sequence: Synthetic oligonucleotide
tacgtggagggcacgagcgtgcagt

SEQ ID NO: 231803 - DNA, 24 bp, Artificial Sequence
  Description of Artificial Sequence: Synthetic oligonucleotide
acgtggagggcacgagcgtgcagt

SEQ ID NO: 231804 - DNA, 23 bp, Artificial Sequence
  Description of Artificial Sequence: Synthetic oligonucleotide
cgtggagggcacgagcgtgcagt

SEQ ID NO: 231805 - DNA, 23 bp, Artificial Sequence
  Description of Artificial Sequence: Synthetic oligonucleotide
gtggagggcacgagcgtgcagtg

SEQ ID NO: 231806 - DNA, 23 bp, Artificial Sequence
  Description of Artificial Sequence: Synthetic oligonucleotide
tggagggcacgagcgtgcagtgg

SEQ ID NO: 231807 - DNA, 22 bp, Artificial Sequence
  Description of Artificial Sequence: Synthetic oligonucleotide
ggagggcacgagcgtgcagtgg

SEQ ID NO: 231808 - DNA, 23 bp, Artificial Sequence
  Description of Artificial Sequence: Synthetic oligonucleotide
gagggcacgagcgtgcagtggct

SEQ ID NO: 231809 - DNA, 23 bp, Artificial Sequence
  Description of Artificial Sequence: Synthetic oligonucleotide
agggcacgagcgtgcagtggctc

SEQ ID NO: 231810 - DNA, 22 bp, Artificial Sequence
  Description of Artificial Sequence: Synthetic oligonucleotide
gggcacgagcgtgcagtggctc

SEQ ID NO: 231811 - DNA, 22 bp, Artificial Sequence
  Description of Artificial Sequence: Synthetic oligonucleotide
ggcacgagcgtgcagtggctcc

SEQ ID NO: 231812 - DNA, 22 bp, Artificial Sequence
  Description of Artificial Sequence: Synthetic oligonucleotide
gcacgagcgtgcagtggctccg

SEQ ID NO: 231813 - DNA, 23 bp, Artificial Sequence
  Description of Artificial Sequence: Synthetic oligonucleotide
cacgagcgtgcagtggctccgct

SEQ ID NO: 231814 - DNA, 26 bp, Artificial Sequence
  Description of Artificial Sequence: Synthetic oligonucleotide
acgagcgtgcagtggctccgctgata

SEQ ID NO: 231815 - DNA, 25 bp, Artificial Sequence
  Description of Artificial Sequence: Synthetic oligonucleotide
cgagcgtgcagtggctccgctgata

SEQ ID NO: 231816 - DNA, 25 bp, Artificial Sequence
  Description of Artificial Sequence: Synthetic oligonucleotide
gagcgtgcagtggctccgctgatac

SEQ ID NO: 231817 - DNA, 26 bp, Artificial Sequence
  Description of Artificial Sequence: Synthetic oligonucleotide
agcgtgcagtggctccgctgatacct

SEQ ID NO: 231818 - DNA, 25 bp, Artificial Sequence
  Description of Artificial Sequence: Synthetic oligonucleotide
gcgtgcagtggctccgctgatacct

SEQ ID NO: 231819 - DNA, 25 bp, Artificial Sequence
  Description of Artificial Sequence: Synthetic oligonucleotide
cgtgcagtggctccgctgatacctg

SEQ ID NO: 231820 - DNA, 26 bp, Artificial Sequence
  Description of Artificial Sequence: Synthetic oligonucleotide
gtgcagtggctccgctgatacctggt

SEQ ID NO: 231821 - DNA, 27 bp, Artificial Sequence
  Description of Artificial Sequence: Synthetic oligonucleotide
tgcagtggctccgctgatacctggtga

SEQ ID NO: 231822 - DNA, 27 bp, Artificial Sequence
  Description of Artificial Sequence: Synthetic oligonucleotide
gcagtggctccgctgatacctggtgaa

SEQ ID NO: 231823 - DNA, 27 bp, Artificial Sequence
  Description of Artificial Sequence: Synthetic oligonucleotide
cagtggctccgctgatacctggtgaac

SEQ ID NO: 231824 - DNA, 27 bp, Artificial Sequence
  Description of Artificial Sequence: Synthetic oligonucleotide
agtggctccgctgatacctggtgaacg

SEQ ID NO: 231825 - DNA, 26 bp, Artificial Sequence
  Description of Artificial Sequence: Synthetic oligonucleotide
gtggctccgctgatacctggtgaacg

SEQ ID NO: 231826 - DNA, 26 bp, Artificial Sequence
  Description of Artificial Sequence: Synthetic oligonucleotide
tggctccgctgatacctggtgaacgg

SEQ ID NO: 231827 - DNA, 25 bp, Artificial Sequence
  Description of Artificial Sequence: Synthetic oligonucleotide
ggctccgctgatacctggtgaacgg

SEQ ID NO: 231828 - DNA, 27 bp, Artificial Sequence
  Description of Artificial Sequence: Synthetic oligonucleotide
gctccgctgatacctggtgaacgggaa

SEQ ID NO: 231829 - DNA, 27 bp, Artificial Sequence
  Description of Artificial Sequence: Synthetic oligonucleotide
ctccgctgatacctggtgaacgggaac

SEQ ID NO: 231830 - DNA, 27 bp, Artificial Sequence
  Description of Artificial Sequence: Synthetic oligonucleotide
tccgctgatacctggtgaacgggaacg

SEQ ID NO: 231831 - DNA, 27 bp, Artificial Sequence
  Description of Artificial Sequence: Synthetic oligonucleotide
ccgctgatacctggtgaacgggaacga

SEQ ID NO: 231832 - DNA, 27 bp, Artificial Sequence
  Description of Artificial Sequence: Synthetic oligonucleotide
cgctgatacctggtgaacgggaacgag

SEQ ID NO: 231833 - DNA, 28 bp, Artificial Sequence
  Description of Artificial Sequence: Synthetic oligonucleotide
gctgatacctggtgaacgggaacgagac

SEQ ID NO: 231834 - DNA, 28 bp, Artificial Sequence
  Description of Artificial Sequence: Synthetic oligonucleotide
ctgatacctggtgaacgggaacgagacg

SEQ ID NO: 231835 - DNA, 28 bp, Artificial Sequence
  Description of Artificial Sequence: Synthetic oligonucleotide
tgatacctggtgaacgggaacgagacgc

SEQ ID NO: 231836 - DNA, 27 bp, Artificial Sequence
  Description of Artificial Sequence: Synthetic oligonucleotide
gatacctggtgaacgggaacgagacgc

SEQ ID NO: 231837 - DNA, 28 bp, Artificial Sequence
  Description of Artificial Sequence: Synthetic oligonucleotide
atacctggtgaacgggaacgagacgcag

SEQ ID NO: 231838 - DNA, 27 bp, Artificial Sequence
  Description of Artificial Sequence: Synthetic oligonucleotide
tacctggtgaacgggaacgagacgcag

SEQ ID NO: 231839 - DNA, 26 bp, Artificial Sequence
  Description of Artificial Sequence: Synthetic oligonucleotide
acctggtgaacgggaacgagacgcag

SEQ ID NO: 231840 - DNA, 25 bp, Artificial Sequence
  Description of Artificial Sequence: Synthetic oligonucleotide
cctggtgaacgggaacgagacgcag

SEQ ID NO: 231841 - DNA, 26 bp, Artificial Sequence
  Description of Artificial Sequence: Synthetic oligonucleotide
ctggtgaacgggaacgagacgcagca

SEQ ID NO: 231842 - DNA, 26 bp, Artificial Sequence
  Description of Artificial Sequence: Synthetic oligonucleotide
tggtgaacgggaacgagacgcagcag

SEQ ID NO: 231843 - DNA, 25 bp, Artificial Sequence
  Description of Artificial Sequence: Synthetic oligonucleotide
ggtgaacgggaacgagacgcagcag

SEQ ID NO: 231844 - DNA, 25 bp, Artificial Sequence
  Description of Artificial Sequence: Synthetic oligonucleotide
gtgaacgggaacgagacgcagcagc

SEQ ID NO: 231845 - DNA, 25 bp, Artificial Sequence
  Description of Artificial Sequence: Synthetic oligonucleotide
tgaacgggaacgagacgcagcagcg

SEQ ID NO: 231846 - DNA, 24 bp, Artificial Sequence
  Description of Artificial Sequence: Synthetic oligonucleotide
gaacgggaacgagacgcagcagcg

SEQ ID NO: 231847 - DNA, 24 bp, Artificial Sequence
  Description of Artificial Sequence: Synthetic oligonucleotide
aacgggaacgagacgcagcagcgc

SEQ ID NO: 231848 - DNA, 23 bp, Artificial Sequence
  Description of Artificial Sequence: Synthetic oligonucleotide
acgggaacgagacgcagcagcgc

SEQ ID NO: 231849 - DNA, 22 bp, Artificial Sequence
  Description of Artificial Sequence: Synthetic oligonucleotide
cgggaacgagacgcagcagcgc

SEQ ID NO: 231850 - DNA, 22 bp, Artificial Sequence
  Description of Artificial Sequence: Synthetic oligonucleotide
gggaacgagacgcagcagcgcg

SEQ ID NO: 231851 - DNA, 22 bp, Artificial Sequence
  Description of Artificial Sequence: Synthetic oligonucleotide
ggaacgagacgcagcagcgcgc

SEQ ID NO: 231852 - DNA, 22 bp, Artificial Sequence
  Description of Artificial Sequence: Synthetic oligonucleotide
gaacgagacgcagcagcgcgcg

SEQ ID NO: 231853 - DNA, 23 bp, Artificial Sequence
  Description of Artificial Sequence: Synthetic oligonucleotide
aacgagacgcagcagcgcgcggt

SEQ ID NO: 231854 - DNA, 22 bp, Artificial Sequence
  Description of Artificial Sequence: Synthetic oligonucleotide
acgagacgcagcagcgcgcggt

SEQ ID NO: 231855 - DNA, 21 bp, Artificial Sequence
  Description of Artificial Sequence: Synthetic oligonucleotide
cgagacgcagcagcgcgcggt

SEQ ID NO: 231856 - DNA, 21 bp, Artificial Sequence
  Description of Artificial Sequence: Synthetic oligonucleotide
gagacgcagcagcgcgcggtc

SEQ ID NO: 231857 - DNA, 21 bp, Artificial Sequence
  Description of Artificial Sequence: Synthetic oligonucleotide
agacgcagcagcgcgcggtcc

SEQ ID NO: 231858 - DNA, 20 bp, Artificial Sequence
  Description of Artificial Sequence: Synthetic oligonucleotide
gacgcagcagcgcgcggtcc

SEQ ID NO: 231859 - DNA, 20 bp, Artificial Sequence
  Description of Artificial Sequence: Synthetic oligonucleotide
acgcagcagcgcgcggtccc

SEQ ID NO: 231860 - DNA, 20 bp, Artificial Sequence
  Description of Artificial Sequence: Synthetic oligonucleotide
cgcagcagcgcgcggtccct

SEQ ID NO: 231861 - DNA, 20 bp, Artificial Sequence
  Description of Artificial Sequence: Synthetic oligonucleotide
gcagcagcgcgcggtcccct

SEQ ID NO: 231862 - DNA, 20 bp, Artificial Sequence
  Description of Artificial Sequence: Synthetic oligonucleotide
cagcagcgcgcggtccccct

SEQ ID NO: 231863 - DNA, 22 bp, Artificial Sequence
  Description of Artificial Sequence: Synthetic oligonucleotide
agcagcgcgcggtccccccaat

SEQ ID NO: 231864 - DNA, 21 bp, Artificial Sequence
  Description of Artificial Sequence: Synthetic oligonucleotide
gcagcgcgcggtccccccaat

SEQ ID NO: 231865 - DNA, 22 bp, Artificial Sequence
  Description of Artificial Sequence: Synthetic oligonucleotide
cagcgcgcggtccccccaatga

SEQ ID NO: 231866 - DNA, 23 bp, Artificial Sequence
  Description of Artificial Sequence: Synthetic oligonucleotide
agcgcgcggtccccccaatgaca

SEQ ID NO: 231867 - DNA, 22 bp, Artificial Sequence
  Description of Artificial Sequence: Synthetic oligonucleotide
gcgcgcggtccccccaatgaca

SEQ ID NO: 231868 - DNA, 23 bp, Artificial Sequence
  Description of Artificial Sequence: Synthetic oligonucleotide
cgcgcggtccccccaatgacaca

SEQ ID NO: 231869 - DNA, 23 bp, Artificial Sequence
  Description of Artificial Sequence: Synthetic oligonucleotide
gcgcggtccccccaatgacacac

SEQ ID NO: 231870 - DNA, 24 bp, Artificial Sequence
  Description of Artificial Sequence: Synthetic oligonucleotide
cgcggtccccccaatgacacacgt

SEQ ID NO: 231871 - DNA, 25 bp, Artificial Sequence
  Description of Artificial Sequence: Synthetic oligonucleotide
gcggtccccccaatgacacacgtga

SEQ ID NO: 231872 - DNA, 25 bp, Artificial Sequence
  Description of Artificial Sequence: Synthetic oligonucleotide
cggtccccccaatgacacacgtgag

SEQ ID NO: 231873 - DNA, 25 bp, Artificial Sequence
  Description of Artificial Sequence: Synthetic oligonucleotide
ggtccccccaatgacacacgtgagc

SEQ ID NO: 231874 - DNA, 26 bp, Artificial Sequence
  Description of Artificial Sequence: Synthetic oligonucleotide
gtccccccaatgacacacgtgagcca

SEQ ID NO: 231875 - DNA, 26 bp, Artificial Sequence
  Description of Artificial Sequence: Synthetic oligonucleotide
tccccccaatgacacacgtgagccac

SEQ ID NO: 231876 - DNA, 25 bp, Artificial Sequence
  Description of Artificial Sequence: Synthetic oligonucleotide
ccccccaatgacacacgtgagccac

SEQ ID NO: 231877 - DNA, 26 bp, Artificial Sequence
  Description of Artificial Sequence: Synthetic oligonucleotide
cccccaatgacacacgtgagccacca

SEQ ID NO: 231878 - DNA, 26 bp, Artificial Sequence
  Description of Artificial Sequence: Synthetic oligonucleotide
ccccaatgacacacgtgagccaccac

SEQ ID NO: 231879 - DNA, 26 bp, Artificial Sequence
  Description of Artificial Sequence: Synthetic oligonucleotide
cccaatgacacacgtgagccaccacc

SEQ ID NO: 231880 - DNA, 26 bp, Artificial Sequence
  Description of Artificial Sequence: Synthetic oligonucleotide
ccaatgacacacgtgagccaccaccg

SEQ ID NO: 231881 - DNA, 27 bp, Artificial Sequence
  Description of Artificial Sequence: Synthetic oligonucleotide
caatgacacacgtgagccaccaccgca

SEQ ID NO: 231882 - DNA, 28 bp, Artificial Sequence
  Description of Artificial Sequence: Synthetic oligonucleotide
aatgacacacgtgagccaccaccgcatc

SEQ ID NO: 231883 - DNA, 27 bp, Artificial Sequence
  Description of Artificial Sequence: Synthetic oligonucleotide
atgacacacgtgagccaccaccgcatc

SEQ ID NO: 231884 - DNA, 27 bp, Artificial Sequence
  Description of Artificial Sequence: Synthetic oligonucleotide
tgacacacgtgagccaccaccgcatct

SEQ ID NO: 231885 - DNA, 26 bp, Artificial Sequence
  Description of Artificial Sequence: Synthetic oligonucleotide
gacacacgtgagccaccaccgcatct

SEQ ID NO: 231886 - DNA, 27 bp, Artificial Sequence
  Description of Artificial Sequence: Synthetic oligonucleotide
acacacgtgagccaccaccgcatctct

SEQ ID NO: 231887 - DNA, 26 bp, Artificial Sequence
  Description of Artificial Sequence: Synthetic oligonucleotide
cacacgtgagccaccaccgcatctct

SEQ ID NO: 231888 - DNA, 27 bp, Artificial Sequence
  Description of Artificial Sequence: Synthetic oligonucleotide
acacgtgagccaccaccgcatctctga

SEQ ID NO: 231889 - DNA, 26 bp, Artificial Sequence
  Description of Artificial Sequence: Synthetic oligonucleotide
cacgtgagccaccaccgcatctctga

SEQ ID NO: 231890 - DNA, 26 bp, Artificial Sequence
  Description of Artificial Sequence: Synthetic oligonucleotide
acgtgagccaccaccgcatctctgag

SEQ ID NO: 231891 - DNA, 25 bp, Artificial Sequence
  Description of Artificial Sequence: Synthetic oligonucleotide
cgtgagccaccaccgcatctctgag

SEQ ID NO: 231892 - DNA, 27 bp, Artificial Sequence
  Description of Artificial Sequence: Synthetic oligonucleotide
gtgagccaccaccgcatctctgagcat

SEQ ID NO: 231893 - DNA, 27 bp, Artificial Sequence
  Description of Artificial Sequence: Synthetic oligonucleotide
tgagccaccaccgcatctctgagcatg

SEQ ID NO: 231894 - DNA, 27 bp, Artificial Sequence
  Description of Artificial Sequence: Synthetic oligonucleotide
gagccaccaccgcatctctgagcatga

SEQ ID NO: 231895 - DNA, 27 bp, Artificial Sequence
  Description of Artificial Sequence: Synthetic oligonucleotide
agccaccaccgcatctctgagcatgag

SEQ ID NO: 231896 - DNA, 26 bp, Artificial Sequence
  Description of Artificial Sequence: Synthetic oligonucleotide
gccaccaccgcatctctgagcatgag

SEQ ID NO: 231897 - DNA, 26 bp, Artificial Sequence
  Description of Artificial Sequence: Synthetic oligonucleotide
ccaccaccgcatctctgagcatgagg

SEQ ID NO: 231898 - DNA, 26 bp, Artificial Sequence
  Description of Artificial Sequence: Synthetic oligonucleotide
caccaccgcatctctgagcatgaggc

SEQ ID NO: 231899 - DNA, 27 bp, Artificial Sequence
  Description of Artificial Sequence: Synthetic oligonucleotide
accaccgcatctctgagcatgaggcct

SEQ ID NO: 231900 - DNA, 26 bp, Artificial Sequence
  Description of Artificial Sequence: Synthetic oligonucleotide
ccaccgcatctctgagcatgaggcct

SEQ ID NO: 231901 - DNA, 26 bp, Artificial Sequence
  Description of Artificial Sequence: Synthetic oligonucleotide
caccgcatctctgagcatgaggcctc

SEQ ID NO: 231902 - DNA, 26 bp, Artificial Sequence
  Description of Artificial Sequence: Synthetic oligonucleotide
accgcatctctgagcatgaggcctcc

SEQ ID NO: 231903 - DNA, 25 bp, Artificial Sequence
  Description of Artificial Sequence: Synthetic oligonucleotide
ccgcatctctgagcatgaggcctcc

SEQ ID NO: 231904 - DNA, 26 bp, Artificial Sequence
  Description of Artificial Sequence: Synthetic oligonucleotide
cgcatctctgagcatgaggcctccct

SEQ ID NO: 231905 - DNA, 27 bp, Artificial Sequence
  Description of Artificial Sequence: Synthetic oligonucleotide
gcatctctgagcatgaggcctccctga

SEQ ID NO: 231906 - DNA, 27 bp, Artificial Sequence
  Description of Artificial Sequence: Synthetic oligonucleotide
catctctgagcatgaggcctccctgag

SEQ ID NO: 231907 - DNA, 27 bp, Artificial Sequence
  Description of Artificial Sequence: Synthetic oligonucleotide
atctctgagcatgaggcctccctgagg

SEQ ID NO: 231908 - DNA, 27 bp, Artificial Sequence
  Description of Artificial Sequence: Synthetic oligonucleotide
tctctgagcatgaggcctccctgaggt

SEQ ID NO: 231909 - DNA, 26 bp, Artificial Sequence
  Description of Artificial Sequence: Synthetic oligonucleotide
ctctgagcatgaggcctccctgaggt

SEQ ID NO: 231910 - DNA, 26 bp, Artificial Sequence
  Description of Artificial Sequence: Synthetic oligonucleotide
tctgagcatgaggcctccctgaggtc

SEQ ID NO: 231911 - DNA, 25 bp, Artificial Sequence
  Description of Artificial Sequence: Synthetic oligonucleotide
ctgagcatgaggcctccctgaggtc

SEQ ID NO: 231912 - DNA, 26 bp, Artificial Sequence
  Description of Artificial Sequence: Synthetic oligonucleotide
tgagcatgaggcctccctgaggtcct

SEQ ID NO: 231913 - DNA, 25 bp, Artificial Sequence
  Description of Artificial Sequence: Synthetic oligonucleotide
gagcatgaggcctccctgaggtcct

SEQ ID NO: 231914 - DNA, 25 bp, Artificial Sequence
  Description of Artificial Sequence: Synthetic oligonucleotide
agcatgaggcctccctgaggtcctg

SEQ ID NO: 231915 - DNA, 24 bp, Artificial Sequence
  Description of Artificial Sequence: Synthetic oligonucleotide
gcatgaggcctccctgaggtcctg

SEQ ID NO: 231916 - DNA, 24 bp, Artificial Sequence
  Description of Artificial Sequence: Synthetic oligonucleotide
catgaggcctccctgaggtcctgg

SEQ ID NO: 231917 - DNA, 24 bp, Artificial Sequence
  Description of Artificial Sequence: Synthetic oligonucleotide
atgaggcctccctgaggtcctggg

SEQ ID NO: 231918 - DNA, 23 bp, Artificial Sequence
  Description of Artificial Sequence: Synthetic oligonucleotide
tgaggcctccctgaggtcctggg

SEQ ID NO: 231919 - DNA, 22 bp, Artificial Sequence
  Description of Artificial Sequence: Synthetic oligonucleotide
gaggcctccctgaggtcctggg

SEQ ID NO: 231920 - DNA, 22 bp, Artificial Sequence
  Description of Artificial Sequence: Synthetic oligonucleotide
aggcctccctgaggtcctgggc

SEQ ID NO: 231921 - DNA, 21 bp, Artificial Sequence
  Description of Artificial Sequence: Synthetic oligonucleotide
ggcctccctgaggtcctgggc

SEQ ID NO: 231922 - DNA, 21 bp, Artificial Sequence
  Description of Artificial Sequence: Synthetic oligonucleotide
gcctccctgaggtcctgggcc

SEQ ID NO: 231923 - DNA, 22 bp, Artificial Sequence
  Description of Artificial Sequence: Synthetic oligonucleotide
cctccctgaggtcctgggccct

SEQ ID NO: 231924 - DNA, 22 bp, Artificial Sequence
  Description of Artificial Sequence: Synthetic oligonucleotide
ctccctgaggtcctgggccctc

SEQ ID NO: 231925 - DNA, 22 bp, Artificial Sequence
  Description of Artificial Sequence: Synthetic oligonucleotide
tccctgaggtcctgggccctcg

SEQ ID NO: 231926 - DNA, 21 bp, Artificial Sequence
  Description of Artificial Sequence: Synthetic oligonucleotide
ccctgaggtcctgggccctcg

SEQ ID NO: 231927 - DNA, 21 bp, Artificial Sequence
  Description of Artificial Sequence: Synthetic oligonucleotide
cctgaggtcctgggccctcgg

SEQ ID NO: 231928 - DNA, 23 bp, Artificial Sequence
  Description of Artificial Sequence: Synthetic oligonucleotide
ctgaggtcctgggccctcggctt

SEQ ID NO: 231929 - DNA, 25 bp, Artificial Sequence
  Description of Artificial Sequence: Synthetic oligonucleotide
tgaggtcctgggccctcggcttcta

SEQ ID NO: 231930 - DNA, 24 bp, Artificial Sequence
  Description of Artificial Sequence: Synthetic oligonucleotide
gaggtcctgggccctcggcttcta

SEQ ID NO: 231931 - DNA, 24 bp, Artificial Sequence
  Description of Artificial Sequence: Synthetic oligonucleotide
aggtcctgggccctcggcttctac

SEQ ID NO: 231932 - DNA, 23 bp, Artificial Sequence
  Description of Artificial Sequence: Synthetic oligonucleotide
ggtcctgggccctcggcttctac

SEQ ID NO: 231933 - DNA, 23 bp, Artificial Sequence
  Description of Artificial Sequence: Synthetic oligonucleotide
gtcctgggccctcggcttctacg

SEQ ID NO: 231934 - DNA, 24 bp, Artificial Sequence
  Description of Artificial Sequence: Synthetic oligonucleotide
tcctgggccctcggcttctacgct

SEQ ID NO: 231935 - DNA, 23 bp, Artificial Sequence
  Description of Artificial Sequence: Synthetic oligonucleotide
cctgggccctcggcttctacgct

SEQ ID NO: 231936 - DNA, 23 bp, Artificial Sequence
  Description of Artificial Sequence: Synthetic oligonucleotide
ctgggccctcggcttctacgctg

SEQ ID NO: 231937 - DNA, 23 bp, Artificial Sequence
  Description of Artificial Sequence: Synthetic oligonucleotide
tgggccctcggcttctacgctgc

SEQ ID NO: 231938 - DNA, 22 bp, Artificial Sequence
  Description of Artificial Sequence: Synthetic oligonucleotide
gggccctcggcttctacgctgc

SEQ ID NO: 231939 - DNA, 22 bp, Artificial Sequence
  Description of Artificial Sequence: Synthetic oligonucleotide
ggccctcggcttctacgctgcg

SEQ ID NO: 231940 - DNA, 23 bp, Artificial Sequence
  Description of Artificial Sequence: Synthetic oligonucleotide
gccctcggcttctacgctgcgga

SEQ ID NO: 231941 - DNA, 25 bp, Artificial Sequence
  Description of Artificial Sequence: Synthetic oligonucleotide
ccctcggcttctacgctgcggagaa

SEQ ID NO: 231942 - DNA, 26 bp, Artificial Sequence
  Description of Artificial Sequence: Synthetic oligonucleotide
cctcggcttctacgctgcggagaaca

SEQ ID NO: 231943 - DNA, 27 bp, Artificial Sequence
  Description of Artificial Sequence: Synthetic oligonucleotide
ctcggcttctacgctgcggagaacaca

SEQ ID NO: 231944 - DNA, 27 bp, Artificial Sequence
  Description of Artificial Sequence: Synthetic oligonucleotide
tcggcttctacgctgcggagaacacac

SEQ ID NO: 231945 - DNA, 27 bp, Artificial Sequence
  Description of Artificial Sequence: Synthetic oligonucleotide
cggcttctacgctgcggagaacacact

SEQ ID NO: 231946 - DNA, 27 bp, Artificial Sequence
  Description of Artificial Sequence: Synthetic oligonucleotide
ggcttctacgctgcggagaacacactg

SEQ ID NO: 231947 - DNA, 28 bp, Artificial Sequence
  Description of Artificial Sequence: Synthetic oligonucleotide
gcttctacgctgcggagaacacactgac

SEQ ID NO: 231948 - DNA, 28 bp, Artificial Sequence
  Description of Artificial Sequence: Synthetic oligonucleotide
cttctacgctgcggagaacacactgacg

SEQ ID NO: 231949 - DNA, 29 bp, Artificial Sequence
  Description of Artificial Sequence: Synthetic oligonucleotide
ttctacgctgcggagaacacactgacgtg

SEQ ID NO: 231950 - DNA, 28 bp, Artificial Sequence
  Description of Artificial Sequence: Synthetic oligonucleotide
tctacgctgcggagaacacactgacgtg

SEQ ID NO: 231951 - DNA, 27 bp, Artificial Sequence
  Description of Artificial Sequence: Synthetic oligonucleotide
ctacgctgcggagaacacactgacgtg

SEQ ID NO: 231952 - DNA, 27 bp, Artificial Sequence
  Description of Artificial Sequence: Synthetic oligonucleotide
tacgctgcggagaacacactgacgtgg

SEQ ID NO: 231953 - DNA, 26 bp, Artificial Sequence
  Description of Artificial Sequence: Synthetic oligonucleotide
acgctgcggagaacacactgacgtgg

SEQ ID NO: 231954 - DNA, 25 bp, Artificial Sequence
  Description of Artificial Sequence: Synthetic oligonucleotide
cgctgcggagaacacactgacgtgg

SEQ ID NO: 231955 - DNA, 26 bp, Artificial Sequence
  Description of Artificial Sequence: Synthetic oligonucleotide
gctgcggagaacacactgacgtggca

SEQ ID NO: 231956 - DNA, 26 bp, Artificial Sequence
  Description of Artificial Sequence: Synthetic oligonucleotide
ctgcggagaacacactgacgtggcag

SEQ ID NO: 231957 - DNA, 26 bp, Artificial Sequence
  Description of Artificial Sequence: Synthetic oligonucleotide
tgcggagaacacactgacgtggcagc

SEQ ID NO: 231958 - DNA, 25 bp, Artificial Sequence
  Description of Artificial Sequence: Synthetic oligonucleotide
gcggagaacacactgacgtggcagc

SEQ ID NO: 231959 - DNA, 25 bp, Artificial Sequence
  Description of Artificial Sequence: Synthetic oligonucleotide
cggagaacacactgacgtggcagcg

SEQ ID NO: 231960 - DNA, 25 bp, Artificial Sequence
  Description of Artificial Sequence: Synthetic oligonucleotide
ggagaacacactgacgtggcagcgg

SEQ ID NO: 231961 - DNA, 27 bp, Artificial Sequence
  Description of Artificial Sequence: Synthetic oligonucleotide
gagaacacactgacgtggcagcggcat

SEQ ID NO: 231962 - DNA, 27 bp, Artificial Sequence
  Description of Artificial Sequence: Synthetic oligonucleotide
agaacacactgacgtggcagcggcatg

SEQ ID NO: 231963 - DNA, 26 bp, Artificial Sequence
  Description of Artificial Sequence: Synthetic oligonucleotide
gaacacactgacgtggcagcggcatg

SEQ ID NO: 231964 - DNA, 26 bp, Artificial Sequence
  Description of Artificial Sequence: Synthetic oligonucleotide
aacacactgacgtggcagcggcatgg

SEQ ID NO: 231965 - DNA, 25 bp, Artificial Sequence
  Description of Artificial Sequence: Synthetic oligonucleotide
acacactgacgtggcagcggcatgg

SEQ ID NO: 231966 - DNA, 24 bp, Artificial Sequence
  Description of Artificial Sequence: Synthetic oligonucleotide
cacactgacgtggcagcggcatgg

SEQ ID NO: 231967 - DNA, 24 bp, Artificial Sequence
  Description of Artificial Sequence: Synthetic oligonucleotide
acactgacgtggcagcggcatggc

SEQ ID NO: 231968 - DNA, 23 bp, Artificial Sequence
  Description of Artificial Sequence: Synthetic oligonucleotide
cactgacgtggcagcggcatggc

SEQ ID NO: 231969 - DNA, 24 bp, Artificial Sequence
  Description of Artificial Sequence: Synthetic oligonucleotide
actgacgtggcagcggcatggcga

SEQ ID NO: 231970 - DNA, 23 bp, Artificial Sequence
  Description of Artificial Sequence: Synthetic oligonucleotide
ctgacgtggcagcggcatggcga

SEQ ID NO: 231971 - DNA, 23 bp, Artificial Sequence
  Description of Artificial Sequence: Synthetic oligonucleotide
tgacgtggcagcggcatggcgag

SEQ ID NO: 231972 - DNA, 22 bp, Artificial Sequence
  Description of Artificial Sequence: Synthetic oligonucleotide
gacgtggcagcggcatggcgag

SEQ ID NO: 231973 - DNA, 23 bp, Artificial Sequence
  Description of Artificial Sequence: Synthetic oligonucleotide
acgtggcagcggcatggcgagca

SEQ ID NO: 231974 - DNA, 22 bp, Artificial Sequence
  Description of Artificial Sequence: Synthetic oligonucleotide
cgtggcagcggcatggcgagca

SEQ ID NO: 231975 - DNA, 22 bp, Artificial Sequence
  Description of Artificial Sequence: Synthetic oligonucleotide
gtggcagcggcatggcgagcac

SEQ ID NO: 231976 - DNA, 25 bp, Artificial Sequence
  Description of Artificial Sequence: Synthetic oligonucleotide
tggcagcggcatggcgagcaccaaa

SEQ ID NO: 231977 - DNA, 24 bp, Artificial Sequence
  Description of Artificial Sequence: Synthetic oligonucleotide
ggcagcggcatggcgagcaccaaa

SEQ ID NO: 231978 - DNA, 25 bp, Artificial Sequence
  Description of Artificial Sequence: Synthetic oligonucleotide
gcagcggcatggcgagcaccaaact

SEQ ID NO: 231979 - DNA, 26 bp, Artificial Sequence
  Description of Artificial Sequence: Synthetic oligonucleotide
cagcggcatggcgagcaccaaactca

SEQ ID NO: 231980 - DNA, 26 bp, Artificial Sequence
  Description of Artificial Sequence: Synthetic oligonucleotide
agcggcatggcgagcaccaaactcac

SEQ ID NO: 231981 - DNA, 25 bp, Artificial Sequence
  Description of Artificial Sequence: Synthetic oligonucleotide
gcggcatggcgagcaccaaactcac

SEQ ID NO: 231982 - DNA, 26 bp, Artificial Sequence
  Description of Artificial Sequence: Synthetic oligonucleotide
cggcatggcgagcaccaaactcacga

SEQ ID NO: 231983 - DNA, 27 bp, Artificial Sequence
  Description of Artificial Sequence: Synthetic oligonucleotide
ggcatggcgagcaccaaactcacgaca

SEQ ID NO: 231984 - DNA, 27 bp, Artificial Sequence
  Description of Artificial Sequence: Synthetic oligonucleotide
gcatggcgagcaccaaactcacgacac

SEQ ID NO: 231985 - DNA, 27 bp, Artificial Sequence
  Description of Artificial Sequence: Synthetic oligonucleotide
catggcgagcaccaaactcacgacacc

SEQ ID NO: 231986 - DNA, 27 bp, Artificial Sequence
  Description of Artificial Sequence: Synthetic oligonucleotide
atggcgagcaccaaactcacgacaccg

SEQ ID NO: 231987 - DNA, 27 bp, Artificial Sequence
  Description of Artificial Sequence: Synthetic oligonucleotide
tggcgagcaccaaactcacgacaccga

SEQ ID NO: 231988 - DNA, 26 bp, Artificial Sequence
  Description of Artificial Sequence: Synthetic oligonucleotide
ggcgagcaccaaactcacgacaccga

SEQ ID NO: 231989 - DNA, 26 bp, Artificial Sequence
  Description of Artificial Sequence: Synthetic oligonucleotide
gcgagcaccaaactcacgacaccgag

SEQ ID NO: 231990 - DNA, 27 bp, Artificial Sequence
  Description of Artificial Sequence: Synthetic oligonucleotide
cgagcaccaaactcacgacaccgaggt

SEQ ID NO: 231991 - DNA, 28 bp, Artificial Sequence
  Description of Artificial Sequence: Synthetic oligonucleotide
gagcaccaaactcacgacaccgaggttg

SEQ ID NO: 231992 - DNA, 29 bp, Artificial Sequence
  Description of Artificial Sequence: Synthetic oligonucleotide
agcaccaaactcacgacaccgaggttgtg

SEQ ID NO: 231993 - DNA, 28 bp, Artificial Sequence
  Description of Artificial Sequence: Synthetic oligonucleotide
gcaccaaactcacgacaccgaggttgtg

SEQ ID NO: 231994 - DNA, 28 bp, Artificial Sequence
  Description of Artificial Sequence: Synthetic oligonucleotide
caccaaactcacgacaccgaggttgtgg

SEQ ID NO: 231995 - DNA, 29 bp, Artificial Sequence
  Description of Artificial Sequence: Synthetic oligonucleotide
accaaactcacgacaccgaggttgtggag

SEQ ID NO: 231996 - DNA, 28 bp, Artificial Sequence
  Description of Artificial Sequence: Synthetic oligonucleotide
ccaaactcacgacaccgaggttgtggag

SEQ ID NO: 231997 - DNA, 29 bp, Artificial Sequence
  Description of Artificial Sequence: Synthetic oligonucleotide
caaactcacgacaccgaggttgtggagag

SEQ ID NO: 231998 - DNA, 29 bp, Artificial Sequence
  Description of Artificial Sequence: Synthetic oligonucleotide
aaactcacgacaccgaggttgtggagagc

SEQ ID NO: 231999 - DNA, 28 bp, Artificial Sequence
  Description of Artificial Sequence: Synthetic oligonucleotide
aactcacgacaccgaggttgtggagagc

SEQ ID NO: 232000 - DNA, 27 bp, Artificial Sequence
  Description of Artificial Sequence: Synthetic oligonucleotide
actcacgacaccgaggttgtggagagc

SEQ ID NO: 232001 - DNA, 27 bp, Artificial Sequence
  Description of Artificial Sequence: Synthetic oligonucleotide
ctcacgacaccgaggttgtggagagca

SEQ ID NO: 232002 - DNA, 27 bp, Artificial Sequence
  Description of Artificial Sequence: Synthetic oligonucleotide
tcacgacaccgaggttgtggagagcag

SEQ ID NO: 232003 - DNA, 26 bp, Artificial Sequence
  Description of Artificial Sequence: Synthetic oligonucleotide
cacgacaccgaggttgtggagagcag

SEQ ID NO: 232004 - DNA, 26 bp, Artificial Sequence
  Description of Artificial Sequence: Synthetic oligonucleotide
acgacaccgaggttgtggagagcagg

SEQ ID NO: 232005 - DNA, 25 bp, Artificial Sequence
  Description of Artificial Sequence: Synthetic oligonucleotide
cgacaccgaggttgtggagagcagg

SEQ ID NO: 232006 - DNA, 25 bp, Artificial Sequence
  Description of Artificial Sequence: Synthetic oligonucleotide
gacaccgaggttgtggagagcaggc

SEQ ID NO: 232007 - DNA, 26 bp, Artificial Sequence
  Description of Artificial Sequence: Synthetic oligonucleotide
acaccgaggttgtggagagcaggcca

SEQ ID NO: 232008 - DNA, 25 bp, Artificial Sequence
  Description of Artificial Sequence: Synthetic oligonucleotide
caccgaggttgtggagagcaggcca

SEQ ID NO: 232009 - DNA, 25 bp, Artificial Sequence
  Description of Artificial Sequence: Synthetic oligonucleotide
accgaggttgtggagagcaggccag

SEQ ID NO: 232010 - DNA, 24 bp, Artificial Sequence
  Description of Artificial Sequence: Synthetic oligonucleotide
ccgaggttgtggagagcaggccag

SEQ ID NO: 232011 - DNA, 25 bp, Artificial Sequence
  Description of Artificial Sequence: Synthetic oligonucleotide
cgaggttgtggagagcaggccagct

SEQ ID NO: 232012 - DNA, 25 bp, Artificial Sequence
  Description of Artificial Sequence: Synthetic oligonucleotide
gaggttgtggagagcaggccagctg

SEQ ID NO: 232013 - DNA, 26 bp, Artificial Sequence
  Description of Artificial Sequence: Synthetic oligonucleotide
aggttgtggagagcaggccagctgga

SEQ ID NO: 232014 - DNA, 25 bp, Artificial Sequence
  Description of Artificial Sequence: Synthetic oligonucleotide
ggttgtggagagcaggccagctgga

SEQ ID NO: 232015 - DNA, 27 bp, Artificial Sequence
  Description of Artificial Sequence: Synthetic oligonucleotide
gttgtggagagcaggccagctggagat

SEQ ID NO: 232016 - DNA, 27 bp, Artificial Sequence
  Description of Artificial Sequence: Synthetic oligonucleotide
ttgtggagagcaggccagctggagatg

SEQ ID NO: 232017 - DNA, 26 bp, Artificial Sequence
  Description of Artificial Sequence: Synthetic oligonucleotide
tgtggagagcaggccagctggagatg

SEQ ID NO: 232018 - DNA, 25 bp, Artificial Sequence
  Description of Artificial Sequence: Synthetic oligonucleotide
gtggagagcaggccagctggagatg

SEQ ID NO: 232019 - DNA, 27 bp, Artificial Sequence
  Description of Artificial Sequence: Synthetic oligonucleotide
tggagagcaggccagctggagatggat

SEQ ID NO: 232020 - DNA, 26 bp, Artificial Sequence
  Description of Artificial Sequence: Synthetic oligonucleotide
ggagagcaggccagctggagatggat

SEQ ID NO: 232021 - DNA, 26 bp, Artificial Sequence
  Description of Artificial Sequence: Synthetic oligonucleotide
gagagcaggccagctggagatggatc

SEQ ID NO: 232022 - DNA, 27 bp, Artificial Sequence
  Description of Artificial Sequence: Synthetic oligonucleotide
agagcaggccagctggagatggatcct

SEQ ID NO: 232023 - DNA, 27 bp, Artificial Sequence
  Description of Artificial Sequence: Synthetic oligonucleotide
gagcaggccagctggagatggatcctt

SEQ ID NO: 232024 - DNA, 27 bp, Artificial Sequence
  Description of Artificial Sequence: Synthetic oligonucleotide
agcaggccagctggagatggatccttc

SEQ ID NO: 232025 - DNA, 26 bp, Artificial Sequence
  Description of Artificial Sequence: Synthetic oligonucleotide
gcaggccagctggagatggatccttc

SEQ ID NO: 232026 - DNA, 27 bp, Artificial Sequence
  Description of Artificial Sequence: Synthetic oligonucleotide
caggccagctggagatggatccttcca

SEQ ID NO: 232027 - DNA, 27 bp, Artificial Sequence
  Description of Artificial Sequence: Synthetic oligonucleotide
aggccagctggagatggatccttccag

SEQ ID NO: 232028 - DNA, 27 bp, Artificial Sequence
  Description of Artificial Sequence: Synthetic oligonucleotide
ggccagctggagatggatccttccaga

SEQ ID NO: 232029 - DNA, 28 bp, Artificial Sequence
  Description of Artificial Sequence: Synthetic oligonucleotide
gccagctggagatggatccttccagatg

SEQ ID NO: 232030 - DNA, 29 bp, Artificial Sequence
  Description of Artificial Sequence: Synthetic oligonucleotide
ccagctggagatggatccttccagatgtg

SEQ ID NO: 232031 - DNA, 29 bp, Artificial Sequence
  Description of Artificial Sequence: Synthetic oligonucleotide
cagctggagatggatccttccagatgtgg

SEQ ID NO: 232032 - DNA, 29 bp, Artificial Sequence
  Description of Artificial Sequence: Synthetic oligonucleotide
agctggagatggatccttccagatgtggg

SEQ ID NO: 232033 - DNA, 28 bp, Artificial Sequence
  Description of Artificial Sequence: Synthetic oligonucleotide
gctggagatggatccttccagatgtggg

SEQ ID NO: 232034 - DNA, 28 bp, Artificial Sequence
  Description of Artificial Sequence: Synthetic oligonucleotide
ctggagatggatccttccagatgtgggc

SEQ ID NO: 232035 - DNA, 29 bp, Artificial Sequence
  Description of Artificial Sequence: Synthetic oligonucleotide
tggagatggatccttccagatgtgggcag

SEQ ID NO: 232036 - DNA, 28 bp, Artificial Sequence
  Description of Artificial Sequence: Synthetic oligonucleotide
ggagatggatccttccagatgtgggcag

SEQ ID NO: 232037 - DNA, 28 bp, Artificial Sequence
  Description of Artificial Sequence: Synthetic oligonucleotide
gagatggatccttccagatgtgggcagc

SEQ ID NO: 232038 - DNA, 29 bp, Artificial Sequence
  Description of Artificial Sequence: Synthetic oligonucleotide
agatggatccttccagatgtgggcagcag

SEQ ID NO: 232039 - DNA, 28 bp, Artificial Sequence
  Description of Artificial Sequence: Synthetic oligonucleotide
gatggatccttccagatgtgggcagcag

SEQ ID NO: 232040 - DNA, 29 bp, Artificial Sequence
  Description of Artificial Sequence: Synthetic oligonucleotide
atggatccttccagatgtgggcagcagtg

SEQ ID NO: 232041 - DNA, 28 bp, Artificial Sequence
  Description of Artificial Sequence: Synthetic oligonucleotide
tggatccttccagatgtgggcagcagtg

SEQ ID NO: 232042 - DNA, 27 bp, Artificial Sequence
  Description of Artificial Sequence: Synthetic oligonucleotide
ggatccttccagatgtgggcagcagtg

SEQ ID NO: 232043 - DNA, 27 bp, Artificial Sequence
  Description of Artificial Sequence: Synthetic oligonucleotide
gatccttccagatgtgggcagcagtgg

SEQ ID NO: 232044 - DNA, 28 bp, Artificial Sequence
  Description of Artificial Sequence: Synthetic oligonucleotide
atccttccagatgtgggcagcagtggtg

SEQ ID NO: 232045 - DNA, 27 bp, Artificial Sequence
  Description of Artificial Sequence: Synthetic oligonucleotide
tccttccagatgtgggcagcagtggtg

SEQ ID NO: 232046 - DNA, 26 bp, Artificial Sequence
  Description of Artificial Sequence: Synthetic oligonucleotide
ccttccagatgtgggcagcagtggtg

SEQ ID NO: 232047 - DNA, 27 bp, Artificial Sequence
  Description of Artificial Sequence: Synthetic oligonucleotide
cttccagatgtgggcagcagtggtggt

SEQ ID NO: 232048 - DNA, 27 bp, Artificial Sequence
  Description of Artificial Sequence: Synthetic oligonucleotide
ttccagatgtgggcagcagtggtggtg

SEQ ID NO: 232049 - DNA, 26 bp, Artificial Sequence
  Description of Artificial Sequence: Synthetic oligonucleotide
tccagatgtgggcagcagtggtggtg

SEQ ID NO: 232050 - DNA, 25 bp, Artificial Sequence
  Description of Artificial Sequence: Synthetic oligonucleotide
ccagatgtgggcagcagtggtggtg

SEQ ID NO: 232051 - DNA, 25 bp, Artificial Sequence
  Description of Artificial Sequence: Synthetic oligonucleotide
cagatgtgggcagcagtggtggtgg

SEQ ID NO: 232052 - DNA, 27 bp, Artificial Sequence
  Description of Artificial Sequence: Synthetic oligonucleotide
agatgtgggcagcagtggtggtggctt

SEQ ID NO: 232053 - DNA, 26 bp, Artificial Sequence
  Description of Artificial Sequence: Synthetic oligonucleotide
gatgtgggcagcagtggtggtggctt

SEQ ID NO: 232054 - DNA, 27 bp, Artificial Sequence
  Description of Artificial Sequence: Synthetic oligonucleotide
atgtgggcagcagtggtggtggcttct

SEQ ID NO: 232055 - DNA, 26 bp, Artificial Sequence
  Description of Artificial Sequence: Synthetic oligonucleotide
tgtgggcagcagtggtggtggcttct

SEQ ID NO: 232056 - DNA, 25 bp, Artificial Sequence
  Description of Artificial Sequence: Synthetic oligonucleotide
gtgggcagcagtggtggtggcttct

SEQ ID NO: 232057 - DNA, 25 bp, Artificial Sequence
  Description of Artificial Sequence: Synthetic oligonucleotide
tgggcagcagtggtggtggcttctg

SEQ ID NO: 232058 - DNA, 24 bp, Artificial Sequence
  Description of Artificial Sequence: Synthetic oligonucleotide
gggcagcagtggtggtggcttctg

SEQ ID NO: 232059 - DNA, 25 bp, Artificial Sequence
  Description of Artificial Sequence: Synthetic oligonucleotide
ggcagcagtggtggtggcttctgga

SEQ ID NO: 232060 - DNA, 27 bp, Artificial Sequence
  Description of Artificial Sequence: Synthetic oligonucleotide
gcagcagtggtggtggcttctggagta

SEQ ID NO: 232061 - DNA, 27 bp, Artificial Sequence
  Description of Artificial Sequence: Synthetic oligonucleotide
cagcagtggtggtggcttctggagtag

SEQ ID NO: 232062 - DNA, 28 bp, Artificial Sequence
  Description of Artificial Sequence: Synthetic oligonucleotide
agcagtggtggtggcttctggagtagag

SEQ ID NO: 232063 - DNA, 27 bp, Artificial Sequence
  Description of Artificial Sequence: Synthetic oligonucleotide
gcagtggtggtggcttctggagtagag

SEQ ID NO: 232064 - DNA, 27 bp, Artificial Sequence
  Description of Artificial Sequence: Synthetic oligonucleotide
cagtggtggtggcttctggagtagagc

SEQ ID NO: 232065 - DNA, 28 bp, Artificial Sequence
  Description of Artificial Sequence: Synthetic oligonucleotide
agtggtggtggcttctggagtagagcag

SEQ ID NO: 232066 - DNA, 27 bp, Artificial Sequence
  Description of Artificial Sequence: Synthetic oligonucleotide
gtggtggtggcttctggagtagagcag

SEQ ID NO: 232067 - DNA, 28 bp, Artificial Sequence
  Description of Artificial Sequence: Synthetic oligonucleotide
tggtggtggcttctggagtagagcagag

SEQ ID NO: 232068 - DNA, 27 bp, Artificial Sequence
  Description of Artificial Sequence: Synthetic oligonucleotide
ggtggtggcttctggagtagagcagag

SEQ ID NO: 232069 - DNA, 30 bp, Artificial Sequence
  Description of Artificial Sequence: Synthetic oligonucleotide
gtggtggcttctggagtagagcagagttac

SEQ ID NO: 232070 - DNA, 31 bp, Artificial Sequence
  Description of Artificial Sequence: Synthetic oligonucleotide
tggtggcttctggagtagagcagagttacac

SEQ ID NO: 232071 - DNA, 30 bp, Artificial Sequence
  Description of Artificial Sequence: Synthetic oligonucleotide
ggtggcttctggagtagagcagagttacac

SEQ ID NO: 232072 - DNA, 32 bp, Artificial Sequence
  Description of Artificial Sequence: Synthetic oligonucleotide
gtggcttctggagtagagcagagttacacatg

SEQ ID NO: 232073 - DNA, 32 bp, Artificial Sequence
  Description of Artificial Sequence: Synthetic oligonucleotide
tggcttctggagtagagcagagttacacatgc

SEQ ID NO: 232074 - DNA, 31 bp, Artificial Sequence
  Description of Artificial Sequence: Synthetic oligonucleotide
ggcttctggagtagagcagagttacacatgc

SEQ ID NO: 232075 - DNA, 31 bp, Artificial Sequence
  Description of Artificial Sequence: Synthetic oligonucleotide
gcttctggagtagagcagagttacacatgcg

SEQ ID NO: 232076 - DNA, 33 bp, Artificial Sequence
  Description of Artificial Sequence: Synthetic oligonucleotide
cttctggagtagagcagagttacacatgcgatg

SEQ ID NO: 232077 - DNA, 34 bp, Artificial Sequence
  Description of Artificial Sequence: Synthetic oligonucleotide
ttctggagtagagcagagttacacatgcgatgtg

SEQ ID NO: 232078 - DNA, 33 bp, Artificial Sequence
  Description of Artificial Sequence: Synthetic oligonucleotide
tctggagtagagcagagttacacatgcgatgtg

SEQ ID NO: 232079 - DNA, 32 bp, Artificial Sequence
  Description of Artificial Sequence: Synthetic oligonucleotide
ctggagtagagcagagttacacatgcgatgtg

SEQ ID NO: 232080 - DNA, 32 bp, Artificial Sequence
  Description of Artificial Sequence: Synthetic oligonucleotide
tggagtagagcagagttacacatgcgatgtgc

SEQ ID NO: 232081 - DNA, 31 bp, Artificial Sequence
  Description of Artificial Sequence: Synthetic oligonucleotide
ggagtagagcagagttacacatgcgatgtgc

SEQ ID NO: 232082 - DNA, 32 bp, Artificial Sequence
  Description of Artificial Sequence: Synthetic oligonucleotide
gagtagagcagagttacacatgcgatgtgcag

SEQ ID NO: 232083 - DNA, 32 bp, Artificial Sequence
  Description of Artificial Sequence: Synthetic oligonucleotide
agtagagcagagttacacatgcgatgtgcagc

SEQ ID NO: 232084 - DNA, 31 bp, Artificial Sequence
  Description of Artificial Sequence: Synthetic oligonucleotide
gtagagcagagttacacatgcgatgtgcagc

SEQ ID NO: 232085 - DNA, 33 bp, Artificial Sequence
  Description of Artificial Sequence: Synthetic oligonucleotide
tagagcagagttacacatgcgatgtgcagcttg

SEQ ID NO: 232086 - DNA, 32 bp, Artificial Sequence
  Description of Artificial Sequence: Synthetic oligonucleotide
agagcagagttacacatgcgatgtgcagcttg

SEQ ID NO: 232087 - DNA, 31 bp, Artificial Sequence
  Description of Artificial Sequence: Synthetic oligonucleotide
gagcagagttacacatgcgatgtgcagcttg

SEQ ID NO: 232088 - DNA, 32 bp, Artificial Sequence
  Description of Artificial Sequence: Synthetic oligonucleotide
agcagagttacacatgcgatgtgcagcttgag

SEQ ID NO: 232089 - DNA, 31 bp, Artificial Sequence
  Description of Artificial Sequence: Synthetic oligonucleotide
gcagagttacacatgcgatgtgcagcttgag

SEQ ID NO: 232090 - DNA, 31 bp, Artificial Sequence
  Description of Artificial Sequence: Synthetic oligonucleotide
cagagttacacatgcgatgtgcagcttgagg

SEQ ID NO: 232091 - DNA, 31 bp, Artificial Sequence
  Description of Artificial Sequence: Synthetic oligonucleotide
agagttacacatgcgatgtgcagcttgaggg

SEQ ID NO: 232092 - DNA, 30 bp, Artificial Sequence
  Description of Artificial Sequence: Synthetic oligonucleotide
gagttacacatgcgatgtgcagcttgaggg

SEQ ID NO: 232093 - DNA, 30 bp, Artificial Sequence
  Description of Artificial Sequence: Synthetic oligonucleotide
agttacacatgcgatgtgcagcttgagggg

SEQ ID NO: 232094 - DNA, 29 bp, Artificial Sequence
  Description of Artificial Sequence: Synthetic oligonucleotide
gttacacatgcgatgtgcagcttgagggg

SEQ ID NO: 232095 - DNA, 29 bp, Artificial Sequence
  Description of Artificial Sequence: Synthetic oligonucleotide
ttacacatgcgatgtgcagcttgaggggc

SEQ ID NO: 232096 - DNA, 28 bp, Artificial Sequence
  Description of Artificial Sequence: Synthetic oligonucleotide
tacacatgcgatgtgcagcttgaggggc

SEQ ID NO: 232097 - DNA, 27 bp, Artificial Sequence
  Description of Artificial Sequence: Synthetic oligonucleotide
acacatgcgatgtgcagcttgaggggc

SEQ ID NO: 232098 - DNA, 27 bp, Artificial Sequence
  Description of Artificial Sequence: Synthetic oligonucleotide
cacatgcgatgtgcagcttgaggggca

SEQ ID NO: 232099 - DNA, 27 bp, Artificial Sequence
  Description of Artificial Sequence: Synthetic oligonucleotide
acatgcgatgtgcagcttgaggggcag

SEQ ID NO: 232100 - DNA, 26 bp, Artificial Sequence
  Description of Artificial Sequence: Synthetic oligonucleotide
catgcgatgtgcagcttgaggggcag

SEQ ID NO: 232101 - DNA, 26 bp, Artificial Sequence
  Description of Artificial Sequence: Synthetic oligonucleotide
atgcgatgtgcagcttgaggggcagc

SEQ ID NO: 232102 - DNA, 25 bp, Artificial Sequence
  Description of Artificial Sequence: Synthetic oligonucleotide
tgcgatgtgcagcttgaggggcagc

SEQ ID NO: 232103 - DNA, 24 bp, Artificial Sequence
  Description of Artificial Sequence: Synthetic oligonucleotide
gcgatgtgcagcttgaggggcagc

SEQ ID NO: 232104 - DNA, 24 bp, Artificial Sequence
  Description of Artificial Sequence: Synthetic oligonucleotide
cgatgtgcagcttgaggggcagcc

SEQ ID NO: 232105 - DNA, 26 bp, Artificial Sequence
  Description of Artificial Sequence: Synthetic oligonucleotide
gatgtgcagcttgaggggcagccgaa

SEQ ID NO: 232106 - DNA, 26 bp, Artificial Sequence
  Description of Artificial Sequence: Synthetic oligonucleotide
atgtgcagcttgaggggcagccgaag

SEQ ID NO: 232107 - DNA, 25 bp, Artificial Sequence
  Description of Artificial Sequence: Synthetic oligonucleotide
tgtgcagcttgaggggcagccgaag

SEQ ID NO: 232108 - DNA, 24 bp, Artificial Sequence
  Description of Artificial Sequence: Synthetic oligonucleotide
gtgcagcttgaggggcagccgaag

SEQ ID NO: 232109 - DNA, 24 bp, Artificial Sequence
  Description of Artificial Sequence: Synthetic oligonucleotide
tgcagcttgaggggcagccgaagc

SEQ ID NO: 232110 - DNA, 23 bp, Artificial Sequence
  Description of Artificial Sequence: Synthetic oligonucleotide
gcagcttgaggggcagccgaagc

SEQ ID NO: 232111 - DNA, 23 bp, Artificial Sequence
  Description of Artificial Sequence: Synthetic oligonucleotide
cagcttgaggggcagccgaagcc

SEQ ID NO: 232112 - DNA, 23 bp, Artificial Sequence
  Description of Artificial Sequence: Synthetic oligonucleotide
agcttgaggggcagccgaagccg

SEQ ID NO: 232113 - DNA, 22 bp, Artificial Sequence
  Description of Artificial Sequence: Synthetic oligonucleotide
gcttgaggggcagccgaagccg

SEQ ID NO: 232114 - DNA, 23 bp, Artificial Sequence
  Description of Artificial Sequence: Synthetic oligonucleotide
cttgaggggcagccgaagccgct

SEQ ID NO: 232115 - DNA, 24 bp, Artificial Sequence
  Description of Artificial Sequence: Synthetic oligonucleotide
ttgaggggcagccgaagccgctca

SEQ ID NO: 232116 - DNA, 23 bp, Artificial Sequence
  Description of Artificial Sequence: Synthetic oligonucleotide
tgaggggcagccgaagccgctca

SEQ ID NO: 232117 - DNA, 22 bp, Artificial Sequence
  Description of Artificial Sequence: Synthetic oligonucleotide
gaggggcagccgaagccgctca

SEQ ID NO: 232118 - DNA, 22 bp, Artificial Sequence
  Description of Artificial Sequence: Synthetic oligonucleotide
aggggcagccgaagccgctcac

SEQ ID NO: 232119 - DNA, 21 bp, Artificial Sequence
  Description of Artificial Sequence: Synthetic oligonucleotide
ggggcagccgaagccgctcac

SEQ ID NO: 232120 - DNA, 21 bp, Artificial Sequence
  Description of Artificial Sequence: Synthetic oligonucleotide
gggcagccgaagccgctcacc

SEQ ID NO: 232121 - DNA, 22 bp, Artificial Sequence
  Description of Artificial Sequence: Synthetic oligonucleotide
ggcagccgaagccgctcaccct

SEQ ID NO: 232122 - DNA, 23 bp, Artificial Sequence
  Description of Artificial Sequence: Synthetic oligonucleotide
gcagccgaagccgctcaccctga

SEQ ID NO: 232123 - DNA, 25 bp, Artificial Sequence
  Description of Artificial Sequence: Synthetic oligonucleotide
cagccgaagccgctcaccctgacat

SEQ ID NO: 232124 - DNA, 25 bp, Artificial Sequence
  Description of Artificial Sequence: Synthetic oligonucleotide
agccgaagccgctcaccctgacatg

SEQ ID NO: 232125 - DNA, 24 bp, Artificial Sequence
  Description of Artificial Sequence: Synthetic oligonucleotide
gccgaagccgctcaccctgacatg

SEQ ID NO: 232126 - DNA, 24 bp, Artificial Sequence
  Description of Artificial Sequence: Synthetic oligonucleotide
ccgaagccgctcaccctgacatgg

SEQ ID NO: 232127 - DNA, 25 bp, Artificial Sequence
  Description of Artificial Sequence: Synthetic oligonucleotide
cgaagccgctcaccctgacatggga

SEQ ID NO: 232128 - DNA, 25 bp, Artificial Sequence
  Description of Artificial Sequence: Synthetic oligonucleotide
gaagccgctcaccctgacatgggag

SEQ ID NO: 232129 - DNA, 25 bp, Artificial Sequence
  Description of Artificial Sequence: Synthetic oligonucleotide
aagccgctcaccctgacatgggagg

SEQ ID NO: 232130 - DNA, 24 bp, Artificial Sequence
  Description of Artificial Sequence: Synthetic oligonucleotide
agccgctcaccctgacatgggagg

SEQ ID NO: 232131 - DNA, 23 bp, Artificial Sequence
  Description of Artificial Sequence: Synthetic oligonucleotide
gccgctcaccctgacatgggagg

SEQ ID NO: 232132 - DNA, 23 bp, Artificial Sequence
  Description of Artificial Sequence: Synthetic oligonucleotide
ccgctcaccctgacatgggaggc

SEQ ID NO: 232133 - DNA, 24 bp, Artificial Sequence
  Description of Artificial Sequence: Synthetic oligonucleotide
cgctcaccctgacatgggaggcgt

SEQ ID NO: 232134 - DNA, 26 bp, Artificial Sequence
  Description of Artificial Sequence: Synthetic oligonucleotide
gctcaccctgacatgggaggcgtctt

SEQ ID NO: 232135 - DNA, 26 bp, Artificial Sequence
  Description of Artificial Sequence: Synthetic oligonucleotide
ctcaccctgacatgggaggcgtcttc

SEQ ID NO: 232136 - DNA, 26 bp, Artificial Sequence
  Description of Artificial Sequence: Synthetic oligonucleotide
tcaccctgacatgggaggcgtcttcc

SEQ ID NO: 232137 - DNA, 25 bp, Artificial Sequence
  Description of Artificial Sequence: Synthetic oligonucleotide
caccctgacatgggaggcgtcttcc

SEQ ID NO: 232138 - DNA, 26 bp, Artificial Sequence
  Description of Artificial Sequence: Synthetic oligonucleotide
accctgacatgggaggcgtcttccca

SEQ ID NO: 232139 - DNA, 25 bp, Artificial Sequence
  Description of Artificial Sequence: Synthetic oligonucleotide
ccctgacatgggaggcgtcttccca

SEQ ID NO: 232140 - DNA, 25 bp, Artificial Sequence
  Description of Artificial Sequence: Synthetic oligonucleotide
cctgacatgggaggcgtcttcccag

SEQ ID NO: 232141 - DNA, 25 bp, Artificial Sequence
  Description of Artificial Sequence: Synthetic oligonucleotide
ctgacatgggaggcgtcttcccagc

SEQ ID NO: 232142 - DNA, 25 bp, Artificial Sequence
  Description of Artificial Sequence: Synthetic oligonucleotide
tgacatgggaggcgtcttcccagcg

SEQ ID NO: 232143 - DNA, 24 bp, Artificial Sequence
  Description of Artificial Sequence: Synthetic oligonucleotide
gacatgggaggcgtcttcccagcg

SEQ ID NO: 232144 - DNA, 25 bp, Artificial Sequence
  Description of Artificial Sequence: Synthetic oligonucleotide
acatgggaggcgtcttcccagcgca

SEQ ID NO: 232145 - DNA, 24 bp, Artificial Sequence
  Description of Artificial Sequence: Synthetic oligonucleotide
catgggaggcgtcttcccagcgca

SEQ ID NO: 232146 - DNA, 24 bp, Artificial Sequence
  Description of Artificial Sequence: Synthetic oligonucleotide
atgggaggcgtcttcccagcgcac

SEQ ID NO: 232147 - DNA, 23 bp, Artificial Sequence
  Description of Artificial Sequence: Synthetic oligonucleotide
tgggaggcgtcttcccagcgcac

SEQ ID NO: 232148 - DNA, 22 bp, Artificial Sequence
  Description of Artificial Sequence: Synthetic oligonucleotide
gggaggcgtcttcccagcgcac

SEQ ID NO: 232149 - DNA, 24 bp, Artificial Sequence
  Description of Artificial Sequence: Synthetic oligonucleotide
ggaggcgtcttcccagcgcaccat

SEQ ID NO: 232150 - DNA, 24 bp, Artificial Sequence
  Description of Artificial Sequence: Synthetic oligonucleotide
gaggcgtcttcccagcgcaccatc

SEQ ID NO: 232151 - DNA, 24 bp, Artificial Sequence
  Description of Artificial Sequence: Synthetic oligonucleotide
aggcgtcttcccagcgcaccatcc

SEQ ID NO: 232152 - DNA, 23 bp, Artificial Sequence
  Description of Artificial Sequence: Synthetic oligonucleotide
ggcgtcttcccagcgcaccatcc

SEQ ID NO: 232153 - DNA, 23 bp, Artificial Sequence
  Description of Artificial Sequence: Synthetic oligonucleotide
gcgtcttcccagcgcaccatccc

SEQ ID NO: 232154 - DNA, 25 bp, Artificial Sequence
  Description of Artificial Sequence: Synthetic oligonucleotide
cgtcttcccagcgcaccatcccgat

SEQ ID NO: 232155 - DNA, 25 bp, Artificial Sequence
  Description of Artificial Sequence: Synthetic oligonucleotide
gtcttcccagcgcaccatcccgatc

SEQ ID NO: 232156 - DNA, 26 bp, Artificial Sequence
  Description of Artificial Sequence: Synthetic oligonucleotide
tcttcccagcgcaccatcccgatcgt

SEQ ID NO: 232157 - DNA, 25 bp, Artificial Sequence
  Description of Artificial Sequence: Synthetic oligonucleotide
cttcccagcgcaccatcccgatcgt

SEQ ID NO: 232158 - DNA, 25 bp, Artificial Sequence
  Description of Artificial Sequence: Synthetic oligonucleotide
ttcccagcgcaccatcccgatcgtg

SEQ ID NO: 232159 - DNA, 24 bp, Artificial Sequence
  Description of Artificial Sequence: Synthetic oligonucleotide
tcccagcgcaccatcccgatcgtg

SEQ ID NO: 232160 - DNA, 23 bp, Artificial Sequence
  Description of Artificial Sequence: Synthetic oligonucleotide
cccagcgcaccatcccgatcgtg

SEQ ID NO: 232161 - DNA, 23 bp, Artificial Sequence
  Description of Artificial Sequence: Synthetic oligonucleotide
ccagcgcaccatcccgatcgtgg

SEQ ID NO: 232162 - DNA, 23 bp, Artificial Sequence
  Description of Artificial Sequence: Synthetic oligonucleotide
cagcgcaccatcccgatcgtggg

SEQ ID NO: 232163 - DNA, 25 bp, Artificial Sequence
  Description of Artificial Sequence: Synthetic oligonucleotide
agcgcaccatcccgatcgtgggctt

SEQ ID NO: 232164 - DNA, 24 bp, Artificial Sequence
  Description of Artificial Sequence: Synthetic oligonucleotide
gcgcaccatcccgatcgtgggctt

SEQ ID NO: 232165 - DNA, 24 bp, Artificial Sequence
  Description of Artificial Sequence: Synthetic oligonucleotide
cgcaccatcccgatcgtgggcttc

SEQ ID NO: 232166 - DNA, 26 bp, Artificial Sequence
  Description of Artificial Sequence: Synthetic oligonucleotide
gcaccatcccgatcgtgggcttcgtt

SEQ ID NO: 232167 - DNA, 26 bp, Artificial Sequence
  Description of Artificial Sequence: Synthetic oligonucleotide
caccatcccgatcgtgggcttcgttg

SEQ ID NO: 232168 - DNA, 27 bp, Artificial Sequence
  Description of Artificial Sequence: Synthetic oligonucleotide
accatcccgatcgtgggcttcgttgct

SEQ ID NO: 232169 - DNA, 26 bp, Artificial Sequence
  Description of Artificial Sequence: Synthetic oligonucleotide
ccatcccgatcgtgggcttcgttgct

SEQ ID NO: 232170 - DNA, 26 bp, Artificial Sequence
  Description of Artificial Sequence: Synthetic oligonucleotide
catcccgatcgtgggcttcgttgctc

SEQ ID NO: 232171 - DNA, 26 bp, Artificial Sequence
  Description of Artificial Sequence: Synthetic oligonucleotide
atcccgatcgtgggcttcgttgctcg

SEQ ID NO: 232172 - DNA, 25 bp, Artificial Sequence
  Description of Artificial Sequence: Synthetic oligonucleotide
tcccgatcgtgggcttcgttgctcg

SEQ ID NO: 232173 - DNA, 24 bp, Artificial Sequence
  Description of Artificial Sequence: Synthetic oligonucleotide
cccgatcgtgggcttcgttgctcg

SEQ ID NO: 232174 - DNA, 24 bp, Artificial Sequence
  Description of Artificial Sequence: Synthetic oligonucleotide
ccgatcgtgggcttcgttgctcgc

SEQ ID NO: 232175 - DNA, 25 bp, Artificial Sequence
  Description of Artificial Sequence: Synthetic oligonucleotide
cgatcgtgggcttcgttgctcgcct

SEQ ID NO: 232176 - DNA, 25 bp, Artificial Sequence
  Description of Artificial Sequence: Synthetic oligonucleotide
gatcgtgggcttcgttgctcgcctg

SEQ ID NO: 232177 - DNA, 25 bp, Artificial Sequence
  Description of Artificial Sequence: Synthetic oligonucleotide
atcgtgggcttcgttgctcgcctgg

SEQ ID NO: 232178 - DNA, 24 bp, Artificial Sequence
  Description of Artificial Sequence: Synthetic oligonucleotide
tcgtgggcttcgttgctcgcctgg

SEQ ID NO: 232179 - DNA, 23 bp, Artificial Sequence
  Description of Artificial Sequence: Synthetic oligonucleotide
cgtgggcttcgttgctcgcctgg

SEQ ID NO: 232180 - DNA, 24 bp, Artificial Sequence
  Description of Artificial Sequence: Synthetic oligonucleotide
gtgggcttcgttgctcgcctggct

SEQ ID NO: 232181 - DNA, 25 bp, Artificial Sequence
  Description of Artificial Sequence: Synthetic oligonucleotide
tgggcttcgttgctcgcctggctga

SEQ ID NO: 232182 - DNA, 24 bp, Artificial Sequence
  Description of Artificial Sequence: Synthetic oligonucleotide
gggcttcgttgctcgcctggctga

SEQ ID NO: 232183 - DNA, 24 bp, Artificial Sequence
  Description of Artificial Sequence: Synthetic oligonucleotide
ggcttcgttgctcgcctggctgac

SEQ ID NO: 232184 - DNA, 26 bp, Artificial Sequence
  Description of Artificial Sequence: Synthetic oligonucleotide
gcttcgttgctcgcctggctgaccta

SEQ ID NO: 232185 - DNA, 26 bp, Artificial Sequence
  Description of Artificial Sequence: Synthetic oligonucleotide
cttcgttgctcgcctggctgacctag

SEQ ID NO: 232186 - DNA, 27 bp, Artificial Sequence
  Description of Artificial Sequence: Synthetic oligonucleotide
ttcgttgctcgcctggctgacctagca

SEQ ID NO: 232187 - DNA, 26 bp, Artificial Sequence
  Description of Artificial Sequence: Synthetic oligonucleotide
tcgttgctcgcctggctgacctagca

SEQ ID NO: 232188 - DNA, 25 bp, Artificial Sequence
  Description of Artificial Sequence: Synthetic oligonucleotide
cgttgctcgcctggctgacctagca

SEQ ID NO: 232189 - DNA, 27 bp, Artificial Sequence
  Description of Artificial Sequence: Synthetic oligonucleotide
gttgctcgcctggctgacctagcagtt

SEQ ID NO: 232190 - DNA, 27 bp, Artificial Sequence
  Description of Artificial Sequence: Synthetic oligonucleotide
ttgctcgcctggctgacctagcagttg

SEQ ID NO: 232191 - DNA, 27 bp, Artificial Sequence
  Description of Artificial Sequence: Synthetic oligonucleotide
tgctcgcctggctgacctagcagttga

SEQ ID NO: 232192 - DNA, 26 bp, Artificial Sequence
  Description of Artificial Sequence: Synthetic oligonucleotide
gctcgcctggctgacctagcagttga

SEQ ID NO: 232193 - DNA, 26 bp, Artificial Sequence
  Description of Artificial Sequence: Synthetic oligonucleotide
ctcgcctggctgacctagcagttgag

SEQ ID NO: 232194 - DNA, 27 bp, Artificial Sequence
  Description of Artificial Sequence: Synthetic oligonucleotide
tcgcctggctgacctagcagttgaggt

SEQ ID NO: 232195 - DNA, 26 bp, Artificial Sequence
  Description of Artificial Sequence: Synthetic oligonucleotide
cgcctggctgacctagcagttgaggt

SEQ ID NO: 232196 - DNA, 27 bp, Artificial Sequence
  Description of Artificial Sequence: Synthetic oligonucleotide
gcctggctgacctagcagttgaggtca

SEQ ID NO: 232197 - DNA, 28 bp, Artificial Sequence
  Description of Artificial Sequence: Synthetic oligonucleotide
cctggctgacctagcagttgaggtcatc

SEQ ID NO: 232198 - DNA, 28 bp, Artificial Sequence
  Description of Artificial Sequence: Synthetic oligonucleotide
ctggctgacctagcagttgaggtcatcc

SEQ ID NO: 232199 - DNA, 30 bp, Artificial Sequence
  Description of Artificial Sequence: Synthetic oligonucleotide
tggctgacctagcagttgaggtcatcctac

SEQ ID NO: 232200 - DNA, 29 bp, Artificial Sequence
  Description of Artificial Sequence: Synthetic oligonucleotide
ggctgacctagcagttgaggtcatcctac

SEQ ID NO: 232201 - DNA, 29 bp, Artificial Sequence
  Description of Artificial Sequence: Synthetic oligonucleotide
gctgacctagcagttgaggtcatcctacg

SEQ ID NO: 232202 - DNA, 30 bp, Artificial Sequence
  Description of Artificial Sequence: Synthetic oligonucleotide
ctgacctagcagttgaggtcatcctacgag

SEQ ID NO: 232203 - DNA, 30 bp, Artificial Sequence
  Description of Artificial Sequence: Synthetic oligonucleotide
tgacctagcagttgaggtcatcctacgagc

SEQ ID NO: 232204 - DNA, 29 bp, Artificial Sequence
  Description of Artificial Sequence: Synthetic oligonucleotide
gacctagcagttgaggtcatcctacgagc

SEQ ID NO: 232205 - DNA, 30 bp, Artificial Sequence
  Description of Artificial Sequence: Synthetic oligonucleotide
acctagcagttgaggtcatcctacgagctg

SEQ ID NO: 232206 - DNA, 29 bp, Artificial Sequence
  Description of Artificial Sequence: Synthetic oligonucleotide
cctagcagttgaggtcatcctacgagctg

SEQ ID NO: 232207 - DNA, 30 bp, Artificial Sequence
  Description of Artificial Sequence: Synthetic oligonucleotide
ctagcagttgaggtcatcctacgagctgtc

SEQ ID NO: 232208 - DNA, 30 bp, Artificial Sequence
  Description of Artificial Sequence: Synthetic oligonucleotide
tagcagttgaggtcatcctacgagctgtcg

SEQ ID NO: 232209 - DNA, 29 bp, Artificial Sequence
  Description of Artificial Sequence: Synthetic oligonucleotide
agcagttgaggtcatcctacgagctgtcg

SEQ ID NO: 232210 - DNA, 28 bp, Artificial Sequence
  Description of Artificial Sequence: Synthetic oligonucleotide
gcagttgaggtcatcctacgagctgtcg

SEQ ID NO: 232211 - DNA, 29 bp, Artificial Sequence
  Description of Artificial Sequence: Synthetic oligonucleotide
cagttgaggtcatcctacgagctgtcgtc

SEQ ID NO: 232212 - DNA, 29 bp, Artificial Sequence
  Description of Artificial Sequence: Synthetic oligonucleotide
agttgaggtcatcctacgagctgtcgtcg

SEQ ID NO: 232213 - DNA, 28 bp, Artificial Sequence
  Description of Artificial Sequence: Synthetic oligonucleotide
gttgaggtcatcctacgagctgtcgtcg

SEQ ID NO: 232214 - DNA, 28 bp, Artificial Sequence
  Description of Artificial Sequence: Synthetic oligonucleotide
ttgaggtcatcctacgagctgtcgtcgc

SEQ ID NO: 232215 - DNA, 27 bp, Artificial Sequence
  Description of Artificial Sequence: Synthetic oligonucleotide
tgaggtcatcctacgagctgtcgtcgc

SEQ ID NO: 232216 - DNA, 27 bp, Artificial Sequence
  Description of Artificial Sequence: Synthetic oligonucleotide
gaggtcatcctacgagctgtcgtcgct

SEQ ID NO: 232217 - DNA, 27 bp, Artificial Sequence
  Description of Artificial Sequence: Synthetic oligonucleotide
aggtcatcctacgagctgtcgtcgctg

SEQ ID NO: 232218 - DNA, 26 bp, Artificial Sequence
  Description of Artificial Sequence: Synthetic oligonucleotide
ggtcatcctacgagctgtcgtcgctg

SEQ ID NO: 232219 - DNA, 27 bp, Artificial Sequence
  Description of Artificial Sequence: Synthetic oligonucleotide
gtcatcctacgagctgtcgtcgctgct

SEQ ID NO: 232220 - DNA, 27 bp, Artificial Sequence
  Description of Artificial Sequence: Synthetic oligonucleotide
tcatcctacgagctgtcgtcgctgctg

SEQ ID NO: 232221 - DNA, 27 bp, Artificial Sequence
  Description of Artificial Sequence: Synthetic oligonucleotide
catcctacgagctgtcgtcgctgctgt

SEQ ID NO: 232222 - DNA, 27 bp, Artificial Sequence
  Description of Artificial Sequence: Synthetic oligonucleotide
atcctacgagctgtcgtcgctgctgtc

SEQ ID NO: 232223 - DNA, 27 bp, Artificial Sequence
  Description of Artificial Sequence: Synthetic oligonucleotide
tcctacgagctgtcgtcgctgctgtca

SEQ ID NO: 232224 - DNA, 27 bp, Artificial Sequence
  Description of Artificial Sequence: Synthetic oligonucleotide
cctacgagctgtcgtcgctgctgtcat

SEQ ID NO: 232225 - DNA, 27 bp, Artificial Sequence
  Description of Artificial Sequence: Synthetic oligonucleotide
ctacgagctgtcgtcgctgctgtcatg

SEQ ID NO: 232226 - DNA, 28 bp, Artificial Sequence
  Description of Artificial Sequence: Synthetic oligonucleotide
tacgagctgtcgtcgctgctgtcatgtg

SEQ ID NO: 232227 - DNA, 27 bp, Artificial Sequence
  Description of Artificial Sequence: Synthetic oligonucleotide
acgagctgtcgtcgctgctgtcatgtg

SEQ ID NO: 232228 - DNA, 27 bp, Artificial Sequence
  Description of Artificial Sequence: Synthetic oligonucleotide
cgagctgtcgtcgctgctgtcatgtgt

SEQ ID NO: 232229 - DNA, 28 bp, Artificial Sequence
  Description of Artificial Sequence: Synthetic oligonucleotide
gagctgtcgtcgctgctgtcatgtgttg

SEQ ID NO: 232230 - DNA, 28 bp, Artificial Sequence
  Description of Artificial Sequence: Synthetic oligonucleotide
agctgtcgtcgctgctgtcatgtgttgg

SEQ ID NO: 232231 - DNA, 27 bp, Artificial Sequence
  Description of Artificial Sequence: Synthetic oligonucleotide
gctgtcgtcgctgctgtcatgtgttgg

SEQ ID NO: 232232 - DNA, 28 bp, Artificial Sequence
  Description of Artificial Sequence: Synthetic oligonucleotide
ctgtcgtcgctgctgtcatgtgttggag

SEQ ID NO: 232233 - DNA, 28 bp, Artificial Sequence
  Description of Artificial Sequence: Synthetic oligonucleotide
tgtcgtcgctgctgtcatgtgttggagg

SEQ ID NO: 232234 - DNA, 27 bp, Artificial Sequence
  Description of Artificial Sequence: Synthetic oligonucleotide
gtcgtcgctgctgtcatgtgttggagg

SEQ ID NO: 232235 - DNA, 29 bp, Artificial Sequence
  Description of Artificial Sequence: Synthetic oligonucleotide
tcgtcgctgctgtcatgtgttggaggaag

SEQ ID NO: 232236 - DNA, 28 bp, Artificial Sequence
  Description of Artificial Sequence: Synthetic oligonucleotide
cgtcgctgctgtcatgtgttggaggaag

SEQ ID NO: 232237 - DNA, 29 bp, Artificial Sequence
  Description of Artificial Sequence: Synthetic oligonucleotide
gtcgctgctgtcatgtgttggaggaagac

SEQ ID NO: 232238 - DNA, 29 bp, Artificial Sequence
  Description of Artificial Sequence: Synthetic oligonucleotide
tcgctgctgtcatgtgttggaggaagacc

SEQ ID NO: 232239 - DNA, 28 bp, Artificial Sequence
  Description of Artificial Sequence: Synthetic oligonucleotide
cgctgctgtcatgtgttggaggaagacc

SEQ ID NO: 232240 - DNA, 29 bp, Artificial Sequence
  Description of Artificial Sequence: Synthetic oligonucleotide
gctgctgtcatgtgttggaggaagacctc

SEQ ID NO: 232241 - DNA, 30 bp, Artificial Sequence
  Description of Artificial Sequence: Synthetic oligonucleotide
ctgctgtcatgtgttggaggaagacctcag

SEQ ID NO: 232242 - DNA, 30 bp, Artificial Sequence
  Description of Artificial Sequence: Synthetic oligonucleotide
tgctgtcatgtgttggaggaagacctcagg

SEQ ID NO: 232243 - DNA, 29 bp, Artificial Sequence
  Description of Artificial Sequence: Synthetic oligonucleotide
gctgtcatgtgttggaggaagacctcagg

SEQ ID NO: 232244 - DNA, 30 bp, Artificial Sequence
  Description of Artificial Sequence: Synthetic oligonucleotide
ctgtcatgtgttggaggaagacctcaggtg

SEQ ID NO: 232245 - DNA, 30 bp, Artificial Sequence
  Description of Artificial Sequence: Synthetic oligonucleotide
tgtcatgtgttggaggaagacctcaggtgg

SEQ ID NO: 232246 - DNA, 29 bp, Artificial Sequence
  Description of Artificial Sequence: Synthetic oligonucleotide
gtcatgtgttggaggaagacctcaggtgg

SEQ ID NO: 232247 - DNA, 33 bp, Artificial Sequence
  Description of Artificial Sequence: Synthetic oligonucleotide
tcatgtgttggaggaagacctcaggtggtaaag

SEQ ID NO: 232248 - DNA, 32 bp, Artificial Sequence
  Description of Artificial Sequence: Synthetic oligonucleotide
catgtgttggaggaagacctcaggtggtaaag

SEQ ID NO: 232249 - DNA, 32 bp, Artificial Sequence
  Description of Artificial Sequence: Synthetic oligonucleotide
atgtgttggaggaagacctcaggtggtaaagg

SEQ ID NO: 232250 - DNA, 31 bp, Artificial Sequence
  Description of Artificial Sequence: Synthetic oligonucleotide
tgtgttggaggaagacctcaggtggtaaagg

SEQ ID NO: 232251 - DNA, 30 bp, Artificial Sequence
  Description of Artificial Sequence: Synthetic oligonucleotide
gtgttggaggaagacctcaggtggtaaagg

SEQ ID NO: 232252 - DNA, 31 bp, Artificial Sequence
  Description of Artificial Sequence: Synthetic oligonucleotide
tgttggaggaagacctcaggtggtaaaggag

SEQ ID NO: 232253 - DNA, 30 bp, Artificial Sequence
  Description of Artificial Sequence: Synthetic oligonucleotide
gttggaggaagacctcaggtggtaaaggag

SEQ ID NO: 232254 - DNA, 30 bp, Artificial Sequence
  Description of Artificial Sequence: Synthetic oligonucleotide
ttggaggaagacctcaggtggtaaaggagg

SEQ ID NO: 232255 - DNA, 29 bp, Artificial Sequence
  Description of Artificial Sequence: Synthetic oligonucleotide
tggaggaagacctcaggtggtaaaggagg

SEQ ID NO: 232256 - DNA, 28 bp, Artificial Sequence
  Description of Artificial Sequence: Synthetic oligonucleotide
ggaggaagacctcaggtggtaaaggagg

SEQ ID NO: 232257 - DNA, 28 bp, Artificial Sequence
  Description of Artificial Sequence: Synthetic oligonucleotide
gaggaagacctcaggtggtaaaggaggg

SEQ ID NO: 232258 - DNA, 29 bp, Artificial Sequence
  Description of Artificial Sequence: Synthetic oligonucleotide
aggaagacctcaggtggtaaaggagggtg

SEQ ID NO: 232259 - DNA, 28 bp, Artificial Sequence
  Description of Artificial Sequence: Synthetic oligonucleotide
ggaagacctcaggtggtaaaggagggtg

SEQ ID NO: 232260 - DNA, 28 bp, Artificial Sequence
  Description of Artificial Sequence: Synthetic oligonucleotide
gaagacctcaggtggtaaaggagggtgc

SEQ ID NO: 232261 - DNA, 30 bp, Artificial Sequence
  Description of Artificial Sequence: Synthetic oligonucleotide
aagacctcaggtggtaaaggagggtgctac

SEQ ID NO: 232262 - DNA, 29 bp, Artificial Sequence
  Description of Artificial Sequence: Synthetic oligonucleotide
agacctcaggtggtaaaggagggtgctac

SEQ ID NO: 232263 - DNA, 28 bp, Artificial Sequence
  Description of Artificial Sequence: Synthetic oligonucleotide
gacctcaggtggtaaaggagggtgctac

SEQ ID NO: 232264 - DNA, 29 bp, Artificial Sequence
  Description of Artificial Sequence: Synthetic oligonucleotide
acctcaggtggtaaaggagggtgctactc

SEQ ID NO: 232265 - DNA, 28 bp, Artificial Sequence
  Description of Artificial Sequence: Synthetic oligonucleotide
cctcaggtggtaaaggagggtgctactc

SEQ ID NO: 232266 - DNA, 29 bp, Artificial Sequence
  Description of Artificial Sequence: Synthetic oligonucleotide
ctcaggtggtaaaggagggtgctactctc

SEQ ID NO: 232267 - DNA, 30 bp, Artificial Sequence
  Description of Artificial Sequence: Synthetic oligonucleotide
tcaggtggtaaaggagggtgctactctctg

SEQ ID NO: 232268 - DNA, 29 bp, Artificial Sequence
  Description of Artificial Sequence: Synthetic oligonucleotide
caggtggtaaaggagggtgctactctctg

SEQ ID NO: 232269 - DNA, 29 bp, Artificial Sequence
  Description of Artificial Sequence: Synthetic oligonucleotide
aggtggtaaaggagggtgctactctctgg

SEQ ID NO: 232270 - DNA, 28 bp, Artificial Sequence
  Description of Artificial Sequence: Synthetic oligonucleotide
ggtggtaaaggagggtgctactctctgg

SEQ ID NO: 232271 - DNA, 28 bp, Artificial Sequence
  Description of Artificial Sequence: Synthetic oligonucleotide
gtggtaaaggagggtgctactctctggc

SEQ ID NO: 232272 - DNA, 29 bp, Artificial Sequence
  Description of Artificial Sequence: Synthetic oligonucleotide
tggtaaaggagggtgctactctctggctg

SEQ ID NO: 232273 - DNA, 28 bp, Artificial Sequence
  Description of Artificial Sequence: Synthetic oligonucleotide
ggtaaaggagggtgctactctctggctg

SEQ ID NO: 232274 - DNA, 28 bp, Artificial Sequence
  Description of Artificial Sequence: Synthetic oligonucleotide
gtaaaggagggtgctactctctggctgc

SEQ ID NO: 232275 - DNA, 28 bp, Artificial Sequence
  Description of Artificial Sequence: Synthetic oligonucleotide
taaaggagggtgctactctctggctgcg

SEQ ID NO: 232276 - DNA, 27 bp, Artificial Sequence
  Description of Artificial Sequence: Synthetic oligonucleotide
aaaggagggtgctactctctggctgcg

SEQ ID NO: 232277 - DNA, 27 bp, Artificial Sequence
  Description of Artificial Sequence: Synthetic oligonucleotide
aaggagggtgctactctctggctgcgt

SEQ ID NO: 232278 - DNA, 26 bp, Artificial Sequence
  Description of Artificial Sequence: Synthetic oligonucleotide
aggagggtgctactctctggctgcgt

SEQ ID NO: 232279 - DNA, 25 bp, Artificial Sequence
  Description of Artificial Sequence: Synthetic oligonucleotide
ggagggtgctactctctggctgcgt

SEQ ID NO: 232280 - DNA, 25 bp, Artificial Sequence
  Description of Artificial Sequence: Synthetic oligonucleotide
gagggtgctactctctggctgcgtg

SEQ ID NO: 232281 - DNA, 26 bp, Artificial Sequence
  Description of Artificial Sequence: Synthetic oligonucleotide
agggtgctactctctggctgcgtgct

SEQ ID NO: 232282 - DNA, 25 bp, Artificial Sequence
  Description of Artificial Sequence: Synthetic oligonucleotide
gggtgctactctctggctgcgtgct

SEQ ID NO: 232283 - DNA, 25 bp, Artificial Sequence
  Description of Artificial Sequence: Synthetic oligonucleotide
ggtgctactctctggctgcgtgctg

SEQ ID NO: 232284 - DNA, 25 bp, Artificial Sequence
  Description of Artificial Sequence: Synthetic oligonucleotide
gtgctactctctggctgcgtgctgc

SEQ ID NO: 232285 - DNA, 26 bp, Artificial Sequence
  Description of Artificial Sequence: Synthetic oligonucleotide
tgctactctctggctgcgtgctgcga

SEQ ID NO: 232286 - DNA, 25 bp, Artificial Sequence
  Description of Artificial Sequence: Synthetic oligonucleotide
gctactctctggctgcgtgctgcga

SEQ ID NO: 232287 - DNA, 26 bp, Artificial Sequence
  Description of Artificial Sequence: Synthetic oligonucleotide
ctactctctggctgcgtgctgcgaca

SEQ ID NO: 232288 - DNA, 27 bp, Artificial Sequence
  Description of Artificial Sequence: Synthetic oligonucleotide
tactctctggctgcgtgctgcgacagt

SEQ ID NO: 232289 - DNA, 26 bp, Artificial Sequence
  Description of Artificial Sequence: Synthetic oligonucleotide
actctctggctgcgtgctgcgacagt

SEQ ID NO: 232290 - DNA, 25 bp, Artificial Sequence
  Description of Artificial Sequence: Synthetic oligonucleotide
ctctctggctgcgtgctgcgacagt

SEQ ID NO: 232291 - DNA, 25 bp, Artificial Sequence
  Description of Artificial Sequence: Synthetic oligonucleotide
tctctggctgcgtgctgcgacagtc

SEQ ID NO: 232292 - DNA, 24 bp, Artificial Sequence
  Description of Artificial Sequence: Synthetic oligonucleotide
ctctggctgcgtgctgcgacagtc

SEQ ID NO: 232293 - DNA, 24 bp, Artificial Sequence
  Description of Artificial Sequence: Synthetic oligonucleotide
tctggctgcgtgctgcgacagtcc

SEQ ID NO: 232294 - DNA, 23 bp, Artificial Sequence
  Description of Artificial Sequence: Synthetic oligonucleotide
ctggctgcgtgctgcgacagtcc

SEQ ID NO: 232295 - DNA, 23 bp, Artificial Sequence
  Description of Artificial Sequence: Synthetic oligonucleotide
tggctgcgtgctgcgacagtccc

SEQ ID NO: 232296 - DNA, 22 bp, Artificial Sequence
  Description of Artificial Sequence: Synthetic oligonucleotide
ggctgcgtgctgcgacagtccc

SEQ ID NO: 232297 - DNA, 23 bp, Artificial Sequence
  Description of Artificial Sequence: Synthetic oligonucleotide
gctgcgtgctgcgacagtcccca

SEQ ID NO: 232298 - DNA, 23 bp, Artificial Sequence
  Description of Artificial Sequence: Synthetic oligonucleotide
ctgcgtgctgcgacagtccccag

SEQ ID NO: 232299 - DNA, 23 bp, Artificial Sequence
  Description of Artificial Sequence: Synthetic oligonucleotide
tgcgtgctgcgacagtccccagg

SEQ ID NO: 232300 - DNA, 22 bp, Artificial Sequence
  Description of Artificial Sequence: Synthetic oligonucleotide
gcgtgctgcgacagtccccagg

SEQ ID NO: 232301 - DNA, 22 bp, Artificial Sequence
  Description of Artificial Sequence: Synthetic oligonucleotide
cgtgctgcgacagtccccaggg

SEQ ID NO: 232302 - DNA, 23 bp, Artificial Sequence
  Description of Artificial Sequence: Synthetic oligonucleotide
gtgctgcgacagtccccagggct

SEQ ID NO: 232303 - DNA, 24 bp, Artificial Sequence
  Description of Artificial Sequence: Synthetic oligonucleotide
tgctgcgacagtccccagggctgt

SEQ ID NO: 232304 - DNA, 23 bp, Artificial Sequence
  Description of Artificial Sequence: Synthetic oligonucleotide
gctgcgacagtccccagggctgt

SEQ ID NO: 232305 - DNA, 25 bp, Artificial Sequence
  Description of Artificial Sequence: Synthetic oligonucleotide
ctgcgacagtccccagggctgtgat

SEQ ID NO: 232306 - DNA, 26 bp, Artificial Sequence
  Description of Artificial Sequence: Synthetic oligonucleotide
tgcgacagtccccagggctgtgatgt

SEQ ID NO: 232307 - DNA, 25 bp, Artificial Sequence
  Description of Artificial Sequence: Synthetic oligonucleotide
gcgacagtccccagggctgtgatgt

SEQ ID NO: 232308 - DNA, 26 bp, Artificial Sequence
  Description of Artificial Sequence: Synthetic oligonucleotide
cgacagtccccagggctgtgatgtgt

SEQ ID NO: 232309 - DNA, 27 bp, Artificial Sequence
  Description of Artificial Sequence: Synthetic oligonucleotide
gacagtccccagggctgtgatgtgtgt

SEQ ID NO: 232310 - DNA, 27 bp, Artificial Sequence
  Description of Artificial Sequence: Synthetic oligonucleotide
acagtccccagggctgtgatgtgtgtc

SEQ ID NO: 232311 - DNA, 27 bp, Artificial Sequence
  Description of Artificial Sequence: Synthetic oligonucleotide
cagtccccagggctgtgatgtgtgtct

SEQ ID NO: 232312 - DNA, 27 bp, Artificial Sequence
  Description of Artificial Sequence: Synthetic oligonucleotide
agtccccagggctgtgatgtgtgtctc

SEQ ID NO: 232313 - DNA, 27 bp, Artificial Sequence
  Description of Artificial Sequence: Synthetic oligonucleotide
gtccccagggctgtgatgtgtgtctca

SEQ ID NO: 232314 - DNA, 27 bp, Artificial Sequence
  Description of Artificial Sequence: Synthetic oligonucleotide
tccccagggctgtgatgtgtgtctcac

SEQ ID NO: 232315 - DNA, 27 bp, Artificial Sequence
  Description of Artificial Sequence: Synthetic oligonucleotide
ccccagggctgtgatgtgtgtctcaca

SEQ ID NO: 232316 - DNA, 27 bp, Artificial Sequence
  Description of Artificial Sequence: Synthetic oligonucleotide
cccagggctgtgatgtgtgtctcacag

SEQ ID NO: 232317 - DNA, 27 bp, Artificial Sequence
  Description of Artificial Sequence: Synthetic oligonucleotide
ccagggctgtgatgtgtgtctcacagc

SEQ ID NO: 232318 - DNA, 29 bp, Artificial Sequence
  Description of Artificial Sequence: Synthetic oligonucleotide
cagggctgtgatgtgtgtctcacagcatg

SEQ ID NO: 232319 - DNA, 33 bp, Artificial Sequence
  Description of Artificial Sequence: Synthetic oligonucleotide
agggctgtgatgtgtgtctcacagcatgtaaag

SEQ ID NO: 232320 - DNA, 32 bp, Artificial Sequence
  Description of Artificial Sequence: Synthetic oligonucleotide
gggctgtgatgtgtgtctcacagcatgtaaag

SEQ ID NO: 232321 - DNA, 32 bp, Artificial Sequence
  Description of Artificial Sequence: Synthetic oligonucleotide
ggctgtgatgtgtgtctcacagcatgtaaagc

SEQ ID NO: 232322 - DNA, 34 bp, Artificial Sequence
  Description of Artificial Sequence: Synthetic oligonucleotide
gctgtgatgtgtgtctcacagcatgtaaagctag

SEQ ID NO: 232323 - DNA, 29 bp, Artificial Sequence
  Description of Artificial Sequence: Synthetic oligonucleotide
atggccatatgtggagtccgtgtgctagg

SEQ ID NO: 232324 - DNA, 28 bp, Artificial Sequence
  Description of Artificial Sequence: Synthetic oligonucleotide
tggccatatgtggagtccgtgtgctagg

SEQ ID NO: 232325 - DNA, 27 bp, Artificial Sequence
  Description of Artificial Sequence: Synthetic oligonucleotide
ggccatatgtggagtccgtgtgctagg

SEQ ID NO: 232326 - DNA, 33 bp, Artificial Sequence
  Description of Artificial Sequence: Synthetic oligonucleotide
gccatatgtggagtccgtgtgctaggttttttc

SEQ ID NO: 232327 - DNA, 35 bp, Artificial Sequence
  Description of Artificial Sequence: Synthetic oligonucleotide
ccatatgtggagtccgtgtgctaggttttttcatc

SEQ ID NO: 232328 - DNA, 38 bp, Artificial Sequence
  Description of Artificial Sequence: Synthetic oligonucleotide
catatgtggagtccgtgtgctaggttttttcatcttag

SEQ ID NO: 232329 - DNA, 38 bp, Artificial Sequence
  Description of Artificial Sequence: Synthetic oligonucleotide
atatgtggagtccgtgtgctaggttttttcatcttagc

SEQ ID NO: 232330 - DNA, 37 bp, Artificial Sequence
  Description of Artificial Sequence: Synthetic oligonucleotide
tatgtggagtccgtgtgctaggttttttcatcttagc

SEQ ID NO: 232331 - DNA, 36 bp, Artificial Sequence
  Description of Artificial Sequence: Synthetic oligonucleotide
atgtggagtccgtgtgctaggttttttcatcttagc

SEQ ID NO: 232332 - DNA, 35 bp, Artificial Sequence
  Description of Artificial Sequence: Synthetic oligonucleotide
tgtggagtccgtgtgctaggttttttcatcttagc

SEQ ID NO: 232333 - DNA, 34 bp, Artificial Sequence
  Description of Artificial Sequence: Synthetic oligonucleotide
gtggagtccgtgtgctaggttttttcatcttagc

SEQ ID NO: 232334 - DNA, 35 bp, Artificial Sequence
  Description of Artificial Sequence: Synthetic oligonucleotide
tggagtccgtgtgctaggttttttcatcttagctg

SEQ ID NO: 232335 - DNA, 34 bp, Artificial Sequence
  Description of Artificial Sequence: Synthetic oligonucleotide
ggagtccgtgtgctaggttttttcatcttagctg

SEQ ID NO: 232336 - DNA, 35 bp, Artificial Sequence
  Description of Artificial Sequence: Synthetic oligonucleotide
gagtccgtgtgctaggttttttcatcttagctgtg

SEQ ID NO: 232337 - DNA, 35 bp, Artificial Sequence
  Description of Artificial Sequence: Synthetic oligonucleotide
agtccgtgtgctaggttttttcatcttagctgtgc

SEQ ID NO: 232338 - DNA, 34 bp, Artificial Sequence
  Description of Artificial Sequence: Synthetic oligonucleotide
gtccgtgtgctaggttttttcatcttagctgtgc

SEQ ID NO: 232339 - DNA, 35 bp, Artificial Sequence
  Description of Artificial Sequence: Synthetic oligonucleotide
tccgtgtgctaggttttttcatcttagctgtgcag

SEQ ID NO: 232340 - DNA, 34 bp, Artificial Sequence
  Description of Artificial Sequence: Synthetic oligonucleotide
ccgtgtgctaggttttttcatcttagctgtgcag

SEQ ID NO: 232341 - DNA, 36 bp, Artificial Sequence
  Description of Artificial Sequence: Synthetic oligonucleotide
cgtgtgctaggttttttcatcttagctgtgcagatg

SEQ ID NO: 232342 - DNA, 37 bp, Artificial Sequence
  Description of Artificial Sequence: Synthetic oligonucleotide
gtgtgctaggttttttcatcttagctgtgcagatgag

SEQ ID NO: 232343 - DNA, 37 bp, Artificial Sequence
  Description of Artificial Sequence: Synthetic oligonucleotide
tgtgctaggttttttcatcttagctgtgcagatgagc

SEQ ID NO: 232344 - DNA, 36 bp, Artificial Sequence
  Description of Artificial Sequence: Synthetic oligonucleotide
gtgctaggttttttcatcttagctgtgcagatgagc

SEQ ID NO: 232345 - DNA, 36 bp, Artificial Sequence
  Description of Artificial Sequence: Synthetic oligonucleotide
tgctaggttttttcatcttagctgtgcagatgagcg

SEQ ID NO: 232346 - DNA, 35 bp, Artificial Sequence
  Description of Artificial Sequence: Synthetic oligonucleotide
gctaggttttttcatcttagctgtgcagatgagcg

SEQ ID NO: 232347 - DNA, 35 bp, Artificial Sequence
  Description of Artificial Sequence: Synthetic oligonucleotide
ctaggttttttcatcttagctgtgcagatgagcgc

SEQ ID NO: 232348 - DNA, 36 bp, Artificial Sequence
  Description of Artificial Sequence: Synthetic oligonucleotide
taggttttttcatcttagctgtgcagatgagcgcac

SEQ ID NO: 232349 - DNA, 35 bp, Artificial Sequence
  Description of Artificial Sequence: Synthetic oligonucleotide
aggttttttcatcttagctgtgcagatgagcgcac

SEQ ID NO: 232350 - DNA, 34 bp, Artificial Sequence
  Description of Artificial Sequence: Synthetic oligonucleotide
ggttttttcatcttagctgtgcagatgagcgcac

SEQ ID NO: 232351 - DNA, 35 bp, Artificial Sequence
  Description of Artificial Sequence: Synthetic oligonucleotide
gttttttcatcttagctgtgcagatgagcgcacag

SEQ ID NO: 232352 - DNA, 35 bp, Artificial Sequence
  Description of Artificial Sequence: Synthetic oligonucleotide
ttttttcatcttagctgtgcagatgagcgcacagg

SEQ ID NO: 232353 - DNA, 34 bp, Artificial Sequence
  Description of Artificial Sequence: Synthetic oligonucleotide
tttttcatcttagctgtgcagatgagcgcacagg

SEQ ID NO: 232354 - DNA, 33 bp, Artificial Sequence
  Description of Artificial Sequence: Synthetic oligonucleotide
ttttcatcttagctgtgcagatgagcgcacagg

SEQ ID NO: 232355 - DNA, 32 bp, Artificial Sequence
  Description of Artificial Sequence: Synthetic oligonucleotide
tttcatcttagctgtgcagatgagcgcacagg

SEQ ID NO: 232356 - DNA, 31 bp, Artificial Sequence
  Description of Artificial Sequence: Synthetic oligonucleotide
ttcatcttagctgtgcagatgagcgcacagg

SEQ ID NO: 232357 - DNA, 30 bp, Artificial Sequence
  Description of Artificial Sequence: Synthetic oligonucleotide
tcatcttagctgtgcagatgagcgcacagg

SEQ ID NO: 232358 - DNA, 29 bp, Artificial Sequence
  Description of Artificial Sequence: Synthetic oligonucleotide
catcttagctgtgcagatgagcgcacagg

SEQ ID NO: 232359 - DNA, 32 bp, Artificial Sequence
  Description of Artificial Sequence: Synthetic oligonucleotide
atcttagctgtgcagatgagcgcacaggaatc

SEQ ID NO: 232360 - DNA, 31 bp, Artificial Sequence
  Description of Artificial Sequence: Synthetic oligonucleotide
tcttagctgtgcagatgagcgcacaggaatc

SEQ ID NO: 232361 - DNA, 30 bp, Artificial Sequence
  Description of Artificial Sequence: Synthetic oligonucleotide
cttagctgtgcagatgagcgcacaggaatc

SEQ ID NO: 232362 - DNA, 32 bp, Artificial Sequence
  Description of Artificial Sequence: Synthetic oligonucleotide
ttagctgtgcagatgagcgcacaggaatcaag

SEQ ID NO: 232363 - DNA, 31 bp, Artificial Sequence
  Description of Artificial Sequence: Synthetic oligonucleotide
tagctgtgcagatgagcgcacaggaatcaag

SEQ ID NO: 232364 - DNA, 30 bp, Artificial Sequence
  Description of Artificial Sequence: Synthetic oligonucleotide
agctgtgcagatgagcgcacaggaatcaag

SEQ ID NO: 232365 - DNA, 29 bp, Artificial Sequence
  Description of Artificial Sequence: Synthetic oligonucleotide
gctgtgcagatgagcgcacaggaatcaag

SEQ ID NO: 232366 - DNA, 29 bp, Artificial Sequence
  Description of Artificial Sequence: Synthetic oligonucleotide
ctgtgcagatgagcgcacaggaatcaagg

SEQ ID NO: 232367 - DNA, 29 bp, Artificial Sequence
  Description of Artificial Sequence: Synthetic oligonucleotide
tgtgcagatgagcgcacaggaatcaaggg

SEQ ID NO: 232368 - DNA, 28 bp, Artificial Sequence
  Description of Artificial Sequence: Synthetic oligonucleotide
gtgcagatgagcgcacaggaatcaaggg

SEQ ID NO: 232369 - DNA, 28 bp, Artificial Sequence
  Description of Artificial Sequence: Synthetic oligonucleotide
tgcagatgagcgcacaggaatcaagggc

SEQ ID NO: 232370 - DNA, 27 bp, Artificial Sequence
  Description of Artificial Sequence: Synthetic oligonucleotide
gcagatgagcgcacaggaatcaagggc

SEQ ID NO: 232371 - DNA, 30 bp, Artificial Sequence
  Description of Artificial Sequence: Synthetic oligonucleotide
cagatgagcgcacaggaatcaagggctatc

SEQ ID NO: 232372 - DNA, 33 bp, Artificial Sequence
  Description of Artificial Sequence: Synthetic oligonucleotide
agatgagcgcacaggaatcaagggctatcatag

SEQ ID NO: 232373 - DNA, 32 bp, Artificial Sequence
  Description of Artificial Sequence: Synthetic oligonucleotide
gatgagcgcacaggaatcaagggctatcatag

SEQ ID NO: 232374 - DNA, 34 bp, Artificial Sequence
  Description of Artificial Sequence: Synthetic oligonucleotide
atgagcgcacaggaatcaagggctatcatagaag

SEQ ID NO: 232375 - DNA, 33 bp, Artificial Sequence
  Description of Artificial Sequence: Synthetic oligonucleotide
tgagcgcacaggaatcaagggctatcatagaag

SEQ ID NO: 232376 - DNA, 32 bp, Artificial Sequence
  Description of Artificial Sequence: Synthetic oligonucleotide
gagcgcacaggaatcaagggctatcatagaag

SEQ ID NO: 232377 - DNA, 34 bp, Artificial Sequence
  Description of Artificial Sequence: Synthetic oligonucleotide
agcgcacaggaatcaagggctatcatagaagaac

SEQ ID NO: 232378 - DNA, 33 bp, Artificial Sequence
  Description of Artificial Sequence: Synthetic oligonucleotide
gcgcacaggaatcaagggctatcatagaagaac

SEQ ID NO: 232379 - DNA, 35 bp, Artificial Sequence
  Description of Artificial Sequence: Synthetic oligonucleotide
cgcacaggaatcaagggctatcatagaagaacaag

SEQ ID NO: 232380 - DNA, 36 bp, Artificial Sequence
  Description of Artificial Sequence: Synthetic oligonucleotide
gcacaggaatcaagggctatcatagaagaacaagtg

SEQ ID NO: 232381 - DNA, 38 bp, Artificial Sequence
  Description of Artificial Sequence: Synthetic oligonucleotide
cacaggaatcaagggctatcatagaagaacaagtgatc

SEQ ID NO: 232382 - DNA, 40 bp, Artificial Sequence
  Description of Artificial Sequence: Synthetic oligonucleotide
acaggaatcaagggctatcatagaagaacaagtgatcatc

SEQ ID NO: 232383 - DNA, 39 bp, Artificial Sequence
  Description of Artificial Sequence: Synthetic oligonucleotide
caggaatcaagggctatcatagaagaacaagtgatcatc

SEQ ID NO: 232384 - DNA, 39 bp, Artificial Sequence
  Description of Artificial Sequence: Synthetic oligonucleotide
aggaatcaagggctatcatagaagaacaagtgatcatcg

SEQ ID NO: 232385 - DNA, 38 bp, Artificial Sequence
  Description of Artificial Sequence: Synthetic oligonucleotide
ggaatcaagggctatcatagaagaacaagtgatcatcg

SEQ ID NO: 232386 - DNA, 39 bp, Artificial Sequence
  Description of Artificial Sequence: Synthetic oligonucleotide
gaatcaagggctatcatagaagaacaagtgatcatcgag

SEQ ID NO: 232387 - DNA, 39 bp, Artificial Sequence
  Description of Artificial Sequence: Synthetic oligonucleotide
aatcaagggctatcatagaagaacaagtgatcatcgagg

SEQ ID NO: 232388 - DNA, 38 bp, Artificial Sequence
  Description of Artificial Sequence: Synthetic oligonucleotide
atcaagggctatcatagaagaacaagtgatcatcgagg

SEQ ID NO: 232389 - DNA, 37 bp, Artificial Sequence
  Description of Artificial Sequence: Synthetic oligonucleotide
tcaagggctatcatagaagaacaagtgatcatcgagg

SEQ ID NO: 232390 - DNA, 36 bp, Artificial Sequence
  Description of Artificial Sequence: Synthetic oligonucleotide
caagggctatcatagaagaacaagtgatcatcgagg

SEQ ID NO: 232391 - DNA, 36 bp, Artificial Sequence
  Description of Artificial Sequence: Synthetic oligonucleotide
aagggctatcatagaagaacaagtgatcatcgaggc

SEQ ID NO: 232392 - DNA, 35 bp, Artificial Sequence
  Description of Artificial Sequence: Synthetic oligonucleotide
agggctatcatagaagaacaagtgatcatcgaggc

SEQ ID NO: 232393 - DNA, 34 bp, Artificial Sequence
  Description of Artificial Sequence: Synthetic oligonucleotide
gggctatcatagaagaacaagtgatcatcgaggc

SEQ ID NO: 232394 - DNA, 34 bp, Artificial Sequence
  Description of Artificial Sequence: Synthetic oligonucleotide
ggctatcatagaagaacaagtgatcatcgaggcc

SEQ ID NO: 232395 - DNA, 34 bp, Artificial Sequence
  Description of Artificial Sequence: Synthetic oligonucleotide
gctatcatagaagaacaagtgatcatcgaggccg

SEQ ID NO: 232396 - DNA, 35 bp, Artificial Sequence
  Description of Artificial Sequence: Synthetic oligonucleotide
ctatcatagaagaacaagtgatcatcgaggccgag

SEQ ID NO: 232397 - DNA, 37 bp, Artificial Sequence
  Description of Artificial Sequence: Synthetic oligonucleotide
tatcatagaagaacaagtgatcatcgaggccgagtac

SEQ ID NO: 232398 - DNA, 36 bp, Artificial Sequence
  Description of Artificial Sequence: Synthetic oligonucleotide
atcatagaagaacaagtgatcatcgaggccgagtac

SEQ ID NO: 232399 - DNA, 35 bp, Artificial Sequence
  Description of Artificial Sequence: Synthetic oligonucleotide
tcatagaagaacaagtgatcatcgaggccgagtac

SEQ ID NO: 232400 - DNA, 34 bp, Artificial Sequence
  Description of Artificial Sequence: Synthetic oligonucleotide
catagaagaacaagtgatcatcgaggccgagtac

SEQ ID NO: 232401 - DNA, 37 bp, Artificial Sequence
  Description of Artificial Sequence: Synthetic oligonucleotide
atagaagaacaagtgatcatcgaggccgagtactatc

SEQ ID NO: 232402 - DNA, 36 bp, Artificial Sequence
  Description of Artificial Sequence: Synthetic oligonucleotide
tagaagaacaagtgatcatcgaggccgagtactatc

SEQ ID NO: 232403 - DNA, 35 bp, Artificial Sequence
  Description of Artificial Sequence: Synthetic oligonucleotide
agaagaacaagtgatcatcgaggccgagtactatc

SEQ ID NO: 232404 - DNA, 34 bp, Artificial Sequence
  Description of Artificial Sequence: Synthetic oligonucleotide
gaagaacaagtgatcatcgaggccgagtactatc

SEQ ID NO: 232405 - DNA, 35 bp, Artificial Sequence
  Description of Artificial Sequence: Synthetic oligonucleotide
aagaacaagtgatcatcgaggccgagtactatctg

SEQ ID NO: 232406 - DNA, 34 bp, Artificial Sequence
  Description of Artificial Sequence: Synthetic oligonucleotide
agaacaagtgatcatcgaggccgagtactatctg

SEQ ID NO: 232407 - DNA, 33 bp, Artificial Sequence
  Description of Artificial Sequence: Synthetic oligonucleotide
gaacaagtgatcatcgaggccgagtactatctg

SEQ ID NO: 232408 - DNA, 36 bp, Artificial Sequence
  Description of Artificial Sequence: Synthetic oligonucleotide
aacaagtgatcatcgaggccgagtactatctgaaac

SEQ ID NO: 232409 - DNA, 35 bp, Artificial Sequence
  Description of Artificial Sequence: Synthetic oligonucleotide
acaagtgatcatcgaggccgagtactatctgaaac

SEQ ID NO: 232410 - DNA, 34 bp, Artificial Sequence
  Description of Artificial Sequence: Synthetic oligonucleotide
caagtgatcatcgaggccgagtactatctgaaac

SEQ ID NO: 232411 - DNA, 34 bp, Artificial Sequence
  Description of Artificial Sequence: Synthetic oligonucleotide
aagtgatcatcgaggccgagtactatctgaaacc

SEQ ID NO: 232412 - DNA, 33 bp, Artificial Sequence
  Description of Artificial Sequence: Synthetic oligonucleotide
agtgatcatcgaggccgagtactatctgaaacc

SEQ ID NO: 232413 - DNA, 32 bp, Artificial Sequence
  Description of Artificial Sequence: Synthetic oligonucleotide
gtgatcatcgaggccgagtactatctgaaacc

SEQ ID NO: 232414 - DNA, 33 bp, Artificial Sequence
  Description of Artificial Sequence: Synthetic oligonucleotide
tgatcatcgaggccgagtactatctgaaacctg

SEQ ID NO: 232415 - DNA, 32 bp, Artificial Sequence
  Description of Artificial Sequence: Synthetic oligonucleotide
gatcatcgaggccgagtactatctgaaacctg

SEQ ID NO: 232416 - DNA, 33 bp, Artificial Sequence
  Description of Artificial Sequence: Synthetic oligonucleotide
atcatcgaggccgagtactatctgaaacctgac

SEQ ID NO: 232417 - DNA, 32 bp, Artificial Sequence
  Description of Artificial Sequence: Synthetic oligonucleotide
tcatcgaggccgagtactatctgaaacctgac

SEQ ID NO: 232418 - DNA, 31 bp, Artificial Sequence
  Description of Artificial Sequence: Synthetic oligonucleotide
catcgaggccgagtactatctgaaacctgac

SEQ ID NO: 232419 - DNA, 31 bp, Artificial Sequence
  Description of Artificial Sequence: Synthetic oligonucleotide
atcgaggccgagtactatctgaaacctgacc

SEQ ID NO: 232420 - DNA, 30 bp, Artificial Sequence
  Description of Artificial Sequence: Synthetic oligonucleotide
tcgaggccgagtactatctgaaacctgacc

SEQ ID NO: 232421 - DNA, 29 bp, Artificial Sequence
  Description of Artificial Sequence: Synthetic oligonucleotide
cgaggccgagtactatctgaaacctgacc

SEQ ID NO: 232422 - DNA, 32 bp, Artificial Sequence
  Description of Artificial Sequence: Synthetic oligonucleotide
gaggccgagtactatctgaaacctgaccaaac

SEQ ID NO: 232423 - DNA, 33 bp, Artificial Sequence
  Description of Artificial Sequence: Synthetic oligonucleotide
aggccgagtactatctgaaacctgaccaaacag

SEQ ID NO: 232424 - DNA, 32 bp, Artificial Sequence
  Description of Artificial Sequence: Synthetic oligonucleotide
ggccgagtactatctgaaacctgaccaaacag

SEQ ID NO: 232425 - DNA, 32 bp, Artificial Sequence
  Description of Artificial Sequence: Synthetic oligonucleotide
gccgagtactatctgaaacctgaccaaacagg

SEQ ID NO: 232426 - DNA, 32 bp, Artificial Sequence
  Description of Artificial Sequence: Synthetic oligonucleotide
ccgagtactatctgaaacctgaccaaacaggc

SEQ ID NO: 232427 - DNA, 32 bp, Artificial Sequence
  Description of Artificial Sequence: Synthetic oligonucleotide
cgagtactatctgaaacctgaccaaacaggcg

SEQ ID NO: 232428 - DNA, 33 bp, Artificial Sequence
  Description of Artificial Sequence: Synthetic oligonucleotide
gagtactatctgaaacctgaccaaacaggcgag

SEQ ID NO: 232429 - DNA, 38 bp, Artificial Sequence
  Description of Artificial Sequence: Synthetic oligonucleotide
agtactatctgaaacctgaccaaacaggcgagtatatg

SEQ ID NO: 232430 - DNA, 37 bp, Artificial Sequence
  Description of Artificial Sequence: Synthetic oligonucleotide
gtactatctgaaacctgaccaaacaggcgagtatatg

SEQ ID NO: 232431 - DNA, 40 bp, Artificial Sequence
  Description of Artificial Sequence: Synthetic oligonucleotide
tactatctgaaacctgaccaaacaggcgagtatatgtttg

SEQ ID NO: 232432 - DNA, 39 bp, Artificial Sequence
  Description of Artificial Sequence: Synthetic oligonucleotide
actatctgaaacctgaccaaacaggcgagtatatgtttg

SEQ ID NO: 232433 - DNA, 38 bp, Artificial Sequence
  Description of Artificial Sequence: Synthetic oligonucleotide
ctatctgaaacctgaccaaacaggcgagtatatgtttg

SEQ ID NO: 232434 - DNA, 39 bp, Artificial Sequence
  Description of Artificial Sequence: Synthetic oligonucleotide
tatctgaaacctgaccaaacaggcgagtatatgtttgag

SEQ ID NO: 232435 - DNA, 38 bp, Artificial Sequence
  Description of Artificial Sequence: Synthetic oligonucleotide
atctgaaacctgaccaaacaggcgagtatatgtttgag

SEQ ID NO: 232436 - DNA, 37 bp, Artificial Sequence
  Description of Artificial Sequence: Synthetic oligonucleotide
tctgaaacctgaccaaacaggcgagtatatgtttgag

SEQ ID NO: 232437 - DNA, 36 bp, Artificial Sequence
  Description of Artificial Sequence: Synthetic oligonucleotide
ctgaaacctgaccaaacaggcgagtatatgtttgag

SEQ ID NO: 232438 - DNA, 39 bp, Artificial Sequence
  Description of Artificial Sequence: Synthetic oligonucleotide
tgaaacctgaccaaacaggcgagtatatgtttgagtttg

SEQ ID NO: 232439 - DNA, 38 bp, Artificial Sequence
  Description of Artificial Sequence: Synthetic oligonucleotide
gaaacctgaccaaacaggcgagtatatgtttgagtttg

SEQ ID NO: 232440 - DNA, 40 bp, Artificial Sequence
  Description of Artificial Sequence: Synthetic oligonucleotide
aaacctgaccaaacaggcgagtatatgtttgagtttgatg

SEQ ID NO: 232441 - DNA, 39 bp, Artificial Sequence
  Description of Artificial Sequence: Synthetic oligonucleotide
aacctgaccaaacaggcgagtatatgtttgagtttgatg

SEQ ID NO: 232442 - DNA, 38 bp, Artificial Sequence
  Description of Artificial Sequence: Synthetic oligonucleotide
acctgaccaaacaggcgagtatatgtttgagtttgatg

SEQ ID NO: 232443 - DNA, 37 bp, Artificial Sequence
  Description of Artificial Sequence: Synthetic oligonucleotide
cctgaccaaacaggcgagtatatgtttgagtttgatg

SEQ ID NO: 232444 - DNA, 37 bp, Artificial Sequence
  Description of Artificial Sequence: Synthetic oligonucleotide
ctgaccaaacaggcgagtatatgtttgagtttgatgg

SEQ ID NO: 232445 - DNA, 38 bp, Artificial Sequence
  Description of Artificial Sequence: Synthetic oligonucleotide
tgaccaaacaggcgagtatatgtttgagtttgatggtc

SEQ ID NO: 232446 - DNA, 37 bp, Artificial Sequence
  Description of Artificial Sequence: Synthetic oligonucleotide
gaccaaacaggcgagtatatgtttgagtttgatggtc

SEQ ID NO: 232447 - DNA, 39 bp, Artificial Sequence
  Description of Artificial Sequence: Synthetic oligonucleotide
accaaacaggcgagtatatgtttgagtttgatggtcatg

SEQ ID NO: 232448 - DNA, 38 bp, Artificial Sequence
  Description of Artificial Sequence: Synthetic oligonucleotide
ccaaacaggcgagtatatgtttgagtttgatggtcatg

SEQ ID NO: 232449 - DNA, 39 bp, Artificial Sequence
  Description of Artificial Sequence: Synthetic oligonucleotide
caaacaggcgagtatatgtttgagtttgatggtcatgag

SEQ ID NO: 232450 - DNA, 44 bp, Artificial Sequence
  Description of Artificial Sequence: Synthetic oligonucleotide
aaacaggcgagtatatgtttgagtttgatggtcatgagatttac

SEQ ID NO: 232451 - DNA, 43 bp, Artificial Sequence
  Description of Artificial Sequence: Synthetic oligonucleotide
aacaggcgagtatatgtttgagtttgatggtcatgagatttac

SEQ ID NO: 232452 - DNA, 42 bp, Artificial Sequence
  Description of Artificial Sequence: Synthetic oligonucleotide
acaggcgagtatatgtttgagtttgatggtcatgagatttac

SEQ ID NO: 232453 - DNA, 41 bp, Artificial Sequence
  Description of Artificial Sequence: Synthetic oligonucleotide
caggcgagtatatgtttgagtttgatggtcatgagatttac

SEQ ID NO: 232454 - DNA, 41 bp, Artificial Sequence
  Description of Artificial Sequence: Synthetic oligonucleotide
aggcgagtatatgtttgagtttgatggtcatgagatttacc

SEQ ID NO: 232455 - DNA, 40 bp, Artificial Sequence
  Description of Artificial Sequence: Synthetic oligonucleotide
ggcgagtatatgtttgagtttgatggtcatgagatttacc

SEQ ID NO: 232456 - DNA, 42 bp, Artificial Sequence
  Description of Artificial Sequence: Synthetic oligonucleotide
gcgagtatatgtttgagtttgatggtcatgagatttaccatg

SEQ ID NO: 232457 - DNA, 43 bp, Artificial Sequence
  Description of Artificial Sequence: Synthetic oligonucleotide
cgagtatatgtttgagtttgatggtcatgagatttaccatgtg

SEQ ID NO: 232458 - DNA, 43 bp, Artificial Sequence
  Description of Artificial Sequence: Synthetic oligonucleotide
gagtatatgtttgagtttgatggtcatgagatttaccatgtgg

SEQ ID NO: 232459 - DNA, 47 bp, Artificial Sequence
  Description of Artificial Sequence: Synthetic oligonucleotide
agtatatgtttgagtttgatggtcatgagatttaccatgtggaaatg

SEQ ID NO: 232460 - DNA, 46 bp, Artificial Sequence
  Description of Artificial Sequence: Synthetic oligonucleotide
gtatatgtttgagtttgatggtcatgagatttaccatgtggaaatg

SEQ ID NO: 232461 - DNA, 46 bp, Artificial Sequence
  Description of Artificial Sequence: Synthetic oligonucleotide
tatatgtttgagtttgatggtcatgagatttaccatgtggaaatgg

SEQ ID NO: 232462 - DNA, 45 bp, Artificial Sequence
  Description of Artificial Sequence: Synthetic oligonucleotide
atatgtttgagtttgatggtcatgagatttaccatgtggaaatgg

SEQ ID NO: 232463 - DNA, 44 bp, Artificial Sequence
  Description of Artificial Sequence: Synthetic oligonucleotide
tatgtttgagtttgatggtcatgagatttaccatgtggaaatgg

SEQ ID NO: 232464 - DNA, 43 bp, Artificial Sequence
  Description of Artificial Sequence: Synthetic oligonucleotide
atgtttgagtttgatggtcatgagatttaccatgtggaaatgg

SEQ ID NO: 232465 - DNA, 42 bp, Artificial Sequence
  Description of Artificial Sequence: Synthetic oligonucleotide
tgtttgagtttgatggtcatgagatttaccatgtggaaatgg

SEQ ID NO: 232466 - DNA, 41 bp, Artificial Sequence
  Description of Artificial Sequence: Synthetic oligonucleotide
gtttgagtttgatggtcatgagatttaccatgtggaaatgg

SEQ ID NO: 232467 - DNA, 41 bp, Artificial Sequence
  Description of Artificial Sequence: Synthetic oligonucleotide
tttgagtttgatggtcatgagatttaccatgtggaaatggc

SEQ ID NO: 232468 - DNA, 40 bp, Artificial Sequence
  Description of Artificial Sequence: Synthetic oligonucleotide
ttgagtttgatggtcatgagatttaccatgtggaaatggc

SEQ ID NO: 232469 - DNA, 39 bp, Artificial Sequence
  Description of Artificial Sequence: Synthetic oligonucleotide
tgagtttgatggtcatgagatttaccatgtggaaatggc

SEQ ID NO: 232470 - DNA, 38 bp, Artificial Sequence
  Description of Artificial Sequence: Synthetic oligonucleotide
gagtttgatggtcatgagatttaccatgtggaaatggc

SEQ ID NO: 232471 - DNA, 41 bp, Artificial Sequence
  Description of Artificial Sequence: Synthetic oligonucleotide
agtttgatggtcatgagatttaccatgtggaaatggcaaag

SEQ ID NO: 232472 - DNA, 40 bp, Artificial Sequence
  Description of Artificial Sequence: Synthetic oligonucleotide
gtttgatggtcatgagatttaccatgtggaaatggcaaag

SEQ ID NO: 232473 - DNA, 42 bp, Artificial Sequence
  Description of Artificial Sequence: Synthetic oligonucleotide
tttgatggtcatgagatttaccatgtggaaatggcaaagtag

SEQ ID NO: 232474 - DNA, 41 bp, Artificial Sequence
  Description of Artificial Sequence: Synthetic oligonucleotide
ttgatggtcatgagatttaccatgtggaaatggcaaagtag

SEQ ID NO: 232475 - DNA, 40 bp, Artificial Sequence
  Description of Artificial Sequence: Synthetic oligonucleotide
tgatggtcatgagatttaccatgtggaaatggcaaagtag

SEQ ID NO: 232476 - DNA, 39 bp, Artificial Sequence
  Description of Artificial Sequence: Synthetic oligonucleotide
gatggtcatgagatttaccatgtggaaatggcaaagtag

SEQ ID NO: 232477 - DNA, 39 bp, Artificial Sequence
  Description of Artificial Sequence: Synthetic oligonucleotide
atggtcatgagatttaccatgtggaaatggcaaagtagg

SEQ ID NO: 232478 - DNA, 38 bp, Artificial Sequence
  Description of Artificial Sequence: Synthetic oligonucleotide
tggtcatgagatttaccatgtggaaatggcaaagtagg

SEQ ID NO: 232479 - DNA, 37 bp, Artificial Sequence
  Description of Artificial Sequence: Synthetic oligonucleotide
ggtcatgagatttaccatgtggaaatggcaaagtagg

SEQ ID NO: 232480 - DNA, 38 bp, Artificial Sequence
  Description of Artificial Sequence: Synthetic oligonucleotide
gtcatgagatttaccatgtggaaatggcaaagtaggag

SEQ ID NO: 232481 - DNA, 39 bp, Artificial Sequence
  Description of Artificial Sequence: Synthetic oligonucleotide
tcatgagatttaccatgtggaaatggcaaagtaggagac

SEQ ID NO: 232482 - DNA, 38 bp, Artificial Sequence
  Description of Artificial Sequence: Synthetic oligonucleotide
catgagatttaccatgtggaaatggcaaagtaggagac

SEQ ID NO: 232483 - DNA, 38 bp, Artificial Sequence
  Description of Artificial Sequence: Synthetic oligonucleotide
atgagatttaccatgtggaaatggcaaagtaggagacg

SEQ ID NO: 232484 - DNA, 37 bp, Artificial Sequence
  Description of Artificial Sequence: Synthetic oligonucleotide
tgagatttaccatgtggaaatggcaaagtaggagacg

SEQ ID NO: 232485 - DNA, 36 bp, Artificial Sequence
  Description of Artificial Sequence: Synthetic oligonucleotide
gagatttaccatgtggaaatggcaaagtaggagacg

SEQ ID NO: 232486 - DNA, 36 bp, Artificial Sequence
  Description of Artificial Sequence: Synthetic oligonucleotide
agatttaccatgtggaaatggcaaagtaggagacgg

SEQ ID NO: 232487 - DNA, 35 bp, Artificial Sequence
  Description of Artificial Sequence: Synthetic oligonucleotide
gatttaccatgtggaaatggcaaagtaggagacgg

SEQ ID NO: 232488 - DNA, 36 bp, Artificial Sequence
  Description of Artificial Sequence: Synthetic oligonucleotide
atttaccatgtggaaatggcaaagtaggagacggac

SEQ ID NO: 232489 - DNA, 35 bp, Artificial Sequence
  Description of Artificial Sequence: Synthetic oligonucleotide
tttaccatgtggaaatggcaaagtaggagacggac

SEQ ID NO: 232490 - DNA, 34 bp, Artificial Sequence
  Description of Artificial Sequence: Synthetic oligonucleotide
ttaccatgtggaaatggcaaagtaggagacggac

SEQ ID NO: 232491 - DNA, 33 bp, Artificial Sequence
  Description of Artificial Sequence: Synthetic oligonucleotide
taccatgtggaaatggcaaagtaggagacggac

SEQ ID NO: 232492 - DNA, 32 bp, Artificial Sequence
  Description of Artificial Sequence: Synthetic oligonucleotide
accatgtggaaatggcaaagtaggagacggac

SEQ ID NO: 232493 - DNA, 31 bp, Artificial Sequence
  Description of Artificial Sequence: Synthetic oligonucleotide
ccatgtggaaatggcaaagtaggagacggac

SEQ ID NO: 232494 - DNA, 32 bp, Artificial Sequence
  Description of Artificial Sequence: Synthetic oligonucleotide
catgtggaaatggcaaagtaggagacggactg

SEQ ID NO: 232495 - DNA, 32 bp, Artificial Sequence
  Description of Artificial Sequence: Synthetic oligonucleotide
atgtggaaatggcaaagtaggagacggactgg

SEQ ID NO: 232496 - DNA, 31 bp, Artificial Sequence
  Description of Artificial Sequence: Synthetic oligonucleotide
tgtggaaatggcaaagtaggagacggactgg

SEQ ID NO: 232497 - DNA, 30 bp, Artificial Sequence
  Description of Artificial Sequence: Synthetic oligonucleotide
gtggaaatggcaaagtaggagacggactgg

SEQ ID NO: 232498 - DNA, 30 bp, Artificial Sequence
  Description of Artificial Sequence: Synthetic oligonucleotide
tggaaatggcaaagtaggagacggactggc

SEQ ID NO: 232499 - DNA, 29 bp, Artificial Sequence
  Description of Artificial Sequence: Synthetic oligonucleotide
ggaaatggcaaagtaggagacggactggc

SEQ ID NO: 232500 - DNA, 29 bp, Artificial Sequence
  Description of Artificial Sequence: Synthetic oligonucleotide
gaaatggcaaagtaggagacggactggcg

SEQ ID NO: 232501 - DNA, 29 bp, Artificial Sequence
  Description of Artificial Sequence: Synthetic oligonucleotide
aaatggcaaagtaggagacggactggcgg

SEQ ID NO: 232502 - DNA, 28 bp, Artificial Sequence
  Description of Artificial Sequence: Synthetic oligonucleotide
aatggcaaagtaggagacggactggcgg

SEQ ID NO: 232503 - DNA, 27 bp, Artificial Sequence
  Description of Artificial Sequence: Synthetic oligonucleotide
atggcaaagtaggagacggactggcgg

SEQ ID NO: 232504 - DNA, 26 bp, Artificial Sequence
  Description of Artificial Sequence: Synthetic oligonucleotide
tggcaaagtaggagacggactggcgg

SEQ ID NO: 232505 - DNA, 25 bp, Artificial Sequence
  Description of Artificial Sequence: Synthetic oligonucleotide
ggcaaagtaggagacggactggcgg

SEQ ID NO: 232506 - DNA, 27 bp, Artificial Sequence
  Description of Artificial Sequence: Synthetic oligonucleotide
gcaaagtaggagacggactggcggcta

SEQ ID NO: 232507 - DNA, 27 bp, Artificial Sequence
  Description of Artificial Sequence: Synthetic oligonucleotide
caaagtaggagacggactggcggctag

SEQ ID NO: 232508 - DNA, 29 bp, Artificial Sequence
  Description of Artificial Sequence: Synthetic oligonucleotide
aaagtaggagacggactggcggctagaag

SEQ ID NO: 232509 - DNA, 28 bp, Artificial Sequence
  Description of Artificial Sequence: Synthetic oligonucleotide
aagtaggagacggactggcggctagaag

SEQ ID NO: 232510 - DNA, 27 bp, Artificial Sequence
  Description of Artificial Sequence: Synthetic oligonucleotide
agtaggagacggactggcggctagaag

SEQ ID NO: 232511 - DNA, 27 bp, Artificial Sequence
  Description of Artificial Sequence: Synthetic oligonucleotide
gtaggagacggactggcggctagaaga

SEQ ID NO: 232512 - DNA, 31 bp, Artificial Sequence
  Description of Artificial Sequence: Synthetic oligonucleotide
taggagacggactggcggctagaagaatttc

SEQ ID NO: 232513 - DNA, 30 bp, Artificial Sequence
  Description of Artificial Sequence: Synthetic oligonucleotide
aggagacggactggcggctagaagaatttc

SEQ ID NO: 232514 - DNA, 29 bp, Artificial Sequence
  Description of Artificial Sequence: Synthetic oligonucleotide
ggagacggactggcggctagaagaatttc

SEQ ID NO: 232515 - DNA, 29 bp, Artificial Sequence
  Description of Artificial Sequence: Synthetic oligonucleotide
gagacggactggcggctagaagaatttcg

SEQ ID NO: 232516 - DNA, 30 bp, Artificial Sequence
  Description of Artificial Sequence: Synthetic oligonucleotide
agacggactggcggctagaagaatttcgac

SEQ ID NO: 232517 - DNA, 29 bp, Artificial Sequence
  Description of Artificial Sequence: Synthetic oligonucleotide
gacggactggcggctagaagaatttcgac

SEQ ID NO: 232518 - DNA, 29 bp, Artificial Sequence
  Description of Artificial Sequence: Synthetic oligonucleotide
acggactggcggctagaagaatttcgacg

SEQ ID NO: 232519 - DNA, 28 bp, Artificial Sequence
  Description of Artificial Sequence: Synthetic oligonucleotide
cggactggcggctagaagaatttcgacg

SEQ ID NO: 232520 - DNA, 32 bp, Artificial Sequence
  Description of Artificial Sequence: Synthetic oligonucleotide
ggactggcggctagaagaatttcgacgatttg

SEQ ID NO: 232521 - DNA, 32 bp, Artificial Sequence
  Description of Artificial Sequence: Synthetic oligonucleotide
gactggcggctagaagaatttcgacgatttgg

SEQ ID NO: 232522 - DNA, 32 bp, Artificial Sequence
  Description of Artificial Sequence: Synthetic oligonucleotide
actggcggctagaagaatttcgacgatttggc

SEQ ID NO: 232523 - DNA, 31 bp, Artificial Sequence
  Description of Artificial Sequence: Synthetic oligonucleotide
ctggcggctagaagaatttcgacgatttggc

SEQ ID NO: 232524 - DNA, 32 bp, Artificial Sequence
  Description of Artificial Sequence: Synthetic oligonucleotide
tggcggctagaagaatttcgacgatttggcag

SEQ ID NO: 232525 - DNA, 31 bp, Artificial Sequence
  Description of Artificial Sequence: Synthetic oligonucleotide
ggcggctagaagaatttcgacgatttggcag

SEQ ID NO: 232526 - DNA, 31 bp, Artificial Sequence
  Description of Artificial Sequence: Synthetic oligonucleotide
gcggctagaagaatttcgacgatttggcagc

SEQ ID NO: 232527 - DNA, 34 bp, Artificial Sequence
  Description of Artificial Sequence: Synthetic oligonucleotide
cggctagaagaatttcgacgatttggcagctttg

SEQ ID NO: 232528 - DNA, 35 bp, Artificial Sequence
  Description of Artificial Sequence: Synthetic oligonucleotide
ggctagaagaatttcgacgatttggcagctttgac

SEQ ID NO: 232529 - DNA, 35 bp, Artificial Sequence
  Description of Artificial Sequence: Synthetic oligonucleotide
gctagaagaatttcgacgatttggcagctttgacg

SEQ ID NO: 232530 - DNA, 35 bp, Artificial Sequence
  Description of Artificial Sequence: Synthetic oligonucleotide
ctagaagaatttcgacgatttggcagctttgacgc

SEQ ID NO: 232531 - DNA, 36 bp, Artificial Sequence
  Description of Artificial Sequence: Synthetic oligonucleotide
tagaagaatttcgacgatttggcagctttgacgctc

SEQ ID NO: 232532 - DNA, 35 bp, Artificial Sequence
  Description of Artificial Sequence: Synthetic oligonucleotide
agaagaatttcgacgatttggcagctttgacgctc

SEQ ID NO: 232533 - DNA, 34 bp, Artificial Sequence
  Description of Artificial Sequence: Synthetic oligonucleotide
gaagaatttcgacgatttggcagctttgacgctc

SEQ ID NO: 232534 - DNA, 36 bp, Artificial Sequence
  Description of Artificial Sequence: Synthetic oligonucleotide
aagaatttcgacgatttggcagctttgacgctcaag

SEQ ID NO: 232535 - DNA, 35 bp, Artificial Sequence
  Description of Artificial Sequence: Synthetic oligonucleotide
agaatttcgacgatttggcagctttgacgctcaag

SEQ ID NO: 232536 - DNA, 34 bp, Artificial Sequence
  Description of Artificial Sequence: Synthetic oligonucleotide
gaatttcgacgatttggcagctttgacgctcaag

SEQ ID NO: 232537 - DNA, 34 bp, Artificial Sequence
  Description of Artificial Sequence: Synthetic oligonucleotide
aatttcgacgatttggcagctttgacgctcaagg

SEQ ID NO: 232538 - DNA, 33 bp, Artificial Sequence
  Description of Artificial Sequence: Synthetic oligonucleotide
atttcgacgatttggcagctttgacgctcaagg

SEQ ID NO: 232539 - DNA, 32 bp, Artificial Sequence
  Description of Artificial Sequence: Synthetic oligonucleotide
tttcgacgatttggcagctttgacgctcaagg

SEQ ID NO: 232540 - DNA, 31 bp, Artificial Sequence
  Description of Artificial Sequence: Synthetic oligonucleotide
ttcgacgatttggcagctttgacgctcaagg

SEQ ID NO: 232541 - DNA, 30 bp, Artificial Sequence
  Description of Artificial Sequence: Synthetic oligonucleotide
tcgacgatttggcagctttgacgctcaagg

SEQ ID NO: 232542 - DNA, 29 bp, Artificial Sequence
  Description of Artificial Sequence: Synthetic oligonucleotide
cgacgatttggcagctttgacgctcaagg

SEQ ID NO: 232543 - DNA, 30 bp, Artificial Sequence
  Description of Artificial Sequence: Synthetic oligonucleotide
gacgatttggcagctttgacgctcaaggtc

SEQ ID NO: 232544 - DNA, 30 bp, Artificial Sequence
  Description of Artificial Sequence: Synthetic oligonucleotide
acgatttggcagctttgacgctcaaggtcc

SEQ ID NO: 232545 - DNA, 29 bp, Artificial Sequence
  Description of Artificial Sequence: Synthetic oligonucleotide
cgatttggcagctttgacgctcaaggtcc

SEQ ID NO: 232546 - DNA, 32 bp, Artificial Sequence
  Description of Artificial Sequence: Synthetic oligonucleotide
gatttggcagctttgacgctcaaggtccattg

SEQ ID NO: 232547 - DNA, 32 bp, Artificial Sequence
  Description of Artificial Sequence: Synthetic oligonucleotide
atttggcagctttgacgctcaaggtccattgg

SEQ ID NO: 232548 - DNA, 31 bp, Artificial Sequence
  Description of Artificial Sequence: Synthetic oligonucleotide
tttggcagctttgacgctcaaggtccattgg

SEQ ID NO: 232549 - DNA, 30 bp, Artificial Sequence
  Description of Artificial Sequence: Synthetic oligonucleotide
ttggcagctttgacgctcaaggtccattgg

SEQ ID NO: 232550 - DNA, 29 bp, Artificial Sequence
  Description of Artificial Sequence: Synthetic oligonucleotide
tggcagctttgacgctcaaggtccattgg

SEQ ID NO: 232551 - DNA, 28 bp, Artificial Sequence
  Description of Artificial Sequence: Synthetic oligonucleotide
ggcagctttgacgctcaaggtccattgg

SEQ ID NO: 232552 - DNA, 28 bp, Artificial Sequence
  Description of Artificial Sequence: Synthetic oligonucleotide
gcagctttgacgctcaaggtccattggc

SEQ ID NO: 232553 - DNA, 28 bp, Artificial Sequence
  Description of Artificial Sequence: Synthetic oligonucleotide
cagctttgacgctcaaggtccattggcc

SEQ ID NO: 232554 - DNA, 30 bp, Artificial Sequence
  Description of Artificial Sequence: Synthetic oligonucleotide
agctttgacgctcaaggtccattggccatc

SEQ ID NO: 232555 - DNA, 29 bp, Artificial Sequence
  Description of Artificial Sequence: Synthetic oligonucleotide
gctttgacgctcaaggtccattggccatc

SEQ ID NO: 232556 - DNA, 32 bp, Artificial Sequence
  Description of Artificial Sequence: Synthetic oligonucleotide
ctttgacgctcaaggtccattggccatcatag

SEQ ID NO: 232557 - DNA, 32 bp, Artificial Sequence
  Description of Artificial Sequence: Synthetic oligonucleotide
tttgacgctcaaggtccattggccatcatagc

SEQ ID NO: 232558 - DNA, 31 bp, Artificial Sequence
  Description of Artificial Sequence: Synthetic oligonucleotide
ttgacgctcaaggtccattggccatcatagc

SEQ ID NO: 232559 - DNA, 30 bp, Artificial Sequence
  Description of Artificial Sequence: Synthetic oligonucleotide
tgacgctcaaggtccattggccatcatagc

SEQ ID NO: 232560 - DNA, 29 bp, Artificial Sequence
  Description of Artificial Sequence: Synthetic oligonucleotide
gacgctcaaggtccattggccatcatagc

SEQ ID NO: 232561 - DNA, 30 bp, Artificial Sequence
  Description of Artificial Sequence: Synthetic oligonucleotide
acgctcaaggtccattggccatcatagctg

SEQ ID NO: 232562 - DNA, 29 bp, Artificial Sequence
  Description of Artificial Sequence: Synthetic oligonucleotide
cgctcaaggtccattggccatcatagctg

SEQ ID NO: 232563 - DNA, 30 bp, Artificial Sequence
  Description of Artificial Sequence: Synthetic oligonucleotide
gctcaaggtccattggccatcatagctgtc

SEQ ID NO: 232564 - DNA, 30 bp, Artificial Sequence
  Description of Artificial Sequence: Synthetic oligonucleotide
ctcaaggtccattggccatcatagctgtcg

SEQ ID NO: 232565 - DNA, 31 bp, Artificial Sequence
  Description of Artificial Sequence: Synthetic oligonucleotide
tcaaggtccattggccatcatagctgtcgac

SEQ ID NO: 232566 - DNA, 30 bp, Artificial Sequence
  Description of Artificial Sequence: Synthetic oligonucleotide
caaggtccattggccatcatagctgtcgac

SEQ ID NO: 232567 - DNA, 33 bp, Artificial Sequence
  Description of Artificial Sequence: Synthetic oligonucleotide
aaggtccattggccatcatagctgtcgacaaag

SEQ ID NO: 232568 - DNA, 32 bp, Artificial Sequence
  Description of Artificial Sequence: Synthetic oligonucleotide
aggtccattggccatcatagctgtcgacaaag

SEQ ID NO: 232569 - DNA, 31 bp, Artificial Sequence
  Description of Artificial Sequence: Synthetic oligonucleotide
ggtccattggccatcatagctgtcgacaaag

SEQ ID NO: 232570 - DNA, 31 bp, Artificial Sequence
  Description of Artificial Sequence: Synthetic oligonucleotide
gtccattggccatcatagctgtcgacaaagc

SEQ ID NO: 232571 - DNA, 31 bp, Artificial Sequence
  Description of Artificial Sequence: Synthetic oligonucleotide
tccattggccatcatagctgtcgacaaagcc

SEQ ID NO: 232572 - DNA, 30 bp, Artificial Sequence
  Description of Artificial Sequence: Synthetic oligonucleotide
ccattggccatcatagctgtcgacaaagcc

SEQ ID NO: 232573 - DNA, 32 bp, Artificial Sequence
  Description of Artificial Sequence: Synthetic oligonucleotide
cattggccatcatagctgtcgacaaagcctac

SEQ ID NO: 232574 - DNA, 32 bp, Artificial Sequence
  Description of Artificial Sequence: Synthetic oligonucleotide
attggccatcatagctgtcgacaaagcctacc

SEQ ID NO: 232575 - DNA, 31 bp, Artificial Sequence
  Description of Artificial Sequence: Synthetic oligonucleotide
ttggccatcatagctgtcgacaaagcctacc

SEQ ID NO: 232576 - DNA, 30 bp, Artificial Sequence
  Description of Artificial Sequence: Synthetic oligonucleotide
tggccatcatagctgtcgacaaagcctacc

SEQ ID NO: 232577 - DNA, 29 bp, Artificial Sequence
  Description of Artificial Sequence: Synthetic oligonucleotide
ggccatcatagctgtcgacaaagcctacc

SEQ ID NO: 232578 - DNA, 30 bp, Artificial Sequence
  Description of Artificial Sequence: Synthetic oligonucleotide
gccatcatagctgtcgacaaagcctacctg

SEQ ID NO: 232579 - DNA, 30 bp, Artificial Sequence
  Description of Artificial Sequence: Synthetic oligonucleotide
ccatcatagctgtcgacaaagcctacctgg

SEQ ID NO: 232580 - DNA, 34 bp, Artificial Sequence
  Description of Artificial Sequence: Synthetic oligonucleotide
catcatagctgtcgacaaagcctacctggaaaac

SEQ ID NO: 232581 - DNA, 36 bp, Artificial Sequence
  Description of Artificial Sequence: Synthetic oligonucleotide
atcatagctgtcgacaaagcctacctggaaaacatg

SEQ ID NO: 232582 - DNA, 35 bp, Artificial Sequence
  Description of Artificial Sequence: Synthetic oligonucleotide
tcatagctgtcgacaaagcctacctggaaaacatg

SEQ ID NO: 232583 - DNA, 34 bp, Artificial Sequence
  Description of Artificial Sequence: Synthetic oligonucleotide
catagctgtcgacaaagcctacctggaaaacatg

SEQ ID NO: 232584 - DNA, 35 bp, Artificial Sequence
  Description of Artificial Sequence: Synthetic oligonucleotide
atagctgtcgacaaagcctacctggaaaacatgac

SEQ ID NO: 232585 - DNA, 34 bp, Artificial Sequence
  Description of Artificial Sequence: Synthetic oligonucleotide
tagctgtcgacaaagcctacctggaaaacatgac

SEQ ID NO: 232586 - DNA, 33 bp, Artificial Sequence
  Description of Artificial Sequence: Synthetic oligonucleotide
agctgtcgacaaagcctacctggaaaacatgac

SEQ ID NO: 232587 - DNA, 32 bp, Artificial Sequence
  Description of Artificial Sequence: Synthetic oligonucleotide
gctgtcgacaaagcctacctggaaaacatgac

SEQ ID NO: 232588 - DNA, 35 bp, Artificial Sequence
  Description of Artificial Sequence: Synthetic oligonucleotide
ctgtcgacaaagcctacctggaaaacatgacaaac

SEQ ID NO: 232589 - DNA, 35 bp, Artificial Sequence
  Description of Artificial Sequence: Synthetic oligonucleotide
tgtcgacaaagcctacctggaaaacatgacaaacc

SEQ ID NO: 232590 - DNA, 34 bp, Artificial Sequence
  Description of Artificial Sequence: Synthetic oligonucleotide
gtcgacaaagcctacctggaaaacatgacaaacc

SEQ ID NO: 232591 - DNA, 34 bp, Artificial Sequence
  Description of Artificial Sequence: Synthetic oligonucleotide
tcgacaaagcctacctggaaaacatgacaaaccg

SEQ ID NO: 232592 - DNA, 33 bp, Artificial Sequence
  Description of Artificial Sequence: Synthetic oligonucleotide
cgacaaagcctacctggaaaacatgacaaaccg

SEQ ID NO: 232593 - DNA, 33 bp, Artificial Sequence
  Description of Artificial Sequence: Synthetic oligonucleotide
gacaaagcctacctggaaaacatgacaaaccgc

SEQ ID NO: 232594 - DNA, 34 bp, Artificial Sequence
  Description of Artificial Sequence: Synthetic oligonucleotide
acaaagcctacctggaaaacatgacaaaccgctc

SEQ ID NO: 232595 - DNA, 33 bp, Artificial Sequence
  Description of Artificial Sequence: Synthetic oligonucleotide
caaagcctacctggaaaacatgacaaaccgctc

SEQ ID NO: 232596 - DNA, 33 bp, Artificial Sequence
  Description of Artificial Sequence: Synthetic oligonucleotide
aaagcctacctggaaaacatgacaaaccgctcc

SEQ ID NO: 232597 - DNA, 32 bp, Artificial Sequence
  Description of Artificial Sequence: Synthetic oligonucleotide
aagcctacctggaaaacatgacaaaccgctcc

SEQ ID NO: 232598 - DNA, 31 bp, Artificial Sequence
  Description of Artificial Sequence: Synthetic oligonucleotide
agcctacctggaaaacatgacaaaccgctcc

SEQ ID NO: 232599 - DNA, 30 bp, Artificial Sequence
  Description of Artificial Sequence: Synthetic oligonucleotide
gcctacctggaaaacatgacaaaccgctcc

SEQ ID NO: 232600 - DNA, 32 bp, Artificial Sequence
  Description of Artificial Sequence: Synthetic oligonucleotide
cctacctggaaaacatgacaaaccgctccaac

SEQ ID NO: 232601 - DNA, 36 bp, Artificial Sequence
  Description of Artificial Sequence: Synthetic oligonucleotide
ctacctggaaaacatgacaaaccgctccaacaatac

SEQ ID NO: 232602 - DNA, 37 bp, Artificial Sequence
  Description of Artificial Sequence: Synthetic oligonucleotide
tacctggaaaacatgacaaaccgctccaacaatactc

SEQ ID NO: 232603 - DNA, 36 bp, Artificial Sequence
  Description of Artificial Sequence: Synthetic oligonucleotide
acctggaaaacatgacaaaccgctccaacaatactc

SEQ ID NO: 232604 - DNA, 35 bp, Artificial Sequence
  Description of Artificial Sequence: Synthetic oligonucleotide
cctggaaaacatgacaaaccgctccaacaatactc

SEQ ID NO: 232605 - DNA, 35 bp, Artificial Sequence
  Description of Artificial Sequence: Synthetic oligonucleotide
ctggaaaacatgacaaaccgctccaacaatactcc

SEQ ID NO: 232606 - DNA, 35 bp, Artificial Sequence
  Description of Artificial Sequence: Synthetic oligonucleotide
tggaaaacatgacaaaccgctccaacaatactccg

SEQ ID NO: 232607 - DNA, 34 bp, Artificial Sequence
  Description of Artificial Sequence: Synthetic oligonucleotide
ggaaaacatgacaaaccgctccaacaatactccg

SEQ ID NO: 232608 - DNA, 36 bp, Artificial Sequence
  Description of Artificial Sequence: Synthetic oligonucleotide
gaaaacatgacaaaccgctccaacaatactccgaac

SEQ ID NO: 232609 - DNA, 37 bp, Artificial Sequence
  Description of Artificial Sequence: Synthetic oligonucleotide
aaaacatgacaaaccgctccaacaatactccgaacac

SEQ ID NO: 232610 - DNA, 36 bp, Artificial Sequence
  Description of Artificial Sequence: Synthetic oligonucleotide
aaacatgacaaaccgctccaacaatactccgaacac

SEQ ID NO: 232611 - DNA, 35 bp, Artificial Sequence
  Description of Artificial Sequence: Synthetic oligonucleotide
aacatgacaaaccgctccaacaatactccgaacac

SEQ ID NO: 232612 - DNA, 34 bp, Artificial Sequence
  Description of Artificial Sequence: Synthetic oligonucleotide
acatgacaaaccgctccaacaatactccgaacac

SEQ ID NO: 232613 - DNA, 33 bp, Artificial Sequence
  Description of Artificial Sequence: Synthetic oligonucleotide
catgacaaaccgctccaacaatactccgaacac

SEQ ID NO: 232614 - DNA, 33 bp, Artificial Sequence
  Description of Artificial Sequence: Synthetic oligonucleotide
atgacaaaccgctccaacaatactccgaacacc

SEQ ID NO: 232615 - DNA, 32 bp, Artificial Sequence
  Description of Artificial Sequence: Synthetic oligonucleotide
tgacaaaccgctccaacaatactccgaacacc

SEQ ID NO: 232616 - DNA, 31 bp, Artificial Sequence
  Description of Artificial Sequence: Synthetic oligonucleotide
gacaaaccgctccaacaatactccgaacacc

SEQ ID NO: 232617 - DNA, 34 bp, Artificial Sequence
  Description of Artificial Sequence: Synthetic oligonucleotide
acaaaccgctccaacaatactccgaacaccaatg

SEQ ID NO: 232618 - DNA, 33 bp, Artificial Sequence
  Description of Artificial Sequence: Synthetic oligonucleotide
caaaccgctccaacaatactccgaacaccaatg

SEQ ID NO: 232619 - DNA, 35 bp, Artificial Sequence
  Description of Artificial Sequence: Synthetic oligonucleotide
aaaccgctccaacaatactccgaacaccaatgttc

SEQ ID NO: 232620 - DNA, 34 bp, Artificial Sequence
  Description of Artificial Sequence: Synthetic oligonucleotide
aaccgctccaacaatactccgaacaccaatgttc

SEQ ID NO: 232621 - DNA, 33 bp, Artificial Sequence
  Description of Artificial Sequence: Synthetic oligonucleotide
accgctccaacaatactccgaacaccaatgttc

SEQ ID NO: 232622 - DNA, 32 bp, Artificial Sequence
  Description of Artificial Sequence: Synthetic oligonucleotide
ccgctccaacaatactccgaacaccaatgttc

SEQ ID NO: 232623 - DNA, 32 bp, Artificial Sequence
  Description of Artificial Sequence: Synthetic oligonucleotide
cgctccaacaatactccgaacaccaatgttcc

SEQ ID NO: 232624 - DNA, 33 bp, Artificial Sequence
  Description of Artificial Sequence: Synthetic oligonucleotide
gctccaacaatactccgaacaccaatgttcctc

SEQ ID NO: 232625 - DNA, 33 bp, Artificial Sequence
  Description of Artificial Sequence: Synthetic oligonucleotide
ctccaacaatactccgaacaccaatgttcctcc

SEQ ID NO: 232626 - DNA, 34 bp, Artificial Sequence
  Description of Artificial Sequence: Synthetic oligonucleotide
tccaacaatactccgaacaccaatgttcctccag

SEQ ID NO: 232627 - DNA, 33 bp, Artificial Sequence
  Description of Artificial Sequence: Synthetic oligonucleotide
ccaacaatactccgaacaccaatgttcctccag

SEQ ID NO: 232628 - DNA, 34 bp, Artificial Sequence
  Description of Artificial Sequence: Synthetic oligonucleotide
caacaatactccgaacaccaatgttcctccagag

SEQ ID NO: 232629 - DNA, 34 bp, Artificial Sequence
  Description of Artificial Sequence: Synthetic oligonucleotide
aacaatactccgaacaccaatgttcctccagagc

SEQ ID NO: 232630 - DNA, 33 bp, Artificial Sequence
  Description of Artificial Sequence: Synthetic oligonucleotide
acaatactccgaacaccaatgttcctccagagc

SEQ ID NO: 232631 - DNA, 32 bp, Artificial Sequence
  Description of Artificial Sequence: Synthetic oligonucleotide
caatactccgaacaccaatgttcctccagagc

SEQ ID NO: 232632 - DNA, 35 bp, Artificial Sequence
  Description of Artificial Sequence: Synthetic oligonucleotide
aatactccgaacaccaatgttcctccagagctaac

SEQ ID NO: 232633 - DNA, 34 bp, Artificial Sequence
  Description of Artificial Sequence: Synthetic oligonucleotide
atactccgaacaccaatgttcctccagagctaac

SEQ ID NO: 232634 - DNA, 33 bp, Artificial Sequence
  Description of Artificial Sequence: Synthetic oligonucleotide
tactccgaacaccaatgttcctccagagctaac

SEQ ID NO: 232635 - DNA, 32 bp, Artificial Sequence
  Description of Artificial Sequence: Synthetic oligonucleotide
actccgaacaccaatgttcctccagagctaac

SEQ ID NO: 232636 - DNA, 31 bp, Artificial Sequence
  Description of Artificial Sequence: Synthetic oligonucleotide
ctccgaacaccaatgttcctccagagctaac

SEQ ID NO: 232637 - DNA, 32 bp, Artificial Sequence
  Description of Artificial Sequence: Synthetic oligonucleotide
tccgaacaccaatgttcctccagagctaactg

SEQ ID NO: 232638 - DNA, 31 bp, Artificial Sequence
  Description of Artificial Sequence: Synthetic oligonucleotide
ccgaacaccaatgttcctccagagctaactg

SEQ ID NO: 232639 - DNA, 32 bp, Artificial Sequence
  Description of Artificial Sequence: Synthetic oligonucleotide
cgaacaccaatgttcctccagagctaactgtg

SEQ ID NO: 232640 - DNA, 32 bp, Artificial Sequence
  Description of Artificial Sequence: Synthetic oligonucleotide
gaacaccaatgttcctccagagctaactgtgc

SEQ ID NO: 232641 - DNA, 33 bp, Artificial Sequence
  Description of Artificial Sequence: Synthetic oligonucleotide
aacaccaatgttcctccagagctaactgtgcac

SEQ ID NO: 232642 - DNA, 32 bp, Artificial Sequence
  Description of Artificial Sequence: Synthetic oligonucleotide
acaccaatgttcctccagagctaactgtgcac

SEQ ID NO: 232643 - DNA, 31 bp, Artificial Sequence
  Description of Artificial Sequence: Synthetic oligonucleotide
caccaatgttcctccagagctaactgtgcac

SEQ ID NO: 232644 - DNA, 32 bp, Artificial Sequence
  Description of Artificial Sequence: Synthetic oligonucleotide
accaatgttcctccagagctaactgtgcacac

SEQ ID NO: 232645 - DNA, 31 bp, Artificial Sequence
  Description of Artificial Sequence: Synthetic oligonucleotide
ccaatgttcctccagagctaactgtgcacac

SEQ ID NO: 232646 - DNA, 31 bp, Artificial Sequence
  Description of Artificial Sequence: Synthetic oligonucleotide
caatgttcctccagagctaactgtgcacacg

SEQ ID NO: 232647 - DNA, 33 bp, Artificial Sequence
  Description of Artificial Sequence: Synthetic oligonucleotide
aatgttcctccagagctaactgtgcacacgaac

SEQ ID NO: 232648 - DNA, 32 bp, Artificial Sequence
  Description of Artificial Sequence: Synthetic oligonucleotide
atgttcctccagagctaactgtgcacacgaac

SEQ ID NO: 232649 - DNA, 31 bp, Artificial Sequence
  Description of Artificial Sequence: Synthetic oligonucleotide
tgttcctccagagctaactgtgcacacgaac

SEQ ID NO: 232650 - DNA, 30 bp, Artificial Sequence
  Description of Artificial Sequence: Synthetic oligonucleotide
gttcctccagagctaactgtgcacacgaac

SEQ ID NO: 232651 - DNA, 31 bp, Artificial Sequence
  Description of Artificial Sequence: Synthetic oligonucleotide
ttcctccagagctaactgtgcacacgaacag

SEQ ID NO: 232652 - DNA, 30 bp, Artificial Sequence
  Description of Artificial Sequence: Synthetic oligonucleotide
tcctccagagctaactgtgcacacgaacag

SEQ ID NO: 232653 - DNA, 29 bp, Artificial Sequence
  Description of Artificial Sequence: Synthetic oligonucleotide
cctccagagctaactgtgcacacgaacag

SEQ ID NO: 232654 - DNA, 29 bp, Artificial Sequence
  Description of Artificial Sequence: Synthetic oligonucleotide
ctccagagctaactgtgcacacgaacagg

SEQ ID NO: 232655 - DNA, 29 bp, Artificial Sequence
  Description of Artificial Sequence: Synthetic oligonucleotide
tccagagctaactgtgcacacgaacaggc

SEQ ID NO: 232656 - DNA, 28 bp, Artificial Sequence
  Description of Artificial Sequence: Synthetic oligonucleotide
ccagagctaactgtgcacacgaacaggc

SEQ ID NO: 232657 - DNA, 28 bp, Artificial Sequence
  Description of Artificial Sequence: Synthetic oligonucleotide
cagagctaactgtgcacacgaacaggcc

SEQ ID NO: 232658 - DNA, 29 bp, Artificial Sequence
  Description of Artificial Sequence: Synthetic oligonucleotide
agagctaactgtgcacacgaacaggcctg

SEQ ID NO: 232659 - DNA, 28 bp, Artificial Sequence
  Description of Artificial Sequence: Synthetic oligonucleotide
gagctaactgtgcacacgaacaggcctg

SEQ ID NO: 232660 - DNA, 29 bp, Artificial Sequence
  Description of Artificial Sequence: Synthetic oligonucleotide
agctaactgtgcacacgaacaggcctgtg

SEQ ID NO: 232661 - DNA, 28 bp, Artificial Sequence
  Description of Artificial Sequence: Synthetic oligonucleotide
gctaactgtgcacacgaacaggcctgtg

SEQ ID NO: 232662 - DNA, 28 bp, Artificial Sequence
  Description of Artificial Sequence: Synthetic oligonucleotide
ctaactgtgcacacgaacaggcctgtgg

SEQ ID NO: 232663 - DNA, 30 bp, Artificial Sequence
  Description of Artificial Sequence: Synthetic oligonucleotide
taactgtgcacacgaacaggcctgtggaag

SEQ ID NO: 232664 - DNA, 29 bp, Artificial Sequence
  Description of Artificial Sequence: Synthetic oligonucleotide
aactgtgcacacgaacaggcctgtggaag

SEQ ID NO: 232665 - DNA, 28 bp, Artificial Sequence
  Description of Artificial Sequence: Synthetic oligonucleotide
actgtgcacacgaacaggcctgtggaag

SEQ ID NO: 232666 - DNA, 27 bp, Artificial Sequence
  Description of Artificial Sequence: Synthetic oligonucleotide
ctgtgcacacgaacaggcctgtggaag

SEQ ID NO: 232667 - DNA, 28 bp, Artificial Sequence
  Description of Artificial Sequence: Synthetic oligonucleotide
tgtgcacacgaacaggcctgtggaagtg

SEQ ID NO: 232668 - DNA, 27 bp, Artificial Sequence
  Description of Artificial Sequence: Synthetic oligonucleotide
gtgcacacgaacaggcctgtggaagtg

SEQ ID NO: 232669 - DNA, 28 bp, Artificial Sequence
  Description of Artificial Sequence: Synthetic oligonucleotide
tgcacacgaacaggcctgtggaagtgag

SEQ ID NO: 232670 - DNA, 27 bp, Artificial Sequence
  Description of Artificial Sequence: Synthetic oligonucleotide
gcacacgaacaggcctgtggaagtgag

SEQ ID NO: 232671 - DNA, 28 bp, Artificial Sequence
  Description of Artificial Sequence: Synthetic oligonucleotide
cacacgaacaggcctgtggaagtgagag

SEQ ID NO: 232672 - DNA, 29 bp, Artificial Sequence
  Description of Artificial Sequence: Synthetic oligonucleotide
acacgaacaggcctgtggaagtgagagag

SEQ ID NO: 232673 - DNA, 28 bp, Artificial Sequence
  Description of Artificial Sequence: Synthetic oligonucleotide
cacgaacaggcctgtggaagtgagagag

SEQ ID NO: 232674 - DNA, 28 bp, Artificial Sequence
  Description of Artificial Sequence: Synthetic oligonucleotide
acgaacaggcctgtggaagtgagagagc

SEQ ID NO: 232675 - DNA, 27 bp, Artificial Sequence
  Description of Artificial Sequence: Synthetic oligonucleotide
cgaacaggcctgtggaagtgagagagc

SEQ ID NO: 232676 - DNA, 27 bp, Artificial Sequence
  Description of Artificial Sequence: Synthetic oligonucleotide
gaacaggcctgtggaagtgagagagcg

SEQ ID NO: 232677 - DNA, 27 bp, Artificial Sequence
  Description of Artificial Sequence: Synthetic oligonucleotide
aacaggcctgtggaagtgagagagcgc

SEQ ID NO: 232678 - DNA, 27 bp, Artificial Sequence
  Description of Artificial Sequence: Synthetic oligonucleotide
acaggcctgtggaagtgagagagcgca

SEQ ID NO: 232679 - DNA, 27 bp, Artificial Sequence
  Description of Artificial Sequence: Synthetic oligonucleotide
caggcctgtggaagtgagagagcgcaa

SEQ ID NO: 232680 - DNA, 27 bp, Artificial Sequence
  Description of Artificial Sequence: Synthetic oligonucleotide
aggcctgtggaagtgagagagcgcaac

SEQ ID NO: 232681 - DNA, 26 bp, Artificial Sequence
  Description of Artificial Sequence: Synthetic oligonucleotide
ggcctgtggaagtgagagagcgcaac

SEQ ID NO: 232682 - DNA, 27 bp, Artificial Sequence
  Description of Artificial Sequence: Synthetic oligonucleotide
gcctgtggaagtgagagagcgcaacgt

SEQ ID NO: 232683 - DNA, 27 bp, Artificial Sequence
  Description of Artificial Sequence: Synthetic oligonucleotide
cctgtggaagtgagagagcgcaacgtc

SEQ ID NO: 232684 - DNA, 27 bp, Artificial Sequence
  Description of Artificial Sequence: Synthetic oligonucleotide
ctgtggaagtgagagagcgcaacgtcc

SEQ ID NO: 232685 - DNA, 28 bp, Artificial Sequence
  Description of Artificial Sequence: Synthetic oligonucleotide
tgtggaagtgagagagcgcaacgtcctg

SEQ ID NO: 232686 - DNA, 27 bp, Artificial Sequence
  Description of Artificial Sequence: Synthetic oligonucleotide
gtggaagtgagagagcgcaacgtcctg

SEQ ID NO: 232687 - DNA, 29 bp, Artificial Sequence
  Description of Artificial Sequence: Synthetic oligonucleotide
tggaagtgagagagcgcaacgtcctgatc

SEQ ID NO: 232688 - DNA, 28 bp, Artificial Sequence
  Description of Artificial Sequence: Synthetic oligonucleotide
ggaagtgagagagcgcaacgtcctgatc

SEQ ID NO: 232689 - DNA, 29 bp, Artificial Sequence
  Description of Artificial Sequence: Synthetic oligonucleotide
gaagtgagagagcgcaacgtcctgatctg

SEQ ID NO: 232690 - DNA, 32 bp, Artificial Sequence
  Description of Artificial Sequence: Synthetic oligonucleotide
aagtgagagagcgcaacgtcctgatctgtttc

SEQ ID NO: 232691 - DNA, 31 bp, Artificial Sequence
  Description of Artificial Sequence: Synthetic oligonucleotide
agtgagagagcgcaacgtcctgatctgtttc

SEQ ID NO: 232692 - DNA, 30 bp, Artificial Sequence
  Description of Artificial Sequence: Synthetic oligonucleotide
gtgagagagcgcaacgtcctgatctgtttc

SEQ ID NO: 232693 - DNA, 33 bp, Artificial Sequence
  Description of Artificial Sequence: Synthetic oligonucleotide
tgagagagcgcaacgtcctgatctgtttcttag

SEQ ID NO: 232694 - DNA, 32 bp, Artificial Sequence
  Description of Artificial Sequence: Synthetic oligonucleotide
gagagagcgcaacgtcctgatctgtttcttag

SEQ ID NO: 232695 - DNA, 33 bp, Artificial Sequence
  Description of Artificial Sequence: Synthetic oligonucleotide
agagagcgcaacgtcctgatctgtttcttagac

SEQ ID NO: 232696 - DNA, 32 bp, Artificial Sequence
  Description of Artificial Sequence: Synthetic oligonucleotide
gagagcgcaacgtcctgatctgtttcttagac

SEQ ID NO: 232697 - DNA, 34 bp, Artificial Sequence
  Description of Artificial Sequence: Synthetic oligonucleotide
agagcgcaacgtcctgatctgtttcttagacaag

SEQ ID NO: 232698 - DNA, 33 bp, Artificial Sequence
  Description of Artificial Sequence: Synthetic oligonucleotide
gagcgcaacgtcctgatctgtttcttagacaag

SEQ ID NO: 232699 - DNA, 35 bp, Artificial Sequence
  Description of Artificial Sequence: Synthetic oligonucleotide
agcgcaacgtcctgatctgtttcttagacaagtac

SEQ ID NO: 232700 - DNA, 34 bp, Artificial Sequence
  Description of Artificial Sequence: Synthetic oligonucleotide
gcgcaacgtcctgatctgtttcttagacaagtac

SEQ ID NO: 232701 - DNA, 35 bp, Artificial Sequence
  Description of Artificial Sequence: Synthetic oligonucleotide
cgcaacgtcctgatctgtttcttagacaagtacac

SEQ ID NO: 232702 - DNA, 35 bp, Artificial Sequence
  Description of Artificial Sequence: Synthetic oligonucleotide
gcaacgtcctgatctgtttcttagacaagtacacc

SEQ ID NO: 232703 - DNA, 35 bp, Artificial Sequence
  Description of Artificial Sequence: Synthetic oligonucleotide
caacgtcctgatctgtttcttagacaagtacaccc

SEQ ID NO: 232704 - DNA, 35 bp, Artificial Sequence
  Description of Artificial Sequence: Synthetic oligonucleotide
aacgtcctgatctgtttcttagacaagtacacccc

SEQ ID NO: 232705 - DNA, 34 bp, Artificial Sequence
  Description of Artificial Sequence: Synthetic oligonucleotide
acgtcctgatctgtttcttagacaagtacacccc

SEQ ID NO: 232706 - DNA, 33 bp, Artificial Sequence
  Description of Artificial Sequence: Synthetic oligonucleotide
cgtcctgatctgtttcttagacaagtacacccc

SEQ ID NO: 232707 - DNA, 34 bp, Artificial Sequence
  Description of Artificial Sequence: Synthetic oligonucleotide
gtcctgatctgtttcttagacaagtacaccccac

SEQ ID NO: 232708 - DNA, 34 bp, Artificial Sequence
  Description of Artificial Sequence: Synthetic oligonucleotide
tcctgatctgtttcttagacaagtacaccccacc

SEQ ID NO: 232709 - DNA, 33 bp, Artificial Sequence
  Description of Artificial Sequence: Synthetic oligonucleotide
cctgatctgtttcttagacaagtacaccccacc

SEQ ID NO: 232710 - DNA, 34 bp, Artificial Sequence
  Description of Artificial Sequence: Synthetic oligonucleotide
ctgatctgtttcttagacaagtacaccccacctg

SEQ ID NO: 232711 - DNA, 35 bp, Artificial Sequence
  Description of Artificial Sequence: Synthetic oligonucleotide
tgatctgtttcttagacaagtacaccccacctgtg

SEQ ID NO: 232712 - DNA, 34 bp, Artificial Sequence
  Description of Artificial Sequence: Synthetic oligonucleotide
gatctgtttcttagacaagtacaccccacctgtg

SEQ ID NO: 232713 - DNA, 34 bp, Artificial Sequence
  Description of Artificial Sequence: Synthetic oligonucleotide
atctgtttcttagacaagtacaccccacctgtgg

SEQ ID NO: 232714 - DNA, 33 bp, Artificial Sequence
  Description of Artificial Sequence: Synthetic oligonucleotide
tctgtttcttagacaagtacaccccacctgtgg

SEQ ID NO: 232715 - DNA, 32 bp, Artificial Sequence
  Description of Artificial Sequence: Synthetic oligonucleotide
ctgtttcttagacaagtacaccccacctgtgg

SEQ ID NO: 232716 - DNA, 33 bp, Artificial Sequence
  Description of Artificial Sequence: Synthetic oligonucleotide
tgtttcttagacaagtacaccccacctgtggtc

SEQ ID NO: 232717 - DNA, 32 bp, Artificial Sequence
  Description of Artificial Sequence: Synthetic oligonucleotide
gtttcttagacaagtacaccccacctgtggtc

SEQ ID NO: 232718 - DNA, 35 bp, Artificial Sequence
  Description of Artificial Sequence: Synthetic oligonucleotide
tttcttagacaagtacaccccacctgtggtcaatc

SEQ ID NO: 232719 - DNA, 34 bp, Artificial Sequence
  Description of Artificial Sequence: Synthetic oligonucleotide
ttcttagacaagtacaccccacctgtggtcaatc

SEQ ID NO: 232720 - DNA, 33 bp, Artificial Sequence
  Description of Artificial Sequence: Synthetic oligonucleotide
tcttagacaagtacaccccacctgtggtcaatc

SEQ ID NO: 232721 - DNA, 32 bp, Artificial Sequence
  Description of Artificial Sequence: Synthetic oligonucleotide
cttagacaagtacaccccacctgtggtcaatc

SEQ ID NO: 232722 - DNA, 33 bp, Artificial Sequence
  Description of Artificial Sequence: Synthetic oligonucleotide
ttagacaagtacaccccacctgtggtcaatctc

SEQ ID NO: 232723 - DNA, 32 bp, Artificial Sequence
  Description of Artificial Sequence: Synthetic oligonucleotide
tagacaagtacaccccacctgtggtcaatctc

SEQ ID NO: 232724 - DNA, 31 bp, Artificial Sequence
  Description of Artificial Sequence: Synthetic oligonucleotide
agacaagtacaccccacctgtggtcaatctc

SEQ ID NO: 232725 - DNA, 30 bp, Artificial Sequence
  Description of Artificial Sequence: Synthetic oligonucleotide
gacaagtacaccccacctgtggtcaatctc

SEQ ID NO: 232726 - DNA, 31 bp, Artificial Sequence
  Description of Artificial Sequence: Synthetic oligonucleotide
acaagtacaccccacctgtggtcaatctcac

SEQ ID NO: 232727 - DNA, 30 bp, Artificial Sequence
  Description of Artificial Sequence: Synthetic oligonucleotide
caagtacaccccacctgtggtcaatctcac

SEQ ID NO: 232728 - DNA, 30 bp, Artificial Sequence
  Description of Artificial Sequence: Synthetic oligonucleotide
aagtacaccccacctgtggtcaatctcacg

SEQ ID NO: 232729 - DNA, 29 bp, Artificial Sequence
  Description of Artificial Sequence: Synthetic oligonucleotide
agtacaccccacctgtggtcaatctcacg

SEQ ID NO: 232730 - DNA, 28 bp, Artificial Sequence
  Description of Artificial Sequence: Synthetic oligonucleotide
gtacaccccacctgtggtcaatctcacg

SEQ ID NO: 232731 - DNA, 29 bp, Artificial Sequence
  Description of Artificial Sequence: Synthetic oligonucleotide
tacaccccacctgtggtcaatctcacgtg

SEQ ID NO: 232732 - DNA, 28 bp, Artificial Sequence
  Description of Artificial Sequence: Synthetic oligonucleotide
acaccccacctgtggtcaatctcacgtg

SEQ ID NO: 232733 - DNA, 27 bp, Artificial Sequence
  Description of Artificial Sequence: Synthetic oligonucleotide
caccccacctgtggtcaatctcacgtg

SEQ ID NO: 232734 - DNA, 27 bp, Artificial Sequence
  Description of Artificial Sequence: Synthetic oligonucleotide
accccacctgtggtcaatctcacgtgg

SEQ ID NO: 232735 - DNA, 26 bp, Artificial Sequence
  Description of Artificial Sequence: Synthetic oligonucleotide
ccccacctgtggtcaatctcacgtgg

SEQ ID NO: 232736 - DNA, 27 bp, Artificial Sequence
  Description of Artificial Sequence: Synthetic oligonucleotide
cccacctgtggtcaatctcacgtggca

SEQ ID NO: 232737 - DNA, 28 bp, Artificial Sequence
  Description of Artificial Sequence: Synthetic oligonucleotide
ccacctgtggtcaatctcacgtggcatc

SEQ ID NO: 232738 - DNA, 28 bp, Artificial Sequence
  Description of Artificial Sequence: Synthetic oligonucleotide
cacctgtggtcaatctcacgtggcatcg

SEQ ID NO: 232739 - DNA, 32 bp, Artificial Sequence
  Description of Artificial Sequence: Synthetic oligonucleotide
acctgtggtcaatctcacgtggcatcgaaatg

SEQ ID NO: 232740 - DNA, 31 bp, Artificial Sequence
  Description of Artificial Sequence: Synthetic oligonucleotide
cctgtggtcaatctcacgtggcatcgaaatg

SEQ ID NO: 232741 - DNA, 31 bp, Artificial Sequence
  Description of Artificial Sequence: Synthetic oligonucleotide
ctgtggtcaatctcacgtggcatcgaaatgg

SEQ ID NO: 232742 - DNA, 35 bp, Artificial Sequence
  Description of Artificial Sequence: Synthetic oligonucleotide
tgtggtcaatctcacgtggcatcgaaatggtaaac

SEQ ID NO: 232743 - DNA, 34 bp, Artificial Sequence
  Description of Artificial Sequence: Synthetic oligonucleotide
gtggtcaatctcacgtggcatcgaaatggtaaac

SEQ ID NO: 232744 - DNA, 34 bp, Artificial Sequence
  Description of Artificial Sequence: Synthetic oligonucleotide
tggtcaatctcacgtggcatcgaaatggtaaacc

SEQ ID NO: 232745 - DNA, 33 bp, Artificial Sequence
  Description of Artificial Sequence: Synthetic oligonucleotide
ggtcaatctcacgtggcatcgaaatggtaaacc

SEQ ID NO: 232746 - DNA, 34 bp, Artificial Sequence
  Description of Artificial Sequence: Synthetic oligonucleotide
gtcaatctcacgtggcatcgaaatggtaaacctg

SEQ ID NO: 232747 - DNA, 35 bp, Artificial Sequence
  Description of Artificial Sequence: Synthetic oligonucleotide
tcaatctcacgtggcatcgaaatggtaaacctgtc

SEQ ID NO: 232748 - DNA, 34 bp, Artificial Sequence
  Description of Artificial Sequence: Synthetic oligonucleotide
caatctcacgtggcatcgaaatggtaaacctgtc

SEQ ID NO: 232749 - DNA, 35 bp, Artificial Sequence
  Description of Artificial Sequence: Synthetic oligonucleotide
aatctcacgtggcatcgaaatggtaaacctgtctc

SEQ ID NO: 232750 - DNA, 34 bp, Artificial Sequence
  Description of Artificial Sequence: Synthetic oligonucleotide
atctcacgtggcatcgaaatggtaaacctgtctc

SEQ ID NO: 232751 - DNA, 33 bp, Artificial Sequence
  Description of Artificial Sequence: Synthetic oligonucleotide
tctcacgtggcatcgaaatggtaaacctgtctc

SEQ ID NO: 232752 - DNA, 32 bp, Artificial Sequence
  Description of Artificial Sequence: Synthetic oligonucleotide
ctcacgtggcatcgaaatggtaaacctgtctc

SEQ ID NO: 232753 - DNA, 32 bp, Artificial Sequence
  Description of Artificial Sequence: Synthetic oligonucleotide
tcacgtggcatcgaaatggtaaacctgtctcc

SEQ ID NO: 232754 - DNA, 31 bp, Artificial Sequence
  Description of Artificial Sequence: Synthetic oligonucleotide
cacgtggcatcgaaatggtaaacctgtctcc

SEQ ID NO: 232755 - DNA, 32 bp, Artificial Sequence
  Description of Artificial Sequence: Synthetic oligonucleotide
acgtggcatcgaaatggtaaacctgtctccac

SEQ ID NO: 232756 - DNA, 31 bp, Artificial Sequence
  Description of Artificial Sequence: Synthetic oligonucleotide
cgtggcatcgaaatggtaaacctgtctccac

SEQ ID NO: 232757 - DNA, 32 bp, Artificial Sequence
  Description of Artificial Sequence: Synthetic oligonucleotide
gtggcatcgaaatggtaaacctgtctccacag

SEQ ID NO: 232758 - DNA, 32 bp, Artificial Sequence
  Description of Artificial Sequence: Synthetic oligonucleotide
tggcatcgaaatggtaaacctgtctccacagg

SEQ ID NO: 232759 - DNA, 31 bp, Artificial Sequence
  Description of Artificial Sequence: Synthetic oligonucleotide
ggcatcgaaatggtaaacctgtctccacagg

SEQ ID NO: 232760 - DNA, 32 bp, Artificial Sequence
  Description of Artificial Sequence: Synthetic oligonucleotide
gcatcgaaatggtaaacctgtctccacaggag

SEQ ID NO: 232761 - DNA, 33 bp, Artificial Sequence
  Description of Artificial Sequence: Synthetic oligonucleotide
catcgaaatggtaaacctgtctccacaggagag

SEQ ID NO: 232762 - DNA, 34 bp, Artificial Sequence
  Description of Artificial Sequence: Synthetic oligonucleotide
atcgaaatggtaaacctgtctccacaggagagtc

SEQ ID NO: 232763 - DNA, 33 bp, Artificial Sequence
  Description of Artificial Sequence: Synthetic oligonucleotide
tcgaaatggtaaacctgtctccacaggagagtc

SEQ ID NO: 232764 - DNA, 32 bp, Artificial Sequence
  Description of Artificial Sequence: Synthetic oligonucleotide
cgaaatggtaaacctgtctccacaggagagtc

SEQ ID NO: 232765 - DNA, 33 bp, Artificial Sequence
  Description of Artificial Sequence: Synthetic oligonucleotide
gaaatggtaaacctgtctccacaggagagtcag

SEQ ID NO: 232766 - DNA, 34 bp, Artificial Sequence
  Description of Artificial Sequence: Synthetic oligonucleotide
aaatggtaaacctgtctccacaggagagtcagag

SEQ ID NO: 232767 - DNA, 33 bp, Artificial Sequence
  Description of Artificial Sequence: Synthetic oligonucleotide
aatggtaaacctgtctccacaggagagtcagag

SEQ ID NO: 232768 - DNA, 32 bp, Artificial Sequence
  Description of Artificial Sequence: Synthetic oligonucleotide
atggtaaacctgtctccacaggagagtcagag

SEQ ID NO: 232769 - DNA, 31 bp, Artificial Sequence
  Description of Artificial Sequence: Synthetic oligonucleotide
tggtaaacctgtctccacaggagagtcagag

SEQ ID NO: 232770 - DNA, 30 bp, Artificial Sequence
  Description of Artificial Sequence: Synthetic oligonucleotide
ggtaaacctgtctccacaggagagtcagag

SEQ ID NO: 232771 - DNA, 31 bp, Artificial Sequence
  Description of Artificial Sequence: Synthetic oligonucleotide
gtaaacctgtctccacaggagagtcagagac

SEQ ID NO: 232772 - DNA, 32 bp, Artificial Sequence
  Description of Artificial Sequence: Synthetic oligonucleotide
taaacctgtctccacaggagagtcagagactg

SEQ ID NO: 232773 - DNA, 31 bp, Artificial Sequence
  Description of Artificial Sequence: Synthetic oligonucleotide
aaacctgtctccacaggagagtcagagactg

SEQ ID NO: 232774 - DNA, 30 bp, Artificial Sequence
  Description of Artificial Sequence: Synthetic oligonucleotide
aacctgtctccacaggagagtcagagactg

SEQ ID NO: 232775 - DNA, 29 bp, Artificial Sequence
  Description of Artificial Sequence: Synthetic oligonucleotide
acctgtctccacaggagagtcagagactg

SEQ ID NO: 232776 - DNA, 28 bp, Artificial Sequence
  Description of Artificial Sequence: Synthetic oligonucleotide
cctgtctccacaggagagtcagagactg

SEQ ID NO: 232777 - DNA, 29 bp, Artificial Sequence
  Description of Artificial Sequence: Synthetic oligonucleotide
ctgtctccacaggagagtcagagactgtc

SEQ ID NO: 232778 - DNA, 31 bp, Artificial Sequence
  Description of Artificial Sequence: Synthetic oligonucleotide
tgtctccacaggagagtcagagactgtcttc

SEQ ID NO: 232779 - DNA, 30 bp, Artificial Sequence
  Description of Artificial Sequence: Synthetic oligonucleotide
gtctccacaggagagtcagagactgtcttc

SEQ ID NO: 232780 - DNA, 30 bp, Artificial Sequence
  Description of Artificial Sequence: Synthetic oligonucleotide
tctccacaggagagtcagagactgtcttcc

SEQ ID NO: 232781 - DNA, 29 bp, Artificial Sequence
  Description of Artificial Sequence: Synthetic oligonucleotide
ctccacaggagagtcagagactgtcttcc

SEQ ID NO: 232782 - DNA, 30 bp, Artificial Sequence
  Description of Artificial Sequence: Synthetic oligonucleotide
tccacaggagagtcagagactgtcttcctg

SEQ ID NO: 232783 - DNA, 29 bp, Artificial Sequence
  Description of Artificial Sequence: Synthetic oligonucleotide
ccacaggagagtcagagactgtcttcctg

SEQ ID NO: 232784 - DNA, 29 bp, Artificial Sequence
  Description of Artificial Sequence: Synthetic oligonucleotide
cacaggagagtcagagactgtcttcctgg

SEQ ID NO: 232785 - DNA, 29 bp, Artificial Sequence
  Description of Artificial Sequence: Synthetic oligonucleotide
acaggagagtcagagactgtcttcctggc

SEQ ID NO: 232786 - DNA, 28 bp, Artificial Sequence
  Description of Artificial Sequence: Synthetic oligonucleotide
caggagagtcagagactgtcttcctggc

SEQ ID NO: 232787 - DNA, 28 bp, Artificial Sequence
  Description of Artificial Sequence: Synthetic oligonucleotide
aggagagtcagagactgtcttcctggcc

SEQ ID NO: 232788 - DNA, 27 bp, Artificial Sequence
  Description of Artificial Sequence: Synthetic oligonucleotide
ggagagtcagagactgtcttcctggcc

SEQ ID NO: 232789 - DNA, 28 bp, Artificial Sequence
  Description of Artificial Sequence: Synthetic oligonucleotide
gagagtcagagactgtcttcctggccag

SEQ ID NO: 232790 - DNA, 28 bp, Artificial Sequence
  Description of Artificial Sequence: Synthetic oligonucleotide
agagtcagagactgtcttcctggccagg

SEQ ID NO: 232791 - DNA, 27 bp, Artificial Sequence
  Description of Artificial Sequence: Synthetic oligonucleotide
gagtcagagactgtcttcctggccagg

SEQ ID NO: 232792 - DNA, 27 bp, Artificial Sequence
  Description of Artificial Sequence: Synthetic oligonucleotide
agtcagagactgtcttcctggccaggg

SEQ ID NO: 232793 - DNA, 27 bp, Artificial Sequence
  Description of Artificial Sequence: Synthetic oligonucleotide
gtcagagactgtcttcctggccaggga

SEQ ID NO: 232794 - DNA, 28 bp, Artificial Sequence
  Description of Artificial Sequence: Synthetic oligonucleotide
tcagagactgtcttcctggccagggaag

SEQ ID NO: 232795 - DNA, 27 bp, Artificial Sequence
  Description of Artificial Sequence: Synthetic oligonucleotide
cagagactgtcttcctggccagggaag

SEQ ID NO: 232796 - DNA, 28 bp, Artificial Sequence
  Description of Artificial Sequence: Synthetic oligonucleotide
agagactgtcttcctggccagggaagtc

SEQ ID NO: 232797 - DNA, 27 bp, Artificial Sequence
  Description of Artificial Sequence: Synthetic oligonucleotide
gagactgtcttcctggccagggaagtc

SEQ ID NO: 232798 - DNA, 27 bp, Artificial Sequence
  Description of Artificial Sequence: Synthetic oligonucleotide
agactgtcttcctggccagggaagtcc

SEQ ID NO: 232799 - DNA, 27 bp, Artificial Sequence
  Description of Artificial Sequence: Synthetic oligonucleotide
gactgtcttcctggccagggaagtcca

SEQ ID NO: 232800 - DNA, 27 bp, Artificial Sequence
  Description of Artificial Sequence: Synthetic oligonucleotide
actgtcttcctggccagggaagtccac

SEQ ID NO: 232801 - DNA, 26 bp, Artificial Sequence
  Description of Artificial Sequence: Synthetic oligonucleotide
ctgtcttcctggccagggaagtccac

SEQ ID NO: 232802 - DNA, 27 bp, Artificial Sequence
  Description of Artificial Sequence: Synthetic oligonucleotide
tgtcttcctggccagggaagtccacct

SEQ ID NO: 232803 - DNA, 27 bp, Artificial Sequence
  Description of Artificial Sequence: Synthetic oligonucleotide
gtcttcctggccagggaagtccacctt

SEQ ID NO: 232804 - DNA, 29 bp, Artificial Sequence
  Description of Artificial Sequence: Synthetic oligonucleotide
tcttcctggccagggaagtccaccttttg

SEQ ID NO: 232805 - DNA, 28 bp, Artificial Sequence
  Description of Artificial Sequence: Synthetic oligonucleotide
cttcctggccagggaagtccaccttttg

SEQ ID NO: 232806 - DNA, 28 bp, Artificial Sequence
  Description of Artificial Sequence: Synthetic oligonucleotide
ttcctggccagggaagtccaccttttgc

SEQ ID NO: 232807 - DNA, 27 bp, Artificial Sequence
  Description of Artificial Sequence: Synthetic oligonucleotide
tcctggccagggaagtccaccttttgc

SEQ ID NO: 232808 - DNA, 26 bp, Artificial Sequence
  Description of Artificial Sequence: Synthetic oligonucleotide
cctggccagggaagtccaccttttgc

SEQ ID NO: 232809 - DNA, 26 bp, Artificial Sequence
  Description of Artificial Sequence: Synthetic oligonucleotide
ctggccagggaagtccaccttttgcg

SEQ ID NO: 232810 - DNA, 27 bp, Artificial Sequence
  Description of Artificial Sequence: Synthetic oligonucleotide
tggccagggaagtccaccttttgcgca

SEQ ID NO: 232811 - DNA, 27 bp, Artificial Sequence
  Description of Artificial Sequence: Synthetic oligonucleotide
ggccagggaagtccaccttttgcgcaa

SEQ ID NO: 232812 - DNA, 27 bp, Artificial Sequence
  Description of Artificial Sequence: Synthetic oligonucleotide
gccagggaagtccaccttttgcgcaag

SEQ ID NO: 232813 - DNA, 29 bp, Artificial Sequence
  Description of Artificial Sequence: Synthetic oligonucleotide
ccagggaagtccaccttttgcgcaagttc

SEQ ID NO: 232814 - DNA, 29 bp, Artificial Sequence
  Description of Artificial Sequence: Synthetic oligonucleotide
cagggaagtccaccttttgcgcaagttcg

SEQ ID NO: 232815 - DNA, 30 bp, Artificial Sequence
  Description of Artificial Sequence: Synthetic oligonucleotide
agggaagtccaccttttgcgcaagttcgac

SEQ ID NO: 232816 - DNA, 29 bp, Artificial Sequence
  Description of Artificial Sequence: Synthetic oligonucleotide
gggaagtccaccttttgcgcaagttcgac

SEQ ID NO: 232817 - DNA, 32 bp, Artificial Sequence
  Description of Artificial Sequence: Synthetic oligonucleotide
ggaagtccaccttttgcgcaagttcgactatc

SEQ ID NO: 232818 - DNA, 33 bp, Artificial Sequence
  Description of Artificial Sequence: Synthetic oligonucleotide
gaagtccaccttttgcgcaagttcgactatctc

SEQ ID NO: 232819 - DNA, 33 bp, Artificial Sequence
  Description of Artificial Sequence: Synthetic oligonucleotide
aagtccaccttttgcgcaagttcgactatctcc

SEQ ID NO: 232820 - DNA, 32 bp, Artificial Sequence
  Description of Artificial Sequence: Synthetic oligonucleotide
agtccaccttttgcgcaagttcgactatctcc

SEQ ID NO: 232821 - DNA, 31 bp, Artificial Sequence
  Description of Artificial Sequence: Synthetic oligonucleotide
gtccaccttttgcgcaagttcgactatctcc

SEQ ID NO: 232822 - DNA, 31 bp, Artificial Sequence
  Description of Artificial Sequence: Synthetic oligonucleotide
tccaccttttgcgcaagttcgactatctccg

SEQ ID NO: 232823 - DNA, 30 bp, Artificial Sequence
  Description of Artificial Sequence: Synthetic oligonucleotide
ccaccttttgcgcaagttcgactatctccg

SEQ ID NO: 232824 - DNA, 30 bp, Artificial Sequence
  Description of Artificial Sequence: Synthetic oligonucleotide
caccttttgcgcaagttcgactatctccgc

SEQ ID NO: 232825 - DNA, 32 bp, Artificial Sequence
  Description of Artificial Sequence: Synthetic oligonucleotide
accttttgcgcaagttcgactatctccgcttc

SEQ ID NO: 232826 - DNA, 31 bp, Artificial Sequence
  Description of Artificial Sequence: Synthetic oligonucleotide
ccttttgcgcaagttcgactatctccgcttc

SEQ ID NO: 232827 - DNA, 31 bp, Artificial Sequence
  Description of Artificial Sequence: Synthetic oligonucleotide
cttttgcgcaagttcgactatctccgcttcc

SEQ ID NO: 232828 - DNA, 32 bp, Artificial Sequence
  Description of Artificial Sequence: Synthetic oligonucleotide
ttttgcgcaagttcgactatctccgcttcctg

SEQ ID NO: 232829 - DNA, 31 bp, Artificial Sequence
  Description of Artificial Sequence: Synthetic oligonucleotide
tttgcgcaagttcgactatctccgcttcctg

SEQ ID NO: 232830 - DNA, 30 bp, Artificial Sequence
  Description of Artificial Sequence: Synthetic oligonucleotide
ttgcgcaagttcgactatctccgcttcctg

SEQ ID NO: 232831 - DNA, 29 bp, Artificial Sequence
  Description of Artificial Sequence: Synthetic oligonucleotide
tgcgcaagttcgactatctccgcttcctg

SEQ ID NO: 232832 - DNA, 28 bp, Artificial Sequence
  Description of Artificial Sequence: Synthetic oligonucleotide
gcgcaagttcgactatctccgcttcctg

SEQ ID NO: 232833 - DNA, 28 bp, Artificial Sequence
  Description of Artificial Sequence: Synthetic oligonucleotide
cgcaagttcgactatctccgcttcctgc

SEQ ID NO: 232834 - DNA, 28 bp, Artificial Sequence
  Description of Artificial Sequence: Synthetic oligonucleotide
gcaagttcgactatctccgcttcctgcc

SEQ ID NO: 232835 - DNA, 28 bp, Artificial Sequence
  Description of Artificial Sequence: Synthetic oligonucleotide
caagttcgactatctccgcttcctgccg

SEQ ID NO: 232836 - DNA, 29 bp, Artificial Sequence
  Description of Artificial Sequence: Synthetic oligonucleotide
aagttcgactatctccgcttcctgccgtc

SEQ ID NO: 232837 - DNA, 28 bp, Artificial Sequence
  Description of Artificial Sequence: Synthetic oligonucleotide
agttcgactatctccgcttcctgccgtc

SEQ ID NO: 232838 - DNA, 27 bp, Artificial Sequence
  Description of Artificial Sequence: Synthetic oligonucleotide
gttcgactatctccgcttcctgccgtc

SEQ ID NO: 232839 - DNA, 29 bp, Artificial Sequence
  Description of Artificial Sequence: Synthetic oligonucleotide
ttcgactatctccgcttcctgccgtcaac

SEQ ID NO: 232840 - DNA, 28 bp, Artificial Sequence
  Description of Artificial Sequence: Synthetic oligonucleotide
tcgactatctccgcttcctgccgtcaac

SEQ ID NO: 232841 - DNA, 27 bp, Artificial Sequence
  Description of Artificial Sequence: Synthetic oligonucleotide
cgactatctccgcttcctgccgtcaac

SEQ ID NO: 232842 - DNA, 28 bp, Artificial Sequence
  Description of Artificial Sequence: Synthetic oligonucleotide
gactatctccgcttcctgccgtcaactg

SEQ ID NO: 232843 - DNA, 29 bp, Artificial Sequence
  Description of Artificial Sequence: Synthetic oligonucleotide
actatctccgcttcctgccgtcaactgag

SEQ ID NO: 232844 - DNA, 28 bp, Artificial Sequence
  Description of Artificial Sequence: Synthetic oligonucleotide
ctatctccgcttcctgccgtcaactgag

SEQ ID NO: 232845 - DNA, 28 bp, Artificial Sequence
  Description of Artificial Sequence: Synthetic oligonucleotide
tatctccgcttcctgccgtcaactgagc

SEQ ID NO: 232846 - DNA, 27 bp, Artificial Sequence
  Description of Artificial Sequence: Synthetic oligonucleotide
atctccgcttcctgccgtcaactgagc

SEQ ID NO: 232847 - DNA, 27 bp, Artificial Sequence
  Description of Artificial Sequence: Synthetic oligonucleotide
tctccgcttcctgccgtcaactgagca

SEQ ID NO: 232848 - DNA, 26 bp, Artificial Sequence
  Description of Artificial Sequence: Synthetic oligonucleotide
ctccgcttcctgccgtcaactgagca

SEQ ID NO: 232849 - DNA, 26 bp, Artificial Sequence
  Description of Artificial Sequence: Synthetic oligonucleotide
tccgcttcctgccgtcaactgagcac

SEQ ID NO: 232850 - DNA, 25 bp, Artificial Sequence
  Description of Artificial Sequence: Synthetic oligonucleotide
ccgcttcctgccgtcaactgagcac

SEQ ID NO: 232851 - DNA, 27 bp, Artificial Sequence
  Description of Artificial Sequence: Synthetic oligonucleotide
cgcttcctgccgtcaactgagcacgtt

SEQ ID NO: 232852 - DNA, 29 bp, Artificial Sequence
  Description of Artificial Sequence: Synthetic oligonucleotide
gcttcctgccgtcaactgagcacgtttac

SEQ ID NO: 232853 - DNA, 29 bp, Artificial Sequence
  Description of Artificial Sequence: Synthetic oligonucleotide
cttcctgccgtcaactgagcacgtttacg

SEQ ID NO: 232854 - DNA, 30 bp, Artificial Sequence
  Description of Artificial Sequence: Synthetic oligonucleotide
ttcctgccgtcaactgagcacgtttacgtc

SEQ ID NO: 232855 - DNA, 29 bp, Artificial Sequence
  Description of Artificial Sequence: Synthetic oligonucleotide
tcctgccgtcaactgagcacgtttacgtc

SEQ ID NO: 232856 - DNA, 28 bp, Artificial Sequence
  Description of Artificial Sequence: Synthetic oligonucleotide
cctgccgtcaactgagcacgtttacgtc

SEQ ID NO: 232857 - DNA, 29 bp, Artificial Sequence
  Description of Artificial Sequence: Synthetic oligonucleotide
ctgccgtcaactgagcacgtttacgtctg

SEQ ID NO: 232858 - DNA, 29 bp, Artificial Sequence
  Description of Artificial Sequence: Synthetic oligonucleotide
tgccgtcaactgagcacgtttacgtctgc

SEQ ID NO: 232859 - DNA, 28 bp, Artificial Sequence
  Description of Artificial Sequence: Synthetic oligonucleotide
gccgtcaactgagcacgtttacgtctgc

SEQ ID NO: 232860 - DNA, 29 bp, Artificial Sequence
  Description of Artificial Sequence: Synthetic oligonucleotide
ccgtcaactgagcacgtttacgtctgcag

SEQ ID NO: 232861 - DNA, 29 bp, Artificial Sequence
  Description of Artificial Sequence: Synthetic oligonucleotide
cgtcaactgagcacgtttacgtctgcagg

SEQ ID NO: 232862 - DNA, 29 bp, Artificial Sequence
  Description of Artificial Sequence: Synthetic oligonucleotide
gtcaactgagcacgtttacgtctgcaggg

SEQ ID NO: 232863 - DNA, 30 bp, Artificial Sequence
  Description of Artificial Sequence: Synthetic oligonucleotide
tcaactgagcacgtttacgtctgcagggtc

SEQ ID NO: 232864 - DNA, 29 bp, Artificial Sequence
  Description of Artificial Sequence: Synthetic oligonucleotide
caactgagcacgtttacgtctgcagggtc

SEQ ID NO: 232865 - DNA, 29 bp, Artificial Sequence
  Description of Artificial Sequence: Synthetic oligonucleotide
aactgagcacgtttacgtctgcagggtcg

SEQ ID NO: 232866 - DNA, 28 bp, Artificial Sequence
  Description of Artificial Sequence: Synthetic oligonucleotide
actgagcacgtttacgtctgcagggtcg

SEQ ID NO: 232867 - DNA, 27 bp, Artificial Sequence
  Description of Artificial Sequence: Synthetic oligonucleotide
ctgagcacgtttacgtctgcagggtcg

SEQ ID NO: 232868 - DNA, 28 bp, Artificial Sequence
  Description of Artificial Sequence: Synthetic oligonucleotide
tgagcacgtttacgtctgcagggtcgag

SEQ ID NO: 232869 - DNA, 27 bp, Artificial Sequence
  Description of Artificial Sequence: Synthetic oligonucleotide
gagcacgtttacgtctgcagggtcgag

SEQ ID NO: 232870 - DNA, 27 bp, Artificial Sequence
  Description of Artificial Sequence: Synthetic oligonucleotide
agcacgtttacgtctgcagggtcgagc

SEQ ID NO: 232871 - DNA, 27 bp, Artificial Sequence
  Description of Artificial Sequence: Synthetic oligonucleotide
gcacgtttacgtctgcagggtcgagca

SEQ ID NO: 232872 - DNA, 27 bp, Artificial Sequence
  Description of Artificial Sequence: Synthetic oligonucleotide
cacgtttacgtctgcagggtcgagcac

SEQ ID NO: 232873 - DNA, 28 bp, Artificial Sequence
  Description of Artificial Sequence: Synthetic oligonucleotide
acgtttacgtctgcagggtcgagcactg

SEQ ID NO: 232874 - DNA, 27 bp, Artificial Sequence
  Description of Artificial Sequence: Synthetic oligonucleotide
cgtttacgtctgcagggtcgagcactg

SEQ ID NO: 232875 - DNA, 27 bp, Artificial Sequence
  Description of Artificial Sequence: Synthetic oligonucleotide
gtttacgtctgcagggtcgagcactgg

SEQ ID NO: 232876 - DNA, 27 bp, Artificial Sequence
  Description of Artificial Sequence: Synthetic oligonucleotide
tttacgtctgcagggtcgagcactggc

SEQ ID NO: 232877 - DNA, 26 bp, Artificial Sequence
  Description of Artificial Sequence: Synthetic oligonucleotide
ttacgtctgcagggtcgagcactggc

SEQ ID NO: 232878 - DNA, 25 bp, Artificial Sequence
  Description of Artificial Sequence: Synthetic oligonucleotide
tacgtctgcagggtcgagcactggc

SEQ ID NO: 232879 - DNA, 24 bp, Artificial Sequence
  Description of Artificial Sequence: Synthetic oligonucleotide
acgtctgcagggtcgagcactggc

SEQ ID NO: 232880 - DNA, 23 bp, Artificial Sequence
  Description of Artificial Sequence: Synthetic oligonucleotide
cgtctgcagggtcgagcactggc

SEQ ID NO: 232881 - DNA, 23 bp, Artificial Sequence
  Description of Artificial Sequence: Synthetic oligonucleotide
gtctgcagggtcgagcactggcg

SEQ ID NO: 232882 - DNA, 25 bp, Artificial Sequence
  Description of Artificial Sequence: Synthetic oligonucleotide
tctgcagggtcgagcactggcgctt

SEQ ID NO: 232883 - DNA, 24 bp, Artificial Sequence
  Description of Artificial Sequence: Synthetic oligonucleotide
ctgcagggtcgagcactggcgctt

SEQ ID NO: 232884 - DNA, 24 bp, Artificial Sequence
  Description of Artificial Sequence: Synthetic oligonucleotide
tgcagggtcgagcactggcgcttg

SEQ ID NO: 232885 - DNA, 23 bp, Artificial Sequence
  Description of Artificial Sequence: Synthetic oligonucleotide
gcagggtcgagcactggcgcttg

SEQ ID NO: 232886 - DNA, 25 bp, Artificial Sequence
  Description of Artificial Sequence: Synthetic oligonucleotide
cagggtcgagcactggcgcttggat

SEQ ID NO: 232887 - DNA, 26 bp, Artificial Sequence
  Description of Artificial Sequence: Synthetic oligonucleotide
agggtcgagcactggcgcttggatgt

SEQ ID NO: 232888 - DNA, 25 bp, Artificial Sequence
  Description of Artificial Sequence: Synthetic oligonucleotide
gggtcgagcactggcgcttggatgt

SEQ ID NO: 232889 - DNA, 25 bp, Artificial Sequence
  Description of Artificial Sequence: Synthetic oligonucleotide
ggtcgagcactggcgcttggatgtg

SEQ ID NO: 232890 - DNA, 25 bp, Artificial Sequence
  Description of Artificial Sequence: Synthetic oligonucleotide
gtcgagcactggcgcttggatgtgc

SEQ ID NO: 232891 - DNA, 26 bp, Artificial Sequence
  Description of Artificial Sequence: Synthetic oligonucleotide
tcgagcactggcgcttggatgtgcct

SEQ ID NO: 232892 - DNA, 25 bp, Artificial Sequence
  Description of Artificial Sequence: Synthetic oligonucleotide
cgagcactggcgcttggatgtgcct

SEQ ID NO: 232893 - DNA, 27 bp, Artificial Sequence
  Description of Artificial Sequence: Synthetic oligonucleotide
gagcactggcgcttggatgtgcctctt

SEQ ID NO: 232894 - DNA, 27 bp, Artificial Sequence
  Description of Artificial Sequence: Synthetic oligonucleotide
agcactggcgcttggatgtgcctcttc

SEQ ID NO: 232895 - DNA, 27 bp, Artificial Sequence
  Description of Artificial Sequence: Synthetic oligonucleotide
gcactggcgcttggatgtgcctcttct

SEQ ID NO: 232896 - DNA, 27 bp, Artificial Sequence
  Description of Artificial Sequence: Synthetic oligonucleotide
cactggcgcttggatgtgcctcttctg

SEQ ID NO: 232897 - DNA, 29 bp, Artificial Sequence
  Description of Artificial Sequence: Synthetic oligonucleotide
actggcgcttggatgtgcctcttctgaag

SEQ ID NO: 232898 - DNA, 28 bp, Artificial Sequence
  Description of Artificial Sequence: Synthetic oligonucleotide
ctggcgcttggatgtgcctcttctgaag

SEQ ID NO: 232899 - DNA, 28 bp, Artificial Sequence
  Description of Artificial Sequence: Synthetic oligonucleotide
tggcgcttggatgtgcctcttctgaagc

SEQ ID NO: 232900 - DNA, 27 bp, Artificial Sequence
  Description of Artificial Sequence: Synthetic oligonucleotide
ggcgcttggatgtgcctcttctgaagc

SEQ ID NO: 232901 - DNA, 28 bp, Artificial Sequence
  Description of Artificial Sequence: Synthetic oligonucleotide
gcgcttggatgtgcctcttctgaagcac

SEQ ID NO: 232902 - DNA, 29 bp, Artificial Sequence
  Description of Artificial Sequence: Synthetic oligonucleotide
cgcttggatgtgcctcttctgaagcactg

SEQ ID NO: 232903 - DNA, 29 bp, Artificial Sequence
  Description of Artificial Sequence: Synthetic oligonucleotide
gcttggatgtgcctcttctgaagcactgg

SEQ ID NO: 232904 - DNA, 29 bp, Artificial Sequence
  Description of Artificial Sequence: Synthetic oligonucleotide
cttggatgtgcctcttctgaagcactggc

SEQ ID NO: 232905 - DNA, 30 bp, Artificial Sequence
  Description of Artificial Sequence: Synthetic oligonucleotide
ttggatgtgcctcttctgaagcactggcag

SEQ ID NO: 232906 - DNA, 29 bp, Artificial Sequence
  Description of Artificial Sequence: Synthetic oligonucleotide
tggatgtgcctcttctgaagcactggcag

SEQ ID NO: 232907 - DNA, 28 bp, Artificial Sequence
  Description of Artificial Sequence: Synthetic oligonucleotide
ggatgtgcctcttctgaagcactggcag

SEQ ID NO: 232908 - DNA, 31 bp, Artificial Sequence
  Description of Artificial Sequence: Synthetic oligonucleotide
gatgtgcctcttctgaagcactggcagtttg

SEQ ID NO: 232909 - DNA, 33 bp, Artificial Sequence
  Description of Artificial Sequence: Synthetic oligonucleotide
atgtgcctcttctgaagcactggcagtttgatg

SEQ ID NO: 232910 - DNA, 32 bp, Artificial Sequence
  Description of Artificial Sequence: Synthetic oligonucleotide
tgtgcctcttctgaagcactggcagtttgatg

SEQ ID NO: 232911 - DNA, 31 bp, Artificial Sequence
  Description of Artificial Sequence: Synthetic oligonucleotide
gtgcctcttctgaagcactggcagtttgatg

SEQ ID NO: 232912 - DNA, 31 bp, Artificial Sequence
  Description of Artificial Sequence: Synthetic oligonucleotide
tgcctcttctgaagcactggcagtttgatgg

SEQ ID NO: 232913 - DNA, 30 bp, Artificial Sequence
  Description of Artificial Sequence: Synthetic oligonucleotide
gcctcttctgaagcactggcagtttgatgg

SEQ ID NO: 232914 - DNA, 31 bp, Artificial Sequence
  Description of Artificial Sequence: Synthetic oligonucleotide
cctcttctgaagcactggcagtttgatggtc

SEQ ID NO: 232915 - DNA, 31 bp, Artificial Sequence
  Description of Artificial Sequence: Synthetic oligonucleotide
ctcttctgaagcactggcagtttgatggtcc

SEQ ID NO: 232916 - DNA, 33 bp, Artificial Sequence
  Description of Artificial Sequence: Synthetic oligonucleotide
tcttctgaagcactggcagtttgatggtccaag

SEQ ID NO: 232917 - DNA, 32 bp, Artificial Sequence
  Description of Artificial Sequence: Synthetic oligonucleotide
cttctgaagcactggcagtttgatggtccaag

SEQ ID NO: 232918 - DNA, 32 bp, Artificial Sequence
  Description of Artificial Sequence: Synthetic oligonucleotide
ttctgaagcactggcagtttgatggtccaagc

SEQ ID NO: 232919 - DNA, 31 bp, Artificial Sequence
  Description of Artificial Sequence: Synthetic oligonucleotide
tctgaagcactggcagtttgatggtccaagc

SEQ ID NO: 232920 - DNA, 30 bp, Artificial Sequence
  Description of Artificial Sequence: Synthetic oligonucleotide
ctgaagcactggcagtttgatggtccaagc

SEQ ID NO: 232921 - DNA, 30 bp, Artificial Sequence
  Description of Artificial Sequence: Synthetic oligonucleotide
tgaagcactggcagtttgatggtccaagcc

SEQ ID NO: 232922 - DNA, 29 bp, Artificial Sequence
  Description of Artificial Sequence: Synthetic oligonucleotide
gaagcactggcagtttgatggtccaagcc

SEQ ID NO: 232923 - DNA, 29 bp, Artificial Sequence
  Description of Artificial Sequence: Synthetic oligonucleotide
aagcactggcagtttgatggtccaagccc

SEQ ID NO: 232924 - DNA, 28 bp, Artificial Sequence
  Description of Artificial Sequence: Synthetic oligonucleotide
agcactggcagtttgatggtccaagccc

SEQ ID NO: 232925 - DNA, 27 bp, Artificial Sequence
  Description of Artificial Sequence: Synthetic oligonucleotide
gcactggcagtttgatggtccaagccc

SEQ ID NO: 232926 - DNA, 28 bp, Artificial Sequence
  Description of Artificial Sequence: Synthetic oligonucleotide
cactggcagtttgatggtccaagcccac

SEQ ID NO: 232927 - DNA, 29 bp, Artificial Sequence
  Description of Artificial Sequence: Synthetic oligonucleotide
actggcagtttgatggtccaagcccactc

SEQ ID NO: 232928 - DNA, 28 bp, Artificial Sequence
  Description of Artificial Sequence: Synthetic oligonucleotide
ctggcagtttgatggtccaagcccactc

SEQ ID NO: 232929 - DNA, 28 bp, Artificial Sequence
  Description of Artificial Sequence: Synthetic oligonucleotide
tggcagtttgatggtccaagcccactcc

SEQ ID NO: 232930 - DNA, 27 bp, Artificial Sequence
  Description of Artificial Sequence: Synthetic oligonucleotide
ggcagtttgatggtccaagcccactcc

SEQ ID NO: 232931 - DNA, 27 bp, Artificial Sequence
  Description of Artificial Sequence: Synthetic oligonucleotide
gcagtttgatggtccaagcccactccc

SEQ ID NO: 232932 - DNA, 28 bp, Artificial Sequence
  Description of Artificial Sequence: Synthetic oligonucleotide
cagtttgatggtccaagcccactcccag

SEQ ID NO: 232933 - DNA, 29 bp, Artificial Sequence
  Description of Artificial Sequence: Synthetic oligonucleotide
agtttgatggtccaagcccactcccagag

SEQ ID NO: 232934 - DNA, 28 bp, Artificial Sequence
  Description of Artificial Sequence: Synthetic oligonucleotide
gtttgatggtccaagcccactcccagag

SEQ ID NO: 232935 - DNA, 29 bp, Artificial Sequence
  Description of Artificial Sequence: Synthetic oligonucleotide
tttgatggtccaagcccactcccagagtc

SEQ ID NO: 232936 - DNA, 28 bp, Artificial Sequence
  Description of Artificial Sequence: Synthetic oligonucleotide
ttgatggtccaagcccactcccagagtc

SEQ ID NO: 232937 - DNA, 27 bp, Artificial Sequence
  Description of Artificial Sequence: Synthetic oligonucleotide
tgatggtccaagcccactcccagagtc

SEQ ID NO: 232938 - DNA, 27 bp, Artificial Sequence
  Description of Artificial Sequence: Synthetic oligonucleotide
gatggtccaagcccactcccagagtct

SEQ ID NO: 232939 - DNA, 28 bp, Artificial Sequence
  Description of Artificial Sequence: Synthetic oligonucleotide
atggtccaagcccactcccagagtctac

SEQ ID NO: 232940 - DNA, 27 bp, Artificial Sequence
  Description of Artificial Sequence: Synthetic oligonucleotide
tggtccaagcccactcccagagtctac

SEQ ID NO: 232941 - DNA, 27 bp, Artificial Sequence
  Description of Artificial Sequence: Synthetic oligonucleotide
ggtccaagcccactcccagagtctaca

SEQ ID NO: 232942 - DNA, 27 bp, Artificial Sequence
  Description of Artificial Sequence: Synthetic oligonucleotide
gtccaagcccactcccagagtctacag

SEQ ID NO: 232943 - DNA, 28 bp, Artificial Sequence
  Description of Artificial Sequence: Synthetic oligonucleotide
tccaagcccactcccagagtctacagag

SEQ ID NO: 232944 - DNA, 27 bp, Artificial Sequence
  Description of Artificial Sequence: Synthetic oligonucleotide
ccaagcccactcccagagtctacagag

SEQ ID NO: 232945 - DNA, 29 bp, Artificial Sequence
  Description of Artificial Sequence: Synthetic oligonucleotide
caagcccactcccagagtctacagagatc

SEQ ID NO: 232946 - DNA, 29 bp, Artificial Sequence
  Description of Artificial Sequence: Synthetic oligonucleotide
aagcccactcccagagtctacagagatcg

SEQ ID NO: 232947 - DNA, 28 bp, Artificial Sequence
  Description of Artificial Sequence: Synthetic oligonucleotide
agcccactcccagagtctacagagatcg

SEQ ID NO: 232948 - DNA, 27 bp, Artificial Sequence
  Description of Artificial Sequence: Synthetic oligonucleotide
gcccactcccagagtctacagagatcg

SEQ ID NO: 232949 - DNA, 28 bp, Artificial Sequence
  Description of Artificial Sequence: Synthetic oligonucleotide
cccactcccagagtctacagagatcgtg

SEQ ID NO: 232950 - DNA, 28 bp, Artificial Sequence
  Description of Artificial Sequence: Synthetic oligonucleotide
ccactcccagagtctacagagatcgtgg

SEQ ID NO: 232951 - DNA, 29 bp, Artificial Sequence
  Description of Artificial Sequence: Synthetic oligonucleotide
cactcccagagtctacagagatcgtggtg

SEQ ID NO: 232952 - DNA, 30 bp, Artificial Sequence
  Description of Artificial Sequence: Synthetic oligonucleotide
actcccagagtctacagagatcgtggtgtg

SEQ ID NO: 232953 - DNA, 29 bp, Artificial Sequence
  Description of Artificial Sequence: Synthetic oligonucleotide
ctcccagagtctacagagatcgtggtgtg

SEQ ID NO: 232954 - DNA, 30 bp, Artificial Sequence
  Description of Artificial Sequence: Synthetic oligonucleotide
tcccagagtctacagagatcgtggtgtgag

SEQ ID NO: 232955 - DNA, 29 bp, Artificial Sequence
  Description of Artificial Sequence: Synthetic oligonucleotide
cccagagtctacagagatcgtggtgtgag

SEQ ID NO: 232956 - DNA, 29 bp, Artificial Sequence
  Description of Artificial Sequence: Synthetic oligonucleotide
ccagagtctacagagatcgtggtgtgagc

SEQ ID NO: 232957 - DNA, 29 bp, Artificial Sequence
  Description of Artificial Sequence: Synthetic oligonucleotide
cagagtctacagagatcgtggtgtgagcc

SEQ ID NO: 232958 - DNA, 29 bp, Artificial Sequence
  Description of Artificial Sequence: Synthetic oligonucleotide
agagtctacagagatcgtggtgtgagccc

SEQ ID NO: 232959 - DNA, 28 bp, Artificial Sequence
  Description of Artificial Sequence: Synthetic oligonucleotide
gagtctacagagatcgtggtgtgagccc

SEQ ID NO: 232960 - DNA, 29 bp, Artificial Sequence
  Description of Artificial Sequence: Synthetic oligonucleotide
agtctacagagatcgtggtgtgagccctg

SEQ ID NO: 232961 - DNA, 28 bp, Artificial Sequence
  Description of Artificial Sequence: Synthetic oligonucleotide
gtctacagagatcgtggtgtgagccctg

SEQ ID NO: 232962 - DNA, 28 bp, Artificial Sequence
  Description of Artificial Sequence: Synthetic oligonucleotide
tctacagagatcgtggtgtgagccctgg

SEQ ID NO: 232963 - DNA, 27 bp, Artificial Sequence
  Description of Artificial Sequence: Synthetic oligonucleotide
ctacagagatcgtggtgtgagccctgg

SEQ ID NO: 232964 - DNA, 27 bp, Artificial Sequence
  Description of Artificial Sequence: Synthetic oligonucleotide
tacagagatcgtggtgtgagccctggg

SEQ ID NO: 232965 - DNA, 26 bp, Artificial Sequence
  Description of Artificial Sequence: Synthetic oligonucleotide
acagagatcgtggtgtgagccctggg

SEQ ID NO: 232966 - DNA, 25 bp, Artificial Sequence
  Description of Artificial Sequence: Synthetic oligonucleotide
cagagatcgtggtgtgagccctggg

SEQ ID NO: 232967 - DNA, 25 bp, Artificial Sequence
  Description of Artificial Sequence: Synthetic oligonucleotide
agagatcgtggtgtgagccctgggc

SEQ ID NO: 232968 - DNA, 24 bp, Artificial Sequence
  Description of Artificial Sequence: Synthetic oligonucleotide
gagatcgtggtgtgagccctgggc

SEQ ID NO: 232969 - DNA, 25 bp, Artificial Sequence
  Description of Artificial Sequence: Synthetic oligonucleotide
agatcgtggtgtgagccctgggcgt

SEQ ID NO: 232970 - DNA, 24 bp, Artificial Sequence
  Description of Artificial Sequence: Synthetic oligonucleotide
gatcgtggtgtgagccctgggcgt

SEQ ID NO: 232971 - DNA, 25 bp, Artificial Sequence
  Description of Artificial Sequence: Synthetic oligonucleotide
atcgtggtgtgagccctgggcgtga

SEQ ID NO: 232972 - DNA, 24 bp, Artificial Sequence
  Description of Artificial Sequence: Synthetic oligonucleotide
tcgtggtgtgagccctgggcgtga

SEQ ID NO: 232973 - DNA, 23 bp, Artificial Sequence
  Description of Artificial Sequence: Synthetic oligonucleotide
cgtggtgtgagccctgggcgtga

SEQ ID NO: 232974 - DNA, 24 bp, Artificial Sequence
  Description of Artificial Sequence: Synthetic oligonucleotide
gtggtgtgagccctgggcgtgact

SEQ ID NO: 232975 - DNA, 25 bp, Artificial Sequence
  Description of Artificial Sequence: Synthetic oligonucleotide
tggtgtgagccctgggcgtgactgt

SEQ ID NO: 232976 - DNA, 24 bp, Artificial Sequence
  Description of Artificial Sequence: Synthetic oligonucleotide
ggtgtgagccctgggcgtgactgt

SEQ ID NO: 232977 - DNA, 24 bp, Artificial Sequence
  Description of Artificial Sequence: Synthetic oligonucleotide
gtgtgagccctgggcgtgactgtg

SEQ ID NO: 232978 - DNA, 24 bp, Artificial Sequence
  Description of Artificial Sequence: Synthetic oligonucleotide
tgtgagccctgggcgtgactgtgg

SEQ ID NO: 232979 - DNA, 23 bp, Artificial Sequence
  Description of Artificial Sequence: Synthetic oligonucleotide
gtgagccctgggcgtgactgtgg

SEQ ID NO: 232980 - DNA, 24 bp, Artificial Sequence
  Description of Artificial Sequence: Synthetic oligonucleotide
tgagccctgggcgtgactgtggct

SEQ ID NO: 232981 - DNA, 23 bp, Artificial Sequence
  Description of Artificial Sequence: Synthetic oligonucleotide
gagccctgggcgtgactgtggct

SEQ ID NO: 232982 - DNA, 24 bp, Artificial Sequence
  Description of Artificial Sequence: Synthetic oligonucleotide
agccctgggcgtgactgtggctct

SEQ ID NO: 232983 - DNA, 23 bp, Artificial Sequence
  Description of Artificial Sequence: Synthetic oligonucleotide
gccctgggcgtgactgtggctct

SEQ ID NO: 232984 - DNA, 23 bp, Artificial Sequence
  Description of Artificial Sequence: Synthetic oligonucleotide
ccctgggcgtgactgtggctctg

SEQ ID NO: 232985 - DNA, 24 bp, Artificial Sequence
  Description of Artificial Sequence: Synthetic oligonucleotide
cctgggcgtgactgtggctctggt

SEQ ID NO: 232986 - DNA, 24 bp, Artificial Sequence
  Description of Artificial Sequence: Synthetic oligonucleotide
ctgggcgtgactgtggctctggtg

SEQ ID NO: 232987 - DNA, 24 bp, Artificial Sequence
  Description of Artificial Sequence: Synthetic oligonucleotide
tgggcgtgactgtggctctggtgg

SEQ ID NO: 232988 - DNA, 23 bp, Artificial Sequence
  Description of Artificial Sequence: Synthetic oligonucleotide
gggcgtgactgtggctctggtgg

SEQ ID NO: 232989 - DNA, 23 bp, Artificial Sequence
  Description of Artificial Sequence: Synthetic oligonucleotide
ggcgtgactgtggctctggtggg

SEQ ID NO: 232990 - DNA, 25 bp, Artificial Sequence
  Description of Artificial Sequence: Synthetic oligonucleotide
gcgtgactgtggctctggtggggat

SEQ ID NO: 232991 - DNA, 27 bp, Artificial Sequence
  Description of Artificial Sequence: Synthetic oligonucleotide
cgtgactgtggctctggtggggatcat

SEQ ID NO: 232992 - DNA, 31 bp, Artificial Sequence
  Description of Artificial Sequence: Synthetic oligonucleotide
gtgactgtggctctggtggggatcattattc

SEQ ID NO: 232993 - DNA, 31 bp, Artificial Sequence
  Description of Artificial Sequence: Synthetic oligonucleotide
tgactgtggctctggtggggatcattattcg

SEQ ID NO: 232994 - DNA, 30 bp, Artificial Sequence
  Description of Artificial Sequence: Synthetic oligonucleotide
gactgtggctctggtggggatcattattcg

SEQ ID NO: 232995 - DNA, 30 bp, Artificial Sequence
  Description of Artificial Sequence: Synthetic oligonucleotide
actgtggctctggtggggatcattattcgg

SEQ ID NO: 232996 - DNA, 29 bp, Artificial Sequence
  Description of Artificial Sequence: Synthetic oligonucleotide
ctgtggctctggtggggatcattattcgg

SEQ ID NO: 232997 - DNA, 30 bp, Artificial Sequence
  Description of Artificial Sequence: Synthetic oligonucleotide
tgtggctctggtggggatcattattcggac

SEQ ID NO: 232998 - DNA, 29 bp, Artificial Sequence
  Description of Artificial Sequence: Synthetic oligonucleotide
gtggctctggtggggatcattattcggac

SEQ ID NO: 232999 - DNA, 29 bp, Artificial Sequence
  Description of Artificial Sequence: Synthetic oligonucleotide
tggctctggtggggatcattattcggacc

SEQ ID NO: 233000 - DNA, 28 bp, Artificial Sequence
  Description of Artificial Sequence: Synthetic oligonucleotide
ggctctggtggggatcattattcggacc

SEQ ID NO: 233001 - DNA, 30 bp, Artificial Sequence
  Description of Artificial Sequence: Synthetic oligonucleotide
gctctggtggggatcattattcggaccatc

SEQ ID NO: 233002 - DNA, 32 bp, Artificial Sequence
  Description of Artificial Sequence: Synthetic oligonucleotide
ctctggtggggatcattattcggaccatctac

SEQ ID NO: 233003 - DNA, 34 bp, Artificial Sequence
  Description of Artificial Sequence: Synthetic oligonucleotide
tctggtggggatcattattcggaccatctacatc

SEQ ID NO: 233004 - DNA, 33 bp, Artificial Sequence
  Description of Artificial Sequence: Synthetic oligonucleotide
ctggtggggatcattattcggaccatctacatc

SEQ ID NO: 233005 - DNA, 35 bp, Artificial Sequence
  Description of Artificial Sequence: Synthetic oligonucleotide
tggtggggatcattattcggaccatctacatcatc

SEQ ID NO: 233006 - DNA, 34 bp, Artificial Sequence
  Description of Artificial Sequence: Synthetic oligonucleotide
ggtggggatcattattcggaccatctacatcatc

SEQ ID NO: 233007 - DNA, 36 bp, Artificial Sequence
  Description of Artificial Sequence: Synthetic oligonucleotide
gtggggatcattattcggaccatctacatcatcaac

SEQ ID NO: 233008 - DNA, 36 bp, Artificial Sequence
  Description of Artificial Sequence: Synthetic oligonucleotide
tggggatcattattcggaccatctacatcatcaacg

SEQ ID NO: 233009 - DNA, 35 bp, Artificial Sequence
  Description of Artificial Sequence: Synthetic oligonucleotide
ggggatcattattcggaccatctacatcatcaacg

SEQ ID NO: 233010 - DNA, 35 bp, Artificial Sequence
  Description of Artificial Sequence: Synthetic oligonucleotide
gggatcattattcggaccatctacatcatcaacgg

SEQ ID NO: 233011 - DNA, 38 bp, Artificial Sequence
  Description of Artificial Sequence: Synthetic oligonucleotide
ggatcattattcggaccatctacatcatcaacggattg

SEQ ID NO: 233012 - DNA, 38 bp, Artificial Sequence
  Description of Artificial Sequence: Synthetic oligonucleotide
gatcattattcggaccatctacatcatcaacggattgc

SEQ ID NO: 233013 - DNA, 38 bp, Artificial Sequence
  Description of Artificial Sequence: Synthetic oligonucleotide
atcattattcggaccatctacatcatcaacggattgcg

SEQ ID NO: 233014 - DNA, 37 bp, Artificial Sequence
  Description of Artificial Sequence: Synthetic oligonucleotide
tcattattcggaccatctacatcatcaacggattgcg

SEQ ID NO: 233015 - DNA, 36 bp, Artificial Sequence
  Description of Artificial Sequence: Synthetic oligonucleotide
cattattcggaccatctacatcatcaacggattgcg

SEQ ID NO: 233016 - DNA, 36 bp, Artificial Sequence
  Description of Artificial Sequence: Synthetic oligonucleotide
attattcggaccatctacatcatcaacggattgcgc

SEQ ID NO: 233017 - DNA, 35 bp, Artificial Sequence
  Description of Artificial Sequence: Synthetic oligonucleotide
ttattcggaccatctacatcatcaacggattgcgc

SEQ ID NO: 233018 - DNA, 34 bp, Artificial Sequence
  Description of Artificial Sequence: Synthetic oligonucleotide
tattcggaccatctacatcatcaacggattgcgc

SEQ ID NO: 233019 - DNA, 33 bp, Artificial Sequence
  Description of Artificial Sequence: Synthetic oligonucleotide
attcggaccatctacatcatcaacggattgcgc

SEQ ID NO: 233020 - DNA, 32 bp, Artificial Sequence
  Description of Artificial Sequence: Synthetic oligonucleotide
ttcggaccatctacatcatcaacggattgcgc

SEQ ID NO: 233021 - DNA, 31 bp, Artificial Sequence
  Description of Artificial Sequence: Synthetic oligonucleotide
tcggaccatctacatcatcaacggattgcgc

SEQ ID NO: 233022 - DNA, 30 bp, Artificial Sequence
  Description of Artificial Sequence: Synthetic oligonucleotide
cggaccatctacatcatcaacggattgcgc

SEQ ID NO: 233023 - DNA, 34 bp, Artificial Sequence
  Description of Artificial Sequence: Synthetic oligonucleotide
ggaccatctacatcatcaacggattgcgctaaag

SEQ ID NO: 233024 - DNA, 34 bp, Artificial Sequence
  Description of Artificial Sequence: Synthetic oligonucleotide
gaccatctacatcatcaacggattgcgctaaagc

SEQ ID NO: 233025 - DNA, 37 bp, Artificial Sequence
  Description of Artificial Sequence: Synthetic oligonucleotide
accatctacatcatcaacggattgcgctaaagcaatg

SEQ ID NO: 233026 - DNA, 36 bp, Artificial Sequence
  Description of Artificial Sequence: Synthetic oligonucleotide
ccatctacatcatcaacggattgcgctaaagcaatg

SEQ ID NO: 233027 - DNA, 36 bp, Artificial Sequence
  Description of Artificial Sequence: Synthetic oligonucleotide
catctacatcatcaacggattgcgctaaagcaatgg

SEQ ID NO: 233028 - DNA, 37 bp, Artificial Sequence
  Description of Artificial Sequence: Synthetic oligonucleotide
atctacatcatcaacggattgcgctaaagcaatggag

SEQ ID NO: 233029 - DNA, 36 bp, Artificial Sequence
  Description of Artificial Sequence: Synthetic oligonucleotide
tctacatcatcaacggattgcgctaaagcaatggag

SEQ ID NO: 233030 - DNA, 35 bp, Artificial Sequence
  Description of Artificial Sequence: Synthetic oligonucleotide
ctacatcatcaacggattgcgctaaagcaatggag

SEQ ID NO: 233031 - DNA, 35 bp, Artificial Sequence
  Description of Artificial Sequence: Synthetic oligonucleotide
tacatcatcaacggattgcgctaaagcaatggagc

SEQ ID NO: 233032 - DNA, 34 bp, Artificial Sequence
  Description of Artificial Sequence: Synthetic oligonucleotide
acatcatcaacggattgcgctaaagcaatggagc

SEQ ID NO: 233033 - DNA, 33 bp, Artificial Sequence
  Description of Artificial Sequence: Synthetic oligonucleotide
catcatcaacggattgcgctaaagcaatggagc

SEQ ID NO: 233034 - DNA, 34 bp, Artificial Sequence
  Description of Artificial Sequence: Synthetic oligonucleotide
atcatcaacggattgcgctaaagcaatggagcag

SEQ ID NO: 233035 - DNA, 33 bp, Artificial Sequence
  Description of Artificial Sequence: Synthetic oligonucleotide
tcatcaacggattgcgctaaagcaatggagcag

SEQ ID NO: 233036 - DNA, 32 bp, Artificial Sequence
  Description of Artificial Sequence: Synthetic oligonucleotide
catcaacggattgcgctaaagcaatggagcag

SEQ ID NO: 233037 - DNA, 34 bp, Artificial Sequence
  Description of Artificial Sequence: Synthetic oligonucleotide
atcaacggattgcgctaaagcaatggagcagaac

SEQ ID NO: 233038 - DNA, 33 bp, Artificial Sequence
  Description of Artificial Sequence: Synthetic oligonucleotide
tcaacggattgcgctaaagcaatggagcagaac

SEQ ID NO: 233039 - DNA, 32 bp, Artificial Sequence
  Description of Artificial Sequence: Synthetic oligonucleotide
caacggattgcgctaaagcaatggagcagaac

SEQ ID NO: 233040 - DNA, 32 bp, Artificial Sequence
  Description of Artificial Sequence: Synthetic oligonucleotide
aacggattgcgctaaagcaatggagcagaacg

SEQ ID NO: 233041 - DNA, 31 bp, Artificial Sequence
  Description of Artificial Sequence: Synthetic oligonucleotide
acggattgcgctaaagcaatggagcagaacg

SEQ ID NO: 233042 - DNA, 30 bp, Artificial Sequence
  Description of Artificial Sequence: Synthetic oligonucleotide
cggattgcgctaaagcaatggagcagaacg

SEQ ID NO: 233043 - DNA, 30 bp, Artificial Sequence
  Description of Artificial Sequence: Synthetic oligonucleotide
ggattgcgctaaagcaatggagcagaacgg

SEQ ID NO: 233044 - DNA, 31 bp, Artificial Sequence
  Description of Artificial Sequence: Synthetic oligonucleotide
gattgcgctaaagcaatggagcagaacggag

SEQ ID NO: 233045 - DNA, 31 bp, Artificial Sequence
  Description of Artificial Sequence: Synthetic oligonucleotide
attgcgctaaagcaatggagcagaacggagg

SEQ ID NO: 233046 - DNA, 30 bp, Artificial Sequence
  Description of Artificial Sequence: Synthetic oligonucleotide
ttgcgctaaagcaatggagcagaacggagg

SEQ ID NO: 233047 - DNA, 29 bp, Artificial Sequence
  Description of Artificial Sequence: Synthetic oligonucleotide
tgcgctaaagcaatggagcagaacggagg

SEQ ID NO: 233048 - DNA, 28 bp, Artificial Sequence
  Description of Artificial Sequence: Synthetic oligonucleotide
gcgctaaagcaatggagcagaacggagg

SEQ ID NO: 233049 - DNA, 28 bp, Artificial Sequence
  Description of Artificial Sequence: Synthetic oligonucleotide
cgctaaagcaatggagcagaacggaggg

SEQ ID NO: 233050 - DNA, 28 bp, Artificial Sequence
  Description of Artificial Sequence: Synthetic oligonucleotide
gctaaagcaatggagcagaacggagggg

SEQ ID NO: 233051 - DNA, 28 bp, Artificial Sequence
  Description of Artificial Sequence: Synthetic oligonucleotide
ctaaagcaatggagcagaacggaggggg

SEQ ID NO: 233052 - DNA, 28 bp, Artificial Sequence
  Description of Artificial Sequence: Synthetic oligonucleotide
taaagcaatggagcagaacggagggggc

SEQ ID NO: 233053 - DNA, 27 bp, Artificial Sequence
  Description of Artificial Sequence: Synthetic oligonucleotide
aaagcaatggagcagaacggagggggc

SEQ ID NO: 233054 - DNA, 26 bp, Artificial Sequence
  Description of Artificial Sequence: Synthetic oligonucleotide
aagcaatggagcagaacggagggggc

SEQ ID NO: 233055 - DNA, 25 bp, Artificial Sequence
  Description of Artificial Sequence: Synthetic oligonucleotide
agcaatggagcagaacggagggggc

SEQ ID NO: 233056 - DNA, 24 bp, Artificial Sequence
  Description of Artificial Sequence: Synthetic oligonucleotide
gcaatggagcagaacggagggggc

SEQ ID NO: 233057 - DNA, 25 bp, Artificial Sequence
  Description of Artificial Sequence: Synthetic oligonucleotide
caatggagcagaacggagggggcct

SEQ ID NO: 233058 - DNA, 26 bp, Artificial Sequence
  Description of Artificial Sequence: Synthetic oligonucleotide
aatggagcagaacggagggggcctgt

SEQ ID NO: 233059 - DNA, 25 bp, Artificial Sequence
  Description of Artificial Sequence: Synthetic oligonucleotide
atggagcagaacggagggggcctgt

SEQ ID NO: 233060 - DNA, 24 bp, Artificial Sequence
  Description of Artificial Sequence: Synthetic oligonucleotide
tggagcagaacggagggggcctgt

SEQ ID NO: 233061 - DNA, 23 bp, Artificial Sequence
  Description of Artificial Sequence: Synthetic oligonucleotide
ggagcagaacggagggggcctgt

SEQ ID NO: 233062 - DNA, 26 bp, Artificial Sequence
  Description of Artificial Sequence: Synthetic oligonucleotide
gagcagaacggagggggcctgtgtaa

SEQ ID NO: 233063 - DNA, 27 bp, Artificial Sequence
  Description of Artificial Sequence: Synthetic oligonucleotide
atggtgtgtgtgaagctccgtggaggc

SEQ ID NO: 233064 - DNA, 27 bp, Artificial Sequence
  Description of Artificial Sequence: Synthetic oligonucleotide
tggtgtgtgtgaagctccgtggaggct

SEQ ID NO: 233065 - DNA, 26 bp, Artificial Sequence
  Description of Artificial Sequence: Synthetic oligonucleotide
ggtgtgtgtgaagctccgtggaggct

SEQ ID NO: 233066 - DNA, 26 bp, Artificial Sequence
  Description of Artificial Sequence: Synthetic oligonucleotide
gtgtgtgtgaagctccgtggaggctc

SEQ ID NO: 233067 - DNA, 27 bp, Artificial Sequence
  Description of Artificial Sequence: Synthetic oligonucleotide
tgtgtgtgaagctccgtggaggctcgt

SEQ ID NO: 233068 - DNA, 26 bp, Artificial Sequence
  Description of Artificial Sequence: Synthetic oligonucleotide
gtgtgtgaagctccgtggaggctcgt

SEQ ID NO: 233069 - DNA, 26 bp, Artificial Sequence
  Description of Artificial Sequence: Synthetic oligonucleotide
tgtgtgaagctccgtggaggctcgtg

SEQ ID NO: 233070 - DNA, 25 bp, Artificial Sequence
  Description of Artificial Sequence: Synthetic oligonucleotide
gtgtgaagctccgtggaggctcgtg

SEQ ID NO: 233071 - DNA, 27 bp, Artificial Sequence
  Description of Artificial Sequence: Synthetic oligonucleotide
tgtgaagctccgtggaggctcgtgcat

SEQ ID NO: 233072 - DNA, 26 bp, Artificial Sequence
  Description of Artificial Sequence: Synthetic oligonucleotide
gtgaagctccgtggaggctcgtgcat

SEQ ID NO: 233073 - DNA, 26 bp, Artificial Sequence
  Description of Artificial Sequence: Synthetic oligonucleotide
tgaagctccgtggaggctcgtgcatg

SEQ ID NO: 233074 - DNA, 25 bp, Artificial Sequence
  Description of Artificial Sequence: Synthetic oligonucleotide
gaagctccgtggaggctcgtgcatg

SEQ ID NO: 233075 - DNA, 25 bp, Artificial Sequence
  Description of Artificial Sequence: Synthetic oligonucleotide
aagctccgtggaggctcgtgcatgg

SEQ ID NO: 233076 - DNA, 24 bp, Artificial Sequence
  Description of Artificial Sequence: Synthetic oligonucleotide
agctccgtggaggctcgtgcatgg

SEQ ID NO: 233077 - DNA, 23 bp, Artificial Sequence
  Description of Artificial Sequence: Synthetic oligonucleotide
gctccgtggaggctcgtgcatgg

SEQ ID NO: 233078 - DNA, 24 bp, Artificial Sequence
  Description of Artificial Sequence: Synthetic oligonucleotide
ctccgtggaggctcgtgcatggct

SEQ ID NO: 233079 - DNA, 24 bp, Artificial Sequence
  Description of Artificial Sequence: Synthetic oligonucleotide
tccgtggaggctcgtgcatggctg

SEQ ID NO: 233080 - DNA, 23 bp, Artificial Sequence
  Description of Artificial Sequence: Synthetic oligonucleotide
ccgtggaggctcgtgcatggctg

SEQ ID NO: 233081 - DNA, 24 bp, Artificial Sequence
  Description of Artificial Sequence: Synthetic oligonucleotide
cgtggaggctcgtgcatggctgct

SEQ ID NO: 233082 - DNA, 25 bp, Artificial Sequence
  Description of Artificial Sequence: Synthetic oligonucleotide
gtggaggctcgtgcatggctgctct

SEQ ID NO: 233083 - DNA, 26 bp, Artificial Sequence
  Description of Artificial Sequence: Synthetic oligonucleotide
tggaggctcgtgcatggctgctctga

SEQ ID NO: 233084 - DNA, 25 bp, Artificial Sequence
  Description of Artificial Sequence: Synthetic oligonucleotide
ggaggctcgtgcatggctgctctga

SEQ ID NO: 233085 - DNA, 26 bp, Artificial Sequence
  Description of Artificial Sequence: Synthetic oligonucleotide
gaggctcgtgcatggctgctctgaca

SEQ ID NO: 233086 - DNA, 27 bp, Artificial Sequence
  Description of Artificial Sequence: Synthetic oligonucleotide
aggctcgtgcatggctgctctgacaga

SEQ ID NO: 233087 - DNA, 26 bp, Artificial Sequence
  Description of Artificial Sequence: Synthetic oligonucleotide
ggctcgtgcatggctgctctgacaga

SEQ ID NO: 233088 - DNA, 27 bp, Artificial Sequence
  Description of Artificial Sequence: Synthetic oligonucleotide
gctcgtgcatggctgctctgacagaga

SEQ ID NO: 233089 - DNA, 27 bp, Artificial Sequence
  Description of Artificial Sequence: Synthetic oligonucleotide
ctcgtgcatggctgctctgacagagac

SEQ ID NO: 233090 - DNA, 28 bp, Artificial Sequence
  Description of Artificial Sequence: Synthetic oligonucleotide
tcgtgcatggctgctctgacagagacac

SEQ ID NO: 233091 - DNA, 27 bp, Artificial Sequence
  Description of Artificial Sequence: Synthetic oligonucleotide
cgtgcatggctgctctgacagagacac

SEQ ID NO: 233092 - DNA, 28 bp, Artificial Sequence
  Description of Artificial Sequence: Synthetic oligonucleotide
gtgcatggctgctctgacagagacactg

SEQ ID NO: 233093 - DNA, 30 bp, Artificial Sequence
  Description of Artificial Sequence: Synthetic oligonucleotide
tgcatggctgctctgacagagacactgatc

SEQ ID NO: 233094 - DNA, 29 bp, Artificial Sequence
  Description of Artificial Sequence: Synthetic oligonucleotide
gcatggctgctctgacagagacactgatc

SEQ ID NO: 233095 - DNA, 29 bp, Artificial Sequence
  Description of Artificial Sequence: Synthetic oligonucleotide
catggctgctctgacagagacactgatcg

SEQ ID NO: 233096 - DNA, 30 bp, Artificial Sequence
  Description of Artificial Sequence: Synthetic oligonucleotide
atggctgctctgacagagacactgatcgtg

SEQ ID NO: 233097 - DNA, 29 bp, Artificial Sequence
  Description of Artificial Sequence: Synthetic oligonucleotide
tggctgctctgacagagacactgatcgtg

SEQ ID NO: 233098 - DNA, 28 bp, Artificial Sequence
  Description of Artificial Sequence: Synthetic oligonucleotide
ggctgctctgacagagacactgatcgtg

SEQ ID NO: 233099 - DNA, 28 bp, Artificial Sequence
  Description of Artificial Sequence: Synthetic oligonucleotide
gctgctctgacagagacactgatcgtgc

SEQ ID NO: 233100 - DNA, 29 bp, Artificial Sequence
  Description of Artificial Sequence: Synthetic oligonucleotide
ctgctctgacagagacactgatcgtgctg

SEQ ID NO: 233101 - DNA, 30 bp, Artificial Sequence
  Description of Artificial Sequence: Synthetic oligonucleotide
tgctctgacagagacactgatcgtgctgag

SEQ ID NO: 233102 - DNA, 29 bp, Artificial Sequence
  Description of Artificial Sequence: Synthetic oligonucleotide
gctctgacagagacactgatcgtgctgag

SEQ ID NO: 233103 - DNA, 29 bp, Artificial Sequence
  Description of Artificial Sequence: Synthetic oligonucleotide
ctctgacagagacactgatcgtgctgagc

SEQ ID NO: 233104 - DNA, 30 bp, Artificial Sequence
  Description of Artificial Sequence: Synthetic oligonucleotide
tctgacagagacactgatcgtgctgagcac

SEQ ID NO: 233105 - DNA, 29 bp, Artificial Sequence
  Description of Artificial Sequence: Synthetic oligonucleotide
ctgacagagacactgatcgtgctgagcac

SEQ ID NO: 233106 - DNA, 29 bp, Artificial Sequence
  Description of Artificial Sequence: Synthetic oligonucleotide
tgacagagacactgatcgtgctgagcacc

SEQ ID NO: 233107 - DNA, 28 bp, Artificial Sequence
  Description of Artificial Sequence: Synthetic oligonucleotide
gacagagacactgatcgtgctgagcacc

SEQ ID NO: 233108 - DNA, 28 bp, Artificial Sequence
  Description of Artificial Sequence: Synthetic oligonucleotide
acagagacactgatcgtgctgagcaccc

SEQ ID NO: 233109 - DNA, 27 bp, Artificial Sequence
  Description of Artificial Sequence: Synthetic oligonucleotide
cagagacactgatcgtgctgagcaccc

SEQ ID NO: 233110 - DNA, 27 bp, Artificial Sequence
  Description of Artificial Sequence: Synthetic oligonucleotide
agagacactgatcgtgctgagcacccc

SEQ ID NO: 233111 - DNA, 27 bp, Artificial Sequence
  Description of Artificial Sequence: Synthetic oligonucleotide
gagacactgatcgtgctgagcacccca

SEQ ID NO: 233112 - DNA, 27 bp, Artificial Sequence
  Description of Artificial Sequence: Synthetic oligonucleotide
agacactgatcgtgctgagcaccccac

SEQ ID NO: 233113 - DNA, 27 bp, Artificial Sequence
  Description of Artificial Sequence: Synthetic oligonucleotide
gacactgatcgtgctgagcaccccact

SEQ ID NO: 233114 - DNA, 27 bp, Artificial Sequence
  Description of Artificial Sequence: Synthetic oligonucleotide
acactgatcgtgctgagcaccccactg

SEQ ID NO: 233115 - DNA, 26 bp, Artificial Sequence
  Description of Artificial Sequence: Synthetic oligonucleotide
cactgatcgtgctgagcaccccactg

SEQ ID NO: 233116 - DNA, 26 bp, Artificial Sequence
  Description of Artificial Sequence: Synthetic oligonucleotide
actgatcgtgctgagcaccccactgg

SEQ ID NO: 233117 - DNA, 25 bp, Artificial Sequence
  Description of Artificial Sequence: Synthetic oligonucleotide
ctgatcgtgctgagcaccccactgg

SEQ ID NO: 233118 - DNA, 27 bp, Artificial Sequence
  Description of Artificial Sequence: Synthetic oligonucleotide
tgatcgtgctgagcaccccactgggtt

SEQ ID NO: 233119 - DNA, 27 bp, Artificial Sequence
  Description of Artificial Sequence: Synthetic oligonucleotide
gatcgtgctgagcaccccactgggttt

SEQ ID NO: 233120 - DNA, 27 bp, Artificial Sequence
  Description of Artificial Sequence: Synthetic oligonucleotide
atcgtgctgagcaccccactgggtttg

SEQ ID NO: 233121 - DNA, 26 bp, Artificial Sequence
  Description of Artificial Sequence: Synthetic oligonucleotide
tcgtgctgagcaccccactgggtttg

SEQ ID NO: 233122 - DNA, 25 bp, Artificial Sequence
  Description of Artificial Sequence: Synthetic oligonucleotide
cgtgctgagcaccccactgggtttg

SEQ ID NO: 233123 - DNA, 25 bp, Artificial Sequence
  Description of Artificial Sequence: Synthetic oligonucleotide
gtgctgagcaccccactgggtttgg

SEQ ID NO: 233124 - DNA, 26 bp, Artificial Sequence
  Description of Artificial Sequence: Synthetic oligonucleotide
tgctgagcaccccactgggtttggct

SEQ ID NO: 233125 - DNA, 25 bp, Artificial Sequence
  Description of Artificial Sequence: Synthetic oligonucleotide
gctgagcaccccactgggtttggct

SEQ ID NO: 233126 - DNA, 25 bp, Artificial Sequence
  Description of Artificial Sequence: Synthetic oligonucleotide
ctgagcaccccactgggtttggctg

SEQ ID NO: 233127 - DNA, 25 bp, Artificial Sequence
  Description of Artificial Sequence: Synthetic oligonucleotide
tgagcaccccactgggtttggctgg

SEQ ID NO: 233128 - DNA, 24 bp, Artificial Sequence
  Description of Artificial Sequence: Synthetic oligonucleotide
gagcaccccactgggtttggctgg

SEQ ID NO: 233129 - DNA, 24 bp, Artificial Sequence
  Description of Artificial Sequence: Synthetic oligonucleotide
agcaccccactgggtttggctggc

SEQ ID NO: 233130 - DNA, 23 bp, Artificial Sequence
  Description of Artificial Sequence: Synthetic oligonucleotide
gcaccccactgggtttggctggc

SEQ ID NO: 233131 - DNA, 24 bp, Artificial Sequence
  Description of Artificial Sequence: Synthetic oligonucleotide
caccccactgggtttggctggcga

SEQ ID NO: 233132 - DNA, 25 bp, Artificial Sequence
  Description of Artificial Sequence: Synthetic oligonucleotide
accccactgggtttggctggcgaca

SEQ ID NO: 233133 - DNA, 24 bp, Artificial Sequence
  Description of Artificial Sequence: Synthetic oligonucleotide
ccccactgggtttggctggcgaca

SEQ ID NO: 233134 - DNA, 24 bp, Artificial Sequence
  Description of Artificial Sequence: Synthetic oligonucleotide
cccactgggtttggctggcgacac

SEQ ID NO: 233135 - DNA, 24 bp, Artificial Sequence
  Description of Artificial Sequence: Synthetic oligonucleotide
ccactgggtttggctggcgacacc

SEQ ID NO: 233136 - DNA, 24 bp, Artificial Sequence
  Description of Artificial Sequence: Synthetic oligonucleotide
cactgggtttggctggcgacaccc

SEQ ID NO: 233137 - DNA, 25 bp, Artificial Sequence
  Description of Artificial Sequence: Synthetic oligonucleotide
actgggtttggctggcgacacccga

SEQ ID NO: 233138 - DNA, 24 bp, Artificial Sequence
  Description of Artificial Sequence: Synthetic oligonucleotide
ctgggtttggctggcgacacccga

SEQ ID NO: 233139 - DNA, 24 bp, Artificial Sequence
  Description of Artificial Sequence: Synthetic oligonucleotide
tgggtttggctggcgacacccgag

SEQ ID NO: 233140 - DNA, 23 bp, Artificial Sequence
  Description of Artificial Sequence: Synthetic oligonucleotide
gggtttggctggcgacacccgag

SEQ ID NO: 233141 - DNA, 24 bp, Artificial Sequence
  Description of Artificial Sequence: Synthetic oligonucleotide
ggtttggctggcgacacccgagca

SEQ ID NO: 233142 - DNA, 24 bp, Artificial Sequence
  Description of Artificial Sequence: Synthetic oligonucleotide
gtttggctggcgacacccgagcac

SEQ ID NO: 233143 - DNA, 27 bp, Artificial Sequence
  Description of Artificial Sequence: Synthetic oligonucleotide
tttggctggcgacacccgagcacgttt

SEQ ID NO: 233144 - DNA, 26 bp, Artificial Sequence
  Description of Artificial Sequence: Synthetic oligonucleotide
ttggctggcgacacccgagcacgttt

SEQ ID NO: 233145 - DNA, 25 bp, Artificial Sequence
  Description of Artificial Sequence: Synthetic oligonucleotide
tggctggcgacacccgagcacgttt

SEQ ID NO: 233146 - DNA, 24 bp, Artificial Sequence
  Description of Artificial Sequence: Synthetic oligonucleotide
ggctggcgacacccgagcacgttt

SEQ ID NO: 233147 - DNA, 26 bp, Artificial Sequence
  Description of Artificial Sequence: Synthetic oligonucleotide
gctggcgacacccgagcacgtttcta

SEQ ID NO: 233148 - DNA, 26 bp, Artificial Sequence
  Description of Artificial Sequence: Synthetic oligonucleotide
ctggcgacacccgagcacgtttctag

SEQ ID NO: 233149 - DNA, 27 bp, Artificial Sequence
  Description of Artificial Sequence: Synthetic oligonucleotide
tggcgacacccgagcacgtttctagga

SEQ ID NO: 233150 - DNA, 26 bp, Artificial Sequence
  Description of Artificial Sequence: Synthetic oligonucleotide
ggcgacacccgagcacgtttctagga

SEQ ID NO: 233151 - DNA, 26 bp, Artificial Sequence
  Description of Artificial Sequence: Synthetic oligonucleotide
gcgacacccgagcacgtttctaggag

SEQ ID NO: 233152 - DNA, 27 bp, Artificial Sequence
  Description of Artificial Sequence: Synthetic oligonucleotide
cgacacccgagcacgtttctaggagca

SEQ ID NO: 233153 - DNA, 27 bp, Artificial Sequence
  Description of Artificial Sequence: Synthetic oligonucleotide
gacacccgagcacgtttctaggagcag

SEQ ID NO: 233154 - DNA, 28 bp, Artificial Sequence
  Description of Artificial Sequence: Synthetic oligonucleotide
acacccgagcacgtttctaggagcagtc

SEQ ID NO: 233155 - DNA, 27 bp, Artificial Sequence
  Description of Artificial Sequence: Synthetic oligonucleotide
cacccgagcacgtttctaggagcagtc

SEQ ID NO: 233156 - DNA, 30 bp, Artificial Sequence
  Description of Artificial Sequence: Synthetic oligonucleotide
acccgagcacgtttctaggagcagtcaaag

SEQ ID NO: 233157 - DNA, 29 bp, Artificial Sequence
  Description of Artificial Sequence: Synthetic oligonucleotide
cccgagcacgtttctaggagcagtcaaag

SEQ ID NO: 233158 - DNA, 30 bp, Artificial Sequence
  Description of Artificial Sequence: Synthetic oligonucleotide
ccgagcacgtttctaggagcagtcaaagtc

SEQ ID NO: 233159 - DNA, 31 bp, Artificial Sequence
  Description of Artificial Sequence: Synthetic oligonucleotide
cgagcacgtttctaggagcagtcaaagtctg

SEQ ID NO: 233160 - DNA, 32 bp, Artificial Sequence
  Description of Artificial Sequence: Synthetic oligonucleotide
gagcacgtttctaggagcagtcaaagtctgag

SEQ ID NO: 233161 - DNA, 33 bp, Artificial Sequence
  Description of Artificial Sequence: Synthetic oligonucleotide
agcacgtttctaggagcagtcaaagtctgagag

SEQ ID NO: 233162 - DNA, 32 bp, Artificial Sequence
  Description of Artificial Sequence: Synthetic oligonucleotide
gcacgtttctaggagcagtcaaagtctgagag

SEQ ID NO: 233163 - DNA, 33 bp, Artificial Sequence
  Description of Artificial Sequence: Synthetic oligonucleotide
cacgtttctaggagcagtcaaagtctgagagtc

SEQ ID NO: 233164 - DNA, 37 bp, Artificial Sequence
  Description of Artificial Sequence: Synthetic oligonucleotide
acgtttctaggagcagtcaaagtctgagagtcatttc

SEQ ID NO: 233165 - DNA, 36 bp, Artificial Sequence
  Description of Artificial Sequence: Synthetic oligonucleotide
cgtttctaggagcagtcaaagtctgagagtcatttc

SEQ ID NO: 233166 - DNA, 38 bp, Artificial Sequence
  Description of Artificial Sequence: Synthetic oligonucleotide
gtttctaggagcagtcaaagtctgagagtcatttctac

SEQ ID NO: 233167 - DNA, 41 bp, Artificial Sequence
  Description of Artificial Sequence: Synthetic oligonucleotide
tttctaggagcagtcaaagtctgagagtcatttctacaatg

SEQ ID NO: 233168 - DNA, 40 bp, Artificial Sequence
  Description of Artificial Sequence: Synthetic oligonucleotide
ttctaggagcagtcaaagtctgagagtcatttctacaatg

SEQ ID NO: 233169 - DNA, 39 bp, Artificial Sequence
  Description of Artificial Sequence: Synthetic oligonucleotide
tctaggagcagtcaaagtctgagagtcatttctacaatg

SEQ ID NO: 233170 - DNA, 38 bp, Artificial Sequence
  Description of Artificial Sequence: Synthetic oligonucleotide
ctaggagcagtcaaagtctgagagtcatttctacaatg

SEQ ID NO: 233171 - DNA, 38 bp, Artificial Sequence
  Description of Artificial Sequence: Synthetic oligonucleotide
taggagcagtcaaagtctgagagtcatttctacaatgg

SEQ ID NO: 233172 - DNA, 37 bp, Artificial Sequence
  Description of Artificial Sequence: Synthetic oligonucleotide
aggagcagtcaaagtctgagagtcatttctacaatgg

SEQ ID NO: 233173 - DNA, 36 bp, Artificial Sequence
  Description of Artificial Sequence: Synthetic oligonucleotide
ggagcagtcaaagtctgagagtcatttctacaatgg

SEQ ID NO: 233174 - DNA, 36 bp, Artificial Sequence
  Description of Artificial Sequence: Synthetic oligonucleotide
gagcagtcaaagtctgagagtcatttctacaatggg

SEQ ID NO: 233175 - DNA, 37 bp, Artificial Sequence
  Description of Artificial Sequence: Synthetic oligonucleotide
agcagtcaaagtctgagagtcatttctacaatgggac

SEQ ID NO: 233176 - DNA, 36 bp, Artificial Sequence
  Description of Artificial Sequence: Synthetic oligonucleotide
gcagtcaaagtctgagagtcatttctacaatgggac

SEQ ID NO: 233177 - DNA, 36 bp, Artificial Sequence
  Description of Artificial Sequence: Synthetic oligonucleotide
cagtcaaagtctgagagtcatttctacaatgggacc

SEQ ID NO: 233178 - DNA, 36 bp, Artificial Sequence
  Description of Artificial Sequence: Synthetic oligonucleotide
agtcaaagtctgagagtcatttctacaatgggaccg

SEQ ID NO: 233179 - DNA, 35 bp, Artificial Sequence
  Description of Artificial Sequence: Synthetic oligonucleotide
gtcaaagtctgagagtcatttctacaatgggaccg

SEQ ID NO: 233180 - DNA, 36 bp, Artificial Sequence
  Description of Artificial Sequence: Synthetic oligonucleotide
tcaaagtctgagagtcatttctacaatgggaccgag

SEQ ID NO: 233181 - DNA, 35 bp, Artificial Sequence
  Description of Artificial Sequence: Synthetic oligonucleotide
caaagtctgagagtcatttctacaatgggaccgag

SEQ ID NO: 233182 - DNA, 35 bp, Artificial Sequence
  Description of Artificial Sequence: Synthetic oligonucleotide
aaagtctgagagtcatttctacaatgggaccgagc

SEQ ID NO: 233183 - DNA, 34 bp, Artificial Sequence
  Description of Artificial Sequence: Synthetic oligonucleotide
aagtctgagagtcatttctacaatgggaccgagc

SEQ ID NO: 233184 - DNA, 33 bp, Artificial Sequence
  Description of Artificial Sequence: Synthetic oligonucleotide
agtctgagagtcatttctacaatgggaccgagc

SEQ ID NO: 233185 - DNA, 32 bp, Artificial Sequence
  Description of Artificial Sequence: Synthetic oligonucleotide
gtctgagagtcatttctacaatgggaccgagc

SEQ ID NO: 233186 - DNA, 32 bp, Artificial Sequence
  Description of Artificial Sequence: Synthetic oligonucleotide
tctgagagtcatttctacaatgggaccgagcg

SEQ ID NO: 233187 - DNA, 31 bp, Artificial Sequence
  Description of Artificial Sequence: Synthetic oligonucleotide
ctgagagtcatttctacaatgggaccgagcg

SEQ ID NO: 233188 - DNA, 31 bp, Artificial Sequence
  Description of Artificial Sequence: Synthetic oligonucleotide
tgagagtcatttctacaatgggaccgagcgg

SEQ ID NO: 233189 - DNA, 30 bp, Artificial Sequence
  Description of Artificial Sequence: Synthetic oligonucleotide
gagagtcatttctacaatgggaccgagcgg

SEQ ID NO: 233190 - DNA, 30 bp, Artificial Sequence
  Description of Artificial Sequence: Synthetic oligonucleotide
agagtcatttctacaatgggaccgagcggg

SEQ ID NO: 233191 - DNA, 29 bp, Artificial Sequence
  Description of Artificial Sequence: Synthetic oligonucleotide
gagtcatttctacaatgggaccgagcggg

SEQ ID NO: 233192 - DNA, 30 bp, Artificial Sequence
  Description of Artificial Sequence: Synthetic oligonucleotide
agtcatttctacaatgggaccgagcgggtc

SEQ ID NO: 233193 - DNA, 29 bp, Artificial Sequence
  Description of Artificial Sequence: Synthetic oligonucleotide
gtcatttctacaatgggaccgagcgggtc

SEQ ID NO: 233194 - DNA, 29 bp, Artificial Sequence
  Description of Artificial Sequence: Synthetic oligonucleotide
tcatttctacaatgggaccgagcgggtcc

SEQ ID NO: 233195 - DNA, 28 bp, Artificial Sequence
  Description of Artificial Sequence: Synthetic oligonucleotide
catttctacaatgggaccgagcgggtcc

SEQ ID NO: 233196 - DNA, 28 bp, Artificial Sequence
  Description of Artificial Sequence: Synthetic oligonucleotide
atttctacaatgggaccgagcgggtccg

SEQ ID NO: 233197 - DNA, 27 bp, Artificial Sequence
  Description of Artificial Sequence: Synthetic oligonucleotide
tttctacaatgggaccgagcgggtccg

SEQ ID NO: 233198 - DNA, 26 bp, Artificial Sequence
  Description of Artificial Sequence: Synthetic oligonucleotide
ttctacaatgggaccgagcgggtccg

SEQ ID NO: 233199 - DNA, 25 bp, Artificial Sequence
  Description of Artificial Sequence: Synthetic oligonucleotide
tctacaatgggaccgagcgggtccg

SEQ ID NO: 233200 - DNA, 24 bp, Artificial Sequence
  Description of Artificial Sequence: Synthetic oligonucleotide
ctacaatgggaccgagcgggtccg

SEQ ID NO: 233201 - DNA, 26 bp, Artificial Sequence
  Description of Artificial Sequence: Synthetic oligonucleotide
tacaatgggaccgagcgggtccggtt

SEQ ID NO: 233202 - DNA, 25 bp, Artificial Sequence
  Description of Artificial Sequence: Synthetic oligonucleotide
acaatgggaccgagcgggtccggtt

SEQ ID NO: 233203 - DNA, 24 bp, Artificial Sequence
  Description of Artificial Sequence: Synthetic oligonucleotide
caatgggaccgagcgggtccggtt

SEQ ID NO: 233204 - DNA, 24 bp, Artificial Sequence
  Description of Artificial Sequence: Synthetic oligonucleotide
aatgggaccgagcgggtccggttc

SEQ ID NO: 233205 - DNA, 23 bp, Artificial Sequence
  Description of Artificial Sequence: Synthetic oligonucleotide
atgggaccgagcgggtccggttc

SEQ ID NO: 233206 - DNA, 22 bp, Artificial Sequence
  Description of Artificial Sequence: Synthetic oligonucleotide
tgggaccgagcgggtccggttc

SEQ ID NO: 233207 - DNA, 21 bp, Artificial Sequence
  Description of Artificial Sequence: Synthetic oligonucleotide
gggaccgagcgggtccggttc

SEQ ID NO: 233208 - DNA, 22 bp, Artificial Sequence
  Description of Artificial Sequence: Synthetic oligonucleotide
ggaccgagcgggtccggttcct

SEQ ID NO: 233209 - DNA, 22 bp, Artificial Sequence
  Description of Artificial Sequence: Synthetic oligonucleotide
gaccgagcgggtccggttcctc

SEQ ID NO: 233210 - DNA, 23 bp, Artificial Sequence
  Description of Artificial Sequence: Synthetic oligonucleotide
accgagcgggtccggttcctcga

SEQ ID NO: 233211 - DNA, 22 bp, Artificial Sequence
  Description of Artificial Sequence: Synthetic oligonucleotide
ccgagcgggtccggttcctcga

SEQ ID NO: 233212 - DNA, 23 bp, Artificial Sequence
  Description of Artificial Sequence: Synthetic oligonucleotide
cgagcgggtccggttcctcgaca

SEQ ID NO: 233213 - DNA, 26 bp, Artificial Sequence
  Description of Artificial Sequence: Synthetic oligonucleotide
gagcgggtccggttcctcgacagata

SEQ ID NO: 233214 - DNA, 27 bp, Artificial Sequence
  Description of Artificial Sequence: Synthetic oligonucleotide
agcgggtccggttcctcgacagatact

SEQ ID NO: 233215 - DNA, 27 bp, Artificial Sequence
  Description of Artificial Sequence: Synthetic oligonucleotide
gcgggtccggttcctcgacagatactt

SEQ ID NO: 233216 - DNA, 27 bp, Artificial Sequence
  Description of Artificial Sequence: Synthetic oligonucleotide
cgggtccggttcctcgacagatacttg

SEQ ID NO: 233217 - DNA, 29 bp, Artificial Sequence
  Description of Artificial Sequence: Synthetic oligonucleotide
gggtccggttcctcgacagatacttgatg

SEQ ID NO: 233218 - DNA, 29 bp, Artificial Sequence
  Description of Artificial Sequence: Synthetic oligonucleotide
ggtccggttcctcgacagatacttgatgc

SEQ ID NO: 233219 - DNA, 29 bp, Artificial Sequence
  Description of Artificial Sequence: Synthetic oligonucleotide
gtccggttcctcgacagatacttgatgcg

SEQ ID NO: 233220 - DNA, 29 bp, Artificial Sequence
  Description of Artificial Sequence: Synthetic oligonucleotide
tccggttcctcgacagatacttgatgcgg

SEQ ID NO: 233221 - DNA, 28 bp, Artificial Sequence
  Description of Artificial Sequence: Synthetic oligonucleotide
ccggttcctcgacagatacttgatgcgg

SEQ ID NO: 233222 - DNA, 28 bp, Artificial Sequence
  Description of Artificial Sequence: Synthetic oligonucleotide
cggttcctcgacagatacttgatgcggg

SEQ ID NO: 233223 - DNA, 29 bp, Artificial Sequence
  Description of Artificial Sequence: Synthetic oligonucleotide
ggttcctcgacagatacttgatgcgggtc

SEQ ID NO: 233224 - DNA, 31 bp, Artificial Sequence
  Description of Artificial Sequence: Synthetic oligonucleotide
gttcctcgacagatacttgatgcgggtcatc

SEQ ID NO: 233225 - DNA, 31 bp, Artificial Sequence
  Description of Artificial Sequence: Synthetic oligonucleotide
ttcctcgacagatacttgatgcgggtcatcg

SEQ ID NO: 233226 - DNA, 30 bp, Artificial Sequence
  Description of Artificial Sequence: Synthetic oligonucleotide
tcctcgacagatacttgatgcgggtcatcg

SEQ ID NO: 233227 - DNA, 29 bp, Artificial Sequence
  Description of Artificial Sequence: Synthetic oligonucleotide
cctcgacagatacttgatgcgggtcatcg

SEQ ID NO: 233228 - DNA, 29 bp, Artificial Sequence
  Description of Artificial Sequence: Synthetic oligonucleotide
ctcgacagatacttgatgcgggtcatcgc

SEQ ID NO: 233229 - DNA, 29 bp, Artificial Sequence
  Description of Artificial Sequence: Synthetic oligonucleotide
tcgacagatacttgatgcgggtcatcgcg

SEQ ID NO: 233230 - DNA, 28 bp, Artificial Sequence
  Description of Artificial Sequence: Synthetic oligonucleotide
cgacagatacttgatgcgggtcatcgcg

SEQ ID NO: 233231 - DNA, 28 bp, Artificial Sequence
  Description of Artificial Sequence: Synthetic oligonucleotide
gacagatacttgatgcgggtcatcgcgc

SEQ ID NO: 233232 - DNA, 28 bp, Artificial Sequence
  Description of Artificial Sequence: Synthetic oligonucleotide
acagatacttgatgcgggtcatcgcgcc

SEQ ID NO: 233233 - DNA, 27 bp, Artificial Sequence
  Description of Artificial Sequence: Synthetic oligonucleotide
cagatacttgatgcgggtcatcgcgcc

SEQ ID NO: 233234 - DNA, 27 bp, Artificial Sequence
  Description of Artificial Sequence: Synthetic oligonucleotide
agatacttgatgcgggtcatcgcgccc

SEQ ID NO: 233235 - DNA, 26 bp, Artificial Sequence
  Description of Artificial Sequence: Synthetic oligonucleotide
gatacttgatgcgggtcatcgcgccc

SEQ ID NO: 233236 - DNA, 26 bp, Artificial Sequence
  Description of Artificial Sequence: Synthetic oligonucleotide
atacttgatgcgggtcatcgcgcccc

SEQ ID NO: 233237 - DNA, 25 bp, Artificial Sequence
  Description of Artificial Sequence: Synthetic oligonucleotide
tacttgatgcgggtcatcgcgcccc

SEQ ID NO: 233238 - DNA, 24 bp, Artificial Sequence
  Description of Artificial Sequence: Synthetic oligonucleotide
acttgatgcgggtcatcgcgcccc

SEQ ID NO: 233239 - DNA, 23 bp, Artificial Sequence
  Description of Artificial Sequence: Synthetic oligonucleotide
cttgatgcgggtcatcgcgcccc

SEQ ID NO: 233240 - DNA, 25 bp, Artificial Sequence
  Description of Artificial Sequence: Synthetic oligonucleotide
ttgatgcgggtcatcgcgcccccaa

SEQ ID NO: 233241 - DNA, 24 bp, Artificial Sequence
  Description of Artificial Sequence: Synthetic oligonucleotide
tgatgcgggtcatcgcgcccccaa

SEQ ID NO: 233242 - DNA, 23 bp, Artificial Sequence
  Description of Artificial Sequence: Synthetic oligonucleotide
gatgcgggtcatcgcgcccccaa

SEQ ID NO: 233243 - DNA, 20 bp, Artificial Sequence
  Description of Artificial Sequence: Synthetic oligonucleotide
gggcccaggccctgacggag

SEQ ID NO: 233244 - DNA, 21 bp, Artificial Sequence
  Description of Artificial Sequence: Synthetic oligonucleotide
ggcccaggccctgacggagct

SEQ ID NO: 233245 - DNA, 21 bp, Artificial Sequence
  Description of Artificial Sequence: Synthetic oligonucleotide
gcccaggccctgacggagctg

SEQ ID NO: 233246 - DNA, 21 bp, Artificial Sequence
  Description of Artificial Sequence: Synthetic oligonucleotide
cccaggccctgacggagctgg

SEQ ID NO: 233247 - DNA, 21 bp, Artificial Sequence
  Description of Artificial Sequence: Synthetic oligonucleotide
ccaggccctgacggagctggg

SEQ ID NO: 233248 - DNA, 21 bp, Artificial Sequence
  Description of Artificial Sequence: Synthetic oligonucleotide
caggccctgacggagctgggg

SEQ ID NO: 233249 - DNA, 21 bp, Artificial Sequence
  Description of Artificial Sequence: Synthetic oligonucleotide
aggccctgacggagctggggg

SEQ ID NO: 233250 - DNA, 20 bp, Artificial Sequence
  Description of Artificial Sequence: Synthetic oligonucleotide
ggccctgacggagctggggg

SEQ ID NO: 233251 - DNA, 20 bp, Artificial Sequence
  Description of Artificial Sequence: Synthetic oligonucleotide
gccctgacggagctgggggg

SEQ ID NO: 233252 - DNA, 20 bp, Artificial Sequence
  Description of Artificial Sequence: Synthetic oligonucleotide
ccctgacggagctggggggg

SEQ ID NO: 233253 - DNA, 20 bp, Artificial Sequence
  Description of Artificial Sequence: Synthetic oligonucleotide
cctgacggagctgggggggc

SEQ ID NO: 233254 - DNA, 21 bp, Artificial Sequence
  Description of Artificial Sequence: Synthetic oligonucleotide
ctgacggagctgggggggcct

SEQ ID NO: 233255 - DNA, 23 bp, Artificial Sequence
  Description of Artificial Sequence: Synthetic oligonucleotide
tgacggagctgggggggcctgat

SEQ ID NO: 233256 - DNA, 22 bp, Artificial Sequence
  Description of Artificial Sequence: Synthetic oligonucleotide
gacggagctgggggggcctgat

SEQ ID NO: 233257 - DNA, 22 bp, Artificial Sequence
  Description of Artificial Sequence: Synthetic oligonucleotide
acggagctgggggggcctgatg

SEQ ID NO: 233258 - DNA, 21 bp, Artificial Sequence
  Description of Artificial Sequence: Synthetic oligonucleotide
cggagctgggggggcctgatg

SEQ ID NO: 233259 - DNA, 21 bp, Artificial Sequence
  Description of Artificial Sequence: Synthetic oligonucleotide
ggagctgggggggcctgatgg

SEQ ID NO: 233260 - DNA, 21 bp, Artificial Sequence
  Description of Artificial Sequence: Synthetic oligonucleotide
gagctgggggggcctgatggc

SEQ ID NO: 233261 - DNA, 22 bp, Artificial Sequence
  Description of Artificial Sequence: Synthetic oligonucleotide
agctgggggggcctgatggcga

SEQ ID NO: 233262 - DNA, 21 bp, Artificial Sequence
  Description of Artificial Sequence: Synthetic oligonucleotide
gctgggggggcctgatggcga

SEQ ID NO: 233263 - DNA, 23 bp, Artificial Sequence
  Description of Artificial Sequence: Synthetic oligonucleotide
ctgggggggcctgatggcgagta

SEQ ID NO: 233264 - DNA, 24 bp, Artificial Sequence
  Description of Artificial Sequence: Synthetic oligonucleotide
tgggggggcctgatggcgagtact

SEQ ID NO: 233265 - DNA, 23 bp, Artificial Sequence
  Description of Artificial Sequence: Synthetic oligonucleotide
gggggggcctgatggcgagtact

SEQ ID NO: 233266 - DNA, 23 bp, Artificial Sequence
  Description of Artificial Sequence: Synthetic oligonucleotide
ggggggcctgatggcgagtactg

SEQ ID NO: 233267 - DNA, 25 bp, Artificial Sequence
  Description of Artificial Sequence: Synthetic oligonucleotide
gggggcctgatggcgagtactgcaa

SEQ ID NO: 233268 - DNA, 26 bp, Artificial Sequence
  Description of Artificial Sequence: Synthetic oligonucleotide
ggggcctgatggcgagtactgcaaca

SEQ ID NO: 233269 - DNA, 26 bp, Artificial Sequence
  Description of Artificial Sequence: Synthetic oligonucleotide
gggcctgatggcgagtactgcaacag

SEQ ID NO: 233270 - DNA, 26 bp, Artificial Sequence
  Description of Artificial Sequence: Synthetic oligonucleotide
ggcctgatggcgagtactgcaacagc

SEQ ID NO: 233271 - DNA, 27 bp, Artificial Sequence
  Description of Artificial Sequence: Synthetic oligonucleotide
gcctgatggcgagtactgcaacagcca

SEQ ID NO: 233272 - DNA, 27 bp, Artificial Sequence
  Description of Artificial Sequence: Synthetic oligonucleotide
cctgatggcgagtactgcaacagccag

SEQ ID NO: 233273 - DNA, 29 bp, Artificial Sequence
  Description of Artificial Sequence: Synthetic oligonucleotide
ctgatggcgagtactgcaacagccagtag

SEQ ID NO: 233274 - DNA, 29 bp, Artificial Sequence
  Description of Artificial Sequence: Synthetic oligonucleotide
tgatggcgagtactgcaacagccagtagg

SEQ ID NO: 233275 - DNA, 28 bp, Artificial Sequence
  Description of Artificial Sequence: Synthetic oligonucleotide
gatggcgagtactgcaacagccagtagg

SEQ ID NO: 233276 - DNA, 29 bp, Artificial Sequence
  Description of Artificial Sequence: Synthetic oligonucleotide
atggcgagtactgcaacagccagtaggac

SEQ ID NO: 233277 - DNA, 28 bp, Artificial Sequence
  Description of Artificial Sequence: Synthetic oligonucleotide
tggcgagtactgcaacagccagtaggac

SEQ ID NO: 233278 - DNA, 27 bp, Artificial Sequence
  Description of Artificial Sequence: Synthetic oligonucleotide
ggcgagtactgcaacagccagtaggac

SEQ ID NO: 233279 - DNA, 27 bp, Artificial Sequence
  Description of Artificial Sequence: Synthetic oligonucleotide
gcgagtactgcaacagccagtaggacc

SEQ ID NO: 233280 - DNA, 28 bp, Artificial Sequence
  Description of Artificial Sequence: Synthetic oligonucleotide
cgagtactgcaacagccagtaggacctc

SEQ ID NO: 233281 - DNA, 28 bp, Artificial Sequence
  Description of Artificial Sequence: Synthetic oligonucleotide
gagtactgcaacagccagtaggacctcc

SEQ ID NO: 233282 - DNA, 29 bp, Artificial Sequence
  Description of Artificial Sequence: Synthetic oligonucleotide
agtactgcaacagccagtaggacctccag

SEQ ID NO: 233283 - DNA, 28 bp, Artificial Sequence
  Description of Artificial Sequence: Synthetic oligonucleotide
gtactgcaacagccagtaggacctccag

SEQ ID NO: 233284 - DNA, 28 bp, Artificial Sequence
  Description of Artificial Sequence: Synthetic oligonucleotide
tactgcaacagccagtaggacctccagg

SEQ ID NO: 233285 - DNA, 27 bp, Artificial Sequence
  Description of Artificial Sequence: Synthetic oligonucleotide
actgcaacagccagtaggacctccagg

SEQ ID NO: 233286 - DNA, 27 bp, Artificial Sequence
  Description of Artificial Sequence: Synthetic oligonucleotide
ctgcaacagccagtaggacctccagga

SEQ ID NO: 233287 - DNA, 27 bp, Artificial Sequence
  Description of Artificial Sequence: Synthetic oligonucleotide
tgcaacagccagtaggacctccaggag

SEQ ID NO: 233288 - DNA, 26 bp, Artificial Sequence
  Description of Artificial Sequence: Synthetic oligonucleotide
gcaacagccagtaggacctccaggag

SEQ ID NO: 233289 - DNA, 27 bp, Artificial Sequence
  Description of Artificial Sequence: Synthetic oligonucleotide
caacagccagtaggacctccaggagca

SEQ ID NO: 233290 - DNA, 27 bp, Artificial Sequence
  Description of Artificial Sequence: Synthetic oligonucleotide
aacagccagtaggacctccaggagcag

SEQ ID NO: 233291 - DNA, 27 bp, Artificial Sequence
  Description of Artificial Sequence: Synthetic oligonucleotide
acagccagtaggacctccaggagcaga

SEQ ID NO: 233292 - DNA, 26 bp, Artificial Sequence
  Description of Artificial Sequence: Synthetic oligonucleotide
cagccagtaggacctccaggagcaga

SEQ ID NO: 233293 - DNA, 26 bp, Artificial Sequence
  Description of Artificial Sequence: Synthetic oligonucleotide
agccagtaggacctccaggagcagag

SEQ ID NO: 233294 - DNA, 25 bp, Artificial Sequence
  Description of Artificial Sequence: Synthetic oligonucleotide
gccagtaggacctccaggagcagag

SEQ ID NO: 233295 - DNA, 25 bp, Artificial Sequence
  Description of Artificial Sequence: Synthetic oligonucleotide
ccagtaggacctccaggagcagagc

SEQ ID NO: 233296 - DNA, 25 bp, Artificial Sequence
  Description of Artificial Sequence: Synthetic oligonucleotide
cagtaggacctccaggagcagagcc

SEQ ID NO: 233297 - DNA, 25 bp, Artificial Sequence
  Description of Artificial Sequence: Synthetic oligonucleotide
agtaggacctccaggagcagagccg

SEQ ID NO: 233298 - DNA, 24 bp, Artificial Sequence
  Description of Artificial Sequence: Synthetic oligonucleotide
gtaggacctccaggagcagagccg

SEQ ID NO: 233299 - DNA, 24 bp, Artificial Sequence
  Description of Artificial Sequence: Synthetic oligonucleotide
taggacctccaggagcagagccgg

SEQ ID NO: 233300 - DNA, 23 bp, Artificial Sequence
  Description of Artificial Sequence: Synthetic oligonucleotide
aggacctccaggagcagagccgg

SEQ ID NO: 233301 - DNA, 22 bp, Artificial Sequence
  Description of Artificial Sequence: Synthetic oligonucleotide
ggacctccaggagcagagccgg

SEQ ID NO: 233302 - DNA, 22 bp, Artificial Sequence
  Description of Artificial Sequence: Synthetic oligonucleotide
gacctccaggagcagagccggg

SEQ ID NO: 233303 - DNA, 22 bp, Artificial Sequence
  Description of Artificial Sequence: Synthetic oligonucleotide
acctccaggagcagagccgggc

SEQ ID NO: 233304 - DNA, 21 bp, Artificial Sequence
  Description of Artificial Sequence: Synthetic oligonucleotide
cctccaggagcagagccgggc

SEQ ID NO: 233305 - DNA, 21 bp, Artificial Sequence
  Description of Artificial Sequence: Synthetic oligonucleotide
ctccaggagcagagccgggcc

SEQ ID NO: 233306 - DNA, 21 bp, Artificial Sequence
  Description of Artificial Sequence: Synthetic oligonucleotide
tccaggagcagagccgggccg

SEQ ID NO: 233307 - DNA, 20 bp, Artificial Sequence
  Description of Artificial Sequence: Synthetic oligonucleotide
ccaggagcagagccgggccg

SEQ ID NO: 233308 - DNA, 20 bp, Artificial Sequence
  Description of Artificial Sequence: Synthetic oligonucleotide
caggagcagagccgggccgc

SEQ ID NO: 233309 - DNA, 20 bp, Artificial Sequence
  Description of Artificial Sequence: Synthetic oligonucleotide
aggagcagagccgggccgcg

SEQ ID NO: 233310 - DNA, 20 bp, Artificial Sequence
  Description of Artificial Sequence: Synthetic oligonucleotide
ggagcagagccgggccgcgt

SEQ ID NO: 233311 - DNA, 20 bp, Artificial Sequence
  Description of Artificial Sequence: Synthetic oligonucleotide
gagcagagccgggccgcgct

SEQ ID NO: 233312 - DNA, 20 bp, Artificial Sequence
  Description of Artificial Sequence: Synthetic oligonucleotide
agcagagccgggccgcgctg

SEQ ID NO: 233313 - DNA, 20 bp, Artificial Sequence
  Description of Artificial Sequence: Synthetic oligonucleotide
gcagagccgggccgcgctgt

SEQ ID NO: 233314 - DNA, 20 bp, Artificial Sequence
  Description of Artificial Sequence: Synthetic oligonucleotide
cagagccgggccgcgctgga

SEQ ID NO: 233315 - DNA, 21 bp, Artificial Sequence
  Description of Artificial Sequence: Synthetic oligonucleotide
agagccgggccgcgctggaca

SEQ ID NO: 233316 - DNA, 20 bp, Artificial Sequence
  Description of Artificial Sequence: Synthetic oligonucleotide
gagccgggccgcgctggaca

SEQ ID NO: 233317 - DNA, 20 bp, Artificial Sequence
  Description of Artificial Sequence: Synthetic oligonucleotide
agccgggccgcgctggacac

SEQ ID NO: 233318 - DNA, 20 bp, Artificial Sequence
  Description of Artificial Sequence: Synthetic oligonucleotide
gccgggccgcgctggacact

SEQ ID NO: 233319 - DNA, 21 bp, Artificial Sequence
  Description of Artificial Sequence: Synthetic oligonucleotide
ccgggccgcgctggacacctt

SEQ ID NO: 233320 - DNA, 22 bp, Artificial Sequence
  Description of Artificial Sequence: Synthetic oligonucleotide
cgggccgcgctggacaccttct

SEQ ID NO: 233321 - DNA, 22 bp, Artificial Sequence
  Description of Artificial Sequence: Synthetic oligonucleotide
gggccgcgctggacaccttctg

SEQ ID NO: 233322 - DNA, 23 bp, Artificial Sequence
  Description of Artificial Sequence: Synthetic oligonucleotide
ggccgcgctggacaccttctgca

SEQ ID NO: 233323 - DNA, 24 bp, Artificial Sequence
  Description of Artificial Sequence: Synthetic oligonucleotide
gccgcgctggacaccttctgcaga

SEQ ID NO: 233324 - DNA, 25 bp, Artificial Sequence
  Description of Artificial Sequence: Synthetic oligonucleotide
ccgcgctggacaccttctgcagaca

SEQ ID NO: 233325 - DNA, 27 bp, Artificial Sequence
  Description of Artificial Sequence: Synthetic oligonucleotide
cgcgctggacaccttctgcagacagaa

SEQ ID NO: 233326 - DNA, 27 bp, Artificial Sequence
  Description of Artificial Sequence: Synthetic oligonucleotide
gcgctggacaccttctgcagacagaac

SEQ ID NO: 233327 - DNA, 29 bp, Artificial Sequence
  Description of Artificial Sequence: Synthetic oligonucleotide
cgctggacaccttctgcagacagaactac

SEQ ID NO: 233328 - DNA, 29 bp, Artificial Sequence
  Description of Artificial Sequence: Synthetic oligonucleotide
gctggacaccttctgcagacagaactacg

SEQ ID NO: 233329 - DNA, 29 bp, Artificial Sequence
  Description of Artificial Sequence: Synthetic oligonucleotide
ctggacaccttctgcagacagaactacgg

SEQ ID NO: 233330 - DNA, 29 bp, Artificial Sequence
  Description of Artificial Sequence: Synthetic oligonucleotide
tggacaccttctgcagacagaactacggg

SEQ ID NO: 233331 - DNA, 28 bp, Artificial Sequence
  Description of Artificial Sequence: Synthetic oligonucleotide
ggacaccttctgcagacagaactacggg

SEQ ID NO: 233332 - DNA, 28 bp, Artificial Sequence
  Description of Artificial Sequence: Synthetic oligonucleotide
gacaccttctgcagacagaactacgggc

SEQ ID NO: 233333 - DNA, 30 bp, Artificial Sequence
  Description of Artificial Sequence: Synthetic oligonucleotide
acaccttctgcagacagaactacgggcttg

SEQ ID NO: 233334 - DNA, 29 bp, Artificial Sequence
  Description of Artificial Sequence: Synthetic oligonucleotide
caccttctgcagacagaactacgggcttg

SEQ ID NO: 233335 - DNA, 30 bp, Artificial Sequence
  Description of Artificial Sequence: Synthetic oligonucleotide
accttctgcagacagaactacgggcttgtg

SEQ ID NO: 233336 - DNA, 29 bp, Artificial Sequence
  Description of Artificial Sequence: Synthetic oligonucleotide
ccttctgcagacagaactacgggcttgtg

SEQ ID NO: 233337 - DNA, 29 bp, Artificial Sequence
  Description of Artificial Sequence: Synthetic oligonucleotide
cttctgcagacagaactacgggcttgtgg

SEQ ID NO: 233338 - DNA, 30 bp, Artificial Sequence
  Description of Artificial Sequence: Synthetic oligonucleotide
ttctgcagacagaactacgggcttgtggag

SEQ ID NO: 233339 - DNA, 29 bp, Artificial Sequence
  Description of Artificial Sequence: Synthetic oligonucleotide
tctgcagacagaactacgggcttgtggag

SEQ ID NO: 233340 - DNA, 28 bp, Artificial Sequence
  Description of Artificial Sequence: Synthetic oligonucleotide
ctgcagacagaactacgggcttgtggag

SEQ ID NO: 233341 - DNA, 29 bp, Artificial Sequence
  Description of Artificial Sequence: Synthetic oligonucleotide
tgcagacagaactacgggcttgtggagac

SEQ ID NO: 233342 - DNA, 28 bp, Artificial Sequence
  Description of Artificial Sequence: Synthetic oligonucleotide
gcagacagaactacgggcttgtggagac

SEQ ID NO: 233343 - DNA, 28 bp, Artificial Sequence
  Description of Artificial Sequence: Synthetic oligonucleotide
cagacagaactacgggcttgtggagacc

SEQ ID NO: 233344 - DNA, 30 bp, Artificial Sequence
  Description of Artificial Sequence: Synthetic oligonucleotide
agacagaactacgggcttgtggagaccttc

SEQ ID NO: 233345 - DNA, 29 bp, Artificial Sequence
  Description of Artificial Sequence: Synthetic oligonucleotide
gacagaactacgggcttgtggagaccttc

SEQ ID NO: 233346 - DNA, 30 bp, Artificial Sequence
  Description of Artificial Sequence: Synthetic oligonucleotide
acagaactacgggcttgtggagaccttcac

SEQ ID NO: 233347 - DNA, 29 bp, Artificial Sequence
  Description of Artificial Sequence: Synthetic oligonucleotide
cagaactacgggcttgtggagaccttcac

SEQ ID NO: 233348 - DNA, 30 bp, Artificial Sequence
  Description of Artificial Sequence: Synthetic oligonucleotide
agaactacgggcttgtggagaccttcacag

SEQ ID NO: 233349 - DNA, 29 bp, Artificial Sequence
  Description of Artificial Sequence: Synthetic oligonucleotide
gaactacgggcttgtggagaccttcacag

SEQ ID NO: 233350 - DNA, 30 bp, Artificial Sequence
  Description of Artificial Sequence: Synthetic oligonucleotide
aactacgggcttgtggagaccttcacagtc

SEQ ID NO: 233351 - DNA, 29 bp, Artificial Sequence
  Description of Artificial Sequence: Synthetic oligonucleotide
actacgggcttgtggagaccttcacagtc

SEQ ID NO: 233352 - DNA, 28 bp, Artificial Sequence
  Description of Artificial Sequence: Synthetic oligonucleotide
ctacgggcttgtggagaccttcacagtc

SEQ ID NO: 233353 - DNA, 28 bp, Artificial Sequence
  Description of Artificial Sequence: Synthetic oligonucleotide
tacgggcttgtggagaccttcacagtcc

SEQ ID NO: 233354 - DNA, 27 bp, Artificial Sequence
  Description of Artificial Sequence: Synthetic oligonucleotide
acgggcttgtggagaccttcacagtcc

SEQ ID NO: 233355 - DNA, 27 bp, Artificial Sequence
  Description of Artificial Sequence: Synthetic oligonucleotide
cgggcttgtggagaccttcacagtcca

SEQ ID NO: 233356 - DNA, 27 bp, Artificial Sequence
  Description of Artificial Sequence: Synthetic oligonucleotide
gggcttgtggagaccttcacagtccag

SEQ ID NO: 233357 - DNA, 27 bp, Artificial Sequence
  Description of Artificial Sequence: Synthetic oligonucleotide
ggcttgtggagaccttcacagtccagc

SEQ ID NO: 233358 - DNA, 27 bp, Artificial Sequence
  Description of Artificial Sequence: Synthetic oligonucleotide
gcttgtggagaccttcacagtccagcg

SEQ ID NO: 233359 - DNA, 27 bp, Artificial Sequence
  Description of Artificial Sequence: Synthetic oligonucleotide
cttgtggagaccttcacagtccagcgg

SEQ ID NO: 233360 - DNA, 27 bp, Artificial Sequence
  Description of Artificial Sequence: Synthetic oligonucleotide
ttgtggagaccttcacagtccagcggc

SEQ ID NO: 233361 - DNA, 26 bp, Artificial Sequence
  Description of Artificial Sequence: Synthetic oligonucleotide
tgtggagaccttcacagtccagcggc

SEQ ID NO: 233362 - DNA, 25 bp, Artificial Sequence
  Description of Artificial Sequence: Synthetic oligonucleotide
gtggagaccttcacagtccagcggc

SEQ ID NO: 233363 - DNA, 26 bp, Artificial Sequence
  Description of Artificial Sequence: Synthetic oligonucleotide
tggagaccttcacagtccagcggcga

SEQ ID NO: 233364 - DNA, 25 bp, Artificial Sequence
  Description of Artificial Sequence: Synthetic oligonucleotide
ggagaccttcacagtccagcggcga

SEQ ID NO: 233365 - DNA, 26 bp, Artificial Sequence
  Description of Artificial Sequence: Synthetic oligonucleotide
gagaccttcacagtccagcggcgact

SEQ ID NO: 233366 - DNA, 26 bp, Artificial Sequence
  Description of Artificial Sequence: Synthetic oligonucleotide
agaccttcacagtccagcggcgactc

SEQ ID NO: 233367 - DNA, 25 bp, Artificial Sequence
  Description of Artificial Sequence: Synthetic oligonucleotide
gaccttcacagtccagcggcgactc

SEQ ID NO: 233368 - DNA, 27 bp, Artificial Sequence
  Description of Artificial Sequence: Synthetic oligonucleotide
accttcacagtccagcggcgactccat

SEQ ID NO: 233369 - DNA, 26 bp, Artificial Sequence
  Description of Artificial Sequence: Synthetic oligonucleotide
ccttcacagtccagcggcgactccat

SEQ ID NO: 233370 - DNA, 26 bp, Artificial Sequence
  Description of Artificial Sequence: Synthetic oligonucleotide
cttcacagtccagcggcgactccatc

SEQ ID NO: 233371 - DNA, 27 bp, Artificial Sequence
  Description of Artificial Sequence: Synthetic oligonucleotide
ttcacagtccagcggcgactccatcct

SEQ ID NO: 233372 - DNA, 27 bp, Artificial Sequence
  Description of Artificial Sequence: Synthetic oligonucleotide
tcacagtccagcggcgactccatccta

SEQ ID NO: 233373 - DNA, 27 bp, Artificial Sequence
  Description of Artificial Sequence: Synthetic oligonucleotide
cacagtccagcggcgactccatcctat

SEQ ID NO: 233374 - DNA, 27 bp, Artificial Sequence
  Description of Artificial Sequence: Synthetic oligonucleotide
acagtccagcggcgactccatcctatg

SEQ ID NO: 233375 - DNA, 26 bp, Artificial Sequence
  Description of Artificial Sequence: Synthetic oligonucleotide
cagtccagcggcgactccatcctatg

SEQ ID NO: 233376 - DNA, 27 bp, Artificial Sequence
  Description of Artificial Sequence: Synthetic oligonucleotide
agtccagcggcgactccatcctatggt

SEQ ID NO: 233377 - DNA, 26 bp, Artificial Sequence
  Description of Artificial Sequence: Synthetic oligonucleotide
gtccagcggcgactccatcctatggt

SEQ ID NO: 233378 - DNA, 27 bp, Artificial Sequence
  Description of Artificial Sequence: Synthetic oligonucleotide
tccagcggcgactccatcctatggtga

SEQ ID NO: 233379 - DNA, 26 bp, Artificial Sequence
  Description of Artificial Sequence: Synthetic oligonucleotide
ccagcggcgactccatcctatggtga

SEQ ID NO: 233380 - DNA, 27 bp, Artificial Sequence
  Description of Artificial Sequence: Synthetic oligonucleotide
cagcggcgactccatcctatggtgact

SEQ ID NO: 233381 - DNA, 27 bp, Artificial Sequence
  Description of Artificial Sequence: Synthetic oligonucleotide
agcggcgactccatcctatggtgactg

SEQ ID NO: 233382 - DNA, 27 bp, Artificial Sequence
  Description of Artificial Sequence: Synthetic oligonucleotide
gcggcgactccatcctatggtgactga

SEQ ID NO: 233383 - DNA, 27 bp, Artificial Sequence
  Description of Artificial Sequence: Synthetic oligonucleotide
cggcgactccatcctatggtgactgag

SEQ ID NO: 233384 - DNA, 30 bp, Artificial Sequence
  Description of Artificial Sequence: Synthetic oligonucleotide
ggcgactccatcctatggtgactgagtatc

SEQ ID NO: 233385 - DNA, 30 bp, Artificial Sequence
  Description of Artificial Sequence: Synthetic oligonucleotide
gcgactccatcctatggtgactgagtatcc

SEQ ID NO: 233386 - DNA, 32 bp, Artificial Sequence
  Description of Artificial Sequence: Synthetic oligonucleotide
cgactccatcctatggtgactgagtatccttc

SEQ ID NO: 233387 - DNA, 35 bp, Artificial Sequence
  Description of Artificial Sequence: Synthetic oligonucleotide
gactccatcctatggtgactgagtatccttcatag

SEQ ID NO: 233388 - DNA, 36 bp, Artificial Sequence
  Description of Artificial Sequence: Synthetic oligonucleotide
actccatcctatggtgactgagtatccttcatagac

SEQ ID NO: 233389 - DNA, 35 bp, Artificial Sequence
  Description of Artificial Sequence: Synthetic oligonucleotide
ctccatcctatggtgactgagtatccttcatagac

SEQ ID NO: 233390 - DNA, 35 bp, Artificial Sequence
  Description of Artificial Sequence: Synthetic oligonucleotide
tccatcctatggtgactgagtatccttcatagacc

SEQ ID NO: 233391 - DNA, 34 bp, Artificial Sequence
  Description of Artificial Sequence: Synthetic oligonucleotide
ccatcctatggtgactgagtatccttcatagacc

SEQ ID NO: 233392 - DNA, 34 bp, Artificial Sequence
  Description of Artificial Sequence: Synthetic oligonucleotide
catcctatggtgactgagtatccttcatagaccc

SEQ ID NO: 233393 - DNA, 35 bp, Artificial Sequence
  Description of Artificial Sequence: Synthetic oligonucleotide
atcctatggtgactgagtatccttcatagacccag

SEQ ID NO: 233394 - DNA, 34 bp, Artificial Sequence
  Description of Artificial Sequence: Synthetic oligonucleotide
tcctatggtgactgagtatccttcatagacccag

SEQ ID NO: 233395 - DNA, 33 bp, Artificial Sequence
  Description of Artificial Sequence: Synthetic oligonucleotide
cctatggtgactgagtatccttcatagacccag

SEQ ID NO: 233396 - DNA, 33 bp, Artificial Sequence
  Description of Artificial Sequence: Synthetic oligonucleotide
ctatggtgactgagtatccttcatagacccagc

SEQ ID NO: 233397 - DNA, 33 bp, Artificial Sequence
  Description of Artificial Sequence: Synthetic oligonucleotide
tatggtgactgagtatccttcatagacccagcg

SEQ ID NO: 233398 - DNA, 32 bp, Artificial Sequence
  Description of Artificial Sequence: Synthetic oligonucleotide
atggtgactgagtatccttcatagacccagcg

SEQ ID NO: 233399 - DNA, 31 bp, Artificial Sequence
  Description of Artificial Sequence: Synthetic oligonucleotide
tggtgactgagtatccttcatagacccagcg

SEQ ID NO: 233400 - DNA, 30 bp, Artificial Sequence
  Description of Artificial Sequence: Synthetic oligonucleotide
ggtgactgagtatccttcatagacccagcg

SEQ ID NO: 233401 - DNA, 30 bp, Artificial Sequence
  Description of Artificial Sequence: Synthetic oligonucleotide
gtgactgagtatccttcatagacccagcgc

SEQ ID NO: 233402 - DNA, 30 bp, Artificial Sequence
  Description of Artificial Sequence: Synthetic oligonucleotide
tgactgagtatccttcatagacccagcgcc

SEQ ID NO: 233403 - DNA, 29 bp, Artificial Sequence
  Description of Artificial Sequence: Synthetic oligonucleotide
gactgagtatccttcatagacccagcgcc

SEQ ID NO: 233404 - DNA, 30 bp, Artificial Sequence
  Description of Artificial Sequence: Synthetic oligonucleotide
actgagtatccttcatagacccagcgcctg

SEQ ID NO: 233405 - DNA, 29 bp, Artificial Sequence
  Description of Artificial Sequence: Synthetic oligonucleotide
ctgagtatccttcatagacccagcgcctg

SEQ ID NO: 233406 - DNA, 29 bp, Artificial Sequence
  Description of Artificial Sequence: Synthetic oligonucleotide
tgagtatccttcatagacccagcgcctgc

SEQ ID NO: 233407 - DNA, 28 bp, Artificial Sequence
  Description of Artificial Sequence: Synthetic oligonucleotide
gagtatccttcatagacccagcgcctgc

SEQ ID NO: 233408 - DNA, 29 bp, Artificial Sequence
  Description of Artificial Sequence: Synthetic oligonucleotide
agtatccttcatagacccagcgcctgcag

SEQ ID NO: 233409 - DNA, 28 bp, Artificial Sequence
  Description of Artificial Sequence: Synthetic oligonucleotide
gtatccttcatagacccagcgcctgcag

SEQ ID NO: 233410 - DNA, 28 bp, Artificial Sequence
  Description of Artificial Sequence: Synthetic oligonucleotide
tatccttcatagacccagcgcctgcagc

SEQ ID NO: 233411 - DNA, 27 bp, Artificial Sequence
  Description of Artificial Sequence: Synthetic oligonucleotide
atccttcatagacccagcgcctgcagc

SEQ ID NO: 233412 - DNA, 27 bp, Artificial Sequence
  Description of Artificial Sequence: Synthetic oligonucleotide
tccttcatagacccagcgcctgcagca

SEQ ID NO: 233413 - DNA, 26 bp, Artificial Sequence
  Description of Artificial Sequence: Synthetic oligonucleotide
ccttcatagacccagcgcctgcagca

SEQ ID NO: 233414 - DNA, 26 bp, Artificial Sequence
  Description of Artificial Sequence: Synthetic oligonucleotide
cttcatagacccagcgcctgcagcag

SEQ ID NO: 233415 - DNA, 27 bp, Artificial Sequence
  Description of Artificial Sequence: Synthetic oligonucleotide
ttcatagacccagcgcctgcagcagca

SEQ ID NO: 233416 - DNA, 26 bp, Artificial Sequence
  Description of Artificial Sequence: Synthetic oligonucleotide
tcatagacccagcgcctgcagcagca

SEQ ID NO: 233417 - DNA, 25 bp, Artificial Sequence
  Description of Artificial Sequence: Synthetic oligonucleotide
catagacccagcgcctgcagcagca

SEQ ID NO: 233418 - DNA, 27 bp, Artificial Sequence
  Description of Artificial Sequence: Synthetic oligonucleotide
atagacccagcgcctgcagcagcacaa

SEQ ID NO: 233419 - DNA, 26 bp, Artificial Sequence
  Description of Artificial Sequence: Synthetic oligonucleotide
tagacccagcgcctgcagcagcacaa

SEQ ID NO: 233420 - DNA, 25 bp, Artificial Sequence
  Description of Artificial Sequence: Synthetic oligonucleotide
agacccagcgcctgcagcagcacaa

SEQ ID NO: 233421 - DNA, 24 bp, Artificial Sequence
  Description of Artificial Sequence: Synthetic oligonucleotide
gacccagcgcctgcagcagcacaa

SEQ ID NO: 233422 - DNA, 24 bp, Artificial Sequence
  Description of Artificial Sequence: Synthetic oligonucleotide
acccagcgcctgcagcagcacaac

SEQ ID NO: 233423 - DNA, 23 bp, Artificial Sequence
  Description of Artificial Sequence: Synthetic oligonucleotide
cccagcgcctgcagcagcacaac

SEQ ID NO: 233424 - DNA, 24 bp, Artificial Sequence
  Description of Artificial Sequence: Synthetic oligonucleotide
ccagcgcctgcagcagcacaacct

SEQ ID NO: 233425 - DNA, 24 bp, Artificial Sequence
  Description of Artificial Sequence: Synthetic oligonucleotide
cagcgcctgcagcagcacaacctc

SEQ ID NO: 233426 - DNA, 25 bp, Artificial Sequence
  Description of Artificial Sequence: Synthetic oligonucleotide
agcgcctgcagcagcacaacctcgt

SEQ ID NO: 233427 - DNA, 24 bp, Artificial Sequence
  Description of Artificial Sequence: Synthetic oligonucleotide
gcgcctgcagcagcacaacctcgt

SEQ ID NO: 233428 - DNA, 24 bp, Artificial Sequence
  Description of Artificial Sequence: Synthetic oligonucleotide
cgcctgcagcagcacaacctcgtg

SEQ ID NO: 233429 - DNA, 25 bp, Artificial Sequence
  Description of Artificial Sequence: Synthetic oligonucleotide
gcctgcagcagcacaacctcgtggt

SEQ ID NO: 233430 - DNA, 26 bp, Artificial Sequence
  Description of Artificial Sequence: Synthetic oligonucleotide
cctgcagcagcacaacctcgtggtct

SEQ ID NO: 233431 - DNA, 26 bp, Artificial Sequence
  Description of Artificial Sequence: Synthetic oligonucleotide
ctgcagcagcacaacctcgtggtctg

SEQ ID NO: 233432 - DNA, 27 bp, Artificial Sequence
  Description of Artificial Sequence: Synthetic oligonucleotide
tgcagcagcacaacctcgtggtctgct

SEQ ID NO: 233433 - DNA, 26 bp, Artificial Sequence
  Description of Artificial Sequence: Synthetic oligonucleotide
gcagcagcacaacctcgtggtctgct

SEQ ID NO: 233434 - DNA, 27 bp, Artificial Sequence
  Description of Artificial Sequence: Synthetic oligonucleotide
cagcagcacaacctcgtggtctgctgt

SEQ ID NO: 233435 - DNA, 27 bp, Artificial Sequence
  Description of Artificial Sequence: Synthetic oligonucleotide
agcagcacaacctcgtggtctgctgtg

SEQ ID NO: 233436 - DNA, 27 bp, Artificial Sequence
  Description of Artificial Sequence: Synthetic oligonucleotide
gcagcacaacctcgtggtctgctgtgt

SEQ ID NO: 233437 - DNA, 27 bp, Artificial Sequence
  Description of Artificial Sequence: Synthetic oligonucleotide
cagcacaacctcgtggtctgctgtgtg

SEQ ID NO: 233438 - DNA, 28 bp, Artificial Sequence
  Description of Artificial Sequence: Synthetic oligonucleotide
agcacaacctcgtggtctgctgtgtgag

SEQ ID NO: 233439 - DNA, 27 bp, Artificial Sequence
  Description of Artificial Sequence: Synthetic oligonucleotide
gcacaacctcgtggtctgctgtgtgag

SEQ ID NO: 233440 - DNA, 28 bp, Artificial Sequence
  Description of Artificial Sequence: Synthetic oligonucleotide
cacaacctcgtggtctgctgtgtgagtg

SEQ ID NO: 233441 - DNA, 28 bp, Artificial Sequence
  Description of Artificial Sequence: Synthetic oligonucleotide
acaacctcgtggtctgctgtgtgagtgg

SEQ ID NO: 233442 - DNA, 27 bp, Artificial Sequence
  Description of Artificial Sequence: Synthetic oligonucleotide
caacctcgtggtctgctgtgtgagtgg

SEQ ID NO: 233443 - DNA, 30 bp, Artificial Sequence
  Description of Artificial Sequence: Synthetic oligonucleotide
aacctcgtggtctgctgtgtgagtggattc

SEQ ID NO: 233444 - DNA, 29 bp, Artificial Sequence
  Description of Artificial Sequence: Synthetic oligonucleotide
acctcgtggtctgctgtgtgagtggattc

SEQ ID NO: 233445 - DNA, 28 bp, Artificial Sequence
  Description of Artificial Sequence: Synthetic oligonucleotide
cctcgtggtctgctgtgtgagtggattc

SEQ ID NO: 233446 - DNA, 31 bp, Artificial Sequence
  Description of Artificial Sequence: Synthetic oligonucleotide
ctcgtggtctgctgtgtgagtggattctatc

SEQ ID NO: 233447 - DNA, 31 bp, Artificial Sequence
  Description of Artificial Sequence: Synthetic oligonucleotide
tcgtggtctgctgtgtgagtggattctatcc

SEQ ID NO: 233448 - DNA, 30 bp, Artificial Sequence
  Description of Artificial Sequence: Synthetic oligonucleotide
cgtggtctgctgtgtgagtggattctatcc

SEQ ID NO: 233449 - DNA, 31 bp, Artificial Sequence
  Description of Artificial Sequence: Synthetic oligonucleotide
gtggtctgctgtgtgagtggattctatccac

SEQ ID NO: 233450 - DNA, 31 bp, Artificial Sequence
  Description of Artificial Sequence: Synthetic oligonucleotide
tggtctgctgtgtgagtggattctatccacg

SEQ ID NO: 233451 - DNA, 30 bp, Artificial Sequence
  Description of Artificial Sequence: Synthetic oligonucleotide
ggtctgctgtgtgagtggattctatccacg

SEQ ID NO: 233452 - DNA, 30 bp, Artificial Sequence
  Description of Artificial Sequence: Synthetic oligonucleotide
gtctgctgtgtgagtggattctatccacgc

SEQ ID NO: 233453 - DNA, 31 bp, Artificial Sequence
  Description of Artificial Sequence: Synthetic oligonucleotide
tctgctgtgtgagtggattctatccacgcag

SEQ ID NO: 233454 - DNA, 30 bp, Artificial Sequence
  Description of Artificial Sequence: Synthetic oligonucleotide
ctgctgtgtgagtggattctatccacgcag

SEQ ID NO: 233455 - DNA, 30 bp, Artificial Sequence
  Description of Artificial Sequence: Synthetic oligonucleotide
tgctgtgtgagtggattctatccacgcagc

SEQ ID NO: 233456 - DNA, 29 bp, Artificial Sequence
  Description of Artificial Sequence: Synthetic oligonucleotide
gctgtgtgagtggattctatccacgcagc

SEQ ID NO: 233457 - DNA, 32 bp, Artificial Sequence
  Description of Artificial Sequence: Synthetic oligonucleotide
ctgtgtgagtggattctatccacgcagcattg

SEQ ID NO: 233458 - DNA, 34 bp, Artificial Sequence
  Description of Artificial Sequence: Synthetic oligonucleotide
tgtgtgagtggattctatccacgcagcattgtag

SEQ ID NO: 233459 - DNA, 33 bp, Artificial Sequence
  Description of Artificial Sequence: Synthetic oligonucleotide
gtgtgagtggattctatccacgcagcattgtag

SEQ ID NO: 233460 - DNA, 34 bp, Artificial Sequence
  Description of Artificial Sequence: Synthetic oligonucleotide
tgtgagtggattctatccacgcagcattgtagtc

SEQ ID NO: 233461 - DNA, 33 bp, Artificial Sequence
  Description of Artificial Sequence: Synthetic oligonucleotide
gtgagtggattctatccacgcagcattgtagtc

SEQ ID NO: 233462 - DNA, 34 bp, Artificial Sequence
  Description of Artificial Sequence: Synthetic oligonucleotide
tgagtggattctatccacgcagcattgtagtcag

SEQ ID NO: 233463 - DNA, 33 bp, Artificial Sequence
  Description of Artificial Sequence: Synthetic oligonucleotide
gagtggattctatccacgcagcattgtagtcag

SEQ ID NO: 233464 - DNA, 33 bp, Artificial Sequence
  Description of Artificial Sequence: Synthetic oligonucleotide
agtggattctatccacgcagcattgtagtcagg

SEQ ID NO: 233465 - DNA, 32 bp, Artificial Sequence
  Description of Artificial Sequence: Synthetic oligonucleotide
gtggattctatccacgcagcattgtagtcagg

SEQ ID NO: 233466 - DNA, 33 bp, Artificial Sequence
  Description of Artificial Sequence: Synthetic oligonucleotide
tggattctatccacgcagcattgtagtcaggtg

SEQ ID NO: 233467 - DNA, 32 bp, Artificial Sequence
  Description of Artificial Sequence: Synthetic oligonucleotide
ggattctatccacgcagcattgtagtcaggtg

SEQ ID NO: 233468 - DNA, 32 bp, Artificial Sequence
  Description of Artificial Sequence: Synthetic oligonucleotide
gattctatccacgcagcattgtagtcaggtgc

SEQ ID NO: 233469 - DNA, 34 bp, Artificial Sequence
  Description of Artificial Sequence: Synthetic oligonucleotide
attctatccacgcagcattgtagtcaggtgcttc

SEQ ID NO: 233470 - DNA, 33 bp, Artificial Sequence
  Description of Artificial Sequence: Synthetic oligonucleotide
ttctatccacgcagcattgtagtcaggtgcttc

SEQ ID NO: 233471 - DNA, 32 bp, Artificial Sequence
  Description of Artificial Sequence: Synthetic oligonucleotide
tctatccacgcagcattgtagtcaggtgcttc

SEQ ID NO: 233472 - DNA, 31 bp, Artificial Sequence
  Description of Artificial Sequence: Synthetic oligonucleotide
ctatccacgcagcattgtagtcaggtgcttc

SEQ ID NO: 233473 - DNA, 31 bp, Artificial Sequence
  Description of Artificial Sequence: Synthetic oligonucleotide
tatccacgcagcattgtagtcaggtgcttcc

SEQ ID NO: 233474 - DNA, 30 bp, Artificial Sequence
  Description of Artificial Sequence: Synthetic oligonucleotide
atccacgcagcattgtagtcaggtgcttcc

SEQ ID NO: 233475 - DNA, 29 bp, Artificial Sequence
  Description of Artificial Sequence: Synthetic oligonucleotide
tccacgcagcattgtagtcaggtgcttcc

SEQ ID NO: 233476 - DNA, 28 bp, Artificial Sequence
  Description of Artificial Sequence: Synthetic oligonucleotide
ccacgcagcattgtagtcaggtgcttcc

SEQ ID NO: 233477 - DNA, 28 bp, Artificial Sequence
  Description of Artificial Sequence: Synthetic oligonucleotide
cacgcagcattgtagtcaggtgcttccg

SEQ ID NO: 233478 - DNA, 28 bp, Artificial Sequence
  Description of Artificial Sequence: Synthetic oligonucleotide
acgcagcattgtagtcaggtgcttccgg

SEQ ID NO: 233479 - DNA, 27 bp, Artificial Sequence
  Description of Artificial Sequence: Synthetic oligonucleotide
cgcagcattgtagtcaggtgcttccgg

SEQ ID NO: 233480 - DNA, 29 bp, Artificial Sequence
  Description of Artificial Sequence: Synthetic oligonucleotide
gcagcattgtagtcaggtgcttccggaac

SEQ ID NO: 233481 - DNA, 29 bp, Artificial Sequence
  Description of Artificial Sequence: Synthetic oligonucleotide
cagcattgtagtcaggtgcttccggaacc

SEQ ID NO: 233482 - DNA, 29 bp, Artificial Sequence
  Description of Artificial Sequence: Synthetic oligonucleotide
agcattgtagtcaggtgcttccggaaccg

SEQ ID NO: 233483 - DNA, 28 bp, Artificial Sequence
  Description of Artificial Sequence: Synthetic oligonucleotide
gcattgtagtcaggtgcttccggaaccg

SEQ ID NO: 233484 - DNA, 28 bp, Artificial Sequence
  Description of Artificial Sequence: Synthetic oligonucleotide
cattgtagtcaggtgcttccggaaccgc

SEQ ID NO: 233485 - DNA, 28 bp, Artificial Sequence
  Description of Artificial Sequence: Synthetic oligonucleotide
attgtagtcaggtgcttccggaaccgcc

SEQ ID NO: 233486 - DNA, 27 bp, Artificial Sequence
  Description of Artificial Sequence: Synthetic oligonucleotide
ttgtagtcaggtgcttccggaaccgcc

SEQ ID NO: 233487 - DNA, 27 bp, Artificial Sequence
  Description of Artificial Sequence: Synthetic oligonucleotide
tgtagtcaggtgcttccggaaccgcca

SEQ ID NO: 233488 - DNA, 26 bp, Artificial Sequence
  Description of Artificial Sequence: Synthetic oligonucleotide
gtagtcaggtgcttccggaaccgcca

SEQ ID NO: 233489 - DNA, 26 bp, Artificial Sequence
  Description of Artificial Sequence: Synthetic oligonucleotide
tagtcaggtgcttccggaaccgccag

SEQ ID NO: 233490 - DNA, 25 bp, Artificial Sequence
  Description of Artificial Sequence: Synthetic oligonucleotide
agtcaggtgcttccggaaccgccag

SEQ ID NO: 233491 - DNA, 24 bp, Artificial Sequence
  Description of Artificial Sequence: Synthetic oligonucleotide
gtcaggtgcttccggaaccgccag

SEQ ID NO: 233492 - DNA, 26 bp, Artificial Sequence
  Description of Artificial Sequence: Synthetic oligonucleotide
tcaggtgcttccggaaccgccaggaa

SEQ ID NO: 233493 - DNA, 25 bp, Artificial Sequence
  Description of Artificial Sequence: Synthetic oligonucleotide
caggtgcttccggaaccgccaggaa

SEQ ID NO: 233494 - DNA, 26 bp, Artificial Sequence
  Description of Artificial Sequence: Synthetic oligonucleotide
aggtgcttccggaaccgccaggaagt

SEQ ID NO: 233495 - DNA, 25 bp, Artificial Sequence
  Description of Artificial Sequence: Synthetic oligonucleotide
ggtgcttccggaaccgccaggaagt

SEQ ID NO: 233496 - DNA, 27 bp, Artificial Sequence
  Description of Artificial Sequence: Synthetic oligonucleotide
gtgcttccggaaccgccaggaagtgaa

SEQ ID NO: 233497 - DNA, 27 bp, Artificial Sequence
  Description of Artificial Sequence: Synthetic oligonucleotide
tgcttccggaaccgccaggaagtgaag

SEQ ID NO: 233498 - DNA, 27 bp, Artificial Sequence
  Description of Artificial Sequence: Synthetic oligonucleotide
gcttccggaaccgccaggaagtgaaga

SEQ ID NO: 233499 - DNA, 27 bp, Artificial Sequence
  Description of Artificial Sequence: Synthetic oligonucleotide
cttccggaaccgccaggaagtgaagac

SEQ ID NO: 233500 - DNA, 28 bp, Artificial Sequence
  Description of Artificial Sequence: Synthetic oligonucleotide
ttccggaaccgccaggaagtgaagactg

SEQ ID NO: 233501 - DNA, 27 bp, Artificial Sequence
  Description of Artificial Sequence: Synthetic oligonucleotide
tccggaaccgccaggaagtgaagactg

SEQ ID NO: 233502 - DNA, 26 bp, Artificial Sequence
  Description of Artificial Sequence: Synthetic oligonucleotide
ccggaaccgccaggaagtgaagactg

SEQ ID NO: 233503 - DNA, 26 bp, Artificial Sequence
  Description of Artificial Sequence: Synthetic oligonucleotide
cggaaccgccaggaagtgaagactgg

SEQ ID NO: 233504 - DNA, 26 bp, Artificial Sequence
  Description of Artificial Sequence: Synthetic oligonucleotide
ggaaccgccaggaagtgaagactggc

SEQ ID NO: 233505 - DNA, 27 bp, Artificial Sequence
  Description of Artificial Sequence: Synthetic oligonucleotide
gaaccgccaggaagtgaagactggcgt

SEQ ID NO: 233506 - DNA, 27 bp, Artificial Sequence
  Description of Artificial Sequence: Synthetic oligonucleotide
aaccgccaggaagtgaagactggcgtg

SEQ ID NO: 233507 - DNA, 26 bp, Artificial Sequence
  Description of Artificial Sequence: Synthetic oligonucleotide
accgccaggaagtgaagactggcgtg

SEQ ID NO: 233508 - DNA, 25 bp, Artificial Sequence
  Description of Artificial Sequence: Synthetic oligonucleotide
ccgccaggaagtgaagactggcgtg

SEQ ID NO: 233509 - DNA, 26 bp, Artificial Sequence
  Description of Artificial Sequence: Synthetic oligonucleotide
cgccaggaagtgaagactggcgtggt

SEQ ID NO: 233510 - DNA, 27 bp, Artificial Sequence
  Description of Artificial Sequence: Synthetic oligonucleotide
gccaggaagtgaagactggcgtggtgt

SEQ ID NO: 233511 - DNA, 27 bp, Artificial Sequence
  Description of Artificial Sequence: Synthetic oligonucleotide
ccaggaagtgaagactggcgtggtgtc

SEQ ID NO: 233512 - DNA, 27 bp, Artificial Sequence
  Description of Artificial Sequence: Synthetic oligonucleotide
caggaagtgaagactggcgtggtgtcc

SEQ ID NO: 233513 - DNA, 28 bp, Artificial Sequence
  Description of Artificial Sequence: Synthetic oligonucleotide
aggaagtgaagactggcgtggtgtcctc

SEQ ID NO: 233514 - DNA, 27 bp, Artificial Sequence
  Description of Artificial Sequence: Synthetic oligonucleotide
ggaagtgaagactggcgtggtgtcctc

SEQ ID NO: 233515 - DNA, 28 bp, Artificial Sequence
  Description of Artificial Sequence: Synthetic oligonucleotide
gaagtgaagactggcgtggtgtcctcag

SEQ ID NO: 233516 - DNA, 28 bp, Artificial Sequence
  Description of Artificial Sequence: Synthetic oligonucleotide
aagtgaagactggcgtggtgtcctcagg

SEQ ID NO: 233517 - DNA, 27 bp, Artificial Sequence
  Description of Artificial Sequence: Synthetic oligonucleotide
agtgaagactggcgtggtgtcctcagg

SEQ ID NO: 233518 - DNA, 26 bp, Artificial Sequence
  Description of Artificial Sequence: Synthetic oligonucleotide
gtgaagactggcgtggtgtcctcagg

SEQ ID NO: 233519 - DNA, 26 bp, Artificial Sequence
  Description of Artificial Sequence: Synthetic oligonucleotide
tgaagactggcgtggtgtcctcaggc

SEQ ID NO: 233520 - DNA, 25 bp, Artificial Sequence
  Description of Artificial Sequence: Synthetic oligonucleotide
gaagactggcgtggtgtcctcaggc

SEQ ID NO: 233521 - DNA, 26 bp, Artificial Sequence
  Description of Artificial Sequence: Synthetic oligonucleotide
aagactggcgtggtgtcctcaggcct

SEQ ID NO: 233522 - DNA, 25 bp, Artificial Sequence
  Description of Artificial Sequence: Synthetic oligonucleotide
agactggcgtggtgtcctcaggcct

SEQ ID NO: 233523 - DNA, 24 bp, Artificial Sequence
  Description of Artificial Sequence: Synthetic oligonucleotide
gactggcgtggtgtcctcaggcct

SEQ ID NO: 233524 - DNA, 26 bp, Artificial Sequence
  Description of Artificial Sequence: Synthetic oligonucleotide
actggcgtggtgtcctcaggcctgaa

SEQ ID NO: 233525 - DNA, 25 bp, Artificial Sequence
  Description of Artificial Sequence: Synthetic oligonucleotide
ctggcgtggtgtcctcaggcctgaa

SEQ ID NO: 233526 - DNA, 25 bp, Artificial Sequence
  Description of Artificial Sequence: Synthetic oligonucleotide
tggcgtggtgtcctcaggcctgaac

SEQ ID NO: 233527 - DNA, 24 bp, Artificial Sequence
  Description of Artificial Sequence: Synthetic oligonucleotide
ggcgtggtgtcctcaggcctgaac

SEQ ID NO: 233528 - DNA, 25 bp, Artificial Sequence
  Description of Artificial Sequence: Synthetic oligonucleotide
gcgtggtgtcctcaggcctgaacca

SEQ ID NO: 233529 - DNA, 27 bp, Artificial Sequence
  Description of Artificial Sequence: Synthetic oligonucleotide
cgtggtgtcctcaggcctgaaccagaa

SEQ ID NO: 233530 - DNA, 28 bp, Artificial Sequence
  Description of Artificial Sequence: Synthetic oligonucleotide
gtggtgtcctcaggcctgaaccagaatg

SEQ ID NO: 233531 - DNA, 28 bp, Artificial Sequence
  Description of Artificial Sequence: Synthetic oligonucleotide
tggtgtcctcaggcctgaaccagaatgg

SEQ ID NO: 233532 - DNA, 27 bp, Artificial Sequence
  Description of Artificial Sequence: Synthetic oligonucleotide
ggtgtcctcaggcctgaaccagaatgg

SEQ ID NO: 233533 - DNA, 28 bp, Artificial Sequence
  Description of Artificial Sequence: Synthetic oligonucleotide
gtgtcctcaggcctgaaccagaatggtg

SEQ ID NO: 233534 - DNA, 29 bp, Artificial Sequence
  Description of Artificial Sequence: Synthetic oligonucleotide
tgtcctcaggcctgaaccagaatggtgac

SEQ ID NO: 233535 - DNA, 28 bp, Artificial Sequence
  Description of Artificial Sequence: Synthetic oligonucleotide
gtcctcaggcctgaaccagaatggtgac

SEQ ID NO: 233536 - DNA, 29 bp, Artificial Sequence
  Description of Artificial Sequence: Synthetic oligonucleotide
tcctcaggcctgaaccagaatggtgactg

SEQ ID NO: 233537 - DNA, 28 bp, Artificial Sequence
  Description of Artificial Sequence: Synthetic oligonucleotide
cctcaggcctgaaccagaatggtgactg

SEQ ID NO: 233538 - DNA, 28 bp, Artificial Sequence
  Description of Artificial Sequence: Synthetic oligonucleotide
ctcaggcctgaaccagaatggtgactgg

SEQ ID NO: 233539 - DNA, 29 bp, Artificial Sequence
  Description of Artificial Sequence: Synthetic oligonucleotide
tcaggcctgaaccagaatggtgactggac

SEQ ID NO: 233540 - DNA, 28 bp, Artificial Sequence
  Description of Artificial Sequence: Synthetic oligonucleotide
caggcctgaaccagaatggtgactggac

SEQ ID NO: 233541 - DNA, 28 bp, Artificial Sequence
  Description of Artificial Sequence: Synthetic oligonucleotide
aggcctgaaccagaatggtgactggacc

SEQ ID NO: 233542 - DNA, 27 bp, Artificial Sequence
  Description of Artificial Sequence: Synthetic oligonucleotide
ggcctgaaccagaatggtgactggacc

SEQ ID NO: 233543 - DNA, 29 bp, Artificial Sequence
  Description of Artificial Sequence: Synthetic oligonucleotide
gcctgaaccagaatggtgactggaccatc

SEQ ID NO: 233544 - DNA, 29 bp, Artificial Sequence
  Description of Artificial Sequence: Synthetic oligonucleotide
cctgaaccagaatggtgactggaccatcc

SEQ ID NO: 233545 - DNA, 30 bp, Artificial Sequence
  Description of Artificial Sequence: Synthetic oligonucleotide
ctgaaccagaatggtgactggaccatccag

SEQ ID NO: 233546 - DNA, 31 bp, Artificial Sequence
  Description of Artificial Sequence: Synthetic oligonucleotide
tgaaccagaatggtgactggaccatccagac

SEQ ID NO: 233547 - DNA, 30 bp, Artificial Sequence
  Description of Artificial Sequence: Synthetic oligonucleotide
gaaccagaatggtgactggaccatccagac

SEQ ID NO: 233548 - DNA, 30 bp, Artificial Sequence
  Description of Artificial Sequence: Synthetic oligonucleotide
aaccagaatggtgactggaccatccagacc

SEQ ID NO: 233549 - DNA, 29 bp, Artificial Sequence
  Description of Artificial Sequence: Synthetic oligonucleotide
accagaatggtgactggaccatccagacc

SEQ ID NO: 233550 - DNA, 28 bp, Artificial Sequence
  Description of Artificial Sequence: Synthetic oligonucleotide
ccagaatggtgactggaccatccagacc

SEQ ID NO: 233551 - DNA, 28 bp, Artificial Sequence
  Description of Artificial Sequence: Synthetic oligonucleotide
cagaatggtgactggaccatccagaccc

SEQ ID NO: 233552 - DNA, 29 bp, Artificial Sequence
  Description of Artificial Sequence: Synthetic oligonucleotide
agaatggtgactggaccatccagacccag

SEQ ID NO: 233553 - DNA, 28 bp, Artificial Sequence
  Description of Artificial Sequence: Synthetic oligonucleotide
gaatggtgactggaccatccagacccag

SEQ ID NO: 233554 - DNA, 28 bp, Artificial Sequence
  Description of Artificial Sequence: Synthetic oligonucleotide
aatggtgactggaccatccagacccagg

SEQ ID NO: 233555 - DNA, 27 bp, Artificial Sequence
  Description of Artificial Sequence: Synthetic oligonucleotide
atggtgactggaccatccagacccagg

SEQ ID NO: 233556 - DNA, 27 bp, Artificial Sequence
  Description of Artificial Sequence: Synthetic oligonucleotide
tggtgactggaccatccagacccaggt

SEQ ID NO: 233557 - DNA, 26 bp, Artificial Sequence
  Description of Artificial Sequence: Synthetic oligonucleotide
ggtgactggaccatccagacccaggt

SEQ ID NO: 233558 - DNA, 27 bp, Artificial Sequence
  Description of Artificial Sequence: Synthetic oligonucleotide
gtgactggaccatccagacccaggtga

SEQ ID NO: 233559 - DNA, 28 bp, Artificial Sequence
  Description of Artificial Sequence: Synthetic oligonucleotide
tgactggaccatccagacccaggtgatg

SEQ ID NO: 233560 - DNA, 27 bp, Artificial Sequence
  Description of Artificial Sequence: Synthetic oligonucleotide
gactggaccatccagacccaggtgatg

SEQ ID NO: 233561 - DNA, 27 bp, Artificial Sequence
  Description of Artificial Sequence: Synthetic oligonucleotide
actggaccatccagacccaggtgatgc

SEQ ID NO: 233562 - DNA, 27 bp, Artificial Sequence
  Description of Artificial Sequence: Synthetic oligonucleotide
ctggaccatccagacccaggtgatgca

SEQ ID NO: 233563 - DNA, 27 bp, Artificial Sequence
  Description of Artificial Sequence: Synthetic oligonucleotide
tggaccatccagacccaggtgatgcag

SEQ ID NO: 233564 - DNA, 26 bp, Artificial Sequence
  Description of Artificial Sequence: Synthetic oligonucleotide
ggaccatccagacccaggtgatgcag

SEQ ID NO: 233565 - DNA, 27 bp, Artificial Sequence
  Description of Artificial Sequence: Synthetic oligonucleotide
gaccatccagacccaggtgatgcagga

SEQ ID NO: 233566 - DNA, 29 bp, Artificial Sequence
  Description of Artificial Sequence: Synthetic oligonucleotide
accatccagacccaggtgatgcaggaaac

SEQ ID NO: 233567 - DNA, 28 bp, Artificial Sequence
  Description of Artificial Sequence: Synthetic oligonucleotide
ccatccagacccaggtgatgcaggaaac

SEQ ID NO: 233568 - DNA, 29 bp, Artificial Sequence
  Description of Artificial Sequence: Synthetic oligonucleotide
catccagacccaggtgatgcaggaaacag

SEQ ID NO: 233569 - DNA, 31 bp, Artificial Sequence
  Description of Artificial Sequence: Synthetic oligonucleotide
atccagacccaggtgatgcaggaaacagttg

SEQ ID NO: 233570 - DNA, 30 bp, Artificial Sequence
  Description of Artificial Sequence: Synthetic oligonucleotide
tccagacccaggtgatgcaggaaacagttg

SEQ ID NO: 233571 - DNA, 29 bp, Artificial Sequence
  Description of Artificial Sequence: Synthetic oligonucleotide
ccagacccaggtgatgcaggaaacagttg

SEQ ID NO: 233572 - DNA, 29 bp, Artificial Sequence
  Description of Artificial Sequence: Synthetic oligonucleotide
cagacccaggtgatgcaggaaacagttgc

SEQ ID NO: 233573 - DNA, 30 bp, Artificial Sequence
  Description of Artificial Sequence: Synthetic oligonucleotide
agacccaggtgatgcaggaaacagttgctc

SEQ ID NO: 233574 - DNA, 29 bp, Artificial Sequence
  Description of Artificial Sequence: Synthetic oligonucleotide
gacccaggtgatgcaggaaacagttgctc

SEQ ID NO: 233575 - DNA, 29 bp, Artificial Sequence
  Description of Artificial Sequence: Synthetic oligonucleotide
acccaggtgatgcaggaaacagttgctcg

SEQ ID NO: 233576 - DNA, 28 bp, Artificial Sequence
  Description of Artificial Sequence: Synthetic oligonucleotide
cccaggtgatgcaggaaacagttgctcg

SEQ ID NO: 233577 - DNA, 28 bp, Artificial Sequence
  Description of Artificial Sequence: Synthetic oligonucleotide
ccaggtgatgcaggaaacagttgctcgg

SEQ ID NO: 233578 - DNA, 29 bp, Artificial Sequence
  Description of Artificial Sequence: Synthetic oligonucleotide
caggtgatgcaggaaacagttgctcggag

SEQ ID NO: 233579 - DNA, 30 bp, Artificial Sequence
  Description of Artificial Sequence: Synthetic oligonucleotide
aggtgatgcaggaaacagttgctcggagtg

SEQ ID NO: 233580 - DNA, 29 bp, Artificial Sequence
  Description of Artificial Sequence: Synthetic oligonucleotide
ggtgatgcaggaaacagttgctcggagtg

SEQ ID NO: 233581 - DNA, 29 bp, Artificial Sequence
  Description of Artificial Sequence: Synthetic oligonucleotide
gtgatgcaggaaacagttgctcggagtgc

SEQ ID NO: 233582 - DNA, 30 bp, Artificial Sequence
  Description of Artificial Sequence: Synthetic oligonucleotide
tgatgcaggaaacagttgctcggagtgcag

SEQ ID NO: 233583 - DNA, 29 bp, Artificial Sequence
  Description of Artificial Sequence: Synthetic oligonucleotide
gatgcaggaaacagttgctcggagtgcag

SEQ ID NO: 233584 - DNA, 30 bp, Artificial Sequence
  Description of Artificial Sequence: Synthetic oligonucleotide
atgcaggaaacagttgctcggagtgcagag

SEQ ID NO: 233585 - DNA, 29 bp, Artificial Sequence
  Description of Artificial Sequence: Synthetic oligonucleotide
tgcaggaaacagttgctcggagtgcagag

SEQ ID NO: 233586 - DNA, 28 bp, Artificial Sequence
  Description of Artificial Sequence: Synthetic oligonucleotide
gcaggaaacagttgctcggagtgcagag

SEQ ID NO: 233587 - DNA, 28 bp, Artificial Sequence
  Description of Artificial Sequence: Synthetic oligonucleotide
caggaaacagttgctcggagtgcagagg

SEQ ID NO: 233588 - DNA, 32 bp, Artificial Sequence
  Description of Artificial Sequence: Synthetic oligonucleotide
aggaaacagttgctcggagtgcagaggtttag

SEQ ID NO: 233589 - DNA, 31 bp, Artificial Sequence
  Description of Artificial Sequence: Synthetic oligonucleotide
ggaaacagttgctcggagtgcagaggtttag

SEQ ID NO: 233590 - DNA, 32 bp, Artificial Sequence
  Description of Artificial Sequence: Synthetic oligonucleotide
gaaacagttgctcggagtgcagaggtttagac

SEQ ID NO: 233591 - DNA, 32 bp, Artificial Sequence
  Description of Artificial Sequence: Synthetic oligonucleotide
aaacagttgctcggagtgcagaggtttagacc

SEQ ID NO: 233592 - DNA, 31 bp, Artificial Sequence
  Description of Artificial Sequence: Synthetic oligonucleotide
aacagttgctcggagtgcagaggtttagacc

SEQ ID NO: 233593 - DNA, 30 bp, Artificial Sequence
  Description of Artificial Sequence: Synthetic oligonucleotide
acagttgctcggagtgcagaggtttagacc

SEQ ID NO: 233594 - DNA, 29 bp, Artificial Sequence
  Description of Artificial Sequence: Synthetic oligonucleotide
cagttgctcggagtgcagaggtttagacc

SEQ ID NO: 233595 - DNA, 30 bp, Artificial Sequence
  Description of Artificial Sequence: Synthetic oligonucleotide
agttgctcggagtgcagaggtttagacctg

SEQ ID NO: 233596 - DNA, 29 bp, Artificial Sequence
  Description of Artificial Sequence: Synthetic oligonucleotide
gttgctcggagtgcagaggtttagacctg

SEQ ID NO: 233597 - DNA, 29 bp, Artificial Sequence
  Description of Artificial Sequence: Synthetic oligonucleotide
ttgctcggagtgcagaggtttagacctgc

SEQ ID NO: 233598 - DNA, 28 bp, Artificial Sequence
  Description of Artificial Sequence: Synthetic oligonucleotide
tgctcggagtgcagaggtttagacctgc

SEQ ID NO: 233599 - DNA, 27 bp, Artificial Sequence
  Description of Artificial Sequence: Synthetic oligonucleotide
gctcggagtgcagaggtttagacctgc

SEQ ID NO: 233600 - DNA, 27 bp, Artificial Sequence
  Description of Artificial Sequence: Synthetic oligonucleotide
ctcggagtgcagaggtttagacctgcc

SEQ ID NO: 233601 - DNA, 29 bp, Artificial Sequence
  Description of Artificial Sequence: Synthetic oligonucleotide
tcggagtgcagaggtttagacctgccaac

SEQ ID NO: 233602 - DNA, 28 bp, Artificial Sequence
  Description of Artificial Sequence: Synthetic oligonucleotide
cggagtgcagaggtttagacctgccaac

SEQ ID NO: 233603 - DNA, 29 bp, Artificial Sequence
  Description of Artificial Sequence: Synthetic oligonucleotide
ggagtgcagaggtttagacctgccaactg

SEQ ID NO: 233604 - DNA, 29 bp, Artificial Sequence
  Description of Artificial Sequence: Synthetic oligonucleotide
gagtgcagaggtttagacctgccaactgg

SEQ ID NO: 233605 - DNA, 30 bp, Artificial Sequence
  Description of Artificial Sequence: Synthetic oligonucleotide
agtgcagaggtttagacctgccaactggag

SEQ ID NO: 233606 - DNA, 29 bp, Artificial Sequence
  Description of Artificial Sequence: Synthetic oligonucleotide
gtgcagaggtttagacctgccaactggag

SEQ ID NO: 233607 - DNA, 29 bp, Artificial Sequence
  Description of Artificial Sequence: Synthetic oligonucleotide
tgcagaggtttagacctgccaactggagc

SEQ ID NO: 233608 - DNA, 28 bp, Artificial Sequence
  Description of Artificial Sequence: Synthetic oligonucleotide
gcagaggtttagacctgccaactggagc

SEQ ID NO: 233609 - DNA, 29 bp, Artificial Sequence
  Description of Artificial Sequence: Synthetic oligonucleotide
cagaggtttagacctgccaactggagcac

SEQ ID NO: 233610 - DNA, 29 bp, Artificial Sequence
  Description of Artificial Sequence: Synthetic oligonucleotide
agaggtttagacctgccaactggagcacc

SEQ ID NO: 233611 - DNA, 28 bp, Artificial Sequence
  Description of Artificial Sequence: Synthetic oligonucleotide
gaggtttagacctgccaactggagcacc

SEQ ID NO: 233612 - DNA, 28 bp, Artificial Sequence
  Description of Artificial Sequence: Synthetic oligonucleotide
aggtttagacctgccaactggagcaccg

SEQ ID NO: 233613 - DNA, 27 bp, Artificial Sequence
  Description of Artificial Sequence: Synthetic oligonucleotide
ggtttagacctgccaactggagcaccg

SEQ ID NO: 233614 - DNA, 29 bp, Artificial Sequence
  Description of Artificial Sequence: Synthetic oligonucleotide
gtttagacctgccaactggagcaccgaag

SEQ ID NO: 233615 - DNA, 29 bp, Artificial Sequence
  Description of Artificial Sequence: Synthetic oligonucleotide
tttagacctgccaactggagcaccgaagc

SEQ ID NO: 233616 - DNA, 28 bp, Artificial Sequence
  Description of Artificial Sequence: Synthetic oligonucleotide
ttagacctgccaactggagcaccgaagc

SEQ ID NO: 233617 - DNA, 27 bp, Artificial Sequence
  Description of Artificial Sequence: Synthetic oligonucleotide
tagacctgccaactggagcaccgaagc

SEQ ID NO: 233618 - DNA, 26 bp, Artificial Sequence
  Description of Artificial Sequence: Synthetic oligonucleotide
agacctgccaactggagcaccgaagc

SEQ ID NO: 233619 - DNA, 25 bp, Artificial Sequence
  Description of Artificial Sequence: Synthetic oligonucleotide
gacctgccaactggagcaccgaagc

SEQ ID NO: 233620 - DNA, 26 bp, Artificial Sequence
  Description of Artificial Sequence: Synthetic oligonucleotide
acctgccaactggagcaccgaagcgt

SEQ ID NO: 233621 - DNA, 25 bp, Artificial Sequence
  Description of Artificial Sequence: Synthetic oligonucleotide
cctgccaactggagcaccgaagcgt

SEQ ID NO: 233622 - DNA, 26 bp, Artificial Sequence
  Description of Artificial Sequence: Synthetic oligonucleotide
ctgccaactggagcaccgaagcgtga

SEQ ID NO: 233623 - DNA, 27 bp, Artificial Sequence
  Description of Artificial Sequence: Synthetic oligonucleotide
tgccaactggagcaccgaagcgtgaca

SEQ ID NO: 233624 - DNA, 27 bp, Artificial Sequence
  Description of Artificial Sequence: Synthetic oligonucleotide
gccaactggagcaccgaagcgtgacat

SEQ ID NO: 233625 - DNA, 27 bp, Artificial Sequence
  Description of Artificial Sequence: Synthetic oligonucleotide
ccaactggagcaccgaagcgtgacatg

SEQ ID NO: 233626 - DNA, 27 bp, Artificial Sequence
  Description of Artificial Sequence: Synthetic oligonucleotide
caactggagcaccgaagcgtgacatgc

SEQ ID NO: 233627 - DNA, 27 bp, Artificial Sequence
  Description of Artificial Sequence: Synthetic oligonucleotide
aactggagcaccgaagcgtgacatgcc

SEQ ID NO: 233628 - DNA, 26 bp, Artificial Sequence
  Description of Artificial Sequence: Synthetic oligonucleotide
actggagcaccgaagcgtgacatgcc

SEQ ID NO: 233629 - DNA, 25 bp, Artificial Sequence
  Description of Artificial Sequence: Synthetic oligonucleotide
ctggagcaccgaagcgtgacatgcc

SEQ ID NO: 233630 - DNA, 26 bp, Artificial Sequence
  Description of Artificial Sequence: Synthetic oligonucleotide
tggagcaccgaagcgtgacatgccct

SEQ ID NO: 233631 - DNA, 25 bp, Artificial Sequence
  Description of Artificial Sequence: Synthetic oligonucleotide
ggagcaccgaagcgtgacatgccct

SEQ ID NO: 233632 - DNA, 26 bp, Artificial Sequence
  Description of Artificial Sequence: Synthetic oligonucleotide
gagcaccgaagcgtgacatgccctct

SEQ ID NO: 233633 - DNA, 27 bp, Artificial Sequence
  Description of Artificial Sequence: Synthetic oligonucleotide
agcaccgaagcgtgacatgccctctct

SEQ ID NO: 233634 - DNA, 26 bp, Artificial Sequence
  Description of Artificial Sequence: Synthetic oligonucleotide
gcaccgaagcgtgacatgccctctct

SEQ ID NO: 233635 - DNA, 27 bp, Artificial Sequence
  Description of Artificial Sequence: Synthetic oligonucleotide
caccgaagcgtgacatgccctctctca

SEQ ID NO: 233636 - DNA, 27 bp, Artificial Sequence
  Description of Artificial Sequence: Synthetic oligonucleotide
accgaagcgtgacatgccctctctcag

SEQ ID NO: 233637 - DNA, 27 bp, Artificial Sequence
  Description of Artificial Sequence: Synthetic oligonucleotide
ccgaagcgtgacatgccctctctcagt

SEQ ID NO: 233638 - DNA, 27 bp, Artificial Sequence
  Description of Artificial Sequence: Synthetic oligonucleotide
cgaagcgtgacatgccctctctcagtg

SEQ ID NO: 233639 - DNA, 27 bp, Artificial Sequence
  Description of Artificial Sequence: Synthetic oligonucleotide
gaagcgtgacatgccctctctcagtgg

SEQ ID NO: 233640 - DNA, 30 bp, Artificial Sequence
  Description of Artificial Sequence: Synthetic oligonucleotide
aagcgtgacatgccctctctcagtggaatc

SEQ ID NO: 233641 - DNA, 29 bp, Artificial Sequence
  Description of Artificial Sequence: Synthetic oligonucleotide
agcgtgacatgccctctctcagtggaatc

SEQ ID NO: 233642 - DNA, 28 bp, Artificial Sequence
  Description of Artificial Sequence: Synthetic oligonucleotide
gcgtgacatgccctctctcagtggaatc

SEQ ID NO: 233643 - DNA, 28 bp, Artificial Sequence
  Description of Artificial Sequence: Synthetic oligonucleotide
cgtgacatgccctctctcagtggaatcg

SEQ ID NO: 233644 - DNA, 29 bp, Artificial Sequence
  Description of Artificial Sequence: Synthetic oligonucleotide
gtgacatgccctctctcagtggaatcgag

SEQ ID NO: 233645 - DNA, 30 bp, Artificial Sequence
  Description of Artificial Sequence: Synthetic oligonucleotide
tgacatgccctctctcagtggaatcgagag

SEQ ID NO: 233646 - DNA, 29 bp, Artificial Sequence
  Description of Artificial Sequence: Synthetic oligonucleotide
gacatgccctctctcagtggaatcgagag

SEQ ID NO: 233647 - DNA, 29 bp, Artificial Sequence
  Description of Artificial Sequence: Synthetic oligonucleotide
acatgccctctctcagtggaatcgagagc

SEQ ID NO: 233648 - DNA, 28 bp, Artificial Sequence
  Description of Artificial Sequence: Synthetic oligonucleotide
catgccctctctcagtggaatcgagagc

SEQ ID NO: 233649 - DNA, 29 bp, Artificial Sequence
  Description of Artificial Sequence: Synthetic oligonucleotide
atgccctctctcagtggaatcgagagcac

SEQ ID NO: 233650 - DNA, 28 bp, Artificial Sequence
  Description of Artificial Sequence: Synthetic oligonucleotide
tgccctctctcagtggaatcgagagcac

SEQ ID NO: 233651 - DNA, 27 bp, Artificial Sequence
  Description of Artificial Sequence: Synthetic oligonucleotide
gccctctctcagtggaatcgagagcac

SEQ ID NO: 233652 - DNA, 27 bp, Artificial Sequence
  Description of Artificial Sequence: Synthetic oligonucleotide
ccctctctcagtggaatcgagagcacg

SEQ ID NO: 233653 - DNA, 27 bp, Artificial Sequence
  Description of Artificial Sequence: Synthetic oligonucleotide
cctctctcagtggaatcgagagcacgc

SEQ ID NO: 233654 - DNA, 28 bp, Artificial Sequence
  Description of Artificial Sequence: Synthetic oligonucleotide
ctctctcagtggaatcgagagcacgctc

SEQ ID NO: 233655 - DNA, 29 bp, Artificial Sequence
  Description of Artificial Sequence: Synthetic oligonucleotide
tctctcagtggaatcgagagcacgctctg

SEQ ID NO: 233656 - DNA, 28 bp, Artificial Sequence
  Description of Artificial Sequence: Synthetic oligonucleotide
ctctcagtggaatcgagagcacgctctg

SEQ ID NO: 233657 - DNA, 31 bp, Artificial Sequence
  Description of Artificial Sequence: Synthetic oligonucleotide
tctcagtggaatcgagagcacgctctgaatc

SEQ ID NO: 233658 - DNA, 30 bp, Artificial Sequence
  Description of Artificial Sequence: Synthetic oligonucleotide
ctcagtggaatcgagagcacgctctgaatc

SEQ ID NO: 233659 - DNA, 31 bp, Artificial Sequence
  Description of Artificial Sequence: Synthetic oligonucleotide
tcagtggaatcgagagcacgctctgaatctc

SEQ ID NO: 233660 - DNA, 30 bp, Artificial Sequence
  Description of Artificial Sequence: Synthetic oligonucleotide
cagtggaatcgagagcacgctctgaatctc

SEQ ID NO: 233661 - DNA, 30 bp, Artificial Sequence
  Description of Artificial Sequence: Synthetic oligonucleotide
agtggaatcgagagcacgctctgaatctcc

SEQ ID NO: 233662 - DNA, 29 bp, Artificial Sequence
  Description of Artificial Sequence: Synthetic oligonucleotide
gtggaatcgagagcacgctctgaatctcc

SEQ ID NO: 233663 - DNA, 30 bp, Artificial Sequence
  Description of Artificial Sequence: Synthetic oligonucleotide
tggaatcgagagcacgctctgaatctccac

SEQ ID NO: 233664 - DNA, 29 bp, Artificial Sequence
  Description of Artificial Sequence: Synthetic oligonucleotide
ggaatcgagagcacgctctgaatctccac

SEQ ID NO: 233665 - DNA, 30 bp, Artificial Sequence
  Description of Artificial Sequence: Synthetic oligonucleotide
gaatcgagagcacgctctgaatctccacag

SEQ ID NO: 233666 - DNA, 31 bp, Artificial Sequence
  Description of Artificial Sequence: Synthetic oligonucleotide
aatcgagagcacgctctgaatctccacagag

SEQ ID NO: 233667 - DNA, 30 bp, Artificial Sequence
  Description of Artificial Sequence: Synthetic oligonucleotide
atcgagagcacgctctgaatctccacagag

SEQ ID NO: 233668 - DNA, 29 bp, Artificial Sequence
  Description of Artificial Sequence: Synthetic oligonucleotide
tcgagagcacgctctgaatctccacagag

SEQ ID NO: 233669 - DNA, 28 bp, Artificial Sequence
  Description of Artificial Sequence: Synthetic oligonucleotide
cgagagcacgctctgaatctccacagag

SEQ ID NO: 233670 - DNA, 28 bp, Artificial Sequence
  Description of Artificial Sequence: Synthetic oligonucleotide
gagagcacgctctgaatctccacagagc

SEQ ID NO: 233671 - DNA, 29 bp, Artificial Sequence
  Description of Artificial Sequence: Synthetic oligonucleotide
agagcacgctctgaatctccacagagcac

SEQ ID NO: 233672 - DNA, 28 bp, Artificial Sequence
  Description of Artificial Sequence: Synthetic oligonucleotide
gagcacgctctgaatctccacagagcac

SEQ ID NO: 233673 - DNA, 28 bp, Artificial Sequence
  Description of Artificial Sequence: Synthetic oligonucleotide
agcacgctctgaatctccacagagcacg

SEQ ID NO: 233674 - DNA, 27 bp, Artificial Sequence
  Description of Artificial Sequence: Synthetic oligonucleotide
gcacgctctgaatctccacagagcacg

SEQ ID NO: 233675 - DNA, 29 bp, Artificial Sequence
  Description of Artificial Sequence: Synthetic oligonucleotide
cacgctctgaatctccacagagcacgatg

SEQ ID NO: 233676 - DNA, 29 bp, Artificial Sequence
  Description of Artificial Sequence: Synthetic oligonucleotide
acgctctgaatctccacagagcacgatgc

SEQ ID NO: 233677 - DNA, 28 bp, Artificial Sequence
  Description of Artificial Sequence: Synthetic oligonucleotide
cgctctgaatctccacagagcacgatgc

SEQ ID NO: 233678 - DNA, 29 bp, Artificial Sequence
  Description of Artificial Sequence: Synthetic oligonucleotide
gctctgaatctccacagagcacgatgctg

SEQ ID NO: 233679 - DNA, 30 bp, Artificial Sequence
  Description of Artificial Sequence: Synthetic oligonucleotide
ctctgaatctccacagagcacgatgctgag

SEQ ID NO: 233680 - DNA, 31 bp, Artificial Sequence
  Description of Artificial Sequence: Synthetic oligonucleotide
tctgaatctccacagagcacgatgctgagag

SEQ ID NO: 233681 - DNA, 30 bp, Artificial Sequence
  Description of Artificial Sequence: Synthetic oligonucleotide
ctgaatctccacagagcacgatgctgagag

SEQ ID NO: 233682 - DNA, 30 bp, Artificial Sequence
  Description of Artificial Sequence: Synthetic oligonucleotide
tgaatctccacagagcacgatgctgagagg

SEQ ID NO: 233683 - DNA, 29 bp, Artificial Sequence
  Description of Artificial Sequence: Synthetic oligonucleotide
gaatctccacagagcacgatgctgagagg

SEQ ID NO: 233684 - DNA, 30 bp, Artificial Sequence
  Description of Artificial Sequence: Synthetic oligonucleotide
aatctccacagagcacgatgctgagaggag

SEQ ID NO: 233685 - DNA, 29 bp, Artificial Sequence
  Description of Artificial Sequence: Synthetic oligonucleotide
atctccacagagcacgatgctgagaggag

SEQ ID NO: 233686 - DNA, 28 bp, Artificial Sequence
  Description of Artificial Sequence: Synthetic oligonucleotide
tctccacagagcacgatgctgagaggag

SEQ ID NO: 233687 - DNA, 27 bp, Artificial Sequence
  Description of Artificial Sequence: Synthetic oligonucleotide
ctccacagagcacgatgctgagaggag

SEQ ID NO: 233688 - DNA, 28 bp, Artificial Sequence
  Description of Artificial Sequence: Synthetic oligonucleotide
tccacagagcacgatgctgagaggagtc

SEQ ID NO: 233689 - DNA, 27 bp, Artificial Sequence
  Description of Artificial Sequence: Synthetic oligonucleotide
ccacagagcacgatgctgagaggagtc

SEQ ID NO: 233690 - DNA, 27 bp, Artificial Sequence
  Description of Artificial Sequence: Synthetic oligonucleotide
cacagagcacgatgctgagaggagtcg

SEQ ID NO: 233691 - DNA, 27 bp, Artificial Sequence
  Description of Artificial Sequence: Synthetic oligonucleotide
acagagcacgatgctgagaggagtcgg

SEQ ID NO: 233692 - DNA, 26 bp, Artificial Sequence
  Description of Artificial Sequence: Synthetic oligonucleotide
cagagcacgatgctgagaggagtcgg

SEQ ID NO: 233693 - DNA, 26 bp, Artificial Sequence
  Description of Artificial Sequence: Synthetic oligonucleotide
agagcacgatgctgagaggagtcggg

SEQ ID NO: 233694 - DNA, 25 bp, Artificial Sequence
  Description of Artificial Sequence: Synthetic oligonucleotide
gagcacgatgctgagaggagtcggg

SEQ ID NO: 233695 - DNA, 25 bp, Artificial Sequence
  Description of Artificial Sequence: Synthetic oligonucleotide
agcacgatgctgagaggagtcgggc

SEQ ID NO: 233696 - DNA, 24 bp, Artificial Sequence
  Description of Artificial Sequence: Synthetic oligonucleotide
gcacgatgctgagaggagtcgggc

SEQ ID NO: 233697 - DNA, 24 bp, Artificial Sequence
  Description of Artificial Sequence: Synthetic oligonucleotide
cacgatgctgagaggagtcgggcg

SEQ ID NO: 233698 - DNA, 27 bp, Artificial Sequence
  Description of Artificial Sequence: Synthetic oligonucleotide
acgatgctgagaggagtcgggcgcttt

SEQ ID NO: 233699 - DNA, 26 bp, Artificial Sequence
  Description of Artificial Sequence: Synthetic oligonucleotide
cgatgctgagaggagtcgggcgcttt

SEQ ID NO: 233700 - DNA, 27 bp, Artificial Sequence
  Description of Artificial Sequence: Synthetic oligonucleotide
gatgctgagaggagtcgggcgctttgt

SEQ ID NO: 233701 - DNA, 27 bp, Artificial Sequence
  Description of Artificial Sequence: Synthetic oligonucleotide
atgctgagaggagtcgggcgctttgtg

SEQ ID NO: 233702 - DNA, 26 bp, Artificial Sequence
  Description of Artificial Sequence: Synthetic oligonucleotide
tgctgagaggagtcgggcgctttgtg

SEQ ID NO: 233703 - DNA, 25 bp, Artificial Sequence
  Description of Artificial Sequence: Synthetic oligonucleotide
gctgagaggagtcgggcgctttgtg

SEQ ID NO: 233704 - DNA, 26 bp, Artificial Sequence
  Description of Artificial Sequence: Synthetic oligonucleotide
ctgagaggagtcgggcgctttgtgca

SEQ ID NO: 233705 - DNA, 26 bp, Artificial Sequence
  Description of Artificial Sequence: Synthetic oligonucleotide
tgagaggagtcgggcgctttgtgcag

SEQ ID NO: 233706 - DNA, 25 bp, Artificial Sequence
  Description of Artificial Sequence: Synthetic oligonucleotide
gagaggagtcgggcgctttgtgcag

SEQ ID NO: 233707 - DNA, 25 bp, Artificial Sequence
  Description of Artificial Sequence: Synthetic oligonucleotide
agaggagtcgggcgctttgtgcagg

SEQ ID NO: 233708 - DNA, 24 bp, Artificial Sequence
  Description of Artificial Sequence: Synthetic oligonucleotide
gaggagtcgggcgctttgtgcagg

SEQ ID NO: 233709 - DNA, 24 bp, Artificial Sequence
  Description of Artificial Sequence: Synthetic oligonucleotide
aggagtcgggcgctttgtgcaggg

SEQ ID NO: 233710 - DNA, 23 bp, Artificial Sequence
  Description of Artificial Sequence: Synthetic oligonucleotide
ggagtcgggcgctttgtgcaggg

SEQ ID NO: 233711 - DNA, 23 bp, Artificial Sequence
  Description of Artificial Sequence: Synthetic oligonucleotide
gagtcgggcgctttgtgcagggc

SEQ ID NO: 233712 - DNA, 24 bp, Artificial Sequence
  Description of Artificial Sequence: Synthetic oligonucleotide
agtcgggcgctttgtgcagggcct

SEQ ID NO: 233713 - DNA, 23 bp, Artificial Sequence
  Description of Artificial Sequence: Synthetic oligonucleotide
gtcgggcgctttgtgcagggcct

SEQ ID NO: 233714 - DNA, 23 bp, Artificial Sequence
  Description of Artificial Sequence: Synthetic oligonucleotide
tcgggcgctttgtgcagggcctg

SEQ ID NO: 233715 - DNA, 22 bp, Artificial Sequence
  Description of Artificial Sequence: Synthetic oligonucleotide
cgggcgctttgtgcagggcctg

SEQ ID NO: 233716 - DNA, 23 bp, Artificial Sequence
  Description of Artificial Sequence: Synthetic oligonucleotide
gggcgctttgtgcagggcctgct

SEQ ID NO: 233717 - DNA, 25 bp, Artificial Sequence
  Description of Artificial Sequence: Synthetic oligonucleotide
ggcgctttgtgcagggcctgctgtt

SEQ ID NO: 233718 - DNA, 25 bp, Artificial Sequence
  Description of Artificial Sequence: Synthetic oligonucleotide
gcgctttgtgcagggcctgctgttc

SEQ ID NO: 233719 - DNA, 27 bp, Artificial Sequence
  Description of Artificial Sequence: Synthetic oligonucleotide
cgctttgtgcagggcctgctgttcctt

SEQ ID NO: 233720 - DNA, 27 bp, Artificial Sequence
  Description of Artificial Sequence: Synthetic oligonucleotide
gctttgtgcagggcctgctgttccttg

SEQ ID NO: 233721 - DNA, 27 bp, Artificial Sequence
  Description of Artificial Sequence: Synthetic oligonucleotide
ctttgtgcagggcctgctgttccttgg

SEQ ID NO: 233722 - DNA, 27 bp, Artificial Sequence
  Description of Artificial Sequence: Synthetic oligonucleotide
tttgtgcagggcctgctgttccttggc

SEQ ID NO: 233723 - DNA, 26 bp, Artificial Sequence
  Description of Artificial Sequence: Synthetic oligonucleotide
ttgtgcagggcctgctgttccttggc

SEQ ID NO: 233724 - DNA, 25 bp, Artificial Sequence
  Description of Artificial Sequence: Synthetic oligonucleotide
tgtgcagggcctgctgttccttggc

SEQ ID NO: 233725 - DNA, 24 bp, Artificial Sequence
  Description of Artificial Sequence: Synthetic oligonucleotide
gtgcagggcctgctgttccttggc

SEQ ID NO: 233726 - DNA, 24 bp, Artificial Sequence
  Description of Artificial Sequence: Synthetic oligonucleotide
tgcagggcctgctgttccttggcg

SEQ ID NO: 233727 - DNA, 23 bp, Artificial Sequence
  Description of Artificial Sequence: Synthetic oligonucleotide
gcagggcctgctgttccttggcg

SEQ ID NO: 233728 - DNA, 23 bp, Artificial Sequence
  Description of Artificial Sequence: Synthetic oligonucleotide
cagggcctgctgttccttggcgc

SEQ ID NO: 233729 - DNA, 23 bp, Artificial Sequence
  Description of Artificial Sequence: Synthetic oligonucleotide
agggcctgctgttccttggcgcc

SEQ ID NO: 233730 - DNA, 22 bp, Artificial Sequence
  Description of Artificial Sequence: Synthetic oligonucleotide
gggcctgctgttccttggcgcc

SEQ ID NO: 233731 - DNA, 22 bp, Artificial Sequence
  Description of Artificial Sequence: Synthetic oligonucleotide
ggcctgctgttccttggcgccg

SEQ ID NO: 233732 - DNA, 22 bp, Artificial Sequence
  Description of Artificial Sequence: Synthetic oligonucleotide
gcctgctgttccttggcgccgg

SEQ ID NO: 233733 - DNA, 22 bp, Artificial Sequence
  Description of Artificial Sequence: Synthetic oligonucleotide
cctgctgttccttggcgccggg

SEQ ID NO: 233734 - DNA, 23 bp, Artificial Sequence
  Description of Artificial Sequence: Synthetic oligonucleotide
ctgctgttccttggcgccgggct

SEQ ID NO: 233735 - DNA, 25 bp, Artificial Sequence
  Description of Artificial Sequence: Synthetic oligonucleotide
tgctgttccttggcgccgggctgta

SEQ ID NO: 233736 - DNA, 24 bp, Artificial Sequence
  Description of Artificial Sequence: Synthetic oligonucleotide
gctgttccttggcgccgggctgta

SEQ ID NO: 233737 - DNA, 26 bp, Artificial Sequence
  Description of Artificial Sequence: Synthetic oligonucleotide
ctgttccttggcgccgggctgtacat

SEQ ID NO: 233738 - DNA, 27 bp, Artificial Sequence
  Description of Artificial Sequence: Synthetic oligonucleotide
tgttccttggcgccgggctgtacatct

SEQ ID NO: 233739 - DNA, 27 bp, Artificial Sequence
  Description of Artificial Sequence: Synthetic oligonucleotide
gttccttggcgccgggctgtacatcta

SEQ ID NO: 233740 - DNA, 27 bp, Artificial Sequence
  Description of Artificial Sequence: Synthetic oligonucleotide
ttccttggcgccgggctgtacatctac

SEQ ID NO: 233741 - DNA, 27 bp, Artificial Sequence
  Description of Artificial Sequence: Synthetic oligonucleotide
tccttggcgccgggctgtacatctact

SEQ ID NO: 233742 - DNA, 27 bp, Artificial Sequence
  Description of Artificial Sequence: Synthetic oligonucleotide
ccttggcgccgggctgtacatctactt

SEQ ID NO: 233743 - DNA, 27 bp, Artificial Sequence
  Description of Artificial Sequence: Synthetic oligonucleotide
cttggcgccgggctgtacatctacttg

SEQ ID NO: 233744 - DNA, 28 bp, Artificial Sequence
  Description of Artificial Sequence: Synthetic oligonucleotide
ttggcgccgggctgtacatctacttgag

SEQ ID NO: 233745 - DNA, 27 bp, Artificial Sequence
  Description of Artificial Sequence: Synthetic oligonucleotide
tggcgccgggctgtacatctacttgag

SEQ ID NO: 233746 - DNA, 26 bp, Artificial Sequence
  Description of Artificial Sequence: Synthetic oligonucleotide
ggcgccgggctgtacatctacttgag

SEQ ID NO: 233747 - DNA, 27 bp, Artificial Sequence
  Description of Artificial Sequence: Synthetic oligonucleotide
gcgccgggctgtacatctacttgagga

SEQ ID NO: 233748 - DNA, 29 bp, Artificial Sequence
  Description of Artificial Sequence: Synthetic oligonucleotide
cgccgggctgtacatctacttgaggaatc

SEQ ID NO: 233749 - DNA, 30 bp, Artificial Sequence
  Description of Artificial Sequence: Synthetic oligonucleotide
gccgggctgtacatctacttgaggaatcag

SEQ ID NO: 233750 - DNA, 33 bp, Artificial Sequence
  Description of Artificial Sequence: Synthetic oligonucleotide
ccgggctgtacatctacttgaggaatcagtaag

SEQ ID NO: 233751 - DNA, 33 bp, Artificial Sequence
  Description of Artificial Sequence: Synthetic oligonucleotide
cgggctgtacatctacttgaggaatcagtaagg

SEQ ID NO: 233752 - DNA, 34 bp, Artificial Sequence
  Description of Artificial Sequence: Synthetic oligonucleotide
gggctgtacatctacttgaggaatcagtaaggac

SEQ ID NO: 233753 - DNA, 35 bp, Artificial Sequence
  Description of Artificial Sequence: Synthetic oligonucleotide
ggctgtacatctacttgaggaatcagtaaggacac

SEQ ID NO: 233754 - DNA, 36 bp, Artificial Sequence
  Description of Artificial Sequence: Synthetic oligonucleotide
gctgtacatctacttgaggaatcagtaaggacactg

SEQ ID NO: 233755 - DNA, 37 bp, Artificial Sequence
  Description of Artificial Sequence: Synthetic oligonucleotide
ctgtacatctacttgaggaatcagtaaggacactgtg

SEQ ID NO: 233756 - DNA, 37 bp, Artificial Sequence
  Description of Artificial Sequence: Synthetic oligonucleotide
tgtacatctacttgaggaatcagtaaggacactgtgg

SEQ ID NO: 233757 - DNA, 36 bp, Artificial Sequence
  Description of Artificial Sequence: Synthetic oligonucleotide
gtacatctacttgaggaatcagtaaggacactgtgg

SEQ ID NO: 233758 - DNA, 37 bp, Artificial Sequence
  Description of Artificial Sequence: Synthetic oligonucleotide
tacatctacttgaggaatcagtaaggacactgtggac

SEQ ID NO: 233759 - DNA, 36 bp, Artificial Sequence
  Description of Artificial Sequence: Synthetic oligonucleotide
acatctacttgaggaatcagtaaggacactgtggac

SEQ ID NO: 233760 - DNA, 35 bp, Artificial Sequence
  Description of Artificial Sequence: Synthetic oligonucleotide
catctacttgaggaatcagtaaggacactgtggac

SEQ ID NO: 233761 - DNA, 37 bp, Artificial Sequence
  Description of Artificial Sequence: Synthetic oligonucleotide
atctacttgaggaatcagtaaggacactgtggacttg

SEQ ID NO: 233762 - DNA, 36 bp, Artificial Sequence
  Description of Artificial Sequence: Synthetic oligonucleotide
tctacttgaggaatcagtaaggacactgtggacttg

SEQ ID NO: 233763 - DNA, 35 bp, Artificial Sequence
  Description of Artificial Sequence: Synthetic oligonucleotide
ctacttgaggaatcagtaaggacactgtggacttg

SEQ ID NO: 233764 - DNA, 36 bp, Artificial Sequence
  Description of Artificial Sequence: Synthetic oligonucleotide
tacttgaggaatcagtaaggacactgtggacttgag

SEQ ID NO: 233765 - DNA, 35 bp, Artificial Sequence
  Description of Artificial Sequence: Synthetic oligonucleotide
acttgaggaatcagtaaggacactgtggacttgag

SEQ ID NO: 233766 - DNA, 34 bp, Artificial Sequence
  Description of Artificial Sequence: Synthetic oligonucleotide
cttgaggaatcagtaaggacactgtggacttgag

SEQ ID NO: 233767 - DNA, 34 bp, Artificial Sequence
  Description of Artificial Sequence: Synthetic oligonucleotide
ttgaggaatcagtaaggacactgtggacttgagc

SEQ ID NO: 233768 - DNA, 33 bp, Artificial Sequence
  Description of Artificial Sequence: Synthetic oligonucleotide
tgaggaatcagtaaggacactgtggacttgagc

SEQ ID NO: 233769 - DNA, 32 bp, Artificial Sequence
  Description of Artificial Sequence: Synthetic oligonucleotide
gaggaatcagtaaggacactgtggacttgagc

SEQ ID NO: 233770 - DNA, 32 bp, Artificial Sequence
  Description of Artificial Sequence: Synthetic oligonucleotide
aggaatcagtaaggacactgtggacttgagcc

SEQ ID NO: 233771 - DNA, 31 bp, Artificial Sequence
  Description of Artificial Sequence: Synthetic oligonucleotide
ggaatcagtaaggacactgtggacttgagcc

SEQ ID NO: 233772 - DNA, 33 bp, Artificial Sequence
  Description of Artificial Sequence: Synthetic oligonucleotide
gaatcagtaaggacactgtggacttgagccaac

SEQ ID NO: 233773 - DNA, 34 bp, Artificial Sequence
  Description of Artificial Sequence: Synthetic oligonucleotide
aatcagtaaggacactgtggacttgagccaacag

SEQ ID NO: 233774 - DNA, 33 bp, Artificial Sequence
  Description of Artificial Sequence: Synthetic oligonucleotide
atcagtaaggacactgtggacttgagccaacag

SEQ ID NO: 233775 - DNA, 32 bp, Artificial Sequence
  Description of Artificial Sequence: Synthetic oligonucleotide
tcagtaaggacactgtggacttgagccaacag

SEQ ID NO: 233776 - DNA, 31 bp, Artificial Sequence
  Description of Artificial Sequence: Synthetic oligonucleotide
cagtaaggacactgtggacttgagccaacag

SEQ ID NO: 233777 - DNA, 31 bp, Artificial Sequence
  Description of Artificial Sequence: Synthetic oligonucleotide
agtaaggacactgtggacttgagccaacagg

SEQ ID NO: 233778 - DNA, 30 bp, Artificial Sequence
  Description of Artificial Sequence: Synthetic oligonucleotide
gtaaggacactgtggacttgagccaacagg

SEQ ID NO: 233779 - DNA, 33 bp, Artificial Sequence
  Description of Artificial Sequence: Synthetic oligonucleotide
taaggacactgtggacttgagccaacaggtttc

SEQ ID NO: 233780 - DNA, 32 bp, Artificial Sequence
  Description of Artificial Sequence: Synthetic oligonucleotide
aaggacactgtggacttgagccaacaggtttc

SEQ ID NO: 233781 - DNA, 31 bp, Artificial Sequence
  Description of Artificial Sequence: Synthetic oligonucleotide
aggacactgtggacttgagccaacaggtttc

SEQ ID NO: 233782 - DNA, 30 bp, Artificial Sequence
  Description of Artificial Sequence: Synthetic oligonucleotide
ggacactgtggacttgagccaacaggtttc

SEQ ID NO: 233783 - DNA, 30 bp, Artificial Sequence
  Description of Artificial Sequence: Synthetic oligonucleotide
gacactgtggacttgagccaacaggtttcc

SEQ ID NO: 233784 - DNA, 31 bp, Artificial Sequence
  Description of Artificial Sequence: Synthetic oligonucleotide
acactgtggacttgagccaacaggtttcctg

SEQ ID NO: 233785 - DNA, 30 bp, Artificial Sequence
  Description of Artificial Sequence: Synthetic oligonucleotide
cactgtggacttgagccaacaggtttcctg

SEQ ID NO: 233786 - DNA, 31 bp, Artificial Sequence
  Description of Artificial Sequence: Synthetic oligonucleotide
actgtggacttgagccaacaggtttcctgag

SEQ ID NO: 233787 - DNA, 30 bp, Artificial Sequence
  Description of Artificial Sequence: Synthetic oligonucleotide
ctgtggacttgagccaacaggtttcctgag

SEQ ID NO: 233788 - DNA, 30 bp, Artificial Sequence
  Description of Artificial Sequence: Synthetic oligonucleotide
tgtggacttgagccaacaggtttcctgagc

SEQ ID NO: 233789 - DNA, 29 bp, Artificial Sequence
  Description of Artificial Sequence: Synthetic oligonucleotide
gtggacttgagccaacaggtttcctgagc

SEQ ID NO: 233790 - DNA, 30 bp, Artificial Sequence
  Description of Artificial Sequence: Synthetic oligonucleotide
tggacttgagccaacaggtttcctgagctc

SEQ ID NO: 233791 - DNA, 29 bp, Artificial Sequence
  Description of Artificial Sequence: Synthetic oligonucleotide
ggacttgagccaacaggtttcctgagctc

SEQ ID NO: 233792 - DNA, 31 bp, Artificial Sequence
  Description of Artificial Sequence: Synthetic oligonucleotide
atgatcctatacaaagctcagctgctgggcg

SEQ ID NO: 233793 - DNA, 30 bp, Artificial Sequence
  Description of Artificial Sequence: Synthetic oligonucleotide
tgatcctatacaaagctcagctgctgggcg

SEQ ID NO: 233794 - DNA, 29 bp, Artificial Sequence
  Description of Artificial Sequence: Synthetic oligonucleotide
gatcctatacaaagctcagctgctgggcg

SEQ ID NO: 233795 - DNA, 29 bp, Artificial Sequence
  Description of Artificial Sequence: Synthetic oligonucleotide
atcctatacaaagctcagctgctgggcgc

SEQ ID NO: 233796 - DNA, 28 bp, Artificial Sequence
  Description of Artificial Sequence: Synthetic oligonucleotide
tcctatacaaagctcagctgctgggcgc

SEQ ID NO: 233797 - DNA, 27 bp, Artificial Sequence
  Description of Artificial Sequence: Synthetic oligonucleotide
cctatacaaagctcagctgctgggcgc

SEQ ID NO: 233798 - DNA, 27 bp, Artificial Sequence
  Description of Artificial Sequence: Synthetic oligonucleotide
ctatacaaagctcagctgctgggcgcc

SEQ ID NO: 233799 - DNA, 27 bp, Artificial Sequence
  Description of Artificial Sequence: Synthetic oligonucleotide
tatacaaagctcagctgctgggcgccc

SEQ ID NO: 233800 - DNA, 27 bp, Artificial Sequence
  Description of Artificial Sequence: Synthetic oligonucleotide
atacaaagctcagctgctgggcgccct

SEQ ID NO: 233801 - DNA, 26 bp, Artificial Sequence
  Description of Artificial Sequence: Synthetic oligonucleotide
tacaaagctcagctgctgggcgccct

SEQ ID NO: 233802 - DNA, 25 bp, Artificial Sequence
  Description of Artificial Sequence: Synthetic oligonucleotide
acaaagctcagctgctgggcgccct

SEQ ID NO: 233803 - DNA, 24 bp, Artificial Sequence
  Description of Artificial Sequence: Synthetic oligonucleotide
caaagctcagctgctgggcgccct

SEQ ID NO: 233804 - DNA, 24 bp, Artificial Sequence
  Description of Artificial Sequence: Synthetic oligonucleotide
aaagctcagctgctgggcgccctc

SEQ ID NO: 233805 - DNA, 23 bp, Artificial Sequence
  Description of Artificial Sequence: Synthetic oligonucleotide
aagctcagctgctgggcgccctc

SEQ ID NO: 233806 - DNA, 22 bp, Artificial Sequence
  Description of Artificial Sequence: Synthetic oligonucleotide
agctcagctgctgggcgccctc

SEQ ID NO: 233807 - DNA, 21 bp, Artificial Sequence
  Description of Artificial Sequence: Synthetic oligonucleotide
gctcagctgctgggcgccctc

SEQ ID NO: 233808 - DNA, 21 bp, Artificial Sequence
  Description of Artificial Sequence: Synthetic oligonucleotide
ctcagctgctgggcgccctcg

SEQ ID NO: 233809 - DNA, 21 bp, Artificial Sequence
  Description of Artificial Sequence: Synthetic oligonucleotide
tcagctgctgggcgccctcgc

SEQ ID NO: 233810 - DNA, 20 bp, Artificial Sequence
  Description of Artificial Sequence: Synthetic oligonucleotide
cagctgctgggcgccctcgc

SEQ ID NO: 233811 - DNA, 20 bp, Artificial Sequence
  Description of Artificial Sequence: Synthetic oligonucleotide
agctgctgggcgccctcgcc

SEQ ID NO: 233812 - DNA, 20 bp, Artificial Sequence
  Description of Artificial Sequence: Synthetic oligonucleotide
gctgctgggcgccctcgcct

SEQ ID NO: 233813 - DNA, 20 bp, Artificial Sequence
  Description of Artificial Sequence: Synthetic oligonucleotide
ctgctgggcgccctcgccgt

SEQ ID NO: 233814 - DNA, 21 bp, Artificial Sequence
  Description of Artificial Sequence: Synthetic oligonucleotide
tgctgggcgccctcgccgtga

SEQ ID NO: 233815 - DNA, 20 bp, Artificial Sequence
  Description of Artificial Sequence: Synthetic oligonucleotide
gctgggcgccctcgccgtga

SEQ ID NO: 233816 - DNA, 20 bp, Artificial Sequence
  Description of Artificial Sequence: Synthetic oligonucleotide
ctgggcgccctcgccgtgac

SEQ ID NO: 233817 - DNA, 21 bp, Artificial Sequence
  Description of Artificial Sequence: Synthetic oligonucleotide
tgggcgccctcgccgtgacca

SEQ ID NO: 233818 - DNA, 20 bp, Artificial Sequence
  Description of Artificial Sequence: Synthetic oligonucleotide
gggcgccctcgccgtgacca

SEQ ID NO: 233819 - DNA, 20 bp, Artificial Sequence
  Description of Artificial Sequence: Synthetic oligonucleotide
ggcgccctcgccgtgaccac

SEQ ID NO: 233820 - DNA, 20 bp, Artificial Sequence
  Description of Artificial Sequence: Synthetic oligonucleotide
gcgccctcgccgtgaccacc

SEQ ID NO: 233821 - DNA, 21 bp, Artificial Sequence
  Description of Artificial Sequence: Synthetic oligonucleotide
cgccctcgccgtgaccaccga

SEQ ID NO: 233822 - DNA, 23 bp, Artificial Sequence
  Description of Artificial Sequence: Synthetic oligonucleotide
gccctcgccgtgaccaccgagat

SEQ ID NO: 233823 - DNA, 24 bp, Artificial Sequence
  Description of Artificial Sequence: Synthetic oligonucleotide
ccctcgccgtgaccaccgagatga

SEQ ID NO: 233824 - DNA, 24 bp, Artificial Sequence
  Description of Artificial Sequence: Synthetic oligonucleotide
cctcgccgtgaccaccgagatgag

SEQ ID NO: 233825 - DNA, 24 bp, Artificial Sequence
  Description of Artificial Sequence: Synthetic oligonucleotide
ctcgccgtgaccaccgagatgagc

SEQ ID NO: 233826 - DNA, 24 bp, Artificial Sequence
  Description of Artificial Sequence: Synthetic oligonucleotide
tcgccgtgaccaccgagatgagcc

SEQ ID NO: 233827 - DNA, 23 bp, Artificial Sequence
  Description of Artificial Sequence: Synthetic oligonucleotide
cgccgtgaccaccgagatgagcc

SEQ ID NO: 233828 - DNA, 23 bp, Artificial Sequence
  Description of Artificial Sequence: Synthetic oligonucleotide
gccgtgaccaccgagatgagccg

SEQ ID NO: 233829 - DNA, 24 bp, Artificial Sequence
  Description of Artificial Sequence: Synthetic oligonucleotide
ccgtgaccaccgagatgagccgct

SEQ ID NO: 233830 - DNA, 25 bp, Artificial Sequence
  Description of Artificial Sequence: Synthetic oligonucleotide
cgtgaccaccgagatgagccgctgt

SEQ ID NO: 233831 - DNA, 25 bp, Artificial Sequence
  Description of Artificial Sequence: Synthetic oligonucleotide
gtgaccaccgagatgagccgctgtg

SEQ ID NO: 233832 - DNA, 26 bp, Artificial Sequence
  Description of Artificial Sequence: Synthetic oligonucleotide
tgaccaccgagatgagccgctgtgga

SEQ ID NO: 233833 - DNA, 25 bp, Artificial Sequence
  Description of Artificial Sequence: Synthetic oligonucleotide
gaccaccgagatgagccgctgtgga

SEQ ID NO: 233834 - DNA, 25 bp, Artificial Sequence
  Description of Artificial Sequence: Synthetic oligonucleotide
accaccgagatgagccgctgtggag

SEQ ID NO: 233835 - DNA, 24 bp, Artificial Sequence
  Description of Artificial Sequence: Synthetic oligonucleotide
ccaccgagatgagccgctgtggag

SEQ ID NO: 233836 - DNA, 25 bp, Artificial Sequence
  Description of Artificial Sequence: Synthetic oligonucleotide
caccgagatgagccgctgtggagga

SEQ ID NO: 233837 - DNA, 27 bp, Artificial Sequence
  Description of Artificial Sequence: Synthetic oligonucleotide
accgagatgagccgctgtggaggagaa

SEQ ID NO: 233838 - DNA, 26 bp, Artificial Sequence
  Description of Artificial Sequence: Synthetic oligonucleotide
ccgagatgagccgctgtggaggagaa

SEQ ID NO: 233839 - DNA, 27 bp, Artificial Sequence
  Description of Artificial Sequence: Synthetic oligonucleotide
cgagatgagccgctgtggaggagaaga

SEQ ID NO: 233840 - DNA, 27 bp, Artificial Sequence
  Description of Artificial Sequence: Synthetic oligonucleotide
gagatgagccgctgtggaggagaagac

SEQ ID NO: 233841 - DNA, 30 bp, Artificial Sequence
  Description of Artificial Sequence: Synthetic oligonucleotide
agatgagccgctgtggaggagaagacattg

SEQ ID NO: 233842 - DNA, 29 bp, Artificial Sequence
  Description of Artificial Sequence: Synthetic oligonucleotide
gatgagccgctgtggaggagaagacattg

SEQ ID NO: 233843 - DNA, 30 bp, Artificial Sequence
  Description of Artificial Sequence: Synthetic oligonucleotide
atgagccgctgtggaggagaagacattgag

SEQ ID NO: 233844 - DNA, 29 bp, Artificial Sequence
  Description of Artificial Sequence: Synthetic oligonucleotide
tgagccgctgtggaggagaagacattgag

SEQ ID NO: 233845 - DNA, 28 bp, Artificial Sequence
  Description of Artificial Sequence: Synthetic oligonucleotide
gagccgctgtggaggagaagacattgag

SEQ ID NO: 233846 - DNA, 28 bp, Artificial Sequence
  Description of Artificial Sequence: Synthetic oligonucleotide
agccgctgtggaggagaagacattgagg

SEQ ID NO: 233847 - DNA, 27 bp, Artificial Sequence
  Description of Artificial Sequence: Synthetic oligonucleotide
gccgctgtggaggagaagacattgagg

SEQ ID NO: 233848 - DNA, 27 bp, Artificial Sequence
  Description of Artificial Sequence: Synthetic oligonucleotide
ccgctgtggaggagaagacattgaggc

SEQ ID NO: 233849 - DNA, 28 bp, Artificial Sequence
  Description of Artificial Sequence: Synthetic oligonucleotide
cgctgtggaggagaagacattgaggctg

SEQ ID NO: 233850 - DNA, 29 bp, Artificial Sequence
  Description of Artificial Sequence: Synthetic oligonucleotide
gctgtggaggagaagacattgaggctgac

SEQ ID NO: 233851 - DNA, 29 bp, Artificial Sequence
  Description of Artificial Sequence: Synthetic oligonucleotide
ctgtggaggagaagacattgaggctgacc

SEQ ID NO: 233852 - DNA, 30 bp, Artificial Sequence
  Description of Artificial Sequence: Synthetic oligonucleotide
tgtggaggagaagacattgaggctgacctc

SEQ ID NO: 233853 - DNA, 29 bp, Artificial Sequence
  Description of Artificial Sequence: Synthetic oligonucleotide
gtggaggagaagacattgaggctgacctc

SEQ ID NO: 233854 - DNA, 29 bp, Artificial Sequence
  Description of Artificial Sequence: Synthetic oligonucleotide
tggaggagaagacattgaggctgacctcg

SEQ ID NO: 233855 - DNA, 28 bp, Artificial Sequence
  Description of Artificial Sequence: Synthetic oligonucleotide
ggaggagaagacattgaggctgacctcg

SEQ ID NO: 233856 - DNA, 30 bp, Artificial Sequence
  Description of Artificial Sequence: Synthetic oligonucleotide
gaggagaagacattgaggctgacctcgttg

SEQ ID NO: 233857 - DNA, 30 bp, Artificial Sequence
  Description of Artificial Sequence: Synthetic oligonucleotide
aggagaagacattgaggctgacctcgttgc

SEQ ID NO: 233858 - DNA, 29 bp, Artificial Sequence
  Description of Artificial Sequence: Synthetic oligonucleotide
ggagaagacattgaggctgacctcgttgc

SEQ ID NO: 233859 - DNA, 29 bp, Artificial Sequence
  Description of Artificial Sequence: Synthetic oligonucleotide
gagaagacattgaggctgacctcgttgcc

SEQ ID NO: 233860 - DNA, 30 bp, Artificial Sequence
  Description of Artificial Sequence: Synthetic oligonucleotide
agaagacattgaggctgacctcgttgcctc

SEQ ID NO: 233861 - DNA, 29 bp, Artificial Sequence
  Description of Artificial Sequence: Synthetic oligonucleotide
gaagacattgaggctgacctcgttgcctc

SEQ ID NO: 233862 - DNA, 33 bp, Artificial Sequence
  Description of Artificial Sequence: Synthetic oligonucleotide
aagacattgaggctgacctcgttgcctctaatg

SEQ ID NO: 233863 - DNA, 32 bp, Artificial Sequence
  Description of Artificial Sequence: Synthetic oligonucleotide
agacattgaggctgacctcgttgcctctaatg

SEQ ID NO: 233864 - DNA, 31 bp, Artificial Sequence
  Description of Artificial Sequence: Synthetic oligonucleotide
gacattgaggctgacctcgttgcctctaatg

SEQ ID NO: 233865 - DNA, 31 bp, Artificial Sequence
  Description of Artificial Sequence: Synthetic oligonucleotide
acattgaggctgacctcgttgcctctaatgg

SEQ ID NO: 233866 - DNA, 30 bp, Artificial Sequence
  Description of Artificial Sequence: Synthetic oligonucleotide
cattgaggctgacctcgttgcctctaatgg

SEQ ID NO: 233867 - DNA, 31 bp, Artificial Sequence
  Description of Artificial Sequence: Synthetic oligonucleotide
attgaggctgacctcgttgcctctaatggtg

SEQ ID NO: 233868 - DNA, 30 bp, Artificial Sequence
  Description of Artificial Sequence: Synthetic oligonucleotide
ttgaggctgacctcgttgcctctaatggtg

SEQ ID NO: 233869 - DNA, 29 bp, Artificial Sequence
  Description of Artificial Sequence: Synthetic oligonucleotide
tgaggctgacctcgttgcctctaatggtg

SEQ ID NO: 233870 - DNA, 28 bp, Artificial Sequence
  Description of Artificial Sequence: Synthetic oligonucleotide
gaggctgacctcgttgcctctaatggtg

SEQ ID NO: 233871 - DNA, 32 bp, Artificial Sequence
  Description of Artificial Sequence: Synthetic oligonucleotide
aggctgacctcgttgcctctaatggtgtaatc

SEQ ID NO: 233872 - DNA, 31 bp, Artificial Sequence
  Description of Artificial Sequence: Synthetic oligonucleotide
ggctgacctcgttgcctctaatggtgtaatc

SEQ ID NO: 233873 - DNA, 33 bp, Artificial Sequence
  Description of Artificial Sequence: Synthetic oligonucleotide
gctgacctcgttgcctctaatggtgtaatcttg

SEQ ID NO: 233874 - DNA, 35 bp, Artificial Sequence
  Description of Artificial Sequence: Synthetic oligonucleotide
ctgacctcgttgcctctaatggtgtaatcttgtac

SEQ ID NO: 233875 - DNA, 35 bp, Artificial Sequence
  Description of Artificial Sequence: Synthetic oligonucleotide
tgacctcgttgcctctaatggtgtaatcttgtacc

SEQ ID NO: 233876 - DNA, 34 bp, Artificial Sequence
  Description of Artificial Sequence: Synthetic oligonucleotide
gacctcgttgcctctaatggtgtaatcttgtacc

SEQ ID NO: 233877 - DNA, 35 bp, Artificial Sequence
  Description of Artificial Sequence: Synthetic oligonucleotide
acctcgttgcctctaatggtgtaatcttgtaccac

SEQ ID NO: 233878 - DNA, 34 bp, Artificial Sequence
  Description of Artificial Sequence: Synthetic oligonucleotide
cctcgttgcctctaatggtgtaatcttgtaccac

SEQ ID NO: 233879 - DNA, 34 bp, Artificial Sequence
  Description of Artificial Sequence: Synthetic oligonucleotide
ctcgttgcctctaatggtgtaatcttgtaccacc

SEQ ID NO: 233880 - DNA, 37 bp, Artificial Sequence
  Description of Artificial Sequence: Synthetic oligonucleotide
tcgttgcctctaatggtgtaatcttgtaccaccttac

SEQ ID NO: 233881 - DNA, 36 bp, Artificial Sequence
  Description of Artificial Sequence: Synthetic oligonucleotide
cgttgcctctaatggtgtaatcttgtaccaccttac

SEQ ID NO: 233882 - DNA, 36 bp, Artificial Sequence
  Description of Artificial Sequence: Synthetic oligonucleotide
gttgcctctaatggtgtaatcttgtaccaccttacg

SEQ ID NO: 233883 - DNA, 36 bp, Artificial Sequence
  Description of Artificial Sequence: Synthetic oligonucleotide
ttgcctctaatggtgtaatcttgtaccaccttacgg

SEQ ID NO: 233884 - DNA, 35 bp, Artificial Sequence
  Description of Artificial Sequence: Synthetic oligonucleotide
tgcctctaatggtgtaatcttgtaccaccttacgg

SEQ ID NO: 233885 - DNA, 34 bp, Artificial Sequence
  Description of Artificial Sequence: Synthetic oligonucleotide
gcctctaatggtgtaatcttgtaccaccttacgg

SEQ ID NO: 233886 - DNA, 35 bp, Artificial Sequence
  Description of Artificial Sequence: Synthetic oligonucleotide
cctctaatggtgtaatcttgtaccaccttacggtc

SEQ ID NO: 233887 - DNA, 35 bp, Artificial Sequence
  Description of Artificial Sequence: Synthetic oligonucleotide
ctctaatggtgtaatcttgtaccaccttacggtcg

SEQ ID NO: 233888 - DNA, 35 bp, Artificial Sequence
  Description of Artificial Sequence: Synthetic oligonucleotide
tctaatggtgtaatcttgtaccaccttacggtcgc

SEQ ID NO: 233889 - DNA, 34 bp, Artificial Sequence
  Description of Artificial Sequence: Synthetic oligonucleotide
ctaatggtgtaatcttgtaccaccttacggtcgc

SEQ ID NO: 233890 - DNA, 35 bp, Artificial Sequence
  Description of Artificial Sequence: Synthetic oligonucleotide
taatggtgtaatcttgtaccaccttacggtcgctc

SEQ ID NO: 233891 - DNA, 34 bp, Artificial Sequence
  Description of Artificial Sequence: Synthetic oligonucleotide
aatggtgtaatcttgtaccaccttacggtcgctc

SEQ ID NO: 233892 - DNA, 33 bp, Artificial Sequence
  Description of Artificial Sequence: Synthetic oligonucleotide
atggtgtaatcttgtaccaccttacggtcgctc

SEQ ID NO: 233893 - DNA, 32 bp, Artificial Sequence
  Description of Artificial Sequence: Synthetic oligonucleotide
tggtgtaatcttgtaccaccttacggtcgctc

SEQ ID NO: 233894 - DNA, 31 bp, Artificial Sequence
  Description of Artificial Sequence: Synthetic oligonucleotide
ggtgtaatcttgtaccaccttacggtcgctc

SEQ ID NO: 233895 - DNA, 32 bp, Artificial Sequence
  Description of Artificial Sequence: Synthetic oligonucleotide
gtgtaatcttgtaccaccttacggtcgctctg

SEQ ID NO: 233896 - DNA, 32 bp, Artificial Sequence
  Description of Artificial Sequence: Synthetic oligonucleotide
tgtaatcttgtaccaccttacggtcgctctgg

SEQ ID NO: 233897 - DNA, 31 bp, Artificial Sequence
  Description of Artificial Sequence: Synthetic oligonucleotide
gtaatcttgtaccaccttacggtcgctctgg

SEQ ID NO: 233898 - DNA, 31 bp, Artificial Sequence
  Description of Artificial Sequence: Synthetic oligonucleotide
taatcttgtaccaccttacggtcgctctggc

SEQ ID NO: 233899 - DNA, 30 bp, Artificial Sequence
  Description of Artificial Sequence: Synthetic oligonucleotide
aatcttgtaccaccttacggtcgctctggc

SEQ ID NO: 233900 - DNA, 29 bp, Artificial Sequence
  Description of Artificial Sequence: Synthetic oligonucleotide
atcttgtaccaccttacggtcgctctggc

SEQ ID NO: 233901 - DNA, 28 bp, Artificial Sequence
  Description of Artificial Sequence: Synthetic oligonucleotide
tcttgtaccaccttacggtcgctctggc

SEQ ID NO: 233902 - DNA, 27 bp, Artificial Sequence
  Description of Artificial Sequence: Synthetic oligonucleotide
cttgtaccaccttacggtcgctctggc

SEQ ID NO: 233903 - DNA, 27 bp, Artificial Sequence
  Description of Artificial Sequence: Synthetic oligonucleotide
ttgtaccaccttacggtcgctctggcc

SEQ ID NO: 233904 - DNA, 27 bp, Artificial Sequence
  Description of Artificial Sequence: Synthetic oligonucleotide
tgtaccaccttacggtcgctctggcca

SEQ ID NO: 233905 - DNA, 26 bp, Artificial Sequence
  Description of Artificial Sequence: Synthetic oligonucleotide
gtaccaccttacggtcgctctggcca

SEQ ID NO: 233906 - DNA, 27 bp, Artificial Sequence
  Description of Artificial Sequence: Synthetic oligonucleotide
taccaccttacggtcgctctggccact

SEQ ID NO: 233907 - DNA, 27 bp, Artificial Sequence
  Description of Artificial Sequence: Synthetic oligonucleotide
accaccttacggtcgctctggccacta

SEQ ID NO: 233908 - DNA, 26 bp, Artificial Sequence
  Description of Artificial Sequence: Synthetic oligonucleotide
ccaccttacggtcgctctggccacta

SEQ ID NO: 233909 - DNA, 27 bp, Artificial Sequence
  Description of Artificial Sequence: Synthetic oligonucleotide
caccttacggtcgctctggccactaca

SEQ ID NO: 233910 - DNA, 27 bp, Artificial Sequence
  Description of Artificial Sequence: Synthetic oligonucleotide
accttacggtcgctctggccactacac

SEQ ID NO: 233911 - DNA, 26 bp, Artificial Sequence
  Description of Artificial Sequence: Synthetic oligonucleotide
ccttacggtcgctctggccactacac

SEQ ID NO: 233912 - DNA, 26 bp, Artificial Sequence
  Description of Artificial Sequence: Synthetic oligonucleotide
cttacggtcgctctggccactacacc

SEQ ID NO: 233913 - DNA, 27 bp, Artificial Sequence
  Description of Artificial Sequence: Synthetic oligonucleotide
ttacggtcgctctggccactacaccca

SEQ ID NO: 233914 - DNA, 27 bp, Artificial Sequence
  Description of Artificial Sequence: Synthetic oligonucleotide
tacggtcgctctggccactacacccat

SEQ ID NO: 233915 - DNA, 26 bp, Artificial Sequence
  Description of Artificial Sequence: Synthetic oligonucleotide
acggtcgctctggccactacacccat

SEQ ID NO: 233916 - DNA, 25 bp, Artificial Sequence
  Description of Artificial Sequence: Synthetic oligonucleotide
cggtcgctctggccactacacccat

SEQ ID NO: 233917 - DNA, 27 bp, Artificial Sequence
  Description of Artificial Sequence: Synthetic oligonucleotide
ggtcgctctggccactacacccatcaa

SEQ ID NO: 233918 - DNA, 30 bp, Artificial Sequence
  Description of Artificial Sequence: Synthetic oligonucleotide
gtcgctctggccactacacccatcaatttg

SEQ ID NO: 233919 - DNA, 32 bp, Artificial Sequence
  Description of Artificial Sequence: Synthetic oligonucleotide
tcgctctggccactacacccatcaatttgatg

SEQ ID NO: 233920 - DNA, 31 bp, Artificial Sequence
  Description of Artificial Sequence: Synthetic oligonucleotide
cgctctggccactacacccatcaatttgatg

SEQ ID NO: 233921 - DNA, 31 bp, Artificial Sequence
  Description of Artificial Sequence: Synthetic oligonucleotide
gctctggccactacacccatcaatttgatgc

SEQ ID NO: 233922 - DNA, 32 bp, Artificial Sequence
  Description of Artificial Sequence: Synthetic oligonucleotide
ctctggccactacacccatcaatttgatgcag

SEQ ID NO: 233923 - DNA, 34 bp, Artificial Sequence
  Description of Artificial Sequence: Synthetic oligonucleotide
tctggccactacacccatcaatttgatgcagatg

SEQ ID NO: 233924 - DNA, 33 bp, Artificial Sequence
  Description of Artificial Sequence: Synthetic oligonucleotide
ctggccactacacccatcaatttgatgcagatg

SEQ ID NO: 233925 - DNA, 34 bp, Artificial Sequence
  Description of Artificial Sequence: Synthetic oligonucleotide
tggccactacacccatcaatttgatgcagatgag

SEQ ID NO: 233926 - DNA, 33 bp, Artificial Sequence
  Description of Artificial Sequence: Synthetic oligonucleotide
ggccactacacccatcaatttgatgcagatgag

SEQ ID NO: 233927 - DNA, 33 bp, Artificial Sequence
  Description of Artificial Sequence: Synthetic oligonucleotide
gccactacacccatcaatttgatgcagatgagc

SEQ ID NO: 233928 - DNA, 34 bp, Artificial Sequence
  Description of Artificial Sequence: Synthetic oligonucleotide
ccactacacccatcaatttgatgcagatgagcac

SEQ ID NO: 233929 - DNA, 36 bp, Artificial Sequence
  Description of Artificial Sequence: Synthetic oligonucleotide
cactacacccatcaatttgatgcagatgagcacttc

SEQ ID NO: 233930 - DNA, 38 bp, Artificial Sequence
  Description of Artificial Sequence: Synthetic oligonucleotide
actacacccatcaatttgatgcagatgagcacttctac

SEQ ID NO: 233931 - DNA, 37 bp, Artificial Sequence
  Description of Artificial Sequence: Synthetic oligonucleotide
ctacacccatcaatttgatgcagatgagcacttctac

SEQ ID NO: 233932 - DNA, 37 bp, Artificial Sequence
  Description of Artificial Sequence: Synthetic oligonucleotide
tacacccatcaatttgatgcagatgagcacttctacg

SEQ ID NO: 233933 - DNA, 36 bp, Artificial Sequence
  Description of Artificial Sequence: Synthetic oligonucleotide
acacccatcaatttgatgcagatgagcacttctacg

SEQ ID NO: 233934 - DNA, 35 bp, Artificial Sequence
  Description of Artificial Sequence: Synthetic oligonucleotide
cacccatcaatttgatgcagatgagcacttctacg

SEQ ID NO: 233935 - DNA, 36 bp, Artificial Sequence
  Description of Artificial Sequence: Synthetic oligonucleotide
acccatcaatttgatgcagatgagcacttctacgtg

SEQ ID NO: 233936 - DNA, 35 bp, Artificial Sequence
  Description of Artificial Sequence: Synthetic oligonucleotide
cccatcaatttgatgcagatgagcacttctacgtg

SEQ ID NO: 233937 - DNA, 37 bp, Artificial Sequence
  Description of Artificial Sequence: Synthetic oligonucleotide
ccatcaatttgatgcagatgagcacttctacgtgtac

SEQ ID NO: 233938 - DNA, 37 bp, Artificial Sequence
  Description of Artificial Sequence: Synthetic oligonucleotide
catcaatttgatgcagatgagcacttctacgtgtacc

SEQ ID NO: 233939 - DNA, 38 bp, Artificial Sequence
  Description of Artificial Sequence: Synthetic oligonucleotide
atcaatttgatgcagatgagcacttctacgtgtacctg

SEQ ID NO: 233940 - DNA, 37 bp, Artificial Sequence
  Description of Artificial Sequence: Synthetic oligonucleotide
tcaatttgatgcagatgagcacttctacgtgtacctg

SEQ ID NO: 233941 - DNA, 36 bp, Artificial Sequence
  Description of Artificial Sequence: Synthetic oligonucleotide
caatttgatgcagatgagcacttctacgtgtacctg

SEQ ID NO: 233942 - DNA, 36 bp, Artificial Sequence
  Description of Artificial Sequence: Synthetic oligonucleotide
aatttgatgcagatgagcacttctacgtgtacctgg

SEQ ID NO: 233943 - DNA, 35 bp, Artificial Sequence
  Description of Artificial Sequence: Synthetic oligonucleotide
atttgatgcagatgagcacttctacgtgtacctgg

SEQ ID NO: 233944 - DNA, 34 bp, Artificial Sequence
  Description of Artificial Sequence: Synthetic oligonucleotide
tttgatgcagatgagcacttctacgtgtacctgg

SEQ ID NO: 233945 - DNA, 33 bp, Artificial Sequence
  Description of Artificial Sequence: Synthetic oligonucleotide
ttgatgcagatgagcacttctacgtgtacctgg

SEQ ID NO: 233946 - DNA, 32 bp, Artificial Sequence
  Description of Artificial Sequence: Synthetic oligonucleotide
tgatgcagatgagcacttctacgtgtacctgg

SEQ ID NO: 233947 - DNA, 31 bp, Artificial Sequence
  Description of Artificial Sequence: Synthetic oligonucleotide
gatgcagatgagcacttctacgtgtacctgg

SEQ ID NO: 233948 - DNA, 32 bp, Artificial Sequence
  Description of Artificial Sequence: Synthetic oligonucleotide
atgcagatgagcacttctacgtgtacctggag

SEQ ID NO: 233949 - DNA, 31 bp, Artificial Sequence
  Description of Artificial Sequence: Synthetic oligonucleotide
tgcagatgagcacttctacgtgtacctggag

SEQ ID NO: 233950 - DNA, 30 bp, Artificial Sequence
  Description of Artificial Sequence: Synthetic oligonucleotide
gcagatgagcacttctacgtgtacctggag

SEQ ID NO: 233951 - DNA, 31 bp, Artificial Sequence
  Description of Artificial Sequence: Synthetic oligonucleotide
cagatgagcacttctacgtgtacctggagtg

SEQ ID NO: 233952 - DNA, 31 bp, Artificial Sequence
  Description of Artificial Sequence: Synthetic oligonucleotide
agatgagcacttctacgtgtacctggagtgg

SEQ ID NO: 233953 - DNA, 30 bp, Artificial Sequence
  Description of Artificial Sequence: Synthetic oligonucleotide
gatgagcacttctacgtgtacctggagtgg

SEQ ID NO: 233954 - DNA, 32 bp, Artificial Sequence
  Description of Artificial Sequence: Synthetic oligonucleotide
atgagcacttctacgtgtacctggagtggaag

SEQ ID NO: 233955 - DNA, 31 bp, Artificial Sequence
  Description of Artificial Sequence: Synthetic oligonucleotide
tgagcacttctacgtgtacctggagtggaag

SEQ ID NO: 233956 - DNA, 30 bp, Artificial Sequence
  Description of Artificial Sequence: Synthetic oligonucleotide
gagcacttctacgtgtacctggagtggaag

SEQ ID NO: 233957 - DNA, 30 bp, Artificial Sequence
  Description of Artificial Sequence: Synthetic oligonucleotide
agcacttctacgtgtacctggagtggaagg

SEQ ID NO: 233958 - DNA, 29 bp, Artificial Sequence
  Description of Artificial Sequence: Synthetic oligonucleotide
gcacttctacgtgtacctggagtggaagg

SEQ ID NO: 233959 - DNA, 30 bp, Artificial Sequence
  Description of Artificial Sequence: Synthetic oligonucleotide
cacttctacgtgtacctggagtggaaggag

SEQ ID NO: 233960 - DNA, 31 bp, Artificial Sequence
  Description of Artificial Sequence: Synthetic oligonucleotide
acttctacgtgtacctggagtggaaggagac

SEQ ID NO: 233961 - DNA, 30 bp, Artificial Sequence
  Description of Artificial Sequence: Synthetic oligonucleotide
cttctacgtgtacctggagtggaaggagac

SEQ ID NO: 233962 - DNA, 31 bp, Artificial Sequence
  Description of Artificial Sequence: Synthetic oligonucleotide
ttctacgtgtacctggagtggaaggagacag

SEQ ID NO: 233963 - DNA, 30 bp, Artificial Sequence
  Description of Artificial Sequence: Synthetic oligonucleotide
tctacgtgtacctggagtggaaggagacag

SEQ ID NO: 233964 - DNA, 29 bp, Artificial Sequence
  Description of Artificial Sequence: Synthetic oligonucleotide
ctacgtgtacctggagtggaaggagacag

SEQ ID NO: 233965 - DNA, 30 bp, Artificial Sequence
  Description of Artificial Sequence: Synthetic oligonucleotide
tacgtgtacctggagtggaaggagacagtc

SEQ ID NO: 233966 - DNA, 29 bp, Artificial Sequence
  Description of Artificial Sequence: Synthetic oligonucleotide
acgtgtacctggagtggaaggagacagtc

SEQ ID NO: 233967 - DNA, 28 bp, Artificial Sequence
  Description of Artificial Sequence: Synthetic oligonucleotide
cgtgtacctggagtggaaggagacagtc

SEQ ID NO: 233968 - DNA, 29 bp, Artificial Sequence
  Description of Artificial Sequence: Synthetic oligonucleotide
gtgtacctggagtggaaggagacagtctg

SEQ ID NO: 233969 - DNA, 29 bp, Artificial Sequence
  Description of Artificial Sequence: Synthetic oligonucleotide
tgtacctggagtggaaggagacagtctgg

SEQ ID NO: 233970 - DNA, 28 bp, Artificial Sequence
  Description of Artificial Sequence: Synthetic oligonucleotide
gtacctggagtggaaggagacagtctgg

SEQ ID NO: 233971 - DNA, 28 bp, Artificial Sequence
  Description of Artificial Sequence: Synthetic oligonucleotide
tacctggagtggaaggagacagtctggc

SEQ ID NO: 233972 - DNA, 27 bp, Artificial Sequence
  Description of Artificial Sequence: Synthetic oligonucleotide
acctggagtggaaggagacagtctggc

SEQ ID NO: 233973 - DNA, 26 bp, Artificial Sequence
  Description of Artificial Sequence: Synthetic oligonucleotide
cctggagtggaaggagacagtctggc

SEQ ID NO: 233974 - DNA, 26 bp, Artificial Sequence
  Description of Artificial Sequence: Synthetic oligonucleotide
ctggagtggaaggagacagtctggcg

SEQ ID NO: 233975 - DNA, 27 bp, Artificial Sequence
  Description of Artificial Sequence: Synthetic oligonucleotide
tggagtggaaggagacagtctggcgga

SEQ ID NO: 233976 - DNA, 27 bp, Artificial Sequence
  Description of Artificial Sequence: Synthetic oligonucleotide
ggagtggaaggagacagtctggcggat

SEQ ID NO: 233977 - DNA, 27 bp, Artificial Sequence
  Description of Artificial Sequence: Synthetic oligonucleotide
gagtggaaggagacagtctggcggatg

SEQ ID NO: 233978 - DNA, 27 bp, Artificial Sequence
  Description of Artificial Sequence: Synthetic oligonucleotide
agtggaaggagacagtctggcggatgc

SEQ ID NO: 233979 - DNA, 26 bp, Artificial Sequence
  Description of Artificial Sequence: Synthetic oligonucleotide
gtggaaggagacagtctggcggatgc

SEQ ID NO: 233980 - DNA, 27 bp, Artificial Sequence
  Description of Artificial Sequence: Synthetic oligonucleotide
tggaaggagacagtctggcggatgcct

SEQ ID NO: 233981 - DNA, 26 bp, Artificial Sequence
  Description of Artificial Sequence: Synthetic oligonucleotide
ggaaggagacagtctggcggatgcct

SEQ ID NO: 233982 - DNA, 27 bp, Artificial Sequence
  Description of Artificial Sequence: Synthetic oligonucleotide
gaaggagacagtctggcggatgcctgt

SEQ ID NO: 233983 - DNA, 27 bp, Artificial Sequence
  Description of Artificial Sequence: Synthetic oligonucleotide
aaggagacagtctggcggatgcctgtg

SEQ ID NO: 233984 - DNA, 27 bp, Artificial Sequence
  Description of Artificial Sequence: Synthetic oligonucleotide
aggagacagtctggcggatgcctgtgt

SEQ ID NO: 233985 - DNA, 27 bp, Artificial Sequence
  Description of Artificial Sequence: Synthetic oligonucleotide
ggagacagtctggcggatgcctgtgta

SEQ ID NO: 233986 - DNA, 27 bp, Artificial Sequence
  Description of Artificial Sequence: Synthetic oligonucleotide
gagacagtctggcggatgcctgtgtac

SEQ ID NO: 233987 - DNA, 28 bp, Artificial Sequence
  Description of Artificial Sequence: Synthetic oligonucleotide
agacagtctggcggatgcctgtgtacag

SEQ ID NO: 233988 - DNA, 27 bp, Artificial Sequence
  Description of Artificial Sequence: Synthetic oligonucleotide
gacagtctggcggatgcctgtgtacag

SEQ ID NO: 233989 - DNA, 27 bp, Artificial Sequence
  Description of Artificial Sequence: Synthetic oligonucleotide
acagtctggcggatgcctgtgtacagc

SEQ ID NO: 233990 - DNA, 27 bp, Artificial Sequence
  Description of Artificial Sequence: Synthetic oligonucleotide
cagtctggcggatgcctgtgtacagca

SEQ ID NO: 233991 - DNA, 32 bp, Artificial Sequence
  Description of Artificial Sequence: Synthetic oligonucleotide
agtctggcggatgcctgtgtacagcaaattag

SEQ ID NO: 233992 - DNA, 31 bp, Artificial Sequence
  Description of Artificial Sequence: Synthetic oligonucleotide
gtctggcggatgcctgtgtacagcaaattag

SEQ ID NO: 233993 - DNA, 31 bp, Artificial Sequence
  Description of Artificial Sequence: Synthetic oligonucleotide
tctggcggatgcctgtgtacagcaaattagg

SEQ ID NO: 233994 - DNA, 30 bp, Artificial Sequence
  Description of Artificial Sequence: Synthetic oligonucleotide
ctggcggatgcctgtgtacagcaaattagg

SEQ ID NO: 233995 - DNA, 32 bp, Artificial Sequence
  Description of Artificial Sequence: Synthetic oligonucleotide
tggcggatgcctgtgtacagcaaattaggaag

SEQ ID NO: 233996 - DNA, 31 bp, Artificial Sequence
  Description of Artificial Sequence: Synthetic oligonucleotide
ggcggatgcctgtgtacagcaaattaggaag

SEQ ID NO: 233997 - DNA, 37 bp, Artificial Sequence
  Description of Artificial Sequence: Synthetic oligonucleotide
gcggatgcctgtgtacagcaaattaggaagattttac

SEQ ID NO: 233998 - DNA, 37 bp, Artificial Sequence
  Description of Artificial Sequence: Synthetic oligonucleotide
cggatgcctgtgtacagcaaattaggaagattttacc

SEQ ID NO: 233999 - DNA, 37 bp, Artificial Sequence
  Description of Artificial Sequence: Synthetic oligonucleotide
ggatgcctgtgtacagcaaattaggaagattttaccc

SEQ ID NO: 234000 - DNA, 37 bp, Artificial Sequence
  Description of Artificial Sequence: Synthetic oligonucleotide
gatgcctgtgtacagcaaattaggaagattttacccg

SEQ ID NO: 234001 - DNA, 37 bp, Artificial Sequence
  Description of Artificial Sequence: Synthetic oligonucleotide
atgcctgtgtacagcaaattaggaagattttacccgc

SEQ ID NO: 234002 - DNA, 36 bp, Artificial Sequence
  Description of Artificial Sequence: Synthetic oligonucleotide
tgcctgtgtacagcaaattaggaagattttacccgc

SEQ ID NO: 234003 - DNA, 35 bp, Artificial Sequence
  Description of Artificial Sequence: Synthetic oligonucleotide
gcctgtgtacagcaaattaggaagattttacccgc

SEQ ID NO: 234004 - DNA, 40 bp, Artificial Sequence
  Description of Artificial Sequence: Synthetic oligonucleotide
cctgtgtacagcaaattaggaagattttacccgcaattag

SEQ ID NO: 234005 - DNA, 40 bp, Artificial Sequence
  Description of Artificial Sequence: Synthetic oligonucleotide
ctgtgtacagcaaattaggaagattttacccgcaattagc

SEQ ID NO: 234006 - DNA, 41 bp, Artificial Sequence
  Description of Artificial Sequence: Synthetic oligonucleotide
tgtgtacagcaaattaggaagattttacccgcaattagcac

SEQ ID NO: 234007 - DNA, 40 bp, Artificial Sequence
  Description of Artificial Sequence: Synthetic oligonucleotide
gtgtacagcaaattaggaagattttacccgcaattagcac

SEQ ID NO: 234008 - DNA, 41 bp, Artificial Sequence
  Description of Artificial Sequence: Synthetic oligonucleotide
tgtacagcaaattaggaagattttacccgcaattagcactg

SEQ ID NO: 234009 - DNA, 40 bp, Artificial Sequence
  Description of Artificial Sequence: Synthetic oligonucleotide
gtacagcaaattaggaagattttacccgcaattagcactg

SEQ ID NO: 234010 - DNA, 41 bp, Artificial Sequence
  Description of Artificial Sequence: Synthetic oligonucleotide
tacagcaaattaggaagattttacccgcaattagcactgac

SEQ ID NO: 234011 - DNA, 40 bp, Artificial Sequence
  Description of Artificial Sequence: Synthetic oligonucleotide
acagcaaattaggaagattttacccgcaattagcactgac

SEQ ID NO: 234012 - DNA, 39 bp, Artificial Sequence
  Description of Artificial Sequence: Synthetic oligonucleotide
cagcaaattaggaagattttacccgcaattagcactgac

SEQ ID NO: 234013 - DNA, 42 bp, Artificial Sequence
  Description of Artificial Sequence: Synthetic oligonucleotide
agcaaattaggaagattttacccgcaattagcactgactaac

SEQ ID NO: 234014 - DNA, 41 bp, Artificial Sequence
  Description of Artificial Sequence: Synthetic oligonucleotide
gcaaattaggaagattttacccgcaattagcactgactaac

SEQ ID NO: 234015 - DNA, 43 bp, Artificial Sequence
  Description of Artificial Sequence: Synthetic oligonucleotide
caaattaggaagattttacccgcaattagcactgactaacatc

SEQ ID NO: 234016 - DNA, 43 bp, Artificial Sequence
  Description of Artificial Sequence: Synthetic oligonucleotide
aaattaggaagattttacccgcaattagcactgactaacatcg

SEQ ID NO: 234017 - DNA, 42 bp, Artificial Sequence
  Description of Artificial Sequence: Synthetic oligonucleotide
aattaggaagattttacccgcaattagcactgactaacatcg

SEQ ID NO: 234018 - DNA, 41 bp, Artificial Sequence
  Description of Artificial Sequence: Synthetic oligonucleotide
attaggaagattttacccgcaattagcactgactaacatcg

SEQ ID NO: 234019 - DNA, 40 bp, Artificial Sequence
  Description of Artificial Sequence: Synthetic oligonucleotide
ttaggaagattttacccgcaattagcactgactaacatcg

SEQ ID NO: 234020 - DNA, 39 bp, Artificial Sequence
  Description of Artificial Sequence: Synthetic oligonucleotide
taggaagattttacccgcaattagcactgactaacatcg

SEQ ID NO: 234021 - DNA, 38 bp, Artificial Sequence
  Description of Artificial Sequence: Synthetic oligonucleotide
aggaagattttacccgcaattagcactgactaacatcg

SEQ ID NO: 234022 - DNA, 37 bp, Artificial Sequence
  Description of Artificial Sequence: Synthetic oligonucleotide
ggaagattttacccgcaattagcactgactaacatcg

SEQ ID NO: 234023 - DNA, 37 bp, Artificial Sequence
  Description of Artificial Sequence: Synthetic oligonucleotide
gaagattttacccgcaattagcactgactaacatcgc

SEQ ID NO: 234024 - DNA, 38 bp, Artificial Sequence
  Description of Artificial Sequence: Synthetic oligonucleotide
aagattttacccgcaattagcactgactaacatcgctc

SEQ ID NO: 234025 - DNA, 37 bp, Artificial Sequence
  Description of Artificial Sequence: Synthetic oligonucleotide
agattttacccgcaattagcactgactaacatcgctc

SEQ ID NO: 234026 - DNA, 36 bp, Artificial Sequence
  Description of Artificial Sequence: Synthetic oligonucleotide
gattttacccgcaattagcactgactaacatcgctc

SEQ ID NO: 234027 - DNA, 37 bp, Artificial Sequence
  Description of Artificial Sequence: Synthetic oligonucleotide
attttacccgcaattagcactgactaacatcgctctg

SEQ ID NO: 234028 - DNA, 36 bp, Artificial Sequence
  Description of Artificial Sequence: Synthetic oligonucleotide
ttttacccgcaattagcactgactaacatcgctctg

SEQ ID NO: 234029 - DNA, 35 bp, Artificial Sequence
  Description of Artificial Sequence: Synthetic oligonucleotide
tttacccgcaattagcactgactaacatcgctctg

SEQ ID NO: 234030 - DNA, 34 bp, Artificial Sequence
  Description of Artificial Sequence: Synthetic oligonucleotide
ttacccgcaattagcactgactaacatcgctctg

SEQ ID NO: 234031 - DNA, 33 bp, Artificial Sequence
  Description of Artificial Sequence: Synthetic oligonucleotide
tacccgcaattagcactgactaacatcgctctg

SEQ ID NO: 234032 - DNA, 32 bp, Artificial Sequence
  Description of Artificial Sequence: Synthetic oligonucleotide
acccgcaattagcactgactaacatcgctctg

SEQ ID NO: 234033 - DNA, 31 bp, Artificial Sequence
  Description of Artificial Sequence: Synthetic oligonucleotide
cccgcaattagcactgactaacatcgctctg

SEQ ID NO: 234034 - DNA, 31 bp, Artificial Sequence
  Description of Artificial Sequence: Synthetic oligonucleotide
ccgcaattagcactgactaacatcgctctgc

SEQ ID NO: 234035 - DNA, 31 bp, Artificial Sequence
  Description of Artificial Sequence: Synthetic oligonucleotide
cgcaattagcactgactaacatcgctctgcc

SEQ ID NO: 234036 - DNA, 35 bp, Artificial Sequence
  Description of Artificial Sequence: Synthetic oligonucleotide
gcaattagcactgactaacatcgctctgccaaaac

SEQ ID NO: 234037 - DNA, 36 bp, Artificial Sequence
  Description of Artificial Sequence: Synthetic oligonucleotide
caattagcactgactaacatcgctctgccaaaactc

SEQ ID NO: 234038 - DNA, 38 bp, Artificial Sequence
  Description of Artificial Sequence: Synthetic oligonucleotide
aattagcactgactaacatcgctctgccaaaactcaac

SEQ ID NO: 234039 - DNA, 37 bp, Artificial Sequence
  Description of Artificial Sequence: Synthetic oligonucleotide
attagcactgactaacatcgctctgccaaaactcaac

SEQ ID NO: 234040 - DNA, 36 bp, Artificial Sequence
  Description of Artificial Sequence: Synthetic oligonucleotide
ttagcactgactaacatcgctctgccaaaactcaac

SEQ ID NO: 234041 - DNA, 35 bp, Artificial Sequence
  Description of Artificial Sequence: Synthetic oligonucleotide
tagcactgactaacatcgctctgccaaaactcaac

SEQ ID NO: 234042 - DNA, 34 bp, Artificial Sequence
  Description of Artificial Sequence: Synthetic oligonucleotide
agcactgactaacatcgctctgccaaaactcaac

SEQ ID NO: 234043 - DNA, 33 bp, Artificial Sequence
  Description of Artificial Sequence: Synthetic oligonucleotide
gcactgactaacatcgctctgccaaaactcaac

SEQ ID NO: 234044 - DNA, 35 bp, Artificial Sequence
  Description of Artificial Sequence: Synthetic oligonucleotide
cactgactaacatcgctctgccaaaactcaacttg

SEQ ID NO: 234045 - DNA, 37 bp, Artificial Sequence
  Description of Artificial Sequence: Synthetic oligonucleotide
actgactaacatcgctctgccaaaactcaacttgaag

SEQ ID NO: 234046 - DNA, 36 bp, Artificial Sequence
  Description of Artificial Sequence: Synthetic oligonucleotide
ctgactaacatcgctctgccaaaactcaacttgaag

SEQ ID NO: 234047 - DNA, 38 bp, Artificial Sequence
  Description of Artificial Sequence: Synthetic oligonucleotide
tgactaacatcgctctgccaaaactcaacttgaagatc

SEQ ID NO: 234048 - DNA, 37 bp, Artificial Sequence
  Description of Artificial Sequence: Synthetic oligonucleotide
gactaacatcgctctgccaaaactcaacttgaagatc

SEQ ID NO: 234049 - DNA, 39 bp, Artificial Sequence
  Description of Artificial Sequence: Synthetic oligonucleotide
actaacatcgctctgccaaaactcaacttgaagatcatg

SEQ ID NO: 234050 - DNA, 38 bp, Artificial Sequence
  Description of Artificial Sequence: Synthetic oligonucleotide
ctaacatcgctctgccaaaactcaacttgaagatcatg

SEQ ID NO: 234051 - DNA, 45 bp, Artificial Sequence
  Description of Artificial Sequence: Synthetic oligonucleotide
taacatcgctctgccaaaactcaacttgaagatcatgatttaaac

SEQ ID NO: 234052 - DNA, 44 bp, Artificial Sequence
  Description of Artificial Sequence: Synthetic oligonucleotide
aacatcgctctgccaaaactcaacttgaagatcatgatttaaac

SEQ ID NO: 234053 - DNA, 43 bp, Artificial Sequence
  Description of Artificial Sequence: Synthetic oligonucleotide
acatcgctctgccaaaactcaacttgaagatcatgatttaaac

SEQ ID NO: 234054 - DNA, 42 bp, Artificial Sequence
  Description of Artificial Sequence: Synthetic oligonucleotide
catcgctctgccaaaactcaacttgaagatcatgatttaaac

SEQ ID NO: 234055 - DNA, 42 bp, Artificial Sequence
  Description of Artificial Sequence: Synthetic oligonucleotide
atcgctctgccaaaactcaacttgaagatcatgatttaaacg

SEQ ID NO: 234056 - DNA, 41 bp, Artificial Sequence
  Description of Artificial Sequence: Synthetic oligonucleotide
tcgctctgccaaaactcaacttgaagatcatgatttaaacg

SEQ ID NO: 234057 - DNA, 40 bp, Artificial Sequence
  Description of Artificial Sequence: Synthetic oligonucleotide
cgctctgccaaaactcaacttgaagatcatgatttaaacg

SEQ ID NO: 234058 - DNA, 40 bp, Artificial Sequence
  Description of Artificial Sequence: Synthetic oligonucleotide
gctctgccaaaactcaacttgaagatcatgatttaaacgc

SEQ ID NO: 234059 - DNA, 41 bp, Artificial Sequence
  Description of Artificial Sequence: Synthetic oligonucleotide
ctctgccaaaactcaacttgaagatcatgatttaaacgctc

SEQ ID NO: 234060 - DNA, 41 bp, Artificial Sequence
  Description of Artificial Sequence: Synthetic oligonucleotide
tctgccaaaactcaacttgaagatcatgatttaaacgctcc

SEQ ID NO: 234061 - DNA, 40 bp, Artificial Sequence
  Description of Artificial Sequence: Synthetic oligonucleotide
ctgccaaaactcaacttgaagatcatgatttaaacgctcc

SEQ ID NO: 234062 - DNA, 42 bp, Artificial Sequence
  Description of Artificial Sequence: Synthetic oligonucleotide
tgccaaaactcaacttgaagatcatgatttaaacgctcctac

SEQ ID NO: 234063 - DNA, 41 bp, Artificial Sequence
  Description of Artificial Sequence: Synthetic oligonucleotide
gccaaaactcaacttgaagatcatgatttaaacgctcctac

SEQ ID NO: 234064 - DNA, 42 bp, Artificial Sequence
  Description of Artificial Sequence: Synthetic oligonucleotide
ccaaaactcaacttgaagatcatgatttaaacgctcctactc

SEQ ID NO: 234065 - DNA, 44 bp, Artificial Sequence
  Description of Artificial Sequence: Synthetic oligonucleotide
caaaactcaacttgaagatcatgatttaaacgctcctactctac

SEQ ID NO: 234066 - DNA, 44 bp, Artificial Sequence
  Description of Artificial Sequence: Synthetic oligonucleotide
aaaactcaacttgaagatcatgatttaaacgctcctactctacc

SEQ ID NO: 234067 - DNA, 43 bp, Artificial Sequence
  Description of Artificial Sequence: Synthetic oligonucleotide
aaactcaacttgaagatcatgatttaaacgctcctactctacc

SEQ ID NO: 234068 - DNA, 42 bp, Artificial Sequence
  Description of Artificial Sequence: Synthetic oligonucleotide
aactcaacttgaagatcatgatttaaacgctcctactctacc

SEQ ID NO: 234069 - DNA, 41 bp, Artificial Sequence
  Description of Artificial Sequence: Synthetic oligonucleotide
actcaacttgaagatcatgatttaaacgctcctactctacc

SEQ ID NO: 234070 - DNA, 40 bp, Artificial Sequence
  Description of Artificial Sequence: Synthetic oligonucleotide
ctcaacttgaagatcatgatttaaacgctcctactctacc

SEQ ID NO: 234071 - DNA, 40 bp, Artificial Sequence
  Description of Artificial Sequence: Synthetic oligonucleotide
tcaacttgaagatcatgatttaaacgctcctactctaccg

SEQ ID NO: 234072 - DNA, 39 bp, Artificial Sequence
  Description of Artificial Sequence: Synthetic oligonucleotide
caacttgaagatcatgatttaaacgctcctactctaccg

SEQ ID NO: 234073 - DNA, 39 bp, Artificial Sequence
  Description of Artificial Sequence: Synthetic oligonucleotide
aacttgaagatcatgatttaaacgctcctactctaccgg

SEQ ID NO: 234074 - DNA, 38 bp, Artificial Sequence
  Description of Artificial Sequence: Synthetic oligonucleotide
acttgaagatcatgatttaaacgctcctactctaccgg

SEQ ID NO: 234075 - DNA, 37 bp, Artificial Sequence
  Description of Artificial Sequence: Synthetic oligonucleotide
cttgaagatcatgatttaaacgctcctactctaccgg

SEQ ID NO: 234076 - DNA, 38 bp, Artificial Sequence
  Description of Artificial Sequence: Synthetic oligonucleotide
ttgaagatcatgatttaaacgctcctactctaccggtg

SEQ ID NO: 234077 - DNA, 37 bp, Artificial Sequence
  Description of Artificial Sequence: Synthetic oligonucleotide
tgaagatcatgatttaaacgctcctactctaccggtg

SEQ ID NO: 234078 - DNA, 36 bp, Artificial Sequence
  Description of Artificial Sequence: Synthetic oligonucleotide
gaagatcatgatttaaacgctcctactctaccggtg

SEQ ID NO: 234079 - DNA, 36 bp, Artificial Sequence
  Description of Artificial Sequence: Synthetic oligonucleotide
aagatcatgatttaaacgctcctactctaccggtgc

SEQ ID NO: 234080 - DNA, 35 bp, Artificial Sequence
  Description of Artificial Sequence: Synthetic oligonucleotide
agatcatgatttaaacgctcctactctaccggtgc

SEQ ID NO: 234081 - DNA, 34 bp, Artificial Sequence
  Description of Artificial Sequence: Synthetic oligonucleotide
gatcatgatttaaacgctcctactctaccggtgc

SEQ ID NO: 234082 - DNA, 36 bp, Artificial Sequence
  Description of Artificial Sequence: Synthetic oligonucleotide
atcatgatttaaacgctcctactctaccggtgctac

SEQ ID NO: 234083 - DNA, 35 bp, Artificial Sequence
  Description of Artificial Sequence: Synthetic oligonucleotide
tcatgatttaaacgctcctactctaccggtgctac

SEQ ID NO: 234084 - DNA, 34 bp, Artificial Sequence
  Description of Artificial Sequence: Synthetic oligonucleotide
catgatttaaacgctcctactctaccggtgctac

SEQ ID NO: 234085 - DNA, 34 bp, Artificial Sequence
  Description of Artificial Sequence: Synthetic oligonucleotide
atgatttaaacgctcctactctaccggtgctacc

SEQ ID NO: 234086 - DNA, 33 bp, Artificial Sequence
  Description of Artificial Sequence: Synthetic oligonucleotide
tgatttaaacgctcctactctaccggtgctacc

SEQ ID NO: 234087 - DNA, 32 bp, Artificial Sequence
  Description of Artificial Sequence: Synthetic oligonucleotide
gatttaaacgctcctactctaccggtgctacc

SEQ ID NO: 234088 - DNA, 35 bp, Artificial Sequence
  Description of Artificial Sequence: Synthetic oligonucleotide
atttaaacgctcctactctaccggtgctaccaaag

SEQ ID NO: 234089 - DNA, 34 bp, Artificial Sequence
  Description of Artificial Sequence: Synthetic oligonucleotide
tttaaacgctcctactctaccggtgctaccaaag

SEQ ID NO: 234090 - DNA, 33 bp, Artificial Sequence
  Description of Artificial Sequence: Synthetic oligonucleotide
ttaaacgctcctactctaccggtgctaccaaag

SEQ ID NO: 234091 - DNA, 32 bp, Artificial Sequence
  Description of Artificial Sequence: Synthetic oligonucleotide
taaacgctcctactctaccggtgctaccaaag

SEQ ID NO: 234092 - DNA, 31 bp, Artificial Sequence
  Description of Artificial Sequence: Synthetic oligonucleotide
aaacgctcctactctaccggtgctaccaaag

SEQ ID NO: 234093 - DNA, 30 bp, Artificial Sequence
  Description of Artificial Sequence: Synthetic oligonucleotide
aacgctcctactctaccggtgctaccaaag

SEQ ID NO: 234094 - DNA, 29 bp, Artificial Sequence
  Description of Artificial Sequence: Synthetic oligonucleotide
acgctcctactctaccggtgctaccaaag

SEQ ID NO: 234095 - DNA, 28 bp, Artificial Sequence
  Description of Artificial Sequence: Synthetic oligonucleotide
cgctcctactctaccggtgctaccaaag

SEQ ID NO: 234096 - DNA, 29 bp, Artificial Sequence
  Description of Artificial Sequence: Synthetic oligonucleotide
gctcctactctaccggtgctaccaaagag

SEQ ID NO: 234097 - DNA, 29 bp, Artificial Sequence
  Description of Artificial Sequence: Synthetic oligonucleotide
ctcctactctaccggtgctaccaaagagg

SEQ ID NO: 234098 - DNA, 31 bp, Artificial Sequence
  Description of Artificial Sequence: Synthetic oligonucleotide
tcctactctaccggtgctaccaaagaggttc

SEQ ID NO: 234099 - DNA, 30 bp, Artificial Sequence
  Description of Artificial Sequence: Synthetic oligonucleotide
cctactctaccggtgctaccaaagaggttc

SEQ ID NO: 234100 - DNA, 30 bp, Artificial Sequence
  Description of Artificial Sequence: Synthetic oligonucleotide
ctactctaccggtgctaccaaagaggttcc

SEQ ID NO: 234101 - DNA, 31 bp, Artificial Sequence
  Description of Artificial Sequence: Synthetic oligonucleotide
tactctaccggtgctaccaaagaggttcctc

SEQ ID NO: 234102 - DNA, 30 bp, Artificial Sequence
  Description of Artificial Sequence: Synthetic oligonucleotide
actctaccggtgctaccaaagaggttcctc

SEQ ID NO: 234103 - DNA, 29 bp, Artificial Sequence
  Description of Artificial Sequence: Synthetic oligonucleotide
ctctaccggtgctaccaaagaggttcctc

SEQ ID NO: 234104 - DNA, 30 bp, Artificial Sequence
  Description of Artificial Sequence: Synthetic oligonucleotide
tctaccggtgctaccaaagaggttcctcag

SEQ ID NO: 234105 - DNA, 29 bp, Artificial Sequence
  Description of Artificial Sequence: Synthetic oligonucleotide
ctaccggtgctaccaaagaggttcctcag

SEQ ID NO: 234106 - DNA, 29 bp, Artificial Sequence
  Description of Artificial Sequence: Synthetic oligonucleotide
taccggtgctaccaaagaggttcctcagg

SEQ ID NO: 234107 - DNA, 28 bp, Artificial Sequence
  Description of Artificial Sequence: Synthetic oligonucleotide
accggtgctaccaaagaggttcctcagg

SEQ ID NO: 234108 - DNA, 27 bp, Artificial Sequence
  Description of Artificial Sequence: Synthetic oligonucleotide
ccggtgctaccaaagaggttcctcagg

SEQ ID NO: 234109 - DNA, 28 bp, Artificial Sequence
  Description of Artificial Sequence: Synthetic oligonucleotide
cggtgctaccaaagaggttcctcaggtc

SEQ ID NO: 234110 - DNA, 29 bp, Artificial Sequence
  Description of Artificial Sequence: Synthetic oligonucleotide
ggtgctaccaaagaggttcctcaggtcac

SEQ ID NO: 234111 - DNA, 30 bp, Artificial Sequence
  Description of Artificial Sequence: Synthetic oligonucleotide
gtgctaccaaagaggttcctcaggtcacag

SEQ ID NO: 234112 - DNA, 31 bp, Artificial Sequence
  Description of Artificial Sequence: Synthetic oligonucleotide
tgctaccaaagaggttcctcaggtcacagag

SEQ ID NO: 234113 - DNA, 30 bp, Artificial Sequence
  Description of Artificial Sequence: Synthetic oligonucleotide
gctaccaaagaggttcctcaggtcacagag

SEQ ID NO: 234114 - DNA, 34 bp, Artificial Sequence
  Description of Artificial Sequence: Synthetic oligonucleotide
ctaccaaagaggttcctcaggtcacagagttttc

SEQ ID NO: 234115 - DNA, 34 bp, Artificial Sequence
  Description of Artificial Sequence: Synthetic oligonucleotide
taccaaagaggttcctcaggtcacagagttttcc

SEQ ID NO: 234116 - DNA, 33 bp, Artificial Sequence
  Description of Artificial Sequence: Synthetic oligonucleotide
accaaagaggttcctcaggtcacagagttttcc

SEQ ID NO: 234117 - DNA, 32 bp, Artificial Sequence
  Description of Artificial Sequence: Synthetic oligonucleotide
ccaaagaggttcctcaggtcacagagttttcc

SEQ ID NO: 234118 - DNA, 34 bp, Artificial Sequence
  Description of Artificial Sequence: Synthetic oligonucleotide
caaagaggttcctcaggtcacagagttttccaac

SEQ ID NO: 234119 - DNA, 35 bp, Artificial Sequence
  Description of Artificial Sequence: Synthetic oligonucleotide
aaagaggttcctcaggtcacagagttttccaactc

SEQ ID NO: 234120 - DNA, 34 bp, Artificial Sequence
  Description of Artificial Sequence: Synthetic oligonucleotide
aagaggttcctcaggtcacagagttttccaactc

SEQ ID NO: 234121 - DNA, 33 bp, Artificial Sequence
  Description of Artificial Sequence: Synthetic oligonucleotide
agaggttcctcaggtcacagagttttccaactc

SEQ ID NO: 234122 - DNA, 32 bp, Artificial Sequence
  Description of Artificial Sequence: Synthetic oligonucleotide
gaggttcctcaggtcacagagttttccaactc

SEQ ID NO: 234123 - DNA, 33 bp, Artificial Sequence
  Description of Artificial Sequence: Synthetic oligonucleotide
aggttcctcaggtcacagagttttccaactctc

SEQ ID NO: 234124 - DNA, 32 bp, Artificial Sequence
  Description of Artificial Sequence: Synthetic oligonucleotide
ggttcctcaggtcacagagttttccaactctc

SEQ ID NO: 234125 - DNA, 32 bp, Artificial Sequence
  Description of Artificial Sequence: Synthetic oligonucleotide
gttcctcaggtcacagagttttccaactctcc

SEQ ID NO: 234126 - DNA, 32 bp, Artificial Sequence
  Description of Artificial Sequence: Synthetic oligonucleotide
ttcctcaggtcacagagttttccaactctccc

SEQ ID NO: 234127 - DNA, 31 bp, Artificial Sequence
  Description of Artificial Sequence: Synthetic oligonucleotide
tcctcaggtcacagagttttccaactctccc

SEQ ID NO: 234128 - DNA, 30 bp, Artificial Sequence
  Description of Artificial Sequence: Synthetic oligonucleotide
cctcaggtcacagagttttccaactctccc

SEQ ID NO: 234129 - DNA, 30 bp, Artificial Sequence
  Description of Artificial Sequence: Synthetic oligonucleotide
ctcaggtcacagagttttccaactctcccg

SEQ ID NO: 234130 - DNA, 31 bp, Artificial Sequence
  Description of Artificial Sequence: Synthetic oligonucleotide
tcaggtcacagagttttccaactctcccgtg

SEQ ID NO: 234131 - DNA, 30 bp, Artificial Sequence
  Description of Artificial Sequence: Synthetic oligonucleotide
caggtcacagagttttccaactctcccgtg

SEQ ID NO: 234132 - DNA, 31 bp, Artificial Sequence
  Description of Artificial Sequence: Synthetic oligonucleotide
aggtcacagagttttccaactctcccgtgtc

SEQ ID NO: 234133 - DNA, 30 bp, Artificial Sequence
  Description of Artificial Sequence: Synthetic oligonucleotide
ggtcacagagttttccaactctcccgtgtc

SEQ ID NO: 234134 - DNA, 31 bp, Artificial Sequence
  Description of Artificial Sequence: Synthetic oligonucleotide
gtcacagagttttccaactctcccgtgtcac

SEQ ID NO: 234135 - DNA, 32 bp, Artificial Sequence
  Description of Artificial Sequence: Synthetic oligonucleotide
tcacagagttttccaactctcccgtgtcactg

SEQ ID NO: 234136 - DNA, 31 bp, Artificial Sequence
  Description of Artificial Sequence: Synthetic oligonucleotide
cacagagttttccaactctcccgtgtcactg

SEQ ID NO: 234137 - DNA, 31 bp, Artificial Sequence
  Description of Artificial Sequence: Synthetic oligonucleotide
acagagttttccaactctcccgtgtcactgg

SEQ ID NO: 234138 - DNA, 30 bp, Artificial Sequence
  Description of Artificial Sequence: Synthetic oligonucleotide
cagagttttccaactctcccgtgtcactgg

SEQ ID NO: 234139 - DNA, 30 bp, Artificial Sequence
  Description of Artificial Sequence: Synthetic oligonucleotide
agagttttccaactctcccgtgtcactggg

SEQ ID NO: 234140 - DNA, 29 bp, Artificial Sequence
  Description of Artificial Sequence: Synthetic oligonucleotide
gagttttccaactctcccgtgtcactggg

SEQ ID NO: 234141 - DNA, 30 bp, Artificial Sequence
  Description of Artificial Sequence: Synthetic oligonucleotide
agttttccaactctcccgtgtcactgggtc

SEQ ID NO: 234142 - DNA, 29 bp, Artificial Sequence
  Description of Artificial Sequence: Synthetic oligonucleotide
gttttccaactctcccgtgtcactgggtc

SEQ ID NO: 234143 - DNA, 30 bp, Artificial Sequence
  Description of Artificial Sequence: Synthetic oligonucleotide
ttttccaactctcccgtgtcactgggtctg

SEQ ID NO: 234144 - DNA, 29 bp, Artificial Sequence
  Description of Artificial Sequence: Synthetic oligonucleotide
tttccaactctcccgtgtcactgggtctg

SEQ ID NO: 234145 - DNA, 28 bp, Artificial Sequence
  Description of Artificial Sequence: Synthetic oligonucleotide
ttccaactctcccgtgtcactgggtctg

SEQ ID NO: 234146 - DNA, 27 bp, Artificial Sequence
  Description of Artificial Sequence: Synthetic oligonucleotide
tccaactctcccgtgtcactgggtctg

SEQ ID NO: 234147 - DNA, 26 bp, Artificial Sequence
  Description of Artificial Sequence: Synthetic oligonucleotide
ccaactctcccgtgtcactgggtctg

SEQ ID NO: 234148 - DNA, 26 bp, Artificial Sequence
  Description of Artificial Sequence: Synthetic oligonucleotide
caactctcccgtgtcactgggtctgc

SEQ ID NO: 234149 - DNA, 26 bp, Artificial Sequence
  Description of Artificial Sequence: Synthetic oligonucleotide
aactctcccgtgtcactgggtctgcc

SEQ ID NO: 234150 - DNA, 25 bp, Artificial Sequence
  Description of Artificial Sequence: Synthetic oligonucleotide
actctcccgtgtcactgggtctgcc

SEQ ID NO: 234151 - DNA, 24 bp, Artificial Sequence
  Description of Artificial Sequence: Synthetic oligonucleotide
ctctcccgtgtcactgggtctgcc

SEQ ID NO: 234152 - DNA, 26 bp, Artificial Sequence
  Description of Artificial Sequence: Synthetic oligonucleotide
tctcccgtgtcactgggtctgcccaa

SEQ ID NO: 234153 - DNA, 25 bp, Artificial Sequence
  Description of Artificial Sequence: Synthetic oligonucleotide
ctcccgtgtcactgggtctgcccaa

SEQ ID NO: 234154 - DNA, 26 bp, Artificial Sequence
  Description of Artificial Sequence: Synthetic oligonucleotide
tcccgtgtcactgggtctgcccaaca

SEQ ID NO: 234155 - DNA, 25 bp, Artificial Sequence
  Description of Artificial Sequence: Synthetic oligonucleotide
cccgtgtcactgggtctgcccaaca

SEQ ID NO: 234156 - DNA, 25 bp, Artificial Sequence
  Description of Artificial Sequence: Synthetic oligonucleotide
ccgtgtcactgggtctgcccaacac

SEQ ID NO: 234157 - DNA, 25 bp, Artificial Sequence
  Description of Artificial Sequence: Synthetic oligonucleotide
cgtgtcactgggtctgcccaacacg

SEQ ID NO: 234158 - DNA, 26 bp, Artificial Sequence
  Description of Artificial Sequence: Synthetic oligonucleotide
gtgtcactgggtctgcccaacacgct

SEQ ID NO: 234159 - DNA, 27 bp, Artificial Sequence
  Description of Artificial Sequence: Synthetic oligonucleotide
tgtcactgggtctgcccaacacgctca

SEQ ID NO: 234160 - DNA, 27 bp, Artificial Sequence
  Description of Artificial Sequence: Synthetic oligonucleotide
gtcactgggtctgcccaacacgctcat

SEQ ID NO: 234161 - DNA, 27 bp, Artificial Sequence
  Description of Artificial Sequence: Synthetic oligonucleotide
tcactgggtctgcccaacacgctcatc

SEQ ID NO: 234162 - DNA, 27 bp, Artificial Sequence
  Description of Artificial Sequence: Synthetic oligonucleotide
cactgggtctgcccaacacgctcatct

SEQ ID NO: 234163 - DNA, 27 bp, Artificial Sequence
  Description of Artificial Sequence: Synthetic oligonucleotide
actgggtctgcccaacacgctcatctg

SEQ ID NO: 234164 - DNA, 27 bp, Artificial Sequence
  Description of Artificial Sequence: Synthetic oligonucleotide
ctgggtctgcccaacacgctcatctgt

SEQ ID NO: 234165 - DNA, 27 bp, Artificial Sequence
  Description of Artificial Sequence: Synthetic oligonucleotide
tgggtctgcccaacacgctcatctgtg

SEQ ID NO: 234166 - DNA, 27 bp, Artificial Sequence
  Description of Artificial Sequence: Synthetic oligonucleotide
gggtctgcccaacacgctcatctgtgt

SEQ ID NO: 234167 - DNA, 28 bp, Artificial Sequence
  Description of Artificial Sequence: Synthetic oligonucleotide
ggtctgcccaacacgctcatctgtgttg

SEQ ID NO: 234168 - DNA, 29 bp, Artificial Sequence
  Description of Artificial Sequence: Synthetic oligonucleotide
gtctgcccaacacgctcatctgtgttgtg

SEQ ID NO: 234169 - DNA, 29 bp, Artificial Sequence
  Description of Artificial Sequence: Synthetic oligonucleotide
tctgcccaacacgctcatctgtgttgtgg

SEQ ID NO: 234170 - DNA, 28 bp, Artificial Sequence
  Description of Artificial Sequence: Synthetic oligonucleotide
ctgcccaacacgctcatctgtgttgtgg

SEQ ID NO: 234171 - DNA, 29 bp, Artificial Sequence
  Description of Artificial Sequence: Synthetic oligonucleotide
tgcccaacacgctcatctgtgttgtggac

SEQ ID NO: 234172 - DNA, 28 bp, Artificial Sequence
  Description of Artificial Sequence: Synthetic oligonucleotide
gcccaacacgctcatctgtgttgtggac

SEQ ID NO: 234173 - DNA, 30 bp, Artificial Sequence
  Description of Artificial Sequence: Synthetic oligonucleotide
cccaacacgctcatctgtgttgtggacatc

SEQ ID NO: 234174 - DNA, 32 bp, Artificial Sequence
  Description of Artificial Sequence: Synthetic oligonucleotide
ccaacacgctcatctgtgttgtggacatcatc

SEQ ID NO: 234175 - DNA, 35 bp, Artificial Sequence
  Description of Artificial Sequence: Synthetic oligonucleotide
caacacgctcatctgtgttgtggacatcatctttc

SEQ ID NO: 234176 - DNA, 35 bp, Artificial Sequence
  Description of Artificial Sequence: Synthetic oligonucleotide
aacacgctcatctgtgttgtggacatcatctttcc

SEQ ID NO: 234177 - DNA, 34 bp, Artificial Sequence
  Description of Artificial Sequence: Synthetic oligonucleotide
acacgctcatctgtgttgtggacatcatctttcc

SEQ ID NO: 234178 - DNA, 33 bp, Artificial Sequence
  Description of Artificial Sequence: Synthetic oligonucleotide
cacgctcatctgtgttgtggacatcatctttcc

SEQ ID NO: 234179 - DNA, 34 bp, Artificial Sequence
  Description of Artificial Sequence: Synthetic oligonucleotide
acgctcatctgtgttgtggacatcatctttccac

SEQ ID NO: 234180 - DNA, 33 bp, Artificial Sequence
  Description of Artificial Sequence: Synthetic oligonucleotide
cgctcatctgtgttgtggacatcatctttccac

SEQ ID NO: 234181 - DNA, 33 bp, Artificial Sequence
  Description of Artificial Sequence: Synthetic oligonucleotide
gctcatctgtgttgtggacatcatctttccacc

SEQ ID NO: 234182 - DNA, 34 bp, Artificial Sequence
  Description of Artificial Sequence: Synthetic oligonucleotide
ctcatctgtgttgtggacatcatctttccacctg

SEQ ID NO: 234183 - DNA, 35 bp, Artificial Sequence
  Description of Artificial Sequence: Synthetic oligonucleotide
tcatctgtgttgtggacatcatctttccacctgtg

SEQ ID NO: 234184 - DNA, 34 bp, Artificial Sequence
  Description of Artificial Sequence: Synthetic oligonucleotide
catctgtgttgtggacatcatctttccacctgtg

SEQ ID NO: 234185 - DNA, 34 bp, Artificial Sequence
  Description of Artificial Sequence: Synthetic oligonucleotide
atctgtgttgtggacatcatctttccacctgtgg

SEQ ID NO: 234186 - DNA, 33 bp, Artificial Sequence
  Description of Artificial Sequence: Synthetic oligonucleotide
tctgtgttgtggacatcatctttccacctgtgg

SEQ ID NO: 234187 - DNA, 32 bp, Artificial Sequence
  Description of Artificial Sequence: Synthetic oligonucleotide
ctgtgttgtggacatcatctttccacctgtgg

SEQ ID NO: 234188 - DNA, 33 bp, Artificial Sequence
  Description of Artificial Sequence: Synthetic oligonucleotide
tgtgttgtggacatcatctttccacctgtggtc

SEQ ID NO: 234189 - DNA, 32 bp, Artificial Sequence
  Description of Artificial Sequence: Synthetic oligonucleotide
gtgttgtggacatcatctttccacctgtggtc

SEQ ID NO: 234190 - DNA, 34 bp, Artificial Sequence
  Description of Artificial Sequence: Synthetic oligonucleotide
tgttgtggacatcatctttccacctgtggtctac

SEQ ID NO: 234191 - DNA, 33 bp, Artificial Sequence
  Description of Artificial Sequence: Synthetic oligonucleotide
gttgtggacatcatctttccacctgtggtctac

SEQ ID NO: 234192 - DNA, 35 bp, Artificial Sequence
  Description of Artificial Sequence: Synthetic oligonucleotide
ttgtggacatcatctttccacctgtggtctacatc

SEQ ID NO: 234193 - DNA, 34 bp, Artificial Sequence
  Description of Artificial Sequence: Synthetic oligonucleotide
tgtggacatcatctttccacctgtggtctacatc

SEQ ID NO: 234194 - DNA, 33 bp, Artificial Sequence
  Description of Artificial Sequence: Synthetic oligonucleotide
gtggacatcatctttccacctgtggtctacatc

SEQ ID NO: 234195 - DNA, 34 bp, Artificial Sequence
  Description of Artificial Sequence: Synthetic oligonucleotide
tggacatcatctttccacctgtggtctacatcac

SEQ ID NO: 234196 - DNA, 33 bp, Artificial Sequence
  Description of Artificial Sequence: Synthetic oligonucleotide
ggacatcatctttccacctgtggtctacatcac

SEQ ID NO: 234197 - DNA, 35 bp, Artificial Sequence
  Description of Artificial Sequence: Synthetic oligonucleotide
gacatcatctttccacctgtggtctacatcacatc

SEQ ID NO: 234198 - DNA, 35 bp, Artificial Sequence
  Description of Artificial Sequence: Synthetic oligonucleotide
acatcatctttccacctgtggtctacatcacatcg

SEQ ID NO: 234199 - DNA, 34 bp, Artificial Sequence
  Description of Artificial Sequence: Synthetic oligonucleotide
catcatctttccacctgtggtctacatcacatcg

SEQ ID NO: 234200 - DNA, 34 bp, Artificial Sequence
  Description of Artificial Sequence: Synthetic oligonucleotide
atcatctttccacctgtggtctacatcacatcgc

SEQ ID NO: 234201 - DNA, 33 bp, Artificial Sequence
  Description of Artificial Sequence: Synthetic oligonucleotide
tcatctttccacctgtggtctacatcacatcgc

SEQ ID NO: 234202 - DNA, 32 bp, Artificial Sequence
  Description of Artificial Sequence: Synthetic oligonucleotide
catctttccacctgtggtctacatcacatcgc

SEQ ID NO: 234203 - DNA, 33 bp, Artificial Sequence
  Description of Artificial Sequence: Synthetic oligonucleotide
atctttccacctgtggtctacatcacatcgctg

SEQ ID NO: 234204 - DNA, 32 bp, Artificial Sequence
  Description of Artificial Sequence: Synthetic oligonucleotide
tctttccacctgtggtctacatcacatcgctg

SEQ ID NO: 234205 - DNA, 31 bp, Artificial Sequence
  Description of Artificial Sequence: Synthetic oligonucleotide
ctttccacctgtggtctacatcacatcgctg

SEQ ID NO: 234206 - DNA, 32 bp, Artificial Sequence
  Description of Artificial Sequence: Synthetic oligonucleotide
tttccacctgtggtctacatcacatcgctgag

SEQ ID NO: 234207 - DNA, 31 bp, Artificial Sequence
  Description of Artificial Sequence: Synthetic oligonucleotide
ttccacctgtggtctacatcacatcgctgag

SEQ ID NO: 234208 - DNA, 30 bp, Artificial Sequence
  Description of Artificial Sequence: Synthetic oligonucleotide
tccacctgtggtctacatcacatcgctgag

SEQ ID NO: 234209 - DNA, 29 bp, Artificial Sequence
  Description of Artificial Sequence: Synthetic oligonucleotide
ccacctgtggtctacatcacatcgctgag

SEQ ID NO: 234210 - DNA, 29 bp, Artificial Sequence
  Description of Artificial Sequence: Synthetic oligonucleotide
cacctgtggtctacatcacatcgctgagc

SEQ ID NO: 234211 - DNA, 32 bp, Artificial Sequence
  Description of Artificial Sequence: Synthetic oligonucleotide
acctgtggtctacatcacatcgctgagcaaag

SEQ ID NO: 234212 - DNA, 31 bp, Artificial Sequence
  Description of Artificial Sequence: Synthetic oligonucleotide
cctgtggtctacatcacatcgctgagcaaag

SEQ ID NO: 234213 - DNA, 31 bp, Artificial Sequence
  Description of Artificial Sequence: Synthetic oligonucleotide
ctgtggtctacatcacatcgctgagcaaagg

SEQ ID NO: 234214 - DNA, 31 bp, Artificial Sequence
  Description of Artificial Sequence: Synthetic oligonucleotide
tgtggtctacatcacatcgctgagcaaaggg

SEQ ID NO: 234215 - DNA, 30 bp, Artificial Sequence
  Description of Artificial Sequence: Synthetic oligonucleotide
gtggtctacatcacatcgctgagcaaaggg

SEQ ID NO: 234216 - DNA, 30 bp, Artificial Sequence
  Description of Artificial Sequence: Synthetic oligonucleotide
tggtctacatcacatcgctgagcaaagggc

SEQ ID NO: 234217 - DNA, 29 bp, Artificial Sequence
  Description of Artificial Sequence: Synthetic oligonucleotide
ggtctacatcacatcgctgagcaaagggc

SEQ ID NO: 234218 - DNA, 30 bp, Artificial Sequence
  Description of Artificial Sequence: Synthetic oligonucleotide
gtctacatcacatcgctgagcaaagggcac

SEQ ID NO: 234219 - DNA, 31 bp, Artificial Sequence
  Description of Artificial Sequence: Synthetic oligonucleotide
tctacatcacatcgctgagcaaagggcactc

SEQ ID NO: 234220 - DNA, 30 bp, Artificial Sequence
  Description of Artificial Sequence: Synthetic oligonucleotide
ctacatcacatcgctgagcaaagggcactc

SEQ ID NO: 234221 - DNA, 31 bp, Artificial Sequence
  Description of Artificial Sequence: Synthetic oligonucleotide
tacatcacatcgctgagcaaagggcactcac

SEQ ID NO: 234222 - DNA, 30 bp, Artificial Sequence
  Description of Artificial Sequence: Synthetic oligonucleotide
acatcacatcgctgagcaaagggcactcac

SEQ ID NO: 234223 - DNA, 29 bp, Artificial Sequence
  Description of Artificial Sequence: Synthetic oligonucleotide
catcacatcgctgagcaaagggcactcac

SEQ ID NO: 234224 - DNA, 30 bp, Artificial Sequence
  Description of Artificial Sequence: Synthetic oligonucleotide
atcacatcgctgagcaaagggcactcactc

SEQ ID NO: 234225 - DNA, 29 bp, Artificial Sequence
  Description of Artificial Sequence: Synthetic oligonucleotide
tcacatcgctgagcaaagggcactcactc

SEQ ID NO: 234226 - DNA, 28 bp, Artificial Sequence
  Description of Artificial Sequence: Synthetic oligonucleotide
cacatcgctgagcaaagggcactcactc

SEQ ID NO: 234227 - DNA, 29 bp, Artificial Sequence
  Description of Artificial Sequence: Synthetic oligonucleotide
acatcgctgagcaaagggcactcactcac

SEQ ID NO: 234228 - DNA, 28 bp, Artificial Sequence
  Description of Artificial Sequence: Synthetic oligonucleotide
catcgctgagcaaagggcactcactcac

SEQ ID NO: 234229 - DNA, 29 bp, Artificial Sequence
  Description of Artificial Sequence: Synthetic oligonucleotide
atcgctgagcaaagggcactcactcacag

SEQ ID NO: 234230 - DNA, 28 bp, Artificial Sequence
  Description of Artificial Sequence: Synthetic oligonucleotide
tcgctgagcaaagggcactcactcacag

SEQ ID NO: 234231 - DNA, 27 bp, Artificial Sequence
  Description of Artificial Sequence: Synthetic oligonucleotide
cgctgagcaaagggcactcactcacag

SEQ ID NO: 234232 - DNA, 29 bp, Artificial Sequence
  Description of Artificial Sequence: Synthetic oligonucleotide
gctgagcaaagggcactcactcacagaag

SEQ ID NO: 234233 - DNA, 29 bp, Artificial Sequence
  Description of Artificial Sequence: Synthetic oligonucleotide
ctgagcaaagggcactcactcacagaagc

SEQ ID NO: 234234 - DNA, 30 bp, Artificial Sequence
  Description of Artificial Sequence: Synthetic oligonucleotide
tgagcaaagggcactcactcacagaagctg

SEQ ID NO: 234235 - DNA, 29 bp, Artificial Sequence
  Description of Artificial Sequence: Synthetic oligonucleotide
gagcaaagggcactcactcacagaagctg

SEQ ID NO: 234236 - DNA, 32 bp, Artificial Sequence
  Description of Artificial Sequence: Synthetic oligonucleotide
agcaaagggcactcactcacagaagctgtttc

SEQ ID NO: 234237 - DNA, 31 bp, Artificial Sequence
  Description of Artificial Sequence: Synthetic oligonucleotide
gcaaagggcactcactcacagaagctgtttc

SEQ ID NO: 234238 - DNA, 32 bp, Artificial Sequence
  Description of Artificial Sequence: Synthetic oligonucleotide
caaagggcactcactcacagaagctgtttctg

SEQ ID NO: 234239 - DNA, 33 bp, Artificial Sequence
  Description of Artificial Sequence: Synthetic oligonucleotide
aaagggcactcactcacagaagctgtttctgac

SEQ ID NO: 234240 - DNA, 32 bp, Artificial Sequence
  Description of Artificial Sequence: Synthetic oligonucleotide
aagggcactcactcacagaagctgtttctgac

SEQ ID NO: 234241 - DNA, 31 bp, Artificial Sequence
  Description of Artificial Sequence: Synthetic oligonucleotide
agggcactcactcacagaagctgtttctgac

SEQ ID NO: 234242 - DNA, 30 bp, Artificial Sequence
  Description of Artificial Sequence: Synthetic oligonucleotide
gggcactcactcacagaagctgtttctgac

SEQ ID NO: 234243 - DNA, 31 bp, Artificial Sequence
  Description of Artificial Sequence: Synthetic oligonucleotide
ggcactcactcacagaagctgtttctgacac

SEQ ID NO: 234244 - DNA, 31 bp, Artificial Sequence
  Description of Artificial Sequence: Synthetic oligonucleotide
gcactcactcacagaagctgtttctgacacc

SEQ ID NO: 234245 - DNA, 32 bp, Artificial Sequence
  Description of Artificial Sequence: Synthetic oligonucleotide
cactcactcacagaagctgtttctgacaccag

SEQ ID NO: 234246 - DNA, 32 bp, Artificial Sequence
  Description of Artificial Sequence: Synthetic oligonucleotide
actcactcacagaagctgtttctgacaccagc

SEQ ID NO: 234247 - DNA, 31 bp, Artificial Sequence
  Description of Artificial Sequence: Synthetic oligonucleotide
ctcactcacagaagctgtttctgacaccagc

SEQ ID NO: 234248 - DNA, 33 bp, Artificial Sequence
  Description of Artificial Sequence: Synthetic oligonucleotide
tcactcacagaagctgtttctgacaccagcttc

SEQ ID NO: 234249 - DNA, 32 bp, Artificial Sequence
  Description of Artificial Sequence: Synthetic oligonucleotide
cactcacagaagctgtttctgacaccagcttc

SEQ ID NO: 234250 - DNA, 32 bp, Artificial Sequence
  Description of Artificial Sequence: Synthetic oligonucleotide
actcacagaagctgtttctgacaccagcttcg

SEQ ID NO: 234251 - DNA, 31 bp, Artificial Sequence
  Description of Artificial Sequence: Synthetic oligonucleotide
ctcacagaagctgtttctgacaccagcttcg

SEQ ID NO: 234252 - DNA, 32 bp, Artificial Sequence
  Description of Artificial Sequence: Synthetic oligonucleotide
tcacagaagctgtttctgacaccagcttcgtc

SEQ ID NO: 234253 - DNA, 31 bp, Artificial Sequence
  Description of Artificial Sequence: Synthetic oligonucleotide
cacagaagctgtttctgacaccagcttcgtc

SEQ ID NO: 234254 - DNA, 32 bp, Artificial Sequence
  Description of Artificial Sequence: Synthetic oligonucleotide
acagaagctgtttctgacaccagcttcgtctc

SEQ ID NO: 234255 - DNA, 31 bp, Artificial Sequence
  Description of Artificial Sequence: Synthetic oligonucleotide
cagaagctgtttctgacaccagcttcgtctc

SEQ ID NO: 234256 - DNA, 31 bp, Artificial Sequence
  Description of Artificial Sequence: Synthetic oligonucleotide
agaagctgtttctgacaccagcttcgtctcc

SEQ ID NO: 234257 - DNA, 30 bp, Artificial Sequence
  Description of Artificial Sequence: Synthetic oligonucleotide
gaagctgtttctgacaccagcttcgtctcc

SEQ ID NO: 234258 - DNA, 32 bp, Artificial Sequence
  Description of Artificial Sequence: Synthetic oligonucleotide
aagctgtttctgacaccagcttcgtctccaag

SEQ ID NO: 234259 - DNA, 31 bp, Artificial Sequence
  Description of Artificial Sequence: Synthetic oligonucleotide
agctgtttctgacaccagcttcgtctccaag

SEQ ID NO: 234260 - DNA, 30 bp, Artificial Sequence
  Description of Artificial Sequence: Synthetic oligonucleotide
gctgtttctgacaccagcttcgtctccaag

SEQ ID NO: 234261 - DNA, 31 bp, Artificial Sequence
  Description of Artificial Sequence: Synthetic oligonucleotide
ctgtttctgacaccagcttcgtctccaagac

SEQ ID NO: 234262 - DNA, 32 bp, Artificial Sequence
  Description of Artificial Sequence: Synthetic oligonucleotide
tgtttctgacaccagcttcgtctccaagactg

SEQ ID NO: 234263 - DNA, 31 bp, Artificial Sequence
  Description of Artificial Sequence: Synthetic oligonucleotide
gtttctgacaccagcttcgtctccaagactg

SEQ ID NO: 234264 - DNA, 33 bp, Artificial Sequence
  Description of Artificial Sequence: Synthetic oligonucleotide
tttctgacaccagcttcgtctccaagactgatc

SEQ ID NO: 234265 - DNA, 32 bp, Artificial Sequence
  Description of Artificial Sequence: Synthetic oligonucleotide
ttctgacaccagcttcgtctccaagactgatc

SEQ ID NO: 234266 - DNA, 31 bp, Artificial Sequence
  Description of Artificial Sequence: Synthetic oligonucleotide
tctgacaccagcttcgtctccaagactgatc

SEQ ID NO: 234267 - DNA, 30 bp, Artificial Sequence
  Description of Artificial Sequence: Synthetic oligonucleotide
ctgacaccagcttcgtctccaagactgatc

SEQ ID NO: 234268 - DNA, 33 bp, Artificial Sequence
  Description of Artificial Sequence: Synthetic oligonucleotide
tgacaccagcttcgtctccaagactgatcattc

SEQ ID NO: 234269 - DNA, 32 bp, Artificial Sequence
  Description of Artificial Sequence: Synthetic oligonucleotide
gacaccagcttcgtctccaagactgatcattc

SEQ ID NO: 234270 - DNA, 32 bp, Artificial Sequence
  Description of Artificial Sequence: Synthetic oligonucleotide
acaccagcttcgtctccaagactgatcattcg

SEQ ID NO: 234271 - DNA, 31 bp, Artificial Sequence
  Description of Artificial Sequence: Synthetic oligonucleotide
caccagcttcgtctccaagactgatcattcg

SEQ ID NO: 234272 - DNA, 33 bp, Artificial Sequence
  Description of Artificial Sequence: Synthetic oligonucleotide
accagcttcgtctccaagactgatcattcgttc

SEQ ID NO: 234273 - DNA, 32 bp, Artificial Sequence
  Description of Artificial Sequence: Synthetic oligonucleotide
ccagcttcgtctccaagactgatcattcgttc

SEQ ID NO: 234274 - DNA, 34 bp, Artificial Sequence
  Description of Artificial Sequence: Synthetic oligonucleotide
cagcttcgtctccaagactgatcattcgttcttc

SEQ ID NO: 234275 - DNA, 36 bp, Artificial Sequence
  Description of Artificial Sequence: Synthetic oligonucleotide
agcttcgtctccaagactgatcattcgttcttcaag

SEQ ID NO: 234276 - DNA, 35 bp, Artificial Sequence
  Description of Artificial Sequence: Synthetic oligonucleotide
gcttcgtctccaagactgatcattcgttcttcaag

SEQ ID NO: 234277 - DNA, 37 bp, Artificial Sequence
  Description of Artificial Sequence: Synthetic oligonucleotide
cttcgtctccaagactgatcattcgttcttcaagttc

SEQ ID NO: 234278 - DNA, 38 bp, Artificial Sequence
  Description of Artificial Sequence: Synthetic oligonucleotide
ttcgtctccaagactgatcattcgttcttcaagttcag

SEQ ID NO: 234279 - DNA, 37 bp, Artificial Sequence
  Description of Artificial Sequence: Synthetic oligonucleotide
tcgtctccaagactgatcattcgttcttcaagttcag

SEQ ID NO: 234280 - DNA, 36 bp, Artificial Sequence
  Description of Artificial Sequence: Synthetic oligonucleotide
cgtctccaagactgatcattcgttcttcaagttcag

SEQ ID NO: 234281 - DNA, 39 bp, Artificial Sequence
  Description of Artificial Sequence: Synthetic oligonucleotide
gtctccaagactgatcattcgttcttcaagttcagttac

SEQ ID NO: 234282 - DNA, 39 bp, Artificial Sequence
  Description of Artificial Sequence: Synthetic oligonucleotide
tctccaagactgatcattcgttcttcaagttcagttacc

SEQ ID NO: 234283 - DNA, 38 bp, Artificial Sequence
  Description of Artificial Sequence: Synthetic oligonucleotide
ctccaagactgatcattcgttcttcaagttcagttacc

SEQ ID NO: 234284 - DNA, 39 bp, Artificial Sequence
  Description of Artificial Sequence: Synthetic oligonucleotide
tccaagactgatcattcgttcttcaagttcagttaccac

SEQ ID NO: 234285 - DNA, 38 bp, Artificial Sequence
  Description of Artificial Sequence: Synthetic oligonucleotide
ccaagactgatcattcgttcttcaagttcagttaccac

SEQ ID NO: 234286 - DNA, 39 bp, Artificial Sequence
  Description of Artificial Sequence: Synthetic oligonucleotide
caagactgatcattcgttcttcaagttcagttaccacac

SEQ ID NO: 234287 - DNA, 39 bp, Artificial Sequence
  Description of Artificial Sequence: Synthetic oligonucleotide
aagactgatcattcgttcttcaagttcagttaccacacc

SEQ ID NO: 234288 - DNA, 38 bp, Artificial Sequence
  Description of Artificial Sequence: Synthetic oligonucleotide
agactgatcattcgttcttcaagttcagttaccacacc

SEQ ID NO: 234289 - DNA, 37 bp, Artificial Sequence
  Description of Artificial Sequence: Synthetic oligonucleotide
gactgatcattcgttcttcaagttcagttaccacacc

SEQ ID NO: 234290 - DNA, 39 bp, Artificial Sequence
  Description of Artificial Sequence: Synthetic oligonucleotide
actgatcattcgttcttcaagttcagttaccacaccttc

SEQ ID NO: 234291 - DNA, 38 bp, Artificial Sequence
  Description of Artificial Sequence: Synthetic oligonucleotide
ctgatcattcgttcttcaagttcagttaccacaccttc

SEQ ID NO: 234292 - DNA, 38 bp, Artificial Sequence
  Description of Artificial Sequence: Synthetic oligonucleotide
tgatcattcgttcttcaagttcagttaccacaccttcc

SEQ ID NO: 234293 - DNA, 37 bp, Artificial Sequence
  Description of Artificial Sequence: Synthetic oligonucleotide
gatcattcgttcttcaagttcagttaccacaccttcc

SEQ ID NO: 234294 - DNA, 38 bp, Artificial Sequence
  Description of Artificial Sequence: Synthetic oligonucleotide
atcattcgttcttcaagttcagttaccacaccttcctg

SEQ ID NO: 234295 - DNA, 37 bp, Artificial Sequence
  Description of Artificial Sequence: Synthetic oligonucleotide
tcattcgttcttcaagttcagttaccacaccttcctg

SEQ ID NO: 234296 - DNA, 36 bp, Artificial Sequence
  Description of Artificial Sequence: Synthetic oligonucleotide
cattcgttcttcaagttcagttaccacaccttcctg

SEQ ID NO: 234297 - DNA, 36 bp, Artificial Sequence
  Description of Artificial Sequence: Synthetic oligonucleotide
attcgttcttcaagttcagttaccacaccttcctgc

SEQ ID NO: 234298 - DNA, 35 bp, Artificial Sequence
  Description of Artificial Sequence: Synthetic oligonucleotide
ttcgttcttcaagttcagttaccacaccttcctgc

SEQ ID NO: 234299 - DNA, 34 bp, Artificial Sequence
  Description of Artificial Sequence: Synthetic oligonucleotide
tcgttcttcaagttcagttaccacaccttcctgc

SEQ ID NO: 234300 - DNA, 33 bp, Artificial Sequence
  Description of Artificial Sequence: Synthetic oligonucleotide
cgttcttcaagttcagttaccacaccttcctgc

SEQ ID NO: 234301 - DNA, 33 bp, Artificial Sequence
  Description of Artificial Sequence: Synthetic oligonucleotide
gttcttcaagttcagttaccacaccttcctgcc

SEQ ID NO: 234302 - DNA, 35 bp, Artificial Sequence
  Description of Artificial Sequence: Synthetic oligonucleotide
ttcttcaagttcagttaccacaccttcctgccttc

SEQ ID NO: 234303 - DNA, 34 bp, Artificial Sequence
  Description of Artificial Sequence: Synthetic oligonucleotide
tcttcaagttcagttaccacaccttcctgccttc

SEQ ID NO: 234304 - DNA, 33 bp, Artificial Sequence
  Description of Artificial Sequence: Synthetic oligonucleotide
cttcaagttcagttaccacaccttcctgccttc

SEQ ID NO: 234305 - DNA, 34 bp, Artificial Sequence
  Description of Artificial Sequence: Synthetic oligonucleotide
ttcaagttcagttaccacaccttcctgccttctg

SEQ ID NO: 234306 - DNA, 33 bp, Artificial Sequence
  Description of Artificial Sequence: Synthetic oligonucleotide
tcaagttcagttaccacaccttcctgccttctg

SEQ ID NO: 234307 - DNA, 32 bp, Artificial Sequence
  Description of Artificial Sequence: Synthetic oligonucleotide
caagttcagttaccacaccttcctgccttctg

SEQ ID NO: 234308 - DNA, 32 bp, Artificial Sequence
  Description of Artificial Sequence: Synthetic oligonucleotide
aagttcagttaccacaccttcctgccttctgc

SEQ ID NO: 234309 - DNA, 31 bp, Artificial Sequence
  Description of Artificial Sequence: Synthetic oligonucleotide
agttcagttaccacaccttcctgccttctgc

SEQ ID NO: 234310 - DNA, 30 bp, Artificial Sequence
  Description of Artificial Sequence: Synthetic oligonucleotide
gttcagttaccacaccttcctgccttctgc

SEQ ID NO: 234311 - DNA, 31 bp, Artificial Sequence
  Description of Artificial Sequence: Synthetic oligonucleotide
ttcagttaccacaccttcctgccttctgctc

SEQ ID NO: 234312 - DNA, 30 bp, Artificial Sequence
  Description of Artificial Sequence: Synthetic oligonucleotide
tcagttaccacaccttcctgccttctgctc

SEQ ID NO: 234313 - DNA, 29 bp, Artificial Sequence
  Description of Artificial Sequence: Synthetic oligonucleotide
cagttaccacaccttcctgccttctgctc

SEQ ID NO: 234314 - DNA, 31 bp, Artificial Sequence
  Description of Artificial Sequence: Synthetic oligonucleotide
agttaccacaccttcctgccttctgctcatg

SEQ ID NO: 234315 - DNA, 30 bp, Artificial Sequence
  Description of Artificial Sequence: Synthetic oligonucleotide
gttaccacaccttcctgccttctgctcatg

SEQ ID NO: 234316 - DNA, 31 bp, Artificial Sequence
  Description of Artificial Sequence: Synthetic oligonucleotide
ttaccacaccttcctgccttctgctcatgag

SEQ ID NO: 234317 - DNA, 30 bp, Artificial Sequence
  Description of Artificial Sequence: Synthetic oligonucleotide
taccacaccttcctgccttctgctcatgag

SEQ ID NO: 234318 - DNA, 29 bp, Artificial Sequence
  Description of Artificial Sequence: Synthetic oligonucleotide
accacaccttcctgccttctgctcatgag

SEQ ID NO: 234319 - DNA, 28 bp, Artificial Sequence
  Description of Artificial Sequence: Synthetic oligonucleotide
ccacaccttcctgccttctgctcatgag

SEQ ID NO: 234320 - DNA, 34 bp, Artificial Sequence
  Description of Artificial Sequence: Synthetic oligonucleotide
cacaccttcctgccttctgctcatgagatttttg

SEQ ID NO: 234321 - DNA, 35 bp, Artificial Sequence
  Description of Artificial Sequence: Synthetic oligonucleotide
acaccttcctgccttctgctcatgagatttttgac

SEQ ID NO: 234322 - DNA, 34 bp, Artificial Sequence
  Description of Artificial Sequence: Synthetic oligonucleotide
caccttcctgccttctgctcatgagatttttgac

SEQ ID NO: 234323 - DNA, 35 bp, Artificial Sequence
  Description of Artificial Sequence: Synthetic oligonucleotide
accttcctgccttctgctcatgagatttttgactg

SEQ ID NO: 234324 - DNA, 34 bp, Artificial Sequence
  Description of Artificial Sequence: Synthetic oligonucleotide
ccttcctgccttctgctcatgagatttttgactg

SEQ ID NO: 234325 - DNA, 34 bp, Artificial Sequence
  Description of Artificial Sequence: Synthetic oligonucleotide
cttcctgccttctgctcatgagatttttgactgc

SEQ ID NO: 234326 - DNA, 36 bp, Artificial Sequence
  Description of Artificial Sequence: Synthetic oligonucleotide
ttcctgccttctgctcatgagatttttgactgcaac

SEQ ID NO: 234327 - DNA, 35 bp, Artificial Sequence
  Description of Artificial Sequence: Synthetic oligonucleotide
tcctgccttctgctcatgagatttttgactgcaac

SEQ ID NO: 234328 - DNA, 34 bp, Artificial Sequence
  Description of Artificial Sequence: Synthetic oligonucleotide
cctgccttctgctcatgagatttttgactgcaac

SEQ ID NO: 234329 - DNA, 34 bp, Artificial Sequence
  Description of Artificial Sequence: Synthetic oligonucleotide
ctgccttctgctcatgagatttttgactgcaacg

SEQ ID NO: 234330 - DNA, 35 bp, Artificial Sequence
  Description of Artificial Sequence: Synthetic oligonucleotide
tgccttctgctcatgagatttttgactgcaacgtg

SEQ ID NO: 234331 - DNA, 34 bp, Artificial Sequence
  Description of Artificial Sequence: Synthetic oligonucleotide
gccttctgctcatgagatttttgactgcaacgtg

SEQ ID NO: 234332 - DNA, 34 bp, Artificial Sequence
  Description of Artificial Sequence: Synthetic oligonucleotide
ccttctgctcatgagatttttgactgcaacgtgg

SEQ ID NO: 234333 - DNA, 35 bp, Artificial Sequence
  Description of Artificial Sequence: Synthetic oligonucleotide
cttctgctcatgagatttttgactgcaacgtggag

SEQ ID NO: 234334 - DNA, 35 bp, Artificial Sequence
  Description of Artificial Sequence: Synthetic oligonucleotide
ttctgctcatgagatttttgactgcaacgtggagc

SEQ ID NO: 234335 - DNA, 34 bp, Artificial Sequence
  Description of Artificial Sequence: Synthetic oligonucleotide
tctgctcatgagatttttgactgcaacgtggagc

SEQ ID NO: 234336 - DNA, 33 bp, Artificial Sequence
  Description of Artificial Sequence: Synthetic oligonucleotide
ctgctcatgagatttttgactgcaacgtggagc

SEQ ID NO: 234337 - DNA, 34 bp, Artificial Sequence
  Description of Artificial Sequence: Synthetic oligonucleotide
tgctcatgagatttttgactgcaacgtggagcac

SEQ ID NO: 234338 - DNA, 33 bp, Artificial Sequence
  Description of Artificial Sequence: Synthetic oligonucleotide
gctcatgagatttttgactgcaacgtggagcac

SEQ ID NO: 234339 - DNA, 34 bp, Artificial Sequence
  Description of Artificial Sequence: Synthetic oligonucleotide
ctcatgagatttttgactgcaacgtggagcacag

SEQ ID NO: 234340 - DNA, 34 bp, Artificial Sequence
  Description of Artificial Sequence: Synthetic oligonucleotide
tcatgagatttttgactgcaacgtggagcacagg

SEQ ID NO: 234341 - DNA, 33 bp, Artificial Sequence
  Description of Artificial Sequence: Synthetic oligonucleotide
catgagatttttgactgcaacgtggagcacagg

SEQ ID NO: 234342 - DNA, 33 bp, Artificial Sequence
  Description of Artificial Sequence: Synthetic oligonucleotide
atgagatttttgactgcaacgtggagcacaggg

SEQ ID NO: 234343 - DNA, 32 bp, Artificial Sequence
  Description of Artificial Sequence: Synthetic oligonucleotide
tgagatttttgactgcaacgtggagcacaggg

SEQ ID NO: 234344 - DNA, 31 bp, Artificial Sequence
  Description of Artificial Sequence: Synthetic oligonucleotide
gagatttttgactgcaacgtggagcacaggg

SEQ ID NO: 234345 - DNA, 31 bp, Artificial Sequence
  Description of Artificial Sequence: Synthetic oligonucleotide
agatttttgactgcaacgtggagcacagggg

SEQ ID NO: 234346 - DNA, 30 bp, Artificial Sequence
  Description of Artificial Sequence: Synthetic oligonucleotide
gatttttgactgcaacgtggagcacagggg

SEQ ID NO: 234347 - DNA, 30 bp, Artificial Sequence
  Description of Artificial Sequence: Synthetic oligonucleotide
atttttgactgcaacgtggagcacaggggc

SEQ ID NO: 234348 - DNA, 29 bp, Artificial Sequence
  Description of Artificial Sequence: Synthetic oligonucleotide
tttttgactgcaacgtggagcacaggggc

SEQ ID NO: 234349 - DNA, 28 bp, Artificial Sequence
  Description of Artificial Sequence: Synthetic oligonucleotide
ttttgactgcaacgtggagcacaggggc

SEQ ID NO: 234350 - DNA, 27 bp, Artificial Sequence
  Description of Artificial Sequence: Synthetic oligonucleotide
tttgactgcaacgtggagcacaggggc

SEQ ID NO: 234351 - DNA, 26 bp, Artificial Sequence
  Description of Artificial Sequence: Synthetic oligonucleotide
ttgactgcaacgtggagcacaggggc

SEQ ID NO: 234352 - DNA, 25 bp, Artificial Sequence
  Description of Artificial Sequence: Synthetic oligonucleotide
tgactgcaacgtggagcacaggggc

SEQ ID NO: 234353 - DNA, 24 bp, Artificial Sequence
  Description of Artificial Sequence: Synthetic oligonucleotide
gactgcaacgtggagcacaggggc

SEQ ID NO: 234354 - DNA, 25 bp, Artificial Sequence
  Description of Artificial Sequence: Synthetic oligonucleotide
actgcaacgtggagcacaggggcct

SEQ ID NO: 234355 - DNA, 24 bp, Artificial Sequence
  Description of Artificial Sequence: Synthetic oligonucleotide
ctgcaacgtggagcacaggggcct

SEQ ID NO: 234356 - DNA, 24 bp, Artificial Sequence
  Description of Artificial Sequence: Synthetic oligonucleotide
tgcaacgtggagcacaggggcctg

SEQ ID NO: 234357 - DNA, 23 bp, Artificial Sequence
  Description of Artificial Sequence: Synthetic oligonucleotide
gcaacgtggagcacaggggcctg

SEQ ID NO: 234358 - DNA, 24 bp, Artificial Sequence
  Description of Artificial Sequence: Synthetic oligonucleotide
caacgtggagcacaggggcctggt

SEQ ID NO: 234359 - DNA, 24 bp, Artificial Sequence
  Description of Artificial Sequence: Synthetic oligonucleotide
aacgtggagcacaggggcctggtc

SEQ ID NO: 234360 - DNA, 23 bp, Artificial Sequence
  Description of Artificial Sequence: Synthetic oligonucleotide
acgtggagcacaggggcctggtc

SEQ ID NO: 234361 - DNA, 22 bp, Artificial Sequence
  Description of Artificial Sequence: Synthetic oligonucleotide
cgtggagcacaggggcctggtc

SEQ ID NO: 234362 - DNA, 23 bp, Artificial Sequence
  Description of Artificial Sequence: Synthetic oligonucleotide
gtggagcacaggggcctggtcca

SEQ ID NO: 234363 - DNA, 23 bp, Artificial Sequence
  Description of Artificial Sequence: Synthetic oligonucleotide
tggagcacaggggcctggtccag

SEQ ID NO: 234364 - DNA, 22 bp, Artificial Sequence
  Description of Artificial Sequence: Synthetic oligonucleotide
ggagcacaggggcctggtccag

SEQ ID NO: 234365 - DNA, 22 bp, Artificial Sequence
  Description of Artificial Sequence: Synthetic oligonucleotide
gagcacaggggcctggtccagc

SEQ ID NO: 234366 - DNA, 23 bp, Artificial Sequence
  Description of Artificial Sequence: Synthetic oligonucleotide
agcacaggggcctggtccagcct

SEQ ID NO: 234367 - DNA, 22 bp, Artificial Sequence
  Description of Artificial Sequence: Synthetic oligonucleotide
gcacaggggcctggtccagcct

SEQ ID NO: 234368 - DNA, 24 bp, Artificial Sequence
  Description of Artificial Sequence: Synthetic oligonucleotide
cacaggggcctggtccagcctcta

SEQ ID NO: 234369 - DNA, 25 bp, Artificial Sequence
  Description of Artificial Sequence: Synthetic oligonucleotide
acaggggcctggtccagcctctact

SEQ ID NO: 234370 - DNA, 24 bp, Artificial Sequence
  Description of Artificial Sequence: Synthetic oligonucleotide
caggggcctggtccagcctctact

SEQ ID NO: 234371 - DNA, 27 bp, Artificial Sequence
  Description of Artificial Sequence: Synthetic oligonucleotide
aggggcctggtccagcctctactgaaa

SEQ ID NO: 234372 - DNA, 26 bp, Artificial Sequence
  Description of Artificial Sequence: Synthetic oligonucleotide
ggggcctggtccagcctctactgaaa

SEQ ID NO: 234373 - DNA, 27 bp, Artificial Sequence
  Description of Artificial Sequence: Synthetic oligonucleotide
gggcctggtccagcctctactgaaaca

SEQ ID NO: 234374 - DNA, 27 bp, Artificial Sequence
  Description of Artificial Sequence: Synthetic oligonucleotide
ggcctggtccagcctctactgaaacac

SEQ ID NO: 234375 - DNA, 28 bp, Artificial Sequence
  Description of Artificial Sequence: Synthetic oligonucleotide
gcctggtccagcctctactgaaacacag

SEQ ID NO: 234376 - DNA, 28 bp, Artificial Sequence
  Description of Artificial Sequence: Synthetic oligonucleotide
cctggtccagcctctactgaaacacagg

SEQ ID NO: 234377 - DNA, 28 bp, Artificial Sequence
  Description of Artificial Sequence: Synthetic oligonucleotide
ctggtccagcctctactgaaacacaggg

SEQ ID NO: 234378 - DNA, 29 bp, Artificial Sequence
  Description of Artificial Sequence: Synthetic oligonucleotide
tggtccagcctctactgaaacacagggag

SEQ ID NO: 234379 - DNA, 28 bp, Artificial Sequence
  Description of Artificial Sequence: Synthetic oligonucleotide
ggtccagcctctactgaaacacagggag

SEQ ID NO: 234380 - DNA, 28 bp, Artificial Sequence
  Description of Artificial Sequence: Synthetic oligonucleotide
gtccagcctctactgaaacacagggagc

SEQ ID NO: 234381 - DNA, 28 bp, Artificial Sequence
  Description of Artificial Sequence: Synthetic oligonucleotide
tccagcctctactgaaacacagggagcc

SEQ ID NO: 234382 - DNA, 27 bp, Artificial Sequence
  Description of Artificial Sequence: Synthetic oligonucleotide
ccagcctctactgaaacacagggagcc

SEQ ID NO: 234383 - DNA, 28 bp, Artificial Sequence
  Description of Artificial Sequence: Synthetic oligonucleotide
cagcctctactgaaacacagggagcctg

SEQ ID NO: 234384 - DNA, 29 bp, Artificial Sequence
  Description of Artificial Sequence: Synthetic oligonucleotide
agcctctactgaaacacagggagcctgtg

SEQ ID NO: 234385 - DNA, 28 bp, Artificial Sequence
  Description of Artificial Sequence: Synthetic oligonucleotide
gcctctactgaaacacagggagcctgtg

SEQ ID NO: 234386 - DNA, 31 bp, Artificial Sequence
  Description of Artificial Sequence: Synthetic oligonucleotide
cctctactgaaacacagggagcctgtgattc

SEQ ID NO: 234387 - DNA, 31 bp, Artificial Sequence
  Description of Artificial Sequence: Synthetic oligonucleotide
ctctactgaaacacagggagcctgtgattcc

SEQ ID NO: 234388 - DNA, 32 bp, Artificial Sequence
  Description of Artificial Sequence: Synthetic oligonucleotide
tctactgaaacacagggagcctgtgattccag

SEQ ID NO: 234389 - DNA, 31 bp, Artificial Sequence
  Description of Artificial Sequence: Synthetic oligonucleotide
ctactgaaacacagggagcctgtgattccag

SEQ ID NO: 234390 - DNA, 31 bp, Artificial Sequence
  Description of Artificial Sequence: Synthetic oligonucleotide
tactgaaacacagggagcctgtgattccagg

SEQ ID NO: 234391 - DNA, 30 bp, Artificial Sequence
  Description of Artificial Sequence: Synthetic oligonucleotide
actgaaacacagggagcctgtgattccagg

SEQ ID NO: 234392 - DNA, 29 bp, Artificial Sequence
  Description of Artificial Sequence: Synthetic oligonucleotide
ctgaaacacagggagcctgtgattccagg

SEQ ID NO: 234393 - DNA, 29 bp, Artificial Sequence
  Description of Artificial Sequence: Synthetic oligonucleotide
tgaaacacagggagcctgtgattccaggc

SEQ ID NO: 234394 - DNA, 28 bp, Artificial Sequence
  Description of Artificial Sequence: Synthetic oligonucleotide
gaaacacagggagcctgtgattccaggc

SEQ ID NO: 234395 - DNA, 28 bp, Artificial Sequence
  Description of Artificial Sequence: Synthetic oligonucleotide
aaacacagggagcctgtgattccaggcc

SEQ ID NO: 234396 - DNA, 27 bp, Artificial Sequence
  Description of Artificial Sequence: Synthetic oligonucleotide
aacacagggagcctgtgattccaggcc

SEQ ID NO: 234397 - DNA, 26 bp, Artificial Sequence
  Description of Artificial Sequence: Synthetic oligonucleotide
acacagggagcctgtgattccaggcc

SEQ ID NO: 234398 - DNA, 25 bp, Artificial Sequence
  Description of Artificial Sequence: Synthetic oligonucleotide
cacagggagcctgtgattccaggcc

SEQ ID NO: 234399 - DNA, 27 bp, Artificial Sequence
  Description of Artificial Sequence: Synthetic oligonucleotide
acagggagcctgtgattccaggcccta

SEQ ID NO: 234400 - DNA, 27 bp, Artificial Sequence
  Description of Artificial Sequence: Synthetic oligonucleotide
cagggagcctgtgattccaggccctat

SEQ ID NO: 234401 - DNA, 27 bp, Artificial Sequence
  Description of Artificial Sequence: Synthetic oligonucleotide
agggagcctgtgattccaggccctatg

SEQ ID NO: 234402 - DNA, 27 bp, Artificial Sequence
  Description of Artificial Sequence: Synthetic oligonucleotide
gggagcctgtgattccaggccctatgt

SEQ ID NO: 234403 - DNA, 27 bp, Artificial Sequence
  Description of Artificial Sequence: Synthetic oligonucleotide
ggagcctgtgattccaggccctatgtc

SEQ ID NO: 234404 - DNA, 28 bp, Artificial Sequence
  Description of Artificial Sequence: Synthetic oligonucleotide
gagcctgtgattccaggccctatgtcac

SEQ ID NO: 234405 - DNA, 29 bp, Artificial Sequence
  Description of Artificial Sequence: Synthetic oligonucleotide
agcctgtgattccaggccctatgtcacag

SEQ ID NO: 234406 - DNA, 28 bp, Artificial Sequence
  Description of Artificial Sequence: Synthetic oligonucleotide
gcctgtgattccaggccctatgtcacag

SEQ ID NO: 234407 - DNA, 28 bp, Artificial Sequence
  Description of Artificial Sequence: Synthetic oligonucleotide
cctgtgattccaggccctatgtcacagc

SEQ ID NO: 234408 - DNA, 29 bp, Artificial Sequence
  Description of Artificial Sequence: Synthetic oligonucleotide
ctgtgattccaggccctatgtcacagctc

SEQ ID NO: 234409 - DNA, 30 bp, Artificial Sequence
  Description of Artificial Sequence: Synthetic oligonucleotide
tgtgattccaggccctatgtcacagctcac

SEQ ID NO: 234410 - DNA, 29 bp, Artificial Sequence
  Description of Artificial Sequence: Synthetic oligonucleotide
gtgattccaggccctatgtcacagctcac

SEQ ID NO: 234411 - DNA, 30 bp, Artificial Sequence
  Description of Artificial Sequence: Synthetic oligonucleotide
tgattccaggccctatgtcacagctcacag

SEQ ID NO: 234412 - DNA, 29 bp, Artificial Sequence
  Description of Artificial Sequence: Synthetic oligonucleotide
gattccaggccctatgtcacagctcacag

SEQ ID NO: 234413 - DNA, 30 bp, Artificial Sequence
  Description of Artificial Sequence: Synthetic oligonucleotide
attccaggccctatgtcacagctcacagtg

SEQ ID NO: 234414 - DNA, 29 bp, Artificial Sequence
  Description of Artificial Sequence: Synthetic oligonucleotide
ttccaggccctatgtcacagctcacagtg

SEQ ID NO: 234415 - DNA, 28 bp, Artificial Sequence
  Description of Artificial Sequence: Synthetic oligonucleotide
tccaggccctatgtcacagctcacagtg

SEQ ID NO: 234416 - DNA, 27 bp, Artificial Sequence
  Description of Artificial Sequence: Synthetic oligonucleotide
ccaggccctatgtcacagctcacagtg

SEQ ID NO: 234417 - DNA, 28 bp, Artificial Sequence
  Description of Artificial Sequence: Synthetic oligonucleotide
caggccctatgtcacagctcacagtgac

SEQ ID NO: 234418 - DNA, 29 bp, Artificial Sequence
  Description of Artificial Sequence: Synthetic oligonucleotide
aggccctatgtcacagctcacagtgactg

SEQ ID NO: 234419 - DNA, 28 bp, Artificial Sequence
  Description of Artificial Sequence: Synthetic oligonucleotide
ggccctatgtcacagctcacagtgactg

SEQ ID NO: 234420 - DNA, 29 bp, Artificial Sequence
  Description of Artificial Sequence: Synthetic oligonucleotide
gccctatgtcacagctcacagtgactgtg

SEQ ID NO: 234421 - DNA, 29 bp, Artificial Sequence
  Description of Artificial Sequence: Synthetic oligonucleotide
ccctatgtcacagctcacagtgactgtgg

SEQ ID NO: 234422 - DNA, 30 bp, Artificial Sequence
  Description of Artificial Sequence: Synthetic oligonucleotide
cctatgtcacagctcacagtgactgtggtg

SEQ ID NO: 234423 - DNA, 31 bp, Artificial Sequence
  Description of Artificial Sequence: Synthetic oligonucleotide
ctatgtcacagctcacagtgactgtggtgtg

SEQ ID NO: 234424 - DNA, 31 bp, Artificial Sequence
  Description of Artificial Sequence: Synthetic oligonucleotide
tatgtcacagctcacagtgactgtggtgtgc

SEQ ID NO: 234425 - DNA, 30 bp, Artificial Sequence
  Description of Artificial Sequence: Synthetic oligonucleotide
atgtcacagctcacagtgactgtggtgtgc

SEQ ID NO: 234426 - DNA, 29 bp, Artificial Sequence
  Description of Artificial Sequence: Synthetic oligonucleotide
tgtcacagctcacagtgactgtggtgtgc

SEQ ID NO: 234427 - DNA, 28 bp, Artificial Sequence
  Description of Artificial Sequence: Synthetic oligonucleotide
gtcacagctcacagtgactgtggtgtgc

SEQ ID NO: 234428 - DNA, 28 bp, Artificial Sequence
  Description of Artificial Sequence: Synthetic oligonucleotide
tcacagctcacagtgactgtggtgtgcg

SEQ ID NO: 234429 - DNA, 27 bp, Artificial Sequence
  Description of Artificial Sequence: Synthetic oligonucleotide
cacagctcacagtgactgtggtgtgcg

SEQ ID NO: 234430 - DNA, 27 bp, Artificial Sequence
  Description of Artificial Sequence: Synthetic oligonucleotide
acagctcacagtgactgtggtgtgcgc

SEQ ID NO: 234431 - DNA, 26 bp, Artificial Sequence
  Description of Artificial Sequence: Synthetic oligonucleotide
cagctcacagtgactgtggtgtgcgc

SEQ ID NO: 234432 - DNA, 26 bp, Artificial Sequence
  Description of Artificial Sequence: Synthetic oligonucleotide
agctcacagtgactgtggtgtgcgcc

SEQ ID NO: 234433 - DNA, 25 bp, Artificial Sequence
  Description of Artificial Sequence: Synthetic oligonucleotide
gctcacagtgactgtggtgtgcgcc

SEQ ID NO: 234434 - DNA, 26 bp, Artificial Sequence
  Description of Artificial Sequence: Synthetic oligonucleotide
ctcacagtgactgtggtgtgcgccct

SEQ ID NO: 234435 - DNA, 26 bp, Artificial Sequence
  Description of Artificial Sequence: Synthetic oligonucleotide
tcacagtgactgtggtgtgcgccctg

SEQ ID NO: 234436 - DNA, 25 bp, Artificial Sequence
  Description of Artificial Sequence: Synthetic oligonucleotide
cacagtgactgtggtgtgcgccctg

SEQ ID NO: 234437 - DNA, 25 bp, Artificial Sequence
  Description of Artificial Sequence: Synthetic oligonucleotide
acagtgactgtggtgtgcgccctgc

SEQ ID NO: 234438 - DNA, 24 bp, Artificial Sequence
  Description of Artificial Sequence: Synthetic oligonucleotide
cagtgactgtggtgtgcgccctgc

SEQ ID NO: 234439 - DNA, 24 bp, Artificial Sequence
  Description of Artificial Sequence: Synthetic oligonucleotide
agtgactgtggtgtgcgccctgcg

SEQ ID NO: 234440 - DNA, 23 bp, Artificial Sequence
  Description of Artificial Sequence: Synthetic oligonucleotide
gtgactgtggtgtgcgccctgcg

SEQ ID NO: 234441 - DNA, 25 bp, Artificial Sequence
  Description of Artificial Sequence: Synthetic oligonucleotide
tgactgtggtgtgcgccctgcggtt

SEQ ID NO: 234442 - DNA, 24 bp, Artificial Sequence
  Description of Artificial Sequence: Synthetic oligonucleotide
gactgtggtgtgcgccctgcggtt

SEQ ID NO: 234443 - DNA, 25 bp, Artificial Sequence
  Description of Artificial Sequence: Synthetic oligonucleotide
actgtggtgtgcgccctgcggttgt

SEQ ID NO: 234444 - DNA, 24 bp, Artificial Sequence
  Description of Artificial Sequence: Synthetic oligonucleotide
ctgtggtgtgcgccctgcggttgt

SEQ ID NO: 234445 - DNA, 25 bp, Artificial Sequence
  Description of Artificial Sequence: Synthetic oligonucleotide
tgtggtgtgcgccctgcggttgtct

SEQ ID NO: 234446 - DNA, 24 bp, Artificial Sequence
  Description of Artificial Sequence: Synthetic oligonucleotide
gtggtgtgcgccctgcggttgtct

SEQ ID NO: 234447 - DNA, 25 bp, Artificial Sequence
  Description of Artificial Sequence: Synthetic oligonucleotide
tggtgtgcgccctgcggttgtctga

SEQ ID NO: 234448 - DNA, 24 bp, Artificial Sequence
  Description of Artificial Sequence: Synthetic oligonucleotide
ggtgtgcgccctgcggttgtctga

SEQ ID NO: 234449 - DNA, 24 bp, Artificial Sequence
  Description of Artificial Sequence: Synthetic oligonucleotide
gtgtgcgccctgcggttgtctgag

SEQ ID NO: 234450 - DNA, 24 bp, Artificial Sequence
  Description of Artificial Sequence: Synthetic oligonucleotide
tgtgcgccctgcggttgtctgagg

SEQ ID NO: 234451 - DNA, 23 bp, Artificial Sequence
  Description of Artificial Sequence: Synthetic oligonucleotide
gtgcgccctgcggttgtctgagg

SEQ ID NO: 234452 - DNA, 23 bp, Artificial Sequence
  Description of Artificial Sequence: Synthetic oligonucleotide
tgcgccctgcggttgtctgaggg

SEQ ID NO: 234453 - DNA, 22 bp, Artificial Sequence
  Description of Artificial Sequence: Synthetic oligonucleotide
gcgccctgcggttgtctgaggg

SEQ ID NO: 234454 - DNA, 22 bp, Artificial Sequence
  Description of Artificial Sequence: Synthetic oligonucleotide
cgccctgcggttgtctgagggc

SEQ ID NO: 234455 - DNA, 23 bp, Artificial Sequence
  Description of Artificial Sequence: Synthetic oligonucleotide
gccctgcggttgtctgagggcct

SEQ ID NO: 234456 - DNA, 23 bp, Artificial Sequence
  Description of Artificial Sequence: Synthetic oligonucleotide
ccctgcggttgtctgagggcctc

SEQ ID NO: 234457 - DNA, 24 bp, Artificial Sequence
  Description of Artificial Sequence: Synthetic oligonucleotide
cctgcggttgtctgagggcctcgt

SEQ ID NO: 234458 - DNA, 24 bp, Artificial Sequence
  Description of Artificial Sequence: Synthetic oligonucleotide
ctgcggttgtctgagggcctcgtc

SEQ ID NO: 234459 - DNA, 24 bp, Artificial Sequence
  Description of Artificial Sequence: Synthetic oligonucleotide
tgcggttgtctgagggcctcgtcg

SEQ ID NO: 234460 - DNA, 23 bp, Artificial Sequence
  Description of Artificial Sequence: Synthetic oligonucleotide
gcggttgtctgagggcctcgtcg

SEQ ID NO: 234461 - DNA, 23 bp, Artificial Sequence
  Description of Artificial Sequence: Synthetic oligonucleotide
cggttgtctgagggcctcgtcgg

SEQ ID NO: 234462 - DNA, 26 bp, Artificial Sequence
  Description of Artificial Sequence: Synthetic oligonucleotide
ggttgtctgagggcctcgtcggcatt

SEQ ID NO: 234463 - DNA, 27 bp, Artificial Sequence
  Description of Artificial Sequence: Synthetic oligonucleotide
gttgtctgagggcctcgtcggcattgt

SEQ ID NO: 234464 - DNA, 27 bp, Artificial Sequence
  Description of Artificial Sequence: Synthetic oligonucleotide
ttgtctgagggcctcgtcggcattgtg

SEQ ID NO: 234465 - DNA, 26 bp, Artificial Sequence
  Description of Artificial Sequence: Synthetic oligonucleotide
tgtctgagggcctcgtcggcattgtg

SEQ ID NO: 234466 - DNA, 25 bp, Artificial Sequence
  Description of Artificial Sequence: Synthetic oligonucleotide
gtctgagggcctcgtcggcattgtg

SEQ ID NO: 234467 - DNA, 26 bp, Artificial Sequence
  Description of Artificial Sequence: Synthetic oligonucleotide
tctgagggcctcgtcggcattgtgct

SEQ ID NO: 234468 - DNA, 25 bp, Artificial Sequence
  Description of Artificial Sequence: Synthetic oligonucleotide
ctgagggcctcgtcggcattgtgct

SEQ ID NO: 234469 - DNA, 25 bp, Artificial Sequence
  Description of Artificial Sequence: Synthetic oligonucleotide
tgagggcctcgtcggcattgtgctg

SEQ ID NO: 234470 - DNA, 24 bp, Artificial Sequence
  Description of Artificial Sequence: Synthetic oligonucleotide
gagggcctcgtcggcattgtgctg

SEQ ID NO: 234471 - DNA, 24 bp, Artificial Sequence
  Description of Artificial Sequence: Synthetic oligonucleotide
agggcctcgtcggcattgtgctgg

SEQ ID NO: 234472 - DNA, 23 bp, Artificial Sequence
  Description of Artificial Sequence: Synthetic oligonucleotide
gggcctcgtcggcattgtgctgg

SEQ ID NO: 234473 - DNA, 23 bp, Artificial Sequence
  Description of Artificial Sequence: Synthetic oligonucleotide
ggcctcgtcggcattgtgctggg

SEQ ID NO: 234474 - DNA, 24 bp, Artificial Sequence
  Description of Artificial Sequence: Synthetic oligonucleotide
gcctcgtcggcattgtgctgggca

SEQ ID NO: 234475 - DNA, 25 bp, Artificial Sequence
  Description of Artificial Sequence: Synthetic oligonucleotide
cctcgtcggcattgtgctgggcact

SEQ ID NO: 234476 - DNA, 26 bp, Artificial Sequence
  Description of Artificial Sequence: Synthetic oligonucleotide
ctcgtcggcattgtgctgggcactga

SEQ ID NO: 234477 - DNA, 27 bp, Artificial Sequence
  Description of Artificial Sequence: Synthetic oligonucleotide
tcgtcggcattgtgctgggcactgact

SEQ ID NO: 234478 - DNA, 27 bp, Artificial Sequence
  Description of Artificial Sequence: Synthetic oligonucleotide
cgtcggcattgtgctgggcactgactt

SEQ ID NO: 234479 - DNA, 27 bp, Artificial Sequence
  Description of Artificial Sequence: Synthetic oligonucleotide
gtcggcattgtgctgggcactgacttc

SEQ ID NO: 234480 - DNA, 29 bp, Artificial Sequence
  Description of Artificial Sequence: Synthetic oligonucleotide
tcggcattgtgctgggcactgacttcatc

SEQ ID NO: 234481 - DNA, 28 bp, Artificial Sequence
  Description of Artificial Sequence: Synthetic oligonucleotide
cggcattgtgctgggcactgacttcatc

SEQ ID NO: 234482 - DNA, 30 bp, Artificial Sequence
  Description of Artificial Sequence: Synthetic oligonucleotide
ggcattgtgctgggcactgacttcatcatg

SEQ ID NO: 234483 - DNA, 30 bp, Artificial Sequence
  Description of Artificial Sequence: Synthetic oligonucleotide
gcattgtgctgggcactgacttcatcatgc

SEQ ID NO: 234484 - DNA, 30 bp, Artificial Sequence
  Description of Artificial Sequence: Synthetic oligonucleotide
cattgtgctgggcactgacttcatcatgcg

SEQ ID NO: 234485 - DNA, 31 bp, Artificial Sequence
  Description of Artificial Sequence: Synthetic oligonucleotide
attgtgctgggcactgacttcatcatgcgag

SEQ ID NO: 234486 - DNA, 30 bp, Artificial Sequence
  Description of Artificial Sequence: Synthetic oligonucleotide
ttgtgctgggcactgacttcatcatgcgag

SEQ ID NO: 234487 - DNA, 29 bp, Artificial Sequence
  Description of Artificial Sequence: Synthetic oligonucleotide
tgtgctgggcactgacttcatcatgcgag

SEQ ID NO: 234488 - DNA, 28 bp, Artificial Sequence
  Description of Artificial Sequence: Synthetic oligonucleotide
gtgctgggcactgacttcatcatgcgag

SEQ ID NO: 234489 - DNA, 28 bp, Artificial Sequence
  Description of Artificial Sequence: Synthetic oligonucleotide
tgctgggcactgacttcatcatgcgagg

SEQ ID NO: 234490 - DNA, 27 bp, Artificial Sequence
  Description of Artificial Sequence: Synthetic oligonucleotide
gctgggcactgacttcatcatgcgagg

SEQ ID NO: 234491 - DNA, 27 bp, Artificial Sequence
  Description of Artificial Sequence: Synthetic oligonucleotide
ctgggcactgacttcatcatgcgaggc

SEQ ID NO: 234492 - DNA, 27 bp, Artificial Sequence
  Description of Artificial Sequence: Synthetic oligonucleotide
tgggcactgacttcatcatgcgaggcc

SEQ ID NO: 234493 - DNA, 27 bp, Artificial Sequence
  Description of Artificial Sequence: Synthetic oligonucleotide
gggcactgacttcatcatgcgaggcct

SEQ ID NO: 234494 - DNA, 27 bp, Artificial Sequence
  Description of Artificial Sequence: Synthetic oligonucleotide
ggcactgacttcatcatgcgaggcctg

SEQ ID NO: 234495 - DNA, 27 bp, Artificial Sequence
  Description of Artificial Sequence: Synthetic oligonucleotide
gcactgacttcatcatgcgaggcctgg

SEQ ID NO: 234496 - DNA, 27 bp, Artificial Sequence
  Description of Artificial Sequence: Synthetic oligonucleotide
cactgacttcatcatgcgaggcctggg

SEQ ID NO: 234497 - DNA, 29 bp, Artificial Sequence
  Description of Artificial Sequence: Synthetic oligonucleotide
actgacttcatcatgcgaggcctgggttc

SEQ ID NO: 234498 - DNA, 28 bp, Artificial Sequence
  Description of Artificial Sequence: Synthetic oligonucleotide
ctgacttcatcatgcgaggcctgggttc

SEQ ID NO: 234499 - DNA, 29 bp, Artificial Sequence
  Description of Artificial Sequence: Synthetic oligonucleotide
tgacttcatcatgcgaggcctgggttcag

SEQ ID NO: 234500 - DNA, 28 bp, Artificial Sequence
  Description of Artificial Sequence: Synthetic oligonucleotide
gacttcatcatgcgaggcctgggttcag

SEQ ID NO: 234501 - DNA, 30 bp, Artificial Sequence
  Description of Artificial Sequence: Synthetic oligonucleotide
acttcatcatgcgaggcctgggttcagttg

SEQ ID NO: 234502 - DNA, 29 bp, Artificial Sequence
  Description of Artificial Sequence: Synthetic oligonucleotide
cttcatcatgcgaggcctgggttcagttg

SEQ ID NO: 234503 - DNA, 29 bp, Artificial Sequence
  Description of Artificial Sequence: Synthetic oligonucleotide
ttcatcatgcgaggcctgggttcagttgc

SEQ ID NO: 234504 - DNA, 28 bp, Artificial Sequence
  Description of Artificial Sequence: Synthetic oligonucleotide
tcatcatgcgaggcctgggttcagttgc

SEQ ID NO: 234505 - DNA, 27 bp, Artificial Sequence
  Description of Artificial Sequence: Synthetic oligonucleotide
catcatgcgaggcctgggttcagttgc

SEQ ID NO: 234506 - DNA, 28 bp, Artificial Sequence
  Description of Artificial Sequence: Synthetic oligonucleotide
atcatgcgaggcctgggttcagttgctg

SEQ ID NO: 234507 - DNA, 27 bp, Artificial Sequence
  Description of Artificial Sequence: Synthetic oligonucleotide
tcatgcgaggcctgggttcagttgctg

SEQ ID NO: 234508 - DNA, 26 bp, Artificial Sequence
  Description of Artificial Sequence: Synthetic oligonucleotide
catgcgaggcctgggttcagttgctg

SEQ ID NO: 234509 - DNA, 27 bp, Artificial Sequence
  Description of Artificial Sequence: Synthetic oligonucleotide
atgcgaggcctgggttcagttgctgct

SEQ ID NO: 234510 - DNA, 27 bp, Artificial Sequence
  Description of Artificial Sequence: Synthetic oligonucleotide
tgcgaggcctgggttcagttgctgctt

SEQ ID NO: 234511 - DNA, 26 bp, Artificial Sequence
  Description of Artificial Sequence: Synthetic oligonucleotide
gcgaggcctgggttcagttgctgctt

SEQ ID NO: 234512 - DNA, 26 bp, Artificial Sequence
  Description of Artificial Sequence: Synthetic oligonucleotide
cgaggcctgggttcagttgctgcttc

SEQ ID NO: 234513 - DNA, 27 bp, Artificial Sequence
  Description of Artificial Sequence: Synthetic oligonucleotide
gaggcctgggttcagttgctgcttcca

SEQ ID NO: 234514 - DNA, 27 bp, Artificial Sequence
  Description of Artificial Sequence: Synthetic oligonucleotide
aggcctgggttcagttgctgcttccag

SEQ ID NO: 234515 - DNA, 27 bp, Artificial Sequence
  Description of Artificial Sequence: Synthetic oligonucleotide
ggcctgggttcagttgctgcttccagt

SEQ ID NO: 234516 - DNA, 27 bp, Artificial Sequence
  Description of Artificial Sequence: Synthetic oligonucleotide
gcctgggttcagttgctgcttccagtc

SEQ ID NO: 234517 - DNA, 28 bp, Artificial Sequence
  Description of Artificial Sequence: Synthetic oligonucleotide
cctgggttcagttgctgcttccagtcac

SEQ ID NO: 234518 - DNA, 28 bp, Artificial Sequence
  Description of Artificial Sequence: Synthetic oligonucleotide
ctgggttcagttgctgcttccagtcacc

SEQ ID NO: 234519 - DNA, 30 bp, Artificial Sequence
  Description of Artificial Sequence: Synthetic oligonucleotide
tgggttcagttgctgcttccagtcaccaag

SEQ ID NO: 234520 - DNA, 29 bp, Artificial Sequence
  Description of Artificial Sequence: Synthetic oligonucleotide
gggttcagttgctgcttccagtcaccaag

SEQ ID NO: 234521 - DNA, 29 bp, Artificial Sequence
  Description of Artificial Sequence: Synthetic oligonucleotide
ggttcagttgctgcttccagtcaccaagg

SEQ ID NO: 234522 - DNA, 29 bp, Artificial Sequence
  Description of Artificial Sequence: Synthetic oligonucleotide
gttcagttgctgcttccagtcaccaaggg

SEQ ID NO: 234523 - DNA, 29 bp, Artificial Sequence
  Description of Artificial Sequence: Synthetic oligonucleotide
ttcagttgctgcttccagtcaccaagggg

SEQ ID NO: 234524 - DNA, 28 bp, Artificial Sequence
  Description of Artificial Sequence: Synthetic oligonucleotide
tcagttgctgcttccagtcaccaagggg

SEQ ID NO: 234525 - DNA, 27 bp, Artificial Sequence
  Description of Artificial Sequence: Synthetic oligonucleotide
cagttgctgcttccagtcaccaagggg

SEQ ID NO: 234526 - DNA, 27 bp, Artificial Sequence
  Description of Artificial Sequence: Synthetic oligonucleotide
agttgctgcttccagtcaccaaggggc

SEQ ID NO: 234527 - DNA, 26 bp, Artificial Sequence
  Description of Artificial Sequence: Synthetic oligonucleotide
gttgctgcttccagtcaccaaggggc

SEQ ID NO: 234528 - DNA, 27 bp, Artificial Sequence
  Description of Artificial Sequence: Synthetic oligonucleotide
ttgctgcttccagtcaccaaggggcct

SEQ ID NO: 234529 - DNA, 27 bp, Artificial Sequence
  Description of Artificial Sequence: Synthetic oligonucleotide
tgctgcttccagtcaccaaggggcctt

SEQ ID NO: 234530 - DNA, 26 bp, Artificial Sequence
  Description of Artificial Sequence: Synthetic oligonucleotide
gctgcttccagtcaccaaggggcctt

SEQ ID NO: 234531 - DNA, 27 bp, Artificial Sequence
  Description of Artificial Sequence: Synthetic oligonucleotide
ctgcttccagtcaccaaggggccttgt

SEQ ID NO: 234532 - DNA, 27 bp, Artificial Sequence
  Description of Artificial Sequence: Synthetic oligonucleotide
tgcttccagtcaccaaggggccttgtg

SEQ ID NO: 234533 - DNA, 27 bp, Artificial Sequence
  Description of Artificial Sequence: Synthetic oligonucleotide
gcttccagtcaccaaggggccttgtga

SEQ ID NO: 234534 - DNA, 30 bp, Artificial Sequence
  Description of Artificial Sequence: Synthetic oligonucleotide
atgtcttggtagaaggcttagcggatccgc

SEQ ID NO: 234535 - DNA, 29 bp, Artificial Sequence
  Description of Artificial Sequence: Synthetic oligonucleotide
tgtcttggtagaaggcttagcggatccgc

SEQ ID NO: 234536 - DNA, 28 bp, Artificial Sequence
  Description of Artificial Sequence: Synthetic oligonucleotide
gtcttggtagaaggcttagcggatccgc

SEQ ID NO: 234537 - DNA, 28 bp, Artificial Sequence
  Description of Artificial Sequence: Synthetic oligonucleotide
tcttggtagaaggcttagcggatccgcg

SEQ ID NO: 234538 - DNA, 27 bp, Artificial Sequence
  Description of Artificial Sequence: Synthetic oligonucleotide
cttggtagaaggcttagcggatccgcg

SEQ ID NO: 234539 - DNA, 27 bp, Artificial Sequence
  Description of Artificial Sequence: Synthetic oligonucleotide
ttggtagaaggcttagcggatccgcgg

SEQ ID NO: 234540 - DNA, 27 bp, Artificial Sequence
  Description of Artificial Sequence: Synthetic oligonucleotide
tggtagaaggcttagcggatccgcgga

SEQ ID NO: 234541 - DNA, 26 bp, Artificial Sequence
  Description of Artificial Sequence: Synthetic oligonucleotide
ggtagaaggcttagcggatccgcgga

SEQ ID NO: 234542 - DNA, 27 bp, Artificial Sequence
  Description of Artificial Sequence: Synthetic oligonucleotide
gtagaaggcttagcggatccgcggaga

SEQ ID NO: 234543 - DNA, 27 bp, Artificial Sequence
  Description of Artificial Sequence: Synthetic oligonucleotide
tagaaggcttagcggatccgcggagac

SEQ ID NO: 234544 - DNA, 26 bp, Artificial Sequence
  Description of Artificial Sequence: Synthetic oligonucleotide
agaaggcttagcggatccgcggagac

SEQ ID NO: 234545 - DNA, 25 bp, Artificial Sequence
  Description of Artificial Sequence: Synthetic oligonucleotide
gaaggcttagcggatccgcggagac

SEQ ID NO: 234546 - DNA, 27 bp, Artificial Sequence
  Description of Artificial Sequence: Synthetic oligonucleotide
aaggcttagcggatccgcggagacctt

SEQ ID NO: 234547 - DNA, 26 bp, Artificial Sequence
  Description of Artificial Sequence: Synthetic oligonucleotide
aggcttagcggatccgcggagacctt

SEQ ID NO: 234548 - DNA, 25 bp, Artificial Sequence
  Description of Artificial Sequence: Synthetic oligonucleotide
ggcttagcggatccgcggagacctt

SEQ ID NO: 234549 - DNA, 25 bp, Artificial Sequence
  Description of Artificial Sequence: Synthetic oligonucleotide
gcttagcggatccgcggagaccttg

SEQ ID NO: 234550 - DNA, 25 bp, Artificial Sequence
  Description of Artificial Sequence: Synthetic oligonucleotide
cttagcggatccgcggagaccttgg

SEQ ID NO: 234551 - DNA, 25 bp, Artificial Sequence
  Description of Artificial Sequence: Synthetic oligonucleotide
ttagcggatccgcggagaccttggg

SEQ ID NO: 234552 - DNA, 24 bp, Artificial Sequence
  Description of Artificial Sequence: Synthetic oligonucleotide
tagcggatccgcggagaccttggg

SEQ ID NO: 234553 - DNA, 23 bp, Artificial Sequence
  Description of Artificial Sequence: Synthetic oligonucleotide
agcggatccgcggagaccttggg

SEQ ID NO: 234554 - DNA, 22 bp, Artificial Sequence
  Description of Artificial Sequence: Synthetic oligonucleotide
gcggatccgcggagaccttggg

SEQ ID NO: 234555 - DNA, 24 bp, Artificial Sequence
  Description of Artificial Sequence: Synthetic oligonucleotide
cggatccgcggagaccttggggta

SEQ ID NO: 234556 - DNA, 24 bp, Artificial Sequence
  Description of Artificial Sequence: Synthetic oligonucleotide
ggatccgcggagaccttggggtag

SEQ ID NO: 234557 - DNA, 26 bp, Artificial Sequence
  Description of Artificial Sequence: Synthetic oligonucleotide
gatccgcggagaccttggggtagcaa

SEQ ID NO: 234558 - DNA, 27 bp, Artificial Sequence
  Description of Artificial Sequence: Synthetic oligonucleotide
atccgcggagaccttggggtagcaagt

SEQ ID NO: 234559 - DNA, 26 bp, Artificial Sequence
  Description of Artificial Sequence: Synthetic oligonucleotide
tccgcggagaccttggggtagcaagt

SEQ ID NO: 234560 - DNA, 25 bp, Artificial Sequence
  Description of Artificial Sequence: Synthetic oligonucleotide
ccgcggagaccttggggtagcaagt

SEQ ID NO: 234561 - DNA, 26 bp, Artificial Sequence
  Description of Artificial Sequence: Synthetic oligonucleotide
cgcggagaccttggggtagcaagtgt

SEQ ID NO: 234562 - DNA, 27 bp, Artificial Sequence
  Description of Artificial Sequence: Synthetic oligonucleotide
gcggagaccttggggtagcaagtgtca

SEQ ID NO: 234563 - DNA, 27 bp, Artificial Sequence
  Description of Artificial Sequence: Synthetic oligonucleotide
cggagaccttggggtagcaagtgtcac

SEQ ID NO: 234564 - DNA, 27 bp, Artificial Sequence
  Description of Artificial Sequence: Synthetic oligonucleotide
ggagaccttggggtagcaagtgtcacc

SEQ ID NO: 234565 - DNA, 29 bp, Artificial Sequence
  Description of Artificial Sequence: Synthetic oligonucleotide
gagaccttggggtagcaagtgtcaccttc

SEQ ID NO: 234566 - DNA, 31 bp, Artificial Sequence
  Description of Artificial Sequence: Synthetic oligonucleotide
agaccttggggtagcaagtgtcaccttcatg

SEQ ID NO: 234567 - DNA, 30 bp, Artificial Sequence
  Description of Artificial Sequence: Synthetic oligonucleotide
gaccttggggtagcaagtgtcaccttcatg

SEQ ID NO: 234568 - DNA, 30 bp, Artificial Sequence
  Description of Artificial Sequence: Synthetic oligonucleotide
accttggggtagcaagtgtcaccttcatgc

SEQ ID NO: 234569 - DNA, 29 bp, Artificial Sequence
  Description of Artificial Sequence: Synthetic oligonucleotide
ccttggggtagcaagtgtcaccttcatgc

SEQ ID NO: 234570 - DNA, 30 bp, Artificial Sequence
  Description of Artificial Sequence: Synthetic oligonucleotide
cttggggtagcaagtgtcaccttcatgctg

SEQ ID NO: 234571 - DNA, 30 bp, Artificial Sequence
  Description of Artificial Sequence: Synthetic oligonucleotide
ttggggtagcaagtgtcaccttcatgctgg

SEQ ID NO: 234572 - DNA, 29 bp, Artificial Sequence
  Description of Artificial Sequence: Synthetic oligonucleotide
tggggtagcaagtgtcaccttcatgctgg

SEQ ID NO: 234573 - DNA, 28 bp, Artificial Sequence
  Description of Artificial Sequence: Synthetic oligonucleotide
ggggtagcaagtgtcaccttcatgctgg

SEQ ID NO: 234574 - DNA, 28 bp, Artificial Sequence
  Description of Artificial Sequence: Synthetic oligonucleotide
gggtagcaagtgtcaccttcatgctggc

SEQ ID NO: 234575 - DNA, 28 bp, Artificial Sequence
  Description of Artificial Sequence: Synthetic oligonucleotide
ggtagcaagtgtcaccttcatgctggcg

SEQ ID NO: 234576 - DNA, 30 bp, Artificial Sequence
  Description of Artificial Sequence: Synthetic oligonucleotide
gtagcaagtgtcaccttcatgctggcgttg

SEQ ID NO: 234577 - DNA, 30 bp, Artificial Sequence
  Description of Artificial Sequence: Synthetic oligonucleotide
tagcaagtgtcaccttcatgctggcgttgc

SEQ ID NO: 234578 - DNA, 29 bp, Artificial Sequence
  Description of Artificial Sequence: Synthetic oligonucleotide
agcaagtgtcaccttcatgctggcgttgc

SEQ ID NO: 234579 - DNA, 28 bp, Artificial Sequence
  Description of Artificial Sequence: Synthetic oligonucleotide
gcaagtgtcaccttcatgctggcgttgc

SEQ ID NO: 234580 - DNA, 29 bp, Artificial Sequence
  Description of Artificial Sequence: Synthetic oligonucleotide
caagtgtcaccttcatgctggcgttgctg

SEQ ID NO: 234581 - DNA, 30 bp, Artificial Sequence
  Description of Artificial Sequence: Synthetic oligonucleotide
aagtgtcaccttcatgctggcgttgctgag

SEQ ID NO: 234582 - DNA, 29 bp, Artificial Sequence
  Description of Artificial Sequence: Synthetic oligonucleotide
agtgtcaccttcatgctggcgttgctgag

SEQ ID NO: 234583 - DNA, 28 bp, Artificial Sequence
  Description of Artificial Sequence: Synthetic oligonucleotide
gtgtcaccttcatgctggcgttgctgag

SEQ ID NO: 234584 - DNA, 28 bp, Artificial Sequence
  Description of Artificial Sequence: Synthetic oligonucleotide
tgtcaccttcatgctggcgttgctgagc

SEQ ID NO: 234585 - DNA, 27 bp, Artificial Sequence
  Description of Artificial Sequence: Synthetic oligonucleotide
gtcaccttcatgctggcgttgctgagc

SEQ ID NO: 234586 - DNA, 28 bp, Artificial Sequence
  Description of Artificial Sequence: Synthetic oligonucleotide
tcaccttcatgctggcgttgctgagctg

SEQ ID NO: 234587 - DNA, 27 bp, Artificial Sequence
  Description of Artificial Sequence: Synthetic oligonucleotide
caccttcatgctggcgttgctgagctg

SEQ ID NO: 234588 - DNA, 27 bp, Artificial Sequence
  Description of Artificial Sequence: Synthetic oligonucleotide
accttcatgctggcgttgctgagctgc

SEQ ID NO: 234589 - DNA, 26 bp, Artificial Sequence
  Description of Artificial Sequence: Synthetic oligonucleotide
ccttcatgctggcgttgctgagctgc

SEQ ID NO: 234590 - DNA, 27 bp, Artificial Sequence
  Description of Artificial Sequence: Synthetic oligonucleotide
cttcatgctggcgttgctgagctgcct

SEQ ID NO: 234591 - DNA, 28 bp, Artificial Sequence
  Description of Artificial Sequence: Synthetic oligonucleotide
ttcatgctggcgttgctgagctgcctac

SEQ ID NO: 234592 - DNA, 27 bp, Artificial Sequence
  Description of Artificial Sequence: Synthetic oligonucleotide
tcatgctggcgttgctgagctgcctac

SEQ ID NO: 234593 - DNA, 27 bp, Artificial Sequence
  Description of Artificial Sequence: Synthetic oligonucleotide
catgctggcgttgctgagctgcctact

SEQ ID NO: 234594 - DNA, 27 bp, Artificial Sequence
  Description of Artificial Sequence: Synthetic oligonucleotide
atgctggcgttgctgagctgcctactg

SEQ ID NO: 234595 - DNA, 26 bp, Artificial Sequence
  Description of Artificial Sequence: Synthetic oligonucleotide
tgctggcgttgctgagctgcctactg

SEQ ID NO: 234596 - DNA, 25 bp, Artificial Sequence
  Description of Artificial Sequence: Synthetic oligonucleotide
gctggcgttgctgagctgcctactg

SEQ ID NO: 234597 - DNA, 25 bp, Artificial Sequence
  Description of Artificial Sequence: Synthetic oligonucleotide
ctggcgttgctgagctgcctactgg

SEQ ID NO: 234598 - DNA, 25 bp, Artificial Sequence
  Description of Artificial Sequence: Synthetic oligonucleotide
tggcgttgctgagctgcctactggc

SEQ ID NO: 234599 - DNA, 24 bp, Artificial Sequence
  Description of Artificial Sequence: Synthetic oligonucleotide
ggcgttgctgagctgcctactggc

SEQ ID NO: 234600 - DNA, 24 bp, Artificial Sequence
  Description of Artificial Sequence: Synthetic oligonucleotide
gcgttgctgagctgcctactggcc

SEQ ID NO: 234601 - DNA, 25 bp, Artificial Sequence
  Description of Artificial Sequence: Synthetic oligonucleotide
cgttgctgagctgcctactggccga

SEQ ID NO: 234602 - DNA, 25 bp, Artificial Sequence
  Description of Artificial Sequence: Synthetic oligonucleotide
gttgctgagctgcctactggccgag

SEQ ID NO: 234603 - DNA, 25 bp, Artificial Sequence
  Description of Artificial Sequence: Synthetic oligonucleotide
ttgctgagctgcctactggccgagg

SEQ ID NO: 234604 - DNA, 24 bp, Artificial Sequence
  Description of Artificial Sequence: Synthetic oligonucleotide
tgctgagctgcctactggccgagg

SEQ ID NO: 234605 - DNA, 23 bp, Artificial Sequence
  Description of Artificial Sequence: Synthetic oligonucleotide
gctgagctgcctactggccgagg

SEQ ID NO: 234606 - DNA, 23 bp, Artificial Sequence
  Description of Artificial Sequence: Synthetic oligonucleotide
ctgagctgcctactggccgaggg

SEQ ID NO: 234607 - DNA, 24 bp, Artificial Sequence
  Description of Artificial Sequence: Synthetic oligonucleotide
tgagctgcctactggccgagggca

SEQ ID NO: 234608 - DNA, 23 bp, Artificial Sequence
  Description of Artificial Sequence: Synthetic oligonucleotide
gagctgcctactggccgagggca

SEQ ID NO: 234609 - DNA, 24 bp, Artificial Sequence
  Description of Artificial Sequence: Synthetic oligonucleotide
agctgcctactggccgagggcaga

SEQ ID NO: 234610 - DNA, 23 bp, Artificial Sequence
  Description of Artificial Sequence: Synthetic oligonucleotide
gctgcctactggccgagggcaga

SEQ ID NO: 234611 - DNA, 24 bp, Artificial Sequence
  Description of Artificial Sequence: Synthetic oligonucleotide
ctgcctactggccgagggcagaca

SEQ ID NO: 234612 - DNA, 25 bp, Artificial Sequence
  Description of Artificial Sequence: Synthetic oligonucleotide
tgcctactggccgagggcagacact

SEQ ID NO: 234613 - DNA, 24 bp, Artificial Sequence
  Description of Artificial Sequence: Synthetic oligonucleotide
gcctactggccgagggcagacact

SEQ ID NO: 234614 - DNA, 25 bp, Artificial Sequence
  Description of Artificial Sequence: Synthetic oligonucleotide
cctactggccgagggcagacactct

SEQ ID NO: 234615 - DNA, 25 bp, Artificial Sequence
  Description of Artificial Sequence: Synthetic oligonucleotide
ctactggccgagggcagacactctc

SEQ ID NO: 234616 - DNA, 25 bp, Artificial Sequence
  Description of Artificial Sequence: Synthetic oligonucleotide
tactggccgagggcagacactctcc

SEQ ID NO: 234617 - DNA, 24 bp, Artificial Sequence
  Description of Artificial Sequence: Synthetic oligonucleotide
actggccgagggcagacactctcc

SEQ ID NO: 234618 - DNA, 23 bp, Artificial Sequence
  Description of Artificial Sequence: Synthetic oligonucleotide
ctggccgagggcagacactctcc

SEQ ID NO: 234619 - DNA, 23 bp, Artificial Sequence
  Description of Artificial Sequence: Synthetic oligonucleotide
tggccgagggcagacactctccc

SEQ ID NO: 234620 - DNA, 22 bp, Artificial Sequence
  Description of Artificial Sequence: Synthetic oligonucleotide
ggccgagggcagacactctccc

SEQ ID NO: 234621 - DNA, 23 bp, Artificial Sequence
  Description of Artificial Sequence: Synthetic oligonucleotide
gccgagggcagacactctcccgt

SEQ ID NO: 234622 - DNA, 23 bp, Artificial Sequence
  Description of Artificial Sequence: Synthetic oligonucleotide
ccgagggcagacactctcccgtg

SEQ ID NO: 234623 - DNA, 27 bp, Artificial Sequence
  Description of Artificial Sequence: Synthetic oligonucleotide
cgagggcagacactctcccgtggattt

SEQ ID NO: 234624 - DNA, 27 bp, Artificial Sequence
  Description of Artificial Sequence: Synthetic oligonucleotide
gagggcagacactctcccgtggatttc

SEQ ID NO: 234625 - DNA, 27 bp, Artificial Sequence
  Description of Artificial Sequence: Synthetic oligonucleotide
agggcagacactctcccgtggatttcg

SEQ ID NO: 234626 - DNA, 27 bp, Artificial Sequence
  Description of Artificial Sequence: Synthetic oligonucleotide
gggcagacactctcccgtggatttcgt

SEQ ID NO: 234627 - DNA, 27 bp, Artificial Sequence
  Description of Artificial Sequence: Synthetic oligonucleotide
ggcagacactctcccgtggatttcgtc

SEQ ID NO: 234628 - DNA, 29 bp, Artificial Sequence
  Description of Artificial Sequence: Synthetic oligonucleotide
gcagacactctcccgtggatttcgtctac

SEQ ID NO: 234629 - DNA, 29 bp, Artificial Sequence
  Description of Artificial Sequence: Synthetic oligonucleotide
cagacactctcccgtggatttcgtctacc

SEQ ID NO: 234630 - DNA, 30 bp, Artificial Sequence
  Description of Artificial Sequence: Synthetic oligonucleotide
agacactctcccgtggatttcgtctaccag

SEQ ID NO: 234631 - DNA, 29 bp, Artificial Sequence
  Description of Artificial Sequence: Synthetic oligonucleotide
gacactctcccgtggatttcgtctaccag

SEQ ID NO: 234632 - DNA, 34 bp, Artificial Sequence
  Description of Artificial Sequence: Synthetic oligonucleotide
acactctcccgtggatttcgtctaccagttttag

SEQ ID NO: 234633 - DNA, 33 bp, Artificial Sequence
  Description of Artificial Sequence: Synthetic oligonucleotide
cactctcccgtggatttcgtctaccagttttag

SEQ ID NO: 234634 - DNA, 33 bp, Artificial Sequence
  Description of Artificial Sequence: Synthetic oligonucleotide
actctcccgtggatttcgtctaccagttttagg

SEQ ID NO: 234635 - DNA, 32 bp, Artificial Sequence
  Description of Artificial Sequence: Synthetic oligonucleotide
ctctcccgtggatttcgtctaccagttttagg

SEQ ID NO: 234636 - DNA, 32 bp, Artificial Sequence
  Description of Artificial Sequence: Synthetic oligonucleotide
tctcccgtggatttcgtctaccagttttaggg

SEQ ID NO: 234637 - DNA, 31 bp, Artificial Sequence
  Description of Artificial Sequence: Synthetic oligonucleotide
ctcccgtggatttcgtctaccagttttaggg

SEQ ID NO: 234638 - DNA, 31 bp, Artificial Sequence
  Description of Artificial Sequence: Synthetic oligonucleotide
tcccgtggatttcgtctaccagttttagggc

SEQ ID NO: 234639 - DNA, 30 bp, Artificial Sequence
  Description of Artificial Sequence: Synthetic oligonucleotide
cccgtggatttcgtctaccagttttagggc

SEQ ID NO: 234640 - DNA, 32 bp, Artificial Sequence
  Description of Artificial Sequence: Synthetic oligonucleotide
ccgtggatttcgtctaccagttttagggcatg

SEQ ID NO: 234641 - DNA, 33 bp, Artificial Sequence
  Description of Artificial Sequence: Synthetic oligonucleotide
cgtggatttcgtctaccagttttagggcatgtc

SEQ ID NO: 234642 - DNA, 33 bp, Artificial Sequence
  Description of Artificial Sequence: Synthetic oligonucleotide
gtggatttcgtctaccagttttagggcatgtcc

SEQ ID NO: 234643 - DNA, 35 bp, Artificial Sequence
  Description of Artificial Sequence: Synthetic oligonucleotide
tggatttcgtctaccagttttagggcatgtcctac

SEQ ID NO: 234644 - DNA, 34 bp, Artificial Sequence
  Description of Artificial Sequence: Synthetic oligonucleotide
ggatttcgtctaccagttttagggcatgtcctac

SEQ ID NO: 234645 - DNA, 36 bp, Artificial Sequence
  Description of Artificial Sequence: Synthetic oligonucleotide
gatttcgtctaccagttttagggcatgtcctacttc

SEQ ID NO: 234646 - DNA, 37 bp, Artificial Sequence
  Description of Artificial Sequence: Synthetic oligonucleotide
atttcgtctaccagttttagggcatgtcctacttcac

SEQ ID NO: 234647 - DNA, 36 bp, Artificial Sequence
  Description of Artificial Sequence: Synthetic oligonucleotide
tttcgtctaccagttttagggcatgtcctacttcac

SEQ ID NO: 234648 - DNA, 35 bp, Artificial Sequence
  Description of Artificial Sequence: Synthetic oligonucleotide
ttcgtctaccagttttagggcatgtcctacttcac

SEQ ID NO: 234649 - DNA, 34 bp, Artificial Sequence
  Description of Artificial Sequence: Synthetic oligonucleotide
tcgtctaccagttttagggcatgtcctacttcac

SEQ ID NO: 234650 - DNA, 33 bp, Artificial Sequence
  Description of Artificial Sequence: Synthetic oligonucleotide
cgtctaccagttttagggcatgtcctacttcac

SEQ ID NO: 234651 - DNA, 33 bp, Artificial Sequence
  Description of Artificial Sequence: Synthetic oligonucleotide
gtctaccagttttagggcatgtcctacttcacc

SEQ ID NO: 234652 - DNA, 35 bp, Artificial Sequence
  Description of Artificial Sequence: Synthetic oligonucleotide
tctaccagttttagggcatgtcctacttcaccaac

SEQ ID NO: 234653 - DNA, 34 bp, Artificial Sequence
  Description of Artificial Sequence: Synthetic oligonucleotide
ctaccagttttagggcatgtcctacttcaccaac

SEQ ID NO: 234654 - DNA, 34 bp, Artificial Sequence
  Description of Artificial Sequence: Synthetic oligonucleotide
taccagttttagggcatgtcctacttcaccaacg

SEQ ID NO: 234655 - DNA, 33 bp, Artificial Sequence
  Description of Artificial Sequence: Synthetic oligonucleotide
accagttttagggcatgtcctacttcaccaacg

SEQ ID NO: 234656 - DNA, 32 bp, Artificial Sequence
  Description of Artificial Sequence: Synthetic oligonucleotide
ccagttttagggcatgtcctacttcaccaacg

SEQ ID NO: 234657 - DNA, 32 bp, Artificial Sequence
  Description of Artificial Sequence: Synthetic oligonucleotide
cagttttagggcatgtcctacttcaccaacgg

SEQ ID NO: 234658 - DNA, 32 bp, Artificial Sequence
  Description of Artificial Sequence: Synthetic oligonucleotide
agttttagggcatgtcctacttcaccaacggg

SEQ ID NO: 234659 - DNA, 31 bp, Artificial Sequence
  Description of Artificial Sequence: Synthetic oligonucleotide
gttttagggcatgtcctacttcaccaacggg

SEQ ID NO: 234660 - DNA, 32 bp, Artificial Sequence
  Description of Artificial Sequence: Synthetic oligonucleotide
ttttagggcatgtcctacttcaccaacgggac

SEQ ID NO: 234661 - DNA, 31 bp, Artificial Sequence
  Description of Artificial Sequence: Synthetic oligonucleotide
tttagggcatgtcctacttcaccaacgggac

SEQ ID NO: 234662 - DNA, 30 bp, Artificial Sequence
  Description of Artificial Sequence: Synthetic oligonucleotide
ttagggcatgtcctacttcaccaacgggac

SEQ ID NO: 234663 - DNA, 29 bp, Artificial Sequence
  Description of Artificial Sequence: Synthetic oligonucleotide
tagggcatgtcctacttcaccaacgggac

SEQ ID NO: 234664 - DNA, 28 bp, Artificial Sequence
  Description of Artificial Sequence: Synthetic oligonucleotide
agggcatgtcctacttcaccaacgggac

SEQ ID NO: 234665 - DNA, 27 bp, Artificial Sequence
  Description of Artificial Sequence: Synthetic oligonucleotide
gggcatgtcctacttcaccaacgggac

SEQ ID NO: 234666 - DNA, 27 bp, Artificial Sequence
  Description of Artificial Sequence: Synthetic oligonucleotide
ggcatgtcctacttcaccaacgggacg

SEQ ID NO: 234667 - DNA, 27 bp, Artificial Sequence
  Description of Artificial Sequence: Synthetic oligonucleotide
gcatgtcctacttcaccaacgggacgc

SEQ ID NO: 234668 - DNA, 28 bp, Artificial Sequence
  Description of Artificial Sequence: Synthetic oligonucleotide
catgtcctacttcaccaacgggacgcag

SEQ ID NO: 234669 - DNA, 28 bp, Artificial Sequence
  Description of Artificial Sequence: Synthetic oligonucleotide
atgtcctacttcaccaacgggacgcagc

SEQ ID NO: 234670 - DNA, 27 bp, Artificial Sequence
  Description of Artificial Sequence: Synthetic oligonucleotide
tgtcctacttcaccaacgggacgcagc

SEQ ID NO: 234671 - DNA, 26 bp, Artificial Sequence
  Description of Artificial Sequence: Synthetic oligonucleotide
gtcctacttcaccaacgggacgcagc

SEQ ID NO: 234672 - DNA, 26 bp, Artificial Sequence
  Description of Artificial Sequence: Synthetic oligonucleotide
tcctacttcaccaacgggacgcagcg

SEQ ID NO: 234673 - DNA, 25 bp, Artificial Sequence
  Description of Artificial Sequence: Synthetic oligonucleotide
cctacttcaccaacgggacgcagcg

SEQ ID NO: 234674 - DNA, 25 bp, Artificial Sequence
  Description of Artificial Sequence: Synthetic oligonucleotide
ctacttcaccaacgggacgcagcgc

SEQ ID NO: 234675 - DNA, 26 bp, Artificial Sequence
  Description of Artificial Sequence: Synthetic oligonucleotide
tacttcaccaacgggacgcagcgcgt

SEQ ID NO: 234676 - DNA, 25 bp, Artificial Sequence
  Description of Artificial Sequence: Synthetic oligonucleotide
acttcaccaacgggacgcagcgcgt

SEQ ID NO: 234677 - DNA, 24 bp, Artificial Sequence
  Description of Artificial Sequence: Synthetic oligonucleotide
cttcaccaacgggacgcagcgcgt

SEQ ID NO: 234678 - DNA, 24 bp, Artificial Sequence
  Description of Artificial Sequence: Synthetic oligonucleotide
ttcaccaacgggacgcagcgcgtg

SEQ ID NO: 234679 - DNA, 23 bp, Artificial Sequence
  Description of Artificial Sequence: Synthetic oligonucleotide
tcaccaacgggacgcagcgcgtg

SEQ ID NO: 234680 - DNA, 22 bp, Artificial Sequence
  Description of Artificial Sequence: Synthetic oligonucleotide
caccaacgggacgcagcgcgtg

SEQ ID NO: 234681 - DNA, 22 bp, Artificial Sequence
  Description of Artificial Sequence: Synthetic oligonucleotide
accaacgggacgcagcgcgtgc

SEQ ID NO: 234682 - DNA, 21 bp, Artificial Sequence
  Description of Artificial Sequence: Synthetic oligonucleotide
ccaacgggacgcagcgcgtgc

SEQ ID NO: 234683 - DNA, 22 bp, Artificial Sequence
  Description of Artificial Sequence: Synthetic oligonucleotide
caacgggacgcagcgcgtgcct

SEQ ID NO: 234684 - DNA, 24 bp, Artificial Sequence
  Description of Artificial Sequence: Synthetic oligonucleotide
aacgggacgcagcgcgtgcctctt

SEQ ID NO: 234685 - DNA, 23 bp, Artificial Sequence
  Description of Artificial Sequence: Synthetic oligonucleotide
acgggacgcagcgcgtgcctctt

SEQ ID NO: 234686 - DNA, 22 bp, Artificial Sequence
  Description of Artificial Sequence: Synthetic oligonucleotide
cgggacgcagcgcgtgcctctt

SEQ ID NO: 234687 - DNA, 25 bp, Artificial Sequence
  Description of Artificial Sequence: Synthetic oligonucleotide
gggacgcagcgcgtgcctcttgtaa

SEQ ID NO: 234688 - DNA, 25 bp, Artificial Sequence
  Description of Artificial Sequence: Synthetic oligonucleotide
ggacgcagcgcgtgcctcttgtaac

SEQ ID NO: 234689 - DNA, 26 bp, Artificial Sequence
  Description of Artificial Sequence: Synthetic oligonucleotide
gacgcagcgcgtgcctcttgtaacga

SEQ ID NO: 234690 - DNA, 27 bp, Artificial Sequence
  Description of Artificial Sequence: Synthetic oligonucleotide
acgcagcgcgtgcctcttgtaacgaga

SEQ ID NO: 234691 - DNA, 27 bp, Artificial Sequence
  Description of Artificial Sequence: Synthetic oligonucleotide
cgcagcgcgtgcctcttgtaacgagat

SEQ ID NO: 234692 - DNA, 28 bp, Artificial Sequence
  Description of Artificial Sequence: Synthetic oligonucleotide
gcagcgcgtgcctcttgtaacgagatac

SEQ ID NO: 234693 - DNA, 30 bp, Artificial Sequence
  Description of Artificial Sequence: Synthetic oligonucleotide
cagcgcgtgcctcttgtaacgagatacatc

SEQ ID NO: 234694 - DNA, 35 bp, Artificial Sequence
  Description of Artificial Sequence: Synthetic oligonucleotide
agcgcgtgcctcttgtaacgagatacatcaataac

SEQ ID NO: 234695 - DNA, 34 bp, Artificial Sequence
  Description of Artificial Sequence: Synthetic oligonucleotide
gcgcgtgcctcttgtaacgagatacatcaataac

SEQ ID NO: 234696 - DNA, 34 bp, Artificial Sequence
  Description of Artificial Sequence: Synthetic oligonucleotide
cgcgtgcctcttgtaacgagatacatcaataacc

SEQ ID NO: 234697 - DNA, 34 bp, Artificial Sequence
  Description of Artificial Sequence: Synthetic oligonucleotide
gcgtgcctcttgtaacgagatacatcaataaccg

SEQ ID NO: 234698 - DNA, 35 bp, Artificial Sequence
  Description of Artificial Sequence: Synthetic oligonucleotide
cgtgcctcttgtaacgagatacatcaataaccgag

SEQ ID NO: 234699 - DNA, 36 bp, Artificial Sequence
  Description of Artificial Sequence: Synthetic oligonucleotide
gtgcctcttgtaacgagatacatcaataaccgagtg

SEQ ID NO: 234700 - DNA, 36 bp, Artificial Sequence
  Description of Artificial Sequence: Synthetic oligonucleotide
tgcctcttgtaacgagatacatcaataaccgagtgg

SEQ ID NO: 234701 - DNA, 35 bp, Artificial Sequence
  Description of Artificial Sequence: Synthetic oligonucleotide
gcctcttgtaacgagatacatcaataaccgagtgg

SEQ ID NO: 234702 - DNA, 36 bp, Artificial Sequence
  Description of Artificial Sequence: Synthetic oligonucleotide
cctcttgtaacgagatacatcaataaccgagtggag

SEQ ID NO: 234703 - DNA, 38 bp, Artificial Sequence
  Description of Artificial Sequence: Synthetic oligonucleotide
ctcttgtaacgagatacatcaataaccgagtggagtac

SEQ ID NO: 234704 - DNA, 38 bp, Artificial Sequence
  Description of Artificial Sequence: Synthetic oligonucleotide
tcttgtaacgagatacatcaataaccgagtggagtacg

SEQ ID NO: 234705 - DNA, 37 bp, Artificial Sequence
  Description of Artificial Sequence: Synthetic oligonucleotide
cttgtaacgagatacatcaataaccgagtggagtacg

SEQ ID NO: 234706 - DNA, 37 bp, Artificial Sequence
  Description of Artificial Sequence: Synthetic oligonucleotide
ttgtaacgagatacatcaataaccgagtggagtacgc

SEQ ID NO: 234707 - DNA, 36 bp, Artificial Sequence
  Description of Artificial Sequence: Synthetic oligonucleotide
tgtaacgagatacatcaataaccgagtggagtacgc

SEQ ID NO: 234708 - DNA, 35 bp, Artificial Sequence
  Description of Artificial Sequence: Synthetic oligonucleotide
gtaacgagatacatcaataaccgagtggagtacgc

SEQ ID NO: 234709 - DNA, 35 bp, Artificial Sequence
  Description of Artificial Sequence: Synthetic oligonucleotide
taacgagatacatcaataaccgagtggagtacgcg

SEQ ID NO: 234710 - DNA, 34 bp, Artificial Sequence
  Description of Artificial Sequence: Synthetic oligonucleotide
aacgagatacatcaataaccgagtggagtacgcg

SEQ ID NO: 234711 - DNA, 33 bp, Artificial Sequence
  Description of Artificial Sequence: Synthetic oligonucleotide
acgagatacatcaataaccgagtggagtacgcg

SEQ ID NO: 234712 - DNA, 32 bp, Artificial Sequence
  Description of Artificial Sequence: Synthetic oligonucleotide
cgagatacatcaataaccgagtggagtacgcg

SEQ ID NO: 234713 - DNA, 32 bp, Artificial Sequence
  Description of Artificial Sequence: Synthetic oligonucleotide
gagatacatcaataaccgagtggagtacgcgg

SEQ ID NO: 234714 - DNA, 32 bp, Artificial Sequence
  Description of Artificial Sequence: Synthetic oligonucleotide
agatacatcaataaccgagtggagtacgcggg

SEQ ID NO: 234715 - DNA, 31 bp, Artificial Sequence
  Description of Artificial Sequence: Synthetic oligonucleotide
gatacatcaataaccgagtggagtacgcggg

SEQ ID NO: 234716 - DNA, 31 bp, Artificial Sequence
  Description of Artificial Sequence: Synthetic oligonucleotide
atacatcaataaccgagtggagtacgcgggc

SEQ ID NO: 234717 - DNA, 30 bp, Artificial Sequence
  Description of Artificial Sequence: Synthetic oligonucleotide
tacatcaataaccgagtggagtacgcgggc

SEQ ID NO: 234718 - DNA, 29 bp, Artificial Sequence
  Description of Artificial Sequence: Synthetic oligonucleotide
acatcaataaccgagtggagtacgcgggc

SEQ ID NO: 234719 - DNA, 28 bp, Artificial Sequence
  Description of Artificial Sequence: Synthetic oligonucleotide
catcaataaccgagtggagtacgcgggc

SEQ ID NO: 234720 - DNA, 30 bp, Artificial Sequence
  Description of Artificial Sequence: Synthetic oligonucleotide
atcaataaccgagtggagtacgcgggcttc

SEQ ID NO: 234721 - DNA, 29 bp, Artificial Sequence
  Description of Artificial Sequence: Synthetic oligonucleotide
tcaataaccgagtggagtacgcgggcttc

SEQ ID NO: 234722 - DNA, 28 bp, Artificial Sequence
  Description of Artificial Sequence: Synthetic oligonucleotide
caataaccgagtggagtacgcgggcttc

SEQ ID NO: 234723 - DNA, 28 bp, Artificial Sequence
  Description of Artificial Sequence: Synthetic oligonucleotide
aataaccgagtggagtacgcgggcttcg

SEQ ID NO: 234724 - DNA, 27 bp, Artificial Sequence
  Description of Artificial Sequence: Synthetic oligonucleotide
ataaccgagtggagtacgcgggcttcg

SEQ ID NO: 234725 - DNA, 27 bp, Artificial Sequence
  Description of Artificial Sequence: Synthetic oligonucleotide
taaccgagtggagtacgcgggcttcga

SEQ ID NO: 234726 - DNA, 26 bp, Artificial Sequence
  Description of Artificial Sequence: Synthetic oligonucleotide
aaccgagtggagtacgcgggcttcga

SEQ ID NO: 234727 - DNA, 25 bp, Artificial Sequence
  Description of Artificial Sequence: Synthetic oligonucleotide
accgagtggagtacgcgggcttcga

SEQ ID NO: 234728 - DNA, 24 bp, Artificial Sequence
  Description of Artificial Sequence: Synthetic oligonucleotide
ccgagtggagtacgcgggcttcga

SEQ ID NO: 234729 - DNA, 25 bp, Artificial Sequence
  Description of Artificial Sequence: Synthetic oligonucleotide
cgagtggagtacgcgggcttcgact

SEQ ID NO: 234730 - DNA, 25 bp, Artificial Sequence
  Description of Artificial Sequence: Synthetic oligonucleotide
gagtggagtacgcgggcttcgactg

SEQ ID NO: 234731 - DNA, 25 bp, Artificial Sequence
  Description of Artificial Sequence: Synthetic oligonucleotide
agtggagtacgcgggcttcgactgc

SEQ ID NO: 234732 - DNA, 24 bp, Artificial Sequence
  Description of Artificial Sequence: Synthetic oligonucleotide
gtggagtacgcgggcttcgactgc

SEQ ID NO: 234733 - DNA, 25 bp, Artificial Sequence
  Description of Artificial Sequence: Synthetic oligonucleotide
tggagtacgcgggcttcgactgcga

SEQ ID NO: 234734 - DNA, 24 bp, Artificial Sequence
  Description of Artificial Sequence: Synthetic oligonucleotide
ggagtacgcgggcttcgactgcga

SEQ ID NO: 234735 - DNA, 24 bp, Artificial Sequence
  Description of Artificial Sequence: Synthetic oligonucleotide
gagtacgcgggcttcgactgcgac

SEQ ID NO: 234736 - DNA, 25 bp, Artificial Sequence
  Description of Artificial Sequence: Synthetic oligonucleotide
agtacgcgggcttcgactgcgacgt

SEQ ID NO: 234737 - DNA, 24 bp, Artificial Sequence
  Description of Artificial Sequence: Synthetic oligonucleotide
gtacgcgggcttcgactgcgacgt

SEQ ID NO: 234738 - DNA, 24 bp, Artificial Sequence
  Description of Artificial Sequence: Synthetic oligonucleotide
tacgcgggcttcgactgcgacgtg

SEQ ID NO: 234739 - DNA, 23 bp, Artificial Sequence
  Description of Artificial Sequence: Synthetic oligonucleotide
acgcgggcttcgactgcgacgtg

SEQ ID NO: 234740 - DNA, 22 bp, Artificial Sequence
  Description of Artificial Sequence: Synthetic oligonucleotide
cgcgggcttcgactgcgacgtg

SEQ ID NO: 234741 - DNA, 22 bp, Artificial Sequence
  Description of Artificial Sequence: Synthetic oligonucleotide
gcgggcttcgactgcgacgtgc

SEQ ID NO: 234742 - DNA, 22 bp, Artificial Sequence
  Description of Artificial Sequence: Synthetic oligonucleotide
cgggcttcgactgcgacgtgcg

SEQ ID NO: 234743 - DNA, 22 bp, Artificial Sequence
  Description of Artificial Sequence: Synthetic oligonucleotide
gggcttcgactgcgacgtgcgg

SEQ ID NO: 234744 - DNA, 23 bp, Artificial Sequence
  Description of Artificial Sequence: Synthetic oligonucleotide
ggcttcgactgcgacgtgcgggt

SEQ ID NO: 234745 - DNA, 25 bp, Artificial Sequence
  Description of Artificial Sequence: Synthetic oligonucleotide
gcttcgactgcgacgtgcgggtgta

SEQ ID NO: 234746 - DNA, 25 bp, Artificial Sequence
  Description of Artificial Sequence: Synthetic oligonucleotide
cttcgactgcgacgtgcgggtgtac

SEQ ID NO: 234747 - DNA, 25 bp, Artificial Sequence
  Description of Artificial Sequence: Synthetic oligonucleotide
ttcgactgcgacgtgcgggtgtacc

SEQ ID NO: 234748 - DNA, 24 bp, Artificial Sequence
  Description of Artificial Sequence: Synthetic oligonucleotide
tcgactgcgacgtgcgggtgtacc

SEQ ID NO: 234749 - DNA, 23 bp, Artificial Sequence
  Description of Artificial Sequence: Synthetic oligonucleotide
cgactgcgacgtgcgggtgtacc

SEQ ID NO: 234750 - DNA, 23 bp, Artificial Sequence
  Description of Artificial Sequence: Synthetic oligonucleotide
gactgcgacgtgcgggtgtaccc

SEQ ID NO: 234751 - DNA, 23 bp, Artificial Sequence
  Description of Artificial Sequence: Synthetic oligonucleotide
actgcgacgtgcgggtgtacccg

SEQ ID NO: 234752 - DNA, 22 bp, Artificial Sequence
  Description of Artificial Sequence: Synthetic oligonucleotide
ctgcgacgtgcgggtgtacccg

SEQ ID NO: 234753 - DNA, 22 bp, Artificial Sequence
  Description of Artificial Sequence: Synthetic oligonucleotide
tgcgacgtgcgggtgtacccgg

SEQ ID NO: 234754 - DNA, 21 bp, Artificial Sequence
  Description of Artificial Sequence: Synthetic oligonucleotide
gcgacgtgcgggtgtacccgg

SEQ ID NO: 234755 - DNA, 21 bp, Artificial Sequence
  Description of Artificial Sequence: Synthetic oligonucleotide
cgacgtgcgggtgtacccggc

SEQ ID NO: 234756 - DNA, 21 bp, Artificial Sequence
  Description of Artificial Sequence: Synthetic oligonucleotide
gacgtgcgggtgtacccggcg

SEQ ID NO: 234757 - DNA, 22 bp, Artificial Sequence
  Description of Artificial Sequence: Synthetic oligonucleotide
acgtgcgggtgtacccggcggt

SEQ ID NO: 234758 - DNA, 21 bp, Artificial Sequence
  Description of Artificial Sequence: Synthetic oligonucleotide
cgtgcgggtgtacccggcggt

SEQ ID NO: 234759 - DNA, 22 bp, Artificial Sequence
  Description of Artificial Sequence: Synthetic oligonucleotide
gtgcgggtgtacccggcggtga

SEQ ID NO: 234760 - DNA, 22 bp, Artificial Sequence
  Description of Artificial Sequence: Synthetic oligonucleotide
tgcgggtgtacccggcggtgac

SEQ ID NO: 234761 - DNA, 21 bp, Artificial Sequence
  Description of Artificial Sequence: Synthetic oligonucleotide
gcgggtgtacccggcggtgac

SEQ ID NO: 234762 - DNA, 21 bp, Artificial Sequence
  Description of Artificial Sequence: Synthetic oligonucleotide
cgggtgtacccggcggtgacg

SEQ ID NO: 234763 - DNA, 21 bp, Artificial Sequence
  Description of Artificial Sequence: Synthetic oligonucleotide
gggtgtacccggcggtgacgg

SEQ ID NO: 234764 - DNA, 21 bp, Artificial Sequence
  Description of Artificial Sequence: Synthetic oligonucleotide
ggtgtacccggcggtgacggc

SEQ ID NO: 234765 - DNA, 21 bp, Artificial Sequence
  Description of Artificial Sequence: Synthetic oligonucleotide
gtgtacccggcggtgacggcg

SEQ ID NO: 234766 - DNA, 22 bp, Artificial Sequence
  Description of Artificial Sequence: Synthetic oligonucleotide
tgtacccggcggtgacggcgca

SEQ ID NO: 234767 - DNA, 21 bp, Artificial Sequence
  Description of Artificial Sequence: Synthetic oligonucleotide
gtacccggcggtgacggcgca

SEQ ID NO: 234768 - DNA, 21 bp, Artificial Sequence
  Description of Artificial Sequence: Synthetic oligonucleotide
tacccggcggtgacggcgcag

SEQ ID NO: 234769 - DNA, 20 bp, Artificial Sequence
  Description of Artificial Sequence: Synthetic oligonucleotide
acccggcggtgacggcgcag

SEQ ID NO: 234770 - DNA, 20 bp, Artificial Sequence
  Description of Artificial Sequence: Synthetic oligonucleotide
cccggcggtgacggcgcagt

SEQ ID NO: 234771 - DNA, 20 bp, Artificial Sequence
  Description of Artificial Sequence: Synthetic oligonucleotide
ccggcggtgacggcgcaggt

SEQ ID NO: 234772 - DNA, 20 bp, Artificial Sequence
  Description of Artificial Sequence: Synthetic oligonucleotide
cggcggtgacggcgcagggt

SEQ ID NO: 234773 - DNA, 20 bp, Artificial Sequence
  Description of Artificial Sequence: Synthetic oligonucleotide
ggcggtgacggcgcaggggt

SEQ ID NO: 234774 - DNA, 20 bp, Artificial Sequence
  Description of Artificial Sequence: Synthetic oligonucleotide
gcggtgacggcgcaggggct

SEQ ID NO: 234775 - DNA, 20 bp, Artificial Sequence
  Description of Artificial Sequence: Synthetic oligonucleotide
cggtgacggcgcaggggcct

SEQ ID NO: 234776 - DNA, 20 bp, Artificial Sequence
  Description of Artificial Sequence: Synthetic oligonucleotide
ggtgacggcgcaggggccgt

SEQ ID NO: 234777 - DNA, 20 bp, Artificial Sequence
  Description of Artificial Sequence: Synthetic oligonucleotide
gtgacggcgcaggggccgct

SEQ ID NO: 234778 - DNA, 20 bp, Artificial Sequence
  Description of Artificial Sequence: Synthetic oligonucleotide
tgacggcgcaggggccgcct

SEQ ID NO: 234779 - DNA, 20 bp, Artificial Sequence
  Description of Artificial Sequence: Synthetic oligonucleotide
gacggcgcaggggccgcctt

SEQ ID NO: 234780 - DNA, 21 bp, Artificial Sequence
  Description of Artificial Sequence: Synthetic oligonucleotide
acggcgcaggggccgcctgtt

SEQ ID NO: 234781 - DNA, 20 bp, Artificial Sequence
  Description of Artificial Sequence: Synthetic oligonucleotide
cggcgcaggggccgcctgtt

SEQ ID NO: 234782 - DNA, 20 bp, Artificial Sequence
  Description of Artificial Sequence: Synthetic oligonucleotide
ggcgcaggggccgcctgttg

SEQ ID NO: 234783 - DNA, 20 bp, Artificial Sequence
  Description of Artificial Sequence: Synthetic oligonucleotide
gcgcaggggccgcctgttgc

SEQ ID NO: 234784 - DNA, 20 bp, Artificial Sequence
  Description of Artificial Sequence: Synthetic oligonucleotide
cgcaggggccgcctgttgcc

SEQ ID NO: 234785 - DNA, 21 bp, Artificial Sequence
  Description of Artificial Sequence: Synthetic oligonucleotide
gcaggggccgcctgttgccga

SEQ ID NO: 234786 - DNA, 23 bp, Artificial Sequence
  Description of Artificial Sequence: Synthetic oligonucleotide
caggggccgcctgttgccgagta

SEQ ID NO: 234787 - DNA, 24 bp, Artificial Sequence
  Description of Artificial Sequence: Synthetic oligonucleotide
aggggccgcctgttgccgagtact

SEQ ID NO: 234788 - DNA, 23 bp, Artificial Sequence
  Description of Artificial Sequence: Synthetic oligonucleotide
ggggccgcctgttgccgagtact

SEQ ID NO: 234789 - DNA, 23 bp, Artificial Sequence
  Description of Artificial Sequence: Synthetic oligonucleotide
gggccgcctgttgccgagtactg

SEQ ID NO: 234790 - DNA, 25 bp, Artificial Sequence
  Description of Artificial Sequence: Synthetic oligonucleotide
ggccgcctgttgccgagtactggta

SEQ ID NO: 234791 - DNA, 26 bp, Artificial Sequence
  Description of Artificial Sequence: Synthetic oligonucleotide
gccgcctgttgccgagtactggtaca

SEQ ID NO: 234792 - DNA, 26 bp, Artificial Sequence
  Description of Artificial Sequence: Synthetic oligonucleotide
ccgcctgttgccgagtactggtacag

SEQ ID NO: 234793 - DNA, 26 bp, Artificial Sequence
  Description of Artificial Sequence: Synthetic oligonucleotide
cgcctgttgccgagtactggtacagc

SEQ ID NO: 234794 - DNA, 27 bp, Artificial Sequence
  Description of Artificial Sequence: Synthetic oligonucleotide
gcctgttgccgagtactggtacagcca

SEQ ID NO: 234795 - DNA, 27 bp, Artificial Sequence
  Description of Artificial Sequence: Synthetic oligonucleotide
cctgttgccgagtactggtacagccag

SEQ ID NO: 234796 - DNA, 29 bp, Artificial Sequence
  Description of Artificial Sequence: Synthetic oligonucleotide
ctgttgccgagtactggtacagccagatg

SEQ ID NO: 234797 - DNA, 29 bp, Artificial Sequence
  Description of Artificial Sequence: Synthetic oligonucleotide
tgttgccgagtactggtacagccagatgg

SEQ ID NO: 234798 - DNA, 28 bp, Artificial Sequence
  Description of Artificial Sequence: Synthetic oligonucleotide
gttgccgagtactggtacagccagatgg

SEQ ID NO: 234799 - DNA, 30 bp, Artificial Sequence
  Description of Artificial Sequence: Synthetic oligonucleotide
ttgccgagtactggtacagccagatggaag

SEQ ID NO: 234800 - DNA, 29 bp, Artificial Sequence
  Description of Artificial Sequence: Synthetic oligonucleotide
tgccgagtactggtacagccagatggaag

SEQ ID NO: 234801 - DNA, 28 bp, Artificial Sequence
  Description of Artificial Sequence: Synthetic oligonucleotide
gccgagtactggtacagccagatggaag

SEQ ID NO: 234802 - DNA, 29 bp, Artificial Sequence
  Description of Artificial Sequence: Synthetic oligonucleotide
ccgagtactggtacagccagatggaagtc

SEQ ID NO: 234803 - DNA, 29 bp, Artificial Sequence
  Description of Artificial Sequence: Synthetic oligonucleotide
cgagtactggtacagccagatggaagtcc

SEQ ID NO: 234804 - DNA, 30 bp, Artificial Sequence
  Description of Artificial Sequence: Synthetic oligonucleotide
gagtactggtacagccagatggaagtcctc

SEQ ID NO: 234805 - DNA, 30 bp, Artificial Sequence
  Description of Artificial Sequence: Synthetic oligonucleotide
agtactggtacagccagatggaagtcctcg

SEQ ID NO: 234806 - DNA, 29 bp, Artificial Sequence
  Description of Artificial Sequence: Synthetic oligonucleotide
gtactggtacagccagatggaagtcctcg

SEQ ID NO: 234807 - DNA, 30 bp, Artificial Sequence
  Description of Artificial Sequence: Synthetic oligonucleotide
tactggtacagccagatggaagtcctcgag

SEQ ID NO: 234808 - DNA, 29 bp, Artificial Sequence
  Description of Artificial Sequence: Synthetic oligonucleotide
actggtacagccagatggaagtcctcgag

SEQ ID NO: 234809 - DNA, 28 bp, Artificial Sequence
  Description of Artificial Sequence: Synthetic oligonucleotide
ctggtacagccagatggaagtcctcgag

SEQ ID NO: 234810 - DNA, 28 bp, Artificial Sequence
  Description of Artificial Sequence: Synthetic oligonucleotide
tggtacagccagatggaagtcctcgagg

SEQ ID NO: 234811 - DNA, 27 bp, Artificial Sequence
  Description of Artificial Sequence: Synthetic oligonucleotide
ggtacagccagatggaagtcctcgagg

SEQ ID NO: 234812 - DNA, 27 bp, Artificial Sequence
  Description of Artificial Sequence: Synthetic oligonucleotide
gtacagccagatggaagtcctcgaggg

SEQ ID NO: 234813 - DNA, 27 bp, Artificial Sequence
  Description of Artificial Sequence: Synthetic oligonucleotide
tacagccagatggaagtcctcgagggg

SEQ ID NO: 234814 - DNA, 27 bp, Artificial Sequence
  Description of Artificial Sequence: Synthetic oligonucleotide
acagccagatggaagtcctcgagggga

SEQ ID NO: 234815 - DNA, 26 bp, Artificial Sequence
  Description of Artificial Sequence: Synthetic oligonucleotide
cagccagatggaagtcctcgagggga

SEQ ID NO: 234816 - DNA, 26 bp, Artificial Sequence
  Description of Artificial Sequence: Synthetic oligonucleotide
agccagatggaagtcctcgaggggac

SEQ ID NO: 234817 - DNA, 25 bp, Artificial Sequence
  Description of Artificial Sequence: Synthetic oligonucleotide
gccagatggaagtcctcgaggggac

SEQ ID NO: 234818 - DNA, 25 bp, Artificial Sequence
  Description of Artificial Sequence: Synthetic oligonucleotide
ccagatggaagtcctcgaggggacc

SEQ ID NO: 234819 - DNA, 25 bp, Artificial Sequence
  Description of Artificial Sequence: Synthetic oligonucleotide
cagatggaagtcctcgaggggaccg

SEQ ID NO: 234820 - DNA, 25 bp, Artificial Sequence
  Description of Artificial Sequence: Synthetic oligonucleotide
agatggaagtcctcgaggggaccgg

SEQ ID NO: 234821 - DNA, 24 bp, Artificial Sequence
  Description of Artificial Sequence: Synthetic oligonucleotide
gatggaagtcctcgaggggaccgg

SEQ ID NO: 234822 - DNA, 24 bp, Artificial Sequence
  Description of Artificial Sequence: Synthetic oligonucleotide
atggaagtcctcgaggggaccggg

SEQ ID NO: 234823 - DNA, 23 bp, Artificial Sequence
  Description of Artificial Sequence: Synthetic oligonucleotide
tggaagtcctcgaggggaccggg

SEQ ID NO: 234824 - DNA, 22 bp, Artificial Sequence
  Description of Artificial Sequence: Synthetic oligonucleotide
ggaagtcctcgaggggaccggg

SEQ ID NO: 234825 - DNA, 22 bp, Artificial Sequence
  Description of Artificial Sequence: Synthetic oligonucleotide
gaagtcctcgaggggaccgggg

SEQ ID NO: 234826 - DNA, 22 bp, Artificial Sequence
  Description of Artificial Sequence: Synthetic oligonucleotide
aagtcctcgaggggaccggggc

SEQ ID NO: 234827 - DNA, 21 bp, Artificial Sequence
  Description of Artificial Sequence: Synthetic oligonucleotide
agtcctcgaggggaccggggc

SEQ ID NO: 234828 - DNA, 20 bp, Artificial Sequence
  Description of Artificial Sequence: Synthetic oligonucleotide
gtcctcgaggggaccggggc

SEQ ID NO: 234829 - DNA, 20 bp, Artificial Sequence
  Description of Artificial Sequence: Synthetic oligonucleotide
tcctcgaggggaccggggcg

SEQ ID NO: 234830 - DNA, 20 bp, Artificial Sequence
  Description of Artificial Sequence: Synthetic oligonucleotide
cctcgaggggaccggggcgt

SEQ ID NO: 234831 - DNA, 20 bp, Artificial Sequence
  Description of Artificial Sequence: Synthetic oligonucleotide
ctcgaggggaccggggcgga

SEQ ID NO: 234832 - DNA, 22 bp, Artificial Sequence
  Description of Artificial Sequence: Synthetic oligonucleotide
tcgaggggaccggggcggagta

SEQ ID NO: 234833 - DNA, 21 bp, Artificial Sequence
  Description of Artificial Sequence: Synthetic oligonucleotide
cgaggggaccggggcggagta

SEQ ID NO: 234834 - DNA, 21 bp, Artificial Sequence
  Description of Artificial Sequence: Synthetic oligonucleotide
gaggggaccggggcggagtag

SEQ ID NO: 234835 - DNA, 22 bp, Artificial Sequence
  Description of Artificial Sequence: Synthetic oligonucleotide
aggggaccggggcggagtagga

SEQ ID NO: 234836 - DNA, 21 bp, Artificial Sequence
  Description of Artificial Sequence: Synthetic oligonucleotide
ggggaccggggcggagtagga

SEQ ID NO: 234837 - DNA, 22 bp, Artificial Sequence
  Description of Artificial Sequence: Synthetic oligonucleotide
gggaccggggcggagtaggaca

SEQ ID NO: 234838 - DNA, 22 bp, Artificial Sequence
  Description of Artificial Sequence: Synthetic oligonucleotide
ggaccggggcggagtaggacac

SEQ ID NO: 234839 - DNA, 22 bp, Artificial Sequence
  Description of Artificial Sequence: Synthetic oligonucleotide
gaccggggcggagtaggacacg

SEQ ID NO: 234840 - DNA, 23 bp, Artificial Sequence
  Description of Artificial Sequence: Synthetic oligonucleotide
accggggcggagtaggacacggt

SEQ ID NO: 234841 - DNA, 22 bp, Artificial Sequence
  Description of Artificial Sequence: Synthetic oligonucleotide
ccggggcggagtaggacacggt

SEQ ID NO: 234842 - DNA, 23 bp, Artificial Sequence
  Description of Artificial Sequence: Synthetic oligonucleotide
cggggcggagtaggacacggtct

SEQ ID NO: 234843 - DNA, 23 bp, Artificial Sequence
  Description of Artificial Sequence: Synthetic oligonucleotide
ggggcggagtaggacacggtctg

SEQ ID NO: 234844 - DNA, 24 bp, Artificial Sequence
  Description of Artificial Sequence: Synthetic oligonucleotide
gggcggagtaggacacggtctgca

SEQ ID NO: 234845 - DNA, 25 bp, Artificial Sequence
  Description of Artificial Sequence: Synthetic oligonucleotide
ggcggagtaggacacggtctgcaga

SEQ ID NO: 234846 - DNA, 26 bp, Artificial Sequence
  Description of Artificial Sequence: Synthetic oligonucleotide
gcggagtaggacacggtctgcagaca

SEQ ID NO: 234847 - DNA, 27 bp, Artificial Sequence
  Description of Artificial Sequence: Synthetic oligonucleotide
cggagtaggacacggtctgcagacact

SEQ ID NO: 234848 - DNA, 28 bp, Artificial Sequence
  Description of Artificial Sequence: Synthetic oligonucleotide
ggagtaggacacggtctgcagacactac

SEQ ID NO: 234849 - DNA, 30 bp, Artificial Sequence
  Description of Artificial Sequence: Synthetic oligonucleotide
gagtaggacacggtctgcagacactactac

SEQ ID NO: 234850 - DNA, 30 bp, Artificial Sequence
  Description of Artificial Sequence: Synthetic oligonucleotide
agtaggacacggtctgcagacactactacg

SEQ ID NO: 234851 - DNA, 29 bp, Artificial Sequence
  Description of Artificial Sequence: Synthetic oligonucleotide
gtaggacacggtctgcagacactactacg

SEQ ID NO: 234852 - DNA, 30 bp, Artificial Sequence
  Description of Artificial Sequence: Synthetic oligonucleotide
taggacacggtctgcagacactactacgag

SEQ ID NO: 234853 - DNA, 29 bp, Artificial Sequence
  Description of Artificial Sequence: Synthetic oligonucleotide
aggacacggtctgcagacactactacgag

SEQ ID NO: 234854 - DNA, 28 bp, Artificial Sequence
  Description of Artificial Sequence: Synthetic oligonucleotide
ggacacggtctgcagacactactacgag

SEQ ID NO: 234855 - DNA, 28 bp, Artificial Sequence
  Description of Artificial Sequence: Synthetic oligonucleotide
gacacggtctgcagacactactacgagg

SEQ ID NO: 234856 - DNA, 29 bp, Artificial Sequence
  Description of Artificial Sequence: Synthetic oligonucleotide
acacggtctgcagacactactacgaggag

SEQ ID NO: 234857 - DNA, 28 bp, Artificial Sequence
  Description of Artificial Sequence: Synthetic oligonucleotide
cacggtctgcagacactactacgaggag

SEQ ID NO: 234858 - DNA, 28 bp, Artificial Sequence
  Description of Artificial Sequence: Synthetic oligonucleotide
acggtctgcagacactactacgaggagg

SEQ ID NO: 234859 - DNA, 27 bp, Artificial Sequence
  Description of Artificial Sequence: Synthetic oligonucleotide
cggtctgcagacactactacgaggagg

SEQ ID NO: 234860 - DNA, 27 bp, Artificial Sequence
  Description of Artificial Sequence: Synthetic oligonucleotide
ggtctgcagacactactacgaggaggg

SEQ ID NO: 234861 - DNA, 27 bp, Artificial Sequence
  Description of Artificial Sequence: Synthetic oligonucleotide
gtctgcagacactactacgaggagggg

SEQ ID NO: 234862 - DNA, 29 bp, Artificial Sequence
  Description of Artificial Sequence: Synthetic oligonucleotide
tctgcagacactactacgaggaggggtac

SEQ ID NO: 234863 - DNA, 28 bp, Artificial Sequence
  Description of Artificial Sequence: Synthetic oligonucleotide
ctgcagacactactacgaggaggggtac

SEQ ID NO: 234864 - DNA, 28 bp, Artificial Sequence
  Description of Artificial Sequence: Synthetic oligonucleotide
tgcagacactactacgaggaggggtacc

SEQ ID NO: 234865 - DNA, 27 bp, Artificial Sequence
  Description of Artificial Sequence: Synthetic oligonucleotide
gcagacactactacgaggaggggtacc

SEQ ID NO: 234866 - DNA, 27 bp, Artificial Sequence
  Description of Artificial Sequence: Synthetic oligonucleotide
cagacactactacgaggaggggtaccg

SEQ ID NO: 234867 - DNA, 27 bp, Artificial Sequence
  Description of Artificial Sequence: Synthetic oligonucleotide
agacactactacgaggaggggtaccgg

SEQ ID NO: 234868 - DNA, 26 bp, Artificial Sequence
  Description of Artificial Sequence: Synthetic oligonucleotide
gacactactacgaggaggggtaccgg

SEQ ID NO: 234869 - DNA, 26 bp, Artificial Sequence
  Description of Artificial Sequence: Synthetic oligonucleotide
acactactacgaggaggggtaccggg

SEQ ID NO: 234870 - DNA, 25 bp, Artificial Sequence
  Description of Artificial Sequence: Synthetic oligonucleotide
cactactacgaggaggggtaccggg

SEQ ID NO: 234871 - DNA, 25 bp, Artificial Sequence
  Description of Artificial Sequence: Synthetic oligonucleotide
actactacgaggaggggtaccgggg

SEQ ID NO: 234872 - DNA, 24 bp, Artificial Sequence
  Description of Artificial Sequence: Synthetic oligonucleotide
ctactacgaggaggggtaccgggg

SEQ ID NO: 234873 - DNA, 26 bp, Artificial Sequence
  Description of Artificial Sequence: Synthetic oligonucleotide
tactacgaggaggggtaccgggggat

SEQ ID NO: 234874 - DNA, 25 bp, Artificial Sequence
  Description of Artificial Sequence: Synthetic oligonucleotide
actacgaggaggggtaccgggggat

SEQ ID NO: 234875 - DNA, 24 bp, Artificial Sequence
  Description of Artificial Sequence: Synthetic oligonucleotide
ctacgaggaggggtaccgggggat

SEQ ID NO: 234876 - DNA, 24 bp, Artificial Sequence
  Description of Artificial Sequence: Synthetic oligonucleotide
tacgaggaggggtaccgggggatc

SEQ ID NO: 234877 - DNA, 23 bp, Artificial Sequence
  Description of Artificial Sequence: Synthetic oligonucleotide
acgaggaggggtaccgggggatc

SEQ ID NO: 234878 - DNA, 22 bp, Artificial Sequence
  Description of Artificial Sequence: Synthetic oligonucleotide
cgaggaggggtaccgggggatc

SEQ ID NO: 234879 - DNA, 23 bp, Artificial Sequence
  Description of Artificial Sequence: Synthetic oligonucleotide
gaggaggggtaccgggggatcct

SEQ ID NO: 234880 - DNA, 23 bp, Artificial Sequence
  Description of Artificial Sequence: Synthetic oligonucleotide
aggaggggtaccgggggatcctg

SEQ ID NO: 234881 - DNA, 22 bp, Artificial Sequence
  Description of Artificial Sequence: Synthetic oligonucleotide
ggaggggtaccgggggatcctg

SEQ ID NO: 234882 - DNA, 23 bp, Artificial Sequence
  Description of Artificial Sequence: Synthetic oligonucleotide
gaggggtaccgggggatcctgga

SEQ ID NO: 234883 - DNA, 24 bp, Artificial Sequence
  Description of Artificial Sequence: Synthetic oligonucleotide
aggggtaccgggggatcctggaga

SEQ ID NO: 234884 - DNA, 23 bp, Artificial Sequence
  Description of Artificial Sequence: Synthetic oligonucleotide
ggggtaccgggggatcctggaga

SEQ ID NO: 234885 - DNA, 23 bp, Artificial Sequence
  Description of Artificial Sequence: Synthetic oligonucleotide
gggtaccgggggatcctggagag

SEQ ID NO: 234886 - DNA, 24 bp, Artificial Sequence
  Description of Artificial Sequence: Synthetic oligonucleotide
ggtaccgggggatcctggagagga

SEQ ID NO: 234887 - DNA, 25 bp, Artificial Sequence
  Description of Artificial Sequence: Synthetic oligonucleotide
gtaccgggggatcctggagaggaga

SEQ ID NO: 234888 - DNA, 26 bp, Artificial Sequence
  Description of Artificial Sequence: Synthetic oligonucleotide
taccgggggatcctggagaggagaga

SEQ ID NO: 234889 - DNA, 25 bp, Artificial Sequence
  Description of Artificial Sequence: Synthetic oligonucleotide
accgggggatcctggagaggagaga

SEQ ID NO: 234890 - DNA, 24 bp, Artificial Sequence
  Description of Artificial Sequence: Synthetic oligonucleotide
ccgggggatcctggagaggagaga

SEQ ID NO: 234891 - DNA, 24 bp, Artificial Sequence
  Description of Artificial Sequence: Synthetic oligonucleotide
cgggggatcctggagaggagagag

SEQ ID NO: 234892 - DNA, 25 bp, Artificial Sequence
  Description of Artificial Sequence: Synthetic oligonucleotide
gggggatcctggagaggagagagga

SEQ ID NO: 234893 - DNA, 25 bp, Artificial Sequence
  Description of Artificial Sequence: Synthetic oligonucleotide
ggggatcctggagaggagagaggag

SEQ ID NO: 234894 - DNA, 25 bp, Artificial Sequence
  Description of Artificial Sequence: Synthetic oligonucleotide
gggatcctggagaggagagaggagc

SEQ ID NO: 234895 - DNA, 25 bp, Artificial Sequence
  Description of Artificial Sequence: Synthetic oligonucleotide
ggatcctggagaggagagaggagcc

SEQ ID NO: 234896 - DNA, 26 bp, Artificial Sequence
  Description of Artificial Sequence: Synthetic oligonucleotide
gatcctggagaggagagaggagccca

SEQ ID NO: 234897 - DNA, 26 bp, Artificial Sequence
  Description of Artificial Sequence: Synthetic oligonucleotide
atcctggagaggagagaggagcccac

SEQ ID NO: 234898 - DNA, 25 bp, Artificial Sequence
  Description of Artificial Sequence: Synthetic oligonucleotide
tcctggagaggagagaggagcccac

SEQ ID NO: 234899 - DNA, 24 bp, Artificial Sequence
  Description of Artificial Sequence: Synthetic oligonucleotide
cctggagaggagagaggagcccac

SEQ ID NO: 234900 - DNA, 24 bp, Artificial Sequence
  Description of Artificial Sequence: Synthetic oligonucleotide
ctggagaggagagaggagcccacc

SEQ ID NO: 234901 - DNA, 25 bp, Artificial Sequence
  Description of Artificial Sequence: Synthetic oligonucleotide
tggagaggagagaggagcccaccgt

SEQ ID NO: 234902 - DNA, 24 bp, Artificial Sequence
  Description of Artificial Sequence: Synthetic oligonucleotide
ggagaggagagaggagcccaccgt

SEQ ID NO: 234903 - DNA, 25 bp, Artificial Sequence
  Description of Artificial Sequence: Synthetic oligonucleotide
gagaggagagaggagcccaccgtga

SEQ ID NO: 234904 - DNA, 25 bp, Artificial Sequence
  Description of Artificial Sequence: Synthetic oligonucleotide
agaggagagaggagcccaccgtgac

SEQ ID NO: 234905 - DNA, 24 bp, Artificial Sequence
  Description of Artificial Sequence: Synthetic oligonucleotide
gaggagagaggagcccaccgtgac

SEQ ID NO: 234906 - DNA, 26 bp, Artificial Sequence
  Description of Artificial Sequence: Synthetic oligonucleotide
aggagagaggagcccaccgtgaccat

SEQ ID NO: 234907 - DNA, 25 bp, Artificial Sequence
  Description of Artificial Sequence: Synthetic oligonucleotide
ggagagaggagcccaccgtgaccat

SEQ ID NO: 234908 - DNA, 26 bp, Artificial Sequence
  Description of Artificial Sequence: Synthetic oligonucleotide
gagagaggagcccaccgtgaccatca

SEQ ID NO: 234909 - DNA, 26 bp, Artificial Sequence
  Description of Artificial Sequence: Synthetic oligonucleotide
agagaggagcccaccgtgaccatcac

SEQ ID NO: 234910 - DNA, 25 bp, Artificial Sequence
  Description of Artificial Sequence: Synthetic oligonucleotide
gagaggagcccaccgtgaccatcac

SEQ ID NO: 234911 - DNA, 25 bp, Artificial Sequence
  Description of Artificial Sequence: Synthetic oligonucleotide
agaggagcccaccgtgaccatcacc

SEQ ID NO: 234912 - DNA, 24 bp, Artificial Sequence
  Description of Artificial Sequence: Synthetic oligonucleotide
gaggagcccaccgtgaccatcacc

SEQ ID NO: 234913 - DNA, 24 bp, Artificial Sequence
  Description of Artificial Sequence: Synthetic oligonucleotide
aggagcccaccgtgaccatcaccc

SEQ ID NO: 234914 - DNA, 23 bp, Artificial Sequence
  Description of Artificial Sequence: Synthetic oligonucleotide
ggagcccaccgtgaccatcaccc

SEQ ID NO: 234915 - DNA, 25 bp, Artificial Sequence
  Description of Artificial Sequence: Synthetic oligonucleotide
gagcccaccgtgaccatcaccccat

SEQ ID NO: 234916 - DNA, 25 bp, Artificial Sequence
  Description of Artificial Sequence: Synthetic oligonucleotide
agcccaccgtgaccatcaccccatc

SEQ ID NO: 234917 - DNA, 24 bp, Artificial Sequence
  Description of Artificial Sequence: Synthetic oligonucleotide
gcccaccgtgaccatcaccccatc

SEQ ID NO: 234918 - DNA, 25 bp, Artificial Sequence
  Description of Artificial Sequence: Synthetic oligonucleotide
cccaccgtgaccatcaccccatcca

SEQ ID NO: 234919 - DNA, 25 bp, Artificial Sequence
  Description of Artificial Sequence: Synthetic oligonucleotide
ccaccgtgaccatcaccccatccac

SEQ ID NO: 234920 - DNA, 26 bp, Artificial Sequence
  Description of Artificial Sequence: Synthetic oligonucleotide
caccgtgaccatcaccccatccacga

SEQ ID NO: 234921 - DNA, 27 bp, Artificial Sequence
  Description of Artificial Sequence: Synthetic oligonucleotide
accgtgaccatcaccccatccacgaca

SEQ ID NO: 234922 - DNA, 26 bp, Artificial Sequence
  Description of Artificial Sequence: Synthetic oligonucleotide
ccgtgaccatcaccccatccacgaca

SEQ ID NO: 234923 - DNA, 27 bp, Artificial Sequence
  Description of Artificial Sequence: Synthetic oligonucleotide
cgtgaccatcaccccatccacgacaga

SEQ ID NO: 234924 - DNA, 27 bp, Artificial Sequence
  Description of Artificial Sequence: Synthetic oligonucleotide
gtgaccatcaccccatccacgacagag

SEQ ID NO: 234925 - DNA, 27 bp, Artificial Sequence
  Description of Artificial Sequence: Synthetic oligonucleotide
tgaccatcaccccatccacgacagagg

SEQ ID NO: 234926 - DNA, 26 bp, Artificial Sequence
  Description of Artificial Sequence: Synthetic oligonucleotide
gaccatcaccccatccacgacagagg

SEQ ID NO: 234927 - DNA, 26 bp, Artificial Sequence
  Description of Artificial Sequence: Synthetic oligonucleotide
accatcaccccatccacgacagaggc

SEQ ID NO: 234928 - DNA, 25 bp, Artificial Sequence
  Description of Artificial Sequence: Synthetic oligonucleotide
ccatcaccccatccacgacagaggc

SEQ ID NO: 234929 - DNA, 25 bp, Artificial Sequence
  Description of Artificial Sequence: Synthetic oligonucleotide
catcaccccatccacgacagaggcg

SEQ ID NO: 234930 - DNA, 26 bp, Artificial Sequence
  Description of Artificial Sequence: Synthetic oligonucleotide
atcaccccatccacgacagaggcgct

SEQ ID NO: 234931 - DNA, 25 bp, Artificial Sequence
  Description of Artificial Sequence: Synthetic oligonucleotide
tcaccccatccacgacagaggcgct

SEQ ID NO: 234932 - DNA, 24 bp, Artificial Sequence
  Description of Artificial Sequence: Synthetic oligonucleotide
caccccatccacgacagaggcgct

SEQ ID NO: 234933 - DNA, 26 bp, Artificial Sequence
  Description of Artificial Sequence: Synthetic oligonucleotide
accccatccacgacagaggcgctcaa

SEQ ID NO: 234934 - DNA, 25 bp, Artificial Sequence
  Description of Artificial Sequence: Synthetic oligonucleotide
ccccatccacgacagaggcgctcaa

SEQ ID NO: 234935 - DNA, 25 bp, Artificial Sequence
  Description of Artificial Sequence: Synthetic oligonucleotide
cccatccacgacagaggcgctcaac

SEQ ID NO: 234936 - DNA, 26 bp, Artificial Sequence
  Description of Artificial Sequence: Synthetic oligonucleotide
ccatccacgacagaggcgctcaacca

SEQ ID NO: 234937 - DNA, 26 bp, Artificial Sequence
  Description of Artificial Sequence: Synthetic oligonucleotide
catccacgacagaggcgctcaaccac

SEQ ID NO: 234938 - DNA, 27 bp, Artificial Sequence
  Description of Artificial Sequence: Synthetic oligonucleotide
atccacgacagaggcgctcaaccacga

SEQ ID NO: 234939 - DNA, 26 bp, Artificial Sequence
  Description of Artificial Sequence: Synthetic oligonucleotide
tccacgacagaggcgctcaaccacga

SEQ ID NO: 234940 - DNA, 25 bp, Artificial Sequence
  Description of Artificial Sequence: Synthetic oligonucleotide
ccacgacagaggcgctcaaccacga

SEQ ID NO: 234941 - DNA, 27 bp, Artificial Sequence
  Description of Artificial Sequence: Synthetic oligonucleotide
cacgacagaggcgctcaaccacgacaa

SEQ ID NO: 234942 - DNA, 27 bp, Artificial Sequence
  Description of Artificial Sequence: Synthetic oligonucleotide
acgacagaggcgctcaaccacgacaac

SEQ ID NO: 234943 - DNA, 26 bp, Artificial Sequence
  Description of Artificial Sequence: Synthetic oligonucleotide
cgacagaggcgctcaaccacgacaac

SEQ ID NO: 234944 - DNA, 27 bp, Artificial Sequence
  Description of Artificial Sequence: Synthetic oligonucleotide
gacagaggcgctcaaccacgacaacct

SEQ ID NO: 234945 - DNA, 27 bp, Artificial Sequence
  Description of Artificial Sequence: Synthetic oligonucleotide
acagaggcgctcaaccacgacaacctg

SEQ ID NO: 234946 - DNA, 26 bp, Artificial Sequence
  Description of Artificial Sequence: Synthetic oligonucleotide
cagaggcgctcaaccacgacaacctg

SEQ ID NO: 234947 - DNA, 27 bp, Artificial Sequence
  Description of Artificial Sequence: Synthetic oligonucleotide
agaggcgctcaaccacgacaacctgca

SEQ ID NO: 234948 - DNA, 26 bp, Artificial Sequence
  Description of Artificial Sequence: Synthetic oligonucleotide
gaggcgctcaaccacgacaacctgca

SEQ ID NO: 234949 - DNA, 26 bp, Artificial Sequence
  Description of Artificial Sequence: Synthetic oligonucleotide
aggcgctcaaccacgacaacctgcag

SEQ ID NO: 234950 - DNA, 25 bp, Artificial Sequence
  Description of Artificial Sequence: Synthetic oligonucleotide
ggcgctcaaccacgacaacctgcag

SEQ ID NO: 234951 - DNA, 26 bp, Artificial Sequence
  Description of Artificial Sequence: Synthetic oligonucleotide
gcgctcaaccacgacaacctgcaggt

SEQ ID NO: 234952 - DNA, 27 bp, Artificial Sequence
  Description of Artificial Sequence: Synthetic oligonucleotide
cgctcaaccacgacaacctgcaggtct

SEQ ID NO: 234953 - DNA, 27 bp, Artificial Sequence
  Description of Artificial Sequence: Synthetic oligonucleotide
gctcaaccacgacaacctgcaggtctg

SEQ ID NO: 234954 - DNA, 27 bp, Artificial Sequence
  Description of Artificial Sequence: Synthetic oligonucleotide
ctcaaccacgacaacctgcaggtctgc

SEQ ID NO: 234955 - DNA, 28 bp, Artificial Sequence
  Description of Artificial Sequence: Synthetic oligonucleotide
tcaaccacgacaacctgcaggtctgctg

SEQ ID NO: 234956 - DNA, 27 bp, Artificial Sequence
  Description of Artificial Sequence: Synthetic oligonucleotide
caaccacgacaacctgcaggtctgctg

SEQ ID NO: 234957 - DNA, 27 bp, Artificial Sequence
  Description of Artificial Sequence: Synthetic oligonucleotide
aaccacgacaacctgcaggtctgctgg

SEQ ID NO: 234958 - DNA, 26 bp, Artificial Sequence
  Description of Artificial Sequence: Synthetic oligonucleotide
accacgacaacctgcaggtctgctgg

SEQ ID NO: 234959 - DNA, 25 bp, Artificial Sequence
  Description of Artificial Sequence: Synthetic oligonucleotide
ccacgacaacctgcaggtctgctgg

SEQ ID NO: 234960 - DNA, 26 bp, Artificial Sequence
  Description of Artificial Sequence: Synthetic oligonucleotide
cacgacaacctgcaggtctgctgggt

SEQ ID NO: 234961 - DNA, 27 bp, Artificial Sequence
  Description of Artificial Sequence: Synthetic oligonucleotide
acgacaacctgcaggtctgctgggtga

SEQ ID NO: 234962 - DNA, 26 bp, Artificial Sequence
  Description of Artificial Sequence: Synthetic oligonucleotide
cgacaacctgcaggtctgctgggtga

SEQ ID NO: 234963 - DNA, 27 bp, Artificial Sequence
  Description of Artificial Sequence: Synthetic oligonucleotide
gacaacctgcaggtctgctgggtgaca

SEQ ID NO: 234964 - DNA, 27 bp, Artificial Sequence
  Description of Artificial Sequence: Synthetic oligonucleotide
acaacctgcaggtctgctgggtgacag

SEQ ID NO: 234965 - DNA, 27 bp, Artificial Sequence
  Description of Artificial Sequence: Synthetic oligonucleotide
caacctgcaggtctgctgggtgacaga

SEQ ID NO: 234966 - DNA, 30 bp, Artificial Sequence
  Description of Artificial Sequence: Synthetic oligonucleotide
aacctgcaggtctgctgggtgacagatatc

SEQ ID NO: 234967 - DNA, 29 bp, Artificial Sequence
  Description of Artificial Sequence: Synthetic oligonucleotide
acctgcaggtctgctgggtgacagatatc

SEQ ID NO: 234968 - DNA, 28 bp, Artificial Sequence
  Description of Artificial Sequence: Synthetic oligonucleotide
cctgcaggtctgctgggtgacagatatc

SEQ ID NO: 234969 - DNA, 31 bp, Artificial Sequence
  Description of Artificial Sequence: Synthetic oligonucleotide
ctgcaggtctgctgggtgacagatatctatc

SEQ ID NO: 234970 - DNA, 31 bp, Artificial Sequence
  Description of Artificial Sequence: Synthetic oligonucleotide
tgcaggtctgctgggtgacagatatctatcc

SEQ ID NO: 234971 - DNA, 30 bp, Artificial Sequence
  Description of Artificial Sequence: Synthetic oligonucleotide
gcaggtctgctgggtgacagatatctatcc

SEQ ID NO: 234972 - DNA, 31 bp, Artificial Sequence
  Description of Artificial Sequence: Synthetic oligonucleotide
caggtctgctgggtgacagatatctatccag

SEQ ID NO: 234973 - DNA, 31 bp, Artificial Sequence
  Description of Artificial Sequence: Synthetic oligonucleotide
aggtctgctgggtgacagatatctatccagg

SEQ ID NO: 234974 - DNA, 30 bp, Artificial Sequence
  Description of Artificial Sequence: Synthetic oligonucleotide
ggtctgctgggtgacagatatctatccagg

SEQ ID NO: 234975 - DNA, 30 bp, Artificial Sequence
  Description of Artificial Sequence: Synthetic oligonucleotide
gtctgctgggtgacagatatctatccaggc

SEQ ID NO: 234976 - DNA, 30 bp, Artificial Sequence
  Description of Artificial Sequence: Synthetic oligonucleotide
tctgctgggtgacagatatctatccaggcc

SEQ ID NO: 234977 - DNA, 29 bp, Artificial Sequence
  Description of Artificial Sequence: Synthetic oligonucleotide
ctgctgggtgacagatatctatccaggcc

SEQ ID NO: 234978 - DNA, 30 bp, Artificial Sequence
  Description of Artificial Sequence: Synthetic oligonucleotide
tgctgggtgacagatatctatccaggccag

SEQ ID NO: 234979 - DNA, 29 bp, Artificial Sequence
  Description of Artificial Sequence: Synthetic oligonucleotide
gctgggtgacagatatctatccaggccag

SEQ ID NO: 234980 - DNA, 31 bp, Artificial Sequence
  Description of Artificial Sequence: Synthetic oligonucleotide
ctgggtgacagatatctatccaggccagatc

SEQ ID NO: 234981 - DNA, 34 bp, Artificial Sequence
  Description of Artificial Sequence: Synthetic oligonucleotide
tgggtgacagatatctatccaggccagatcaatg

SEQ ID NO: 234982 - DNA, 33 bp, Artificial Sequence
  Description of Artificial Sequence: Synthetic oligonucleotide
gggtgacagatatctatccaggccagatcaatg

SEQ ID NO: 234983 - DNA, 34 bp, Artificial Sequence
  Description of Artificial Sequence: Synthetic oligonucleotide
ggtgacagatatctatccaggccagatcaatgtc

SEQ ID NO: 234984 - DNA, 34 bp, Artificial Sequence
  Description of Artificial Sequence: Synthetic oligonucleotide
gtgacagatatctatccaggccagatcaatgtcc

SEQ ID NO: 234985 - DNA, 35 bp, Artificial Sequence
  Description of Artificial Sequence: Synthetic oligonucleotide
tgacagatatctatccaggccagatcaatgtccag

SEQ ID NO: 234986 - DNA, 34 bp, Artificial Sequence
  Description of Artificial Sequence: Synthetic oligonucleotide
gacagatatctatccaggccagatcaatgtccag

SEQ ID NO: 234987 - DNA, 35 bp, Artificial Sequence
  Description of Artificial Sequence: Synthetic oligonucleotide
acagatatctatccaggccagatcaatgtccagtg

SEQ ID NO: 234988 - DNA, 34 bp, Artificial Sequence
  Description of Artificial Sequence: Synthetic oligonucleotide
cagatatctatccaggccagatcaatgtccagtg

SEQ ID NO: 234989 - DNA, 34 bp, Artificial Sequence
  Description of Artificial Sequence: Synthetic oligonucleotide
agatatctatccaggccagatcaatgtccagtgg

SEQ ID NO: 234990 - DNA, 33 bp, Artificial Sequence
  Description of Artificial Sequence: Synthetic oligonucleotide
gatatctatccaggccagatcaatgtccagtgg

SEQ ID NO: 234991 - DNA, 36 bp, Artificial Sequence
  Description of Artificial Sequence: Synthetic oligonucleotide
atatctatccaggccagatcaatgtccagtggattc

SEQ ID NO: 234992 - DNA, 35 bp, Artificial Sequence
  Description of Artificial Sequence: Synthetic oligonucleotide
tatctatccaggccagatcaatgtccagtggattc

SEQ ID NO: 234993 - DNA, 34 bp, Artificial Sequence
  Description of Artificial Sequence: Synthetic oligonucleotide
atctatccaggccagatcaatgtccagtggattc

SEQ ID NO: 234994 - DNA, 33 bp, Artificial Sequence
  Description of Artificial Sequence: Synthetic oligonucleotide
tctatccaggccagatcaatgtccagtggattc

SEQ ID NO: 234995 - DNA, 32 bp, Artificial Sequence
  Description of Artificial Sequence: Synthetic oligonucleotide
ctatccaggccagatcaatgtccagtggattc

SEQ ID NO: 234996 - DNA, 32 bp, Artificial Sequence
  Description of Artificial Sequence: Synthetic oligonucleotide
tatccaggccagatcaatgtccagtggattcg

SEQ ID NO: 234997 - DNA, 31 bp, Artificial Sequence
  Description of Artificial Sequence: Synthetic oligonucleotide
atccaggccagatcaatgtccagtggattcg

SEQ ID NO: 234998 - DNA, 30 bp, Artificial Sequence
  Description of Artificial Sequence: Synthetic oligonucleotide
tccaggccagatcaatgtccagtggattcg

SEQ ID NO: 234999 - DNA, 29 bp, Artificial Sequence
  Description of Artificial Sequence: Synthetic oligonucleotide
ccaggccagatcaatgtccagtggattcg

SEQ ID NO: 235000 - DNA, 29 bp, Artificial Sequence
  Description of Artificial Sequence: Synthetic oligonucleotide
caggccagatcaatgtccagtggattcgg

SEQ ID NO: 235001 - DNA, 32 bp, Artificial Sequence
  Description of Artificial Sequence: Synthetic oligonucleotide
aggccagatcaatgtccagtggattcggaatc

SEQ ID NO: 235002 - DNA, 31 bp, Artificial Sequence
  Description of Artificial Sequence: Synthetic oligonucleotide
ggccagatcaatgtccagtggattcggaatc

SEQ ID NO: 235003 - DNA, 33 bp, Artificial Sequence
  Description of Artificial Sequence: Synthetic oligonucleotide
gccagatcaatgtccagtggattcggaatcatc

SEQ ID NO: 235004 - DNA, 34 bp, Artificial Sequence
  Description of Artificial Sequence: Synthetic oligonucleotide
ccagatcaatgtccagtggattcggaatcatcag

SEQ ID NO: 235005 - DNA, 34 bp, Artificial Sequence
  Description of Artificial Sequence: Synthetic oligonucleotide
cagatcaatgtccagtggattcggaatcatcagg

SEQ ID NO: 235006 - DNA, 35 bp, Artificial Sequence
  Description of Artificial Sequence: Synthetic oligonucleotide
agatcaatgtccagtggattcggaatcatcaggag

SEQ ID NO: 235007 - DNA, 34 bp, Artificial Sequence
  Description of Artificial Sequence: Synthetic oligonucleotide
gatcaatgtccagtggattcggaatcatcaggag

SEQ ID NO: 235008 - DNA, 34 bp, Artificial Sequence
  Description of Artificial Sequence: Synthetic oligonucleotide
atcaatgtccagtggattcggaatcatcaggagg

SEQ ID NO: 235009 - DNA, 33 bp, Artificial Sequence
  Description of Artificial Sequence: Synthetic oligonucleotide
tcaatgtccagtggattcggaatcatcaggagg

SEQ ID NO: 235010 - DNA, 32 bp, Artificial Sequence
  Description of Artificial Sequence: Synthetic oligonucleotide
caatgtccagtggattcggaatcatcaggagg

SEQ ID NO: 235011 - DNA, 33 bp, Artificial Sequence
  Description of Artificial Sequence: Synthetic oligonucleotide
aatgtccagtggattcggaatcatcaggaggac

SEQ ID NO: 235012 - DNA, 32 bp, Artificial Sequence
  Description of Artificial Sequence: Synthetic oligonucleotide
atgtccagtggattcggaatcatcaggaggac

SEQ ID NO: 235013 - DNA, 31 bp, Artificial Sequence
  Description of Artificial Sequence: Synthetic oligonucleotide
tgtccagtggattcggaatcatcaggaggac

SEQ ID NO: 235014 - DNA, 30 bp, Artificial Sequence
  Description of Artificial Sequence: Synthetic oligonucleotide
gtccagtggattcggaatcatcaggaggac

SEQ ID NO: 235015 - DNA, 31 bp, Artificial Sequence
  Description of Artificial Sequence: Synthetic oligonucleotide
tccagtggattcggaatcatcaggaggacac

SEQ ID NO: 235016 - DNA, 30 bp, Artificial Sequence
  Description of Artificial Sequence: Synthetic oligonucleotide
ccagtggattcggaatcatcaggaggacac

SEQ ID NO: 235017 - DNA, 31 bp, Artificial Sequence
  Description of Artificial Sequence: Synthetic oligonucleotide
cagtggattcggaatcatcaggaggacacag

SEQ ID NO: 235018 - DNA, 31 bp, Artificial Sequence
  Description of Artificial Sequence: Synthetic oligonucleotide
agtggattcggaatcatcaggaggacacagc

SEQ ID NO: 235019 - DNA, 30 bp, Artificial Sequence
  Description of Artificial Sequence: Synthetic oligonucleotide
gtggattcggaatcatcaggaggacacagc

SEQ ID NO: 235020 - DNA, 30 bp, Artificial Sequence
  Description of Artificial Sequence: Synthetic oligonucleotide
tggattcggaatcatcaggaggacacagcc

SEQ ID NO: 235021 - DNA, 29 bp, Artificial Sequence
  Description of Artificial Sequence: Synthetic oligonucleotide
ggattcggaatcatcaggaggacacagcc

SEQ ID NO: 235022 - DNA, 29 bp, Artificial Sequence
  Description of Artificial Sequence: Synthetic oligonucleotide
gattcggaatcatcaggaggacacagccg

SEQ ID NO: 235023 - DNA, 29 bp, Artificial Sequence
  Description of Artificial Sequence: Synthetic oligonucleotide
attcggaatcatcaggaggacacagccgg

SEQ ID NO: 235024 - DNA, 28 bp, Artificial Sequence
  Description of Artificial Sequence: Synthetic oligonucleotide
ttcggaatcatcaggaggacacagccgg

SEQ ID NO: 235025 - DNA, 27 bp, Artificial Sequence
  Description of Artificial Sequence: Synthetic oligonucleotide
tcggaatcatcaggaggacacagccgg

SEQ ID NO: 235026 - DNA, 26 bp, Artificial Sequence
  Description of Artificial Sequence: Synthetic oligonucleotide
cggaatcatcaggaggacacagccgg

SEQ ID NO: 235027 - DNA, 26 bp, Artificial Sequence
  Description of Artificial Sequence: Synthetic oligonucleotide
ggaatcatcaggaggacacagccggc

SEQ ID NO: 235028 - DNA, 27 bp, Artificial Sequence
  Description of Artificial Sequence: Synthetic oligonucleotide
gaatcatcaggaggacacagccggcct

SEQ ID NO: 235029 - DNA, 28 bp, Artificial Sequence
  Description of Artificial Sequence: Synthetic oligonucleotide
aatcatcaggaggacacagccggccttg

SEQ ID NO: 235030 - DNA, 27 bp, Artificial Sequence
  Description of Artificial Sequence: Synthetic oligonucleotide
atcatcaggaggacacagccggccttg

SEQ ID NO: 235031 - DNA, 27 bp, Artificial Sequence
  Description of Artificial Sequence: Synthetic oligonucleotide
tcatcaggaggacacagccggccttgt

SEQ ID NO: 235032 - DNA, 26 bp, Artificial Sequence
  Description of Artificial Sequence: Synthetic oligonucleotide
catcaggaggacacagccggccttgt

SEQ ID NO: 235033 - DNA, 27 bp, Artificial Sequence
  Description of Artificial Sequence: Synthetic oligonucleotide
atcaggaggacacagccggccttgtgt

SEQ ID NO: 235034 - DNA, 26 bp, Artificial Sequence
  Description of Artificial Sequence: Synthetic oligonucleotide
tcaggaggacacagccggccttgtgt

SEQ ID NO: 235035 - DNA, 25 bp, Artificial Sequence
  Description of Artificial Sequence: Synthetic oligonucleotide
caggaggacacagccggccttgtgt

SEQ ID NO: 235036 - DNA, 25 bp, Artificial Sequence
  Description of Artificial Sequence: Synthetic oligonucleotide
aggaggacacagccggccttgtgtc

SEQ ID NO: 235037 - DNA, 24 bp, Artificial Sequence
  Description of Artificial Sequence: Synthetic oligonucleotide
ggaggacacagccggccttgtgtc

SEQ ID NO: 235038 - DNA, 25 bp, Artificial Sequence
  Description of Artificial Sequence: Synthetic oligonucleotide
gaggacacagccggccttgtgtcca

SEQ ID NO: 235039 - DNA, 25 bp, Artificial Sequence
  Description of Artificial Sequence: Synthetic oligonucleotide
aggacacagccggccttgtgtccag

SEQ ID NO: 235040 - DNA, 24 bp, Artificial Sequence
  Description of Artificial Sequence: Synthetic oligonucleotide
ggacacagccggccttgtgtccag

SEQ ID NO: 235041 - DNA, 24 bp, Artificial Sequence
  Description of Artificial Sequence: Synthetic oligonucleotide
gacacagccggccttgtgtccagc

SEQ ID NO: 235042 - DNA, 24 bp, Artificial Sequence
  Description of Artificial Sequence: Synthetic oligonucleotide
acacagccggccttgtgtccagcc

SEQ ID NO: 235043 - DNA, 23 bp, Artificial Sequence
  Description of Artificial Sequence: Synthetic oligonucleotide
cacagccggccttgtgtccagcc

SEQ ID NO: 235044 - DNA, 23 bp, Artificial Sequence
  Description of Artificial Sequence: Synthetic oligonucleotide
acagccggccttgtgtccagccc

SEQ ID NO: 235045 - DNA, 22 bp, Artificial Sequence
  Description of Artificial Sequence: Synthetic oligonucleotide
cagccggccttgtgtccagccc

SEQ ID NO: 235046 - DNA, 22 bp, Artificial Sequence
  Description of Artificial Sequence: Synthetic oligonucleotide
agccggccttgtgtccagcccc

SEQ ID NO: 235047 - DNA, 21 bp, Artificial Sequence
  Description of Artificial Sequence: Synthetic oligonucleotide
gccggccttgtgtccagcccc

SEQ ID NO: 235048 - DNA, 27 bp, Artificial Sequence
  Description of Artificial Sequence: Synthetic oligonucleotide
ccggccttgtgtccagcccccttataa

SEQ ID NO: 235049 - DNA, 27 bp, Artificial Sequence
  Description of Artificial Sequence: Synthetic oligonucleotide
cggccttgtgtccagcccccttataag

SEQ ID NO: 235050 - DNA, 27 bp, Artificial Sequence
  Description of Artificial Sequence: Synthetic oligonucleotide
ggccttgtgtccagcccccttataagg

SEQ ID NO: 235051 - DNA, 30 bp, Artificial Sequence
  Description of Artificial Sequence: Synthetic oligonucleotide
gccttgtgtccagcccccttataaggaatg

SEQ ID NO: 235052 - DNA, 30 bp, Artificial Sequence
  Description of Artificial Sequence: Synthetic oligonucleotide
ccttgtgtccagcccccttataaggaatgg

SEQ ID NO: 235053 - DNA, 31 bp, Artificial Sequence
  Description of Artificial Sequence: Synthetic oligonucleotide
cttgtgtccagcccccttataaggaatggtc

SEQ ID NO: 235054 - DNA, 32 bp, Artificial Sequence
  Description of Artificial Sequence: Synthetic oligonucleotide
ttgtgtccagcccccttataaggaatggtcac

SEQ ID NO: 235055 - DNA, 31 bp, Artificial Sequence
  Description of Artificial Sequence: Synthetic oligonucleotide
tgtgtccagcccccttataaggaatggtcac

SEQ ID NO: 235056 - DNA, 30 bp, Artificial Sequence
  Description of Artificial Sequence: Synthetic oligonucleotide
gtgtccagcccccttataaggaatggtcac

SEQ ID NO: 235057 - DNA, 31 bp, Artificial Sequence
  Description of Artificial Sequence: Synthetic oligonucleotide
tgtccagcccccttataaggaatggtcactg

SEQ ID NO: 235058 - DNA, 30 bp, Artificial Sequence
  Description of Artificial Sequence: Synthetic oligonucleotide
gtccagcccccttataaggaatggtcactg

SEQ ID NO: 235059 - DNA, 30 bp, Artificial Sequence
  Description of Artificial Sequence: Synthetic oligonucleotide
tccagcccccttataaggaatggtcactgg

SEQ ID NO: 235060 - DNA, 29 bp, Artificial Sequence
  Description of Artificial Sequence: Synthetic oligonucleotide
ccagcccccttataaggaatggtcactgg

SEQ ID NO: 235061 - DNA, 30 bp, Artificial Sequence
  Description of Artificial Sequence: Synthetic oligonucleotide
cagcccccttataaggaatggtcactggac

SEQ ID NO: 235062 - DNA, 33 bp, Artificial Sequence
  Description of Artificial Sequence: Synthetic oligonucleotide
agcccccttataaggaatggtcactggacttac

SEQ ID NO: 235063 - DNA, 32 bp, Artificial Sequence
  Description of Artificial Sequence: Synthetic oligonucleotide
gcccccttataaggaatggtcactggacttac

SEQ ID NO: 235064 - DNA, 32 bp, Artificial Sequence
  Description of Artificial Sequence: Synthetic oligonucleotide
cccccttataaggaatggtcactggacttacc

SEQ ID NO: 235065 - DNA, 33 bp, Artificial Sequence
  Description of Artificial Sequence: Synthetic oligonucleotide
ccccttataaggaatggtcactggacttaccag

SEQ ID NO: 235066 - DNA, 35 bp, Artificial Sequence
  Description of Artificial Sequence: Synthetic oligonucleotide
cccttataaggaatggtcactggacttaccagatc

SEQ ID NO: 235067 - DNA, 35 bp, Artificial Sequence
  Description of Artificial Sequence: Synthetic oligonucleotide
ccttataaggaatggtcactggacttaccagatcc

SEQ ID NO: 235068 - DNA, 36 bp, Artificial Sequence
  Description of Artificial Sequence: Synthetic oligonucleotide
cttataaggaatggtcactggacttaccagatcctc

SEQ ID NO: 235069 - DNA, 36 bp, Artificial Sequence
  Description of Artificial Sequence: Synthetic oligonucleotide
ttataaggaatggtcactggacttaccagatcctcg

SEQ ID NO: 235070 - DNA, 35 bp, Artificial Sequence
  Description of Artificial Sequence: Synthetic oligonucleotide
tataaggaatggtcactggacttaccagatcctcg

SEQ ID NO: 235071 - DNA, 34 bp, Artificial Sequence
  Description of Artificial Sequence: Synthetic oligonucleotide
ataaggaatggtcactggacttaccagatcctcg

SEQ ID NO: 235072 - DNA, 33 bp, Artificial Sequence
  Description of Artificial Sequence: Synthetic oligonucleotide
taaggaatggtcactggacttaccagatcctcg

SEQ ID NO: 235073 - DNA, 32 bp, Artificial Sequence
  Description of Artificial Sequence: Synthetic oligonucleotide
aaggaatggtcactggacttaccagatcctcg

SEQ ID NO: 235074 - DNA, 31 bp, Artificial Sequence
  Description of Artificial Sequence: Synthetic oligonucleotide
aggaatggtcactggacttaccagatcctcg

SEQ ID NO: 235075 - DNA, 30 bp, Artificial Sequence
  Description of Artificial Sequence: Synthetic oligonucleotide
ggaatggtcactggacttaccagatcctcg

SEQ ID NO: 235076 - DNA, 31 bp, Artificial Sequence
  Description of Artificial Sequence: Synthetic oligonucleotide
gaatggtcactggacttaccagatcctcgtg

SEQ ID NO: 235077 - DNA, 33 bp, Artificial Sequence
  Description of Artificial Sequence: Synthetic oligonucleotide
aatggtcactggacttaccagatcctcgtgatg

SEQ ID NO: 235078 - DNA, 32 bp, Artificial Sequence
  Description of Artificial Sequence: Synthetic oligonucleotide
atggtcactggacttaccagatcctcgtgatg

SEQ ID NO: 235079 - DNA, 31 bp, Artificial Sequence
  Description of Artificial Sequence: Synthetic oligonucleotide
tggtcactggacttaccagatcctcgtgatg

SEQ ID NO: 235080 - DNA, 30 bp, Artificial Sequence
  Description of Artificial Sequence: Synthetic oligonucleotide
ggtcactggacttaccagatcctcgtgatg

SEQ ID NO: 235081 - DNA, 30 bp, Artificial Sequence
  Description of Artificial Sequence: Synthetic oligonucleotide
gtcactggacttaccagatcctcgtgatgc

SEQ ID NO: 235082 - DNA, 31 bp, Artificial Sequence
  Description of Artificial Sequence: Synthetic oligonucleotide
tcactggacttaccagatcctcgtgatgctg

SEQ ID NO: 235083 - DNA, 30 bp, Artificial Sequence
  Description of Artificial Sequence: Synthetic oligonucleotide
cactggacttaccagatcctcgtgatgctg

SEQ ID NO: 235084 - DNA, 30 bp, Artificial Sequence
  Description of Artificial Sequence: Synthetic oligonucleotide
actggacttaccagatcctcgtgatgctgc

SEQ ID NO: 235085 - DNA, 29 bp, Artificial Sequence
  Description of Artificial Sequence: Synthetic oligonucleotide
ctggacttaccagatcctcgtgatgctgc

SEQ ID NO: 235086 - DNA, 33 bp, Artificial Sequence
  Description of Artificial Sequence: Synthetic oligonucleotide
tggacttaccagatcctcgtgatgctgcaaatg

SEQ ID NO: 235087 - DNA, 32 bp, Artificial Sequence
  Description of Artificial Sequence: Synthetic oligonucleotide
ggacttaccagatcctcgtgatgctgcaaatg

SEQ ID NO: 235088 - DNA, 33 bp, Artificial Sequence
  Description of Artificial Sequence: Synthetic oligonucleotide
gacttaccagatcctcgtgatgctgcaaatgac

SEQ ID NO: 235089 - DNA, 34 bp, Artificial Sequence
  Description of Artificial Sequence: Synthetic oligonucleotide
acttaccagatcctcgtgatgctgcaaatgactc

SEQ ID NO: 235090 - DNA, 33 bp, Artificial Sequence
  Description of Artificial Sequence: Synthetic oligonucleotide
cttaccagatcctcgtgatgctgcaaatgactc

SEQ ID NO: 235091 - DNA, 33 bp, Artificial Sequence
  Description of Artificial Sequence: Synthetic oligonucleotide
ttaccagatcctcgtgatgctgcaaatgactcg

SEQ ID NO: 235092 - DNA, 32 bp, Artificial Sequence
  Description of Artificial Sequence: Synthetic oligonucleotide
taccagatcctcgtgatgctgcaaatgactcg

SEQ ID NO: 235093 - DNA, 31 bp, Artificial Sequence
  Description of Artificial Sequence: Synthetic oligonucleotide
accagatcctcgtgatgctgcaaatgactcg

SEQ ID NO: 235094 - DNA, 30 bp, Artificial Sequence
  Description of Artificial Sequence: Synthetic oligonucleotide
ccagatcctcgtgatgctgcaaatgactcg

SEQ ID NO: 235095 - DNA, 30 bp, Artificial Sequence
  Description of Artificial Sequence: Synthetic oligonucleotide
cagatcctcgtgatgctgcaaatgactcgc

SEQ ID NO: 235096 - DNA, 30 bp, Artificial Sequence
  Description of Artificial Sequence: Synthetic oligonucleotide
agatcctcgtgatgctgcaaatgactcgcc

SEQ ID NO: 235097 - DNA, 29 bp, Artificial Sequence
  Description of Artificial Sequence: Synthetic oligonucleotide
gatcctcgtgatgctgcaaatgactcgcc

SEQ ID NO: 235098 - DNA, 30 bp, Artificial Sequence
  Description of Artificial Sequence: Synthetic oligonucleotide
atcctcgtgatgctgcaaatgactcgccag

SEQ ID NO: 235099 - DNA, 29 bp, Artificial Sequence
  Description of Artificial Sequence: Synthetic oligonucleotide
tcctcgtgatgctgcaaatgactcgccag

SEQ ID NO: 235100 - DNA, 28 bp, Artificial Sequence
  Description of Artificial Sequence: Synthetic oligonucleotide
cctcgtgatgctgcaaatgactcgccag

SEQ ID NO: 235101 - DNA, 28 bp, Artificial Sequence
  Description of Artificial Sequence: Synthetic oligonucleotide
ctcgtgatgctgcaaatgactcgccagc

SEQ ID NO: 235102 - DNA, 28 bp, Artificial Sequence
  Description of Artificial Sequence: Synthetic oligonucleotide
tcgtgatgctgcaaatgactcgccagcg

SEQ ID NO: 235103 - DNA, 27 bp, Artificial Sequence
  Description of Artificial Sequence: Synthetic oligonucleotide
cgtgatgctgcaaatgactcgccagcg

SEQ ID NO: 235104 - DNA, 28 bp, Artificial Sequence
  Description of Artificial Sequence: Synthetic oligonucleotide
gtgatgctgcaaatgactcgccagcgtg

SEQ ID NO: 235105 - DNA, 28 bp, Artificial Sequence
  Description of Artificial Sequence: Synthetic oligonucleotide
tgatgctgcaaatgactcgccagcgtgg

SEQ ID NO: 235106 - DNA, 27 bp, Artificial Sequence
  Description of Artificial Sequence: Synthetic oligonucleotide
gatgctgcaaatgactcgccagcgtgg

SEQ ID NO: 235107 - DNA, 28 bp, Artificial Sequence
  Description of Artificial Sequence: Synthetic oligonucleotide
atgctgcaaatgactcgccagcgtggtg

SEQ ID NO: 235108 - DNA, 27 bp, Artificial Sequence
  Description of Artificial Sequence: Synthetic oligonucleotide
tgctgcaaatgactcgccagcgtggtg

SEQ ID NO: 235109 - DNA, 27 bp, Artificial Sequence
  Description of Artificial Sequence: Synthetic oligonucleotide
gctgcaaatgactcgccagcgtggtga

SEQ ID NO: 235110 - DNA, 28 bp, Artificial Sequence
  Description of Artificial Sequence: Synthetic oligonucleotide
ctgcaaatgactcgccagcgtggtgatg

SEQ ID NO: 235111 - DNA, 29 bp, Artificial Sequence
  Description of Artificial Sequence: Synthetic oligonucleotide
tgcaaatgactcgccagcgtggtgatgtc

SEQ ID NO: 235112 - DNA, 28 bp, Artificial Sequence
  Description of Artificial Sequence: Synthetic oligonucleotide
gcaaatgactcgccagcgtggtgatgtc

SEQ ID NO: 235113 - DNA, 30 bp, Artificial Sequence
  Description of Artificial Sequence: Synthetic oligonucleotide
caaatgactcgccagcgtggtgatgtctac

SEQ ID NO: 235114 - DNA, 31 bp, Artificial Sequence
  Description of Artificial Sequence: Synthetic oligonucleotide
aaatgactcgccagcgtggtgatgtctactc

SEQ ID NO: 235115 - DNA, 30 bp, Artificial Sequence
  Description of Artificial Sequence: Synthetic oligonucleotide
aatgactcgccagcgtggtgatgtctactc

SEQ ID NO: 235116 - DNA, 29 bp, Artificial Sequence
  Description of Artificial Sequence: Synthetic oligonucleotide
atgactcgccagcgtggtgatgtctactc

SEQ ID NO: 235117 - DNA, 28 bp, Artificial Sequence
  Description of Artificial Sequence: Synthetic oligonucleotide
tgactcgccagcgtggtgatgtctactc

SEQ ID NO: 235118 - DNA, 27 bp, Artificial Sequence
  Description of Artificial Sequence: Synthetic oligonucleotide
gactcgccagcgtggtgatgtctactc

SEQ ID NO: 235119 - DNA, 27 bp, Artificial Sequence
  Description of Artificial Sequence: Synthetic oligonucleotide
actcgccagcgtggtgatgtctactcc

SEQ ID NO: 235120 - DNA, 27 bp, Artificial Sequence
  Description of Artificial Sequence: Synthetic oligonucleotide
ctcgccagcgtggtgatgtctactcct

SEQ ID NO: 235121 - DNA, 27 bp, Artificial Sequence
  Description of Artificial Sequence: Synthetic oligonucleotide
tcgccagcgtggtgatgtctactcctg

SEQ ID NO: 235122 - DNA, 26 bp, Artificial Sequence
  Description of Artificial Sequence: Synthetic oligonucleotide
cgccagcgtggtgatgtctactcctg

SEQ ID NO: 235123 - DNA, 26 bp, Artificial Sequence
  Description of Artificial Sequence: Synthetic oligonucleotide
gccagcgtggtgatgtctactcctgc

SEQ ID NO: 235124 - DNA, 27 bp, Artificial Sequence
  Description of Artificial Sequence: Synthetic oligonucleotide
ccagcgtggtgatgtctactcctgcca

SEQ ID NO: 235125 - DNA, 27 bp, Artificial Sequence
  Description of Artificial Sequence: Synthetic oligonucleotide
cagcgtggtgatgtctactcctgccac

SEQ ID NO: 235126 - DNA, 27 bp, Artificial Sequence
  Description of Artificial Sequence: Synthetic oligonucleotide
agcgtggtgatgtctactcctgccacg

SEQ ID NO: 235127 - DNA, 27 bp, Artificial Sequence
  Description of Artificial Sequence: Synthetic oligonucleotide
gcgtggtgatgtctactcctgccacga

SEQ ID NO: 235128 - DNA, 27 bp, Artificial Sequence
  Description of Artificial Sequence: Synthetic oligonucleotide
cgtggtgatgtctactcctgccacgag

SEQ ID NO: 235129 - DNA, 27 bp, Artificial Sequence
  Description of Artificial Sequence: Synthetic oligonucleotide
gtggtgatgtctactcctgccacgagg

SEQ ID NO: 235130 - DNA, 28 bp, Artificial Sequence
  Description of Artificial Sequence: Synthetic oligonucleotide
tggtgatgtctactcctgccacgaggag

SEQ ID NO: 235131 - DNA, 27 bp, Artificial Sequence
  Description of Artificial Sequence: Synthetic oligonucleotide
ggtgatgtctactcctgccacgaggag

SEQ ID NO: 235132 - DNA, 27 bp, Artificial Sequence
  Description of Artificial Sequence: Synthetic oligonucleotide
gtgatgtctactcctgccacgaggagc

SEQ ID NO: 235133 - DNA, 28 bp, Artificial Sequence
  Description of Artificial Sequence: Synthetic oligonucleotide
tgatgtctactcctgccacgaggagcac

SEQ ID NO: 235134 - DNA, 27 bp, Artificial Sequence
  Description of Artificial Sequence: Synthetic oligonucleotide
gatgtctactcctgccacgaggagcac

SEQ ID NO: 235135 - DNA, 27 bp, Artificial Sequence
  Description of Artificial Sequence: Synthetic oligonucleotide
atgtctactcctgccacgaggagcacc

SEQ ID NO: 235136 - DNA, 26 bp, Artificial Sequence
  Description of Artificial Sequence: Synthetic oligonucleotide
tgtctactcctgccacgaggagcacc

SEQ ID NO: 235137 - DNA, 25 bp, Artificial Sequence
  Description of Artificial Sequence: Synthetic oligonucleotide
gtctactcctgccacgaggagcacc

SEQ ID NO: 235138 - DNA, 25 bp, Artificial Sequence
  Description of Artificial Sequence: Synthetic oligonucleotide
tctactcctgccacgaggagcaccc

SEQ ID NO: 235139 - DNA, 24 bp, Artificial Sequence
  Description of Artificial Sequence: Synthetic oligonucleotide
ctactcctgccacgaggagcaccc

SEQ ID NO: 235140 - DNA, 25 bp, Artificial Sequence
  Description of Artificial Sequence: Synthetic oligonucleotide
tactcctgccacgaggagcacccga

SEQ ID NO: 235141 - DNA, 24 bp, Artificial Sequence
  Description of Artificial Sequence: Synthetic oligonucleotide
actcctgccacgaggagcacccga

SEQ ID NO: 235142 - DNA, 23 bp, Artificial Sequence
  Description of Artificial Sequence: Synthetic oligonucleotide
ctcctgccacgaggagcacccga

SEQ ID NO: 235143 - DNA, 23 bp, Artificial Sequence
  Description of Artificial Sequence: Synthetic oligonucleotide
tcctgccacgaggagcacccgag

SEQ ID NO: 235144 - DNA, 22 bp, Artificial Sequence
  Description of Artificial Sequence: Synthetic oligonucleotide
cctgccacgaggagcacccgag

SEQ ID NO: 235145 - DNA, 22 bp, Artificial Sequence
  Description of Artificial Sequence: Synthetic oligonucleotide
ctgccacgaggagcacccgagc

SEQ ID NO: 235146 - DNA, 23 bp, Artificial Sequence
  Description of Artificial Sequence: Synthetic oligonucleotide
tgccacgaggagcacccgagcct

SEQ ID NO: 235147 - DNA, 22 bp, Artificial Sequence
  Description of Artificial Sequence: Synthetic oligonucleotide
gccacgaggagcacccgagcct

SEQ ID NO: 235148 - DNA, 22 bp, Artificial Sequence
  Description of Artificial Sequence: Synthetic oligonucleotide
ccacgaggagcacccgagcctc

SEQ ID NO: 235149 - DNA, 23 bp, Artificial Sequence
  Description of Artificial Sequence: Synthetic oligonucleotide
cacgaggagcacccgagcctcca

SEQ ID NO: 235150 - DNA, 24 bp, Artificial Sequence
  Description of Artificial Sequence: Synthetic oligonucleotide
acgaggagcacccgagcctccagt

SEQ ID NO: 235151 - DNA, 23 bp, Artificial Sequence
  Description of Artificial Sequence: Synthetic oligonucleotide
cgaggagcacccgagcctccagt

SEQ ID NO: 235152 - DNA, 23 bp, Artificial Sequence
  Description of Artificial Sequence: Synthetic oligonucleotide
gaggagcacccgagcctccagtg

SEQ ID NO: 235153 - DNA, 23 bp, Artificial Sequence
  Description of Artificial Sequence: Synthetic oligonucleotide
aggagcacccgagcctccagtgc

SEQ ID NO: 235154 - DNA, 22 bp, Artificial Sequence
  Description of Artificial Sequence: Synthetic oligonucleotide
ggagcacccgagcctccagtgc

SEQ ID NO: 235155 - DNA, 22 bp, Artificial Sequence
  Description of Artificial Sequence: Synthetic oligonucleotide
gagcacccgagcctccagtgcc

SEQ ID NO: 235156 - DNA, 22 bp, Artificial Sequence
  Description of Artificial Sequence: Synthetic oligonucleotide
agcacccgagcctccagtgccc

SEQ ID NO: 235157 - DNA, 21 bp, Artificial Sequence
  Description of Artificial Sequence: Synthetic oligonucleotide
gcacccgagcctccagtgccc

SEQ ID NO: 235158 - DNA, 23 bp, Artificial Sequence
  Description of Artificial Sequence: Synthetic oligonucleotide
cacccgagcctccagtgccccat

SEQ ID NO: 235159 - DNA, 24 bp, Artificial Sequence
  Description of Artificial Sequence: Synthetic oligonucleotide
acccgagcctccagtgccccatct

SEQ ID NO: 235160 - DNA, 23 bp, Artificial Sequence
  Description of Artificial Sequence: Synthetic oligonucleotide
cccgagcctccagtgccccatct

SEQ ID NO: 235161 - DNA, 23 bp, Artificial Sequence
  Description of Artificial Sequence: Synthetic oligonucleotide
ccgagcctccagtgccccatctc

SEQ ID NO: 235162 - DNA, 23 bp, Artificial Sequence
  Description of Artificial Sequence: Synthetic oligonucleotide
cgagcctccagtgccccatctcc

SEQ ID NO: 235163 - DNA, 24 bp, Artificial Sequence
  Description of Artificial Sequence: Synthetic oligonucleotide
gagcctccagtgccccatctccgt

SEQ ID NO: 235164 - DNA, 24 bp, Artificial Sequence
  Description of Artificial Sequence: Synthetic oligonucleotide
agcctccagtgccccatctccgtg

SEQ ID NO: 235165 - DNA, 23 bp, Artificial Sequence
  Description of Artificial Sequence: Synthetic oligonucleotide
gcctccagtgccccatctccgtg

SEQ ID NO: 235166 - DNA, 24 bp, Artificial Sequence
  Description of Artificial Sequence: Synthetic oligonucleotide
cctccagtgccccatctccgtgga

SEQ ID NO: 235167 - DNA, 25 bp, Artificial Sequence
  Description of Artificial Sequence: Synthetic oligonucleotide
ctccagtgccccatctccgtggagt

SEQ ID NO: 235168 - DNA, 25 bp, Artificial Sequence
  Description of Artificial Sequence: Synthetic oligonucleotide
tccagtgccccatctccgtggagtg

SEQ ID NO: 235169 - DNA, 24 bp, Artificial Sequence
  Description of Artificial Sequence: Synthetic oligonucleotide
ccagtgccccatctccgtggagtg

SEQ ID NO: 235170 - DNA, 24 bp, Artificial Sequence
  Description of Artificial Sequence: Synthetic oligonucleotide
cagtgccccatctccgtggagtgc

SEQ ID NO: 235171 - DNA, 24 bp, Artificial Sequence
  Description of Artificial Sequence: Synthetic oligonucleotide
agtgccccatctccgtggagtgcc

SEQ ID NO: 235172 - DNA, 23 bp, Artificial Sequence
  Description of Artificial Sequence: Synthetic oligonucleotide
gtgccccatctccgtggagtgcc

SEQ ID NO: 235173 - DNA, 23 bp, Artificial Sequence
  Description of Artificial Sequence: Synthetic oligonucleotide
tgccccatctccgtggagtgccg

SEQ ID NO: 235174 - DNA, 22 bp, Artificial Sequence
  Description of Artificial Sequence: Synthetic oligonucleotide
gccccatctccgtggagtgccg

SEQ ID NO: 235175 - DNA, 22 bp, Artificial Sequence
  Description of Artificial Sequence: Synthetic oligonucleotide
ccccatctccgtggagtgccgg

SEQ ID NO: 235176 - DNA, 22 bp, Artificial Sequence
  Description of Artificial Sequence: Synthetic oligonucleotide
cccatctccgtggagtgccggg

SEQ ID NO: 235177 - DNA, 23 bp, Artificial Sequence
  Description of Artificial Sequence: Synthetic oligonucleotide
ccatctccgtggagtgccgggct

SEQ ID NO: 235178 - DNA, 24 bp, Artificial Sequence
  Description of Artificial Sequence: Synthetic oligonucleotide
catctccgtggagtgccgggctca

SEQ ID NO: 235179 - DNA, 25 bp, Artificial Sequence
  Description of Artificial Sequence: Synthetic oligonucleotide
atctccgtggagtgccgggctcaga

SEQ ID NO: 235180 - DNA, 24 bp, Artificial Sequence
  Description of Artificial Sequence: Synthetic oligonucleotide
tctccgtggagtgccgggctcaga

SEQ ID NO: 235181 - DNA, 23 bp, Artificial Sequence
  Description of Artificial Sequence: Synthetic oligonucleotide
ctccgtggagtgccgggctcaga

SEQ ID NO: 235182 - DNA, 24 bp, Artificial Sequence
  Description of Artificial Sequence: Synthetic oligonucleotide
tccgtggagtgccgggctcagact

SEQ ID NO: 235183 - DNA, 23 bp, Artificial Sequence
  Description of Artificial Sequence: Synthetic oligonucleotide
ccgtggagtgccgggctcagact

SEQ ID NO: 235184 - DNA, 26 bp, Artificial Sequence
  Description of Artificial Sequence: Synthetic oligonucleotide
cgtggagtgccgggctcagactgaat

SEQ ID NO: 235185 - DNA, 27 bp, Artificial Sequence
  Description of Artificial Sequence: Synthetic oligonucleotide
gtggagtgccgggctcagactgaatct

SEQ ID NO: 235186 - DNA, 27 bp, Artificial Sequence
  Description of Artificial Sequence: Synthetic oligonucleotide
tggagtgccgggctcagactgaatctg

SEQ ID NO: 235187 - DNA, 26 bp, Artificial Sequence
  Description of Artificial Sequence: Synthetic oligonucleotide
ggagtgccgggctcagactgaatctg

SEQ ID NO: 235188 - DNA, 26 bp, Artificial Sequence
  Description of Artificial Sequence: Synthetic oligonucleotide
gagtgccgggctcagactgaatctgg

SEQ ID NO: 235189 - DNA, 26 bp, Artificial Sequence
  Description of Artificial Sequence: Synthetic oligonucleotide
agtgccgggctcagactgaatctggc

SEQ ID NO: 235190 - DNA, 25 bp, Artificial Sequence
  Description of Artificial Sequence: Synthetic oligonucleotide
gtgccgggctcagactgaatctggc

SEQ ID NO: 235191 - DNA, 26 bp, Artificial Sequence
  Description of Artificial Sequence: Synthetic oligonucleotide
tgccgggctcagactgaatctggcca

SEQ ID NO: 235192 - DNA, 25 bp, Artificial Sequence
  Description of Artificial Sequence: Synthetic oligonucleotide
gccgggctcagactgaatctggcca

SEQ ID NO: 235193 - DNA, 26 bp, Artificial Sequence
  Description of Artificial Sequence: Synthetic oligonucleotide
ccgggctcagactgaatctggccaga

SEQ ID NO: 235194 - DNA, 26 bp, Artificial Sequence
  Description of Artificial Sequence: Synthetic oligonucleotide
cgggctcagactgaatctggccagag

SEQ ID NO: 235195 - DNA, 27 bp, Artificial Sequence
  Description of Artificial Sequence: Synthetic oligonucleotide
gggctcagactgaatctggccagagca

SEQ ID NO: 235196 - DNA, 28 bp, Artificial Sequence
  Description of Artificial Sequence: Synthetic oligonucleotide
ggctcagactgaatctggccagagcaac

SEQ ID NO: 235197 - DNA, 30 bp, Artificial Sequence
  Description of Artificial Sequence: Synthetic oligonucleotide
gctcagactgaatctggccagagcaacatg

SEQ ID NO: 235198 - DNA, 30 bp, Artificial Sequence
  Description of Artificial Sequence: Synthetic oligonucleotide
ctcagactgaatctggccagagcaacatgc

SEQ ID NO: 235199 - DNA, 31 bp, Artificial Sequence
  Description of Artificial Sequence: Synthetic oligonucleotide
tcagactgaatctggccagagcaacatgctg

SEQ ID NO: 235200 - DNA, 30 bp, Artificial Sequence
  Description of Artificial Sequence: Synthetic oligonucleotide
cagactgaatctggccagagcaacatgctg

SEQ ID NO: 235201 - DNA, 31 bp, Artificial Sequence
  Description of Artificial Sequence: Synthetic oligonucleotide
agactgaatctggccagagcaacatgctgag

SEQ ID NO: 235202 - DNA, 30 bp, Artificial Sequence
  Description of Artificial Sequence: Synthetic oligonucleotide
gactgaatctggccagagcaacatgctgag

SEQ ID NO: 235203 - DNA, 31 bp, Artificial Sequence
  Description of Artificial Sequence: Synthetic oligonucleotide
actgaatctggccagagcaacatgctgagtc

SEQ ID NO: 235204 - DNA, 30 bp, Artificial Sequence
  Description of Artificial Sequence: Synthetic oligonucleotide
ctgaatctggccagagcaacatgctgagtc

SEQ ID NO: 235205 - DNA, 30 bp, Artificial Sequence
  Description of Artificial Sequence: Synthetic oligonucleotide
tgaatctggccagagcaacatgctgagtcg

SEQ ID NO: 235206 - DNA, 29 bp, Artificial Sequence
  Description of Artificial Sequence: Synthetic oligonucleotide
gaatctggccagagcaacatgctgagtcg

SEQ ID NO: 235207 - DNA, 29 bp, Artificial Sequence
  Description of Artificial Sequence: Synthetic oligonucleotide
aatctggccagagcaacatgctgagtcgc

SEQ ID NO: 235208 - DNA, 28 bp, Artificial Sequence
  Description of Artificial Sequence: Synthetic oligonucleotide
atctggccagagcaacatgctgagtcgc

SEQ ID NO: 235209 - DNA, 27 bp, Artificial Sequence
  Description of Artificial Sequence: Synthetic oligonucleotide
tctggccagagcaacatgctgagtcgc

SEQ ID NO: 235210 - DNA, 26 bp, Artificial Sequence
  Description of Artificial Sequence: Synthetic oligonucleotide
ctggccagagcaacatgctgagtcgc

SEQ ID NO: 235211 - DNA, 27 bp, Artificial Sequence
  Description of Artificial Sequence: Synthetic oligonucleotide
tggccagagcaacatgctgagtcgcgt

SEQ ID NO: 235212 - DNA, 27 bp, Artificial Sequence
  Description of Artificial Sequence: Synthetic oligonucleotide
ggccagagcaacatgctgagtcgcgtt

SEQ ID NO: 235213 - DNA, 27 bp, Artificial Sequence
  Description of Artificial Sequence: Synthetic oligonucleotide
gccagagcaacatgctgagtcgcgttg

SEQ ID NO: 235214 - DNA, 27 bp, Artificial Sequence
  Description of Artificial Sequence: Synthetic oligonucleotide
ccagagcaacatgctgagtcgcgttgg

SEQ ID NO: 235215 - DNA, 28 bp, Artificial Sequence
  Description of Artificial Sequence: Synthetic oligonucleotide
cagagcaacatgctgagtcgcgttggag

SEQ ID NO: 235216 - DNA, 28 bp, Artificial Sequence
  Description of Artificial Sequence: Synthetic oligonucleotide
agagcaacatgctgagtcgcgttggagc

SEQ ID NO: 235217 - DNA, 27 bp, Artificial Sequence
  Description of Artificial Sequence: Synthetic oligonucleotide
gagcaacatgctgagtcgcgttggagc

SEQ ID NO: 235218 - DNA, 27 bp, Artificial Sequence
  Description of Artificial Sequence: Synthetic oligonucleotide
agcaacatgctgagtcgcgttggagcc

SEQ ID NO: 235219 - DNA, 27 bp, Artificial Sequence
  Description of Artificial Sequence: Synthetic oligonucleotide
gcaacatgctgagtcgcgttggagcct

SEQ ID NO: 235220 - DNA, 28 bp, Artificial Sequence
  Description of Artificial Sequence: Synthetic oligonucleotide
caacatgctgagtcgcgttggagccttc

SEQ ID NO: 235221 - DNA, 28 bp, Artificial Sequence
  Description of Artificial Sequence: Synthetic oligonucleotide
aacatgctgagtcgcgttggagccttcg

SEQ ID NO: 235222 - DNA, 27 bp, Artificial Sequence
  Description of Artificial Sequence: Synthetic oligonucleotide
acatgctgagtcgcgttggagccttcg

SEQ ID NO: 235223 - DNA, 27 bp, Artificial Sequence
  Description of Artificial Sequence: Synthetic oligonucleotide
catgctgagtcgcgttggagccttcgt

SEQ ID NO: 235224 - DNA, 27 bp, Artificial Sequence
  Description of Artificial Sequence: Synthetic oligonucleotide
atgctgagtcgcgttggagccttcgtg

SEQ ID NO: 235225 - DNA, 26 bp, Artificial Sequence
  Description of Artificial Sequence: Synthetic oligonucleotide
tgctgagtcgcgttggagccttcgtg

SEQ ID NO: 235226 - DNA, 25 bp, Artificial Sequence
  Description of Artificial Sequence: Synthetic oligonucleotide
gctgagtcgcgttggagccttcgtg

SEQ ID NO: 235227 - DNA, 26 bp, Artificial Sequence
  Description of Artificial Sequence: Synthetic oligonucleotide
ctgagtcgcgttggagccttcgtgct

SEQ ID NO: 235228 - DNA, 26 bp, Artificial Sequence
  Description of Artificial Sequence: Synthetic oligonucleotide
tgagtcgcgttggagccttcgtgctc

SEQ ID NO: 235229 - DNA, 25 bp, Artificial Sequence
  Description of Artificial Sequence: Synthetic oligonucleotide
gagtcgcgttggagccttcgtgctc

SEQ ID NO: 235230 - DNA, 25 bp, Artificial Sequence
  Description of Artificial Sequence: Synthetic oligonucleotide
agtcgcgttggagccttcgtgctcg

SEQ ID NO: 235231 - DNA, 24 bp, Artificial Sequence
  Description of Artificial Sequence: Synthetic oligonucleotide
gtcgcgttggagccttcgtgctcg

SEQ ID NO: 235232 - DNA, 24 bp, Artificial Sequence
  Description of Artificial Sequence: Synthetic oligonucleotide
tcgcgttggagccttcgtgctcgg

SEQ ID NO: 235233 - DNA, 23 bp, Artificial Sequence
  Description of Artificial Sequence: Synthetic oligonucleotide
cgcgttggagccttcgtgctcgg

SEQ ID NO: 235234 - DNA, 23 bp, Artificial Sequence
  Description of Artificial Sequence: Synthetic oligonucleotide
gcgttggagccttcgtgctcggg

SEQ ID NO: 235235 - DNA, 24 bp, Artificial Sequence
  Description of Artificial Sequence: Synthetic oligonucleotide
cgttggagccttcgtgctcgggct

SEQ ID NO: 235236 - DNA, 26 bp, Artificial Sequence
  Description of Artificial Sequence: Synthetic oligonucleotide
gttggagccttcgtgctcgggctgat

SEQ ID NO: 235237 - DNA, 27 bp, Artificial Sequence
  Description of Artificial Sequence: Synthetic oligonucleotide
ttggagccttcgtgctcgggctgatca

SEQ ID NO: 235238 - DNA, 27 bp, Artificial Sequence
  Description of Artificial Sequence: Synthetic oligonucleotide
tggagccttcgtgctcgggctgatcat

SEQ ID NO: 235239 - DNA, 26 bp, Artificial Sequence
  Description of Artificial Sequence: Synthetic oligonucleotide
ggagccttcgtgctcgggctgatcat

SEQ ID NO: 235240 - DNA, 26 bp, Artificial Sequence
  Description of Artificial Sequence: Synthetic oligonucleotide
gagccttcgtgctcgggctgatcatc

SEQ ID NO: 235241 - DNA, 27 bp, Artificial Sequence
  Description of Artificial Sequence: Synthetic oligonucleotide
agccttcgtgctcgggctgatcatcct

SEQ ID NO: 235242 - DNA, 27 bp, Artificial Sequence
  Description of Artificial Sequence: Synthetic oligonucleotide
gccttcgtgctcgggctgatcatcctt

SEQ ID NO: 235243 - DNA, 27 bp, Artificial Sequence
  Description of Artificial Sequence: Synthetic oligonucleotide
ccttcgtgctcgggctgatcatccttg

SEQ ID NO: 235244 - DNA, 27 bp, Artificial Sequence
  Description of Artificial Sequence: Synthetic oligonucleotide
cttcgtgctcgggctgatcatccttgg

SEQ ID NO: 235245 - DNA, 27 bp, Artificial Sequence
  Description of Artificial Sequence: Synthetic oligonucleotide
ttcgtgctcgggctgatcatccttggg

SEQ ID NO: 235246 - DNA, 26 bp, Artificial Sequence
  Description of Artificial Sequence: Synthetic oligonucleotide
tcgtgctcgggctgatcatccttggg

SEQ ID NO: 235247 - DNA, 25 bp, Artificial Sequence
  Description of Artificial Sequence: Synthetic oligonucleotide
cgtgctcgggctgatcatccttggg

SEQ ID NO: 235248 - DNA, 26 bp, Artificial Sequence
  Description of Artificial Sequence: Synthetic oligonucleotide
gtgctcgggctgatcatccttgggca

SEQ ID NO: 235249 - DNA, 26 bp, Artificial Sequence
  Description of Artificial Sequence: Synthetic oligonucleotide
tgctcgggctgatcatccttgggcag

SEQ ID NO: 235250 - DNA, 25 bp, Artificial Sequence
  Description of Artificial Sequence: Synthetic oligonucleotide
gctcgggctgatcatccttgggcag

SEQ ID NO: 235251 - DNA, 25 bp, Artificial Sequence
  Description of Artificial Sequence: Synthetic oligonucleotide
ctcgggctgatcatccttgggcagg

SEQ ID NO: 235252 - DNA, 25 bp, Artificial Sequence
  Description of Artificial Sequence: Synthetic oligonucleotide
tcgggctgatcatccttgggcaggg

SEQ ID NO: 235253 - DNA, 24 bp, Artificial Sequence
  Description of Artificial Sequence: Synthetic oligonucleotide
cgggctgatcatccttgggcaggg

SEQ ID NO: 235254 - DNA, 24 bp, Artificial Sequence
  Description of Artificial Sequence: Synthetic oligonucleotide
gggctgatcatccttgggcagggc

SEQ ID NO: 235255 - DNA, 27 bp, Artificial Sequence
  Description of Artificial Sequence: Synthetic oligonucleotide
ggctgatcatccttgggcagggcctta

SEQ ID NO: 235256 - DNA, 28 bp, Artificial Sequence
  Description of Artificial Sequence: Synthetic oligonucleotide
gctgatcatccttgggcagggccttaag

SEQ ID NO: 235257 - DNA, 30 bp, Artificial Sequence
  Description of Artificial Sequence: Synthetic oligonucleotide
ctgatcatccttgggcagggccttaagatc

SEQ ID NO: 235258 - DNA, 30 bp, Artificial Sequence
  Description of Artificial Sequence: Synthetic oligonucleotide
tgatcatccttgggcagggccttaagatcc

SEQ ID NO: 235259 - DNA, 29 bp, Artificial Sequence
  Description of Artificial Sequence: Synthetic oligonucleotide
gatcatccttgggcagggccttaagatcc

SEQ ID NO: 235260 - DNA, 29 bp, Artificial Sequence
  Description of Artificial Sequence: Synthetic oligonucleotide
atcatccttgggcagggccttaagatccg

SEQ ID NO: 235261 - DNA, 28 bp, Artificial Sequence
  Description of Artificial Sequence: Synthetic oligonucleotide
tcatccttgggcagggccttaagatccg

SEQ ID NO: 235262 - DNA, 27 bp, Artificial Sequence
  Description of Artificial Sequence: Synthetic oligonucleotide
catccttgggcagggccttaagatccg

SEQ ID NO: 235263 - DNA, 28 bp, Artificial Sequence
  Description of Artificial Sequence: Synthetic oligonucleotide
atccttgggcagggccttaagatccgtc

SEQ ID NO: 235264 - DNA, 27 bp, Artificial Sequence
  Description of Artificial Sequence: Synthetic oligonucleotide
tccttgggcagggccttaagatccgtc

SEQ ID NO: 235265 - DNA, 27 bp, Artificial Sequence
  Description of Artificial Sequence: Synthetic oligonucleotide
ccttgggcagggccttaagatccgtca

SEQ ID NO: 235266 - DNA, 29 bp, Artificial Sequence
  Description of Artificial Sequence: Synthetic oligonucleotide
cttgggcagggccttaagatccgtcaatg

SEQ ID NO: 235267 - DNA, 29 bp, Artificial Sequence
  Description of Artificial Sequence: Synthetic oligonucleotide
ttgggcagggccttaagatccgtcaatgg

SEQ ID NO: 235268 - DNA, 28 bp, Artificial Sequence
  Description of Artificial Sequence: Synthetic oligonucleotide
tgggcagggccttaagatccgtcaatgg

SEQ ID NO: 235269 - DNA, 27 bp, Artificial Sequence
  Description of Artificial Sequence: Synthetic oligonucleotide
gggcagggccttaagatccgtcaatgg

SEQ ID NO: 235270 - DNA, 28 bp, Artificial Sequence
  Description of Artificial Sequence: Synthetic oligonucleotide
ggcagggccttaagatccgtcaatggag

SEQ ID NO: 235271 - DNA, 29 bp, Artificial Sequence
  Description of Artificial Sequence: Synthetic oligonucleotide
gcagggccttaagatccgtcaatggagtc

SEQ ID NO: 235272 - DNA, 30 bp, Artificial Sequence
  Description of Artificial Sequence: Synthetic oligonucleotide
cagggccttaagatccgtcaatggagtcag

SEQ ID NO: 235273 - DNA, 33 bp, Artificial Sequence
  Description of Artificial Sequence: Synthetic oligonucleotide
agggccttaagatccgtcaatggagtcagatag

SEQ ID NO: 235274 - DNA, 32 bp, Artificial Sequence
  Description of Artificial Sequence: Synthetic oligonucleotide
gggccttaagatccgtcaatggagtcagatag

SEQ ID NO: 235275 - DNA, 32 bp, Artificial Sequence
  Description of Artificial Sequence: Synthetic oligonucleotide
ggccttaagatccgtcaatggagtcagatagg

SEQ ID NO: 235276 - DNA, 32 bp, Artificial Sequence
  Description of Artificial Sequence: Synthetic oligonucleotide
gccttaagatccgtcaatggagtcagataggg

SEQ ID NO: 235277 - DNA, 32 bp, Artificial Sequence
  Description of Artificial Sequence: Synthetic oligonucleotide
ccttaagatccgtcaatggagtcagatagggc

SEQ ID NO: 235278 - DNA, 34 bp, Artificial Sequence
  Description of Artificial Sequence: Synthetic oligonucleotide
cttaagatccgtcaatggagtcagatagggcttc

SEQ ID NO: 235279 - DNA, 35 bp, Artificial Sequence
  Description of Artificial Sequence: Synthetic oligonucleotide
ttaagatccgtcaatggagtcagatagggcttctc

SEQ ID NO: 235280 - DNA, 34 bp, Artificial Sequence
  Description of Artificial Sequence: Synthetic oligonucleotide
taagatccgtcaatggagtcagatagggcttctc

SEQ ID NO: 235281 - DNA, 33 bp, Artificial Sequence
  Description of Artificial Sequence: Synthetic oligonucleotide
aagatccgtcaatggagtcagatagggcttctc

SEQ ID NO: 235282 - DNA, 32 bp, Artificial Sequence
  Description of Artificial Sequence: Synthetic oligonucleotide
agatccgtcaatggagtcagatagggcttctc

SEQ ID NO: 235283 - DNA, 31 bp, Artificial Sequence
  Description of Artificial Sequence: Synthetic oligonucleotide
gatccgtcaatggagtcagatagggcttctc

SEQ ID NO: 235284 - DNA, 31 bp, Artificial Sequence
  Description of Artificial Sequence: Synthetic oligonucleotide
atccgtcaatggagtcagatagggcttctcc

SEQ ID NO: 235285 - DNA, 30 bp, Artificial Sequence
  Description of Artificial Sequence: Synthetic oligonucleotide
tccgtcaatggagtcagatagggcttctcc

SEQ ID NO: 235286 - DNA, 29 bp, Artificial Sequence
  Description of Artificial Sequence: Synthetic oligonucleotide
ccgtcaatggagtcagatagggcttctcc

SEQ ID NO: 235287 - DNA, 30 bp, Artificial Sequence
  Description of Artificial Sequence: Synthetic oligonucleotide
cgtcaatggagtcagatagggcttctccac

SEQ ID NO: 235288 - DNA, 31 bp, Artificial Sequence
  Description of Artificial Sequence: Synthetic oligonucleotide
gtcaatggagtcagatagggcttctccactg

SEQ ID NO: 235289 - DNA, 34 bp, Artificial Sequence
  Description of Artificial Sequence: Synthetic oligonucleotide
atgcgccctcaagacagaaagttccatatgagag

SEQ ID NO: 235290 - DNA, 33 bp, Artificial Sequence
  Description of Artificial Sequence: Synthetic oligonucleotide
tgcgccctcaagacagaaagttccatatgagag

SEQ ID NO: 235291 - DNA, 32 bp, Artificial Sequence
  Description of Artificial Sequence: Synthetic oligonucleotide
gcgccctcaagacagaaagttccatatgagag

SEQ ID NO: 235292 - DNA, 32 bp, Artificial Sequence
  Description of Artificial Sequence: Synthetic oligonucleotide
cgccctcaagacagaaagttccatatgagagc

SEQ ID NO: 235293 - DNA, 33 bp, Artificial Sequence
  Description of Artificial Sequence: Synthetic oligonucleotide
gccctcaagacagaaagttccatatgagagctg

SEQ ID NO: 235294 - DNA, 34 bp, Artificial Sequence
  Description of Artificial Sequence: Synthetic oligonucleotide
ccctcaagacagaaagttccatatgagagctgtg

SEQ ID NO: 235295 - DNA, 36 bp, Artificial Sequence
  Description of Artificial Sequence: Synthetic oligonucleotide
cctcaagacagaaagttccatatgagagctgtgttc

SEQ ID NO: 235296 - DNA, 38 bp, Artificial Sequence
  Description of Artificial Sequence: Synthetic oligonucleotide
ctcaagacagaaagttccatatgagagctgtgttcttg

SEQ ID NO: 235297 - DNA, 39 bp, Artificial Sequence
  Description of Artificial Sequence: Synthetic oligonucleotide
tcaagacagaaagttccatatgagagctgtgttcttgag

SEQ ID NO: 235298 - DNA, 38 bp, Artificial Sequence
  Description of Artificial Sequence: Synthetic oligonucleotide
caagacagaaagttccatatgagagctgtgttcttgag

SEQ ID NO: 235299 - DNA, 39 bp, Artificial Sequence
  Description of Artificial Sequence: Synthetic oligonucleotide
aagacagaaagttccatatgagagctgtgttcttgagag

SEQ ID NO: 235300 - DNA, 38 bp, Artificial Sequence
  Description of Artificial Sequence: Synthetic oligonucleotide
agacagaaagttccatatgagagctgtgttcttgagag

SEQ ID NO: 235301 - DNA, 37 bp, Artificial Sequence
  Description of Artificial Sequence: Synthetic oligonucleotide
gacagaaagttccatatgagagctgtgttcttgagag

SEQ ID NO: 235302 - DNA, 37 bp, Artificial Sequence
  Description of Artificial Sequence: Synthetic oligonucleotide
acagaaagttccatatgagagctgtgttcttgagagg

SEQ ID NO: 235303 - DNA, 36 bp, Artificial Sequence
  Description of Artificial Sequence: Synthetic oligonucleotide
cagaaagttccatatgagagctgtgttcttgagagg

SEQ ID NO: 235304 - DNA, 36 bp, Artificial Sequence
  Description of Artificial Sequence: Synthetic oligonucleotide
agaaagttccatatgagagctgtgttcttgagaggc

SEQ ID NO: 235305 - DNA, 35 bp, Artificial Sequence
  Description of Artificial Sequence: Synthetic oligonucleotide
gaaagttccatatgagagctgtgttcttgagaggc

SEQ ID NO: 235306 - DNA, 35 bp, Artificial Sequence
  Description of Artificial Sequence: Synthetic oligonucleotide
aaagttccatatgagagctgtgttcttgagaggcc

SEQ ID NO: 235307 - DNA, 34 bp, Artificial Sequence
  Description of Artificial Sequence: Synthetic oligonucleotide
aagttccatatgagagctgtgttcttgagaggcc

SEQ ID NO: 235308 - DNA, 33 bp, Artificial Sequence
  Description of Artificial Sequence: Synthetic oligonucleotide
agttccatatgagagctgtgttcttgagaggcc

SEQ ID NO: 235309 - DNA, 32 bp, Artificial Sequence
  Description of Artificial Sequence: Synthetic oligonucleotide
gttccatatgagagctgtgttcttgagaggcc

SEQ ID NO: 235310 - DNA, 33 bp, Artificial Sequence
  Description of Artificial Sequence: Synthetic oligonucleotide
ttccatatgagagctgtgttcttgagaggcctc

SEQ ID NO: 235311 - DNA, 32 bp, Artificial Sequence
  Description of Artificial Sequence: Synthetic oligonucleotide
tccatatgagagctgtgttcttgagaggcctc

SEQ ID NO: 235312 - DNA, 31 bp, Artificial Sequence
  Description of Artificial Sequence: Synthetic oligonucleotide
ccatatgagagctgtgttcttgagaggcctc

SEQ ID NO: 235313 - DNA, 32 bp, Artificial Sequence
  Description of Artificial Sequence: Synthetic oligonucleotide
catatgagagctgtgttcttgagaggcctctc

SEQ ID NO: 235314 - DNA, 32 bp, Artificial Sequence
  Description of Artificial Sequence: Synthetic oligonucleotide
atatgagagctgtgttcttgagaggcctctcc

SEQ ID NO: 235315 - DNA, 31 bp, Artificial Sequence
  Description of Artificial Sequence: Synthetic oligonucleotide
tatgagagctgtgttcttgagaggcctctcc

SEQ ID NO: 235316 - DNA, 30 bp, Artificial Sequence
  Description of Artificial Sequence: Synthetic oligonucleotide
atgagagctgtgttcttgagaggcctctcc

SEQ ID NO: 235317 - DNA, 29 bp, Artificial Sequence
  Description of Artificial Sequence: Synthetic oligonucleotide
tgagagctgtgttcttgagaggcctctcc

SEQ ID NO: 235318 - DNA, 28 bp, Artificial Sequence
  Description of Artificial Sequence: Synthetic oligonucleotide
gagagctgtgttcttgagaggcctctcc

SEQ ID NO: 235319 - DNA, 30 bp, Artificial Sequence
  Description of Artificial Sequence: Synthetic oligonucleotide
agagctgtgttcttgagaggcctctccttc

SEQ ID NO: 235320 - DNA, 29 bp, Artificial Sequence
  Description of Artificial Sequence: Synthetic oligonucleotide
gagctgtgttcttgagaggcctctccttc

SEQ ID NO: 235321 - DNA, 29 bp, Artificial Sequence
  Description of Artificial Sequence: Synthetic oligonucleotide
agctgtgttcttgagaggcctctccttcg

SEQ ID NO: 235322 - DNA, 28 bp, Artificial Sequence
  Description of Artificial Sequence: Synthetic oligonucleotide
gctgtgttcttgagaggcctctccttcg

SEQ ID NO: 235323 - DNA, 28 bp, Artificial Sequence
  Description of Artificial Sequence: Synthetic oligonucleotide
ctgtgttcttgagaggcctctccttcgc

SEQ ID NO: 235324 - DNA, 31 bp, Artificial Sequence
  Description of Artificial Sequence: Synthetic oligonucleotide
tgtgttcttgagaggcctctccttcgctttc

SEQ ID NO: 235325 - DNA, 30 bp, Artificial Sequence
  Description of Artificial Sequence: Synthetic oligonucleotide
gtgttcttgagaggcctctccttcgctttc

SEQ ID NO: 235326 - DNA, 30 bp, Artificial Sequence
  Description of Artificial Sequence: Synthetic oligonucleotide
tgttcttgagaggcctctccttcgctttcc

SEQ ID NO: 235327 - DNA, 29 bp, Artificial Sequence
  Description of Artificial Sequence: Synthetic oligonucleotide
gttcttgagaggcctctccttcgctttcc

SEQ ID NO: 235328 - DNA, 30 bp, Artificial Sequence
  Description of Artificial Sequence: Synthetic oligonucleotide
ttcttgagaggcctctccttcgctttcctg

SEQ ID NO: 235329 - DNA, 29 bp, Artificial Sequence
  Description of Artificial Sequence: Synthetic oligonucleotide
tcttgagaggcctctccttcgctttcctg

SEQ ID NO: 235330 - DNA, 28 bp, Artificial Sequence
  Description of Artificial Sequence: Synthetic oligonucleotide
cttgagaggcctctccttcgctttcctg

SEQ ID NO: 235331 - DNA, 28 bp, Artificial Sequence
  Description of Artificial Sequence: Synthetic oligonucleotide
ttgagaggcctctccttcgctttcctgg

SEQ ID NO: 235332 - DNA, 27 bp, Artificial Sequence
  Description of Artificial Sequence: Synthetic oligonucleotide
tgagaggcctctccttcgctttcctgg

SEQ ID NO: 235333 - DNA, 27 bp, Artificial Sequence
  Description of Artificial Sequence: Synthetic oligonucleotide
gagaggcctctccttcgctttcctggt

SEQ ID NO: 235334 - DNA, 27 bp, Artificial Sequence
  Description of Artificial Sequence: Synthetic oligonucleotide
agaggcctctccttcgctttcctggtg

SEQ ID NO: 235335 - DNA, 27 bp, Artificial Sequence
  Description of Artificial Sequence: Synthetic oligonucleotide
gaggcctctccttcgctttcctggtga

SEQ ID NO: 235336 - DNA, 27 bp, Artificial Sequence
  Description of Artificial Sequence: Synthetic oligonucleotide
aggcctctccttcgctttcctggtgag

SEQ ID NO: 235337 - DNA, 27 bp, Artificial Sequence
  Description of Artificial Sequence: Synthetic oligonucleotide
ggcctctccttcgctttcctggtgagt

SEQ ID NO: 235338 - DNA, 27 bp, Artificial Sequence
  Description of Artificial Sequence: Synthetic oligonucleotide
gcctctccttcgctttcctggtgagtc

SEQ ID NO: 235339 - DNA, 28 bp, Artificial Sequence
  Description of Artificial Sequence: Synthetic oligonucleotide
cctctccttcgctttcctggtgagtctc

SEQ ID NO: 235340 - DNA, 28 bp, Artificial Sequence
  Description of Artificial Sequence: Synthetic oligonucleotide
ctctccttcgctttcctggtgagtctcc

SEQ ID NO: 235341 - DNA, 28 bp, Artificial Sequence
  Description of Artificial Sequence: Synthetic oligonucleotide
tctccttcgctttcctggtgagtctccc

SEQ ID NO: 235342 - DNA, 27 bp, Artificial Sequence
  Description of Artificial Sequence: Synthetic oligonucleotide
ctccttcgctttcctggtgagtctccc

SEQ ID NO: 235343 - DNA, 28 bp, Artificial Sequence
  Description of Artificial Sequence: Synthetic oligonucleotide
tccttcgctttcctggtgagtctcccag

SEQ ID NO: 235344 - DNA, 27 bp, Artificial Sequence
  Description of Artificial Sequence: Synthetic oligonucleotide
ccttcgctttcctggtgagtctcccag

SEQ ID NO: 235345 - DNA, 27 bp, Artificial Sequence
  Description of Artificial Sequence: Synthetic oligonucleotide
cttcgctttcctggtgagtctcccagg

SEQ ID NO: 235346 - DNA, 28 bp, Artificial Sequence
  Description of Artificial Sequence: Synthetic oligonucleotide
ttcgctttcctggtgagtctcccaggag

SEQ ID NO: 235347 - DNA, 27 bp, Artificial Sequence
  Description of Artificial Sequence: Synthetic oligonucleotide
tcgctttcctggtgagtctcccaggag

SEQ ID NO: 235348 - DNA, 26 bp, Artificial Sequence
  Description of Artificial Sequence: Synthetic oligonucleotide
cgctttcctggtgagtctcccaggag

SEQ ID NO: 235349 - DNA, 27 bp, Artificial Sequence
  Description of Artificial Sequence: Synthetic oligonucleotide
gctttcctggtgagtctcccaggagct

SEQ ID NO: 235350 - DNA, 27 bp, Artificial Sequence
  Description of Artificial Sequence: Synthetic oligonucleotide
ctttcctggtgagtctcccaggagctg

SEQ ID NO: 235351 - DNA, 27 bp, Artificial Sequence
  Description of Artificial Sequence: Synthetic oligonucleotide
tttcctggtgagtctcccaggagctgg

SEQ ID NO: 235352 - DNA, 26 bp, Artificial Sequence
  Description of Artificial Sequence: Synthetic oligonucleotide
ttcctggtgagtctcccaggagctgg

SEQ ID NO: 235353 - DNA, 25 bp, Artificial Sequence
  Description of Artificial Sequence: Synthetic oligonucleotide
tcctggtgagtctcccaggagctgg

SEQ ID NO: 235354 - DNA, 24 bp, Artificial Sequence
  Description of Artificial Sequence: Synthetic oligonucleotide
cctggtgagtctcccaggagctgg

SEQ ID NO: 235355 - DNA, 24 bp, Artificial Sequence
  Description of Artificial Sequence: Synthetic oligonucleotide
ctggtgagtctcccaggagctggc

SEQ ID NO: 235356 - DNA, 24 bp, Artificial Sequence
  Description of Artificial Sequence: Synthetic oligonucleotide
tggtgagtctcccaggagctggcg

SEQ ID NO: 235357 - DNA, 23 bp, Artificial Sequence
  Description of Artificial Sequence: Synthetic oligonucleotide
ggtgagtctcccaggagctggcg

SEQ ID NO: 235358 - DNA, 23 bp, Artificial Sequence
  Description of Artificial Sequence: Synthetic oligonucleotide
gtgagtctcccaggagctggcgc

SEQ ID NO: 235359 - DNA, 25 bp, Artificial Sequence
  Description of Artificial Sequence: Synthetic oligonucleotide
tgagtctcccaggagctggcgccat

SEQ ID NO: 235360 - DNA, 24 bp, Artificial Sequence
  Description of Artificial Sequence: Synthetic oligonucleotide
gagtctcccaggagctggcgccat

SEQ ID NO: 235361 - DNA, 26 bp, Artificial Sequence
  Description of Artificial Sequence: Synthetic oligonucleotide
agtctcccaggagctggcgccatcaa

SEQ ID NO: 235362 - DNA, 25 bp, Artificial Sequence
  Description of Artificial Sequence: Synthetic oligonucleotide
gtctcccaggagctggcgccatcaa

SEQ ID NO: 235363 - DNA, 25 bp, Artificial Sequence
  Description of Artificial Sequence: Synthetic oligonucleotide
tctcccaggagctggcgccatcaag

SEQ ID NO: 235364 - DNA, 24 bp, Artificial Sequence
  Description of Artificial Sequence: Synthetic oligonucleotide
ctcccaggagctggcgccatcaag

SEQ ID NO: 235365 - DNA, 24 bp, Artificial Sequence
  Description of Artificial Sequence: Synthetic oligonucleotide
tcccaggagctggcgccatcaagc

SEQ ID NO: 235366 - DNA, 23 bp, Artificial Sequence
  Description of Artificial Sequence: Synthetic oligonucleotide
cccaggagctggcgccatcaagc

SEQ ID NO: 235367 - DNA, 23 bp, Artificial Sequence
  Description of Artificial Sequence: Synthetic oligonucleotide
ccaggagctggcgccatcaagcc

SEQ ID NO: 235368 - DNA, 23 bp, Artificial Sequence
  Description of Artificial Sequence: Synthetic oligonucleotide
caggagctggcgccatcaagccg

SEQ ID NO: 235369 - DNA, 24 bp, Artificial Sequence
  Description of Artificial Sequence: Synthetic oligonucleotide
aggagctggcgccatcaagccgga

SEQ ID NO: 235370 - DNA, 23 bp, Artificial Sequence
  Description of Artificial Sequence: Synthetic oligonucleotide
ggagctggcgccatcaagccgga

SEQ ID NO: 235371 - DNA, 23 bp, Artificial Sequence
  Description of Artificial Sequence: Synthetic oligonucleotide
gagctggcgccatcaagccggac

SEQ ID NO: 235372 - DNA, 25 bp, Artificial Sequence
  Description of Artificial Sequence: Synthetic oligonucleotide
agctggcgccatcaagccggaccat

SEQ ID NO: 235373 - DNA, 24 bp, Artificial Sequence
  Description of Artificial Sequence: Synthetic oligonucleotide
gctggcgccatcaagccggaccat

SEQ ID NO: 235374 - DNA, 25 bp, Artificial Sequence
  Description of Artificial Sequence: Synthetic oligonucleotide
ctggcgccatcaagccggaccatga

SEQ ID NO: 235375 - DNA, 26 bp, Artificial Sequence
  Description of Artificial Sequence: Synthetic oligonucleotide
tggcgccatcaagccggaccatgagt

SEQ ID NO: 235376 - DNA, 25 bp, Artificial Sequence
  Description of Artificial Sequence: Synthetic oligonucleotide
ggcgccatcaagccggaccatgagt

SEQ ID NO: 235377 - DNA, 27 bp, Artificial Sequence
  Description of Artificial Sequence: Synthetic oligonucleotide
gcgccatcaagccggaccatgagtcaa

SEQ ID NO: 235378 - DNA, 27 bp, Artificial Sequence
  Description of Artificial Sequence: Synthetic oligonucleotide
cgccatcaagccggaccatgagtcaac

SEQ ID NO: 235379 - DNA, 31 bp, Artificial Sequence
  Description of Artificial Sequence: Synthetic oligonucleotide
gccatcaagccggaccatgagtcaacttaag

SEQ ID NO: 235380 - DNA, 31 bp, Artificial Sequence
  Description of Artificial Sequence: Synthetic oligonucleotide
ccatcaagccggaccatgagtcaacttaagc

SEQ ID NO: 235381 - DNA, 31 bp, Artificial Sequence
  Description of Artificial Sequence: Synthetic oligonucleotide
catcaagccggaccatgagtcaacttaagcc

SEQ ID NO: 235382 - DNA, 31 bp, Artificial Sequence
  Description of Artificial Sequence: Synthetic oligonucleotide
atcaagccggaccatgagtcaacttaagccg

SEQ ID NO: 235383 - DNA, 30 bp, Artificial Sequence
  Description of Artificial Sequence: Synthetic oligonucleotide
tcaagccggaccatgagtcaacttaagccg

SEQ ID NO: 235384 - DNA, 29 bp, Artificial Sequence
  Description of Artificial Sequence: Synthetic oligonucleotide
caagccggaccatgagtcaacttaagccg

SEQ ID NO: 235385 - DNA, 29 bp, Artificial Sequence
  Description of Artificial Sequence: Synthetic oligonucleotide
aagccggaccatgagtcaacttaagccgc

SEQ ID NO: 235386 - DNA, 28 bp, Artificial Sequence
  Description of Artificial Sequence: Synthetic oligonucleotide
agccggaccatgagtcaacttaagccgc

SEQ ID NO: 235387 - DNA, 27 bp, Artificial Sequence
  Description of Artificial Sequence: Synthetic oligonucleotide
gccggaccatgagtcaacttaagccgc

SEQ ID NO: 235388 - DNA, 27 bp, Artificial Sequence
  Description of Artificial Sequence: Synthetic oligonucleotide
ccggaccatgagtcaacttaagccgcg

SEQ ID NO: 235389 - DNA, 30 bp, Artificial Sequence
  Description of Artificial Sequence: Synthetic oligonucleotide
cggaccatgagtcaacttaagccgcgtttc

SEQ ID NO: 235390 - DNA, 32 bp, Artificial Sequence
  Description of Artificial Sequence: Synthetic oligonucleotide
ggaccatgagtcaacttaagccgcgtttctac

SEQ ID NO: 235391 - DNA, 33 bp, Artificial Sequence
  Description of Artificial Sequence: Synthetic oligonucleotide
gaccatgagtcaacttaagccgcgtttctacag

SEQ ID NO: 235392 - DNA, 34 bp, Artificial Sequence
  Description of Artificial Sequence: Synthetic oligonucleotide
accatgagtcaacttaagccgcgtttctacagac

SEQ ID NO: 235393 - DNA, 33 bp, Artificial Sequence
  Description of Artificial Sequence: Synthetic oligonucleotide
ccatgagtcaacttaagccgcgtttctacagac

SEQ ID NO: 235394 - DNA, 33 bp, Artificial Sequence
  Description of Artificial Sequence: Synthetic oligonucleotide
catgagtcaacttaagccgcgtttctacagacg

SEQ ID NO: 235395 - DNA, 33 bp, Artificial Sequence
  Description of Artificial Sequence: Synthetic oligonucleotide
atgagtcaacttaagccgcgtttctacagacgc

SEQ ID NO: 235396 - DNA, 32 bp, Artificial Sequence
  Description of Artificial Sequence: Synthetic oligonucleotide
tgagtcaacttaagccgcgtttctacagacgc

SEQ ID NO: 235397 - DNA, 31 bp, Artificial Sequence
  Description of Artificial Sequence: Synthetic oligonucleotide
gagtcaacttaagccgcgtttctacagacgc

SEQ ID NO: 235398 - DNA, 34 bp, Artificial Sequence
  Description of Artificial Sequence: Synthetic oligonucleotide
agtcaacttaagccgcgtttctacagacgcttag

SEQ ID NO: 235399 - DNA, 33 bp, Artificial Sequence
  Description of Artificial Sequence: Synthetic oligonucleotide
gtcaacttaagccgcgtttctacagacgcttag

SEQ ID NO: 235400 - DNA, 34 bp, Artificial Sequence
  Description of Artificial Sequence: Synthetic oligonucleotide
tcaacttaagccgcgtttctacagacgcttagac

SEQ ID NO: 235401 - DNA, 33 bp, Artificial Sequence
  Description of Artificial Sequence: Synthetic oligonucleotide
caacttaagccgcgtttctacagacgcttagac

SEQ ID NO: 235402 - DNA, 33 bp, Artificial Sequence
  Description of Artificial Sequence: Synthetic oligonucleotide
aacttaagccgcgtttctacagacgcttagacc

SEQ ID NO: 235403 - DNA, 32 bp, Artificial Sequence
  Description of Artificial Sequence: Synthetic oligonucleotide
acttaagccgcgtttctacagacgcttagacc

SEQ ID NO: 235404 - DNA, 31 bp, Artificial Sequence
  Description of Artificial Sequence: Synthetic oligonucleotide
cttaagccgcgtttctacagacgcttagacc

SEQ ID NO: 235405 - DNA, 33 bp, Artificial Sequence
  Description of Artificial Sequence: Synthetic oligonucleotide
ttaagccgcgtttctacagacgcttagaccaac

SEQ ID NO: 235406 - DNA, 32 bp, Artificial Sequence
  Description of Artificial Sequence: Synthetic oligonucleotide
taagccgcgtttctacagacgcttagaccaac

SEQ ID NO: 235407 - DNA, 31 bp, Artificial Sequence
  Description of Artificial Sequence: Synthetic oligonucleotide
aagccgcgtttctacagacgcttagaccaac

SEQ ID NO: 235408 - DNA, 30 bp, Artificial Sequence
  Description of Artificial Sequence: Synthetic oligonucleotide
agccgcgtttctacagacgcttagaccaac

SEQ ID NO: 235409 - DNA, 29 bp, Artificial Sequence
  Description of Artificial Sequence: Synthetic oligonucleotide
gccgcgtttctacagacgcttagaccaac

SEQ ID NO: 235410 - DNA, 30 bp, Artificial Sequence
  Description of Artificial Sequence: Synthetic oligonucleotide
ccgcgtttctacagacgcttagaccaactg

SEQ ID NO: 235411 - DNA, 30 bp, Artificial Sequence
  Description of Artificial Sequence: Synthetic oligonucleotide
cgcgtttctacagacgcttagaccaactgg

SEQ ID NO: 235412 - DNA, 30 bp, Artificial Sequence
  Description of Artificial Sequence: Synthetic oligonucleotide
gcgtttctacagacgcttagaccaactggg

SEQ ID NO: 235413 - DNA, 30 bp, Artificial Sequence
  Description of Artificial Sequence: Synthetic oligonucleotide
cgtttctacagacgcttagaccaactgggg

SEQ ID NO: 235414 - DNA, 31 bp, Artificial Sequence
  Description of Artificial Sequence: Synthetic oligonucleotide
gtttctacagacgcttagaccaactggggag

SEQ ID NO: 235415 - DNA, 36 bp, Artificial Sequence
  Description of Artificial Sequence: Synthetic oligonucleotide
tttctacagacgcttagaccaactggggagtttttg

SEQ ID NO: 235416 - DNA, 35 bp, Artificial Sequence
  Description of Artificial Sequence: Synthetic oligonucleotide
ttctacagacgcttagaccaactggggagtttttg

SEQ ID NO: 235417 - DNA, 34 bp, Artificial Sequence
  Description of Artificial Sequence: Synthetic oligonucleotide
tctacagacgcttagaccaactggggagtttttg

SEQ ID NO: 235418 - DNA, 33 bp, Artificial Sequence
  Description of Artificial Sequence: Synthetic oligonucleotide
ctacagacgcttagaccaactggggagtttttg

SEQ ID NO: 235419 - DNA, 36 bp, Artificial Sequence
  Description of Artificial Sequence: Synthetic oligonucleotide
tacagacgcttagaccaactggggagtttttgtttg

SEQ ID NO: 235420 - DNA, 35 bp, Artificial Sequence
  Description of Artificial Sequence: Synthetic oligonucleotide
acagacgcttagaccaactggggagtttttgtttg

SEQ ID NO: 235421 - DNA, 34 bp, Artificial Sequence
  Description of Artificial Sequence: Synthetic oligonucleotide
cagacgcttagaccaactggggagtttttgtttg

SEQ ID NO: 235422 - DNA, 39 bp, Artificial Sequence
  Description of Artificial Sequence: Synthetic oligonucleotide
agacgcttagaccaactggggagtttttgtttgaatatg

SEQ ID NO: 235423 - DNA, 38 bp, Artificial Sequence
  Description of Artificial Sequence: Synthetic oligonucleotide
gacgcttagaccaactggggagtttttgtttgaatatg

SEQ ID NO: 235424 - DNA, 40 bp, Artificial Sequence
  Description of Artificial Sequence: Synthetic oligonucleotide
acgcttagaccaactggggagtttttgtttgaatatgatg

SEQ ID NO: 235425 - DNA, 39 bp, Artificial Sequence
  Description of Artificial Sequence: Synthetic oligonucleotide
cgcttagaccaactggggagtttttgtttgaatatgatg

SEQ ID NO: 235426 - DNA, 41 bp, Artificial Sequence
  Description of Artificial Sequence: Synthetic oligonucleotide
gcttagaccaactggggagtttttgtttgaatatgatgaag

SEQ ID NO: 235427 - DNA, 43 bp, Artificial Sequence
  Description of Artificial Sequence: Synthetic oligonucleotide
cttagaccaactggggagtttttgtttgaatatgatgaagaag

SEQ ID NO: 235428 - DNA, 44 bp, Artificial Sequence
  Description of Artificial Sequence: Synthetic oligonucleotide
ttagaccaactggggagtttttgtttgaatatgatgaagaagag

SEQ ID NO: 235429 - DNA, 43 bp, Artificial Sequence
  Description of Artificial Sequence: Synthetic oligonucleotide
tagaccaactggggagtttttgtttgaatatgatgaagaagag

SEQ ID NO: 235430 - DNA, 42 bp, Artificial Sequence
  Description of Artificial Sequence: Synthetic oligonucleotide
agaccaactggggagtttttgtttgaatatgatgaagaagag

SEQ ID NO: 235431 - DNA, 41 bp, Artificial Sequence
  Description of Artificial Sequence: Synthetic oligonucleotide
gaccaactggggagtttttgtttgaatatgatgaagaagag

SEQ ID NO: 235432 - DNA, 43 bp, Artificial Sequence
  Description of Artificial Sequence: Synthetic oligonucleotide
accaactggggagtttttgtttgaatatgatgaagaagagatg

SEQ ID NO: 235433 - DNA, 42 bp, Artificial Sequence
  Description of Artificial Sequence: Synthetic oligonucleotide
ccaactggggagtttttgtttgaatatgatgaagaagagatg

SEQ ID NO: 235434 - DNA, 44 bp, Artificial Sequence
  Description of Artificial Sequence: Synthetic oligonucleotide
caactggggagtttttgtttgaatatgatgaagaagagatgttc

SEQ ID NO: 235435 - DNA, 47 bp, Artificial Sequence
  Description of Artificial Sequence: Synthetic oligonucleotide
aactggggagtttttgtttgaatatgatgaagaagagatgttcaatg

SEQ ID NO: 235436 - DNA, 46 bp, Artificial Sequence
  Description of Artificial Sequence: Synthetic oligonucleotide
actggggagtttttgtttgaatatgatgaagaagagatgttcaatg

SEQ ID NO: 235437 - DNA, 45 bp, Artificial Sequence
  Description of Artificial Sequence: Synthetic oligonucleotide
ctggggagtttttgtttgaatatgatgaagaagagatgttcaatg

SEQ ID NO: 235438 - DNA, 46 bp, Artificial Sequence
  Description of Artificial Sequence: Synthetic oligonucleotide
tggggagtttttgtttgaatatgatgaagaagagatgttcaatgtg

SEQ ID NO: 235439 - DNA, 45 bp, Artificial Sequence
  Description of Artificial Sequence: Synthetic oligonucleotide
ggggagtttttgtttgaatatgatgaagaagagatgttcaatgtg

SEQ ID NO: 235440 - DNA, 45 bp, Artificial Sequence
  Description of Artificial Sequence: Synthetic oligonucleotide
gggagtttttgtttgaatatgatgaagaagagatgttcaatgtgg

SEQ ID NO: 235441 - DNA, 47 bp, Artificial Sequence
  Description of Artificial Sequence: Synthetic oligonucleotide
ggagtttttgtttgaatatgatgaagaagagatgttcaatgtggatc

SEQ ID NO: 235442 - DNA, 48 bp, Artificial Sequence
  Description of Artificial Sequence: Synthetic oligonucleotide
gagtttttgtttgaatatgatgaagaagagatgttcaatgtggatcag

SEQ ID NO: 235443 - DNA, 48 bp, Artificial Sequence
  Description of Artificial Sequence: Synthetic oligonucleotide
agtttttgtttgaatatgatgaagaagagatgttcaatgtggatcagg

SEQ ID NO: 235444 - DNA, 47 bp, Artificial Sequence
  Description of Artificial Sequence: Synthetic oligonucleotide
gtttttgtttgaatatgatgaagaagagatgttcaatgtggatcagg

SEQ ID NO: 235445 - DNA, 48 bp, Artificial Sequence
  Description of Artificial Sequence: Synthetic oligonucleotide
tttttgtttgaatatgatgaagaagagatgttcaatgtggatcaggac

SEQ ID NO: 235446 - DNA, 47 bp, Artificial Sequence
  Description of Artificial Sequence: Synthetic oligonucleotide
ttttgtttgaatatgatgaagaagagatgttcaatgtggatcaggac

SEQ ID NO: 235447 - DNA, 46 bp, Artificial Sequence
  Description of Artificial Sequence: Synthetic oligonucleotide
tttgtttgaatatgatgaagaagagatgttcaatgtggatcaggac

SEQ ID NO: 235448 - DNA, 45 bp, Artificial Sequence
  Description of Artificial Sequence: Synthetic oligonucleotide
ttgtttgaatatgatgaagaagagatgttcaatgtggatcaggac

SEQ ID NO: 235449 - DNA, 44 bp, Artificial Sequence
  Description of Artificial Sequence: Synthetic oligonucleotide
tgtttgaatatgatgaagaagagatgttcaatgtggatcaggac

SEQ ID NO: 235450 - DNA, 43 bp, Artificial Sequence
  Description of Artificial Sequence: Synthetic oligonucleotide
gtttgaatatgatgaagaagagatgttcaatgtggatcaggac

SEQ ID NO: 235451 - DNA, 45 bp, Artificial Sequence
  Description of Artificial Sequence: Synthetic oligonucleotide
tttgaatatgatgaagaagagatgttcaatgtggatcaggacaag

SEQ ID NO: 235452 - DNA, 44 bp, Artificial Sequence
  Description of Artificial Sequence: Synthetic oligonucleotide
ttgaatatgatgaagaagagatgttcaatgtggatcaggacaag

SEQ ID NO: 235453 - DNA, 43 bp, Artificial Sequence
  Description of Artificial Sequence: Synthetic oligonucleotide
tgaatatgatgaagaagagatgttcaatgtggatcaggacaag

SEQ ID NO: 235454 - DNA, 42 bp, Artificial Sequence
  Description of Artificial Sequence: Synthetic oligonucleotide
gaatatgatgaagaagagatgttcaatgtggatcaggacaag

SEQ ID NO: 235455 - DNA, 44 bp, Artificial Sequence
  Description of Artificial Sequence: Synthetic oligonucleotide
aatatgatgaagaagagatgttcaatgtggatcaggacaagaac

SEQ ID NO: 235456 - DNA, 43 bp, Artificial Sequence
  Description of Artificial Sequence: Synthetic oligonucleotide
atatgatgaagaagagatgttcaatgtggatcaggacaagaac

SEQ ID NO: 235457 - DNA, 42 bp, Artificial Sequence
  Description of Artificial Sequence: Synthetic oligonucleotide
tatgatgaagaagagatgttcaatgtggatcaggacaagaac

SEQ ID NO: 235458 - DNA, 41 bp, Artificial Sequence
  Description of Artificial Sequence: Synthetic oligonucleotide
atgatgaagaagagatgttcaatgtggatcaggacaagaac

SEQ ID NO: 235459 - DNA, 40 bp, Artificial Sequence
  Description of Artificial Sequence: Synthetic oligonucleotide
tgatgaagaagagatgttcaatgtggatcaggacaagaac

SEQ ID NO: 235460 - DNA, 39 bp, Artificial Sequence
  Description of Artificial Sequence: Synthetic oligonucleotide
gatgaagaagagatgttcaatgtggatcaggacaagaac

SEQ ID NO: 235461 - DNA, 39 bp, Artificial Sequence
  Description of Artificial Sequence: Synthetic oligonucleotide
atgaagaagagatgttcaatgtggatcaggacaagaacg

SEQ ID NO: 235462 - DNA, 38 bp, Artificial Sequence
  Description of Artificial Sequence: Synthetic oligonucleotide
tgaagaagagatgttcaatgtggatcaggacaagaacg

SEQ ID NO: 235463 - DNA, 37 bp, Artificial Sequence
  Description of Artificial Sequence: Synthetic oligonucleotide
gaagaagagatgttcaatgtggatcaggacaagaacg

SEQ ID NO: 235464 - DNA, 38 bp, Artificial Sequence
  Description of Artificial Sequence: Synthetic oligonucleotide
aagaagagatgttcaatgtggatcaggacaagaacgag

SEQ ID NO: 235465 - DNA, 37 bp, Artificial Sequence
  Description of Artificial Sequence: Synthetic oligonucleotide
agaagagatgttcaatgtggatcaggacaagaacgag

SEQ ID NO: 235466 - DNA, 36 bp, Artificial Sequence
  Description of Artificial Sequence: Synthetic oligonucleotide
gaagagatgttcaatgtggatcaggacaagaacgag

SEQ ID NO: 235467 - DNA, 37 bp, Artificial Sequence
  Description of Artificial Sequence: Synthetic oligonucleotide
aagagatgttcaatgtggatcaggacaagaacgagac

SEQ ID NO: 235468 - DNA, 36 bp, Artificial Sequence
  Description of Artificial Sequence: Synthetic oligonucleotide
agagatgttcaatgtggatcaggacaagaacgagac

SEQ ID NO: 235469 - DNA, 35 bp, Artificial Sequence
  Description of Artificial Sequence: Synthetic oligonucleotide
gagatgttcaatgtggatcaggacaagaacgagac

SEQ ID NO: 235470 - DNA, 35 bp, Artificial Sequence
  Description of Artificial Sequence: Synthetic oligonucleotide
agatgttcaatgtggatcaggacaagaacgagacc

SEQ ID NO: 235471 - DNA, 34 bp, Artificial Sequence
  Description of Artificial Sequence: Synthetic oligonucleotide
gatgttcaatgtggatcaggacaagaacgagacc

SEQ ID NO: 235472 - DNA, 34 bp, Artificial Sequence
  Description of Artificial Sequence: Synthetic oligonucleotide
atgttcaatgtggatcaggacaagaacgagaccg

SEQ ID NO: 235473 - DNA, 33 bp, Artificial Sequence
  Description of Artificial Sequence: Synthetic oligonucleotide
tgttcaatgtggatcaggacaagaacgagaccg

SEQ ID NO: 235474 - DNA, 32 bp, Artificial Sequence
  Description of Artificial Sequence: Synthetic oligonucleotide
gttcaatgtggatcaggacaagaacgagaccg

SEQ ID NO: 235475 - DNA, 33 bp, Artificial Sequence
  Description of Artificial Sequence: Synthetic oligonucleotide
ttcaatgtggatcaggacaagaacgagaccgtc

SEQ ID NO: 235476 - DNA, 32 bp, Artificial Sequence
  Description of Artificial Sequence: Synthetic oligonucleotide
tcaatgtggatcaggacaagaacgagaccgtc

SEQ ID NO: 235477 - DNA, 31 bp, Artificial Sequence
  Description of Artificial Sequence: Synthetic oligonucleotide
caatgtggatcaggacaagaacgagaccgtc

SEQ ID NO: 235478 - DNA, 32 bp, Artificial Sequence
  Description of Artificial Sequence: Synthetic oligonucleotide
aatgtggatcaggacaagaacgagaccgtcag

SEQ ID NO: 235479 - DNA, 31 bp, Artificial Sequence
  Description of Artificial Sequence: Synthetic oligonucleotide
atgtggatcaggacaagaacgagaccgtcag

SEQ ID NO: 235480 - DNA, 30 bp, Artificial Sequence
  Description of Artificial Sequence: Synthetic oligonucleotide
tgtggatcaggacaagaacgagaccgtcag

SEQ ID NO: 235481 - DNA, 29 bp, Artificial Sequence
  Description of Artificial Sequence: Synthetic oligonucleotide
gtggatcaggacaagaacgagaccgtcag

SEQ ID NO: 235482 - DNA, 29 bp, Artificial Sequence
  Description of Artificial Sequence: Synthetic oligonucleotide
tggatcaggacaagaacgagaccgtcagg

SEQ ID NO: 235483 - DNA, 28 bp, Artificial Sequence
  Description of Artificial Sequence: Synthetic oligonucleotide
ggatcaggacaagaacgagaccgtcagg

SEQ ID NO: 235484 - DNA, 28 bp, Artificial Sequence
  Description of Artificial Sequence: Synthetic oligonucleotide
gatcaggacaagaacgagaccgtcaggc

SEQ ID NO: 235485 - DNA, 30 bp, Artificial Sequence
  Description of Artificial Sequence: Synthetic oligonucleotide
atcaggacaagaacgagaccgtcaggcatc

SEQ ID NO: 235486 - DNA, 29 bp, Artificial Sequence
  Description of Artificial Sequence: Synthetic oligonucleotide
tcaggacaagaacgagaccgtcaggcatc

SEQ ID NO: 235487 - DNA, 28 bp, Artificial Sequence
  Description of Artificial Sequence: Synthetic oligonucleotide
caggacaagaacgagaccgtcaggcatc

SEQ ID NO: 235488 - DNA, 29 bp, Artificial Sequence
  Description of Artificial Sequence: Synthetic oligonucleotide
aggacaagaacgagaccgtcaggcatctg

SEQ ID NO: 235489 - DNA, 28 bp, Artificial Sequence
  Description of Artificial Sequence: Synthetic oligonucleotide
ggacaagaacgagaccgtcaggcatctg

SEQ ID NO: 235490 - DNA, 28 bp, Artificial Sequence
  Description of Artificial Sequence: Synthetic oligonucleotide
gacaagaacgagaccgtcaggcatctgg

SEQ ID NO: 235491 - DNA, 29 bp, Artificial Sequence
  Description of Artificial Sequence: Synthetic oligonucleotide
acaagaacgagaccgtcaggcatctggtg

SEQ ID NO: 235492 - DNA, 28 bp, Artificial Sequence
  Description of Artificial Sequence: Synthetic oligonucleotide
caagaacgagaccgtcaggcatctggtg

SEQ ID NO: 235493 - DNA, 28 bp, Artificial Sequence
  Description of Artificial Sequence: Synthetic oligonucleotide
aagaacgagaccgtcaggcatctggtgg

SEQ ID NO: 235494 - DNA, 27 bp, Artificial Sequence
  Description of Artificial Sequence: Synthetic oligonucleotide
agaacgagaccgtcaggcatctggtgg

SEQ ID NO: 235495 - DNA, 27 bp, Artificial Sequence
  Description of Artificial Sequence: Synthetic oligonucleotide
gaacgagaccgtcaggcatctggtgga

SEQ ID NO: 235496 - DNA, 27 bp, Artificial Sequence
  Description of Artificial Sequence: Synthetic oligonucleotide
aacgagaccgtcaggcatctggtggag

SEQ ID NO: 235497 - DNA, 27 bp, Artificial Sequence
  Description of Artificial Sequence: Synthetic oligonucleotide
acgagaccgtcaggcatctggtggagt

SEQ ID NO: 235498 - DNA, 27 bp, Artificial Sequence
  Description of Artificial Sequence: Synthetic oligonucleotide
cgagaccgtcaggcatctggtggagtt

SEQ ID NO: 235499 - DNA, 28 bp, Artificial Sequence
  Description of Artificial Sequence: Synthetic oligonucleotide
gagaccgtcaggcatctggtggagtttg

SEQ ID NO: 235500 - DNA, 28 bp, Artificial Sequence
  Description of Artificial Sequence: Synthetic oligonucleotide
agaccgtcaggcatctggtggagtttgg

SEQ ID NO: 235501 - DNA, 27 bp, Artificial Sequence
  Description of Artificial Sequence: Synthetic oligonucleotide
gaccgtcaggcatctggtggagtttgg

SEQ ID NO: 235502 - DNA, 27 bp, Artificial Sequence
  Description of Artificial Sequence: Synthetic oligonucleotide
accgtcaggcatctggtggagtttggg

SEQ ID NO: 235503 - DNA, 26 bp, Artificial Sequence
  Description of Artificial Sequence: Synthetic oligonucleotide
ccgtcaggcatctggtggagtttggg

SEQ ID NO: 235504 - DNA, 27 bp, Artificial Sequence
  Description of Artificial Sequence: Synthetic oligonucleotide
cgtcaggcatctggtggagtttgggca

SEQ ID NO: 235505 - DNA, 28 bp, Artificial Sequence
  Description of Artificial Sequence: Synthetic oligonucleotide
gtcaggcatctggtggagtttgggcaag

SEQ ID NO: 235506 - DNA, 28 bp, Artificial Sequence
  Description of Artificial Sequence: Synthetic oligonucleotide
tcaggcatctggtggagtttgggcaagc

SEQ ID NO: 235507 - DNA, 27 bp, Artificial Sequence
  Description of Artificial Sequence: Synthetic oligonucleotide
caggcatctggtggagtttgggcaagc

SEQ ID NO: 235508 - DNA, 27 bp, Artificial Sequence
  Description of Artificial Sequence: Synthetic oligonucleotide
aggcatctggtggagtttgggcaagcc

SEQ ID NO: 235509 - DNA, 27 bp, Artificial Sequence
  Description of Artificial Sequence: Synthetic oligonucleotide
ggcatctggtggagtttgggcaagcct

SEQ ID NO: 235510 - DNA, 30 bp, Artificial Sequence
  Description of Artificial Sequence: Synthetic oligonucleotide
gcatctggtggagtttgggcaagcctttac

SEQ ID NO: 235511 - DNA, 30 bp, Artificial Sequence
  Description of Artificial Sequence: Synthetic oligonucleotide
catctggtggagtttgggcaagcctttacc

SEQ ID NO: 235512 - DNA, 33 bp, Artificial Sequence
  Description of Artificial Sequence: Synthetic oligonucleotide
atctggtggagtttgggcaagcctttacctttg

SEQ ID NO: 235513 - DNA, 32 bp, Artificial Sequence
  Description of Artificial Sequence: Synthetic oligonucleotide
tctggtggagtttgggcaagcctttacctttg

SEQ ID NO: 235514 - DNA, 31 bp, Artificial Sequence
  Description of Artificial Sequence: Synthetic oligonucleotide
ctggtggagtttgggcaagcctttacctttg

SEQ ID NO: 235515 - DNA, 32 bp, Artificial Sequence
  Description of Artificial Sequence: Synthetic oligonucleotide
tggtggagtttgggcaagcctttacctttgag

SEQ ID NO: 235516 - DNA, 31 bp, Artificial Sequence
  Description of Artificial Sequence: Synthetic oligonucleotide
ggtggagtttgggcaagcctttacctttgag

SEQ ID NO: 235517 - DNA, 31 bp, Artificial Sequence
  Description of Artificial Sequence: Synthetic oligonucleotide
gtggagtttgggcaagcctttacctttgagg

SEQ ID NO: 235518 - DNA, 31 bp, Artificial Sequence
  Description of Artificial Sequence: Synthetic oligonucleotide
tggagtttgggcaagcctttacctttgaggg

SEQ ID NO: 235519 - DNA, 30 bp, Artificial Sequence
  Description of Artificial Sequence: Synthetic oligonucleotide
ggagtttgggcaagcctttacctttgaggg

SEQ ID NO: 235520 - DNA, 31 bp, Artificial Sequence
  Description of Artificial Sequence: Synthetic oligonucleotide
gagtttgggcaagcctttacctttgagggtc

SEQ ID NO: 235521 - DNA, 32 bp, Artificial Sequence
  Description of Artificial Sequence: Synthetic oligonucleotide
agtttgggcaagcctttacctttgagggtcag

SEQ ID NO: 235522 - DNA, 31 bp, Artificial Sequence
  Description of Artificial Sequence: Synthetic oligonucleotide
gtttgggcaagcctttacctttgagggtcag

SEQ ID NO: 235523 - DNA, 31 bp, Artificial Sequence
  Description of Artificial Sequence: Synthetic oligonucleotide
tttgggcaagcctttacctttgagggtcagg

SEQ ID NO: 235524 - DNA, 30 bp, Artificial Sequence
  Description of Artificial Sequence: Synthetic oligonucleotide
ttgggcaagcctttacctttgagggtcagg

SEQ ID NO: 235525 - DNA, 29 bp, Artificial Sequence
  Description of Artificial Sequence: Synthetic oligonucleotide
tgggcaagcctttacctttgagggtcagg

SEQ ID NO: 235526 - DNA, 28 bp, Artificial Sequence
  Description of Artificial Sequence: Synthetic oligonucleotide
gggcaagcctttacctttgagggtcagg

SEQ ID NO: 235527 - DNA, 28 bp, Artificial Sequence
  Description of Artificial Sequence: Synthetic oligonucleotide
ggcaagcctttacctttgagggtcaggg

SEQ ID NO: 235528 - DNA, 28 bp, Artificial Sequence
  Description of Artificial Sequence: Synthetic oligonucleotide
gcaagcctttacctttgagggtcagggc

SEQ ID NO: 235529 - DNA, 28 bp, Artificial Sequence
  Description of Artificial Sequence: Synthetic oligonucleotide
caagcctttacctttgagggtcagggcg

SEQ ID NO: 235530 - DNA, 28 bp, Artificial Sequence
  Description of Artificial Sequence: Synthetic oligonucleotide
aagcctttacctttgagggtcagggcgg

SEQ ID NO: 235531 - DNA, 27 bp, Artificial Sequence
  Description of Artificial Sequence: Synthetic oligonucleotide
agcctttacctttgagggtcagggcgg

SEQ ID NO: 235532 - DNA, 26 bp, Artificial Sequence
  Description of Artificial Sequence: Synthetic oligonucleotide
gcctttacctttgagggtcagggcgg

SEQ ID NO: 235533 - DNA, 26 bp, Artificial Sequence
  Description of Artificial Sequence: Synthetic oligonucleotide
cctttacctttgagggtcagggcggc

SEQ ID NO: 235534 - DNA, 27 bp, Artificial Sequence
  Description of Artificial Sequence: Synthetic oligonucleotide
ctttacctttgagggtcagggcggcct

SEQ ID NO: 235535 - DNA, 27 bp, Artificial Sequence
  Description of Artificial Sequence: Synthetic oligonucleotide
tttacctttgagggtcagggcggcctg

SEQ ID NO: 235536 - DNA, 26 bp, Artificial Sequence
  Description of Artificial Sequence: Synthetic oligonucleotide
ttacctttgagggtcagggcggcctg

SEQ ID NO: 235537 - DNA, 25 bp, Artificial Sequence
  Description of Artificial Sequence: Synthetic oligonucleotide
tacctttgagggtcagggcggcctg

SEQ ID NO: 235538 - DNA, 24 bp, Artificial Sequence
  Description of Artificial Sequence: Synthetic oligonucleotide
acctttgagggtcagggcggcctg

SEQ ID NO: 235539 - DNA, 23 bp, Artificial Sequence
  Description of Artificial Sequence: Synthetic oligonucleotide
cctttgagggtcagggcggcctg

SEQ ID NO: 235540 - DNA, 23 bp, Artificial Sequence
  Description of Artificial Sequence: Synthetic oligonucleotide
ctttgagggtcagggcggcctgg

SEQ ID NO: 235541 - DNA, 26 bp, Artificial Sequence
  Description of Artificial Sequence: Synthetic oligonucleotide
tttgagggtcagggcggcctggctaa

SEQ ID NO: 235542 - DNA, 25 bp, Artificial Sequence
  Description of Artificial Sequence: Synthetic oligonucleotide
ttgagggtcagggcggcctggctaa

SEQ ID NO: 235543 - DNA, 24 bp, Artificial Sequence
  Description of Artificial Sequence: Synthetic oligonucleotide
tgagggtcagggcggcctggctaa

SEQ ID NO: 235544 - DNA, 23 bp, Artificial Sequence
  Description of Artificial Sequence: Synthetic oligonucleotide
gagggtcagggcggcctggctaa

SEQ ID NO: 235545 - DNA, 26 bp, Artificial Sequence
  Description of Artificial Sequence: Synthetic oligonucleotide
agggtcagggcggcctggctaacttt

SEQ ID NO: 235546 - DNA, 25 bp, Artificial Sequence
  Description of Artificial Sequence: Synthetic oligonucleotide
gggtcagggcggcctggctaacttt

SEQ ID NO: 235547 - DNA, 25 bp, Artificial Sequence
  Description of Artificial Sequence: Synthetic oligonucleotide
ggtcagggcggcctggctaactttg

SEQ ID NO: 235548 - DNA, 27 bp, Artificial Sequence
  Description of Artificial Sequence: Synthetic oligonucleotide
gtcagggcggcctggctaactttgcta

SEQ ID NO: 235549 - DNA, 31 bp, Artificial Sequence
  Description of Artificial Sequence: Synthetic oligonucleotide
tcagggcggcctggctaactttgctatatag

SEQ ID NO: 235550 - DNA, 30 bp, Artificial Sequence
  Description of Artificial Sequence: Synthetic oligonucleotide
cagggcggcctggctaactttgctatatag

SEQ ID NO: 235551 - DNA, 32 bp, Artificial Sequence
  Description of Artificial Sequence: Synthetic oligonucleotide
agggcggcctggctaactttgctatatagaac

SEQ ID NO: 235552 - DNA, 31 bp, Artificial Sequence
  Description of Artificial Sequence: Synthetic oligonucleotide
gggcggcctggctaactttgctatatagaac

SEQ ID NO: 235553 - DNA, 33 bp, Artificial Sequence
  Description of Artificial Sequence: Synthetic oligonucleotide
ggcggcctggctaactttgctatatagaacaac

SEQ ID NO: 235554 - DNA, 35 bp, Artificial Sequence
  Description of Artificial Sequence: Synthetic oligonucleotide
gcggcctggctaactttgctatatagaacaacaag

SEQ ID NO: 235555 - DNA, 37 bp, Artificial Sequence
  Description of Artificial Sequence: Synthetic oligonucleotide
cggcctggctaactttgctatatagaacaacaagttg

SEQ ID NO: 235556 - DNA, 41 bp, Artificial Sequence
  Description of Artificial Sequence: Synthetic oligonucleotide
ggcctggctaactttgctatatagaacaacaagttgaatac

SEQ ID NO: 235557 - DNA, 41 bp, Artificial Sequence
  Description of Artificial Sequence: Synthetic oligonucleotide
gcctggctaactttgctatatagaacaacaagttgaatacc

SEQ ID NO: 235558 - DNA, 43 bp, Artificial Sequence
  Description of Artificial Sequence: Synthetic oligonucleotide
cctggctaactttgctatatagaacaacaagttgaataccatg

SEQ ID NO: 235559 - DNA, 45 bp, Artificial Sequence
  Description of Artificial Sequence: Synthetic oligonucleotide
ctggctaactttgctatatagaacaacaagttgaataccatgatc

SEQ ID NO: 235560 - DNA, 45 bp, Artificial Sequence
  Description of Artificial Sequence: Synthetic oligonucleotide
tggctaactttgctatatagaacaacaagttgaataccatgatcc

SEQ ID NO: 235561 - DNA, 44 bp, Artificial Sequence
  Description of Artificial Sequence: Synthetic oligonucleotide
ggctaactttgctatatagaacaacaagttgaataccatgatcc

SEQ ID NO: 235562 - DNA, 45 bp, Artificial Sequence
  Description of Artificial Sequence: Synthetic oligonucleotide
gctaactttgctatatagaacaacaagttgaataccatgatccag

SEQ ID NO: 235563 - DNA, 45 bp, Artificial Sequence
  Description of Artificial Sequence: Synthetic oligonucleotide
ctaactttgctatatagaacaacaagttgaataccatgatccagc

SEQ ID NO: 235564 - DNA, 45 bp, Artificial Sequence
  Description of Artificial Sequence: Synthetic oligonucleotide
taactttgctatatagaacaacaagttgaataccatgatccagcg

SEQ ID NO: 235565 - DNA, 44 bp, Artificial Sequence
  Description of Artificial Sequence: Synthetic oligonucleotide
aactttgctatatagaacaacaagttgaataccatgatccagcg

SEQ ID NO: 235566 - DNA, 43 bp, Artificial Sequence
  Description of Artificial Sequence: Synthetic oligonucleotide
actttgctatatagaacaacaagttgaataccatgatccagcg

SEQ ID NO: 235567 - DNA, 42 bp, Artificial Sequence
  Description of Artificial Sequence: Synthetic oligonucleotide
ctttgctatatagaacaacaagttgaataccatgatccagcg

SEQ ID NO: 235568 - DNA, 44 bp, Artificial Sequence
  Description of Artificial Sequence: Synthetic oligonucleotide
tttgctatatagaacaacaagttgaataccatgatccagcgttc

SEQ ID NO: 235569 - DNA, 43 bp, Artificial Sequence
  Description of Artificial Sequence: Synthetic oligonucleotide
ttgctatatagaacaacaagttgaataccatgatccagcgttc

SEQ ID NO: 235570 - DNA, 42 bp, Artificial Sequence
  Description of Artificial Sequence: Synthetic oligonucleotide
tgctatatagaacaacaagttgaataccatgatccagcgttc

SEQ ID NO: 235571 - DNA, 41 bp, Artificial Sequence
  Description of Artificial Sequence: Synthetic oligonucleotide
gctatatagaacaacaagttgaataccatgatccagcgttc

SEQ ID NO: 235572 - DNA, 41 bp, Artificial Sequence
  Description of Artificial Sequence: Synthetic oligonucleotide
ctatatagaacaacaagttgaataccatgatccagcgttcc

SEQ ID NO: 235573 - DNA, 43 bp, Artificial Sequence
  Description of Artificial Sequence: Synthetic oligonucleotide
tatatagaacaacaagttgaataccatgatccagcgttccaac

SEQ ID NO: 235574 - DNA, 42 bp, Artificial Sequence
  Description of Artificial Sequence: Synthetic oligonucleotide
atatagaacaacaagttgaataccatgatccagcgttccaac

SEQ ID NO: 235575 - DNA, 41 bp, Artificial Sequence
  Description of Artificial Sequence: Synthetic oligonucleotide
tatagaacaacaagttgaataccatgatccagcgttccaac

SEQ ID NO: 235576 - DNA, 40 bp, Artificial Sequence
  Description of Artificial Sequence: Synthetic oligonucleotide
atagaacaacaagttgaataccatgatccagcgttccaac

SEQ ID NO: 235577 - DNA, 39 bp, Artificial Sequence
  Description of Artificial Sequence: Synthetic oligonucleotide
tagaacaacaagttgaataccatgatccagcgttccaac

SEQ ID NO: 235578 - DNA, 38 bp, Artificial Sequence
  Description of Artificial Sequence: Synthetic oligonucleotide
agaacaacaagttgaataccatgatccagcgttccaac

SEQ ID NO: 235579 - DNA, 37 bp, Artificial Sequence
  Description of Artificial Sequence: Synthetic oligonucleotide
gaacaacaagttgaataccatgatccagcgttccaac

SEQ ID NO: 235580 - DNA, 37 bp, Artificial Sequence
  Description of Artificial Sequence: Synthetic oligonucleotide
aacaacaagttgaataccatgatccagcgttccaacc

SEQ ID NO: 235581 - DNA, 36 bp, Artificial Sequence
  Description of Artificial Sequence: Synthetic oligonucleotide
acaacaagttgaataccatgatccagcgttccaacc

SEQ ID NO: 235582 - DNA, 35 bp, Artificial Sequence
  Description of Artificial Sequence: Synthetic oligonucleotide
caacaagttgaataccatgatccagcgttccaacc

SEQ ID NO: 235583 - DNA, 36 bp, Artificial Sequence
  Description of Artificial Sequence: Synthetic oligonucleotide
aacaagttgaataccatgatccagcgttccaaccag

SEQ ID NO: 235584 - DNA, 35 bp, Artificial Sequence
  Description of Artificial Sequence: Synthetic oligonucleotide
acaagttgaataccatgatccagcgttccaaccag

SEQ ID NO: 235585 - DNA, 34 bp, Artificial Sequence
  Description of Artificial Sequence: Synthetic oligonucleotide
caagttgaataccatgatccagcgttccaaccag

SEQ ID NO: 235586 - DNA, 35 bp, Artificial Sequence
  Description of Artificial Sequence: Synthetic oligonucleotide
aagttgaataccatgatccagcgttccaaccagac

SEQ ID NO: 235587 - DNA, 34 bp, Artificial Sequence
  Description of Artificial Sequence: Synthetic oligonucleotide
agttgaataccatgatccagcgttccaaccagac

SEQ ID NO: 235588 - DNA, 33 bp, Artificial Sequence
  Description of Artificial Sequence: Synthetic oligonucleotide
gttgaataccatgatccagcgttccaaccagac

SEQ ID NO: 235589 - DNA, 34 bp, Artificial Sequence
  Description of Artificial Sequence: Synthetic oligonucleotide
ttgaataccatgatccagcgttccaaccagactc

SEQ ID NO: 235590 - DNA, 33 bp, Artificial Sequence
  Description of Artificial Sequence: Synthetic oligonucleotide
tgaataccatgatccagcgttccaaccagactc

SEQ ID NO: 235591 - DNA, 32 bp, Artificial Sequence
  Description of Artificial Sequence: Synthetic oligonucleotide
gaataccatgatccagcgttccaaccagactc

SEQ ID NO: 235592 - DNA, 33 bp, Artificial Sequence
  Description of Artificial Sequence: Synthetic oligonucleotide
aataccatgatccagcgttccaaccagactcag

SEQ ID NO: 235593 - DNA, 32 bp, Artificial Sequence
  Description of Artificial Sequence: Synthetic oligonucleotide
ataccatgatccagcgttccaaccagactcag

SEQ ID NO: 235594 - DNA, 31 bp, Artificial Sequence
  Description of Artificial Sequence: Synthetic oligonucleotide
taccatgatccagcgttccaaccagactcag

SEQ ID NO: 235595 - DNA, 30 bp, Artificial Sequence
  Description of Artificial Sequence: Synthetic oligonucleotide
accatgatccagcgttccaaccagactcag

SEQ ID NO: 235596 - DNA, 29 bp, Artificial Sequence
  Description of Artificial Sequence: Synthetic oligonucleotide
ccatgatccagcgttccaaccagactcag

SEQ ID NO: 235597 - DNA, 29 bp, Artificial Sequence
  Description of Artificial Sequence: Synthetic oligonucleotide
catgatccagcgttccaaccagactcagg

SEQ ID NO: 235598 - DNA, 29 bp, Artificial Sequence
  Description of Artificial Sequence: Synthetic oligonucleotide
atgatccagcgttccaaccagactcaggc

SEQ ID NO: 235599 - DNA, 28 bp, Artificial Sequence
  Description of Artificial Sequence: Synthetic oligonucleotide
tgatccagcgttccaaccagactcaggc

SEQ ID NO: 235600 - DNA, 27 bp, Artificial Sequence
  Description of Artificial Sequence: Synthetic oligonucleotide
gatccagcgttccaaccagactcaggc

SEQ ID NO: 235601 - DNA, 27 bp, Artificial Sequence
  Description of Artificial Sequence: Synthetic oligonucleotide
atccagcgttccaaccagactcaggcg

SEQ ID NO: 235602 - DNA, 27 bp, Artificial Sequence
  Description of Artificial Sequence: Synthetic oligonucleotide
tccagcgttccaaccagactcaggcga

SEQ ID NO: 235603 - DNA, 26 bp, Artificial Sequence
  Description of Artificial Sequence: Synthetic oligonucleotide
ccagcgttccaaccagactcaggcga

SEQ ID NO: 235604 - DNA, 26 bp, Artificial Sequence
  Description of Artificial Sequence: Synthetic oligonucleotide
cagcgttccaaccagactcaggcgac

SEQ ID NO: 235605 - DNA, 27 bp, Artificial Sequence
  Description of Artificial Sequence: Synthetic oligonucleotide
agcgttccaaccagactcaggcgacca

SEQ ID NO: 235606 - DNA, 27 bp, Artificial Sequence
  Description of Artificial Sequence: Synthetic oligonucleotide
gcgttccaaccagactcaggcgaccaa

SEQ ID NO: 235607 - DNA, 27 bp, Artificial Sequence
  Description of Artificial Sequence: Synthetic oligonucleotide
cgttccaaccagactcaggcgaccaac

SEQ ID NO: 235608 - DNA, 27 bp, Artificial Sequence
  Description of Artificial Sequence: Synthetic oligonucleotide
gttccaaccagactcaggcgaccaacg

SEQ ID NO: 235609 - DNA, 29 bp, Artificial Sequence
  Description of Artificial Sequence: Synthetic oligonucleotide
ttccaaccagactcaggcgaccaacgatc

SEQ ID NO: 235610 - DNA, 28 bp, Artificial Sequence
  Description of Artificial Sequence: Synthetic oligonucleotide
tccaaccagactcaggcgaccaacgatc

SEQ ID NO: 235611 - DNA, 27 bp, Artificial Sequence
  Description of Artificial Sequence: Synthetic oligonucleotide
ccaaccagactcaggcgaccaacgatc

SEQ ID NO: 235612 - DNA, 27 bp, Artificial Sequence
  Description of Artificial Sequence: Synthetic oligonucleotide
caaccagactcaggcgaccaacgatcg

SEQ ID NO: 235613 - DNA, 27 bp, Artificial Sequence
  Description of Artificial Sequence: Synthetic oligonucleotide
aaccagactcaggcgaccaacgatcgc

SEQ ID NO: 235614 - DNA, 26 bp, Artificial Sequence
  Description of Artificial Sequence: Synthetic oligonucleotide
accagactcaggcgaccaacgatcgc

SEQ ID NO: 235615 - DNA, 25 bp, Artificial Sequence
  Description of Artificial Sequence: Synthetic oligonucleotide
ccagactcaggcgaccaacgatcgc

SEQ ID NO: 235616 - DNA, 25 bp, Artificial Sequence
  Description of Artificial Sequence: Synthetic oligonucleotide
cagactcaggcgaccaacgatcgcc

SEQ ID NO: 235617 - DNA, 26 bp, Artificial Sequence
  Description of Artificial Sequence: Synthetic oligonucleotide
agactcaggcgaccaacgatcgccct

SEQ ID NO: 235618 - DNA, 25 bp, Artificial Sequence
  Description of Artificial Sequence: Synthetic oligonucleotide
gactcaggcgaccaacgatcgccct

SEQ ID NO: 235619 - DNA, 26 bp, Artificial Sequence
  Description of Artificial Sequence: Synthetic oligonucleotide
actcaggcgaccaacgatcgccctga

SEQ ID NO: 235620 - DNA, 25 bp, Artificial Sequence
  Description of Artificial Sequence: Synthetic oligonucleotide
ctcaggcgaccaacgatcgccctga

SEQ ID NO: 235621 - DNA, 25 bp, Artificial Sequence
  Description of Artificial Sequence: Synthetic oligonucleotide
tcaggcgaccaacgatcgccctgag

SEQ ID NO: 235622 - DNA, 24 bp, Artificial Sequence
  Description of Artificial Sequence: Synthetic oligonucleotide
caggcgaccaacgatcgccctgag

SEQ ID NO: 235623 - DNA, 25 bp, Artificial Sequence
  Description of Artificial Sequence: Synthetic oligonucleotide
aggcgaccaacgatcgccctgaggt

SEQ ID NO: 235624 - DNA, 24 bp, Artificial Sequence
  Description of Artificial Sequence: Synthetic oligonucleotide
ggcgaccaacgatcgccctgaggt

SEQ ID NO: 235625 - DNA, 24 bp, Artificial Sequence
  Description of Artificial Sequence: Synthetic oligonucleotide
gcgaccaacgatcgccctgaggtc

SEQ ID NO: 235626 - DNA, 25 bp, Artificial Sequence
  Description of Artificial Sequence: Synthetic oligonucleotide
cgaccaacgatcgccctgaggtcga

SEQ ID NO: 235627 - DNA, 27 bp, Artificial Sequence
  Description of Artificial Sequence: Synthetic oligonucleotide
gaccaacgatcgccctgaggtcgacaa

SEQ ID NO: 235628 - DNA, 27 bp, Artificial Sequence
  Description of Artificial Sequence: Synthetic oligonucleotide
accaacgatcgccctgaggtcgacaag

SEQ ID NO: 235629 - DNA, 27 bp, Artificial Sequence
  Description of Artificial Sequence: Synthetic oligonucleotide
ccaacgatcgccctgaggtcgacaagt

SEQ ID NO: 235630 - DNA, 28 bp, Artificial Sequence
  Description of Artificial Sequence: Synthetic oligonucleotide
caacgatcgccctgaggtcgacaagttc

SEQ ID NO: 235631 - DNA, 30 bp, Artificial Sequence
  Description of Artificial Sequence: Synthetic oligonucleotide
aacgatcgccctgaggtcgacaagttcatc

SEQ ID NO: 235632 - DNA, 29 bp, Artificial Sequence
  Description of Artificial Sequence: Synthetic oligonucleotide
acgatcgccctgaggtcgacaagttcatc

SEQ ID NO: 235633 - DNA, 28 bp, Artificial Sequence
  Description of Artificial Sequence: Synthetic oligonucleotide
cgatcgccctgaggtcgacaagttcatc

SEQ ID NO: 235634 - DNA, 28 bp, Artificial Sequence
  Description of Artificial Sequence: Synthetic oligonucleotide
gatcgccctgaggtcgacaagttcatcc

SEQ ID NO: 235635 - DNA, 28 bp, Artificial Sequence
  Description of Artificial Sequence: Synthetic oligonucleotide
atcgccctgaggtcgacaagttcatccc

SEQ ID NO: 235636 - DNA, 27 bp, Artificial Sequence
  Description of Artificial Sequence: Synthetic oligonucleotide
tcgccctgaggtcgacaagttcatccc

SEQ ID NO: 235637 - DNA, 27 bp, Artificial Sequence
  Description of Artificial Sequence: Synthetic oligonucleotide
cgccctgaggtcgacaagttcatccca

SEQ ID NO: 235638 - DNA, 27 bp, Artificial Sequence
  Description of Artificial Sequence: Synthetic oligonucleotide
gccctgaggtcgacaagttcatcccac

SEQ ID NO: 235639 - DNA, 27 bp, Artificial Sequence
  Description of Artificial Sequence: Synthetic oligonucleotide
ccctgaggtcgacaagttcatcccacc

SEQ ID NO: 235640 - DNA, 28 bp, Artificial Sequence
  Description of Artificial Sequence: Synthetic oligonucleotide
cctgaggtcgacaagttcatcccaccag

SEQ ID NO: 235641 - DNA, 29 bp, Artificial Sequence
  Description of Artificial Sequence: Synthetic oligonucleotide
ctgaggtcgacaagttcatcccaccagag

SEQ ID NO: 235642 - DNA, 29 bp, Artificial Sequence
  Description of Artificial Sequence: Synthetic oligonucleotide
tgaggtcgacaagttcatcccaccagagc

SEQ ID NO: 235643 - DNA, 28 bp, Artificial Sequence
  Description of Artificial Sequence: Synthetic oligonucleotide
gaggtcgacaagttcatcccaccagagc

SEQ ID NO: 235644 - DNA, 29 bp, Artificial Sequence
  Description of Artificial Sequence: Synthetic oligonucleotide
aggtcgacaagttcatcccaccagagctc

SEQ ID NO: 235645 - DNA, 28 bp, Artificial Sequence
  Description of Artificial Sequence: Synthetic oligonucleotide
ggtcgacaagttcatcccaccagagctc

SEQ ID NO: 235646 - DNA, 30 bp, Artificial Sequence
  Description of Artificial Sequence: Synthetic oligonucleotide
gtcgacaagttcatcccaccagagctcaac

SEQ ID NO: 235647 - DNA, 30 bp, Artificial Sequence
  Description of Artificial Sequence: Synthetic oligonucleotide
tcgacaagttcatcccaccagagctcaacg

SEQ ID NO: 235648 - DNA, 29 bp, Artificial Sequence
  Description of Artificial Sequence: Synthetic oligonucleotide
cgacaagttcatcccaccagagctcaacg

SEQ ID NO: 235649 - DNA, 30 bp, Artificial Sequence
  Description of Artificial Sequence: Synthetic oligonucleotide
gacaagttcatcccaccagagctcaacgtg

SEQ ID NO: 235650 - DNA, 31 bp, Artificial Sequence
  Description of Artificial Sequence: Synthetic oligonucleotide
acaagttcatcccaccagagctcaacgtgac

SEQ ID NO: 235651 - DNA, 30 bp, Artificial Sequence
  Description of Artificial Sequence: Synthetic oligonucleotide
caagttcatcccaccagagctcaacgtgac

SEQ ID NO: 235652 - DNA, 30 bp, Artificial Sequence
  Description of Artificial Sequence: Synthetic oligonucleotide
aagttcatcccaccagagctcaacgtgacg

SEQ ID NO: 235653 - DNA, 29 bp, Artificial Sequence
  Description of Artificial Sequence: Synthetic oligonucleotide
agttcatcccaccagagctcaacgtgacg

SEQ ID NO: 235654 - DNA, 28 bp, Artificial Sequence
  Description of Artificial Sequence: Synthetic oligonucleotide
gttcatcccaccagagctcaacgtgacg

SEQ ID NO: 235655 - DNA, 29 bp, Artificial Sequence
  Description of Artificial Sequence: Synthetic oligonucleotide
ttcatcccaccagagctcaacgtgacgtg

SEQ ID NO: 235656 - DNA, 28 bp, Artificial Sequence
  Description of Artificial Sequence: Synthetic oligonucleotide
tcatcccaccagagctcaacgtgacgtg

SEQ ID NO: 235657 - DNA, 27 bp, Artificial Sequence
  Description of Artificial Sequence: Synthetic oligonucleotide
catcccaccagagctcaacgtgacgtg

SEQ ID NO: 235658 - DNA, 27 bp, Artificial Sequence
  Description of Artificial Sequence: Synthetic oligonucleotide
atcccaccagagctcaacgtgacgtgg

SEQ ID NO: 235659 - DNA, 26 bp, Artificial Sequence
  Description of Artificial Sequence: Synthetic oligonucleotide
tcccaccagagctcaacgtgacgtgg

SEQ ID NO: 235660 - DNA, 25 bp, Artificial Sequence
  Description of Artificial Sequence: Synthetic oligonucleotide
cccaccagagctcaacgtgacgtgg

SEQ ID NO: 235661 - DNA, 26 bp, Artificial Sequence
  Description of Artificial Sequence: Synthetic oligonucleotide
ccaccagagctcaacgtgacgtggct

SEQ ID NO: 235662 - DNA, 27 bp, Artificial Sequence
  Description of Artificial Sequence: Synthetic oligonucleotide
caccagagctcaacgtgacgtggctga

SEQ ID NO: 235663 - DNA, 27 bp, Artificial Sequence
  Description of Artificial Sequence: Synthetic oligonucleotide
accagagctcaacgtgacgtggctgag

SEQ ID NO: 235664 - DNA, 26 bp, Artificial Sequence
  Description of Artificial Sequence: Synthetic oligonucleotide
ccagagctcaacgtgacgtggctgag

SEQ ID NO: 235665 - DNA, 27 bp, Artificial Sequence
  Description of Artificial Sequence: Synthetic oligonucleotide
cagagctcaacgtgacgtggctgagca

SEQ ID NO: 235666 - DNA, 28 bp, Artificial Sequence
  Description of Artificial Sequence: Synthetic oligonucleotide
agagctcaacgtgacgtggctgagcaac

SEQ ID NO: 235667 - DNA, 27 bp, Artificial Sequence
  Description of Artificial Sequence: Synthetic oligonucleotide
gagctcaacgtgacgtggctgagcaac

SEQ ID NO: 235668 - DNA, 27 bp, Artificial Sequence
  Description of Artificial Sequence: Synthetic oligonucleotide
agctcaacgtgacgtggctgagcaacg

SEQ ID NO: 235669 - DNA, 26 bp, Artificial Sequence
  Description of Artificial Sequence: Synthetic oligonucleotide
gctcaacgtgacgtggctgagcaacg

SEQ ID NO: 235670 - DNA, 26 bp, Artificial Sequence
  Description of Artificial Sequence: Synthetic oligonucleotide
ctcaacgtgacgtggctgagcaacgg

SEQ ID NO: 235671 - DNA, 26 bp, Artificial Sequence
  Description of Artificial Sequence: Synthetic oligonucleotide
tcaacgtgacgtggctgagcaacggg

SEQ ID NO: 235672 - DNA, 25 bp, Artificial Sequence
  Description of Artificial Sequence: Synthetic oligonucleotide
caacgtgacgtggctgagcaacggg

SEQ ID NO: 235673 - DNA, 26 bp, Artificial Sequence
  Description of Artificial Sequence: Synthetic oligonucleotide
aacgtgacgtggctgagcaacggggt

SEQ ID NO: 235674 - DNA, 25 bp, Artificial Sequence
  Description of Artificial Sequence: Synthetic oligonucleotide
acgtgacgtggctgagcaacggggt

SEQ ID NO: 235675 - DNA, 24 bp, Artificial Sequence
  Description of Artificial Sequence: Synthetic oligonucleotide
cgtgacgtggctgagcaacggggt

SEQ ID NO: 235676 - DNA, 24 bp, Artificial Sequence
  Description of Artificial Sequence: Synthetic oligonucleotide
gtgacgtggctgagcaacggggtg

SEQ ID NO: 235677 - DNA, 25 bp, Artificial Sequence
  Description of Artificial Sequence: Synthetic oligonucleotide
tgacgtggctgagcaacggggtgct

SEQ ID NO: 235678 - DNA, 24 bp, Artificial Sequence
  Description of Artificial Sequence: Synthetic oligonucleotide
gacgtggctgagcaacggggtgct

SEQ ID NO: 235679 - DNA, 24 bp, Artificial Sequence
  Description of Artificial Sequence: Synthetic oligonucleotide
acgtggctgagcaacggggtgctg

SEQ ID NO: 235680 - DNA, 23 bp, Artificial Sequence
  Description of Artificial Sequence: Synthetic oligonucleotide
cgtggctgagcaacggggtgctg

SEQ ID NO: 235681 - DNA, 24 bp, Artificial Sequence
  Description of Artificial Sequence: Synthetic oligonucleotide
gtggctgagcaacggggtgctggt

SEQ ID NO: 235682 - DNA, 25 bp, Artificial Sequence
  Description of Artificial Sequence: Synthetic oligonucleotide
tggctgagcaacggggtgctggtca

SEQ ID NO: 235683 - DNA, 24 bp, Artificial Sequence
  Description of Artificial Sequence: Synthetic oligonucleotide
ggctgagcaacggggtgctggtca

SEQ ID NO: 235684 - DNA, 25 bp, Artificial Sequence
  Description of Artificial Sequence: Synthetic oligonucleotide
gctgagcaacggggtgctggtcaca

SEQ ID NO: 235685 - DNA, 26 bp, Artificial Sequence
  Description of Artificial Sequence: Synthetic oligonucleotide
ctgagcaacggggtgctggtcacaga

SEQ ID NO: 235686 - DNA, 26 bp, Artificial Sequence
  Description of Artificial Sequence: Synthetic oligonucleotide
tgagcaacggggtgctggtcacagag

SEQ ID NO: 235687 - DNA, 25 bp, Artificial Sequence
  Description of Artificial Sequence: Synthetic oligonucleotide
gagcaacggggtgctggtcacagag

SEQ ID NO: 235688 - DNA, 25 bp, Artificial Sequence
  Description of Artificial Sequence: Synthetic oligonucleotide
agcaacggggtgctggtcacagagg

SEQ ID NO: 235689 - DNA, 24 bp, Artificial Sequence
  Description of Artificial Sequence: Synthetic oligonucleotide
gcaacggggtgctggtcacagagg

SEQ ID NO: 235690 - DNA, 25 bp, Artificial Sequence
  Description of Artificial Sequence: Synthetic oligonucleotide
caacggggtgctggtcacagagggt

SEQ ID NO: 235691 - DNA, 26 bp, Artificial Sequence
  Description of Artificial Sequence: Synthetic oligonucleotide
aacggggtgctggtcacagagggtgt

SEQ ID NO: 235692 - DNA, 25 bp, Artificial Sequence
  Description of Artificial Sequence: Synthetic oligonucleotide
acggggtgctggtcacagagggtgt

SEQ ID NO: 235693 - DNA, 24 bp, Artificial Sequence
  Description of Artificial Sequence: Synthetic oligonucleotide
cggggtgctggtcacagagggtgt

SEQ ID NO: 235694 - DNA, 24 bp, Artificial Sequence
  Description of Artificial Sequence: Synthetic oligonucleotide
ggggtgctggtcacagagggtgtc

SEQ ID NO: 235695 - DNA, 24 bp, Artificial Sequence
  Description of Artificial Sequence: Synthetic oligonucleotide
gggtgctggtcacagagggtgtcc

SEQ ID NO: 235696 - DNA, 25 bp, Artificial Sequence
  Description of Artificial Sequence: Synthetic oligonucleotide
ggtgctggtcacagagggtgtccct

SEQ ID NO: 235697 - DNA, 26 bp, Artificial Sequence
  Description of Artificial Sequence: Synthetic oligonucleotide
gtgctggtcacagagggtgtccctga

SEQ ID NO: 235698 - DNA, 27 bp, Artificial Sequence
  Description of Artificial Sequence: Synthetic oligonucleotide
tgctggtcacagagggtgtccctgaga

SEQ ID NO: 235699 - DNA, 26 bp, Artificial Sequence
  Description of Artificial Sequence: Synthetic oligonucleotide
gctggtcacagagggtgtccctgaga

SEQ ID NO: 235700 - DNA, 26 bp, Artificial Sequence
  Description of Artificial Sequence: Synthetic oligonucleotide
ctggtcacagagggtgtccctgagag

SEQ ID NO: 235701 - DNA, 26 bp, Artificial Sequence
  Description of Artificial Sequence: Synthetic oligonucleotide
tggtcacagagggtgtccctgagagc

SEQ ID NO: 235702 - DNA, 25 bp, Artificial Sequence
  Description of Artificial Sequence: Synthetic oligonucleotide
ggtcacagagggtgtccctgagagc

SEQ ID NO: 235703 - DNA, 26 bp, Artificial Sequence
  Description of Artificial Sequence: Synthetic oligonucleotide
gtcacagagggtgtccctgagagcca

SEQ ID NO: 235704 - DNA, 27 bp, Artificial Sequence
  Description of Artificial Sequence: Synthetic oligonucleotide
tcacagagggtgtccctgagagccact

SEQ ID NO: 235705 - DNA, 27 bp, Artificial Sequence
  Description of Artificial Sequence: Synthetic oligonucleotide
cacagagggtgtccctgagagccactt

SEQ ID NO: 235706 - DNA, 27 bp, Artificial Sequence
  Description of Artificial Sequence: Synthetic oligonucleotide
acagagggtgtccctgagagccacttc

SEQ ID NO: 235707 - DNA, 26 bp, Artificial Sequence
  Description of Artificial Sequence: Synthetic oligonucleotide
cagagggtgtccctgagagccacttc

SEQ ID NO: 235708 - DNA, 27 bp, Artificial Sequence
  Description of Artificial Sequence: Synthetic oligonucleotide
agagggtgtccctgagagccacttcct

SEQ ID NO: 235709 - DNA, 26 bp, Artificial Sequence
  Description of Artificial Sequence: Synthetic oligonucleotide
gagggtgtccctgagagccacttcct

SEQ ID NO: 235710 - DNA, 26 bp, Artificial Sequence
  Description of Artificial Sequence: Synthetic oligonucleotide
agggtgtccctgagagccacttcctg

SEQ ID NO: 235711 - DNA, 25 bp, Artificial Sequence
  Description of Artificial Sequence: Synthetic oligonucleotide
gggtgtccctgagagccacttcctg

SEQ ID NO: 235712 - DNA, 25 bp, Artificial Sequence
  Description of Artificial Sequence: Synthetic oligonucleotide
ggtgtccctgagagccacttcctgc

SEQ ID NO: 235713 - DNA, 25 bp, Artificial Sequence
  Description of Artificial Sequence: Synthetic oligonucleotide
gtgtccctgagagccacttcctgcc

SEQ ID NO: 235714 - DNA, 26 bp, Artificial Sequence
  Description of Artificial Sequence: Synthetic oligonucleotide
tgtccctgagagccacttcctgccga

SEQ ID NO: 235715 - DNA, 25 bp, Artificial Sequence
  Description of Artificial Sequence: Synthetic oligonucleotide
gtccctgagagccacttcctgccga

SEQ ID NO: 235716 - DNA, 27 bp, Artificial Sequence
  Description of Artificial Sequence: Synthetic oligonucleotide
tccctgagagccacttcctgccgagaa

SEQ ID NO: 235717 - DNA, 26 bp, Artificial Sequence
  Description of Artificial Sequence: Synthetic oligonucleotide
ccctgagagccacttcctgccgagaa

SEQ ID NO: 235718 - DNA, 27 bp, Artificial Sequence
  Description of Artificial Sequence: Synthetic oligonucleotide
cctgagagccacttcctgccgagaaca

SEQ ID NO: 235719 - DNA, 27 bp, Artificial Sequence
  Description of Artificial Sequence: Synthetic oligonucleotide
ctgagagccacttcctgccgagaacag

SEQ ID NO: 235720 - DNA, 31 bp, Artificial Sequence
  Description of Artificial Sequence: Synthetic oligonucleotide
tgagagccacttcctgccgagaacagataac

SEQ ID NO: 235721 - DNA, 30 bp, Artificial Sequence
  Description of Artificial Sequence: Synthetic oligonucleotide
gagagccacttcctgccgagaacagataac

SEQ ID NO: 235722 - DNA, 31 bp, Artificial Sequence
  Description of Artificial Sequence: Synthetic oligonucleotide
agagccacttcctgccgagaacagataacag

SEQ ID NO: 235723 - DNA, 30 bp, Artificial Sequence
  Description of Artificial Sequence: Synthetic oligonucleotide
gagccacttcctgccgagaacagataacag

SEQ ID NO: 235724 - DNA, 30 bp, Artificial Sequence
  Description of Artificial Sequence: Synthetic oligonucleotide
agccacttcctgccgagaacagataacagc

SEQ ID NO: 235725 - DNA, 29 bp, Artificial Sequence
  Description of Artificial Sequence: Synthetic oligonucleotide
gccacttcctgccgagaacagataacagc

SEQ ID NO: 235726 - DNA, 31 bp, Artificial Sequence
  Description of Artificial Sequence: Synthetic oligonucleotide
ccacttcctgccgagaacagataacagcttc

SEQ ID NO: 235727 - DNA, 31 bp, Artificial Sequence
  Description of Artificial Sequence: Synthetic oligonucleotide
cacttcctgccgagaacagataacagcttcc

SEQ ID NO: 235728 - DNA, 32 bp, Artificial Sequence
  Description of Artificial Sequence: Synthetic oligonucleotide
acttcctgccgagaacagataacagcttcctc

SEQ ID NO: 235729 - DNA, 31 bp, Artificial Sequence
  Description of Artificial Sequence: Synthetic oligonucleotide
cttcctgccgagaacagataacagcttcctc

SEQ ID NO: 235730 - DNA, 33 bp, Artificial Sequence
  Description of Artificial Sequence: Synthetic oligonucleotide
ttcctgccgagaacagataacagcttcctcaag

SEQ ID NO: 235731 - DNA, 32 bp, Artificial Sequence
  Description of Artificial Sequence: Synthetic oligonucleotide
tcctgccgagaacagataacagcttcctcaag

SEQ ID NO: 235732 - DNA, 31 bp, Artificial Sequence
  Description of Artificial Sequence: Synthetic oligonucleotide
cctgccgagaacagataacagcttcctcaag

SEQ ID NO: 235733 - DNA, 33 bp, Artificial Sequence
  Description of Artificial Sequence: Synthetic oligonucleotide
ctgccgagaacagataacagcttcctcaagttc

SEQ ID NO: 235734 - DNA, 33 bp, Artificial Sequence
  Description of Artificial Sequence: Synthetic oligonucleotide
tgccgagaacagataacagcttcctcaagttcc

SEQ ID NO: 235735 - DNA, 32 bp, Artificial Sequence
  Description of Artificial Sequence: Synthetic oligonucleotide
gccgagaacagataacagcttcctcaagttcc

SEQ ID NO: 235736 - DNA, 36 bp, Artificial Sequence
  Description of Artificial Sequence: Synthetic oligonucleotide
ccgagaacagataacagcttcctcaagttccaatac

SEQ ID NO: 235737 - DNA, 36 bp, Artificial Sequence
  Description of Artificial Sequence: Synthetic oligonucleotide
cgagaacagataacagcttcctcaagttccaatacc

SEQ ID NO: 235738 - DNA, 37 bp, Artificial Sequence
  Description of Artificial Sequence: Synthetic oligonucleotide
gagaacagataacagcttcctcaagttccaatacctg

SEQ ID NO: 235739 - DNA, 38 bp, Artificial Sequence
  Description of Artificial Sequence: Synthetic oligonucleotide
agaacagataacagcttcctcaagttccaatacctgac

SEQ ID NO: 235740 - DNA, 37 bp, Artificial Sequence
  Description of Artificial Sequence: Synthetic oligonucleotide
gaacagataacagcttcctcaagttccaatacctgac

SEQ ID NO: 235741 - DNA, 37 bp, Artificial Sequence
  Description of Artificial Sequence: Synthetic oligonucleotide
aacagataacagcttcctcaagttccaatacctgacc

SEQ ID NO: 235742 - DNA, 36 bp, Artificial Sequence
  Description of Artificial Sequence: Synthetic oligonucleotide
acagataacagcttcctcaagttccaatacctgacc

SEQ ID NO: 235743 - DNA, 35 bp, Artificial Sequence
  Description of Artificial Sequence: Synthetic oligonucleotide
cagataacagcttcctcaagttccaatacctgacc

SEQ ID NO: 235744 - DNA, 38 bp, Artificial Sequence
  Description of Artificial Sequence: Synthetic oligonucleotide
agataacagcttcctcaagttccaatacctgaccattg

SEQ ID NO: 235745 - DNA, 37 bp, Artificial Sequence
  Description of Artificial Sequence: Synthetic oligonucleotide
gataacagcttcctcaagttccaatacctgaccattg

SEQ ID NO: 235746 - DNA, 38 bp, Artificial Sequence
  Description of Artificial Sequence: Synthetic oligonucleotide
ataacagcttcctcaagttccaatacctgaccattgtg

SEQ ID NO: 235747 - DNA, 37 bp, Artificial Sequence
  Description of Artificial Sequence: Synthetic oligonucleotide
taacagcttcctcaagttccaatacctgaccattgtg

SEQ ID NO: 235748 - DNA, 36 bp, Artificial Sequence
  Description of Artificial Sequence: Synthetic oligonucleotide
aacagcttcctcaagttccaatacctgaccattgtg

SEQ ID NO: 235749 - DNA, 35 bp, Artificial Sequence
  Description of Artificial Sequence: Synthetic oligonucleotide
acagcttcctcaagttccaatacctgaccattgtg

SEQ ID NO: 235750 - DNA, 34 bp, Artificial Sequence
  Description of Artificial Sequence: Synthetic oligonucleotide
cagcttcctcaagttccaatacctgaccattgtg

SEQ ID NO: 235751 - DNA, 34 bp, Artificial Sequence
  Description of Artificial Sequence: Synthetic oligonucleotide
agcttcctcaagttccaatacctgaccattgtgc

SEQ ID NO: 235752 - DNA, 33 bp, Artificial Sequence
  Description of Artificial Sequence: Synthetic oligonucleotide
gcttcctcaagttccaatacctgaccattgtgc

SEQ ID NO: 235753 - DNA, 33 bp, Artificial Sequence
  Description of Artificial Sequence: Synthetic oligonucleotide
cttcctcaagttccaatacctgaccattgtgcc

SEQ ID NO: 235754 - DNA, 33 bp, Artificial Sequence
  Description of Artificial Sequence: Synthetic oligonucleotide
ttcctcaagttccaatacctgaccattgtgccc

SEQ ID NO: 235755 - DNA, 32 bp, Artificial Sequence
  Description of Artificial Sequence: Synthetic oligonucleotide
tcctcaagttccaatacctgaccattgtgccc

SEQ ID NO: 235756 - DNA, 31 bp, Artificial Sequence
  Description of Artificial Sequence: Synthetic oligonucleotide
cctcaagttccaatacctgaccattgtgccc

SEQ ID NO: 235757 - DNA, 32 bp, Artificial Sequence
  Description of Artificial Sequence: Synthetic oligonucleotide
ctcaagttccaatacctgaccattgtgccctg

SEQ ID NO: 235758 - DNA, 33 bp, Artificial Sequence
  Description of Artificial Sequence: Synthetic oligonucleotide
tcaagttccaatacctgaccattgtgccctgag

SEQ ID NO: 235759 - DNA, 32 bp, Artificial Sequence
  Description of Artificial Sequence: Synthetic oligonucleotide
caagttccaatacctgaccattgtgccctgag

SEQ ID NO: 235760 - DNA, 32 bp, Artificial Sequence
  Description of Artificial Sequence: Synthetic oligonucleotide
aagttccaatacctgaccattgtgccctgagc

SEQ ID NO: 235761 - DNA, 31 bp, Artificial Sequence
  Description of Artificial Sequence: Synthetic oligonucleotide
agttccaatacctgaccattgtgccctgagc

SEQ ID NO: 235762 - DNA, 30 bp, Artificial Sequence
  Description of Artificial Sequence: Synthetic oligonucleotide
gttccaatacctgaccattgtgccctgagc

SEQ ID NO: 235763 - DNA, 31 bp, Artificial Sequence
  Description of Artificial Sequence: Synthetic oligonucleotide
ttccaatacctgaccattgtgccctgagcag

SEQ ID NO: 235764 - DNA, 30 bp, Artificial Sequence
  Description of Artificial Sequence: Synthetic oligonucleotide
tccaatacctgaccattgtgccctgagcag

SEQ ID NO: 235765 - DNA, 29 bp, Artificial Sequence
  Description of Artificial Sequence: Synthetic oligonucleotide
ccaatacctgaccattgtgccctgagcag

SEQ ID NO: 235766 - DNA, 30 bp, Artificial Sequence
  Description of Artificial Sequence: Synthetic oligonucleotide
caatacctgaccattgtgccctgagcagag

SEQ ID NO: 235767 - DNA, 30 bp, Artificial Sequence
  Description of Artificial Sequence: Synthetic oligonucleotide
aatacctgaccattgtgccctgagcagagg

SEQ ID NO: 235768 - DNA, 29 bp, Artificial Sequence
  Description of Artificial Sequence: Synthetic oligonucleotide
atacctgaccattgtgccctgagcagagg

SEQ ID NO: 235769 - DNA, 28 bp, Artificial Sequence
  Description of Artificial Sequence: Synthetic oligonucleotide
tacctgaccattgtgccctgagcagagg

SEQ ID NO: 235770 - DNA, 27 bp, Artificial Sequence
  Description of Artificial Sequence: Synthetic oligonucleotide
acctgaccattgtgccctgagcagagg

SEQ ID NO: 235771 - DNA, 27 bp, Artificial Sequence
  Description of Artificial Sequence: Synthetic oligonucleotide
cctgaccattgtgccctgagcagagga

SEQ ID NO: 235772 - DNA, 27 bp, Artificial Sequence
  Description of Artificial Sequence: Synthetic oligonucleotide
ctgaccattgtgccctgagcagaggag

SEQ ID NO: 235773 - DNA, 29 bp, Artificial Sequence
  Description of Artificial Sequence: Synthetic oligonucleotide
tgaccattgtgccctgagcagaggagttc

SEQ ID NO: 235774 - DNA, 28 bp, Artificial Sequence
  Description of Artificial Sequence: Synthetic oligonucleotide
gaccattgtgccctgagcagaggagttc

SEQ ID NO: 235775 - DNA, 31 bp, Artificial Sequence
  Description of Artificial Sequence: Synthetic oligonucleotide
accattgtgccctgagcagaggagttctatg

SEQ ID NO: 235776 - DNA, 30 bp, Artificial Sequence
  Description of Artificial Sequence: Synthetic oligonucleotide
ccattgtgccctgagcagaggagttctatg

SEQ ID NO: 235777 - DNA, 31 bp, Artificial Sequence
  Description of Artificial Sequence: Synthetic oligonucleotide
cattgtgccctgagcagaggagttctatgac

SEQ ID NO: 235778 - DNA, 32 bp, Artificial Sequence
  Description of Artificial Sequence: Synthetic oligonucleotide
attgtgccctgagcagaggagttctatgacag

SEQ ID NO: 235779 - DNA, 31 bp, Artificial Sequence
  Description of Artificial Sequence: Synthetic oligonucleotide
ttgtgccctgagcagaggagttctatgacag

SEQ ID NO: 235780 - DNA, 30 bp, Artificial Sequence
  Description of Artificial Sequence: Synthetic oligonucleotide
tgtgccctgagcagaggagttctatgacag

SEQ ID NO: 235781 - DNA, 29 bp, Artificial Sequence
  Description of Artificial Sequence: Synthetic oligonucleotide
gtgccctgagcagaggagttctatgacag

SEQ ID NO: 235782 - DNA, 29 bp, Artificial Sequence
  Description of Artificial Sequence: Synthetic oligonucleotide
tgccctgagcagaggagttctatgacagc

SEQ ID NO: 235783 - DNA, 28 bp, Artificial Sequence
  Description of Artificial Sequence: Synthetic oligonucleotide
gccctgagcagaggagttctatgacagc

SEQ ID NO: 235784 - DNA, 29 bp, Artificial Sequence
  Description of Artificial Sequence: Synthetic oligonucleotide
ccctgagcagaggagttctatgacagcag

SEQ ID NO: 235785 - DNA, 29 bp, Artificial Sequence
  Description of Artificial Sequence: Synthetic oligonucleotide
cctgagcagaggagttctatgacagcagg

SEQ ID NO: 235786 - DNA, 29 bp, Artificial Sequence
  Description of Artificial Sequence: Synthetic oligonucleotide
ctgagcagaggagttctatgacagcaggg

SEQ ID NO: 235787 - DNA, 30 bp, Artificial Sequence
  Description of Artificial Sequence: Synthetic oligonucleotide
tgagcagaggagttctatgacagcagggtg

SEQ ID NO: 235788 - DNA, 29 bp, Artificial Sequence
  Description of Artificial Sequence: Synthetic oligonucleotide
gagcagaggagttctatgacagcagggtg

SEQ ID NO: 235789 - DNA, 29 bp, Artificial Sequence
  Description of Artificial Sequence: Synthetic oligonucleotide
agcagaggagttctatgacagcagggtgg

SEQ ID NO: 235790 - DNA, 28 bp, Artificial Sequence
  Description of Artificial Sequence: Synthetic oligonucleotide
gcagaggagttctatgacagcagggtgg

SEQ ID NO: 235791 - DNA, 29 bp, Artificial Sequence
  Description of Artificial Sequence: Synthetic oligonucleotide
cagaggagttctatgacagcagggtggtg

SEQ ID NO: 235792 - DNA, 29 bp, Artificial Sequence
  Description of Artificial Sequence: Synthetic oligonucleotide
agaggagttctatgacagcagggtggtgc

SEQ ID NO: 235793 - DNA, 28 bp, Artificial Sequence
  Description of Artificial Sequence: Synthetic oligonucleotide
gaggagttctatgacagcagggtggtgc

SEQ ID NO: 235794 - DNA, 29 bp, Artificial Sequence
  Description of Artificial Sequence: Synthetic oligonucleotide
aggagttctatgacagcagggtggtgcac

SEQ ID NO: 235795 - DNA, 28 bp, Artificial Sequence
  Description of Artificial Sequence: Synthetic oligonucleotide
ggagttctatgacagcagggtggtgcac

SEQ ID NO: 235796 - DNA, 29 bp, Artificial Sequence
  Description of Artificial Sequence: Synthetic oligonucleotide
gagttctatgacagcagggtggtgcactg

SEQ ID NO: 235797 - DNA, 29 bp, Artificial Sequence
  Description of Artificial Sequence: Synthetic oligonucleotide
agttctatgacagcagggtggtgcactgg

SEQ ID NO: 235798 - DNA, 28 bp, Artificial Sequence
  Description of Artificial Sequence: Synthetic oligonucleotide
gttctatgacagcagggtggtgcactgg

SEQ ID NO: 235799 - DNA, 28 bp, Artificial Sequence
  Description of Artificial Sequence: Synthetic oligonucleotide
ttctatgacagcagggtggtgcactggg

SEQ ID NO: 235800 - DNA, 27 bp, Artificial Sequence
  Description of Artificial Sequence: Synthetic oligonucleotide
tctatgacagcagggtggtgcactggg

SEQ ID NO: 235801 - DNA, 26 bp, Artificial Sequence
  Description of Artificial Sequence: Synthetic oligonucleotide
ctatgacagcagggtggtgcactggg

SEQ ID NO: 235802 - DNA, 26 bp, Artificial Sequence
  Description of Artificial Sequence: Synthetic oligonucleotide
tatgacagcagggtggtgcactgggg

SEQ ID NO: 235803 - DNA, 25 bp, Artificial Sequence
  Description of Artificial Sequence: Synthetic oligonucleotide
atgacagcagggtggtgcactgggg

SEQ ID NO: 235804 - DNA, 24 bp, Artificial Sequence
  Description of Artificial Sequence: Synthetic oligonucleotide
tgacagcagggtggtgcactgggg

SEQ ID NO: 235805 - DNA, 23 bp, Artificial Sequence
  Description of Artificial Sequence: Synthetic oligonucleotide
gacagcagggtggtgcactgggg

SEQ ID NO: 235806 - DNA, 25 bp, Artificial Sequence
  Description of Artificial Sequence: Synthetic oligonucleotide
acagcagggtggtgcactgggggtt

SEQ ID NO: 235807 - DNA, 24 bp, Artificial Sequence
  Description of Artificial Sequence: Synthetic oligonucleotide
cagcagggtggtgcactgggggtt

SEQ ID NO: 235808 - DNA, 24 bp, Artificial Sequence
  Description of Artificial Sequence: Synthetic oligonucleotide
agcagggtggtgcactgggggttg

SEQ ID NO: 235809 - DNA, 23 bp, Artificial Sequence
  Description of Artificial Sequence: Synthetic oligonucleotide
gcagggtggtgcactgggggttg

SEQ ID NO: 235810 - DNA, 24 bp, Artificial Sequence
  Description of Artificial Sequence: Synthetic oligonucleotide
cagggtggtgcactgggggttgga

SEQ ID NO: 235811 - DNA, 24 bp, Artificial Sequence
  Description of Artificial Sequence: Synthetic oligonucleotide
agggtggtgcactgggggttggac

SEQ ID NO: 235812 - DNA, 23 bp, Artificial Sequence
  Description of Artificial Sequence: Synthetic oligonucleotide
gggtggtgcactgggggttggac

SEQ ID NO: 235813 - DNA, 24 bp, Artificial Sequence
  Description of Artificial Sequence: Synthetic oligonucleotide
ggtggtgcactgggggttggacca

SEQ ID NO: 235814 - DNA, 24 bp, Artificial Sequence
  Description of Artificial Sequence: Synthetic oligonucleotide
gtggtgcactgggggttggaccag

SEQ ID NO: 235815 - DNA, 24 bp, Artificial Sequence
  Description of Artificial Sequence: Synthetic oligonucleotide
tggtgcactgggggttggaccagg

SEQ ID NO: 235816 - DNA, 23 bp, Artificial Sequence
  Description of Artificial Sequence: Synthetic oligonucleotide
ggtgcactgggggttggaccagg

SEQ ID NO: 235817 - DNA, 23 bp, Artificial Sequence
  Description of Artificial Sequence: Synthetic oligonucleotide
gtgcactgggggttggaccaggc

SEQ ID NO: 235818 - DNA, 23 bp, Artificial Sequence
  Description of Artificial Sequence: Synthetic oligonucleotide
tgcactgggggttggaccaggcg

SEQ ID NO: 235819 - DNA, 22 bp, Artificial Sequence
  Description of Artificial Sequence: Synthetic oligonucleotide
gcactgggggttggaccaggcg

SEQ ID NO: 235820 - DNA, 23 bp, Artificial Sequence
  Description of Artificial Sequence: Synthetic oligonucleotide
cactgggggttggaccaggcgct

SEQ ID NO: 235821 - DNA, 23 bp, Artificial Sequence
  Description of Artificial Sequence: Synthetic oligonucleotide
actgggggttggaccaggcgctc

SEQ ID NO: 235822 - DNA, 22 bp, Artificial Sequence
  Description of Artificial Sequence: Synthetic oligonucleotide
ctgggggttggaccaggcgctc

SEQ ID NO: 235823 - DNA, 23 bp, Artificial Sequence
  Description of Artificial Sequence: Synthetic oligonucleotide
tgggggttggaccaggcgctcct

SEQ ID NO: 235824 - DNA, 22 bp, Artificial Sequence
  Description of Artificial Sequence: Synthetic oligonucleotide
gggggttggaccaggcgctcct

SEQ ID NO: 235825 - DNA, 24 bp, Artificial Sequence
  Description of Artificial Sequence: Synthetic oligonucleotide
ggggttggaccaggcgctcctcat

SEQ ID NO: 235826 - DNA, 24 bp, Artificial Sequence
  Description of Artificial Sequence: Synthetic oligonucleotide
gggttggaccaggcgctcctcatg

SEQ ID NO: 235827 - DNA, 25 bp, Artificial Sequence
  Description of Artificial Sequence: Synthetic oligonucleotide
ggttggaccaggcgctcctcatgca

SEQ ID NO: 235828 - DNA, 26 bp, Artificial Sequence
  Description of Artificial Sequence: Synthetic oligonucleotide
gttggaccaggcgctcctcatgcact

SEQ ID NO: 235829 - DNA, 26 bp, Artificial Sequence
  Description of Artificial Sequence: Synthetic oligonucleotide
ttggaccaggcgctcctcatgcactg

SEQ ID NO: 235830 - DNA, 25 bp, Artificial Sequence
  Description of Artificial Sequence: Synthetic oligonucleotide
tggaccaggcgctcctcatgcactg

SEQ ID NO: 235831 - DNA, 24 bp, Artificial Sequence
  Description of Artificial Sequence: Synthetic oligonucleotide
ggaccaggcgctcctcatgcactg

SEQ ID NO: 235832 - DNA, 24 bp, Artificial Sequence
  Description of Artificial Sequence: Synthetic oligonucleotide
gaccaggcgctcctcatgcactgg

SEQ ID NO: 235833 - DNA, 25 bp, Artificial Sequence
  Description of Artificial Sequence: Synthetic oligonucleotide
accaggcgctcctcatgcactggga

SEQ ID NO: 235834 - DNA, 24 bp, Artificial Sequence
  Description of Artificial Sequence: Synthetic oligonucleotide
ccaggcgctcctcatgcactggga

SEQ ID NO: 235835 - DNA, 24 bp, Artificial Sequence
  Description of Artificial Sequence: Synthetic oligonucleotide
caggcgctcctcatgcactgggac

SEQ ID NO: 235836 - DNA, 24 bp, Artificial Sequence
  Description of Artificial Sequence: Synthetic oligonucleotide
aggcgctcctcatgcactgggacg

SEQ ID NO: 235837 - DNA, 23 bp, Artificial Sequence
  Description of Artificial Sequence: Synthetic oligonucleotide
ggcgctcctcatgcactgggacg

SEQ ID NO: 235838 - DNA, 23 bp, Artificial Sequence
  Description of Artificial Sequence: Synthetic oligonucleotide
gcgctcctcatgcactgggacgc

SEQ ID NO: 235839 - DNA, 23 bp, Artificial Sequence
  Description of Artificial Sequence: Synthetic oligonucleotide
cgctcctcatgcactgggacgcc

SEQ ID NO: 235840 - DNA, 25 bp, Artificial Sequence
  Description of Artificial Sequence: Synthetic oligonucleotide
gctcctcatgcactgggacgcccaa

SEQ ID NO: 235841 - DNA, 26 bp, Artificial Sequence
  Description of Artificial Sequence: Synthetic oligonucleotide
ctcctcatgcactgggacgcccaaga

SEQ ID NO: 235842 - DNA, 26 bp, Artificial Sequence
  Description of Artificial Sequence: Synthetic oligonucleotide
tcctcatgcactgggacgcccaagag

SEQ ID NO: 235843 - DNA, 25 bp, Artificial Sequence
  Description of Artificial Sequence: Synthetic oligonucleotide
cctcatgcactgggacgcccaagag

SEQ ID NO: 235844 - DNA, 25 bp, Artificial Sequence
  Description of Artificial Sequence: Synthetic oligonucleotide
ctcatgcactgggacgcccaagagg

SEQ ID NO: 235845 - DNA, 27 bp, Artificial Sequence
  Description of Artificial Sequence: Synthetic oligonucleotide
tcatgcactgggacgcccaagaggcaa

SEQ ID NO: 235846 - DNA, 27 bp, Artificial Sequence
  Description of Artificial Sequence: Synthetic oligonucleotide
catgcactgggacgcccaagaggcaat

SEQ ID NO: 235847 - DNA, 27 bp, Artificial Sequence
  Description of Artificial Sequence: Synthetic oligonucleotide
atgcactgggacgcccaagaggcaatc

SEQ ID NO: 235848 - DNA, 26 bp, Artificial Sequence
  Description of Artificial Sequence: Synthetic oligonucleotide
tgcactgggacgcccaagaggcaatc

SEQ ID NO: 235849 - DNA, 25 bp, Artificial Sequence
  Description of Artificial Sequence: Synthetic oligonucleotide
gcactgggacgcccaagaggcaatc

SEQ ID NO: 235850 - DNA, 26 bp, Artificial Sequence
  Description of Artificial Sequence: Synthetic oligonucleotide
cactgggacgcccaagaggcaatcca

SEQ ID NO: 235851 - DNA, 27 bp, Artificial Sequence
  Description of Artificial Sequence: Synthetic oligonucleotide
actgggacgcccaagaggcaatccaga

SEQ ID NO: 235852 - DNA, 27 bp, Artificial Sequence
  Description of Artificial Sequence: Synthetic oligonucleotide
ctgggacgcccaagaggcaatccagaa

SEQ ID NO: 235853 - DNA, 27 bp, Artificial Sequence
  Description of Artificial Sequence: Synthetic oligonucleotide
tgggacgcccaagaggcaatccagaag

SEQ ID NO: 235854 - DNA, 26 bp, Artificial Sequence
  Description of Artificial Sequence: Synthetic oligonucleotide
gggacgcccaagaggcaatccagaag

SEQ ID NO: 235855 - DNA, 26 bp, Artificial Sequence
  Description of Artificial Sequence: Synthetic oligonucleotide
ggacgcccaagaggcaatccagaagc

SEQ ID NO: 235856 - DNA, 27 bp, Artificial Sequence
  Description of Artificial Sequence: Synthetic oligonucleotide
gacgcccaagaggcaatccagaagcct

SEQ ID NO: 235857 - DNA, 27 bp, Artificial Sequence
  Description of Artificial Sequence: Synthetic oligonucleotide
acgcccaagaggcaatccagaagcctg

SEQ ID NO: 235858 - DNA, 27 bp, Artificial Sequence
  Description of Artificial Sequence: Synthetic oligonucleotide
cgcccaagaggcaatccagaagcctga

SEQ ID NO: 235859 - DNA, 27 bp, Artificial Sequence
  Description of Artificial Sequence: Synthetic oligonucleotide
gcccaagaggcaatccagaagcctgag

SEQ ID NO: 235860 - DNA, 28 bp, Artificial Sequence
  Description of Artificial Sequence: Synthetic oligonucleotide
cccaagaggcaatccagaagcctgagac

SEQ ID NO: 235861 - DNA, 30 bp, Artificial Sequence
  Description of Artificial Sequence: Synthetic oligonucleotide
ccaagaggcaatccagaagcctgagactac

SEQ ID NO: 235862 - DNA, 30 bp, Artificial Sequence
  Description of Artificial Sequence: Synthetic oligonucleotide
caagaggcaatccagaagcctgagactacg

SEQ ID NO: 235863 - DNA, 30 bp, Artificial Sequence
  Description of Artificial Sequence: Synthetic oligonucleotide
aagaggcaatccagaagcctgagactacgg

SEQ ID NO: 235864 - DNA, 29 bp, Artificial Sequence
  Description of Artificial Sequence: Synthetic oligonucleotide
agaggcaatccagaagcctgagactacgg

SEQ ID NO: 235865 - DNA, 28 bp, Artificial Sequence
  Description of Artificial Sequence: Synthetic oligonucleotide
gaggcaatccagaagcctgagactacgg

SEQ ID NO: 235866 - DNA, 29 bp, Artificial Sequence
  Description of Artificial Sequence: Synthetic oligonucleotide
aggcaatccagaagcctgagactacggag

SEQ ID NO: 235867 - DNA, 28 bp, Artificial Sequence
  Description of Artificial Sequence: Synthetic oligonucleotide
ggcaatccagaagcctgagactacggag

SEQ ID NO: 235868 - DNA, 29 bp, Artificial Sequence
  Description of Artificial Sequence: Synthetic oligonucleotide
gcaatccagaagcctgagactacggagac

SEQ ID NO: 235869 - DNA, 30 bp, Artificial Sequence
  Description of Artificial Sequence: Synthetic oligonucleotide
caatccagaagcctgagactacggagactc

SEQ ID NO: 235870 - DNA, 31 bp, Artificial Sequence
  Description of Artificial Sequence: Synthetic oligonucleotide
aatccagaagcctgagactacggagactctg

SEQ ID NO: 235871 - DNA, 30 bp, Artificial Sequence
  Description of Artificial Sequence: Synthetic oligonucleotide
atccagaagcctgagactacggagactctg

SEQ ID NO: 235872 - DNA, 29 bp, Artificial Sequence
  Description of Artificial Sequence: Synthetic oligonucleotide
tccagaagcctgagactacggagactctg

SEQ ID NO: 235873 - DNA, 28 bp, Artificial Sequence
  Description of Artificial Sequence: Synthetic oligonucleotide
ccagaagcctgagactacggagactctg

SEQ ID NO: 235874 - DNA, 28 bp, Artificial Sequence
  Description of Artificial Sequence: Synthetic oligonucleotide
cagaagcctgagactacggagactctgc

SEQ ID NO: 235875 - DNA, 29 bp, Artificial Sequence
  Description of Artificial Sequence: Synthetic oligonucleotide
agaagcctgagactacggagactctgctc

SEQ ID NO: 235876 - DNA, 28 bp, Artificial Sequence
  Description of Artificial Sequence: Synthetic oligonucleotide
gaagcctgagactacggagactctgctc

SEQ ID NO: 235877 - DNA, 29 bp, Artificial Sequence
  Description of Artificial Sequence: Synthetic oligonucleotide
aagcctgagactacggagactctgctctg

SEQ ID NO: 235878 - DNA, 28 bp, Artificial Sequence
  Description of Artificial Sequence: Synthetic oligonucleotide
agcctgagactacggagactctgctctg

SEQ ID NO: 235879 - DNA, 27 bp, Artificial Sequence
  Description of Artificial Sequence: Synthetic oligonucleotide
gcctgagactacggagactctgctctg

SEQ ID NO: 235880 - DNA, 28 bp, Artificial Sequence
  Description of Artificial Sequence: Synthetic oligonucleotide
cctgagactacggagactctgctctgtg

SEQ ID NO: 235881 - DNA, 28 bp, Artificial Sequence
  Description of Artificial Sequence: Synthetic oligonucleotide
ctgagactacggagactctgctctgtgg

SEQ ID NO: 235882 - DNA, 28 bp, Artificial Sequence
  Description of Artificial Sequence: Synthetic oligonucleotide
tgagactacggagactctgctctgtggc

SEQ ID NO: 235883 - DNA, 27 bp, Artificial Sequence
  Description of Artificial Sequence: Synthetic oligonucleotide
gagactacggagactctgctctgtggc

SEQ ID NO: 235884 - DNA, 27 bp, Artificial Sequence
  Description of Artificial Sequence: Synthetic oligonucleotide
agactacggagactctgctctgtggcc

SEQ ID NO: 235885 - DNA, 27 bp, Artificial Sequence
  Description of Artificial Sequence: Synthetic oligonucleotide
gactacggagactctgctctgtggcct

SEQ ID NO: 235886 - DNA, 27 bp, Artificial Sequence
  Description of Artificial Sequence: Synthetic oligonucleotide
actacggagactctgctctgtggcctg

SEQ ID NO: 235887 - DNA, 26 bp, Artificial Sequence
  Description of Artificial Sequence: Synthetic oligonucleotide
ctacggagactctgctctgtggcctg

SEQ ID NO: 235888 - DNA, 26 bp, Artificial Sequence
  Description of Artificial Sequence: Synthetic oligonucleotide
tacggagactctgctctgtggcctgg

SEQ ID NO: 235889 - DNA, 25 bp, Artificial Sequence
  Description of Artificial Sequence: Synthetic oligonucleotide
acggagactctgctctgtggcctgg

SEQ ID NO: 235890 - DNA, 24 bp, Artificial Sequence
  Description of Artificial Sequence: Synthetic oligonucleotide
cggagactctgctctgtggcctgg

SEQ ID NO: 235891 - DNA, 24 bp, Artificial Sequence
  Description of Artificial Sequence: Synthetic oligonucleotide
ggagactctgctctgtggcctggg

SEQ ID NO: 235892 - DNA, 24 bp, Artificial Sequence
  Description of Artificial Sequence: Synthetic oligonucleotide
gagactctgctctgtggcctgggc

SEQ ID NO: 235893 - DNA, 25 bp, Artificial Sequence
  Description of Artificial Sequence: Synthetic oligonucleotide
agactctgctctgtggcctgggcct

SEQ ID NO: 235894 - DNA, 24 bp, Artificial Sequence
  Description of Artificial Sequence: Synthetic oligonucleotide
gactctgctctgtggcctgggcct

SEQ ID NO: 235895 - DNA, 24 bp, Artificial Sequence
  Description of Artificial Sequence: Synthetic oligonucleotide
actctgctctgtggcctgggcctc

SEQ ID NO: 235896 - DNA, 23 bp, Artificial Sequence
  Description of Artificial Sequence: Synthetic oligonucleotide
ctctgctctgtggcctgggcctc

SEQ ID NO: 235897 - DNA, 24 bp, Artificial Sequence
  Description of Artificial Sequence: Synthetic oligonucleotide
tctgctctgtggcctgggcctcgt

SEQ ID NO: 235898 - DNA, 23 bp, Artificial Sequence
  Description of Artificial Sequence: Synthetic oligonucleotide
ctgctctgtggcctgggcctcgt

SEQ ID NO: 235899 - DNA, 23 bp, Artificial Sequence
  Description of Artificial Sequence: Synthetic oligonucleotide
tgctctgtggcctgggcctcgtg

SEQ ID NO: 235900 - DNA, 22 bp, Artificial Sequence
  Description of Artificial Sequence: Synthetic oligonucleotide
gctctgtggcctgggcctcgtg

SEQ ID NO: 235901 - DNA, 23 bp, Artificial Sequence
  Description of Artificial Sequence: Synthetic oligonucleotide
ctctgtggcctgggcctcgtgct

SEQ ID NO: 235902 - DNA, 23 bp, Artificial Sequence
  Description of Artificial Sequence: Synthetic oligonucleotide
tctgtggcctgggcctcgtgctg

SEQ ID NO: 235903 - DNA, 22 bp, Artificial Sequence
  Description of Artificial Sequence: Synthetic oligonucleotide
ctgtggcctgggcctcgtgctg

SEQ ID NO: 235904 - DNA, 22 bp, Artificial Sequence
  Description of Artificial Sequence: Synthetic oligonucleotide
tgtggcctgggcctcgtgctgg

SEQ ID NO: 235905 - DNA, 21 bp, Artificial Sequence
  Description of Artificial Sequence: Synthetic oligonucleotide
gtggcctgggcctcgtgctgg

SEQ ID NO: 235906 - DNA, 21 bp, Artificial Sequence
  Description of Artificial Sequence: Synthetic oligonucleotide
tggcctgggcctcgtgctggg

SEQ ID NO: 235907 - DNA, 20 bp, Artificial Sequence
  Description of Artificial Sequence: Synthetic oligonucleotide
ggcctgggcctcgtgctggg

SEQ ID NO: 235908 - DNA, 20 bp, Artificial Sequence
  Description of Artificial Sequence: Synthetic oligonucleotide
gcctgggcctcgtgctgggc

SEQ ID NO: 235909 - DNA, 22 bp, Artificial Sequence
  Description of Artificial Sequence: Synthetic oligonucleotide
cctgggcctcgtgctgggcgta

SEQ ID NO: 235910 - DNA, 23 bp, Artificial Sequence
  Description of Artificial Sequence: Synthetic oligonucleotide
ctgggcctcgtgctgggcgtagt

SEQ ID NO: 235911 - DNA, 23 bp, Artificial Sequence
  Description of Artificial Sequence: Synthetic oligonucleotide
tgggcctcgtgctgggcgtagtg

SEQ ID NO: 235912 - DNA, 22 bp, Artificial Sequence
  Description of Artificial Sequence: Synthetic oligonucleotide
gggcctcgtgctgggcgtagtg

SEQ ID NO: 235913 - DNA, 22 bp, Artificial Sequence
  Description of Artificial Sequence: Synthetic oligonucleotide
ggcctcgtgctgggcgtagtgg

SEQ ID NO: 235914 - DNA, 22 bp, Artificial Sequence
  Description of Artificial Sequence: Synthetic oligonucleotide
gcctcgtgctgggcgtagtggg

SEQ ID NO: 235915 - DNA, 24 bp, Artificial Sequence
  Description of Artificial Sequence: Synthetic oligonucleotide
cctcgtgctgggcgtagtgggcaa

SEQ ID NO: 235916 - DNA, 26 bp, Artificial Sequence
  Description of Artificial Sequence: Synthetic oligonucleotide
ctcgtgctgggcgtagtgggcaacat

SEQ ID NO: 235917 - DNA, 26 bp, Artificial Sequence
  Description of Artificial Sequence: Synthetic oligonucleotide
tcgtgctgggcgtagtgggcaacatc

SEQ ID NO: 235918 - DNA, 25 bp, Artificial Sequence
  Description of Artificial Sequence: Synthetic oligonucleotide
cgtgctgggcgtagtgggcaacatc

SEQ ID NO: 235919 - DNA, 26 bp, Artificial Sequence
  Description of Artificial Sequence: Synthetic oligonucleotide
gtgctgggcgtagtgggcaacatcgt

SEQ ID NO: 235920 - DNA, 26 bp, Artificial Sequence
  Description of Artificial Sequence: Synthetic oligonucleotide
tgctgggcgtagtgggcaacatcgtg

SEQ ID NO: 235921 - DNA, 25 bp, Artificial Sequence
  Description of Artificial Sequence: Synthetic oligonucleotide
gctgggcgtagtgggcaacatcgtg

SEQ ID NO: 235922 - DNA, 25 bp, Artificial Sequence
  Description of Artificial Sequence: Synthetic oligonucleotide
ctgggcgtagtgggcaacatcgtgg

SEQ ID NO: 235923 - DNA, 25 bp, Artificial Sequence
  Description of Artificial Sequence: Synthetic oligonucleotide
tgggcgtagtgggcaacatcgtggg

SEQ ID NO: 235924 - DNA, 24 bp, Artificial Sequence
  Description of Artificial Sequence: Synthetic oligonucleotide
gggcgtagtgggcaacatcgtggg

SEQ ID NO: 235925 - DNA, 25 bp, Artificial Sequence
  Description of Artificial Sequence: Synthetic oligonucleotide
ggcgtagtgggcaacatcgtgggga

SEQ ID NO: 235926 - DNA, 25 bp, Artificial Sequence
  Description of Artificial Sequence: Synthetic oligonucleotide
gcgtagtgggcaacatcgtggggac

SEQ ID NO: 235927 - DNA, 25 bp, Artificial Sequence
  Description of Artificial Sequence: Synthetic oligonucleotide
cgtagtgggcaacatcgtggggacc

SEQ ID NO: 235928 - DNA, 26 bp, Artificial Sequence
  Description of Artificial Sequence: Synthetic oligonucleotide
gtagtgggcaacatcgtggggaccgt

SEQ ID NO: 235929 - DNA, 26 bp, Artificial Sequence
  Description of Artificial Sequence: Synthetic oligonucleotide
tagtgggcaacatcgtggggaccgtc

SEQ ID NO: 235930 - DNA, 25 bp, Artificial Sequence
  Description of Artificial Sequence: Synthetic oligonucleotide
agtgggcaacatcgtggggaccgtc

SEQ ID NO: 235931 - DNA, 24 bp, Artificial Sequence
  Description of Artificial Sequence: Synthetic oligonucleotide
gtgggcaacatcgtggggaccgtc

SEQ ID NO: 235932 - DNA, 25 bp, Artificial Sequence
  Description of Artificial Sequence: Synthetic oligonucleotide
tgggcaacatcgtggggaccgtcct

SEQ ID NO: 235933 - DNA, 24 bp, Artificial Sequence
  Description of Artificial Sequence: Synthetic oligonucleotide
gggcaacatcgtggggaccgtcct

SEQ ID NO: 235934 - DNA, 26 bp, Artificial Sequence
  Description of Artificial Sequence: Synthetic oligonucleotide
ggcaacatcgtggggaccgtcctctt

SEQ ID NO: 235935 - DNA, 27 bp, Artificial Sequence
  Description of Artificial Sequence: Synthetic oligonucleotide
gcaacatcgtggggaccgtcctcttca

SEQ ID NO: 235936 - DNA, 31 bp, Artificial Sequence
  Description of Artificial Sequence: Synthetic oligonucleotide
caacatcgtggggaccgtcctcttcataaag

SEQ ID NO: 235937 - DNA, 32 bp, Artificial Sequence
  Description of Artificial Sequence: Synthetic oligonucleotide
aacatcgtggggaccgtcctcttcataaagtg

SEQ ID NO: 235938 - DNA, 31 bp, Artificial Sequence
  Description of Artificial Sequence: Synthetic oligonucleotide
acatcgtggggaccgtcctcttcataaagtg

SEQ ID NO: 235939 - DNA, 30 bp, Artificial Sequence
  Description of Artificial Sequence: Synthetic oligonucleotide
catcgtggggaccgtcctcttcataaagtg

SEQ ID NO: 235940 - DNA, 31 bp, Artificial Sequence
  Description of Artificial Sequence: Synthetic oligonucleotide
atcgtggggaccgtcctcttcataaagtgtc

SEQ ID NO: 235941 - DNA, 30 bp, Artificial Sequence
  Description of Artificial Sequence: Synthetic oligonucleotide
tcgtggggaccgtcctcttcataaagtgtc

SEQ ID NO: 235942 - DNA, 29 bp, Artificial Sequence
  Description of Artificial Sequence: Synthetic oligonucleotide
cgtggggaccgtcctcttcataaagtgtc

SEQ ID NO: 235943 - DNA, 30 bp, Artificial Sequence
  Description of Artificial Sequence: Synthetic oligonucleotide
gtggggaccgtcctcttcataaagtgtctg

SEQ ID NO: 235944 - DNA, 30 bp, Artificial Sequence
  Description of Artificial Sequence: Synthetic oligonucleotide
tggggaccgtcctcttcataaagtgtctgc

SEQ ID NO: 235945 - DNA, 29 bp, Artificial Sequence
  Description of Artificial Sequence: Synthetic oligonucleotide
ggggaccgtcctcttcataaagtgtctgc

SEQ ID NO: 235946 - DNA, 29 bp, Artificial Sequence
  Description of Artificial Sequence: Synthetic oligonucleotide
gggaccgtcctcttcataaagtgtctgcg

SEQ ID NO: 235947 - DNA, 31 bp, Artificial Sequence
  Description of Artificial Sequence: Synthetic oligonucleotide
ggaccgtcctcttcataaagtgtctgcgttc

SEQ ID NO: 235948 - DNA, 32 bp, Artificial Sequence
  Description of Artificial Sequence: Synthetic oligonucleotide
gaccgtcctcttcataaagtgtctgcgttcag

SEQ ID NO: 235949 - DNA, 32 bp, Artificial Sequence
  Description of Artificial Sequence: Synthetic oligonucleotide
accgtcctcttcataaagtgtctgcgttcagg

SEQ ID NO: 235950 - DNA, 31 bp, Artificial Sequence
  Description of Artificial Sequence: Synthetic oligonucleotide
ccgtcctcttcataaagtgtctgcgttcagg

SEQ ID NO: 235951 - DNA, 31 bp, Artificial Sequence
  Description of Artificial Sequence: Synthetic oligonucleotide
cgtcctcttcataaagtgtctgcgttcaggc

SEQ ID NO: 235952 - DNA, 31 bp, Artificial Sequence
  Description of Artificial Sequence: Synthetic oligonucleotide
gtcctcttcataaagtgtctgcgttcaggcc

SEQ ID NO: 235953 - DNA, 33 bp, Artificial Sequence
  Description of Artificial Sequence: Synthetic oligonucleotide
tcctcttcataaagtgtctgcgttcaggccatg

SEQ ID NO: 235954 - DNA, 32 bp, Artificial Sequence
  Description of Artificial Sequence: Synthetic oligonucleotide
cctcttcataaagtgtctgcgttcaggccatg

SEQ ID NO: 235955 - DNA, 33 bp, Artificial Sequence
  Description of Artificial Sequence: Synthetic oligonucleotide
ctcttcataaagtgtctgcgttcaggccatgac

SEQ ID NO: 235956 - DNA, 33 bp, Artificial Sequence
  Description of Artificial Sequence: Synthetic oligonucleotide
tcttcataaagtgtctgcgttcaggccatgacg

SEQ ID NO: 235957 - DNA, 32 bp, Artificial Sequence
  Description of Artificial Sequence: Synthetic oligonucleotide
cttcataaagtgtctgcgttcaggccatgacg

SEQ ID NO: 235958 - DNA, 32 bp, Artificial Sequence
  Description of Artificial Sequence: Synthetic oligonucleotide
ttcataaagtgtctgcgttcaggccatgacgc

SEQ ID NO: 235959 - DNA, 31 bp, Artificial Sequence
  Description of Artificial Sequence: Synthetic oligonucleotide
tcataaagtgtctgcgttcaggccatgacgc

SEQ ID NO: 235960 - DNA, 30 bp, Artificial Sequence
  Description of Artificial Sequence: Synthetic oligonucleotide
cataaagtgtctgcgttcaggccatgacgc

SEQ ID NO: 235961 - DNA, 30 bp, Artificial Sequence
  Description of Artificial Sequence: Synthetic oligonucleotide
ataaagtgtctgcgttcaggccatgacgcc

SEQ ID NO: 235962 - DNA, 29 bp, Artificial Sequence
  Description of Artificial Sequence: Synthetic oligonucleotide
taaagtgtctgcgttcaggccatgacgcc

SEQ ID NO: 235963 - DNA, 28 bp, Artificial Sequence
  Description of Artificial Sequence: Synthetic oligonucleotide
aaagtgtctgcgttcaggccatgacgcc

SEQ ID NO: 235964 - DNA, 27 bp, Artificial Sequence
  Description of Artificial Sequence: Synthetic oligonucleotide
aagtgtctgcgttcaggccatgacgcc

SEQ ID NO: 235965 - DNA, 26 bp, Artificial Sequence
  Description of Artificial Sequence: Synthetic oligonucleotide
agtgtctgcgttcaggccatgacgcc

SEQ ID NO: 235966 - DNA, 25 bp, Artificial Sequence
  Description of Artificial Sequence: Synthetic oligonucleotide
gtgtctgcgttcaggccatgacgcc

SEQ ID NO: 235967 - DNA, 25 bp, Artificial Sequence
  Description of Artificial Sequence: Synthetic oligonucleotide
tgtctgcgttcaggccatgacgccc

SEQ ID NO: 235968 - DNA, 24 bp, Artificial Sequence
  Description of Artificial Sequence: Synthetic oligonucleotide
gtctgcgttcaggccatgacgccc

SEQ ID NO: 235969 - DNA, 24 bp, Artificial Sequence
  Description of Artificial Sequence: Synthetic oligonucleotide
tctgcgttcaggccatgacgcccg

SEQ ID NO: 235970 - DNA, 23 bp, Artificial Sequence
  Description of Artificial Sequence: Synthetic oligonucleotide
ctgcgttcaggccatgacgcccg

SEQ ID NO: 235971 - DNA, 23 bp, Artificial Sequence
  Description of Artificial Sequence: Synthetic oligonucleotide
tgcgttcaggccatgacgcccgg

SEQ ID NO: 235972 - DNA, 22 bp, Artificial Sequence
  Description of Artificial Sequence: Synthetic oligonucleotide
gcgttcaggccatgacgcccgg

SEQ ID NO: 235973 - DNA, 22 bp, Artificial Sequence
  Description of Artificial Sequence: Synthetic oligonucleotide
cgttcaggccatgacgcccggg

SEQ ID NO: 235974 - DNA, 22 bp, Artificial Sequence
  Description of Artificial Sequence: Synthetic oligonucleotide
gttcaggccatgacgcccgggc

SEQ ID NO: 235975 - DNA, 22 bp, Artificial Sequence
  Description of Artificial Sequence: Synthetic oligonucleotide
ttcaggccatgacgcccgggcc

SEQ ID NO: 235976 - DNA, 21 bp, Artificial Sequence
  Description of Artificial Sequence: Synthetic oligonucleotide
tcaggccatgacgcccgggcc

SEQ ID NO: 235977 - DNA, 20 bp, Artificial Sequence
  Description of Artificial Sequence: Synthetic oligonucleotide
caggccatgacgcccgggcc

SEQ ID NO: 235978 - DNA, 21 bp, Artificial Sequence
  Description of Artificial Sequence: Synthetic oligonucleotide
aggccatgacgcccgggccct

SEQ ID NO: 235979 - DNA, 20 bp, Artificial Sequence
  Description of Artificial Sequence: Synthetic oligonucleotide
ggccatgacgcccgggccct

SEQ ID NO: 235980 - DNA, 20 bp, Artificial Sequence
  Description of Artificial Sequence: Synthetic oligonucleotide
gccatgacgcccgggccctg

SEQ ID NO: 235981 - DNA, 20 bp, Artificial Sequence
  Description of Artificial Sequence: Synthetic oligonucleotide
ccatgacgcccgggccctgg

SEQ ID NO: 235982 - DNA, 20 bp, Artificial Sequence
  Description of Artificial Sequence: Synthetic oligonucleotide
catgacgcccgggccctggg

SEQ ID NO: 235983 - DNA, 21 bp, Artificial Sequence
  Description of Artificial Sequence: Synthetic oligonucleotide
atgacgcccgggccctgggga

SEQ ID NO: 235984 - DNA, 20 bp, Artificial Sequence
  Description of Artificial Sequence: Synthetic oligonucleotide
tgacgcccgggccctgggga

SEQ ID NO: 235985 - DNA, 20 bp, Artificial Sequence
  Description of Artificial Sequence: Synthetic oligonucleotide
gacgcccgggccctggggat

SEQ ID NO: 235986 - DNA, 20 bp, Artificial Sequence
  Description of Artificial Sequence: Synthetic oligonucleotide
acgcccgggccctggggact

SEQ ID NO: 235987 - DNA, 20 bp, Artificial Sequence
  Description of Artificial Sequence: Synthetic oligonucleotide
cgcccgggccctggggactt

SEQ ID NO: 235988 - DNA, 20 bp, Artificial Sequence
  Description of Artificial Sequence: Synthetic oligonucleotide
gcccgggccctggggacctt

SEQ ID NO: 235989 - DNA, 20 bp, Artificial Sequence
  Description of Artificial Sequence: Synthetic oligonucleotide
cccgggccctggggaccctt

SEQ ID NO: 235990 - DNA, 20 bp, Artificial Sequence
  Description of Artificial Sequence: Synthetic oligonucleotide
ccgggccctggggaccctct

SEQ ID NO: 235991 - DNA, 21 bp, Artificial Sequence
  Description of Artificial Sequence: Synthetic oligonucleotide
cgggccctggggaccctctga

SEQ ID NO: 235992 - DNA, 28 bp, Artificial Sequence
  Description of Artificial Sequence: Synthetic oligonucleotide
atgatggttgtgcaggtttgtgcggccc

SEQ ID NO: 235993 - DNA, 27 bp, Artificial Sequence
  Description of Artificial Sequence: Synthetic oligonucleotide
tgatggttgtgcaggtttgtgcggccc

SEQ ID NO: 235994 - DNA, 26 bp, Artificial Sequence
  Description of Artificial Sequence: Synthetic oligonucleotide
gatggttgtgcaggtttgtgcggccc

SEQ ID NO: 235995 - DNA, 26 bp, Artificial Sequence
  Description of Artificial Sequence: Synthetic oligonucleotide
atggttgtgcaggtttgtgcggcccc

SEQ ID NO: 235996 - DNA, 25 bp, Artificial Sequence
  Description of Artificial Sequence: Synthetic oligonucleotide
tggttgtgcaggtttgtgcggcccc

SEQ ID NO: 235997 - DNA, 24 bp, Artificial Sequence
  Description of Artificial Sequence: Synthetic oligonucleotide
ggttgtgcaggtttgtgcggcccc

SEQ ID NO: 235998 - DNA, 24 bp, Artificial Sequence
  Description of Artificial Sequence: Synthetic oligonucleotide
gttgtgcaggtttgtgcggccccg

SEQ ID NO: 235999 - DNA, 24 bp, Artificial Sequence
  Description of Artificial Sequence: Synthetic oligonucleotide
ttgtgcaggtttgtgcggccccgc

SEQ ID NO: 236000 - DNA, 23 bp, Artificial Sequence
  Description of Artificial Sequence: Synthetic oligonucleotide
tgtgcaggtttgtgcggccccgc

SEQ ID NO: 236001 - DNA, 22 bp, Artificial Sequence
  Description of Artificial Sequence: Synthetic oligonucleotide
gtgcaggtttgtgcggccccgc

SEQ ID NO: 236002 - DNA, 22 bp, Artificial Sequence
  Description of Artificial Sequence: Synthetic oligonucleotide
tgcaggtttgtgcggccccgcg

SEQ ID NO: 236003 - DNA, 21 bp, Artificial Sequence
  Description of Artificial Sequence: Synthetic oligonucleotide
gcaggtttgtgcggccccgcg

SEQ ID NO: 236004 - DNA, 22 bp, Artificial Sequence
  Description of Artificial Sequence: Synthetic oligonucleotide
caggtttgtgcggccccgcgga

SEQ ID NO: 236005 - DNA, 23 bp, Artificial Sequence
  Description of Artificial Sequence: Synthetic oligonucleotide
aggtttgtgcggccccgcggaca

SEQ ID NO: 236006 - DNA, 22 bp, Artificial Sequence
  Description of Artificial Sequence: Synthetic oligonucleotide
ggtttgtgcggccccgcggaca

SEQ ID NO: 236007 - DNA, 23 bp, Artificial Sequence
  Description of Artificial Sequence: Synthetic oligonucleotide
gtttgtgcggccccgcggacagt

SEQ ID NO: 236008 - DNA, 23 bp, Artificial Sequence
  Description of Artificial Sequence: Synthetic oligonucleotide
tttgtgcggccccgcggacagtg

SEQ ID NO: 236009 - DNA, 22 bp, Artificial Sequence
  Description of Artificial Sequence: Synthetic oligonucleotide
ttgtgcggccccgcggacagtg

SEQ ID NO: 236010 - DNA, 21 bp, Artificial Sequence
  Description of Artificial Sequence: Synthetic oligonucleotide
tgtgcggccccgcggacagtg

SEQ ID NO: 236011 - DNA, 20 bp, Artificial Sequence
  Description of Artificial Sequence: Synthetic oligonucleotide
gtgcggccccgcggacagtg

SEQ ID NO: 236012 - DNA, 20 bp, Artificial Sequence
  Description of Artificial Sequence: Synthetic oligonucleotide
tgcggccccgcggacagtgc

SEQ ID NO: 236013 - DNA, 20 bp, Artificial Sequence
  Description of Artificial Sequence: Synthetic oligonucleotide
gcggccccgcggacagtgct

SEQ ID NO: 236014 - DNA, 20 bp, Artificial Sequence
  Description of Artificial Sequence: Synthetic oligonucleotide
cggccccgcggacagtgcct

SEQ ID NO: 236015 - DNA, 21 bp, Artificial Sequence
  Description of Artificial Sequence: Synthetic oligonucleotide
ggccccgcggacagtgcctct

SEQ ID NO: 236016 - DNA, 22 bp, Artificial Sequence
  Description of Artificial Sequence: Synthetic oligonucleotide
gccccgcggacagtgcctctga

SEQ ID NO: 236017 - DNA, 22 bp, Artificial Sequence
  Description of Artificial Sequence: Synthetic oligonucleotide
ccccgcggacagtgcctctgac

SEQ ID NO: 236018 - DNA, 22 bp, Artificial Sequence
  Description of Artificial Sequence: Synthetic oligonucleotide
cccgcggacagtgcctctgacg

SEQ ID NO: 236019 - DNA, 22 bp, Artificial Sequence
  Description of Artificial Sequence: Synthetic oligonucleotide
ccgcggacagtgcctctgacgg

SEQ ID NO: 236020 - DNA, 22 bp, Artificial Sequence
  Description of Artificial Sequence: Synthetic oligonucleotide
cgcggacagtgcctctgacggg

SEQ ID NO: 236021 - DNA, 25 bp, Artificial Sequence
  Description of Artificial Sequence: Synthetic oligonucleotide
gcggacagtgcctctgacggggtta

SEQ ID NO: 236022 - DNA, 26 bp, Artificial Sequence
  Description of Artificial Sequence: Synthetic oligonucleotide
cggacagtgcctctgacggggttact

SEQ ID NO: 236023 - DNA, 27 bp, Artificial Sequence
  Description of Artificial Sequence: Synthetic oligonucleotide
ggacagtgcctctgacggggttactga

SEQ ID NO: 236024 - DNA, 28 bp, Artificial Sequence
  Description of Artificial Sequence: Synthetic oligonucleotide
gacagtgcctctgacggggttactgatg

SEQ ID NO: 236025 - DNA, 29 bp, Artificial Sequence
  Description of Artificial Sequence: Synthetic oligonucleotide
acagtgcctctgacggggttactgatgtg

SEQ ID NO: 236026 - DNA, 28 bp, Artificial Sequence
  Description of Artificial Sequence: Synthetic oligonucleotide
cagtgcctctgacggggttactgatgtg

SEQ ID NO: 236027 - DNA, 28 bp, Artificial Sequence
  Description of Artificial Sequence: Synthetic oligonucleotide
agtgcctctgacggggttactgatgtgc

SEQ ID NO: 236028 - DNA, 27 bp, Artificial Sequence
  Description of Artificial Sequence: Synthetic oligonucleotide
gtgcctctgacggggttactgatgtgc

SEQ ID NO: 236029 - DNA, 28 bp, Artificial Sequence
  Description of Artificial Sequence: Synthetic oligonucleotide
tgcctctgacggggttactgatgtgctg

SEQ ID NO: 236030 - DNA, 27 bp, Artificial Sequence
  Description of Artificial Sequence: Synthetic oligonucleotide
gcctctgacggggttactgatgtgctg

SEQ ID NO: 236031 - DNA, 27 bp, Artificial Sequence
  Description of Artificial Sequence: Synthetic oligonucleotide
cctctgacggggttactgatgtgctgc

SEQ ID NO: 236032 - DNA, 28 bp, Artificial Sequence
  Description of Artificial Sequence: Synthetic oligonucleotide
ctctgacggggttactgatgtgctgctc

SEQ ID NO: 236033 - DNA, 29 bp, Artificial Sequence
  Description of Artificial Sequence: Synthetic oligonucleotide
tctgacggggttactgatgtgctgctctc

SEQ ID NO: 236034 - DNA, 28 bp, Artificial Sequence
  Description of Artificial Sequence: Synthetic oligonucleotide
ctgacggggttactgatgtgctgctctc

SEQ ID NO: 236035 - DNA, 30 bp, Artificial Sequence
  Description of Artificial Sequence: Synthetic oligonucleotide
tgacggggttactgatgtgctgctctcatc

SEQ ID NO: 236036 - DNA, 29 bp, Artificial Sequence
  Description of Artificial Sequence: Synthetic oligonucleotide
gacggggttactgatgtgctgctctcatc

SEQ ID NO: 236037 - DNA, 30 bp, Artificial Sequence
  Description of Artificial Sequence: Synthetic oligonucleotide
acggggttactgatgtgctgctctcatctg

SEQ ID NO: 236038 - DNA, 29 bp, Artificial Sequence
  Description of Artificial Sequence: Synthetic oligonucleotide
cggggttactgatgtgctgctctcatctg

SEQ ID NO: 236039 - DNA, 30 bp, Artificial Sequence
  Description of Artificial Sequence: Synthetic oligonucleotide
ggggttactgatgtgctgctctcatctgtg

SEQ ID NO: 236040 - DNA, 30 bp, Artificial Sequence
  Description of Artificial Sequence: Synthetic oligonucleotide
gggttactgatgtgctgctctcatctgtgg

SEQ ID NO: 236041 - DNA, 31 bp, Artificial Sequence
  Description of Artificial Sequence: Synthetic oligonucleotide
ggttactgatgtgctgctctcatctgtggac

SEQ ID NO: 236042 - DNA, 31 bp, Artificial Sequence
  Description of Artificial Sequence: Synthetic oligonucleotide
gttactgatgtgctgctctcatctgtggacc

SEQ ID NO: 236043 - DNA, 32 bp, Artificial Sequence
  Description of Artificial Sequence: Synthetic oligonucleotide
ttactgatgtgctgctctcatctgtggaccag

SEQ ID NO: 236044 - DNA, 31 bp, Artificial Sequence
  Description of Artificial Sequence: Synthetic oligonucleotide
tactgatgtgctgctctcatctgtggaccag

SEQ ID NO: 236045 - DNA, 30 bp, Artificial Sequence
  Description of Artificial Sequence: Synthetic oligonucleotide
actgatgtgctgctctcatctgtggaccag

SEQ ID NO: 236046 - DNA, 29 bp, Artificial Sequence
  Description of Artificial Sequence: Synthetic oligonucleotide
ctgatgtgctgctctcatctgtggaccag

SEQ ID NO: 236047 - DNA, 29 bp, Artificial Sequence
  Description of Artificial Sequence: Synthetic oligonucleotide
tgatgtgctgctctcatctgtggaccagg

SEQ ID NO: 236048 - DNA, 28 bp, Artificial Sequence
  Description of Artificial Sequence: Synthetic oligonucleotide
gatgtgctgctctcatctgtggaccagg

SEQ ID NO: 236049 - DNA, 28 bp, Artificial Sequence
  Description of Artificial Sequence: Synthetic oligonucleotide
atgtgctgctctcatctgtggaccaggg

SEQ ID NO: 236050 - DNA, 27 bp, Artificial Sequence
  Description of Artificial Sequence: Synthetic oligonucleotide
tgtgctgctctcatctgtggaccaggg

SEQ ID NO: 236051 - DNA, 26 bp, Artificial Sequence
  Description of Artificial Sequence: Synthetic oligonucleotide
gtgctgctctcatctgtggaccaggg

SEQ ID NO: 236052 - DNA, 27 bp, Artificial Sequence
  Description of Artificial Sequence: Synthetic oligonucleotide
tgctgctctcatctgtggaccagggca

SEQ ID NO: 236053 - DNA, 26 bp, Artificial Sequence
  Description of Artificial Sequence: Synthetic oligonucleotide
gctgctctcatctgtggaccagggca

SEQ ID NO: 236054 - DNA, 26 bp, Artificial Sequence
  Description of Artificial Sequence: Synthetic oligonucleotide
ctgctctcatctgtggaccagggcag

SEQ ID NO: 236055 - DNA, 26 bp, Artificial Sequence
  Description of Artificial Sequence: Synthetic oligonucleotide
tgctctcatctgtggaccagggcagc

SEQ ID NO: 236056 - DNA, 25 bp, Artificial Sequence
  Description of Artificial Sequence: Synthetic oligonucleotide
gctctcatctgtggaccagggcagc

SEQ ID NO: 236057 - DNA, 25 bp, Artificial Sequence
  Description of Artificial Sequence: Synthetic oligonucleotide
ctctcatctgtggaccagggcagcg

SEQ ID NO: 236058 - DNA, 25 bp, Artificial Sequence
  Description of Artificial Sequence: Synthetic oligonucleotide
tctcatctgtggaccagggcagcgc

SEQ ID NO: 236059 - DNA, 24 bp, Artificial Sequence
  Description of Artificial Sequence: Synthetic oligonucleotide
ctcatctgtggaccagggcagcgc

SEQ ID NO: 236060 - DNA, 25 bp, Artificial Sequence
  Description of Artificial Sequence: Synthetic oligonucleotide
tcatctgtggaccagggcagcgcca

SEQ ID NO: 236061 - DNA, 24 bp, Artificial Sequence
  Description of Artificial Sequence: Synthetic oligonucleotide
catctgtggaccagggcagcgcca

SEQ ID NO: 236062 - DNA, 25 bp, Artificial Sequence
  Description of Artificial Sequence: Synthetic oligonucleotide
atctgtggaccagggcagcgccact

SEQ ID NO: 236063 - DNA, 24 bp, Artificial Sequence
  Description of Artificial Sequence: Synthetic oligonucleotide
tctgtggaccagggcagcgccact

SEQ ID NO: 236064 - DNA, 23 bp, Artificial Sequence
  Description of Artificial Sequence: Synthetic oligonucleotide
ctgtggaccagggcagcgccact

SEQ ID NO: 236065 - DNA, 23 bp, Artificial Sequence
  Description of Artificial Sequence: Synthetic oligonucleotide
tgtggaccagggcagcgccactc

SEQ ID NO: 236066 - DNA, 22 bp, Artificial Sequence
  Description of Artificial Sequence: Synthetic oligonucleotide
gtggaccagggcagcgccactc

SEQ ID NO: 236067 - DNA, 23 bp, Artificial Sequence
  Description of Artificial Sequence: Synthetic oligonucleotide
tggaccagggcagcgccactcca

SEQ ID NO: 236068 - DNA, 22 bp, Artificial Sequence
  Description of Artificial Sequence: Synthetic oligonucleotide
ggaccagggcagcgccactcca

SEQ ID NO: 236069 - DNA, 23 bp, Artificial Sequence
  Description of Artificial Sequence: Synthetic oligonucleotide
gaccagggcagcgccactccaca

SEQ ID NO: 236070 - DNA, 27 bp, Artificial Sequence
  Description of Artificial Sequence: Synthetic oligonucleotide
accagggcagcgccactccacagaatt

SEQ ID NO: 236071 - DNA, 27 bp, Artificial Sequence
  Description of Artificial Sequence: Synthetic oligonucleotide
ccagggcagcgccactccacagaatta

SEQ ID NO: 236072 - DNA, 27 bp, Artificial Sequence
  Description of Artificial Sequence: Synthetic oligonucleotide
cagggcagcgccactccacagaattac

SEQ ID NO: 236073 - DNA, 27 bp, Artificial Sequence
  Description of Artificial Sequence: Synthetic oligonucleotide
agggcagcgccactccacagaattacc

SEQ ID NO: 236074 - DNA, 27 bp, Artificial Sequence
  Description of Artificial Sequence: Synthetic oligonucleotide
gggcagcgccactccacagaattacca

SEQ ID NO: 236075 - DNA, 30 bp, Artificial Sequence
  Description of Artificial Sequence: Synthetic oligonucleotide
ggcagcgccactccacagaattaccatttc

SEQ ID NO: 236076 - DNA, 30 bp, Artificial Sequence
  Description of Artificial Sequence: Synthetic oligonucleotide
gcagcgccactccacagaattaccatttcc

SEQ ID NO: 236077 - DNA, 31 bp, Artificial Sequence
  Description of Artificial Sequence: Synthetic oligonucleotide
cagcgccactccacagaattaccatttccag

SEQ ID NO: 236078 - DNA, 31 bp, Artificial Sequence
  Description of Artificial Sequence: Synthetic oligonucleotide
agcgccactccacagaattaccatttccagg

SEQ ID NO: 236079 - DNA, 30 bp, Artificial Sequence
  Description of Artificial Sequence: Synthetic oligonucleotide
gcgccactccacagaattaccatttccagg

SEQ ID NO: 236080 - DNA, 30 bp, Artificial Sequence
  Description of Artificial Sequence: Synthetic oligonucleotide
cgccactccacagaattaccatttccaggg

SEQ ID NO: 236081 - DNA, 30 bp, Artificial Sequence
  Description of Artificial Sequence: Synthetic oligonucleotide
gccactccacagaattaccatttccagggc

SEQ ID NO: 236082 - DNA, 30 bp, Artificial Sequence
  Description of Artificial Sequence: Synthetic oligonucleotide
ccactccacagaattaccatttccagggcg

SEQ ID NO: 236083 - DNA, 30 bp, Artificial Sequence
  Description of Artificial Sequence: Synthetic oligonucleotide
cactccacagaattaccatttccagggcgg

SEQ ID NO: 236084 - DNA, 30 bp, Artificial Sequence
  Description of Artificial Sequence: Synthetic oligonucleotide
actccacagaattaccatttccagggcggc

SEQ ID NO: 236085 - DNA, 29 bp, Artificial Sequence
  Description of Artificial Sequence: Synthetic oligonucleotide
ctccacagaattaccatttccagggcggc

SEQ ID NO: 236086 - DNA, 30 bp, Artificial Sequence
  Description of Artificial Sequence: Synthetic oligonucleotide
tccacagaattaccatttccagggcggcag

SEQ ID NO: 236087 - DNA, 29 bp, Artificial Sequence
  Description of Artificial Sequence: Synthetic oligonucleotide
ccacagaattaccatttccagggcggcag

SEQ ID NO: 236088 - DNA, 29 bp, Artificial Sequence
  Description of Artificial Sequence: Synthetic oligonucleotide
cacagaattaccatttccagggcggcagg

SEQ ID NO: 236089 - DNA, 32 bp, Artificial Sequence
  Description of Artificial Sequence: Synthetic oligonucleotide
acagaattaccatttccagggcggcaggaaag

SEQ ID NO: 236090 - DNA, 31 bp, Artificial Sequence
  Description of Artificial Sequence: Synthetic oligonucleotide
cagaattaccatttccagggcggcaggaaag

SEQ ID NO: 236091 - DNA, 31 bp, Artificial Sequence
  Description of Artificial Sequence: Synthetic oligonucleotide
agaattaccatttccagggcggcaggaaagc

SEQ ID NO: 236092 - DNA, 30 bp, Artificial Sequence
  Description of Artificial Sequence: Synthetic oligonucleotide
gaattaccatttccagggcggcaggaaagc

SEQ ID NO: 236093 - DNA, 32 bp, Artificial Sequence
  Description of Artificial Sequence: Synthetic oligonucleotide
aattaccatttccagggcggcaggaaagctac

SEQ ID NO: 236094 - DNA, 31 bp, Artificial Sequence
  Description of Artificial Sequence: Synthetic oligonucleotide
attaccatttccagggcggcaggaaagctac

SEQ ID NO: 236095 - DNA, 30 bp, Artificial Sequence
  Description of Artificial Sequence: Synthetic oligonucleotide
ttaccatttccagggcggcaggaaagctac

SEQ ID NO: 236096 - DNA, 29 bp, Artificial Sequence
  Description of Artificial Sequence: Synthetic oligonucleotide
taccatttccagggcggcaggaaagctac

SEQ ID NO: 236097 - DNA, 28 bp, Artificial Sequence
  Description of Artificial Sequence: Synthetic oligonucleotide
accatttccagggcggcaggaaagctac

SEQ ID NO: 236098 - DNA, 27 bp, Artificial Sequence
  Description of Artificial Sequence: Synthetic oligonucleotide
ccatttccagggcggcaggaaagctac

SEQ ID NO: 236099 - DNA, 27 bp, Artificial Sequence
  Description of Artificial Sequence: Synthetic oligonucleotide
catttccagggcggcaggaaagctacg

SEQ ID NO: 236100 - DNA, 27 bp, Artificial Sequence
  Description of Artificial Sequence: Synthetic oligonucleotide
atttccagggcggcaggaaagctacgc

SEQ ID NO: 236101 - DNA, 26 bp, Artificial Sequence
  Description of Artificial Sequence: Synthetic oligonucleotide
tttccagggcggcaggaaagctacgc

SEQ ID NO: 236102 - DNA, 25 bp, Artificial Sequence
  Description of Artificial Sequence: Synthetic oligonucleotide
ttccagggcggcaggaaagctacgc

SEQ ID NO: 236103 - DNA, 24 bp, Artificial Sequence
  Description of Artificial Sequence: Synthetic oligonucleotide
tccagggcggcaggaaagctacgc

SEQ ID NO: 236104 - DNA, 23 bp, Artificial Sequence
  Description of Artificial Sequence: Synthetic oligonucleotide
ccagggcggcaggaaagctacgc

SEQ ID NO: 236105 - DNA, 27 bp, Artificial Sequence
  Description of Artificial Sequence: Synthetic oligonucleotide
cagggcggcaggaaagctacgcgtata

SEQ ID NO: 236106 - DNA, 29 bp, Artificial Sequence
  Description of Artificial Sequence: Synthetic oligonucleotide
agggcggcaggaaagctacgcgtataatg

SEQ ID NO: 236107 - DNA, 28 bp, Artificial Sequence
  Description of Artificial Sequence: Synthetic oligonucleotide
gggcggcaggaaagctacgcgtataatg

SEQ ID NO: 236108 - DNA, 28 bp, Artificial Sequence
  Description of Artificial Sequence: Synthetic oligonucleotide
ggcggcaggaaagctacgcgtataatgg

SEQ ID NO: 236109 - DNA, 28 bp, Artificial Sequence
  Description of Artificial Sequence: Synthetic oligonucleotide
gcggcaggaaagctacgcgtataatggg

SEQ ID NO: 236110 - DNA, 29 bp, Artificial Sequence
  Description of Artificial Sequence: Synthetic oligonucleotide
cggcaggaaagctacgcgtataatgggac

SEQ ID NO: 236111 - DNA, 30 bp, Artificial Sequence
  Description of Artificial Sequence: Synthetic oligonucleotide
ggcaggaaagctacgcgtataatgggactc

SEQ ID NO: 236112 - DNA, 31 bp, Artificial Sequence
  Description of Artificial Sequence: Synthetic oligonucleotide
gcaggaaagctacgcgtataatgggactcag

SEQ ID NO: 236113 - DNA, 31 bp, Artificial Sequence
  Description of Artificial Sequence: Synthetic oligonucleotide
caggaaagctacgcgtataatgggactcagc

SEQ ID NO: 236114 - DNA, 31 bp, Artificial Sequence
  Description of Artificial Sequence: Synthetic oligonucleotide
aggaaagctacgcgtataatgggactcagcg

SEQ ID NO: 236115 - DNA, 30 bp, Artificial Sequence
  Description of Artificial Sequence: Synthetic oligonucleotide
ggaaagctacgcgtataatgggactcagcg

SEQ ID NO: 236116 - DNA, 30 bp, Artificial Sequence
  Description of Artificial Sequence: Synthetic oligonucleotide
gaaagctacgcgtataatgggactcagcgc

SEQ ID NO: 236117 - DNA, 32 bp, Artificial Sequence
  Description of Artificial Sequence: Synthetic oligonucleotide
aaagctacgcgtataatgggactcagcgcttc

SEQ ID NO: 236118 - DNA, 31 bp, Artificial Sequence
  Description of Artificial Sequence: Synthetic oligonucleotide
aagctacgcgtataatgggactcagcgcttc

SEQ ID NO: 236119 - DNA, 30 bp, Artificial Sequence
  Description of Artificial Sequence: Synthetic oligonucleotide
agctacgcgtataatgggactcagcgcttc

SEQ ID NO: 236120 - DNA, 29 bp, Artificial Sequence
  Description of Artificial Sequence: Synthetic oligonucleotide
gctacgcgtataatgggactcagcgcttc

SEQ ID NO: 236121 - DNA, 29 bp, Artificial Sequence
  Description of Artificial Sequence: Synthetic oligonucleotide
ctacgcgtataatgggactcagcgcttcg

SEQ ID NO: 236122 - DNA, 30 bp, Artificial Sequence
  Description of Artificial Sequence: Synthetic oligonucleotide
tacgcgtataatgggactcagcgcttcgtg

SEQ ID NO: 236123 - DNA, 29 bp, Artificial Sequence
  Description of Artificial Sequence: Synthetic oligonucleotide
acgcgtataatgggactcagcgcttcgtg

SEQ ID NO: 236124 - DNA, 28 bp, Artificial Sequence
  Description of Artificial Sequence: Synthetic oligonucleotide
cgcgtataatgggactcagcgcttcgtg

SEQ ID NO: 236125 - DNA, 28 bp, Artificial Sequence
  Description of Artificial Sequence: Synthetic oligonucleotide
gcgtataatgggactcagcgcttcgtgg

SEQ ID NO: 236126 - DNA, 29 bp, Artificial Sequence
  Description of Artificial Sequence: Synthetic oligonucleotide
cgtataatgggactcagcgcttcgtggag

SEQ ID NO: 236127 - DNA, 30 bp, Artificial Sequence
  Description of Artificial Sequence: Synthetic oligonucleotide
gtataatgggactcagcgcttcgtggagag

SEQ ID NO: 236128 - DNA, 33 bp, Artificial Sequence
  Description of Artificial Sequence: Synthetic oligonucleotide
tataatgggactcagcgcttcgtggagagattc

SEQ ID NO: 236129 - DNA, 32 bp, Artificial Sequence
  Description of Artificial Sequence: Synthetic oligonucleotide
ataatgggactcagcgcttcgtggagagattc

SEQ ID NO: 236130 - DNA, 31 bp, Artificial Sequence
  Description of Artificial Sequence: Synthetic oligonucleotide
taatgggactcagcgcttcgtggagagattc

SEQ ID NO: 236131 - DNA, 30 bp, Artificial Sequence
  Description of Artificial Sequence: Synthetic oligonucleotide
aatgggactcagcgcttcgtggagagattc

SEQ ID NO: 236132 - DNA, 29 bp, Artificial Sequence
  Description of Artificial Sequence: Synthetic oligonucleotide
atgggactcagcgcttcgtggagagattc

SEQ ID NO: 236133 - DNA, 28 bp, Artificial Sequence
  Description of Artificial Sequence: Synthetic oligonucleotide
tgggactcagcgcttcgtggagagattc

SEQ ID NO: 236134 - DNA, 27 bp, Artificial Sequence
  Description of Artificial Sequence: Synthetic oligonucleotide
gggactcagcgcttcgtggagagattc

SEQ ID NO: 236135 - DNA, 29 bp, Artificial Sequence
  Description of Artificial Sequence: Synthetic oligonucleotide
ggactcagcgcttcgtggagagattcatc

SEQ ID NO: 236136 - DNA, 31 bp, Artificial Sequence
  Description of Artificial Sequence: Synthetic oligonucleotide
gactcagcgcttcgtggagagattcatctac

SEQ ID NO: 236137 - DNA, 33 bp, Artificial Sequence
  Description of Artificial Sequence: Synthetic oligonucleotide
actcagcgcttcgtggagagattcatctacaac

SEQ ID NO: 236138 - DNA, 32 bp, Artificial Sequence
  Description of Artificial Sequence: Synthetic oligonucleotide
ctcagcgcttcgtggagagattcatctacaac

SEQ ID NO: 236139 - DNA, 32 bp, Artificial Sequence
  Description of Artificial Sequence: Synthetic oligonucleotide
tcagcgcttcgtggagagattcatctacaacg

SEQ ID NO: 236140 - DNA, 31 bp, Artificial Sequence
  Description of Artificial Sequence: Synthetic oligonucleotide
cagcgcttcgtggagagattcatctacaacg

SEQ ID NO: 236141 - DNA, 31 bp, Artificial Sequence
  Description of Artificial Sequence: Synthetic oligonucleotide
agcgcttcgtggagagattcatctacaacgg

SEQ ID NO: 236142 - DNA, 30 bp, Artificial Sequence
  Description of Artificial Sequence: Synthetic oligonucleotide
gcgcttcgtggagagattcatctacaacgg

SEQ ID NO: 236143 - DNA, 30 bp, Artificial Sequence
  Description of Artificial Sequence: Synthetic oligonucleotide
cgcttcgtggagagattcatctacaacggg

SEQ ID NO: 236144 - DNA, 31 bp, Artificial Sequence
  Description of Artificial Sequence: Synthetic oligonucleotide
gcttcgtggagagattcatctacaacgggag

SEQ ID NO: 236145 - DNA, 31 bp, Artificial Sequence
  Description of Artificial Sequence: Synthetic oligonucleotide
cttcgtggagagattcatctacaacgggagg

SEQ ID NO: 236146 - DNA, 32 bp, Artificial Sequence
  Description of Artificial Sequence: Synthetic oligonucleotide
ttcgtggagagattcatctacaacgggaggac

SEQ ID NO: 236147 - DNA, 31 bp, Artificial Sequence
  Description of Artificial Sequence: Synthetic oligonucleotide
tcgtggagagattcatctacaacgggaggac

SEQ ID NO: 236148 - DNA, 30 bp, Artificial Sequence
  Description of Artificial Sequence: Synthetic oligonucleotide
cgtggagagattcatctacaacgggaggac

SEQ ID NO: 236149 - DNA, 32 bp, Artificial Sequence
  Description of Artificial Sequence: Synthetic oligonucleotide
gtggagagattcatctacaacgggaggacttc

SEQ ID NO: 236150 - DNA, 32 bp, Artificial Sequence
  Description of Artificial Sequence: Synthetic oligonucleotide
tggagagattcatctacaacgggaggacttcg

SEQ ID NO: 236151 - DNA, 31 bp, Artificial Sequence
  Description of Artificial Sequence: Synthetic oligonucleotide
ggagagattcatctacaacgggaggacttcg

SEQ ID NO: 236152 - DNA, 32 bp, Artificial Sequence
  Description of Artificial Sequence: Synthetic oligonucleotide
gagagattcatctacaacgggaggacttcgtg

SEQ ID NO: 236153 - DNA, 32 bp, Artificial Sequence
  Description of Artificial Sequence: Synthetic oligonucleotide
agagattcatctacaacgggaggacttcgtgc

SEQ ID NO: 236154 - DNA, 31 bp, Artificial Sequence
  Description of Artificial Sequence: Synthetic oligonucleotide
gagattcatctacaacgggaggacttcgtgc

SEQ ID NO: 236155 - DNA, 31 bp, Artificial Sequence
  Description of Artificial Sequence: Synthetic oligonucleotide
agattcatctacaacgggaggacttcgtgcg

SEQ ID NO: 236156 - DNA, 30 bp, Artificial Sequence
  Description of Artificial Sequence: Synthetic oligonucleotide
gattcatctacaacgggaggacttcgtgcg

SEQ ID NO: 236157 - DNA, 30 bp, Artificial Sequence
  Description of Artificial Sequence: Synthetic oligonucleotide
attcatctacaacgggaggacttcgtgcgc

SEQ ID NO: 236158 - DNA, 29 bp, Artificial Sequence
  Description of Artificial Sequence: Synthetic oligonucleotide
ttcatctacaacgggaggacttcgtgcgc

SEQ ID NO: 236159 - DNA, 28 bp, Artificial Sequence
  Description of Artificial Sequence: Synthetic oligonucleotide
tcatctacaacgggaggacttcgtgcgc

SEQ ID NO: 236160 - DNA, 27 bp, Artificial Sequence
  Description of Artificial Sequence: Synthetic oligonucleotide
catctacaacgggaggacttcgtgcgc

SEQ ID NO: 236161 - DNA, 29 bp, Artificial Sequence
  Description of Artificial Sequence: Synthetic oligonucleotide
atctacaacgggaggacttcgtgcgctac

SEQ ID NO: 236162 - DNA, 28 bp, Artificial Sequence
  Description of Artificial Sequence: Synthetic oligonucleotide
tctacaacgggaggacttcgtgcgctac

SEQ ID NO: 236163 - DNA, 27 bp, Artificial Sequence
  Description of Artificial Sequence: Synthetic oligonucleotide
ctacaacgggaggacttcgtgcgctac

SEQ ID NO: 236164 - DNA, 27 bp, Artificial Sequence
  Description of Artificial Sequence: Synthetic oligonucleotide
tacaacgggaggacttcgtgcgctacg

SEQ ID NO: 236165 - DNA, 27 bp, Artificial Sequence
  Description of Artificial Sequence: Synthetic oligonucleotide
acaacgggaggacttcgtgcgctacga

SEQ ID NO: 236166 - DNA, 26 bp, Artificial Sequence
  Description of Artificial Sequence: Synthetic oligonucleotide
caacgggaggacttcgtgcgctacga

SEQ ID NO: 236167 - DNA, 27 bp, Artificial Sequence
  Description of Artificial Sequence: Synthetic oligonucleotide
aacgggaggacttcgtgcgctacgaca

SEQ ID NO: 236168 - DNA, 26 bp, Artificial Sequence
  Description of Artificial Sequence: Synthetic oligonucleotide
acgggaggacttcgtgcgctacgaca

SEQ ID NO: 236169 - DNA, 25 bp, Artificial Sequence
  Description of Artificial Sequence: Synthetic oligonucleotide
cgggaggacttcgtgcgctacgaca

SEQ ID NO: 236170 - DNA, 25 bp, Artificial Sequence
  Description of Artificial Sequence: Synthetic oligonucleotide
gggaggacttcgtgcgctacgacag

SEQ ID NO: 236171 - DNA, 25 bp, Artificial Sequence
  Description of Artificial Sequence: Synthetic oligonucleotide
ggaggacttcgtgcgctacgacagc

SEQ ID NO: 236172 - DNA, 26 bp, Artificial Sequence
  Description of Artificial Sequence: Synthetic oligonucleotide
gaggacttcgtgcgctacgacagcga

SEQ ID NO: 236173 - DNA, 26 bp, Artificial Sequence
  Description of Artificial Sequence: Synthetic oligonucleotide
aggacttcgtgcgctacgacagcgag

SEQ ID NO: 236174 - DNA, 25 bp, Artificial Sequence
  Description of Artificial Sequence: Synthetic oligonucleotide
ggacttcgtgcgctacgacagcgag

SEQ ID NO: 236175 - DNA, 26 bp, Artificial Sequence
  Description of Artificial Sequence: Synthetic oligonucleotide
gacttcgtgcgctacgacagcgaggt

SEQ ID NO: 236176 - DNA, 26 bp, Artificial Sequence
  Description of Artificial Sequence: Synthetic oligonucleotide
acttcgtgcgctacgacagcgaggtg

SEQ ID NO: 236177 - DNA, 25 bp, Artificial Sequence
  Description of Artificial Sequence: Synthetic oligonucleotide
cttcgtgcgctacgacagcgaggtg

SEQ ID NO: 236178 - DNA, 25 bp, Artificial Sequence
  Description of Artificial Sequence: Synthetic oligonucleotide
ttcgtgcgctacgacagcgaggtgg

SEQ ID NO: 236179 - DNA, 24 bp, Artificial Sequence
  Description of Artificial Sequence: Synthetic oligonucleotide
tcgtgcgctacgacagcgaggtgg

SEQ ID NO: 236180 - DNA, 23 bp, Artificial Sequence
  Description of Artificial Sequence: Synthetic oligonucleotide
cgtgcgctacgacagcgaggtgg

SEQ ID NO: 236181 - DNA, 23 bp, Artificial Sequence
  Description of Artificial Sequence: Synthetic oligonucleotide
gtgcgctacgacagcgaggtggg

SEQ ID NO: 236182 - DNA, 23 bp, Artificial Sequence
  Description of Artificial Sequence: Synthetic oligonucleotide
tgcgctacgacagcgaggtgggg

SEQ ID NO: 236183 - DNA, 22 bp, Artificial Sequence
  Description of Artificial Sequence: Synthetic oligonucleotide
gcgctacgacagcgaggtgggg

SEQ ID NO: 236184 - DNA, 23 bp, Artificial Sequence
  Description of Artificial Sequence: Synthetic oligonucleotide
cgctacgacagcgaggtggggga

SEQ ID NO: 236185 - DNA, 25 bp, Artificial Sequence
  Description of Artificial Sequence: Synthetic oligonucleotide
gctacgacagcgaggtgggggagat

SEQ ID NO: 236186 - DNA, 25 bp, Artificial Sequence
  Description of Artificial Sequence: Synthetic oligonucleotide
ctacgacagcgaggtgggggagatc

SEQ ID NO: 236187 - DNA, 25 bp, Artificial Sequence
  Description of Artificial Sequence: Synthetic oligonucleotide
tacgacagcgaggtgggggagatcc

SEQ ID NO: 236188 - DNA, 24 bp, Artificial Sequence
  Description of Artificial Sequence: Synthetic oligonucleotide
acgacagcgaggtgggggagatcc

SEQ ID NO: 236189 - DNA, 23 bp, Artificial Sequence
  Description of Artificial Sequence: Synthetic oligonucleotide
cgacagcgaggtgggggagatcc

SEQ ID NO: 236190 - DNA, 23 bp, Artificial Sequence
  Description of Artificial Sequence: Synthetic oligonucleotide
gacagcgaggtgggggagatccg

SEQ ID NO: 236191 - DNA, 23 bp, Artificial Sequence
  Description of Artificial Sequence: Synthetic oligonucleotide
acagcgaggtgggggagatccgg

SEQ ID NO: 236192 - DNA, 22 bp, Artificial Sequence
  Description of Artificial Sequence: Synthetic oligonucleotide
cagcgaggtgggggagatccgg

SEQ ID NO: 236193 - DNA, 22 bp, Artificial Sequence
  Description of Artificial Sequence: Synthetic oligonucleotide
agcgaggtgggggagatccggg

SEQ ID NO: 236194 - DNA, 21 bp, Artificial Sequence
  Description of Artificial Sequence: Synthetic oligonucleotide
gcgaggtgggggagatccggg

SEQ ID NO: 236195 - DNA, 21 bp, Artificial Sequence
  Description of Artificial Sequence: Synthetic oligonucleotide
cgaggtgggggagatccgggc

SEQ ID NO: 236196 - DNA, 21 bp, Artificial Sequence
  Description of Artificial Sequence: Synthetic oligonucleotide
gaggtgggggagatccgggcg

SEQ ID NO: 236197 - DNA, 22 bp, Artificial Sequence
  Description of Artificial Sequence: Synthetic oligonucleotide
aggtgggggagatccgggcgga

SEQ ID NO: 236198 - DNA, 21 bp, Artificial Sequence
  Description of Artificial Sequence: Synthetic oligonucleotide
ggtgggggagatccgggcgga

SEQ ID NO: 236199 - DNA, 22 bp, Artificial Sequence
  Description of Artificial Sequence: Synthetic oligonucleotide
gtgggggagatccgggcggaga

SEQ ID NO: 236200 - DNA, 22 bp, Artificial Sequence
  Description of Artificial Sequence: Synthetic oligonucleotide
tgggggagatccgggcggagac

SEQ ID NO: 236201 - DNA, 21 bp, Artificial Sequence
  Description of Artificial Sequence: Synthetic oligonucleotide
gggggagatccgggcggagac

SEQ ID NO: 236202 - DNA, 21 bp, Artificial Sequence
  Description of Artificial Sequence: Synthetic oligonucleotide
ggggagatccgggcggagacg

SEQ ID NO: 236203 - DNA, 22 bp, Artificial Sequence
  Description of Artificial Sequence: Synthetic oligonucleotide
gggagatccgggcggagacgga

SEQ ID NO: 236204 - DNA, 22 bp, Artificial Sequence
  Description of Artificial Sequence: Synthetic oligonucleotide
ggagatccgggcggagacggag

SEQ ID NO: 236205 - DNA, 23 bp, Artificial Sequence
  Description of Artificial Sequence: Synthetic oligonucleotide
gagatccgggcggagacggagct

SEQ ID NO: 236206 - DNA, 23 bp, Artificial Sequence
  Description of Artificial Sequence: Synthetic oligonucleotide
agatccgggcggagacggagctg

SEQ ID NO: 236207 - DNA, 22 bp, Artificial Sequence
  Description of Artificial Sequence: Synthetic oligonucleotide
gatccgggcggagacggagctg

SEQ ID NO: 236208 - DNA, 22 bp, Artificial Sequence
  Description of Artificial Sequence: Synthetic oligonucleotide
atccgggcggagacggagctgg

SEQ ID NO: 236209 - DNA, 21 bp, Artificial Sequence
  Description of Artificial Sequence: Synthetic oligonucleotide
tccgggcggagacggagctgg

SEQ ID NO: 236210 - DNA, 20 bp, Artificial Sequence
  Description of Artificial Sequence: Synthetic oligonucleotide
ccgggcggagacggagctgg

SEQ ID NO: 236211 - DNA, 20 bp, Artificial Sequence
  Description of Artificial Sequence: Synthetic oligonucleotide
cgggcggagacggagctggg

SEQ ID NO: 236212 - DNA, 20 bp, Artificial Sequence
  Description of Artificial Sequence: Synthetic oligonucleotide
gggcggagacggagctgggc

SEQ ID NO: 236213 - DNA, 20 bp, Artificial Sequence
  Description of Artificial Sequence: Synthetic oligonucleotide
ggcggagacggagctgggcg

SEQ ID NO: 236214 - DNA, 20 bp, Artificial Sequence
  Description of Artificial Sequence: Synthetic oligonucleotide
gcggagacggagctgggcgg

SEQ ID NO: 236215 - DNA, 20 bp, Artificial Sequence
  Description of Artificial Sequence: Synthetic oligonucleotide
cggagacggagctgggcggc

SEQ ID NO: 236216 - DNA, 21 bp, Artificial Sequence
  Description of Artificial Sequence: Synthetic oligonucleotide
ggagacggagctgggcggcct

SEQ ID NO: 236217 - DNA, 22 bp, Artificial Sequence
  Description of Artificial Sequence: Synthetic oligonucleotide
gagacggagctgggcggcctca

SEQ ID NO: 236218 - DNA, 22 bp, Artificial Sequence
  Description of Artificial Sequence: Synthetic oligonucleotide
agacggagctgggcggcctcag

SEQ ID NO: 236219 - DNA, 21 bp, Artificial Sequence
  Description of Artificial Sequence: Synthetic oligonucleotide
gacggagctgggcggcctcag

SEQ ID NO: 236220 - DNA, 21 bp, Artificial Sequence
  Description of Artificial Sequence: Synthetic oligonucleotide
acggagctgggcggcctcagg

SEQ ID NO: 236221 - DNA, 20 bp, Artificial Sequence
  Description of Artificial Sequence: Synthetic oligonucleotide
cggagctgggcggcctcagg

SEQ ID NO: 236222 - DNA, 20 bp, Artificial Sequence
  Description of Artificial Sequence: Synthetic oligonucleotide
ggagctgggcggcctcaggc

SEQ ID NO: 236223 - DNA, 20 bp, Artificial Sequence
  Description of Artificial Sequence: Synthetic oligonucleotide
gagctgggcggcctcaggcg

SEQ ID NO: 236224 - DNA, 21 bp, Artificial Sequence
  Description of Artificial Sequence: Synthetic oligonucleotide
agctgggcggcctcaggcgga

SEQ ID NO: 236225 - DNA, 20 bp, Artificial Sequence
  Description of Artificial Sequence: Synthetic oligonucleotide
gctgggcggcctcaggcgga

SEQ ID NO: 236226 - DNA, 22 bp, Artificial Sequence
  Description of Artificial Sequence: Synthetic oligonucleotide
ctgggcggcctcaggcggagtt

SEQ ID NO: 236227 - DNA, 23 bp, Artificial Sequence
  Description of Artificial Sequence: Synthetic oligonucleotide
tgggcggcctcaggcggagttct

SEQ ID NO: 236228 - DNA, 22 bp, Artificial Sequence
  Description of Artificial Sequence: Synthetic oligonucleotide
gggcggcctcaggcggagttct

SEQ ID NO: 236229 - DNA, 22 bp, Artificial Sequence
  Description of Artificial Sequence: Synthetic oligonucleotide
ggcggcctcaggcggagttctg

SEQ ID NO: 236230 - DNA, 24 bp, Artificial Sequence
  Description of Artificial Sequence: Synthetic oligonucleotide
gcggcctcaggcggagttctggaa

SEQ ID NO: 236231 - DNA, 25 bp, Artificial Sequence
  Description of Artificial Sequence: Synthetic oligonucleotide
cggcctcaggcggagttctggaaca

SEQ ID NO: 236232 - DNA, 25 bp, Artificial Sequence
  Description of Artificial Sequence: Synthetic oligonucleotide
ggcctcaggcggagttctggaacag

SEQ ID NO: 236233 - DNA, 25 bp, Artificial Sequence
  Description of Artificial Sequence: Synthetic oligonucleotide
gcctcaggcggagttctggaacagg

SEQ ID NO: 236234 - DNA, 26 bp, Artificial Sequence
  Description of Artificial Sequence: Synthetic oligonucleotide
cctcaggcggagttctggaacaggca

SEQ ID NO: 236235 - DNA, 27 bp, Artificial Sequence
  Description of Artificial Sequence: Synthetic oligonucleotide
ctcaggcggagttctggaacaggcaga

SEQ ID NO: 236236 - DNA, 28 bp, Artificial Sequence
  Description of Artificial Sequence: Synthetic oligonucleotide
tcaggcggagttctggaacaggcagaag

SEQ ID NO: 236237 - DNA, 27 bp, Artificial Sequence
  Description of Artificial Sequence: Synthetic oligonucleotide
caggcggagttctggaacaggcagaag

SEQ ID NO: 236238 - DNA, 27 bp, Artificial Sequence
  Description of Artificial Sequence: Synthetic oligonucleotide
aggcggagttctggaacaggcagaagg

SEQ ID NO: 236239 - DNA, 27 bp, Artificial Sequence
  Description of Artificial Sequence: Synthetic oligonucleotide
ggcggagttctggaacaggcagaagga

SEQ ID NO: 236240 - DNA, 27 bp, Artificial Sequence
  Description of Artificial Sequence: Synthetic oligonucleotide
gcggagttctggaacaggcagaaggag

SEQ ID NO: 236241 - DNA, 29 bp, Artificial Sequence
  Description of Artificial Sequence: Synthetic oligonucleotide
cggagttctggaacaggcagaaggagatc

SEQ ID NO: 236242 - DNA, 29 bp, Artificial Sequence
  Description of Artificial Sequence: Synthetic oligonucleotide
ggagttctggaacaggcagaaggagatcc

SEQ ID NO: 236243 - DNA, 30 bp, Artificial Sequence
  Description of Artificial Sequence: Synthetic oligonucleotide
gagttctggaacaggcagaaggagatcctg

SEQ ID NO: 236244 - DNA, 30 bp, Artificial Sequence
  Description of Artificial Sequence: Synthetic oligonucleotide
agttctggaacaggcagaaggagatcctgg

SEQ ID NO: 236245 - DNA, 29 bp, Artificial Sequence
  Description of Artificial Sequence: Synthetic oligonucleotide
gttctggaacaggcagaaggagatcctgg

SEQ ID NO: 236246 - DNA, 30 bp, Artificial Sequence
  Description of Artificial Sequence: Synthetic oligonucleotide
ttctggaacaggcagaaggagatcctggag

SEQ ID NO: 236247 - DNA, 29 bp, Artificial Sequence
  Description of Artificial Sequence: Synthetic oligonucleotide
tctggaacaggcagaaggagatcctggag

SEQ ID NO: 236248 - DNA, 28 bp, Artificial Sequence
  Description of Artificial Sequence: Synthetic oligonucleotide
ctggaacaggcagaaggagatcctggag

SEQ ID NO: 236249 - DNA, 28 bp, Artificial Sequence
  Description of Artificial Sequence: Synthetic oligonucleotide
tggaacaggcagaaggagatcctggagg

SEQ ID NO: 236250 - DNA, 27 bp, Artificial Sequence
  Description of Artificial Sequence: Synthetic oligonucleotide
ggaacaggcagaaggagatcctggagg

SEQ ID NO: 236251 - DNA, 28 bp, Artificial Sequence
  Description of Artificial Sequence: Synthetic oligonucleotide
gaacaggcagaaggagatcctggaggtg

SEQ ID NO: 236252 - DNA, 28 bp, Artificial Sequence
  Description of Artificial Sequence: Synthetic oligonucleotide
aacaggcagaaggagatcctggaggtgg

SEQ ID NO: 236253 - DNA, 27 bp, Artificial Sequence
  Description of Artificial Sequence: Synthetic oligonucleotide
acaggcagaaggagatcctggaggtgg

SEQ ID NO: 236254 - DNA, 27 bp, Artificial Sequence
  Description of Artificial Sequence: Synthetic oligonucleotide
caggcagaaggagatcctggaggtgga

SEQ ID NO: 236255 - DNA, 27 bp, Artificial Sequence
  Description of Artificial Sequence: Synthetic oligonucleotide
aggcagaaggagatcctggaggtggag

SEQ ID NO: 236256 - DNA, 26 bp, Artificial Sequence
  Description of Artificial Sequence: Synthetic oligonucleotide
ggcagaaggagatcctggaggtggag

SEQ ID NO: 236257 - DNA, 26 bp, Artificial Sequence
  Description of Artificial Sequence: Synthetic oligonucleotide
gcagaaggagatcctggaggtggagc

SEQ ID NO: 236258 - DNA, 26 bp, Artificial Sequence
  Description of Artificial Sequence: Synthetic oligonucleotide
cagaaggagatcctggaggtggagcg

SEQ ID NO: 236259 - DNA, 26 bp, Artificial Sequence
  Description of Artificial Sequence: Synthetic oligonucleotide
agaaggagatcctggaggtggagcgg

SEQ ID NO: 236260 - DNA, 25 bp, Artificial Sequence
  Description of Artificial Sequence: Synthetic oligonucleotide
gaaggagatcctggaggtggagcgg

SEQ ID NO: 236261 - DNA, 25 bp, Artificial Sequence
  Description of Artificial Sequence: Synthetic oligonucleotide
aaggagatcctggaggtggagcggg

SEQ ID NO: 236262 - DNA, 24 bp, Artificial Sequence
  Description of Artificial Sequence: Synthetic oligonucleotide
aggagatcctggaggtggagcggg

SEQ ID NO: 236263 - DNA, 23 bp, Artificial Sequence
  Description of Artificial Sequence: Synthetic oligonucleotide
ggagatcctggaggtggagcggg

SEQ ID NO: 236264 - DNA, 23 bp, Artificial Sequence
  Description of Artificial Sequence: Synthetic oligonucleotide
gagatcctggaggtggagcgggc

SEQ ID NO: 236265 - DNA, 24 bp, Artificial Sequence
  Description of Artificial Sequence: Synthetic oligonucleotide
agatcctggaggtggagcgggcgt

SEQ ID NO: 236266 - DNA, 23 bp, Artificial Sequence
  Description of Artificial Sequence: Synthetic oligonucleotide
gatcctggaggtggagcgggcgt

SEQ ID NO: 236267 - DNA, 23 bp, Artificial Sequence
  Description of Artificial Sequence: Synthetic oligonucleotide
atcctggaggtggagcgggcgtg

SEQ ID NO: 236268 - DNA, 22 bp, Artificial Sequence
  Description of Artificial Sequence: Synthetic oligonucleotide
tcctggaggtggagcgggcgtg

SEQ ID NO: 236269 - DNA, 21 bp, Artificial Sequence
  Description of Artificial Sequence: Synthetic oligonucleotide
cctggaggtggagcgggcgtg

SEQ ID NO: 236270 - DNA, 21 bp, Artificial Sequence
  Description of Artificial Sequence: Synthetic oligonucleotide
ctggaggtggagcgggcgtgc

SEQ ID NO: 236271 - DNA, 21 bp, Artificial Sequence
  Description of Artificial Sequence: Synthetic oligonucleotide
tggaggtggagcgggcgtgcc

SEQ ID NO: 236272 - DNA, 20 bp, Artificial Sequence
  Description of Artificial Sequence: Synthetic oligonucleotide
ggaggtggagcgggcgtgcc

SEQ ID NO: 236273 - DNA, 20 bp, Artificial Sequence
  Description of Artificial Sequence: Synthetic oligonucleotide
gaggtggagcgggcgtgccg

SEQ ID NO: 236274 - DNA, 21 bp, Artificial Sequence
  Description of Artificial Sequence: Synthetic oligonucleotide
aggtggagcgggcgtgccgga

SEQ ID NO: 236275 - DNA, 20 bp, Artificial Sequence
  Description of Artificial Sequence: Synthetic oligonucleotide
ggtggagcgggcgtgccgga

SEQ ID NO: 236276 - DNA, 21 bp, Artificial Sequence
  Description of Artificial Sequence: Synthetic oligonucleotide
gtggagcgggcgtgccggact

SEQ ID NO: 236277 - DNA, 21 bp, Artificial Sequence
  Description of Artificial Sequence: Synthetic oligonucleotide
tggagcgggcgtgccggactg

SEQ ID NO: 236278 - DNA, 20 bp, Artificial Sequence
  Description of Artificial Sequence: Synthetic oligonucleotide
ggagcgggcgtgccggactg

SEQ ID NO: 236279 - DNA, 24 bp, Artificial Sequence
  Description of Artificial Sequence: Synthetic oligonucleotide
gagcgggcgtgccggactggatat

SEQ ID NO: 236280 - DNA, 24 bp, Artificial Sequence
  Description of Artificial Sequence: Synthetic oligonucleotide
agcgggcgtgccggactggatatg

SEQ ID NO: 236281 - DNA, 23 bp, Artificial Sequence
  Description of Artificial Sequence: Synthetic oligonucleotide
gcgggcgtgccggactggatatg

SEQ ID NO: 236282 - DNA, 24 bp, Artificial Sequence
  Description of Artificial Sequence: Synthetic oligonucleotide
cgggcgtgccggactggatatgca

SEQ ID NO: 236283 - DNA, 25 bp, Artificial Sequence
  Description of Artificial Sequence: Synthetic oligonucleotide
gggcgtgccggactggatatgcaca

SEQ ID NO: 236284 - DNA, 26 bp, Artificial Sequence
  Description of Artificial Sequence: Synthetic oligonucleotide
ggcgtgccggactggatatgcacaca

SEQ ID NO: 236285 - DNA, 27 bp, Artificial Sequence
  Description of Artificial Sequence: Synthetic oligonucleotide
gcgtgccggactggatatgcacacaca

SEQ ID NO: 236286 - DNA, 28 bp, Artificial Sequence
  Description of Artificial Sequence: Synthetic oligonucleotide
cgtgccggactggatatgcacacacaac

SEQ ID NO: 236287 - DNA, 30 bp, Artificial Sequence
  Description of Artificial Sequence: Synthetic oligonucleotide
gtgccggactggatatgcacacacaactag

SEQ ID NO: 236288 - DNA, 30 bp, Artificial Sequence
  Description of Artificial Sequence: Synthetic oligonucleotide
tgccggactggatatgcacacacaactagg

SEQ ID NO: 236289 - DNA, 29 bp, Artificial Sequence
  Description of Artificial Sequence: Synthetic oligonucleotide
gccggactggatatgcacacacaactagg

SEQ ID NO: 236290 - DNA, 30 bp, Artificial Sequence
  Description of Artificial Sequence: Synthetic oligonucleotide
ccggactggatatgcacacacaactaggag

SEQ ID NO: 236291 - DNA, 30 bp, Artificial Sequence
  Description of Artificial Sequence: Synthetic oligonucleotide
cggactggatatgcacacacaactaggagc

SEQ ID NO: 236292 - DNA, 31 bp, Artificial Sequence
  Description of Artificial Sequence: Synthetic oligonucleotide
ggactggatatgcacacacaactaggagctg

SEQ ID NO: 236293 - DNA, 31 bp, Artificial Sequence
  Description of Artificial Sequence: Synthetic oligonucleotide
gactggatatgcacacacaactaggagctgg

SEQ ID NO: 236294 - DNA, 32 bp, Artificial Sequence
  Description of Artificial Sequence: Synthetic oligonucleotide
actggatatgcacacacaactaggagctggac

SEQ ID NO: 236295 - DNA, 31 bp, Artificial Sequence
  Description of Artificial Sequence: Synthetic oligonucleotide
ctggatatgcacacacaactaggagctggac

SEQ ID NO: 236296 - DNA, 31 bp, Artificial Sequence
  Description of Artificial Sequence: Synthetic oligonucleotide
tggatatgcacacacaactaggagctggacc

SEQ ID NO: 236297 - DNA, 30 bp, Artificial Sequence
  Description of Artificial Sequence: Synthetic oligonucleotide
ggatatgcacacacaactaggagctggacc

SEQ ID NO: 236298 - DNA, 31 bp, Artificial Sequence
  Description of Artificial Sequence: Synthetic oligonucleotide
gatatgcacacacaactaggagctggaccag

SEQ ID NO: 236299 - DNA, 31 bp, Artificial Sequence
  Description of Artificial Sequence: Synthetic oligonucleotide
atatgcacacacaactaggagctggaccagg

SEQ ID NO: 236300 - DNA, 30 bp, Artificial Sequence
  Description of Artificial Sequence: Synthetic oligonucleotide
tatgcacacacaactaggagctggaccagg

SEQ ID NO: 236301 - DNA, 29 bp, Artificial Sequence
  Description of Artificial Sequence: Synthetic oligonucleotide
atgcacacacaactaggagctggaccagg

SEQ ID NO: 236302 - DNA, 28 bp, Artificial Sequence
  Description of Artificial Sequence: Synthetic oligonucleotide
tgcacacacaactaggagctggaccagg

SEQ ID NO: 236303 - DNA, 27 bp, Artificial Sequence
  Description of Artificial Sequence: Synthetic oligonucleotide
gcacacacaactaggagctggaccagg

SEQ ID NO: 236304 - DNA, 27 bp, Artificial Sequence
  Description of Artificial Sequence: Synthetic oligonucleotide
cacacacaactaggagctggaccaggc

SEQ ID NO: 236305 - DNA, 27 bp, Artificial Sequence
  Description of Artificial Sequence: Synthetic oligonucleotide
acacacaactaggagctggaccaggcc

SEQ ID NO: 236306 - DNA, 26 bp, Artificial Sequence
  Description of Artificial Sequence: Synthetic oligonucleotide
cacacaactaggagctggaccaggcc

SEQ ID NO: 236307 - DNA, 27 bp, Artificial Sequence
  Description of Artificial Sequence: Synthetic oligonucleotide
acacaactaggagctggaccaggccgt

SEQ ID NO: 236308 - DNA, 26 bp, Artificial Sequence
  Description of Artificial Sequence: Synthetic oligonucleotide
cacaactaggagctggaccaggccgt

SEQ ID NO: 236309 - DNA, 27 bp, Artificial Sequence
  Description of Artificial Sequence: Synthetic oligonucleotide
acaactaggagctggaccaggccgtga

SEQ ID NO: 236310 - DNA, 26 bp, Artificial Sequence
  Description of Artificial Sequence: Synthetic oligonucleotide
caactaggagctggaccaggccgtga

SEQ ID NO: 236311 - DNA, 26 bp, Artificial Sequence
  Description of Artificial Sequence: Synthetic oligonucleotide
aactaggagctggaccaggccgtgag

SEQ ID NO: 236312 - DNA, 25 bp, Artificial Sequence
  Description of Artificial Sequence: Synthetic oligonucleotide
actaggagctggaccaggccgtgag

SEQ ID NO: 236313 - DNA, 24 bp, Artificial Sequence
  Description of Artificial Sequence: Synthetic oligonucleotide
ctaggagctggaccaggccgtgag

SEQ ID NO: 236314 - DNA, 24 bp, Artificial Sequence
  Description of Artificial Sequence: Synthetic oligonucleotide
taggagctggaccaggccgtgagc

SEQ ID NO: 236315 - DNA, 23 bp, Artificial Sequence
  Description of Artificial Sequence: Synthetic oligonucleotide
aggagctggaccaggccgtgagc

SEQ ID NO: 236316 - DNA, 22 bp, Artificial Sequence
  Description of Artificial Sequence: Synthetic oligonucleotide
ggagctggaccaggccgtgagc

SEQ ID NO: 236317 - DNA, 23 bp, Artificial Sequence
  Description of Artificial Sequence: Synthetic oligonucleotide
gagctggaccaggccgtgagcct

SEQ ID NO: 236318 - DNA, 23 bp, Artificial Sequence
  Description of Artificial Sequence: Synthetic oligonucleotide
agctggaccaggccgtgagcctg

SEQ ID NO: 236319 - DNA, 22 bp, Artificial Sequence
  Description of Artificial Sequence: Synthetic oligonucleotide
gctggaccaggccgtgagcctg

SEQ ID NO: 236320 - DNA, 23 bp, Artificial Sequence
  Description of Artificial Sequence: Synthetic oligonucleotide
ctggaccaggccgtgagcctgca

SEQ ID NO: 236321 - DNA, 23 bp, Artificial Sequence
  Description of Artificial Sequence: Synthetic oligonucleotide
tggaccaggccgtgagcctgcag

SEQ ID NO: 236322 - DNA, 22 bp, Artificial Sequence
  Description of Artificial Sequence: Synthetic oligonucleotide
ggaccaggccgtgagcctgcag

SEQ ID NO: 236323 - DNA, 22 bp, Artificial Sequence
  Description of Artificial Sequence: Synthetic oligonucleotide
gaccaggccgtgagcctgcagc

SEQ ID NO: 236324 - DNA, 22 bp, Artificial Sequence
  Description of Artificial Sequence: Synthetic oligonucleotide
accaggccgtgagcctgcagcg

SEQ ID NO: 236325 - DNA, 21 bp, Artificial Sequence
  Description of Artificial Sequence: Synthetic oligonucleotide
ccaggccgtgagcctgcagcg

SEQ ID NO: 236326 - DNA, 21 bp, Artificial Sequence
  Description of Artificial Sequence: Synthetic oligonucleotide
caggccgtgagcctgcagcgc

SEQ ID NO: 236327 - DNA, 22 bp, Artificial Sequence
  Description of Artificial Sequence: Synthetic oligonucleotide
aggccgtgagcctgcagcgcga

SEQ ID NO: 236328 - DNA, 21 bp, Artificial Sequence
  Description of Artificial Sequence: Synthetic oligonucleotide
ggccgtgagcctgcagcgcga

SEQ ID NO: 236329 - DNA, 22 bp, Artificial Sequence
  Description of Artificial Sequence: Synthetic oligonucleotide
gccgtgagcctgcagcgcgagt

SEQ ID NO: 236330 - DNA, 22 bp, Artificial Sequence
  Description of Artificial Sequence: Synthetic oligonucleotide
ccgtgagcctgcagcgcgagtc

SEQ ID NO: 236331 - DNA, 23 bp, Artificial Sequence
  Description of Artificial Sequence: Synthetic oligonucleotide
cgtgagcctgcagcgcgagtcca

SEQ ID NO: 236332 - DNA, 23 bp, Artificial Sequence
  Description of Artificial Sequence: Synthetic oligonucleotide
gtgagcctgcagcgcgagtccag

SEQ ID NO: 236333 - DNA, 23 bp, Artificial Sequence
  Description of Artificial Sequence: Synthetic oligonucleotide
tgagcctgcagcgcgagtccagg

SEQ ID NO: 236334 - DNA, 22 bp, Artificial Sequence
  Description of Artificial Sequence: Synthetic oligonucleotide
gagcctgcagcgcgagtccagg

SEQ ID NO: 236335 - DNA, 25 bp, Artificial Sequence
  Description of Artificial Sequence: Synthetic oligonucleotide
agcctgcagcgcgagtccaggctaa

SEQ ID NO: 236336 - DNA, 24 bp, Artificial Sequence
  Description of Artificial Sequence: Synthetic oligonucleotide
gcctgcagcgcgagtccaggctaa

SEQ ID NO: 236337 - DNA, 24 bp, Artificial Sequence
  Description of Artificial Sequence: Synthetic oligonucleotide
cctgcagcgcgagtccaggctaag

SEQ ID NO: 236338 - DNA, 25 bp, Artificial Sequence
  Description of Artificial Sequence: Synthetic oligonucleotide
ctgcagcgcgagtccaggctaaggt

SEQ ID NO: 236339 - DNA, 27 bp, Artificial Sequence
  Description of Artificial Sequence: Synthetic oligonucleotide
tgcagcgcgagtccaggctaaggtgat

SEQ ID NO: 236340 - DNA, 26 bp, Artificial Sequence
  Description of Artificial Sequence: Synthetic oligonucleotide
gcagcgcgagtccaggctaaggtgat

SEQ ID NO: 236341 - DNA, 26 bp, Artificial Sequence
  Description of Artificial Sequence: Synthetic oligonucleotide
cagcgcgagtccaggctaaggtgatc

SEQ ID NO: 236342 - DNA, 27 bp, Artificial Sequence
  Description of Artificial Sequence: Synthetic oligonucleotide
agcgcgagtccaggctaaggtgatcgt

SEQ ID NO: 236343 - DNA, 27 bp, Artificial Sequence
  Description of Artificial Sequence: Synthetic oligonucleotide
gcgcgagtccaggctaaggtgatcgtt

SEQ ID NO: 236344 - DNA, 28 bp, Artificial Sequence
  Description of Artificial Sequence: Synthetic oligonucleotide
cgcgagtccaggctaaggtgatcgtttc

SEQ ID NO: 236345 - DNA, 28 bp, Artificial Sequence
  Description of Artificial Sequence: Synthetic oligonucleotide
gcgagtccaggctaaggtgatcgtttcc

SEQ ID NO: 236346 - DNA, 28 bp, Artificial Sequence
  Description of Artificial Sequence: Synthetic oligonucleotide
cgagtccaggctaaggtgatcgtttccc

SEQ ID NO: 236347 - DNA, 28 bp, Artificial Sequence
  Description of Artificial Sequence: Synthetic oligonucleotide
gagtccaggctaaggtgatcgtttcccc

SEQ ID NO: 236348 - DNA, 28 bp, Artificial Sequence
  Description of Artificial Sequence: Synthetic oligonucleotide
agtccaggctaaggtgatcgtttccccg

SEQ ID NO: 236349 - DNA, 27 bp, Artificial Sequence
  Description of Artificial Sequence: Synthetic oligonucleotide
gtccaggctaaggtgatcgtttccccg

SEQ ID NO: 236350 - DNA, 28 bp, Artificial Sequence
  Description of Artificial Sequence: Synthetic oligonucleotide
tccaggctaaggtgatcgtttccccgtc

SEQ ID NO: 236351 - DNA, 27 bp, Artificial Sequence
  Description of Artificial Sequence: Synthetic oligonucleotide
ccaggctaaggtgatcgtttccccgtc

SEQ ID NO: 236352 - DNA, 27 bp, Artificial Sequence
  Description of Artificial Sequence: Synthetic oligonucleotide
caggctaaggtgatcgtttccccgtcc

SEQ ID NO: 236353 - DNA, 29 bp, Artificial Sequence
  Description of Artificial Sequence: Synthetic oligonucleotide
aggctaaggtgatcgtttccccgtccaag

SEQ ID NO: 236354 - DNA, 28 bp, Artificial Sequence
  Description of Artificial Sequence: Synthetic oligonucleotide
ggctaaggtgatcgtttccccgtccaag

SEQ ID NO: 236355 - DNA, 30 bp, Artificial Sequence
  Description of Artificial Sequence: Synthetic oligonucleotide
gctaaggtgatcgtttccccgtccaagaag

SEQ ID NO: 236356 - DNA, 30 bp, Artificial Sequence
  Description of Artificial Sequence: Synthetic oligonucleotide
ctaaggtgatcgtttccccgtccaagaagc

SEQ ID NO: 236357 - DNA, 30 bp, Artificial Sequence
  Description of Artificial Sequence: Synthetic oligonucleotide
taaggtgatcgtttccccgtccaagaagcg

SEQ ID NO: 236358 - DNA, 29 bp, Artificial Sequence
  Description of Artificial Sequence: Synthetic oligonucleotide
aaggtgatcgtttccccgtccaagaagcg

SEQ ID NO: 236359 - DNA, 28 bp, Artificial Sequence
  Description of Artificial Sequence: Synthetic oligonucleotide
aggtgatcgtttccccgtccaagaagcg

SEQ ID NO: 236360 - DNA, 27 bp, Artificial Sequence
  Description of Artificial Sequence: Synthetic oligonucleotide
ggtgatcgtttccccgtccaagaagcg

SEQ ID NO: 236361 - DNA, 27 bp, Artificial Sequence
  Description of Artificial Sequence: Synthetic oligonucleotide
gtgatcgtttccccgtccaagaagcgg

SEQ ID NO: 236362 - DNA, 27 bp, Artificial Sequence
  Description of Artificial Sequence: Synthetic oligonucleotide
tgatcgtttccccgtccaagaagcggc

SEQ ID NO: 236363 - DNA, 26 bp, Artificial Sequence
  Description of Artificial Sequence: Synthetic oligonucleotide
gatcgtttccccgtccaagaagcggc

SEQ ID NO: 236364 - DNA, 26 bp, Artificial Sequence
  Description of Artificial Sequence: Synthetic oligonucleotide
atcgtttccccgtccaagaagcggcc

SEQ ID NO: 236365 - DNA, 25 bp, Artificial Sequence
  Description of Artificial Sequence: Synthetic oligonucleotide
tcgtttccccgtccaagaagcggcc

SEQ ID NO: 236366 - DNA, 24 bp, Artificial Sequence
  Description of Artificial Sequence: Synthetic oligonucleotide
cgtttccccgtccaagaagcggcc

SEQ ID NO: 236367 - DNA, 24 bp, Artificial Sequence
  Description of Artificial Sequence: Synthetic oligonucleotide
gtttccccgtccaagaagcggccc

SEQ ID NO: 236368 - DNA, 25 bp, Artificial Sequence
  Description of Artificial Sequence: Synthetic oligonucleotide
tttccccgtccaagaagcggcccct

SEQ ID NO: 236369 - DNA, 24 bp, Artificial Sequence
  Description of Artificial Sequence: Synthetic oligonucleotide
ttccccgtccaagaagcggcccct

SEQ ID NO: 236370 - DNA, 23 bp, Artificial Sequence
  Description of Artificial Sequence: Synthetic oligonucleotide
tccccgtccaagaagcggcccct

SEQ ID NO: 236371 - DNA, 22 bp, Artificial Sequence
  Description of Artificial Sequence: Synthetic oligonucleotide
ccccgtccaagaagcggcccct

SEQ ID NO: 236372 - DNA, 22 bp, Artificial Sequence
  Description of Artificial Sequence: Synthetic oligonucleotide
cccgtccaagaagcggcccctg

SEQ ID NO: 236373 - DNA, 23 bp, Artificial Sequence
  Description of Artificial Sequence: Synthetic oligonucleotide
ccgtccaagaagcggcccctgct

SEQ ID NO: 236374 - DNA, 23 bp, Artificial Sequence
  Description of Artificial Sequence: Synthetic oligonucleotide
cgtccaagaagcggcccctgctg

SEQ ID NO: 236375 - DNA, 24 bp, Artificial Sequence
  Description of Artificial Sequence: Synthetic oligonucleotide
gtccaagaagcggcccctgctgca

SEQ ID NO: 236376 - DNA, 24 bp, Artificial Sequence
  Description of Artificial Sequence: Synthetic oligonucleotide
tccaagaagcggcccctgctgcac

SEQ ID NO: 236377 - DNA, 23 bp, Artificial Sequence
  Description of Artificial Sequence: Synthetic oligonucleotide
ccaagaagcggcccctgctgcac

SEQ ID NO: 236378 - DNA, 24 bp, Artificial Sequence
  Description of Artificial Sequence: Synthetic oligonucleotide
caagaagcggcccctgctgcacca

SEQ ID NO: 236379 - DNA, 26 bp, Artificial Sequence
  Description of Artificial Sequence: Synthetic oligonucleotide
aagaagcggcccctgctgcaccacaa

SEQ ID NO: 236380 - DNA, 25 bp, Artificial Sequence
  Description of Artificial Sequence: Synthetic oligonucleotide
agaagcggcccctgctgcaccacaa

SEQ ID NO: 236381 - DNA, 24 bp, Artificial Sequence
  Description of Artificial Sequence: Synthetic oligonucleotide
gaagcggcccctgctgcaccacaa

SEQ ID NO: 236382 - DNA, 25 bp, Artificial Sequence
  Description of Artificial Sequence: Synthetic oligonucleotide
aagcggcccctgctgcaccacaact

SEQ ID NO: 236383 - DNA, 24 bp, Artificial Sequence
  Description of Artificial Sequence: Synthetic oligonucleotide
agcggcccctgctgcaccacaact

SEQ ID NO: 236384 - DNA, 23 bp, Artificial Sequence
  Description of Artificial Sequence: Synthetic oligonucleotide
gcggcccctgctgcaccacaact

SEQ ID NO: 236385 - DNA, 23 bp, Artificial Sequence
  Description of Artificial Sequence: Synthetic oligonucleotide
cggcccctgctgcaccacaactg

SEQ ID NO: 236386 - DNA, 25 bp, Artificial Sequence
  Description of Artificial Sequence: Synthetic oligonucleotide
ggcccctgctgcaccacaactgctt

SEQ ID NO: 236387 - DNA, 26 bp, Artificial Sequence
  Description of Artificial Sequence: Synthetic oligonucleotide
gcccctgctgcaccacaactgcttgt

SEQ ID NO: 236388 - DNA, 27 bp, Artificial Sequence
  Description of Artificial Sequence: Synthetic oligonucleotide
cccctgctgcaccacaactgcttgtca

SEQ ID NO: 236389 - DNA, 27 bp, Artificial Sequence
  Description of Artificial Sequence: Synthetic oligonucleotide
ccctgctgcaccacaactgcttgtcag

SEQ ID NO: 236390 - DNA, 27 bp, Artificial Sequence
  Description of Artificial Sequence: Synthetic oligonucleotide
cctgctgcaccacaactgcttgtcagc

SEQ ID NO: 236391 - DNA, 27 bp, Artificial Sequence
  Description of Artificial Sequence: Synthetic oligonucleotide
ctgctgcaccacaactgcttgtcagcc

SEQ ID NO: 236392 - DNA, 28 bp, Artificial Sequence
  Description of Artificial Sequence: Synthetic oligonucleotide
tgctgcaccacaactgcttgtcagccac

SEQ ID NO: 236393 - DNA, 27 bp, Artificial Sequence
  Description of Artificial Sequence: Synthetic oligonucleotide
gctgcaccacaactgcttgtcagccac

SEQ ID NO: 236394 - DNA, 27 bp, Artificial Sequence
  Description of Artificial Sequence: Synthetic oligonucleotide
ctgcaccacaactgcttgtcagccacg

SEQ ID NO: 236395 - DNA, 28 bp, Artificial Sequence
  Description of Artificial Sequence: Synthetic oligonucleotide
tgcaccacaactgcttgtcagccacgtg

SEQ ID NO: 236396 - DNA, 27 bp, Artificial Sequence
  Description of Artificial Sequence: Synthetic oligonucleotide
gcaccacaactgcttgtcagccacgtg

SEQ ID NO: 236397 - DNA, 28 bp, Artificial Sequence
  Description of Artificial Sequence: Synthetic oligonucleotide
caccacaactgcttgtcagccacgtgag

SEQ ID NO: 236398 - DNA, 29 bp, Artificial Sequence
  Description of Artificial Sequence: Synthetic oligonucleotide
accacaactgcttgtcagccacgtgagag

SEQ ID NO: 236399 - DNA, 28 bp, Artificial Sequence
  Description of Artificial Sequence: Synthetic oligonucleotide
ccacaactgcttgtcagccacgtgagag

SEQ ID NO: 236400 - DNA, 32 bp, Artificial Sequence
  Description of Artificial Sequence: Synthetic oligonucleotide
cacaactgcttgtcagccacgtgagagatttc

SEQ ID NO: 236401 - DNA, 34 bp, Artificial Sequence
  Description of Artificial Sequence: Synthetic oligonucleotide
acaactgcttgtcagccacgtgagagatttctag

SEQ ID NO: 236402 - DNA, 33 bp, Artificial Sequence
  Description of Artificial Sequence: Synthetic oligonucleotide
caactgcttgtcagccacgtgagagatttctag

SEQ ID NO: 236403 - DNA, 33 bp, Artificial Sequence
  Description of Artificial Sequence: Synthetic oligonucleotide
aactgcttgtcagccacgtgagagatttctagc

SEQ ID NO: 236404 - DNA, 32 bp, Artificial Sequence
  Description of Artificial Sequence: Synthetic oligonucleotide
actgcttgtcagccacgtgagagatttctagc

SEQ ID NO: 236405 - DNA, 31 bp, Artificial Sequence
  Description of Artificial Sequence: Synthetic oligonucleotide
ctgcttgtcagccacgtgagagatttctagc

SEQ ID NO: 236406 - DNA, 31 bp, Artificial Sequence
  Description of Artificial Sequence: Synthetic oligonucleotide
tgcttgtcagccacgtgagagatttctagcc

SEQ ID NO: 236407 - DNA, 30 bp, Artificial Sequence
  Description of Artificial Sequence: Synthetic oligonucleotide
gcttgtcagccacgtgagagatttctagcc

SEQ ID NO: 236408 - DNA, 31 bp, Artificial Sequence
  Description of Artificial Sequence: Synthetic oligonucleotide
cttgtcagccacgtgagagatttctagccag

SEQ ID NO: 236409 - DNA, 31 bp, Artificial Sequence
  Description of Artificial Sequence: Synthetic oligonucleotide
ttgtcagccacgtgagagatttctagccagg

SEQ ID NO: 236410 - DNA, 30 bp, Artificial Sequence
  Description of Artificial Sequence: Synthetic oligonucleotide
tgtcagccacgtgagagatttctagccagg

SEQ ID NO: 236411 - DNA, 29 bp, Artificial Sequence
  Description of Artificial Sequence: Synthetic oligonucleotide
gtcagccacgtgagagatttctagccagg

SEQ ID NO: 236412 - DNA, 29 bp, Artificial Sequence
  Description of Artificial Sequence: Synthetic oligonucleotide
tcagccacgtgagagatttctagccaggc

SEQ ID NO: 236413 - DNA, 28 bp, Artificial Sequence
  Description of Artificial Sequence: Synthetic oligonucleotide
cagccacgtgagagatttctagccaggc

SEQ ID NO: 236414 - DNA, 29 bp, Artificial Sequence
  Description of Artificial Sequence: Synthetic oligonucleotide
agccacgtgagagatttctagccaggcag

SEQ ID NO: 236415 - DNA, 28 bp, Artificial Sequence
  Description of Artificial Sequence: Synthetic oligonucleotide
gccacgtgagagatttctagccaggcag

SEQ ID NO: 236416 - DNA, 28 bp, Artificial Sequence
  Description of Artificial Sequence: Synthetic oligonucleotide
ccacgtgagagatttctagccaggcagc

SEQ ID NO: 236417 - DNA, 31 bp, Artificial Sequence
  Description of Artificial Sequence: Synthetic oligonucleotide
cacgtgagagatttctagccaggcagctttc

SEQ ID NO: 236418 - DNA, 33 bp, Artificial Sequence
  Description of Artificial Sequence: Synthetic oligonucleotide
acgtgagagatttctagccaggcagctttcaag

SEQ ID NO: 236419 - DNA, 32 bp, Artificial Sequence
  Description of Artificial Sequence: Synthetic oligonucleotide
cgtgagagatttctagccaggcagctttcaag

SEQ ID NO: 236420 - DNA, 33 bp, Artificial Sequence
  Description of Artificial Sequence: Synthetic oligonucleotide
gtgagagatttctagccaggcagctttcaagtc

SEQ ID NO: 236421 - DNA, 33 bp, Artificial Sequence
  Description of Artificial Sequence: Synthetic oligonucleotide
tgagagatttctagccaggcagctttcaagtcc

SEQ ID NO: 236422 - DNA, 32 bp, Artificial Sequence
  Description of Artificial Sequence: Synthetic oligonucleotide
gagagatttctagccaggcagctttcaagtcc

SEQ ID NO: 236423 - DNA, 32 bp, Artificial Sequence
  Description of Artificial Sequence: Synthetic oligonucleotide
agagatttctagccaggcagctttcaagtccc

SEQ ID NO: 236424 - DNA, 31 bp, Artificial Sequence
  Description of Artificial Sequence: Synthetic oligonucleotide
gagatttctagccaggcagctttcaagtccc

SEQ ID NO: 236425 - DNA, 33 bp, Artificial Sequence
  Description of Artificial Sequence: Synthetic oligonucleotide
agatttctagccaggcagctttcaagtcccatg

SEQ ID NO: 236426 - DNA, 32 bp, Artificial Sequence
  Description of Artificial Sequence: Synthetic oligonucleotide
gatttctagccaggcagctttcaagtcccatg

SEQ ID NO: 236427 - DNA, 32 bp, Artificial Sequence
  Description of Artificial Sequence: Synthetic oligonucleotide
atttctagccaggcagctttcaagtcccatgg

SEQ ID NO: 236428 - DNA, 31 bp, Artificial Sequence
  Description of Artificial Sequence: Synthetic oligonucleotide
tttctagccaggcagctttcaagtcccatgg

SEQ ID NO: 236429 - DNA, 30 bp, Artificial Sequence
  Description of Artificial Sequence: Synthetic oligonucleotide
ttctagccaggcagctttcaagtcccatgg

SEQ ID NO: 236430 - DNA, 29 bp, Artificial Sequence
  Description of Artificial Sequence: Synthetic oligonucleotide
tctagccaggcagctttcaagtcccatgg

SEQ ID NO: 236431 - DNA, 28 bp, Artificial Sequence
  Description of Artificial Sequence: Synthetic oligonucleotide
ctagccaggcagctttcaagtcccatgg

SEQ ID NO: 236432 - DNA, 30 bp, Artificial Sequence
  Description of Artificial Sequence: Synthetic oligonucleotide
tagccaggcagctttcaagtcccatggttc

SEQ ID NO: 236433 - DNA, 29 bp, Artificial Sequence
  Description of Artificial Sequence: Synthetic oligonucleotide
agccaggcagctttcaagtcccatggttc

SEQ ID NO: 236434 - DNA, 28 bp, Artificial Sequence
  Description of Artificial Sequence: Synthetic oligonucleotide
gccaggcagctttcaagtcccatggttc

SEQ ID NO: 236435 - DNA, 28 bp, Artificial Sequence
  Description of Artificial Sequence: Synthetic oligonucleotide
ccaggcagctttcaagtcccatggttcc

SEQ ID NO: 236436 - DNA, 32 bp, Artificial Sequence
  Description of Artificial Sequence: Synthetic oligonucleotide
caggcagctttcaagtcccatggttcctaatg

SEQ ID NO: 236437 - DNA, 32 bp, Artificial Sequence
  Description of Artificial Sequence: Synthetic oligonucleotide
aggcagctttcaagtcccatggttcctaatgg

SEQ ID NO: 236438 - DNA, 31 bp, Artificial Sequence
  Description of Artificial Sequence: Synthetic oligonucleotide
ggcagctttcaagtcccatggttcctaatgg

SEQ ID NO: 236439 - DNA, 32 bp, Artificial Sequence
  Description of Artificial Sequence: Synthetic oligonucleotide
gcagctttcaagtcccatggttcctaatggac

SEQ ID NO: 236440 - DNA, 33 bp, Artificial Sequence
  Description of Artificial Sequence: Synthetic oligonucleotide
cagctttcaagtcccatggttcctaatggacag

SEQ ID NO: 236441 - DNA, 33 bp, Artificial Sequence
  Description of Artificial Sequence: Synthetic oligonucleotide
agctttcaagtcccatggttcctaatggacagc

SEQ ID NO: 236442 - DNA, 32 bp, Artificial Sequence
  Description of Artificial Sequence: Synthetic oligonucleotide
gctttcaagtcccatggttcctaatggacagc

SEQ ID NO: 236443 - DNA, 33 bp, Artificial Sequence
  Description of Artificial Sequence: Synthetic oligonucleotide
ctttcaagtcccatggttcctaatggacagcag

SEQ ID NO: 236444 - DNA, 33 bp, Artificial Sequence
  Description of Artificial Sequence: Synthetic oligonucleotide
tttcaagtcccatggttcctaatggacagcagg

SEQ ID NO: 236445 - DNA, 32 bp, Artificial Sequence
  Description of Artificial Sequence: Synthetic oligonucleotide
ttcaagtcccatggttcctaatggacagcagg

SEQ ID NO: 236446 - DNA, 31 bp, Artificial Sequence
  Description of Artificial Sequence: Synthetic oligonucleotide
tcaagtcccatggttcctaatggacagcagg

SEQ ID NO: 236447 - DNA, 30 bp, Artificial Sequence
  Description of Artificial Sequence: Synthetic oligonucleotide
caagtcccatggttcctaatggacagcagg

SEQ ID NO: 236448 - DNA, 33 bp, Artificial Sequence
  Description of Artificial Sequence: Synthetic oligonucleotide
aagtcccatggttcctaatggacagcaggaaac

SEQ ID NO: 236449 - DNA, 32 bp, Artificial Sequence
  Description of Artificial Sequence: Synthetic oligonucleotide
agtcccatggttcctaatggacagcaggaaac

SEQ ID NO: 236450 - DNA, 31 bp, Artificial Sequence
  Description of Artificial Sequence: Synthetic oligonucleotide
gtcccatggttcctaatggacagcaggaaac

SEQ ID NO: 236451 - DNA, 32 bp, Artificial Sequence
  Description of Artificial Sequence: Synthetic oligonucleotide
tcccatggttcctaatggacagcaggaaacag

SEQ ID NO: 236452 - DNA, 31 bp, Artificial Sequence
  Description of Artificial Sequence: Synthetic oligonucleotide
cccatggttcctaatggacagcaggaaacag

SEQ ID NO: 236453 - DNA, 31 bp, Artificial Sequence
  Description of Artificial Sequence: Synthetic oligonucleotide
ccatggttcctaatggacagcaggaaacagg

SEQ ID NO: 236454 - DNA, 32 bp, Artificial Sequence
  Description of Artificial Sequence: Synthetic oligonucleotide
catggttcctaatggacagcaggaaacaggtg

SEQ ID NO: 236455 - DNA, 32 bp, Artificial Sequence
  Description of Artificial Sequence: Synthetic oligonucleotide
atggttcctaatggacagcaggaaacaggtgg

SEQ ID NO: 236456 - DNA, 31 bp, Artificial Sequence
  Description of Artificial Sequence: Synthetic oligonucleotide
tggttcctaatggacagcaggaaacaggtgg

SEQ ID NO: 236457 - DNA, 30 bp, Artificial Sequence
  Description of Artificial Sequence: Synthetic oligonucleotide
ggttcctaatggacagcaggaaacaggtgg

SEQ ID NO: 236458 - DNA, 30 bp, Artificial Sequence
  Description of Artificial Sequence: Synthetic oligonucleotide
gttcctaatggacagcaggaaacaggtggg

SEQ ID NO: 236459 - DNA, 30 bp, Artificial Sequence
  Description of Artificial Sequence: Synthetic oligonucleotide
ttcctaatggacagcaggaaacaggtgggg

SEQ ID NO: 236460 - DNA, 29 bp, Artificial Sequence
  Description of Artificial Sequence: Synthetic oligonucleotide
tcctaatggacagcaggaaacaggtgggg

SEQ ID NO: 236461 - DNA, 28 bp, Artificial Sequence
  Description of Artificial Sequence: Synthetic oligonucleotide
cctaatggacagcaggaaacaggtgggg

SEQ ID NO: 236462 - DNA, 29 bp, Artificial Sequence
  Description of Artificial Sequence: Synthetic oligonucleotide
ctaatggacagcaggaaacaggtggggtc

SEQ ID NO: 236463 - DNA, 29 bp, Artificial Sequence
  Description of Artificial Sequence: Synthetic oligonucleotide
taatggacagcaggaaacaggtggggtcg

SEQ ID NO: 236464 - DNA, 28 bp, Artificial Sequence
  Description of Artificial Sequence: Synthetic oligonucleotide
aatggacagcaggaaacaggtggggtcg

SEQ ID NO: 236465 - DNA, 27 bp, Artificial Sequence
  Description of Artificial Sequence: Synthetic oligonucleotide
atggacagcaggaaacaggtggggtcg

SEQ ID NO: 236466 - DNA, 27 bp, Artificial Sequence
  Description of Artificial Sequence: Synthetic oligonucleotide
tggacagcaggaaacaggtggggtcgt

SEQ ID NO: 236467 - DNA, 26 bp, Artificial Sequence
  Description of Artificial Sequence: Synthetic oligonucleotide
ggacagcaggaaacaggtggggtcgt

SEQ ID NO: 236468 - DNA, 27 bp, Artificial Sequence
  Description of Artificial Sequence: Synthetic oligonucleotide
gacagcaggaaacaggtggggtcgtct

SEQ ID NO: 236469 - DNA, 27 bp, Artificial Sequence
  Description of Artificial Sequence: Synthetic oligonucleotide
acagcaggaaacaggtggggtcgtctc

SEQ ID NO: 236470 - DNA, 26 bp, Artificial Sequence
  Description of Artificial Sequence: Synthetic oligonucleotide
cagcaggaaacaggtggggtcgtctc

SEQ ID NO: 236471 - DNA, 27 bp, Artificial Sequence
  Description of Artificial Sequence: Synthetic oligonucleotide
agcaggaaacaggtggggtcgtctcca

SEQ ID NO: 236472 - DNA, 26 bp, Artificial Sequence
  Description of Artificial Sequence: Synthetic oligonucleotide
gcaggaaacaggtggggtcgtctcca

SEQ ID NO: 236473 - DNA, 26 bp, Artificial Sequence
  Description of Artificial Sequence: Synthetic oligonucleotide
caggaaacaggtggggtcgtctccac

SEQ ID NO: 236474 - DNA, 27 bp, Artificial Sequence
  Description of Artificial Sequence: Synthetic oligonucleotide
aggaaacaggtggggtcgtctccacca

SEQ ID NO: 236475 - DNA, 27 bp, Artificial Sequence
  Description of Artificial Sequence: Synthetic oligonucleotide
ggaaacaggtggggtcgtctccaccaa

SEQ ID NO: 236476 - DNA, 27 bp, Artificial Sequence
  Description of Artificial Sequence: Synthetic oligonucleotide
gaaacaggtggggtcgtctccaccaac

SEQ ID NO: 236477 - DNA, 27 bp, Artificial Sequence
  Description of Artificial Sequence: Synthetic oligonucleotide
aaacaggtggggtcgtctccaccaacg

SEQ ID NO: 236478 - DNA, 27 bp, Artificial Sequence
  Description of Artificial Sequence: Synthetic oligonucleotide
aacaggtggggtcgtctccaccaacgt

SEQ ID NO: 236479 - DNA, 26 bp, Artificial Sequence
  Description of Artificial Sequence: Synthetic oligonucleotide
acaggtggggtcgtctccaccaacgt

SEQ ID NO: 236480 - DNA, 25 bp, Artificial Sequence
  Description of Artificial Sequence: Synthetic oligonucleotide
caggtggggtcgtctccaccaacgt

SEQ ID NO: 236481 - DNA, 27 bp, Artificial Sequence
  Description of Artificial Sequence: Synthetic oligonucleotide
aggtggggtcgtctccaccaacgtgat

SEQ ID NO: 236482 - DNA, 26 bp, Artificial Sequence
  Description of Artificial Sequence: Synthetic oligonucleotide
ggtggggtcgtctccaccaacgtgat

SEQ ID NO: 236483 - DNA, 26 bp, Artificial Sequence
  Description of Artificial Sequence: Synthetic oligonucleotide
gtggggtcgtctccaccaacgtgatc

SEQ ID NO: 236484 - DNA, 26 bp, Artificial Sequence
  Description of Artificial Sequence: Synthetic oligonucleotide
tggggtcgtctccaccaacgtgatcc

SEQ ID NO: 236485 - DNA, 25 bp, Artificial Sequence
  Description of Artificial Sequence: Synthetic oligonucleotide
ggggtcgtctccaccaacgtgatcc

SEQ ID NO: 236486 - DNA, 27 bp, Artificial Sequence
  Description of Artificial Sequence: Synthetic oligonucleotide
gggtcgtctccaccaacgtgatccgta

SEQ ID NO: 236487 - DNA, 29 bp, Artificial Sequence
  Description of Artificial Sequence: Synthetic oligonucleotide
ggtcgtctccaccaacgtgatccgtattg

SEQ ID NO: 236488 - DNA, 29 bp, Artificial Sequence
  Description of Artificial Sequence: Synthetic oligonucleotide
gtcgtctccaccaacgtgatccgtattgg

SEQ ID NO: 236489 - DNA, 30 bp, Artificial Sequence
  Description of Artificial Sequence: Synthetic oligonucleotide
tcgtctccaccaacgtgatccgtattggag

SEQ ID NO: 236490 - DNA, 29 bp, Artificial Sequence
  Description of Artificial Sequence: Synthetic oligonucleotide
cgtctccaccaacgtgatccgtattggag

SEQ ID NO: 236491 - DNA, 30 bp, Artificial Sequence
  Description of Artificial Sequence: Synthetic oligonucleotide
gtctccaccaacgtgatccgtattggagac

SEQ ID NO: 236492 - DNA, 31 bp, Artificial Sequence
  Description of Artificial Sequence: Synthetic oligonucleotide
tctccaccaacgtgatccgtattggagactg

SEQ ID NO: 236493 - DNA, 30 bp, Artificial Sequence
  Description of Artificial Sequence: Synthetic oligonucleotide
ctccaccaacgtgatccgtattggagactg

SEQ ID NO: 236494 - DNA, 31 bp, Artificial Sequence
  Description of Artificial Sequence: Synthetic oligonucleotide
tccaccaacgtgatccgtattggagactgac

SEQ ID NO: 236495 - DNA, 30 bp, Artificial Sequence
  Description of Artificial Sequence: Synthetic oligonucleotide
ccaccaacgtgatccgtattggagactgac

SEQ ID NO: 236496 - DNA, 30 bp, Artificial Sequence
  Description of Artificial Sequence: Synthetic oligonucleotide
caccaacgtgatccgtattggagactgacc

SEQ ID NO: 236497 - DNA, 32 bp, Artificial Sequence
  Description of Artificial Sequence: Synthetic oligonucleotide
accaacgtgatccgtattggagactgaccttc

SEQ ID NO: 236498 - DNA, 31 bp, Artificial Sequence
  Description of Artificial Sequence: Synthetic oligonucleotide
ccaacgtgatccgtattggagactgaccttc

SEQ ID NO: 236499 - DNA, 31 bp, Artificial Sequence
  Description of Artificial Sequence: Synthetic oligonucleotide
caacgtgatccgtattggagactgaccttcc

SEQ ID NO: 236500 - DNA, 32 bp, Artificial Sequence
  Description of Artificial Sequence: Synthetic oligonucleotide
aacgtgatccgtattggagactgaccttccag

SEQ ID NO: 236501 - DNA, 31 bp, Artificial Sequence
  Description of Artificial Sequence: Synthetic oligonucleotide
acgtgatccgtattggagactgaccttccag

SEQ ID NO: 236502 - DNA, 30 bp, Artificial Sequence
  Description of Artificial Sequence: Synthetic oligonucleotide
cgtgatccgtattggagactgaccttccag

SEQ ID NO: 236503 - DNA, 32 bp, Artificial Sequence
  Description of Artificial Sequence: Synthetic oligonucleotide
gtgatccgtattggagactgaccttccagttc

SEQ ID NO: 236504 - DNA, 32 bp, Artificial Sequence
  Description of Artificial Sequence: Synthetic oligonucleotide
tgatccgtattggagactgaccttccagttcc

SEQ ID NO: 236505 - DNA, 31 bp, Artificial Sequence
  Description of Artificial Sequence: Synthetic oligonucleotide
gatccgtattggagactgaccttccagttcc

SEQ ID NO: 236506 - DNA, 32 bp, Artificial Sequence
  Description of Artificial Sequence: Synthetic oligonucleotide
atccgtattggagactgaccttccagttcctg

SEQ ID NO: 236507 - DNA, 31 bp, Artificial Sequence
  Description of Artificial Sequence: Synthetic oligonucleotide
tccgtattggagactgaccttccagttcctg

SEQ ID NO: 236508 - DNA, 30 bp, Artificial Sequence
  Description of Artificial Sequence: Synthetic oligonucleotide
ccgtattggagactgaccttccagttcctg

SEQ ID NO: 236509 - DNA, 30 bp, Artificial Sequence
  Description of Artificial Sequence: Synthetic oligonucleotide
cgtattggagactgaccttccagttcctgg

SEQ ID NO: 236510 - DNA, 31 bp, Artificial Sequence
  Description of Artificial Sequence: Synthetic oligonucleotide
gtattggagactgaccttccagttcctggtg

SEQ ID NO: 236511 - DNA, 33 bp, Artificial Sequence
  Description of Artificial Sequence: Synthetic oligonucleotide
tattggagactgaccttccagttcctggtgaag

SEQ ID NO: 236512 - DNA, 32 bp, Artificial Sequence
  Description of Artificial Sequence: Synthetic oligonucleotide
attggagactgaccttccagttcctggtgaag

SEQ ID NO: 236513 - DNA, 31 bp, Artificial Sequence
  Description of Artificial Sequence: Synthetic oligonucleotide
ttggagactgaccttccagttcctggtgaag

SEQ ID NO: 236514 - DNA, 30 bp, Artificial Sequence
  Description of Artificial Sequence: Synthetic oligonucleotide
tggagactgaccttccagttcctggtgaag

SEQ ID NO: 236515 - DNA, 29 bp, Artificial Sequence
  Description of Artificial Sequence: Synthetic oligonucleotide
ggagactgaccttccagttcctggtgaag

SEQ ID NO: 236516 - DNA, 29 bp, Artificial Sequence
  Description of Artificial Sequence: Synthetic oligonucleotide
gagactgaccttccagttcctggtgaagc

SEQ ID NO: 236517 - DNA, 30 bp, Artificial Sequence
  Description of Artificial Sequence: Synthetic oligonucleotide
agactgaccttccagttcctggtgaagctg

SEQ ID NO: 236518 - DNA, 29 bp, Artificial Sequence
  Description of Artificial Sequence: Synthetic oligonucleotide
gactgaccttccagttcctggtgaagctg

SEQ ID NO: 236519 - DNA, 29 bp, Artificial Sequence
  Description of Artificial Sequence: Synthetic oligonucleotide
actgaccttccagttcctggtgaagctgg

SEQ ID NO: 236520 - DNA, 28 bp, Artificial Sequence
  Description of Artificial Sequence: Synthetic oligonucleotide
ctgaccttccagttcctggtgaagctgg

SEQ ID NO: 236521 - DNA, 32 bp, Artificial Sequence
  Description of Artificial Sequence: Synthetic oligonucleotide
tgaccttccagttcctggtgaagctggaaatc

SEQ ID NO: 236522 - DNA, 31 bp, Artificial Sequence
  Description of Artificial Sequence: Synthetic oligonucleotide
gaccttccagttcctggtgaagctggaaatc

SEQ ID NO: 236523 - DNA, 32 bp, Artificial Sequence
  Description of Artificial Sequence: Synthetic oligonucleotide
accttccagttcctggtgaagctggaaatcac

SEQ ID NO: 236524 - DNA, 31 bp, Artificial Sequence
  Description of Artificial Sequence: Synthetic oligonucleotide
ccttccagttcctggtgaagctggaaatcac

SEQ ID NO: 236525 - DNA, 31 bp, Artificial Sequence
  Description of Artificial Sequence: Synthetic oligonucleotide
cttccagttcctggtgaagctggaaatcacc

SEQ ID NO: 236526 - DNA, 31 bp, Artificial Sequence
  Description of Artificial Sequence: Synthetic oligonucleotide
ttccagttcctggtgaagctggaaatcaccc

SEQ ID NO: 236527 - DNA, 30 bp, Artificial Sequence
  Description of Artificial Sequence: Synthetic oligonucleotide
tccagttcctggtgaagctggaaatcaccc

SEQ ID NO: 236528 - DNA, 29 bp, Artificial Sequence
  Description of Artificial Sequence: Synthetic oligonucleotide
ccagttcctggtgaagctggaaatcaccc

SEQ ID NO: 236529 - DNA, 29 bp, Artificial Sequence
  Description of Artificial Sequence: Synthetic oligonucleotide
cagttcctggtgaagctggaaatcacccc

SEQ ID NO: 236530 - DNA, 29 bp, Artificial Sequence
  Description of Artificial Sequence: Synthetic oligonucleotide
agttcctggtgaagctggaaatcaccccc

SEQ ID NO: 236531 - DNA, 28 bp, Artificial Sequence
  Description of Artificial Sequence: Synthetic oligonucleotide
gttcctggtgaagctggaaatcaccccc

SEQ ID NO: 236532 - DNA, 28 bp, Artificial Sequence
  Description of Artificial Sequence: Synthetic oligonucleotide
ttcctggtgaagctggaaatcacccccc

SEQ ID NO: 236533 - DNA, 27 bp, Artificial Sequence
  Description of Artificial Sequence: Synthetic oligonucleotide
tcctggtgaagctggaaatcacccccc

SEQ ID NO: 236534 - DNA, 27 bp, Artificial Sequence
  Description of Artificial Sequence: Synthetic oligonucleotide
cctggtgaagctggaaatcacccccca

SEQ ID NO: 236535 - DNA, 27 bp, Artificial Sequence
  Description of Artificial Sequence: Synthetic oligonucleotide
ctggtgaagctggaaatcaccccccag

SEQ ID NO: 236536 - DNA, 27 bp, Artificial Sequence
  Description of Artificial Sequence: Synthetic oligonucleotide
tggtgaagctggaaatcaccccccagg

SEQ ID NO: 236537 - DNA, 27 bp, Artificial Sequence
  Description of Artificial Sequence: Synthetic oligonucleotide
ggtgaagctggaaatcaccccccagga

SEQ ID NO: 236538 - DNA, 27 bp, Artificial Sequence
  Description of Artificial Sequence: Synthetic oligonucleotide
gtgaagctggaaatcaccccccaggag

SEQ ID NO: 236539 - DNA, 27 bp, Artificial Sequence
  Description of Artificial Sequence: Synthetic oligonucleotide
tgaagctggaaatcaccccccaggagg

SEQ ID NO: 236540 - DNA, 26 bp, Artificial Sequence
  Description of Artificial Sequence: Synthetic oligonucleotide
gaagctggaaatcaccccccaggagg

SEQ ID NO: 236541 - DNA, 27 bp, Artificial Sequence
  Description of Artificial Sequence: Synthetic oligonucleotide
aagctggaaatcaccccccaggaggga

SEQ ID NO: 236542 - DNA, 26 bp, Artificial Sequence
  Description of Artificial Sequence: Synthetic oligonucleotide
agctggaaatcaccccccaggaggga

SEQ ID NO: 236543 - DNA, 25 bp, Artificial Sequence
  Description of Artificial Sequence: Synthetic oligonucleotide
gctggaaatcaccccccaggaggga

SEQ ID NO: 236544 - DNA, 26 bp, Artificial Sequence
  Description of Artificial Sequence: Synthetic oligonucleotide
ctggaaatcaccccccaggagggaga

SEQ ID NO: 236545 - DNA, 26 bp, Artificial Sequence
  Description of Artificial Sequence: Synthetic oligonucleotide
tggaaatcaccccccaggagggagac

SEQ ID NO: 236546 - DNA, 25 bp, Artificial Sequence
  Description of Artificial Sequence: Synthetic oligonucleotide
ggaaatcaccccccaggagggagac

SEQ ID NO: 236547 - DNA, 26 bp, Artificial Sequence
  Description of Artificial Sequence: Synthetic oligonucleotide
gaaatcaccccccaggagggagacga

SEQ ID NO: 236548 - DNA, 27 bp, Artificial Sequence
  Description of Artificial Sequence: Synthetic oligonucleotide
aaatcaccccccaggagggagacgact

SEQ ID NO: 236549 - DNA, 27 bp, Artificial Sequence
  Description of Artificial Sequence: Synthetic oligonucleotide
aatcaccccccaggagggagacgacta

SEQ ID NO: 236550 - DNA, 26 bp, Artificial Sequence
  Description of Artificial Sequence: Synthetic oligonucleotide
atcaccccccaggagggagacgacta

SEQ ID NO: 236551 - DNA, 25 bp, Artificial Sequence
  Description of Artificial Sequence: Synthetic oligonucleotide
tcaccccccaggagggagacgacta

SEQ ID NO: 236552 - DNA, 24 bp, Artificial Sequence
  Description of Artificial Sequence: Synthetic oligonucleotide
caccccccaggagggagacgacta

SEQ ID NO: 236553 - DNA, 26 bp, Artificial Sequence
  Description of Artificial Sequence: Synthetic oligonucleotide
accccccaggagggagacgactacat

SEQ ID NO: 236554 - DNA, 25 bp, Artificial Sequence
  Description of Artificial Sequence: Synthetic oligonucleotide
ccccccaggagggagacgactacat

SEQ ID NO: 236555 - DNA, 26 bp, Artificial Sequence
  Description of Artificial Sequence: Synthetic oligonucleotide
cccccaggagggagacgactacatct

SEQ ID NO: 236556 - DNA, 26 bp, Artificial Sequence
  Description of Artificial Sequence: Synthetic oligonucleotide
ccccaggagggagacgactacatctg

SEQ ID NO: 236557 - DNA, 27 bp, Artificial Sequence
  Description of Artificial Sequence: Synthetic oligonucleotide
cccaggagggagacgactacatctgca

SEQ ID NO: 236558 - DNA, 28 bp, Artificial Sequence
  Description of Artificial Sequence: Synthetic oligonucleotide
ccaggagggagacgactacatctgcaag

SEQ ID NO: 236559 - DNA, 29 bp, Artificial Sequence
  Description of Artificial Sequence: Synthetic oligonucleotide
caggagggagacgactacatctgcaagtg

SEQ ID NO: 236560 - DNA, 29 bp, Artificial Sequence
  Description of Artificial Sequence: Synthetic oligonucleotide
aggagggagacgactacatctgcaagtgg

SEQ ID NO: 236561 - DNA, 28 bp, Artificial Sequence
  Description of Artificial Sequence: Synthetic oligonucleotide
ggagggagacgactacatctgcaagtgg

SEQ ID NO: 236562 - DNA, 29 bp, Artificial Sequence
  Description of Artificial Sequence: Synthetic oligonucleotide
gagggagacgactacatctgcaagtggag

SEQ ID NO: 236563 - DNA, 29 bp, Artificial Sequence
  Description of Artificial Sequence: Synthetic oligonucleotide
agggagacgactacatctgcaagtggagg

SEQ ID NO: 236564 - DNA, 28 bp, Artificial Sequence
  Description of Artificial Sequence: Synthetic oligonucleotide
gggagacgactacatctgcaagtggagg

SEQ ID NO: 236565 - DNA, 29 bp, Artificial Sequence
  Description of Artificial Sequence: Synthetic oligonucleotide
ggagacgactacatctgcaagtggaggac

SEQ ID NO: 236566 - DNA, 30 bp, Artificial Sequence
  Description of Artificial Sequence: Synthetic oligonucleotide
gagacgactacatctgcaagtggaggacac

SEQ ID NO: 236567 - DNA, 30 bp, Artificial Sequence
  Description of Artificial Sequence: Synthetic oligonucleotide
agacgactacatctgcaagtggaggacacc

SEQ ID NO: 236568 - DNA, 29 bp, Artificial Sequence
  Description of Artificial Sequence: Synthetic oligonucleotide
gacgactacatctgcaagtggaggacacc

SEQ ID NO: 236569 - DNA, 30 bp, Artificial Sequence
  Description of Artificial Sequence: Synthetic oligonucleotide
acgactacatctgcaagtggaggacaccag

SEQ ID NO: 236570 - DNA, 29 bp, Artificial Sequence
  Description of Artificial Sequence: Synthetic oligonucleotide
cgactacatctgcaagtggaggacaccag

SEQ ID NO: 236571 - DNA, 29 bp, Artificial Sequence
  Description of Artificial Sequence: Synthetic oligonucleotide
gactacatctgcaagtggaggacaccagc

SEQ ID NO: 236572 - DNA, 29 bp, Artificial Sequence
  Description of Artificial Sequence: Synthetic oligonucleotide
actacatctgcaagtggaggacaccagcc

SEQ ID NO: 236573 - DNA, 28 bp, Artificial Sequence
  Description of Artificial Sequence: Synthetic oligonucleotide
ctacatctgcaagtggaggacaccagcc

SEQ ID NO: 236574 - DNA, 29 bp, Artificial Sequence
  Description of Artificial Sequence: Synthetic oligonucleotide
tacatctgcaagtggaggacaccagccag

SEQ ID NO: 236575 - DNA, 28 bp, Artificial Sequence
  Description of Artificial Sequence: Synthetic oligonucleotide
acatctgcaagtggaggacaccagccag

SEQ ID NO: 236576 - DNA, 27 bp, Artificial Sequence
  Description of Artificial Sequence: Synthetic oligonucleotide
catctgcaagtggaggacaccagccag

SEQ ID NO: 236577 - DNA, 27 bp, Artificial Sequence
  Description of Artificial Sequence: Synthetic oligonucleotide
atctgcaagtggaggacaccagccagg

SEQ ID NO: 236578 - DNA, 27 bp, Artificial Sequence
  Description of Artificial Sequence: Synthetic oligonucleotide
tctgcaagtggaggacaccagccagga

SEQ ID NO: 236579 - DNA, 26 bp, Artificial Sequence
  Description of Artificial Sequence: Synthetic oligonucleotide
ctgcaagtggaggacaccagccagga

SEQ ID NO: 236580 - DNA, 27 bp, Artificial Sequence
  Description of Artificial Sequence: Synthetic oligonucleotide
tgcaagtggaggacaccagccaggaca

SEQ ID NO: 236581 - DNA, 26 bp, Artificial Sequence
  Description of Artificial Sequence: Synthetic oligonucleotide
gcaagtggaggacaccagccaggaca

SEQ ID NO: 236582 - DNA, 27 bp, Artificial Sequence
  Description of Artificial Sequence: Synthetic oligonucleotide
caagtggaggacaccagccaggacagt

SEQ ID NO: 236583 - DNA, 27 bp, Artificial Sequence
  Description of Artificial Sequence: Synthetic oligonucleotide
aagtggaggacaccagccaggacagtc

SEQ ID NO: 236584 - DNA, 26 bp, Artificial Sequence
  Description of Artificial Sequence: Synthetic oligonucleotide
agtggaggacaccagccaggacagtc

SEQ ID NO: 236585 - DNA, 25 bp, Artificial Sequence
  Description of Artificial Sequence: Synthetic oligonucleotide
gtggaggacaccagccaggacagtc

SEQ ID NO: 236586 - DNA, 26 bp, Artificial Sequence
  Description of Artificial Sequence: Synthetic oligonucleotide
tggaggacaccagccaggacagtcca

SEQ ID NO: 236587 - DNA, 25 bp, Artificial Sequence
  Description of Artificial Sequence: Synthetic oligonucleotide
ggaggacaccagccaggacagtcca

SEQ ID NO: 236588 - DNA, 26 bp, Artificial Sequence
  Description of Artificial Sequence: Synthetic oligonucleotide
gaggacaccagccaggacagtccagt

SEQ ID NO: 236589 - DNA, 27 bp, Artificial Sequence
  Description of Artificial Sequence: Synthetic oligonucleotide
aggacaccagccaggacagtccagtca

SEQ ID NO: 236590 - DNA, 26 bp, Artificial Sequence
  Description of Artificial Sequence: Synthetic oligonucleotide
ggacaccagccaggacagtccagtca

SEQ ID NO: 236591 - DNA, 26 bp, Artificial Sequence
  Description of Artificial Sequence: Synthetic oligonucleotide
gacaccagccaggacagtccagtcac

SEQ ID NO: 236592 - DNA, 26 bp, Artificial Sequence
  Description of Artificial Sequence: Synthetic oligonucleotide
acaccagccaggacagtccagtcacc

SEQ ID NO: 236593 - DNA, 25 bp, Artificial Sequence
  Description of Artificial Sequence: Synthetic oligonucleotide
caccagccaggacagtccagtcacc

SEQ ID NO: 236594 - DNA, 26 bp, Artificial Sequence
  Description of Artificial Sequence: Synthetic oligonucleotide
accagccaggacagtccagtcaccgt

SEQ ID NO: 236595 - DNA, 25 bp, Artificial Sequence
  Description of Artificial Sequence: Synthetic oligonucleotide
ccagccaggacagtccagtcaccgt

SEQ ID NO: 236596 - DNA, 25 bp, Artificial Sequence
  Description of Artificial Sequence: Synthetic oligonucleotide
cagccaggacagtccagtcaccgtg

SEQ ID NO: 236597 - DNA, 26 bp, Artificial Sequence
  Description of Artificial Sequence: Synthetic oligonucleotide
agccaggacagtccagtcaccgtgca

SEQ ID NO: 236598 - DNA, 25 bp, Artificial Sequence
  Description of Artificial Sequence: Synthetic oligonucleotide
gccaggacagtccagtcaccgtgca

SEQ ID NO: 236599 - DNA, 26 bp, Artificial Sequence
  Description of Artificial Sequence: Synthetic oligonucleotide
ccaggacagtccagtcaccgtgcagt

SEQ ID NO: 236600 - DNA, 26 bp, Artificial Sequence
  Description of Artificial Sequence: Synthetic oligonucleotide
caggacagtccagtcaccgtgcagtg

SEQ ID NO: 236601 - DNA, 27 bp, Artificial Sequence
  Description of Artificial Sequence: Synthetic oligonucleotide
aggacagtccagtcaccgtgcagtgga

SEQ ID NO: 236602 - DNA, 27 bp, Artificial Sequence
  Description of Artificial Sequence: Synthetic oligonucleotide
ggacagtccagtcaccgtgcagtggaa

SEQ ID NO: 236603 - DNA, 27 bp, Artificial Sequence
  Description of Artificial Sequence: Synthetic oligonucleotide
gacagtccagtcaccgtgcagtggaag

SEQ ID NO: 236604 - DNA, 27 bp, Artificial Sequence
  Description of Artificial Sequence: Synthetic oligonucleotide
acagtccagtcaccgtgcagtggaagg

SEQ ID NO: 236605 - DNA, 26 bp, Artificial Sequence
  Description of Artificial Sequence: Synthetic oligonucleotide
cagtccagtcaccgtgcagtggaagg

SEQ ID NO: 236606 - DNA, 27 bp, Artificial Sequence
  Description of Artificial Sequence: Synthetic oligonucleotide
agtccagtcaccgtgcagtggaaggga

SEQ ID NO: 236607 - DNA, 26 bp, Artificial Sequence
  Description of Artificial Sequence: Synthetic oligonucleotide
gtccagtcaccgtgcagtggaaggga

SEQ ID NO: 236608 - DNA, 27 bp, Artificial Sequence
  Description of Artificial Sequence: Synthetic oligonucleotide
tccagtcaccgtgcagtggaagggaca

SEQ ID NO: 236609 - DNA, 26 bp, Artificial Sequence
  Description of Artificial Sequence: Synthetic oligonucleotide
ccagtcaccgtgcagtggaagggaca

SEQ ID NO: 236610 - DNA, 27 bp, Artificial Sequence
  Description of Artificial Sequence: Synthetic oligonucleotide
cagtcaccgtgcagtggaagggacagt

SEQ ID NO: 236611 - DNA, 27 bp, Artificial Sequence
  Description of Artificial Sequence: Synthetic oligonucleotide
agtcaccgtgcagtggaagggacagtc

SEQ ID NO: 236612 - DNA, 27 bp, Artificial Sequence
  Description of Artificial Sequence: Synthetic oligonucleotide
gtcaccgtgcagtggaagggacagtct

SEQ ID NO: 236613 - DNA, 27 bp, Artificial Sequence
  Description of Artificial Sequence: Synthetic oligonucleotide
tcaccgtgcagtggaagggacagtctg

SEQ ID NO: 236614 - DNA, 27 bp, Artificial Sequence
  Description of Artificial Sequence: Synthetic oligonucleotide
caccgtgcagtggaagggacagtctga

SEQ ID NO: 236615 - DNA, 28 bp, Artificial Sequence
  Description of Artificial Sequence: Synthetic oligonucleotide
accgtgcagtggaagggacagtctgatc

SEQ ID NO: 236616 - DNA, 27 bp, Artificial Sequence
  Description of Artificial Sequence: Synthetic oligonucleotide
ccgtgcagtggaagggacagtctgatc

SEQ ID NO: 236617 - DNA, 28 bp, Artificial Sequence
  Description of Artificial Sequence: Synthetic oligonucleotide
cgtgcagtggaagggacagtctgatctg

SEQ ID NO: 236618 - DNA, 28 bp, Artificial Sequence
  Description of Artificial Sequence: Synthetic oligonucleotide
gtgcagtggaagggacagtctgatctgc

SEQ ID NO: 236619 - DNA, 28 bp, Artificial Sequence
  Description of Artificial Sequence: Synthetic oligonucleotide
tgcagtggaagggacagtctgatctgcc

SEQ ID NO: 236620 - DNA, 27 bp, Artificial Sequence
  Description of Artificial Sequence: Synthetic oligonucleotide
gcagtggaagggacagtctgatctgcc

SEQ ID NO: 236621 - DNA, 27 bp, Artificial Sequence
  Description of Artificial Sequence: Synthetic oligonucleotide
cagtggaagggacagtctgatctgccc

SEQ ID NO: 236622 - DNA, 27 bp, Artificial Sequence
  Description of Artificial Sequence: Synthetic oligonucleotide
agtggaagggacagtctgatctgcccg

SEQ ID NO: 236623 - DNA, 26 bp, Artificial Sequence
  Description of Artificial Sequence: Synthetic oligonucleotide
gtggaagggacagtctgatctgcccg

SEQ ID NO: 236624 - DNA, 27 bp, Artificial Sequence
  Description of Artificial Sequence: Synthetic oligonucleotide
tggaagggacagtctgatctgcccggt

SEQ ID NO: 236625 - DNA, 26 bp, Artificial Sequence
  Description of Artificial Sequence: Synthetic oligonucleotide
ggaagggacagtctgatctgcccggt

SEQ ID NO: 236626 - DNA, 27 bp, Artificial Sequence
  Description of Artificial Sequence: Synthetic oligonucleotide
gaagggacagtctgatctgcccggtgt

SEQ ID NO: 236627 - DNA, 29 bp, Artificial Sequence
  Description of Artificial Sequence: Synthetic oligonucleotide
aagggacagtctgatctgcccggtgtaag

SEQ ID NO: 236628 - DNA, 28 bp, Artificial Sequence
  Description of Artificial Sequence: Synthetic oligonucleotide
agggacagtctgatctgcccggtgtaag

SEQ ID NO: 236629 - DNA, 27 bp, Artificial Sequence
  Description of Artificial Sequence: Synthetic oligonucleotide
gggacagtctgatctgcccggtgtaag

SEQ ID NO: 236630 - DNA, 28 bp, Artificial Sequence
  Description of Artificial Sequence: Synthetic oligonucleotide
ggacagtctgatctgcccggtgtaagac

SEQ ID NO: 236631 - DNA, 31 bp, Artificial Sequence
  Description of Artificial Sequence: Synthetic oligonucleotide
gacagtctgatctgcccggtgtaagacatag

SEQ ID NO: 236632 - DNA, 32 bp, Artificial Sequence
  Description of Artificial Sequence: Synthetic oligonucleotide
acagtctgatctgcccggtgtaagacatagac

SEQ ID NO: 236633 - DNA, 31 bp, Artificial Sequence
  Description of Artificial Sequence: Synthetic oligonucleotide
cagtctgatctgcccggtgtaagacatagac

SEQ ID NO: 236634 - DNA, 31 bp, Artificial Sequence
  Description of Artificial Sequence: Synthetic oligonucleotide
agtctgatctgcccggtgtaagacatagacg

SEQ ID NO: 236635 - DNA, 30 bp, Artificial Sequence
  Description of Artificial Sequence: Synthetic oligonucleotide
gtctgatctgcccggtgtaagacatagacg

SEQ ID NO: 236636 - DNA, 30 bp, Artificial Sequence
  Description of Artificial Sequence: Synthetic oligonucleotide
tctgatctgcccggtgtaagacatagacgg

SEQ ID NO: 236637 - DNA, 29 bp, Artificial Sequence
  Description of Artificial Sequence: Synthetic oligonucleotide
ctgatctgcccggtgtaagacatagacgg

SEQ ID NO: 236638 - DNA, 29 bp, Artificial Sequence
  Description of Artificial Sequence: Synthetic oligonucleotide
tgatctgcccggtgtaagacatagacggg

SEQ ID NO: 236639 - DNA, 28 bp, Artificial Sequence
  Description of Artificial Sequence: Synthetic oligonucleotide
gatctgcccggtgtaagacatagacggg

SEQ ID NO: 236640 - DNA, 29 bp, Artificial Sequence
  Description of Artificial Sequence: Synthetic oligonucleotide
atctgcccggtgtaagacatagacgggag

SEQ ID NO: 236641 - DNA, 28 bp, Artificial Sequence
  Description of Artificial Sequence: Synthetic oligonucleotide
tctgcccggtgtaagacatagacgggag

SEQ ID NO: 236642 - DNA, 27 bp, Artificial Sequence
  Description of Artificial Sequence: Synthetic oligonucleotide
ctgcccggtgtaagacatagacgggag

SEQ ID NO: 236643 - DNA, 27 bp, Artificial Sequence
  Description of Artificial Sequence: Synthetic oligonucleotide
tgcccggtgtaagacatagacgggagc

SEQ ID NO: 236644 - DNA, 27 bp, Artificial Sequence
  Description of Artificial Sequence: Synthetic oligonucleotide
gcccggtgtaagacatagacgggagca

SEQ ID NO: 236645 - DNA, 27 bp, Artificial Sequence
  Description of Artificial Sequence: Synthetic oligonucleotide
cccggtgtaagacatagacgggagcag

SEQ ID NO: 236646 - DNA, 27 bp, Artificial Sequence
  Description of Artificial Sequence: Synthetic oligonucleotide
ccggtgtaagacatagacgggagcagg

SEQ ID NO: 236647 - DNA, 27 bp, Artificial Sequence
  Description of Artificial Sequence: Synthetic oligonucleotide
cggtgtaagacatagacgggagcaggg

SEQ ID NO: 236648 - DNA, 27 bp, Artificial Sequence
  Description of Artificial Sequence: Synthetic oligonucleotide
ggtgtaagacatagacgggagcagggg

SEQ ID NO: 236649 - DNA, 27 bp, Artificial Sequence
  Description of Artificial Sequence: Synthetic oligonucleotide
gtgtaagacatagacgggagcaggggg

SEQ ID NO: 236650 - DNA, 27 bp, Artificial Sequence
  Description of Artificial Sequence: Synthetic oligonucleotide
tgtaagacatagacgggagcagggggc

SEQ ID NO: 236651 - DNA, 27 bp, Artificial Sequence
  Description of Artificial Sequence: Synthetic oligonucleotide
gtaagacatagacgggagcagggggct

SEQ ID NO: 236652 - DNA, 28 bp, Artificial Sequence
  Description of Artificial Sequence: Synthetic oligonucleotide
taagacatagacgggagcagggggcttg

SEQ ID NO: 236653 - DNA, 27 bp, Artificial Sequence
  Description of Artificial Sequence: Synthetic oligonucleotide
aagacatagacgggagcagggggcttg

SEQ ID NO: 236654 - DNA, 26 bp, Artificial Sequence
  Description of Artificial Sequence: Synthetic oligonucleotide
agacatagacgggagcagggggcttg

SEQ ID NO: 236655 - DNA, 25 bp, Artificial Sequence
  Description of Artificial Sequence: Synthetic oligonucleotide
gacatagacgggagcagggggcttg

SEQ ID NO: 236656 - DNA, 26 bp, Artificial Sequence
  Description of Artificial Sequence: Synthetic oligonucleotide
acatagacgggagcagggggcttggt

SEQ ID NO: 236657 - DNA, 25 bp, Artificial Sequence
  Description of Artificial Sequence: Synthetic oligonucleotide
catagacgggagcagggggcttggt

SEQ ID NO: 236658 - DNA, 25 bp, Artificial Sequence
  Description of Artificial Sequence: Synthetic oligonucleotide
atagacgggagcagggggcttggtg

SEQ ID NO: 236659 - DNA, 24 bp, Artificial Sequence
  Description of Artificial Sequence: Synthetic oligonucleotide
tagacgggagcagggggcttggtg

SEQ ID NO: 236660 - DNA, 23 bp, Artificial Sequence
  Description of Artificial Sequence: Synthetic oligonucleotide
agacgggagcagggggcttggtg

SEQ ID NO: 236661 - DNA, 22 bp, Artificial Sequence
  Description of Artificial Sequence: Synthetic oligonucleotide
gacgggagcagggggcttggtg

SEQ ID NO: 236662 - DNA, 23 bp, Artificial Sequence
  Description of Artificial Sequence: Synthetic oligonucleotide
acgggagcagggggcttggtgct

SEQ ID NO: 236663 - DNA, 22 bp, Artificial Sequence
  Description of Artificial Sequence: Synthetic oligonucleotide
cgggagcagggggcttggtgct

SEQ ID NO: 236664 - DNA, 22 bp, Artificial Sequence
  Description of Artificial Sequence: Synthetic oligonucleotide
gggagcagggggcttggtgctg

SEQ ID NO: 236665 - DNA, 22 bp, Artificial Sequence
  Description of Artificial Sequence: Synthetic oligonucleotide
ggagcagggggcttggtgctgg

SEQ ID NO: 236666 - DNA, 22 bp, Artificial Sequence
  Description of Artificial Sequence: Synthetic oligonucleotide
gagcagggggcttggtgctggg

SEQ ID NO: 236667 - DNA, 22 bp, Artificial Sequence
  Description of Artificial Sequence: Synthetic oligonucleotide
agcagggggcttggtgctgggg

SEQ ID NO: 236668 - DNA, 21 bp, Artificial Sequence
  Description of Artificial Sequence: Synthetic oligonucleotide
gcagggggcttggtgctgggg

SEQ ID NO: 236669 - DNA, 22 bp, Artificial Sequence
  Description of Artificial Sequence: Synthetic oligonucleotide
cagggggcttggtgctggggca

SEQ ID NO: 236670 - DNA, 24 bp, Artificial Sequence
  Description of Artificial Sequence: Synthetic oligonucleotide
agggggcttggtgctggggcacat

SEQ ID NO: 236671 - DNA, 23 bp, Artificial Sequence
  Description of Artificial Sequence: Synthetic oligonucleotide
gggggcttggtgctggggcacat

SEQ ID NO: 236672 - DNA, 25 bp, Artificial Sequence
  Description of Artificial Sequence: Synthetic oligonucleotide
ggggcttggtgctggggcacatcat

SEQ ID NO: 236673 - DNA, 26 bp, Artificial Sequence
  Description of Artificial Sequence: Synthetic oligonucleotide
gggcttggtgctggggcacatcatct

SEQ ID NO: 236674 - DNA, 26 bp, Artificial Sequence
  Description of Artificial Sequence: Synthetic oligonucleotide
ggcttggtgctggggcacatcatctg

SEQ ID NO: 236675 - DNA, 26 bp, Artificial Sequence
  Description of Artificial Sequence: Synthetic oligonucleotide
gcttggtgctggggcacatcatctgg

SEQ ID NO: 236676 - DNA, 27 bp, Artificial Sequence
  Description of Artificial Sequence: Synthetic oligonucleotide
cttggtgctggggcacatcatctggga

SEQ ID NO: 236677 - DNA, 27 bp, Artificial Sequence
  Description of Artificial Sequence: Synthetic oligonucleotide
ttggtgctggggcacatcatctgggag

SEQ ID NO: 236678 - DNA, 27 bp, Artificial Sequence
  Description of Artificial Sequence: Synthetic oligonucleotide
tggtgctggggcacatcatctgggagt

SEQ ID NO: 236679 - DNA, 26 bp, Artificial Sequence
  Description of Artificial Sequence: Synthetic oligonucleotide
ggtgctggggcacatcatctgggagt

SEQ ID NO: 236680 - DNA, 26 bp, Artificial Sequence
  Description of Artificial Sequence: Synthetic oligonucleotide
gtgctggggcacatcatctgggagtg

SEQ ID NO: 236681 - DNA, 26 bp, Artificial Sequence
  Description of Artificial Sequence: Synthetic oligonucleotide
tgctggggcacatcatctgggagtgg

SEQ ID NO: 236682 - DNA, 25 bp, Artificial Sequence
  Description of Artificial Sequence: Synthetic oligonucleotide
gctggggcacatcatctgggagtgg

SEQ ID NO: 236683 - DNA, 25 bp, Artificial Sequence
  Description of Artificial Sequence: Synthetic oligonucleotide
ctggggcacatcatctgggagtggg

SEQ ID NO: 236684 - DNA, 27 bp, Artificial Sequence
  Description of Artificial Sequence: Synthetic oligonucleotide
tggggcacatcatctgggagtgggctt

SEQ ID NO: 236685 - DNA, 26 bp, Artificial Sequence
  Description of Artificial Sequence: Synthetic oligonucleotide
ggggcacatcatctgggagtgggctt

SEQ ID NO: 236686 - DNA, 27 bp, Artificial Sequence
  Description of Artificial Sequence: Synthetic oligonucleotide
gggcacatcatctgggagtgggcttct

SEQ ID NO: 236687 - DNA, 28 bp, Artificial Sequence
  Description of Artificial Sequence: Synthetic oligonucleotide
ggcacatcatctgggagtgggcttcttc

SEQ ID NO: 236688 - DNA, 30 bp, Artificial Sequence
  Description of Artificial Sequence: Synthetic oligonucleotide
gcacatcatctgggagtgggcttcttcatg

SEQ ID NO: 236689 - DNA, 30 bp, Artificial Sequence
  Description of Artificial Sequence: Synthetic oligonucleotide
cacatcatctgggagtgggcttcttcatgc

SEQ ID NO: 236690 - DNA, 31 bp, Artificial Sequence
  Description of Artificial Sequence: Synthetic oligonucleotide
acatcatctgggagtgggcttcttcatgctc

SEQ ID NO: 236691 - DNA, 30 bp, Artificial Sequence
  Description of Artificial Sequence: Synthetic oligonucleotide
catcatctgggagtgggcttcttcatgctc

SEQ ID NO: 236692 - DNA, 31 bp, Artificial Sequence
  Description of Artificial Sequence: Synthetic oligonucleotide
atcatctgggagtgggcttcttcatgctcag

SEQ ID NO: 236693 - DNA, 30 bp, Artificial Sequence
  Description of Artificial Sequence: Synthetic oligonucleotide
tcatctgggagtgggcttcttcatgctcag

SEQ ID NO: 236694 - DNA, 29 bp, Artificial Sequence
  Description of Artificial Sequence: Synthetic oligonucleotide
catctgggagtgggcttcttcatgctcag

SEQ ID NO: 236695 - DNA, 29 bp, Artificial Sequence
  Description of Artificial Sequence: Synthetic oligonucleotide
atctgggagtgggcttcttcatgctcagg

SEQ ID NO: 236696 - DNA, 28 bp, Artificial Sequence
  Description of Artificial Sequence: Synthetic oligonucleotide
tctgggagtgggcttcttcatgctcagg

SEQ ID NO: 236697 - DNA, 27 bp, Artificial Sequence
  Description of Artificial Sequence: Synthetic oligonucleotide
ctgggagtgggcttcttcatgctcagg

SEQ ID NO: 236698 - DNA, 28 bp, Artificial Sequence
  Description of Artificial Sequence: Synthetic oligonucleotide
tgggagtgggcttcttcatgctcaggag

SEQ ID NO: 236699 - DNA, 27 bp, Artificial Sequence
  Description of Artificial Sequence: Synthetic oligonucleotide
gggagtgggcttcttcatgctcaggag

SEQ ID NO: 236700 - DNA, 27 bp, Artificial Sequence
  Description of Artificial Sequence: Synthetic oligonucleotide
ggagtgggcttcttcatgctcaggagg

SEQ ID NO: 236701 - DNA, 28 bp, Artificial Sequence
  Description of Artificial Sequence: Synthetic oligonucleotide
gagtgggcttcttcatgctcaggaggag

SEQ ID NO: 236702 - DNA, 28 bp, Artificial Sequence
  Description of Artificial Sequence: Synthetic oligonucleotide
agtgggcttcttcatgctcaggaggagg

SEQ ID NO: 236703 - DNA, 27 bp, Artificial Sequence
  Description of Artificial Sequence: Synthetic oligonucleotide
gtgggcttcttcatgctcaggaggagg

SEQ ID NO: 236704 - DNA, 29 bp, Artificial Sequence
  Description of Artificial Sequence: Synthetic oligonucleotide
tgggcttcttcatgctcaggaggaggaag

SEQ ID NO: 236705 - DNA, 28 bp, Artificial Sequence
  Description of Artificial Sequence: Synthetic oligonucleotide
gggcttcttcatgctcaggaggaggaag

SEQ ID NO: 236706 - DNA, 31 bp, Artificial Sequence
  Description of Artificial Sequence: Synthetic oligonucleotide
ggcttcttcatgctcaggaggaggaagaaag

SEQ ID NO: 236707 - DNA, 33 bp, Artificial Sequence
  Description of Artificial Sequence: Synthetic oligonucleotide
gcttcttcatgctcaggaggaggaagaaagttg

SEQ ID NO: 236708 - DNA, 35 bp, Artificial Sequence
  Description of Artificial Sequence: Synthetic oligonucleotide
cttcttcatgctcaggaggaggaagaaagttgaac

SEQ ID NO: 236709 - DNA, 35 bp, Artificial Sequence
  Description of Artificial Sequence: Synthetic oligonucleotide
ttcttcatgctcaggaggaggaagaaagttgaacg

SEQ ID NO: 236710 - DNA, 34 bp, Artificial Sequence
  Description of Artificial Sequence: Synthetic oligonucleotide
tcttcatgctcaggaggaggaagaaagttgaacg

SEQ ID NO: 236711 - DNA, 33 bp, Artificial Sequence
  Description of Artificial Sequence: Synthetic oligonucleotide
cttcatgctcaggaggaggaagaaagttgaacg

SEQ ID NO: 236712 - DNA, 34 bp, Artificial Sequence
  Description of Artificial Sequence: Synthetic oligonucleotide
ttcatgctcaggaggaggaagaaagttgaacgag

SEQ ID NO: 236713 - DNA, 33 bp, Artificial Sequence
  Description of Artificial Sequence: Synthetic oligonucleotide
tcatgctcaggaggaggaagaaagttgaacgag

SEQ ID NO: 236714 - DNA, 32 bp, Artificial Sequence
  Description of Artificial Sequence: Synthetic oligonucleotide
catgctcaggaggaggaagaaagttgaacgag

SEQ ID NO: 236715 - DNA, 32 bp, Artificial Sequence
  Description of Artificial Sequence: Synthetic oligonucleotide
atgctcaggaggaggaagaaagttgaacgagg

SEQ ID NO: 236716 - DNA, 31 bp, Artificial Sequence
  Description of Artificial Sequence: Synthetic oligonucleotide
tgctcaggaggaggaagaaagttgaacgagg

SEQ ID NO: 236717 - DNA, 30 bp, Artificial Sequence
  Description of Artificial Sequence: Synthetic oligonucleotide
gctcaggaggaggaagaaagttgaacgagg

SEQ ID NO: 236718 - DNA, 32 bp, Artificial Sequence
  Description of Artificial Sequence: Synthetic oligonucleotide
ctcaggaggaggaagaaagttgaacgaggatg

SEQ ID NO: 236719 - DNA, 33 bp, Artificial Sequence
  Description of Artificial Sequence: Synthetic oligonucleotide
tcaggaggaggaagaaagttgaacgaggatgtg

SEQ ID NO: 236720 - DNA, 32 bp, Artificial Sequence
  Description of Artificial Sequence: Synthetic oligonucleotide
caggaggaggaagaaagttgaacgaggatgtg

SEQ ID NO: 236721 - DNA, 32 bp, Artificial Sequence
  Description of Artificial Sequence: Synthetic oligonucleotide
aggaggaggaagaaagttgaacgaggatgtgc

SEQ ID NO: 236722 - DNA, 31 bp, Artificial Sequence
  Description of Artificial Sequence: Synthetic oligonucleotide
ggaggaggaagaaagttgaacgaggatgtgc

SEQ ID NO: 236723 - DNA, 30 bp, Artificial Sequence
  Description of Artificial Sequence: Synthetic oligonucleotide
atgggtcatcaacagaacctaggagctgcc

SEQ ID NO: 236724 - DNA, 29 bp, Artificial Sequence
  Description of Artificial Sequence: Synthetic oligonucleotide
tgggtcatcaacagaacctaggagctgcc

SEQ ID NO: 236725 - DNA, 28 bp, Artificial Sequence
  Description of Artificial Sequence: Synthetic oligonucleotide
gggtcatcaacagaacctaggagctgcc

SEQ ID NO: 236726 - DNA, 28 bp, Artificial Sequence
  Description of Artificial Sequence: Synthetic oligonucleotide
ggtcatcaacagaacctaggagctgccc

SEQ ID NO: 236727 - DNA, 29 bp, Artificial Sequence
  Description of Artificial Sequence: Synthetic oligonucleotide
gtcatcaacagaacctaggagctgccctg

SEQ ID NO: 236728 - DNA, 29 bp, Artificial Sequence
  Description of Artificial Sequence: Synthetic oligonucleotide
tcatcaacagaacctaggagctgccctgc

SEQ ID NO: 236729 - DNA, 28 bp, Artificial Sequence
  Description of Artificial Sequence: Synthetic oligonucleotide
catcaacagaacctaggagctgccctgc

SEQ ID NO: 236730 - DNA, 30 bp, Artificial Sequence
  Description of Artificial Sequence: Synthetic oligonucleotide
atcaacagaacctaggagctgccctgctac

SEQ ID NO: 236731 - DNA, 29 bp, Artificial Sequence
  Description of Artificial Sequence: Synthetic oligonucleotide
tcaacagaacctaggagctgccctgctac

SEQ ID NO: 236732 - DNA, 28 bp, Artificial Sequence
  Description of Artificial Sequence: Synthetic oligonucleotide
caacagaacctaggagctgccctgctac

SEQ ID NO: 236733 - DNA, 29 bp, Artificial Sequence
  Description of Artificial Sequence: Synthetic oligonucleotide
aacagaacctaggagctgccctgctacag

SEQ ID NO: 236734 - DNA, 28 bp, Artificial Sequence
  Description of Artificial Sequence: Synthetic oligonucleotide
acagaacctaggagctgccctgctacag

SEQ ID NO: 236735 - DNA, 27 bp, Artificial Sequence
  Description of Artificial Sequence: Synthetic oligonucleotide
cagaacctaggagctgccctgctacag

SEQ ID NO: 236736 - DNA, 29 bp, Artificial Sequence
  Description of Artificial Sequence: Synthetic oligonucleotide
agaacctaggagctgccctgctacagttg

SEQ ID NO: 236737 - DNA, 28 bp, Artificial Sequence
  Description of Artificial Sequence: Synthetic oligonucleotide
gaacctaggagctgccctgctacagttg

SEQ ID NO: 236738 - DNA, 31 bp, Artificial Sequence
  Description of Artificial Sequence: Synthetic oligonucleotide
aacctaggagctgccctgctacagttgttac

SEQ ID NO: 236739 - DNA, 30 bp, Artificial Sequence
  Description of Artificial Sequence: Synthetic oligonucleotide
acctaggagctgccctgctacagttgttac

SEQ ID NO: 236740 - DNA, 29 bp, Artificial Sequence
  Description of Artificial Sequence: Synthetic oligonucleotide
cctaggagctgccctgctacagttgttac

SEQ ID NO: 236741 - DNA, 29 bp, Artificial Sequence
  Description of Artificial Sequence: Synthetic oligonucleotide
ctaggagctgccctgctacagttgttacc

SEQ ID NO: 236742 - DNA, 30 bp, Artificial Sequence
  Description of Artificial Sequence: Synthetic oligonucleotide
taggagctgccctgctacagttgttaccac

SEQ ID NO: 236743 - DNA, 29 bp, Artificial Sequence
  Description of Artificial Sequence: Synthetic oligonucleotide
aggagctgccctgctacagttgttaccac

SEQ ID NO: 236744 - DNA, 28 bp, Artificial Sequence
  Description of Artificial Sequence: Synthetic oligonucleotide
ggagctgccctgctacagttgttaccac

SEQ ID NO: 236745 - DNA, 30 bp, Artificial Sequence
  Description of Artificial Sequence: Synthetic oligonucleotide
gagctgccctgctacagttgttaccacatc

SEQ ID NO: 236746 - DNA, 31 bp, Artificial Sequence
  Description of Artificial Sequence: Synthetic oligonucleotide
agctgccctgctacagttgttaccacatctg

SEQ ID NO: 236747 - DNA, 30 bp, Artificial Sequence
  Description of Artificial Sequence: Synthetic oligonucleotide
gctgccctgctacagttgttaccacatctg

SEQ ID NO: 236748 - DNA, 31 bp, Artificial Sequence
  Description of Artificial Sequence: Synthetic oligonucleotide
ctgccctgctacagttgttaccacatctgtg

SEQ ID NO: 236749 - DNA, 31 bp, Artificial Sequence
  Description of Artificial Sequence: Synthetic oligonucleotide
tgccctgctacagttgttaccacatctgtgg

SEQ ID NO: 236750 - DNA, 30 bp, Artificial Sequence
  Description of Artificial Sequence: Synthetic oligonucleotide
gccctgctacagttgttaccacatctgtgg

SEQ ID NO: 236751 - DNA, 30 bp, Artificial Sequence
  Description of Artificial Sequence: Synthetic oligonucleotide
ccctgctacagttgttaccacatctgtggc

SEQ ID NO: 236752 - DNA, 31 bp, Artificial Sequence
  Description of Artificial Sequence: Synthetic oligonucleotide
cctgctacagttgttaccacatctgtggctc

SEQ ID NO: 236753 - DNA, 31 bp, Artificial Sequence
  Description of Artificial Sequence: Synthetic oligonucleotide
ctgctacagttgttaccacatctgtggctcc

SEQ ID NO: 236754 - DNA, 33 bp, Artificial Sequence
  Description of Artificial Sequence: Synthetic oligonucleotide
tgctacagttgttaccacatctgtggctcctac

SEQ ID NO: 236755 - DNA, 32 bp, Artificial Sequence
  Description of Artificial Sequence: Synthetic oligonucleotide
gctacagttgttaccacatctgtggctcctac

SEQ ID NO: 236756 - DNA, 32 bp, Artificial Sequence
  Description of Artificial Sequence: Synthetic oligonucleotide
ctacagttgttaccacatctgtggctcctacc

SEQ ID NO: 236757 - DNA, 32 bp, Artificial Sequence
  Description of Artificial Sequence: Synthetic oligonucleotide
tacagttgttaccacatctgtggctcctaccc

SEQ ID NO: 236758 - DNA, 31 bp, Artificial Sequence
  Description of Artificial Sequence: Synthetic oligonucleotide
acagttgttaccacatctgtggctcctaccc

SEQ ID NO: 236759 - DNA, 30 bp, Artificial Sequence
  Description of Artificial Sequence: Synthetic oligonucleotide
cagttgttaccacatctgtggctcctaccc

SEQ ID NO: 236760 - DNA, 30 bp, Artificial Sequence
  Description of Artificial Sequence: Synthetic oligonucleotide
agttgttaccacatctgtggctcctacccc

SEQ ID NO: 236761 - DNA, 29 bp, Artificial Sequence
  Description of Artificial Sequence: Synthetic oligonucleotide
gttgttaccacatctgtggctcctacccc

SEQ ID NO: 236762 - DNA, 30 bp, Artificial Sequence
  Description of Artificial Sequence: Synthetic oligonucleotide
ttgttaccacatctgtggctcctaccccac

SEQ ID NO: 236763 - DNA, 29 bp, Artificial Sequence
  Description of Artificial Sequence: Synthetic oligonucleotide
tgttaccacatctgtggctcctaccccac

SEQ ID NO: 236764 - DNA, 28 bp, Artificial Sequence
  Description of Artificial Sequence: Synthetic oligonucleotide
gttaccacatctgtggctcctaccccac

SEQ ID NO: 236765 - DNA, 29 bp, Artificial Sequence
  Description of Artificial Sequence: Synthetic oligonucleotide
ttaccacatctgtggctcctaccccacac

SEQ ID NO: 236766 - DNA, 28 bp, Artificial Sequence
  Description of Artificial Sequence: Synthetic oligonucleotide
taccacatctgtggctcctaccccacac

SEQ ID NO: 236767 - DNA, 27 bp, Artificial Sequence
  Description of Artificial Sequence: Synthetic oligonucleotide
accacatctgtggctcctaccccacac

SEQ ID NO: 236768 - DNA, 26 bp, Artificial Sequence
  Description of Artificial Sequence: Synthetic oligonucleotide
ccacatctgtggctcctaccccacac

SEQ ID NO: 236769 - DNA, 27 bp, Artificial Sequence
  Description of Artificial Sequence: Synthetic oligonucleotide
cacatctgtggctcctaccccacacct

SEQ ID NO: 236770 - DNA, 27 bp, Artificial Sequence
  Description of Artificial Sequence: Synthetic oligonucleotide
acatctgtggctcctaccccacacctg

SEQ ID NO: 236771 - DNA, 26 bp, Artificial Sequence
  Description of Artificial Sequence: Synthetic oligonucleotide
catctgtggctcctaccccacacctg

SEQ ID NO: 236772 - DNA, 26 bp, Artificial Sequence
  Description of Artificial Sequence: Synthetic oligonucleotide
atctgtggctcctaccccacacctgg

SEQ ID NO: 236773 - DNA, 25 bp, Artificial Sequence
  Description of Artificial Sequence: Synthetic oligonucleotide
tctgtggctcctaccccacacctgg

SEQ ID NO: 236774 - DNA, 24 bp, Artificial Sequence
  Description of Artificial Sequence: Synthetic oligonucleotide
ctgtggctcctaccccacacctgg

SEQ ID NO: 236775 - DNA, 24 bp, Artificial Sequence
  Description of Artificial Sequence: Synthetic oligonucleotide
tgtggctcctaccccacacctggg

SEQ ID NO: 236776 - DNA, 23 bp, Artificial Sequence
  Description of Artificial Sequence: Synthetic oligonucleotide
gtggctcctaccccacacctggg

SEQ ID NO: 236777 - DNA, 23 bp, Artificial Sequence
  Description of Artificial Sequence: Synthetic oligonucleotide
tggctcctaccccacacctgggc

SEQ ID NO: 236778 - DNA, 22 bp, Artificial Sequence
  Description of Artificial Sequence: Synthetic oligonucleotide
ggctcctaccccacacctgggc

SEQ ID NO: 236779 - DNA, 22 bp, Artificial Sequence
  Description of Artificial Sequence: Synthetic oligonucleotide
gctcctaccccacacctgggcc

SEQ ID NO: 236780 - DNA, 23 bp, Artificial Sequence
  Description of Artificial Sequence: Synthetic oligonucleotide
ctcctaccccacacctgggccga

SEQ ID NO: 236781 - DNA, 23 bp, Artificial Sequence
  Description of Artificial Sequence: Synthetic oligonucleotide
tcctaccccacacctgggccgac

SEQ ID NO: 236782 - DNA, 22 bp, Artificial Sequence
  Description of Artificial Sequence: Synthetic oligonucleotide
cctaccccacacctgggccgac

SEQ ID NO: 236783 - DNA, 22 bp, Artificial Sequence
  Description of Artificial Sequence: Synthetic oligonucleotide
ctaccccacacctgggccgacc

SEQ ID NO: 236784 - DNA, 23 bp, Artificial Sequence
  Description of Artificial Sequence: Synthetic oligonucleotide
taccccacacctgggccgaccct

SEQ ID NO: 236785 - DNA, 22 bp, Artificial Sequence
  Description of Artificial Sequence: Synthetic oligonucleotide
accccacacctgggccgaccct

SEQ ID NO: 236786 - DNA, 21 bp, Artificial Sequence
  Description of Artificial Sequence: Synthetic oligonucleotide
ccccacacctgggccgaccct

SEQ ID NO: 236787 - DNA, 23 bp, Artificial Sequence
  Description of Artificial Sequence: Synthetic oligonucleotide
cccacacctgggccgaccctgaa

SEQ ID NO: 236788 - DNA, 23 bp, Artificial Sequence
  Description of Artificial Sequence: Synthetic oligonucleotide
ccacacctgggccgaccctgaag

SEQ ID NO: 236789 - DNA, 24 bp, Artificial Sequence
  Description of Artificial Sequence: Synthetic oligonucleotide
cacacctgggccgaccctgaagca

SEQ ID NO: 236790 - DNA, 24 bp, Artificial Sequence
  Description of Artificial Sequence: Synthetic oligonucleotide
acacctgggccgaccctgaagcac

SEQ ID NO: 236791 - DNA, 23 bp, Artificial Sequence
  Description of Artificial Sequence: Synthetic oligonucleotide
cacctgggccgaccctgaagcac

SEQ ID NO: 236792 - DNA, 25 bp, Artificial Sequence
  Description of Artificial Sequence: Synthetic oligonucleotide
acctgggccgaccctgaagcaccta

SEQ ID NO: 236793 - DNA, 24 bp, Artificial Sequence
  Description of Artificial Sequence: Synthetic oligonucleotide
cctgggccgaccctgaagcaccta

SEQ ID NO: 236794 - DNA, 25 bp, Artificial Sequence
  Description of Artificial Sequence: Synthetic oligonucleotide
ctgggccgaccctgaagcacctact

SEQ ID NO: 236795 - DNA, 25 bp, Artificial Sequence
  Description of Artificial Sequence: Synthetic oligonucleotide
tgggccgaccctgaagcacctactc

SEQ ID NO: 236796 - DNA, 24 bp, Artificial Sequence
  Description of Artificial Sequence: Synthetic oligonucleotide
gggccgaccctgaagcacctactc

SEQ ID NO: 236797 - DNA, 27 bp, Artificial Sequence
  Description of Artificial Sequence: Synthetic oligonucleotide
ggccgaccctgaagcacctactccatt

SEQ ID NO: 236798 - DNA, 27 bp, Artificial Sequence
  Description of Artificial Sequence: Synthetic oligonucleotide
gccgaccctgaagcacctactccattg

SEQ ID NO: 236799 - DNA, 28 bp, Artificial Sequence
  Description of Artificial Sequence: Synthetic oligonucleotide
ccgaccctgaagcacctactccattgtg

SEQ ID NO: 236800 - DNA, 28 bp, Artificial Sequence
  Description of Artificial Sequence: Synthetic oligonucleotide
cgaccctgaagcacctactccattgtgg

SEQ ID NO: 236801 - DNA, 28 bp, Artificial Sequence
  Description of Artificial Sequence: Synthetic oligonucleotide
gaccctgaagcacctactccattgtggc

SEQ ID NO: 236802 - DNA, 28 bp, Artificial Sequence
  Description of Artificial Sequence: Synthetic oligonucleotide
accctgaagcacctactccattgtggcc

SEQ ID NO: 236803 - DNA, 27 bp, Artificial Sequence
  Description of Artificial Sequence: Synthetic oligonucleotide
ccctgaagcacctactccattgtggcc

SEQ ID NO: 236804 - DNA, 28 bp, Artificial Sequence
  Description of Artificial Sequence: Synthetic oligonucleotide
cctgaagcacctactccattgtggccag

SEQ ID NO: 236805 - DNA, 30 bp, Artificial Sequence
  Description of Artificial Sequence: Synthetic oligonucleotide
ctgaagcacctactccattgtggccagttg

SEQ ID NO: 236806 - DNA, 31 bp, Artificial Sequence
  Description of Artificial Sequence: Synthetic oligonucleotide
tgaagcacctactccattgtggccagttgac

SEQ ID NO: 236807 - DNA, 30 bp, Artificial Sequence
  Description of Artificial Sequence: Synthetic oligonucleotide
gaagcacctactccattgtggccagttgac

SEQ ID NO: 236808 - DNA, 30 bp, Artificial Sequence
  Description of Artificial Sequence: Synthetic oligonucleotide
aagcacctactccattgtggccagttgacc

SEQ ID NO: 236809 - DNA, 29 bp, Artificial Sequence
  Description of Artificial Sequence: Synthetic oligonucleotide
agcacctactccattgtggccagttgacc

SEQ ID NO: 236810 - DNA, 28 bp, Artificial Sequence
  Description of Artificial Sequence: Synthetic oligonucleotide
gcacctactccattgtggccagttgacc

SEQ ID NO: 236811 - DNA, 29 bp, Artificial Sequence
  Description of Artificial Sequence: Synthetic oligonucleotide
cacctactccattgtggccagttgacctg

SEQ ID NO: 236812 - DNA, 29 bp, Artificial Sequence
  Description of Artificial Sequence: Synthetic oligonucleotide
acctactccattgtggccagttgacctgc

SEQ ID NO: 236813 - DNA, 28 bp, Artificial Sequence
  Description of Artificial Sequence: Synthetic oligonucleotide
cctactccattgtggccagttgacctgc

SEQ ID NO: 236814 - DNA, 32 bp, Artificial Sequence
  Description of Artificial Sequence: Synthetic oligonucleotide
ctactccattgtggccagttgacctgcataac

SEQ ID NO: 236815 - DNA, 32 bp, Artificial Sequence
  Description of Artificial Sequence: Synthetic oligonucleotide
tactccattgtggccagttgacctgcataacc

SEQ ID NO: 236816 - DNA, 31 bp, Artificial Sequence
  Description of Artificial Sequence: Synthetic oligonucleotide
actccattgtggccagttgacctgcataacc

SEQ ID NO: 236817 - DNA, 30 bp, Artificial Sequence
  Description of Artificial Sequence: Synthetic oligonucleotide
ctccattgtggccagttgacctgcataacc

SEQ ID NO: 236818 - DNA, 31 bp, Artificial Sequence
  Description of Artificial Sequence: Synthetic oligonucleotide
tccattgtggccagttgacctgcataaccac

SEQ ID NO: 236819 - DNA, 30 bp, Artificial Sequence
  Description of Artificial Sequence: Synthetic oligonucleotide
ccattgtggccagttgacctgcataaccac

SEQ ID NO: 236820 - DNA, 31 bp, Artificial Sequence
  Description of Artificial Sequence: Synthetic oligonucleotide
cattgtggccagttgacctgcataaccacac

SEQ ID NO: 236821 - DNA, 34 bp, Artificial Sequence
  Description of Artificial Sequence: Synthetic oligonucleotide
attgtggccagttgacctgcataaccacacaatc

SEQ ID NO: 236822 - DNA, 33 bp, Artificial Sequence
  Description of Artificial Sequence: Synthetic oligonucleotide
ttgtggccagttgacctgcataaccacacaatc

SEQ ID NO: 236823 - DNA, 32 bp, Artificial Sequence
  Description of Artificial Sequence: Synthetic oligonucleotide
tgtggccagttgacctgcataaccacacaatc

SEQ ID NO: 236824 - DNA, 31 bp, Artificial Sequence
  Description of Artificial Sequence: Synthetic oligonucleotide
gtggccagttgacctgcataaccacacaatc

SEQ ID NO: 236825 - DNA, 31 bp, Artificial Sequence
  Description of Artificial Sequence: Synthetic oligonucleotide
tggccagttgacctgcataaccacacaatcc

SEQ ID NO: 236826 - DNA, 30 bp, Artificial Sequence
  Description of Artificial Sequence: Synthetic oligonucleotide
ggccagttgacctgcataaccacacaatcc

SEQ ID NO: 236827 - DNA, 31 bp, Artificial Sequence
  Description of Artificial Sequence: Synthetic oligonucleotide
gccagttgacctgcataaccacacaatcctg

SEQ ID NO: 236828 - DNA, 31 bp, Artificial Sequence
  Description of Artificial Sequence: Synthetic oligonucleotide
ccagttgacctgcataaccacacaatcctgc

SEQ ID NO: 236829 - DNA, 32 bp, Artificial Sequence
  Description of Artificial Sequence: Synthetic oligonucleotide
cagttgacctgcataaccacacaatcctgcac

SEQ ID NO: 236830 - DNA, 33 bp, Artificial Sequence
  Description of Artificial Sequence: Synthetic oligonucleotide
agttgacctgcataaccacacaatcctgcacag

SEQ ID NO: 236831 - DNA, 32 bp, Artificial Sequence
  Description of Artificial Sequence: Synthetic oligonucleotide
gttgacctgcataaccacacaatcctgcacag

SEQ ID NO: 236832 - DNA, 33 bp, Artificial Sequence
  Description of Artificial Sequence: Synthetic oligonucleotide
ttgacctgcataaccacacaatcctgcacagag

SEQ ID NO: 236833 - DNA, 32 bp, Artificial Sequence
  Description of Artificial Sequence: Synthetic oligonucleotide
tgacctgcataaccacacaatcctgcacagag

SEQ ID NO: 236834 - DNA, 31 bp, Artificial Sequence
  Description of Artificial Sequence: Synthetic oligonucleotide
gacctgcataaccacacaatcctgcacagag

SEQ ID NO: 236835 - DNA, 32 bp, Artificial Sequence
  Description of Artificial Sequence: Synthetic oligonucleotide
acctgcataaccacacaatcctgcacagagtg

SEQ ID NO: 236836 - DNA, 31 bp, Artificial Sequence
  Description of Artificial Sequence: Synthetic oligonucleotide
cctgcataaccacacaatcctgcacagagtg

SEQ ID NO: 236837 - DNA, 33 bp, Artificial Sequence
  Description of Artificial Sequence: Synthetic oligonucleotide
ctgcataaccacacaatcctgcacagagtgtac

SEQ ID NO: 236838 - DNA, 34 bp, Artificial Sequence
  Description of Artificial Sequence: Synthetic oligonucleotide
tgcataaccacacaatcctgcacagagtgtactg

SEQ ID NO: 236839 - DNA, 33 bp, Artificial Sequence
  Description of Artificial Sequence: Synthetic oligonucleotide
gcataaccacacaatcctgcacagagtgtactg

SEQ ID NO: 236840 - DNA, 33 bp, Artificial Sequence
  Description of Artificial Sequence: Synthetic oligonucleotide
cataaccacacaatcctgcacagagtgtactgg

SEQ ID NO: 236841 - DNA, 33 bp, Artificial Sequence
  Description of Artificial Sequence: Synthetic oligonucleotide
ataaccacacaatcctgcacagagtgtactggc

SEQ ID NO: 236842 - DNA, 32 bp, Artificial Sequence
  Description of Artificial Sequence: Synthetic oligonucleotide
taaccacacaatcctgcacagagtgtactggc

SEQ ID NO: 236843 - DNA, 31 bp, Artificial Sequence
  Description of Artificial Sequence: Synthetic oligonucleotide
aaccacacaatcctgcacagagtgtactggc

SEQ ID NO: 236844 - DNA, 30 bp, Artificial Sequence
  Description of Artificial Sequence: Synthetic oligonucleotide
accacacaatcctgcacagagtgtactggc

SEQ ID NO: 236845 - DNA, 29 bp, Artificial Sequence
  Description of Artificial Sequence: Synthetic oligonucleotide
ccacacaatcctgcacagagtgtactggc

SEQ ID NO: 236846 - DNA, 30 bp, Artificial Sequence
  Description of Artificial Sequence: Synthetic oligonucleotide
cacacaatcctgcacagagtgtactggcag

SEQ ID NO: 236847 - DNA, 30 bp, Artificial Sequence
  Description of Artificial Sequence: Synthetic oligonucleotide
acacaatcctgcacagagtgtactggcagg

SEQ ID NO: 236848 - DNA, 29 bp, Artificial Sequence
  Description of Artificial Sequence: Synthetic oligonucleotide
cacaatcctgcacagagtgtactggcagg

SEQ ID NO: 236849 - DNA, 31 bp, Artificial Sequence
  Description of Artificial Sequence: Synthetic oligonucleotide
acaatcctgcacagagtgtactggcaggatg

SEQ ID NO: 236850 - DNA, 30 bp, Artificial Sequence
  Description of Artificial Sequence: Synthetic oligonucleotide
caatcctgcacagagtgtactggcaggatg

SEQ ID NO: 236851 - DNA, 30 bp, Artificial Sequence
  Description of Artificial Sequence: Synthetic oligonucleotide
aatcctgcacagagtgtactggcaggatgg

SEQ ID NO: 236852 - DNA, 29 bp, Artificial Sequence
  Description of Artificial Sequence: Synthetic oligonucleotide
atcctgcacagagtgtactggcaggatgg

SEQ ID NO: 236853 - DNA, 28 bp, Artificial Sequence
  Description of Artificial Sequence: Synthetic oligonucleotide
tcctgcacagagtgtactggcaggatgg

SEQ ID NO: 236854 - DNA, 27 bp, Artificial Sequence
  Description of Artificial Sequence: Synthetic oligonucleotide
cctgcacagagtgtactggcaggatgg

SEQ ID NO: 236855 - DNA, 27 bp, Artificial Sequence
  Description of Artificial Sequence: Synthetic oligonucleotide
ctgcacagagtgtactggcaggatggg

SEQ ID NO: 236856 - DNA, 28 bp, Artificial Sequence
  Description of Artificial Sequence: Synthetic oligonucleotide
tgcacagagtgtactggcaggatgggtg

SEQ ID NO: 236857 - DNA, 27 bp, Artificial Sequence
  Description of Artificial Sequence: Synthetic oligonucleotide
gcacagagtgtactggcaggatgggtg

SEQ ID NO: 236858 - DNA, 28 bp, Artificial Sequence
  Description of Artificial Sequence: Synthetic oligonucleotide
cacagagtgtactggcaggatgggtgtc

SEQ ID NO: 236859 - DNA, 28 bp, Artificial Sequence
  Description of Artificial Sequence: Synthetic oligonucleotide
acagagtgtactggcaggatgggtgtcc

SEQ ID NO: 236860 - DNA, 27 bp, Artificial Sequence
  Description of Artificial Sequence: Synthetic oligonucleotide
cagagtgtactggcaggatgggtgtcc

SEQ ID NO: 236861 - DNA, 27 bp, Artificial Sequence
  Description of Artificial Sequence: Synthetic oligonucleotide
agagtgtactggcaggatgggtgtccc

SEQ ID NO: 236862 - DNA, 27 bp, Artificial Sequence
  Description of Artificial Sequence: Synthetic oligonucleotide
gagtgtactggcaggatgggtgtccca

SEQ ID NO: 236863 - DNA, 27 bp, Artificial Sequence
  Description of Artificial Sequence: Synthetic oligonucleotide
agtgtactggcaggatgggtgtcccag

SEQ ID NO: 236864 - DNA, 27 bp, Artificial Sequence
  Description of Artificial Sequence: Synthetic oligonucleotide
gtgtactggcaggatgggtgtcccagt

SEQ ID NO: 236865 - DNA, 27 bp, Artificial Sequence
  Description of Artificial Sequence: Synthetic oligonucleotide
tgtactggcaggatgggtgtcccagtg

SEQ ID NO: 236866 - DNA, 27 bp, Artificial Sequence
  Description of Artificial Sequence: Synthetic oligonucleotide
gtactggcaggatgggtgtcccagtga

SEQ ID NO: 236867 - DNA, 27 bp, Artificial Sequence
  Description of Artificial Sequence: Synthetic oligonucleotide
tactggcaggatgggtgtcccagtgag

SEQ ID NO: 236868 - DNA, 26 bp, Artificial Sequence
  Description of Artificial Sequence: Synthetic oligonucleotide
actggcaggatgggtgtcccagtgag

SEQ ID NO: 236869 - DNA, 25 bp, Artificial Sequence
  Description of Artificial Sequence: Synthetic oligonucleotide
ctggcaggatgggtgtcccagtgag

SEQ ID NO: 236870 - DNA, 25 bp, Artificial Sequence
  Description of Artificial Sequence: Synthetic oligonucleotide
tggcaggatgggtgtcccagtgagg

SEQ ID NO: 236871 - DNA, 24 bp, Artificial Sequence
  Description of Artificial Sequence: Synthetic oligonucleotide
ggcaggatgggtgtcccagtgagg

SEQ ID NO: 236872 - DNA, 25 bp, Artificial Sequence
  Description of Artificial Sequence: Synthetic oligonucleotide
gcaggatgggtgtcccagtgaggga

SEQ ID NO: 236873 - DNA, 26 bp, Artificial Sequence
  Description of Artificial Sequence: Synthetic oligonucleotide
caggatgggtgtcccagtgagggact

SEQ ID NO: 236874 - DNA, 27 bp, Artificial Sequence
  Description of Artificial Sequence: Synthetic oligonucleotide
aggatgggtgtcccagtgagggactct

SEQ ID NO: 236875 - DNA, 26 bp, Artificial Sequence
  Description of Artificial Sequence: Synthetic oligonucleotide
ggatgggtgtcccagtgagggactct

SEQ ID NO: 236876 - DNA, 27 bp, Artificial Sequence
  Description of Artificial Sequence: Synthetic oligonucleotide
gatgggtgtcccagtgagggactctca

SEQ ID NO: 236877 - DNA, 27 bp, Artificial Sequence
  Description of Artificial Sequence: Synthetic oligonucleotide
atgggtgtcccagtgagggactctcag

SEQ ID NO: 236878 - DNA, 27 bp, Artificial Sequence
  Description of Artificial Sequence: Synthetic oligonucleotide
tgggtgtcccagtgagggactctcaga

SEQ ID NO: 236879 - DNA, 26 bp, Artificial Sequence
  Description of Artificial Sequence: Synthetic oligonucleotide
gggtgtcccagtgagggactctcaga

SEQ ID NO: 236880 - DNA, 26 bp, Artificial Sequence
  Description of Artificial Sequence: Synthetic oligonucleotide
ggtgtcccagtgagggactctcagag

SEQ ID NO: 236881 - DNA, 26 bp, Artificial Sequence
  Description of Artificial Sequence: Synthetic oligonucleotide
gtgtcccagtgagggactctcagagg

SEQ ID NO: 236882 - DNA, 26 bp, Artificial Sequence
  Description of Artificial Sequence: Synthetic oligonucleotide
tgtcccagtgagggactctcagaggc

SEQ ID NO: 236883 - DNA, 25 bp, Artificial Sequence
  Description of Artificial Sequence: Synthetic oligonucleotide
gtcccagtgagggactctcagaggc

SEQ ID NO: 236884 - DNA, 27 bp, Artificial Sequence
  Description of Artificial Sequence: Synthetic oligonucleotide
tcccagtgagggactctcagaggccta

SEQ ID NO: 236885 - DNA, 26 bp, Artificial Sequence
  Description of Artificial Sequence: Synthetic oligonucleotide
cccagtgagggactctcagaggccta

SEQ ID NO: 236886 - DNA, 26 bp, Artificial Sequence
  Description of Artificial Sequence: Synthetic oligonucleotide
ccagtgagggactctcagaggcctac

SEQ ID NO: 236887 - DNA, 27 bp, Artificial Sequence
  Description of Artificial Sequence: Synthetic oligonucleotide
cagtgagggactctcagaggcctacca

SEQ ID NO: 236888 - DNA, 27 bp, Artificial Sequence
  Description of Artificial Sequence: Synthetic oligonucleotide
agtgagggactctcagaggcctaccac

SEQ ID NO: 236889 - DNA, 26 bp, Artificial Sequence
  Description of Artificial Sequence: Synthetic oligonucleotide
gtgagggactctcagaggcctaccac

SEQ ID NO: 236890 - DNA, 27 bp, Artificial Sequence
  Description of Artificial Sequence: Synthetic oligonucleotide
tgagggactctcagaggcctaccacga

SEQ ID NO: 236891 - DNA, 26 bp, Artificial Sequence
  Description of Artificial Sequence: Synthetic oligonucleotide
gagggactctcagaggcctaccacga

SEQ ID NO: 236892 - DNA, 26 bp, Artificial Sequence
  Description of Artificial Sequence: Synthetic oligonucleotide
agggactctcagaggcctaccacgag

SEQ ID NO: 236893 - DNA, 25 bp, Artificial Sequence
  Description of Artificial Sequence: Synthetic oligonucleotide
gggactctcagaggcctaccacgag

SEQ ID NO: 236894 - DNA, 26 bp, Artificial Sequence
  Description of Artificial Sequence: Synthetic oligonucleotide
ggactctcagaggcctaccacgagga

SEQ ID NO: 236895 - DNA, 26 bp, Artificial Sequence
  Description of Artificial Sequence: Synthetic oligonucleotide
gactctcagaggcctaccacgaggac

SEQ ID NO: 236896 - DNA, 27 bp, Artificial Sequence
  Description of Artificial Sequence: Synthetic oligonucleotide
actctcagaggcctaccacgaggacct

SEQ ID NO: 236897 - DNA, 26 bp, Artificial Sequence
  Description of Artificial Sequence: Synthetic oligonucleotide
ctctcagaggcctaccacgaggacct

SEQ ID NO: 236898 - DNA, 26 bp, Artificial Sequence
  Description of Artificial Sequence: Synthetic oligonucleotide
tctcagaggcctaccacgaggacctg

SEQ ID NO: 236899 - DNA, 25 bp, Artificial Sequence
  Description of Artificial Sequence: Synthetic oligonucleotide
ctcagaggcctaccacgaggacctg

SEQ ID NO: 236900 - DNA, 27 bp, Artificial Sequence
  Description of Artificial Sequence: Synthetic oligonucleotide
tcagaggcctaccacgaggacctgctt

SEQ ID NO: 236901 - DNA, 27 bp, Artificial Sequence
  Description of Artificial Sequence: Synthetic oligonucleotide
cagaggcctaccacgaggacctgcttt

SEQ ID NO: 236902 - DNA, 28 bp, Artificial Sequence
  Description of Artificial Sequence: Synthetic oligonucleotide
agaggcctaccacgaggacctgcttttc

SEQ ID NO: 236903 - DNA, 27 bp, Artificial Sequence
  Description of Artificial Sequence: Synthetic oligonucleotide
gaggcctaccacgaggacctgcttttc

SEQ ID NO: 236904 - DNA, 29 bp, Artificial Sequence
  Description of Artificial Sequence: Synthetic oligonucleotide
aggcctaccacgaggacctgcttttcttg

SEQ ID NO: 236905 - DNA, 28 bp, Artificial Sequence
  Description of Artificial Sequence: Synthetic oligonucleotide
ggcctaccacgaggacctgcttttcttg

SEQ ID NO: 236906 - DNA, 30 bp, Artificial Sequence
  Description of Artificial Sequence: Synthetic oligonucleotide
gcctaccacgaggacctgcttttcttgttc

SEQ ID NO: 236907 - DNA, 30 bp, Artificial Sequence
  Description of Artificial Sequence: Synthetic oligonucleotide
cctaccacgaggacctgcttttcttgttcg

SEQ ID NO: 236908 - DNA, 31 bp, Artificial Sequence
  Description of Artificial Sequence: Synthetic oligonucleotide
ctaccacgaggacctgcttttcttgttcgac

SEQ ID NO: 236909 - DNA, 35 bp, Artificial Sequence
  Description of Artificial Sequence: Synthetic oligonucleotide
taccacgaggacctgcttttcttgttcgactttac

SEQ ID NO: 236910 - DNA, 34 bp, Artificial Sequence
  Description of Artificial Sequence: Synthetic oligonucleotide
accacgaggacctgcttttcttgttcgactttac

SEQ ID NO: 236911 - DNA, 33 bp, Artificial Sequence
  Description of Artificial Sequence: Synthetic oligonucleotide
ccacgaggacctgcttttcttgttcgactttac

SEQ ID NO: 236912 - DNA, 33 bp, Artificial Sequence
  Description of Artificial Sequence: Synthetic oligonucleotide
cacgaggacctgcttttcttgttcgactttacc

SEQ ID NO: 236913 - DNA, 33 bp, Artificial Sequence
  Description of Artificial Sequence: Synthetic oligonucleotide
acgaggacctgcttttcttgttcgactttaccc

SEQ ID NO: 236914 - DNA, 32 bp, Artificial Sequence
  Description of Artificial Sequence: Synthetic oligonucleotide
cgaggacctgcttttcttgttcgactttaccc

SEQ ID NO: 236915 - DNA, 33 bp, Artificial Sequence
  Description of Artificial Sequence: Synthetic oligonucleotide
gaggacctgcttttcttgttcgactttacccag

SEQ ID NO: 236916 - DNA, 35 bp, Artificial Sequence
  Description of Artificial Sequence: Synthetic oligonucleotide
aggacctgcttttcttgttcgactttacccagaac

SEQ ID NO: 236917 - DNA, 34 bp, Artificial Sequence
  Description of Artificial Sequence: Synthetic oligonucleotide
ggacctgcttttcttgttcgactttacccagaac

SEQ ID NO: 236918 - DNA, 35 bp, Artificial Sequence
  Description of Artificial Sequence: Synthetic oligonucleotide
gacctgcttttcttgttcgactttacccagaacag

SEQ ID NO: 236919 - DNA, 36 bp, Artificial Sequence
  Description of Artificial Sequence: Synthetic oligonucleotide
acctgcttttcttgttcgactttacccagaacagtc

SEQ ID NO: 236920 - DNA, 35 bp, Artificial Sequence
  Description of Artificial Sequence: Synthetic oligonucleotide
cctgcttttcttgttcgactttacccagaacagtc

SEQ ID NO: 236921 - DNA, 35 bp, Artificial Sequence
  Description of Artificial Sequence: Synthetic oligonucleotide
ctgcttttcttgttcgactttacccagaacagtcg

SEQ ID NO: 236922 - DNA, 35 bp, Artificial Sequence
  Description of Artificial Sequence: Synthetic oligonucleotide
tgcttttcttgttcgactttacccagaacagtcgg

SEQ ID NO: 236923 - DNA, 34 bp, Artificial Sequence
  Description of Artificial Sequence: Synthetic oligonucleotide
gcttttcttgttcgactttacccagaacagtcgg

SEQ ID NO: 236924 - DNA, 34 bp, Artificial Sequence
  Description of Artificial Sequence: Synthetic oligonucleotide
cttttcttgttcgactttacccagaacagtcggg

SEQ ID NO: 236925 - DNA, 35 bp, Artificial Sequence
  Description of Artificial Sequence: Synthetic oligonucleotide
ttttcttgttcgactttacccagaacagtcgggtg

SEQ ID NO: 236926 - DNA, 34 bp, Artificial Sequence
  Description of Artificial Sequence: Synthetic oligonucleotide
tttcttgttcgactttacccagaacagtcgggtg

SEQ ID NO: 236927 - DNA, 33 bp, Artificial Sequence
  Description of Artificial Sequence: Synthetic oligonucleotide
ttcttgttcgactttacccagaacagtcgggtg

SEQ ID NO: 236928 - DNA, 32 bp, Artificial Sequence
  Description of Artificial Sequence: Synthetic oligonucleotide
tcttgttcgactttacccagaacagtcgggtg

SEQ ID NO: 236929 - DNA, 31 bp, Artificial Sequence
  Description of Artificial Sequence: Synthetic oligonucleotide
cttgttcgactttacccagaacagtcgggtg

SEQ ID NO: 236930 - DNA, 31 bp, Artificial Sequence
  Description of Artificial Sequence: Synthetic oligonucleotide
ttgttcgactttacccagaacagtcgggtgc

SEQ ID NO: 236931 - DNA, 30 bp, Artificial Sequence
  Description of Artificial Sequence: Synthetic oligonucleotide
tgttcgactttacccagaacagtcgggtgc

SEQ ID NO: 236932 - DNA, 29 bp, Artificial Sequence
  Description of Artificial Sequence: Synthetic oligonucleotide
gttcgactttacccagaacagtcgggtgc

SEQ ID NO: 236933 - DNA, 29 bp, Artificial Sequence
  Description of Artificial Sequence: Synthetic oligonucleotide
ttcgactttacccagaacagtcgggtgcc

SEQ ID NO: 236934 - DNA, 28 bp, Artificial Sequence
  Description of Artificial Sequence: Synthetic oligonucleotide
tcgactttacccagaacagtcgggtgcc

SEQ ID NO: 236935 - DNA, 27 bp, Artificial Sequence
  Description of Artificial Sequence: Synthetic oligonucleotide
cgactttacccagaacagtcgggtgcc

SEQ ID NO: 236936 - DNA, 28 bp, Artificial Sequence
  Description of Artificial Sequence: Synthetic oligonucleotide
gactttacccagaacagtcgggtgccac

SEQ ID NO: 236937 - DNA, 28 bp, Artificial Sequence
  Description of Artificial Sequence: Synthetic oligonucleotide
actttacccagaacagtcgggtgccacg

SEQ ID NO: 236938 - DNA, 27 bp, Artificial Sequence
  Description of Artificial Sequence: Synthetic oligonucleotide
ctttacccagaacagtcgggtgccacg

SEQ ID NO: 236939 - DNA, 27 bp, Artificial Sequence
  Description of Artificial Sequence: Synthetic oligonucleotide
tttacccagaacagtcgggtgccacgc

SEQ ID NO: 236940 - DNA, 26 bp, Artificial Sequence
  Description of Artificial Sequence: Synthetic oligonucleotide
ttacccagaacagtcgggtgccacgc

SEQ ID NO: 236941 - DNA, 25 bp, Artificial Sequence
  Description of Artificial Sequence: Synthetic oligonucleotide
tacccagaacagtcgggtgccacgc

SEQ ID NO: 236942 - DNA, 24 bp, Artificial Sequence
  Description of Artificial Sequence: Synthetic oligonucleotide
acccagaacagtcgggtgccacgc

SEQ ID NO: 236943 - DNA, 23 bp, Artificial Sequence
  Description of Artificial Sequence: Synthetic oligonucleotide
cccagaacagtcgggtgccacgc

SEQ ID NO: 236944 - DNA, 24 bp, Artificial Sequence
  Description of Artificial Sequence: Synthetic oligonucleotide
ccagaacagtcgggtgccacgcct

SEQ ID NO: 236945 - DNA, 24 bp, Artificial Sequence
  Description of Artificial Sequence: Synthetic oligonucleotide
cagaacagtcgggtgccacgcctg

SEQ ID NO: 236946 - DNA, 24 bp, Artificial Sequence
  Description of Artificial Sequence: Synthetic oligonucleotide
agaacagtcgggtgccacgcctgc

SEQ ID NO: 236947 - DNA, 23 bp, Artificial Sequence
  Description of Artificial Sequence: Synthetic oligonucleotide
gaacagtcgggtgccacgcctgc

SEQ ID NO: 236948 - DNA, 23 bp, Artificial Sequence
  Description of Artificial Sequence: Synthetic oligonucleotide
aacagtcgggtgccacgcctgcc

SEQ ID NO: 236949 - DNA, 22 bp, Artificial Sequence
  Description of Artificial Sequence: Synthetic oligonucleotide
acagtcgggtgccacgcctgcc

SEQ ID NO: 236950 - DNA, 21 bp, Artificial Sequence
  Description of Artificial Sequence: Synthetic oligonucleotide
cagtcgggtgccacgcctgcc

SEQ ID NO: 236951 - DNA, 21 bp, Artificial Sequence
  Description of Artificial Sequence: Synthetic oligonucleotide
agtcgggtgccacgcctgccc

SEQ ID NO: 236952 - DNA, 20 bp, Artificial Sequence
  Description of Artificial Sequence: Synthetic oligonucleotide
gtcgggtgccacgcctgccc

SEQ ID NO: 236953 - DNA, 25 bp, Artificial Sequence
  Description of Artificial Sequence: Synthetic oligonucleotide
tcgggtgccacgcctgccccaattt

SEQ ID NO: 236954 - DNA, 24 bp, Artificial Sequence
  Description of Artificial Sequence: Synthetic oligonucleotide
cgggtgccacgcctgccccaattt

SEQ ID NO: 236955 - DNA, 24 bp, Artificial Sequence
  Description of Artificial Sequence: Synthetic oligonucleotide
gggtgccacgcctgccccaatttg

SEQ ID NO: 236956 - DNA, 25 bp, Artificial Sequence
  Description of Artificial Sequence: Synthetic oligonucleotide
ggtgccacgcctgccccaatttgct

SEQ ID NO: 236957 - DNA, 26 bp, Artificial Sequence
  Description of Artificial Sequence: Synthetic oligonucleotide
gtgccacgcctgccccaatttgctgt

SEQ ID NO: 236958 - DNA, 27 bp, Artificial Sequence
  Description of Artificial Sequence: Synthetic oligonucleotide
tgccacgcctgccccaatttgctgtct

SEQ ID NO: 236959 - DNA, 26 bp, Artificial Sequence
  Description of Artificial Sequence: Synthetic oligonucleotide
gccacgcctgccccaatttgctgtct

SEQ ID NO: 236960 - DNA, 26 bp, Artificial Sequence
  Description of Artificial Sequence: Synthetic oligonucleotide
ccacgcctgccccaatttgctgtctg

SEQ ID NO: 236961 - DNA, 26 bp, Artificial Sequence
  Description of Artificial Sequence: Synthetic oligonucleotide
cacgcctgccccaatttgctgtctgg

SEQ ID NO: 236962 - DNA, 26 bp, Artificial Sequence
  Description of Artificial Sequence: Synthetic oligonucleotide
acgcctgccccaatttgctgtctggg

SEQ ID NO: 236963 - DNA, 25 bp, Artificial Sequence
  Description of Artificial Sequence: Synthetic oligonucleotide
cgcctgccccaatttgctgtctggg

SEQ ID NO: 236964 - DNA, 26 bp, Artificial Sequence
  Description of Artificial Sequence: Synthetic oligonucleotide
gcctgccccaatttgctgtctgggct

SEQ ID NO: 236965 - DNA, 27 bp, Artificial Sequence
  Description of Artificial Sequence: Synthetic oligonucleotide
cctgccccaatttgctgtctgggctca

SEQ ID NO: 236966 - DNA, 27 bp, Artificial Sequence
  Description of Artificial Sequence: Synthetic oligonucleotide
ctgccccaatttgctgtctgggctcac

SEQ ID NO: 236967 - DNA, 27 bp, Artificial Sequence
  Description of Artificial Sequence: Synthetic oligonucleotide
tgccccaatttgctgtctgggctcacg

SEQ ID NO: 236968 - DNA, 27 bp, Artificial Sequence
  Description of Artificial Sequence: Synthetic oligonucleotide
gccccaatttgctgtctgggctcacga

SEQ ID NO: 236969 - DNA, 28 bp, Artificial Sequence
  Description of Artificial Sequence: Synthetic oligonucleotide
ccccaatttgctgtctgggctcacgaac

SEQ ID NO: 236970 - DNA, 29 bp, Artificial Sequence
  Description of Artificial Sequence: Synthetic oligonucleotide
cccaatttgctgtctgggctcacgaacag

SEQ ID NO: 236971 - DNA, 29 bp, Artificial Sequence
  Description of Artificial Sequence: Synthetic oligonucleotide
ccaatttgctgtctgggctcacgaacagg

SEQ ID NO: 236972 - DNA, 29 bp, Artificial Sequence
  Description of Artificial Sequence: Synthetic oligonucleotide
caatttgctgtctgggctcacgaacaggg

SEQ ID NO: 236973 - DNA, 30 bp, Artificial Sequence
  Description of Artificial Sequence: Synthetic oligonucleotide
aatttgctgtctgggctcacgaacagggac

SEQ ID NO: 236974 - DNA, 29 bp, Artificial Sequence
  Description of Artificial Sequence: Synthetic oligonucleotide
atttgctgtctgggctcacgaacagggac

SEQ ID NO: 236975 - DNA, 28 bp, Artificial Sequence
  Description of Artificial Sequence: Synthetic oligonucleotide
tttgctgtctgggctcacgaacagggac

SEQ ID NO: 236976 - DNA, 27 bp, Artificial Sequence
  Description of Artificial Sequence: Synthetic oligonucleotide
ttgctgtctgggctcacgaacagggac

SEQ ID NO: 236977 - DNA, 27 bp, Artificial Sequence
  Description of Artificial Sequence: Synthetic oligonucleotide
tgctgtctgggctcacgaacagggaca

SEQ ID NO: 236978 - DNA, 27 bp, Artificial Sequence
  Description of Artificial Sequence: Synthetic oligonucleotide
gctgtctgggctcacgaacagggacat

SEQ ID NO: 236979 - DNA, 27 bp, Artificial Sequence
  Description of Artificial Sequence: Synthetic oligonucleotide
ctgtctgggctcacgaacagggacatg

SEQ ID NO: 236980 - DNA, 27 bp, Artificial Sequence
  Description of Artificial Sequence: Synthetic oligonucleotide
tgtctgggctcacgaacagggacatgc

SEQ ID NO: 236981 - DNA, 27 bp, Artificial Sequence
  Description of Artificial Sequence: Synthetic oligonucleotide
gtctgggctcacgaacagggacatgct

SEQ ID NO: 236982 - DNA, 27 bp, Artificial Sequence
  Description of Artificial Sequence: Synthetic oligonucleotide
tctgggctcacgaacagggacatgctc

SEQ ID NO: 236983 - DNA, 26 bp, Artificial Sequence
  Description of Artificial Sequence: Synthetic oligonucleotide
ctgggctcacgaacagggacatgctc

SEQ ID NO: 236984 - DNA, 27 bp, Artificial Sequence
  Description of Artificial Sequence: Synthetic oligonucleotide
tgggctcacgaacagggacatgctcct

SEQ ID NO: 236985 - DNA, 26 bp, Artificial Sequence
  Description of Artificial Sequence: Synthetic oligonucleotide
gggctcacgaacagggacatgctcct

SEQ ID NO: 236986 - DNA, 26 bp, Artificial Sequence
  Description of Artificial Sequence: Synthetic oligonucleotide
ggctcacgaacagggacatgctcctg

SEQ ID NO: 236987 - DNA, 26 bp, Artificial Sequence
  Description of Artificial Sequence: Synthetic oligonucleotide
gctcacgaacagggacatgctcctgg

SEQ ID NO: 236988 - DNA, 27 bp, Artificial Sequence
  Description of Artificial Sequence: Synthetic oligonucleotide
ctcacgaacagggacatgctcctggca

SEQ ID NO: 236989 - DNA, 35 bp, Artificial Sequence
  Description of Artificial Sequence: Synthetic oligonucleotide
tcacgaacagggacatgctcctggcattttattag

SEQ ID NO: 236990 - DNA, 34 bp, Artificial Sequence
  Description of Artificial Sequence: Synthetic oligonucleotide
cacgaacagggacatgctcctggcattttattag

SEQ ID NO: 236991 - DNA, 35 bp, Artificial Sequence
  Description of Artificial Sequence: Synthetic oligonucleotide
acgaacagggacatgctcctggcattttattagac

SEQ ID NO: 236992 - DNA, 34 bp, Artificial Sequence
  Description of Artificial Sequence: Synthetic oligonucleotide
cgaacagggacatgctcctggcattttattagac

SEQ ID NO: 236993 - DNA, 37 bp, Artificial Sequence
  Description of Artificial Sequence: Synthetic oligonucleotide
gaacagggacatgctcctggcattttattagacaaag

SEQ ID NO: 236994 - DNA, 38 bp, Artificial Sequence
  Description of Artificial Sequence: Synthetic oligonucleotide
aacagggacatgctcctggcattttattagacaaagag

SEQ ID NO: 236995 - DNA, 37 bp, Artificial Sequence
  Description of Artificial Sequence: Synthetic oligonucleotide
acagggacatgctcctggcattttattagacaaagag

SEQ ID NO: 236996 - DNA, 36 bp, Artificial Sequence
  Description of Artificial Sequence: Synthetic oligonucleotide
cagggacatgctcctggcattttattagacaaagag

SEQ ID NO: 236997 - DNA, 38 bp, Artificial Sequence
  Description of Artificial Sequence: Synthetic oligonucleotide
agggacatgctcctggcattttattagacaaagagatc

SEQ ID NO: 236998 - DNA, 37 bp, Artificial Sequence
  Description of Artificial Sequence: Synthetic oligonucleotide
gggacatgctcctggcattttattagacaaagagatc

SEQ ID NO: 236999 - DNA, 38 bp, Artificial Sequence
  Description of Artificial Sequence: Synthetic oligonucleotide
ggacatgctcctggcattttattagacaaagagatctg

SEQ ID NO: 237000 - DNA, 38 bp, Artificial Sequence
  Description of Artificial Sequence: Synthetic oligonucleotide
gacatgctcctggcattttattagacaaagagatctgc

SEQ ID NO: 237001 - DNA, 38 bp, Artificial Sequence
  Description of Artificial Sequence: Synthetic oligonucleotide
acatgctcctggcattttattagacaaagagatctgcg

SEQ ID NO: 237002 - DNA, 37 bp, Artificial Sequence
  Description of Artificial Sequence: Synthetic oligonucleotide
catgctcctggcattttattagacaaagagatctgcg

SEQ ID NO: 237003 - DNA, 38 bp, Artificial Sequence
  Description of Artificial Sequence: Synthetic oligonucleotide
atgctcctggcattttattagacaaagagatctgcgag

SEQ ID NO: 237004 - DNA, 37 bp, Artificial Sequence
  Description of Artificial Sequence: Synthetic oligonucleotide
tgctcctggcattttattagacaaagagatctgcgag

SEQ ID NO: 237005 - DNA, 36 bp, Artificial Sequence
  Description of Artificial Sequence: Synthetic oligonucleotide
gctcctggcattttattagacaaagagatctgcgag

SEQ ID NO: 237006 - DNA, 37 bp, Artificial Sequence
  Description of Artificial Sequence: Synthetic oligonucleotide
ctcctggcattttattagacaaagagatctgcgagtc

SEQ ID NO: 237007 - DNA, 37 bp, Artificial Sequence
  Description of Artificial Sequence: Synthetic oligonucleotide
tcctggcattttattagacaaagagatctgcgagtcg

SEQ ID NO: 237008 - DNA, 36 bp, Artificial Sequence
  Description of Artificial Sequence: Synthetic oligonucleotide
cctggcattttattagacaaagagatctgcgagtcg

SEQ ID NO: 237009 - DNA, 38 bp, Artificial Sequence
  Description of Artificial Sequence: Synthetic oligonucleotide
ctggcattttattagacaaagagatctgcgagtcgatg

SEQ ID NO: 237010 - DNA, 40 bp, Artificial Sequence
  Description of Artificial Sequence: Synthetic oligonucleotide
tggcattttattagacaaagagatctgcgagtcgatgatc

SEQ ID NO: 237011 - DNA, 39 bp, Artificial Sequence
  Description of Artificial Sequence: Synthetic oligonucleotide
ggcattttattagacaaagagatctgcgagtcgatgatc

SEQ ID NO: 237012 - DNA, 39 bp, Artificial Sequence
  Description of Artificial Sequence: Synthetic oligonucleotide
gcattttattagacaaagagatctgcgagtcgatgatcc

SEQ ID NO: 237013 - DNA, 40 bp, Artificial Sequence
  Description of Artificial Sequence: Synthetic oligonucleotide
cattttattagacaaagagatctgcgagtcgatgatccac

SEQ ID NO: 237014 - DNA, 40 bp, Artificial Sequence
  Description of Artificial Sequence: Synthetic oligonucleotide
attttattagacaaagagatctgcgagtcgatgatccacc

SEQ ID NO: 237015 - DNA, 39 bp, Artificial Sequence
  Description of Artificial Sequence: Synthetic oligonucleotide
ttttattagacaaagagatctgcgagtcgatgatccacc

SEQ ID NO: 237016 - DNA, 38 bp, Artificial Sequence
  Description of Artificial Sequence: Synthetic oligonucleotide
tttattagacaaagagatctgcgagtcgatgatccacc

SEQ ID NO: 237017 - DNA, 37 bp, Artificial Sequence
  Description of Artificial Sequence: Synthetic oligonucleotide
ttattagacaaagagatctgcgagtcgatgatccacc

SEQ ID NO: 237018 - DNA, 36 bp, Artificial Sequence
  Description of Artificial Sequence: Synthetic oligonucleotide
tattagacaaagagatctgcgagtcgatgatccacc

SEQ ID NO: 237019 - DNA, 35 bp, Artificial Sequence
  Description of Artificial Sequence: Synthetic oligonucleotide
attagacaaagagatctgcgagtcgatgatccacc

SEQ ID NO: 237020 - DNA, 34 bp, Artificial Sequence
  Description of Artificial Sequence: Synthetic oligonucleotide
ttagacaaagagatctgcgagtcgatgatccacc

SEQ ID NO: 237021 - DNA, 33 bp, Artificial Sequence
  Description of Artificial Sequence: Synthetic oligonucleotide
tagacaaagagatctgcgagtcgatgatccacc

SEQ ID NO: 237022 - DNA, 32 bp, Artificial Sequence
  Description of Artificial Sequence: Synthetic oligonucleotide
agacaaagagatctgcgagtcgatgatccacc

SEQ ID NO: 237023 - DNA, 31 bp, Artificial Sequence
  Description of Artificial Sequence: Synthetic oligonucleotide
gacaaagagatctgcgagtcgatgatccacc

SEQ ID NO: 237024 - DNA, 36 bp, Artificial Sequence
  Description of Artificial Sequence: Synthetic oligonucleotide
acaaagagatctgcgagtcgatgatccaccaaatag

SEQ ID NO: 237025 - DNA, 35 bp, Artificial Sequence
  Description of Artificial Sequence: Synthetic oligonucleotide
caaagagatctgcgagtcgatgatccaccaaatag

SEQ ID NO: 237026 - DNA, 35 bp, Artificial Sequence
  Description of Artificial Sequence: Synthetic oligonucleotide
aaagagatctgcgagtcgatgatccaccaaatagg

SEQ ID NO: 237027 - DNA, 34 bp, Artificial Sequence
  Description of Artificial Sequence: Synthetic oligonucleotide
aagagatctgcgagtcgatgatccaccaaatagg

SEQ ID NO: 237028 - DNA, 33 bp, Artificial Sequence
  Description of Artificial Sequence: Synthetic oligonucleotide
agagatctgcgagtcgatgatccaccaaatagg

SEQ ID NO: 237029 - DNA, 32 bp, Artificial Sequence
  Description of Artificial Sequence: Synthetic oligonucleotide
gagatctgcgagtcgatgatccaccaaatagg

SEQ ID NO: 237030 - DNA, 32 bp, Artificial Sequence
  Description of Artificial Sequence: Synthetic oligonucleotide
agatctgcgagtcgatgatccaccaaataggg

SEQ ID NO: 237031 - DNA, 31 bp, Artificial Sequence
  Description of Artificial Sequence: Synthetic oligonucleotide
gatctgcgagtcgatgatccaccaaataggg

SEQ ID NO: 237032 - DNA, 31 bp, Artificial Sequence
  Description of Artificial Sequence: Synthetic oligonucleotide
atctgcgagtcgatgatccaccaaatagggg

SEQ ID NO: 237033 - DNA, 30 bp, Artificial Sequence
  Description of Artificial Sequence: Synthetic oligonucleotide
tctgcgagtcgatgatccaccaaatagggg

SEQ ID NO: 237034 - DNA, 29 bp, Artificial Sequence
  Description of Artificial Sequence: Synthetic oligonucleotide
ctgcgagtcgatgatccaccaaatagggg

SEQ ID NO: 237035 - DNA, 29 bp, Artificial Sequence
  Description of Artificial Sequence: Synthetic oligonucleotide
tgcgagtcgatgatccaccaaataggggc

SEQ ID NO: 237036 - DNA, 28 bp, Artificial Sequence
  Description of Artificial Sequence: Synthetic oligonucleotide
gcgagtcgatgatccaccaaataggggc

SEQ ID NO: 237037 - DNA, 32 bp, Artificial Sequence
  Description of Artificial Sequence: Synthetic oligonucleotide
cgagtcgatgatccaccaaataggggcaaaac

SEQ ID NO: 237038 - DNA, 34 bp, Artificial Sequence
  Description of Artificial Sequence: Synthetic oligonucleotide
gagtcgatgatccaccaaataggggcaaaacttg

SEQ ID NO: 237039 - DNA, 36 bp, Artificial Sequence
  Description of Artificial Sequence: Synthetic oligonucleotide
agtcgatgatccaccaaataggggcaaaacttgttg

SEQ ID NO: 237040 - DNA, 35 bp, Artificial Sequence
  Description of Artificial Sequence: Synthetic oligonucleotide
gtcgatgatccaccaaataggggcaaaacttgttg

SEQ ID NO: 237041 - DNA, 35 bp, Artificial Sequence
  Description of Artificial Sequence: Synthetic oligonucleotide
tcgatgatccaccaaataggggcaaaacttgttgg

SEQ ID NO: 237042 - DNA, 34 bp, Artificial Sequence
  Description of Artificial Sequence: Synthetic oligonucleotide
cgatgatccaccaaataggggcaaaacttgttgg

SEQ ID NO: 237043 - DNA, 34 bp, Artificial Sequence
  Description of Artificial Sequence: Synthetic oligonucleotide
gatgatccaccaaataggggcaaaacttgttggg

SEQ ID NO: 237044 - DNA, 39 bp, Artificial Sequence
  Description of Artificial Sequence: Synthetic oligonucleotide
atgatccaccaaataggggcaaaacttgttgggaaaatg

SEQ ID NO: 237045 - DNA, 38 bp, Artificial Sequence
  Description of Artificial Sequence: Synthetic oligonucleotide
tgatccaccaaataggggcaaaacttgttgggaaaatg

SEQ ID NO: 237046 - DNA, 37 bp, Artificial Sequence
  Description of Artificial Sequence: Synthetic oligonucleotide
gatccaccaaataggggcaaaacttgttgggaaaatg

SEQ ID NO: 237047 - DNA, 37 bp, Artificial Sequence
  Description of Artificial Sequence: Synthetic oligonucleotide
atccaccaaataggggcaaaacttgttgggaaaatgc

SEQ ID NO: 237048 - DNA, 36 bp, Artificial Sequence
  Description of Artificial Sequence: Synthetic oligonucleotide
tccaccaaataggggcaaaacttgttgggaaaatgc

SEQ ID NO: 237049 - DNA, 35 bp, Artificial Sequence
  Description of Artificial Sequence: Synthetic oligonucleotide
ccaccaaataggggcaaaacttgttgggaaaatgc

SEQ ID NO: 237050 - DNA, 35 bp, Artificial Sequence
  Description of Artificial Sequence: Synthetic oligonucleotide
caccaaataggggcaaaacttgttgggaaaatgcc

SEQ ID NO: 237051 - DNA, 35 bp, Artificial Sequence
  Description of Artificial Sequence: Synthetic oligonucleotide
accaaataggggcaaaacttgttgggaaaatgccg

SEQ ID NO: 237052 - DNA, 34 bp, Artificial Sequence
  Description of Artificial Sequence: Synthetic oligonucleotide
ccaaataggggcaaaacttgttgggaaaatgccg

SEQ ID NO: 237053 - DNA, 34 bp, Artificial Sequence
  Description of Artificial Sequence: Synthetic oligonucleotide
caaataggggcaaaacttgttgggaaaatgccgg

SEQ ID NO: 237054 - DNA, 35 bp, Artificial Sequence
  Description of Artificial Sequence: Synthetic oligonucleotide
aaataggggcaaaacttgttgggaaaatgccggtg

SEQ ID NO: 237055 - DNA, 34 bp, Artificial Sequence
  Description of Artificial Sequence: Synthetic oligonucleotide
aataggggcaaaacttgttgggaaaatgccggtg

SEQ ID NO: 237056 - DNA, 33 bp, Artificial Sequence
  Description of Artificial Sequence: Synthetic oligonucleotide
ataggggcaaaacttgttgggaaaatgccggtg

SEQ ID NO: 237057 - DNA, 32 bp, Artificial Sequence
  Description of Artificial Sequence: Synthetic oligonucleotide
taggggcaaaacttgttgggaaaatgccggtg

SEQ ID NO: 237058 - DNA, 31 bp, Artificial Sequence
  Description of Artificial Sequence: Synthetic oligonucleotide
aggggcaaaacttgttgggaaaatgccggtg

SEQ ID NO: 237059 - DNA, 30 bp, Artificial Sequence
  Description of Artificial Sequence: Synthetic oligonucleotide
ggggcaaaacttgttgggaaaatgccggtg

SEQ ID NO: 237060 - DNA, 31 bp, Artificial Sequence
  Description of Artificial Sequence: Synthetic oligonucleotide
gggcaaaacttgttgggaaaatgccggtgtc

SEQ ID NO: 237061 - DNA, 31 bp, Artificial Sequence
  Description of Artificial Sequence: Synthetic oligonucleotide
ggcaaaacttgttgggaaaatgccggtgtcc

SEQ ID NO: 237062 - DNA, 32 bp, Artificial Sequence
  Description of Artificial Sequence: Synthetic oligonucleotide
gcaaaacttgttgggaaaatgccggtgtcctg

SEQ ID NO: 237063 - DNA, 33 bp, Artificial Sequence
  Description of Artificial Sequence: Synthetic oligonucleotide
caaaacttgttgggaaaatgccggtgtcctgag

SEQ ID NO: 237064 - DNA, 33 bp, Artificial Sequence
  Description of Artificial Sequence: Synthetic oligonucleotide
aaaacttgttgggaaaatgccggtgtcctgagg

SEQ ID NO: 237065 - DNA, 32 bp, Artificial Sequence
  Description of Artificial Sequence: Synthetic oligonucleotide
aaacttgttgggaaaatgccggtgtcctgagg

SEQ ID NO: 237066 - DNA, 31 bp, Artificial Sequence
  Description of Artificial Sequence: Synthetic oligonucleotide
aacttgttgggaaaatgccggtgtcctgagg

SEQ ID NO: 237067 - DNA, 30 bp, Artificial Sequence
  Description of Artificial Sequence: Synthetic oligonucleotide
acttgttgggaaaatgccggtgtcctgagg

SEQ ID NO: 237068 - DNA, 29 bp, Artificial Sequence
  Description of Artificial Sequence: Synthetic oligonucleotide
cttgttgggaaaatgccggtgtcctgagg

SEQ ID NO: 237069 - DNA, 29 bp, Artificial Sequence
  Description of Artificial Sequence: Synthetic oligonucleotide
ttgttgggaaaatgccggtgtcctgaggg

SEQ ID NO: 237070 - DNA, 28 bp, Artificial Sequence
  Description of Artificial Sequence: Synthetic oligonucleotide
tgttgggaaaatgccggtgtcctgaggg

SEQ ID NO: 237071 - DNA, 27 bp, Artificial Sequence
  Description of Artificial Sequence: Synthetic oligonucleotide
gttgggaaaatgccggtgtcctgaggg

SEQ ID NO: 237072 - DNA, 30 bp, Artificial Sequence
  Description of Artificial Sequence: Synthetic oligonucleotide
ttgggaaaatgccggtgtcctgagggtttc

SEQ ID NO: 237073 - DNA, 29 bp, Artificial Sequence
  Description of Artificial Sequence: Synthetic oligonucleotide
tgggaaaatgccggtgtcctgagggtttc

SEQ ID NO: 237074 - DNA, 28 bp, Artificial Sequence
  Description of Artificial Sequence: Synthetic oligonucleotide
gggaaaatgccggtgtcctgagggtttc

SEQ ID NO: 237075 - DNA, 28 bp, Artificial Sequence
  Description of Artificial Sequence: Synthetic oligonucleotide
ggaaaatgccggtgtcctgagggtttcg

SEQ ID NO: 237076 - DNA, 31 bp, Artificial Sequence
  Description of Artificial Sequence: Synthetic oligonucleotide
gaaaatgccggtgtcctgagggtttcgtatc

SEQ ID NO: 237077 - DNA, 31 bp, Artificial Sequence
  Description of Artificial Sequence: Synthetic oligonucleotide
aaaatgccggtgtcctgagggtttcgtatcg

SEQ ID NO: 237078 - DNA, 30 bp, Artificial Sequence
  Description of Artificial Sequence: Synthetic oligonucleotide
aaatgccggtgtcctgagggtttcgtatcg

SEQ ID NO: 237079 - DNA, 29 bp, Artificial Sequence
  Description of Artificial Sequence: Synthetic oligonucleotide
aatgccggtgtcctgagggtttcgtatcg

SEQ ID NO: 237080 - DNA, 28 bp, Artificial Sequence
  Description of Artificial Sequence: Synthetic oligonucleotide
atgccggtgtcctgagggtttcgtatcg

SEQ ID NO: 237081 - DNA, 27 bp, Artificial Sequence
  Description of Artificial Sequence: Synthetic oligonucleotide
tgccggtgtcctgagggtttcgtatcg

SEQ ID NO: 237082 - DNA, 26 bp, Artificial Sequence
  Description of Artificial Sequence: Synthetic oligonucleotide
gccggtgtcctgagggtttcgtatcg

SEQ ID NO: 237083 - DNA, 27 bp, Artificial Sequence
  Description of Artificial Sequence: Synthetic oligonucleotide
ccggtgtcctgagggtttcgtatcgct

SEQ ID NO: 237084 - DNA, 27 bp, Artificial Sequence
  Description of Artificial Sequence: Synthetic oligonucleotide
cggtgtcctgagggtttcgtatcgctg

SEQ ID NO: 237085 - DNA, 29 bp, Artificial Sequence
  Description of Artificial Sequence: Synthetic oligonucleotide
ggtgtcctgagggtttcgtatcgctgatg

SEQ ID NO: 237086 - DNA, 30 bp, Artificial Sequence
  Description of Artificial Sequence: Synthetic oligonucleotide
gtgtcctgagggtttcgtatcgctgatgtg

SEQ ID NO: 237087 - DNA, 32 bp, Artificial Sequence
  Description of Artificial Sequence: Synthetic oligonucleotide
tgtcctgagggtttcgtatcgctgatgtgttc

SEQ ID NO: 237088 - DNA, 31 bp, Artificial Sequence
  Description of Artificial Sequence: Synthetic oligonucleotide
gtcctgagggtttcgtatcgctgatgtgttc

SEQ ID NO: 237089 - DNA, 32 bp, Artificial Sequence
  Description of Artificial Sequence: Synthetic oligonucleotide
tcctgagggtttcgtatcgctgatgtgttcac

SEQ ID NO: 237090 - DNA, 31 bp, Artificial Sequence
  Description of Artificial Sequence: Synthetic oligonucleotide
cctgagggtttcgtatcgctgatgtgttcac

SEQ ID NO: 237091 - DNA, 31 bp, Artificial Sequence
  Description of Artificial Sequence: Synthetic oligonucleotide
ctgagggtttcgtatcgctgatgtgttcacg

SEQ ID NO: 237092 - DNA, 31 bp, Artificial Sequence
  Description of Artificial Sequence: Synthetic oligonucleotide
tgagggtttcgtatcgctgatgtgttcacgg

SEQ ID NO: 237093 - DNA, 30 bp, Artificial Sequence
  Description of Artificial Sequence: Synthetic oligonucleotide
gagggtttcgtatcgctgatgtgttcacgg

SEQ ID NO: 237094 - DNA, 31 bp, Artificial Sequence
  Description of Artificial Sequence: Synthetic oligonucleotide
agggtttcgtatcgctgatgtgttcacggtg

SEQ ID NO: 237095 - DNA, 30 bp, Artificial Sequence
  Description of Artificial Sequence: Synthetic oligonucleotide
gggtttcgtatcgctgatgtgttcacggtg

SEQ ID NO: 237096 - DNA, 32 bp, Artificial Sequence
  Description of Artificial Sequence: Synthetic oligonucleotide
ggtttcgtatcgctgatgtgttcacggtgaag

SEQ ID NO: 237097 - DNA, 32 bp, Artificial Sequence
  Description of Artificial Sequence: Synthetic oligonucleotide
gtttcgtatcgctgatgtgttcacggtgaagc

SEQ ID NO: 237098 - DNA, 32 bp, Artificial Sequence
  Description of Artificial Sequence: Synthetic oligonucleotide
tttcgtatcgctgatgtgttcacggtgaagcc

SEQ ID NO: 237099 - DNA, 31 bp, Artificial Sequence
  Description of Artificial Sequence: Synthetic oligonucleotide
ttcgtatcgctgatgtgttcacggtgaagcc

SEQ ID NO: 237100 - DNA, 30 bp, Artificial Sequence
  Description of Artificial Sequence: Synthetic oligonucleotide
tcgtatcgctgatgtgttcacggtgaagcc

SEQ ID NO: 237101 - DNA, 29 bp, Artificial Sequence
  Description of Artificial Sequence: Synthetic oligonucleotide
cgtatcgctgatgtgttcacggtgaagcc

SEQ ID NO: 237102 - DNA, 29 bp, Artificial Sequence
  Description of Artificial Sequence: Synthetic oligonucleotide
gtatcgctgatgtgttcacggtgaagccc

SEQ ID NO: 237103 - DNA, 29 bp, Artificial Sequence
  Description of Artificial Sequence: Synthetic oligonucleotide
tatcgctgatgtgttcacggtgaagcccc

SEQ ID NO: 237104 - DNA, 28 bp, Artificial Sequence
  Description of Artificial Sequence: Synthetic oligonucleotide
atcgctgatgtgttcacggtgaagcccc

SEQ ID NO: 237105 - DNA, 27 bp, Artificial Sequence
  Description of Artificial Sequence: Synthetic oligonucleotide
tcgctgatgtgttcacggtgaagcccc

SEQ ID NO: 237106 - DNA, 27 bp, Artificial Sequence
  Description of Artificial Sequence: Synthetic oligonucleotide
cgctgatgtgttcacggtgaagcccca

SEQ ID NO: 237107 - DNA, 27 bp, Artificial Sequence
  Description of Artificial Sequence: Synthetic oligonucleotide
gctgatgtgttcacggtgaagccccag

SEQ ID NO: 237108 - DNA, 27 bp, Artificial Sequence
  Description of Artificial Sequence: Synthetic oligonucleotide
ctgatgtgttcacggtgaagccccagg

SEQ ID NO: 237109 - DNA, 28 bp, Artificial Sequence
  Description of Artificial Sequence: Synthetic oligonucleotide
tgatgtgttcacggtgaagccccaggag

SEQ ID NO: 237110 - DNA, 27 bp, Artificial Sequence
  Description of Artificial Sequence: Synthetic oligonucleotide
gatgtgttcacggtgaagccccaggag

SEQ ID NO: 237111 - DNA, 30 bp, Artificial Sequence
  Description of Artificial Sequence: Synthetic oligonucleotide
atgtgttcacggtgaagccccaggagtttg

SEQ ID NO: 237112 - DNA, 29 bp, Artificial Sequence
  Description of Artificial Sequence: Synthetic oligonucleotide
tgtgttcacggtgaagccccaggagtttg

SEQ ID NO: 237113 - DNA, 28 bp, Artificial Sequence
  Description of Artificial Sequence: Synthetic oligonucleotide
gtgttcacggtgaagccccaggagtttg

SEQ ID NO: 237114 - DNA, 28 bp, Artificial Sequence
  Description of Artificial Sequence: Synthetic oligonucleotide
tgttcacggtgaagccccaggagtttgg

SEQ ID NO: 237115 - DNA, 27 bp, Artificial Sequence
  Description of Artificial Sequence: Synthetic oligonucleotide
gttcacggtgaagccccaggagtttgg

SEQ ID NO: 237116 - DNA, 27 bp, Artificial Sequence
  Description of Artificial Sequence: Synthetic oligonucleotide
ttcacggtgaagccccaggagtttggg

SEQ ID NO: 237117 - DNA, 27 bp, Artificial Sequence
  Description of Artificial Sequence: Synthetic oligonucleotide
tcacggtgaagccccaggagtttggga

SEQ ID NO: 237118 - DNA, 27 bp, Artificial Sequence
  Description of Artificial Sequence: Synthetic oligonucleotide
cacggtgaagccccaggagtttgggaa

SEQ ID NO: 237119 - DNA, 27 bp, Artificial Sequence
  Description of Artificial Sequence: Synthetic oligonucleotide
acggtgaagccccaggagtttgggaag

SEQ ID NO: 237120 - DNA, 26 bp, Artificial Sequence
  Description of Artificial Sequence: Synthetic oligonucleotide
cggtgaagccccaggagtttgggaag

SEQ ID NO: 237121 - DNA, 26 bp, Artificial Sequence
  Description of Artificial Sequence: Synthetic oligonucleotide
ggtgaagccccaggagtttgggaagc

SEQ ID NO: 237122 - DNA, 26 bp, Artificial Sequence
  Description of Artificial Sequence: Synthetic oligonucleotide
gtgaagccccaggagtttgggaagcc

SEQ ID NO: 237123 - DNA, 27 bp, Artificial Sequence
  Description of Artificial Sequence: Synthetic oligonucleotide
tgaagccccaggagtttgggaagccca

SEQ ID NO: 237124 - DNA, 27 bp, Artificial Sequence
  Description of Artificial Sequence: Synthetic oligonucleotide
gaagccccaggagtttgggaagcccaa

SEQ ID NO: 237125 - DNA, 27 bp, Artificial Sequence
  Description of Artificial Sequence: Synthetic oligonucleotide
aagccccaggagtttgggaagcccaac

SEQ ID NO: 237126 - DNA, 27 bp, Artificial Sequence
  Description of Artificial Sequence: Synthetic oligonucleotide
agccccaggagtttgggaagcccaact

SEQ ID NO: 237127 - DNA, 26 bp, Artificial Sequence
  Description of Artificial Sequence: Synthetic oligonucleotide
gccccaggagtttgggaagcccaact

SEQ ID NO: 237128 - DNA, 27 bp, Artificial Sequence
  Description of Artificial Sequence: Synthetic oligonucleotide
ccccaggagtttgggaagcccaactct

SEQ ID NO: 237129 - DNA, 29 bp, Artificial Sequence
  Description of Artificial Sequence: Synthetic oligonucleotide
cccaggagtttgggaagcccaactctttg

SEQ ID NO: 237130 - DNA, 29 bp, Artificial Sequence
  Description of Artificial Sequence: Synthetic oligonucleotide
ccaggagtttgggaagcccaactctttgg

SEQ ID NO: 237131 - DNA, 30 bp, Artificial Sequence
  Description of Artificial Sequence: Synthetic oligonucleotide
caggagtttgggaagcccaactctttggtc

SEQ ID NO: 237132 - DNA, 31 bp, Artificial Sequence
  Description of Artificial Sequence: Synthetic oligonucleotide
aggagtttgggaagcccaactctttggtctc

SEQ ID NO: 237133 - DNA, 30 bp, Artificial Sequence
  Description of Artificial Sequence: Synthetic oligonucleotide
ggagtttgggaagcccaactctttggtctc

SEQ ID NO: 237134 - DNA, 34 bp, Artificial Sequence
  Description of Artificial Sequence: Synthetic oligonucleotide
gagtttgggaagcccaactctttggtctcttttg

SEQ ID NO: 237135 - DNA, 35 bp, Artificial Sequence
  Description of Artificial Sequence: Synthetic oligonucleotide
agtttgggaagcccaactctttggtctcttttgtc

SEQ ID NO: 237136 - DNA, 34 bp, Artificial Sequence
  Description of Artificial Sequence: Synthetic oligonucleotide
gtttgggaagcccaactctttggtctcttttgtc

SEQ ID NO: 237137 - DNA, 35 bp, Artificial Sequence
  Description of Artificial Sequence: Synthetic oligonucleotide
tttgggaagcccaactctttggtctcttttgtcag

SEQ ID NO: 237138 - DNA, 34 bp, Artificial Sequence
  Description of Artificial Sequence: Synthetic oligonucleotide
ttgggaagcccaactctttggtctcttttgtcag

SEQ ID NO: 237139 - DNA, 33 bp, Artificial Sequence
  Description of Artificial Sequence: Synthetic oligonucleotide
tgggaagcccaactctttggtctcttttgtcag

SEQ ID NO: 237140 - DNA, 32 bp, Artificial Sequence
  Description of Artificial Sequence: Synthetic oligonucleotide
gggaagcccaactctttggtctcttttgtcag

SEQ ID NO: 237141 - DNA, 36 bp, Artificial Sequence
  Description of Artificial Sequence: Synthetic oligonucleotide
ggaagcccaactctttggtctcttttgtcagaaatc

SEQ ID NO: 237142 - DNA, 37 bp, Artificial Sequence
  Description of Artificial Sequence: Synthetic oligonucleotide
gaagcccaactctttggtctcttttgtcagaaatctc

SEQ ID NO: 237143 - DNA, 39 bp, Artificial Sequence
  Description of Artificial Sequence: Synthetic oligonucleotide
aagcccaactctttggtctcttttgtcagaaatctcttc

SEQ ID NO: 237144 - DNA, 38 bp, Artificial Sequence
  Description of Artificial Sequence: Synthetic oligonucleotide
agcccaactctttggtctcttttgtcagaaatctcttc

SEQ ID NO: 237145 - DNA, 37 bp, Artificial Sequence
  Description of Artificial Sequence: Synthetic oligonucleotide
gcccaactctttggtctcttttgtcagaaatctcttc

SEQ ID NO: 237146 - DNA, 37 bp, Artificial Sequence
  Description of Artificial Sequence: Synthetic oligonucleotide
cccaactctttggtctcttttgtcagaaatctcttcg

SEQ ID NO: 237147 - DNA, 37 bp, Artificial Sequence
  Description of Artificial Sequence: Synthetic oligonucleotide
ccaactctttggtctcttttgtcagaaatctcttcgc

SEQ ID NO: 237148 - DNA, 38 bp, Artificial Sequence
  Description of Artificial Sequence: Synthetic oligonucleotide
caactctttggtctcttttgtcagaaatctcttcgcac

SEQ ID NO: 237149 - DNA, 38 bp, Artificial Sequence
  Description of Artificial Sequence: Synthetic oligonucleotide
aactctttggtctcttttgtcagaaatctcttcgcacc

SEQ ID NO: 237150 - DNA, 37 bp, Artificial Sequence
  Description of Artificial Sequence: Synthetic oligonucleotide
actctttggtctcttttgtcagaaatctcttcgcacc

SEQ ID NO: 237151 - DNA, 36 bp, Artificial Sequence
  Description of Artificial Sequence: Synthetic oligonucleotide
ctctttggtctcttttgtcagaaatctcttcgcacc

SEQ ID NO: 237152 - DNA, 36 bp, Artificial Sequence
  Description of Artificial Sequence: Synthetic oligonucleotide
tctttggtctcttttgtcagaaatctcttcgcaccc

SEQ ID NO: 237153 - DNA, 35 bp, Artificial Sequence
  Description of Artificial Sequence: Synthetic oligonucleotide
ctttggtctcttttgtcagaaatctcttcgcaccc

SEQ ID NO: 237154 - DNA, 37 bp, Artificial Sequence
  Description of Artificial Sequence: Synthetic oligonucleotide
tttggtctcttttgtcagaaatctcttcgcacccatg

SEQ ID NO: 237155 - DNA, 36 bp, Artificial Sequence
  Description of Artificial Sequence: Synthetic oligonucleotide
ttggtctcttttgtcagaaatctcttcgcacccatg

SEQ ID NO: 237156 - DNA, 35 bp, Artificial Sequence
  Description of Artificial Sequence: Synthetic oligonucleotide
tggtctcttttgtcagaaatctcttcgcacccatg

SEQ ID NO: 237157 - DNA, 34 bp, Artificial Sequence
  Description of Artificial Sequence: Synthetic oligonucleotide
ggtctcttttgtcagaaatctcttcgcacccatg

SEQ ID NO: 237158 - DNA, 34 bp, Artificial Sequence
  Description of Artificial Sequence: Synthetic oligonucleotide
gtctcttttgtcagaaatctcttcgcacccatgc

SEQ ID NO: 237159 - DNA, 35 bp, Artificial Sequence
  Description of Artificial Sequence: Synthetic oligonucleotide
tctcttttgtcagaaatctcttcgcacccatgcag

SEQ ID NO: 237160 - DNA, 34 bp, Artificial Sequence
  Description of Artificial Sequence: Synthetic oligonucleotide
ctcttttgtcagaaatctcttcgcacccatgcag

SEQ ID NO: 237161 - DNA, 35 bp, Artificial Sequence
  Description of Artificial Sequence: Synthetic oligonucleotide
tcttttgtcagaaatctcttcgcacccatgcagac

SEQ ID NO: 237162 - DNA, 34 bp, Artificial Sequence
  Description of Artificial Sequence: Synthetic oligonucleotide
cttttgtcagaaatctcttcgcacccatgcagac

SEQ ID NO: 237163 - DNA, 35 bp, Artificial Sequence
  Description of Artificial Sequence: Synthetic oligonucleotide
ttttgtcagaaatctcttcgcacccatgcagacag

SEQ ID NO: 237164 - DNA, 34 bp, Artificial Sequence
  Description of Artificial Sequence: Synthetic oligonucleotide
tttgtcagaaatctcttcgcacccatgcagacag

SEQ ID NO: 237165 - DNA, 33 bp, Artificial Sequence
  Description of Artificial Sequence: Synthetic oligonucleotide
ttgtcagaaatctcttcgcacccatgcagacag

SEQ ID NO: 237166 - DNA, 32 bp, Artificial Sequence
  Description of Artificial Sequence: Synthetic oligonucleotide
tgtcagaaatctcttcgcacccatgcagacag

SEQ ID NO: 237167 - DNA, 31 bp, Artificial Sequence
  Description of Artificial Sequence: Synthetic oligonucleotide
gtcagaaatctcttcgcacccatgcagacag

SEQ ID NO: 237168 - DNA, 32 bp, Artificial Sequence
  Description of Artificial Sequence: Synthetic oligonucleotide
tcagaaatctcttcgcacccatgcagacagtg

SEQ ID NO: 237169 - DNA, 31 bp, Artificial Sequence
  Description of Artificial Sequence: Synthetic oligonucleotide
cagaaatctcttcgcacccatgcagacagtg

SEQ ID NO: 237170 - DNA, 33 bp, Artificial Sequence
  Description of Artificial Sequence: Synthetic oligonucleotide
agaaatctcttcgcacccatgcagacagtgaag

SEQ ID NO: 237171 - DNA, 32 bp, Artificial Sequence
  Description of Artificial Sequence: Synthetic oligonucleotide
gaaatctcttcgcacccatgcagacagtgaag

SEQ ID NO: 237172 - DNA, 33 bp, Artificial Sequence
  Description of Artificial Sequence: Synthetic oligonucleotide
aaatctcttcgcacccatgcagacagtgaagtg

SEQ ID NO: 237173 - DNA, 32 bp, Artificial Sequence
  Description of Artificial Sequence: Synthetic oligonucleotide
aatctcttcgcacccatgcagacagtgaagtg

SEQ ID NO: 237174 - DNA, 31 bp, Artificial Sequence
  Description of Artificial Sequence: Synthetic oligonucleotide
atctcttcgcacccatgcagacagtgaagtg

SEQ ID NO: 237175 - DNA, 30 bp, Artificial Sequence
  Description of Artificial Sequence: Synthetic oligonucleotide
tctcttcgcacccatgcagacagtgaagtg

SEQ ID NO: 237176 - DNA, 29 bp, Artificial Sequence
  Description of Artificial Sequence: Synthetic oligonucleotide
ctcttcgcacccatgcagacagtgaagtg

SEQ ID NO: 237177 - DNA, 29 bp, Artificial Sequence
  Description of Artificial Sequence: Synthetic oligonucleotide
tcttcgcacccatgcagacagtgaagtgg

SEQ ID NO: 237178 - DNA, 28 bp, Artificial Sequence
  Description of Artificial Sequence: Synthetic oligonucleotide
cttcgcacccatgcagacagtgaagtgg

SEQ ID NO: 237179 - DNA, 28 bp, Artificial Sequence
  Description of Artificial Sequence: Synthetic oligonucleotide
ttcgcacccatgcagacagtgaagtggc

SEQ ID NO: 237180 - DNA, 27 bp, Artificial Sequence
  Description of Artificial Sequence: Synthetic oligonucleotide
tcgcacccatgcagacagtgaagtggc

SEQ ID NO: 237181 - DNA, 27 bp, Artificial Sequence
  Description of Artificial Sequence: Synthetic oligonucleotide
cgcacccatgcagacagtgaagtggca

SEQ ID NO: 237182 - DNA, 27 bp, Artificial Sequence
  Description of Artificial Sequence: Synthetic oligonucleotide
gcacccatgcagacagtgaagtggcag

SEQ ID NO: 237183 - DNA, 27 bp, Artificial Sequence
  Description of Artificial Sequence: Synthetic oligonucleotide
cacccatgcagacagtgaagtggcagc

SEQ ID NO: 237184 - DNA, 29 bp, Artificial Sequence
  Description of Artificial Sequence: Synthetic oligonucleotide
acccatgcagacagtgaagtggcagcatg

SEQ ID NO: 237185 - DNA, 28 bp, Artificial Sequence
  Description of Artificial Sequence: Synthetic oligonucleotide
cccatgcagacagtgaagtggcagcatg

SEQ ID NO: 237186 - DNA, 31 bp, Artificial Sequence
  Description of Artificial Sequence: Synthetic oligonucleotide
ccatgcagacagtgaagtggcagcatgattc

SEQ ID NO: 237187 - DNA, 31 bp, Artificial Sequence
  Description of Artificial Sequence: Synthetic oligonucleotide
catgcagacagtgaagtggcagcatgattcc

SEQ ID NO: 237188 - DNA, 31 bp, Artificial Sequence
  Description of Artificial Sequence: Synthetic oligonucleotide
atgcagacagtgaagtggcagcatgattccg

SEQ ID NO: 237189 - DNA, 30 bp, Artificial Sequence
  Description of Artificial Sequence: Synthetic oligonucleotide
tgcagacagtgaagtggcagcatgattccg

SEQ ID NO: 237190 - DNA, 29 bp, Artificial Sequence
  Description of Artificial Sequence: Synthetic oligonucleotide
gcagacagtgaagtggcagcatgattccg

SEQ ID NO: 237191 - DNA, 30 bp, Artificial Sequence
  Description of Artificial Sequence: Synthetic oligonucleotide
cagacagtgaagtggcagcatgattccgtc

SEQ ID NO: 237192 - DNA, 30 bp, Artificial Sequence
  Description of Artificial Sequence: Synthetic oligonucleotide
agacagtgaagtggcagcatgattccgtcc

SEQ ID NO: 237193 - DNA, 29 bp, Artificial Sequence
  Description of Artificial Sequence: Synthetic oligonucleotide
gacagtgaagtggcagcatgattccgtcc

SEQ ID NO: 237194 - DNA, 29 bp, Artificial Sequence
  Description of Artificial Sequence: Synthetic oligonucleotide
acagtgaagtggcagcatgattccgtccg

SEQ ID NO: 237195 - DNA, 28 bp, Artificial Sequence
  Description of Artificial Sequence: Synthetic oligonucleotide
cagtgaagtggcagcatgattccgtccg

SEQ ID NO: 237196 - DNA, 29 bp, Artificial Sequence
  Description of Artificial Sequence: Synthetic oligonucleotide
agtgaagtggcagcatgattccgtccgtg

SEQ ID NO: 237197 - DNA, 28 bp, Artificial Sequence
  Description of Artificial Sequence: Synthetic oligonucleotide
gtgaagtggcagcatgattccgtccgtg

SEQ ID NO: 237198 - DNA, 29 bp, Artificial Sequence
  Description of Artificial Sequence: Synthetic oligonucleotide
tgaagtggcagcatgattccgtccgtgtg

SEQ ID NO: 237199 - DNA, 28 bp, Artificial Sequence
  Description of Artificial Sequence: Synthetic oligonucleotide
gaagtggcagcatgattccgtccgtgtg

SEQ ID NO: 237200 - DNA, 28 bp, Artificial Sequence
  Description of Artificial Sequence: Synthetic oligonucleotide
aagtggcagcatgattccgtccgtgtgg

SEQ ID NO: 237201 - DNA, 27 bp, Artificial Sequence
  Description of Artificial Sequence: Synthetic oligonucleotide
agtggcagcatgattccgtccgtgtgg

SEQ ID NO: 237202 - DNA, 27 bp, Artificial Sequence
  Description of Artificial Sequence: Synthetic oligonucleotide
gtggcagcatgattccgtccgtgtgga

SEQ ID NO: 237203 - DNA, 28 bp, Artificial Sequence
  Description of Artificial Sequence: Synthetic oligonucleotide
tggcagcatgattccgtccgtgtggaag

SEQ ID NO: 237204 - DNA, 27 bp, Artificial Sequence
  Description of Artificial Sequence: Synthetic oligonucleotide
ggcagcatgattccgtccgtgtggaag

SEQ ID NO: 237205 - DNA, 27 bp, Artificial Sequence
  Description of Artificial Sequence: Synthetic oligonucleotide
gcagcatgattccgtccgtgtggaagg

SEQ ID NO: 237206 - DNA, 31 bp, Artificial Sequence
  Description of Artificial Sequence: Synthetic oligonucleotide
cagcatgattccgtccgtgtggaaggttttg

SEQ ID NO: 237207 - DNA, 31 bp, Artificial Sequence
  Description of Artificial Sequence: Synthetic oligonucleotide
agcatgattccgtccgtgtggaaggttttgg

SEQ ID NO: 237208 - DNA, 30 bp, Artificial Sequence
  Description of Artificial Sequence: Synthetic oligonucleotide
gcatgattccgtccgtgtggaaggttttgg

SEQ ID NO: 237209 - DNA, 30 bp, Artificial Sequence
  Description of Artificial Sequence: Synthetic oligonucleotide
catgattccgtccgtgtggaaggttttggg

SEQ ID NO: 237210 - DNA, 30 bp, Artificial Sequence
  Description of Artificial Sequence: Synthetic oligonucleotide
atgattccgtccgtgtggaaggttttgggc

SEQ ID NO: 237211 - DNA, 29 bp, Artificial Sequence
  Description of Artificial Sequence: Synthetic oligonucleotide
tgattccgtccgtgtggaaggttttgggc

SEQ ID NO: 237212 - DNA, 28 bp, Artificial Sequence
  Description of Artificial Sequence: Synthetic oligonucleotide
gattccgtccgtgtggaaggttttgggc

SEQ ID NO: 237213 - DNA, 28 bp, Artificial Sequence
  Description of Artificial Sequence: Synthetic oligonucleotide
attccgtccgtgtggaaggttttgggcc

SEQ ID NO: 237214 - DNA, 27 bp, Artificial Sequence
  Description of Artificial Sequence: Synthetic oligonucleotide
ttccgtccgtgtggaaggttttgggcc

SEQ ID NO: 237215 - DNA, 27 bp, Artificial Sequence
  Description of Artificial Sequence: Synthetic oligonucleotide
tccgtccgtgtggaaggttttgggcct

SEQ ID NO: 237216 - DNA, 27 bp, Artificial Sequence
  Description of Artificial Sequence: Synthetic oligonucleotide
ccgtccgtgtggaaggttttgggcctt

SEQ ID NO: 237217 - DNA, 27 bp, Artificial Sequence
  Description of Artificial Sequence: Synthetic oligonucleotide
cgtccgtgtggaaggttttgggccttc

SEQ ID NO: 237218 - DNA, 31 bp, Artificial Sequence
  Description of Artificial Sequence: Synthetic oligonucleotide
gtccgtgtggaaggttttgggccttcttttg

SEQ ID NO: 237219 - DNA, 32 bp, Artificial Sequence
  Description of Artificial Sequence: Synthetic oligonucleotide
tccgtgtggaaggttttgggccttcttttgtc

SEQ ID NO: 237220 - DNA, 31 bp, Artificial Sequence
  Description of Artificial Sequence: Synthetic oligonucleotide
ccgtgtggaaggttttgggccttcttttgtc

SEQ ID NO: 237221 - DNA, 32 bp, Artificial Sequence
  Description of Artificial Sequence: Synthetic oligonucleotide
cgtgtggaaggttttgggccttcttttgtctg

SEQ ID NO: 237222 - DNA, 33 bp, Artificial Sequence
  Description of Artificial Sequence: Synthetic oligonucleotide
gtgtggaaggttttgggccttcttttgtctgag

SEQ ID NO: 237223 - DNA, 33 bp, Artificial Sequence
  Description of Artificial Sequence: Synthetic oligonucleotide
tgtggaaggttttgggccttcttttgtctgagc

SEQ ID NO: 237224 - DNA, 32 bp, Artificial Sequence
  Description of Artificial Sequence: Synthetic oligonucleotide
gtggaaggttttgggccttcttttgtctgagc

SEQ ID NO: 237225 - DNA, 33 bp, Artificial Sequence
  Description of Artificial Sequence: Synthetic oligonucleotide
tggaaggttttgggccttcttttgtctgagctg

SEQ ID NO: 237226 - DNA, 32 bp, Artificial Sequence
  Description of Artificial Sequence: Synthetic oligonucleotide
ggaaggttttgggccttcttttgtctgagctg

SEQ ID NO: 237227 - DNA, 33 bp, Artificial Sequence
  Description of Artificial Sequence: Synthetic oligonucleotide
gaaggttttgggccttcttttgtctgagctgtc

SEQ ID NO: 237228 - DNA, 33 bp, Artificial Sequence
  Description of Artificial Sequence: Synthetic oligonucleotide
aaggttttgggccttcttttgtctgagctgtcg

SEQ ID NO: 237229 - DNA, 32 bp, Artificial Sequence
  Description of Artificial Sequence: Synthetic oligonucleotide
aggttttgggccttcttttgtctgagctgtcg

SEQ ID NO: 237230 - DNA, 31 bp, Artificial Sequence
  Description of Artificial Sequence: Synthetic oligonucleotide
ggttttgggccttcttttgtctgagctgtcg

SEQ ID NO: 237231 - DNA, 33 bp, Artificial Sequence
  Description of Artificial Sequence: Synthetic oligonucleotide
gttttgggccttcttttgtctgagctgtcgaag

SEQ ID NO: 237232 - DNA, 33 bp, Artificial Sequence
  Description of Artificial Sequence: Synthetic oligonucleotide
ttttgggccttcttttgtctgagctgtcgaagg

SEQ ID NO: 237233 - DNA, 32 bp, Artificial Sequence
  Description of Artificial Sequence: Synthetic oligonucleotide
tttgggccttcttttgtctgagctgtcgaagg

SEQ ID NO: 237234 - DNA, 31 bp, Artificial Sequence
  Description of Artificial Sequence: Synthetic oligonucleotide
ttgggccttcttttgtctgagctgtcgaagg

SEQ ID NO: 237235 - DNA, 30 bp, Artificial Sequence
  Description of Artificial Sequence: Synthetic oligonucleotide
tgggccttcttttgtctgagctgtcgaagg

SEQ ID NO: 237236 - DNA, 29 bp, Artificial Sequence
  Description of Artificial Sequence: Synthetic oligonucleotide
gggccttcttttgtctgagctgtcgaagg

SEQ ID NO: 237237 - DNA, 30 bp, Artificial Sequence
  Description of Artificial Sequence: Synthetic oligonucleotide
ggccttcttttgtctgagctgtcgaaggac

SEQ ID NO: 237238 - DNA, 31 bp, Artificial Sequence
  Description of Artificial Sequence: Synthetic oligonucleotide
gccttcttttgtctgagctgtcgaaggactc

SEQ ID NO: 237239 - DNA, 32 bp, Artificial Sequence
  Description of Artificial Sequence: Synthetic oligonucleotide
ccttcttttgtctgagctgtcgaaggactcag

SEQ ID NO: 237240 - DNA, 32 bp, Artificial Sequence
  Description of Artificial Sequence: Synthetic oligonucleotide
cttcttttgtctgagctgtcgaaggactcagc

SEQ ID NO: 237241 - DNA, 34 bp, Artificial Sequence
  Description of Artificial Sequence: Synthetic oligonucleotide
ttcttttgtctgagctgtcgaaggactcagcatc

SEQ ID NO: 237242 - DNA, 33 bp, Artificial Sequence
  Description of Artificial Sequence: Synthetic oligonucleotide
tcttttgtctgagctgtcgaaggactcagcatc

SEQ ID NO: 237243 - DNA, 32 bp, Artificial Sequence
  Description of Artificial Sequence: Synthetic oligonucleotide
cttttgtctgagctgtcgaaggactcagcatc

SEQ ID NO: 237244 - DNA, 32 bp, Artificial Sequence
  Description of Artificial Sequence: Synthetic oligonucleotide
ttttgtctgagctgtcgaaggactcagcatcc

SEQ ID NO: 237245 - DNA, 31 bp, Artificial Sequence
  Description of Artificial Sequence: Synthetic oligonucleotide
tttgtctgagctgtcgaaggactcagcatcc

SEQ ID NO: 237246 - DNA, 30 bp, Artificial Sequence
  Description of Artificial Sequence: Synthetic oligonucleotide
ttgtctgagctgtcgaaggactcagcatcc

SEQ ID NO: 237247 - DNA, 29 bp, Artificial Sequence
  Description of Artificial Sequence: Synthetic oligonucleotide
tgtctgagctgtcgaaggactcagcatcc

SEQ ID NO: 237248 - DNA, 28 bp, Artificial Sequence
  Description of Artificial Sequence: Synthetic oligonucleotide
gtctgagctgtcgaaggactcagcatcc

SEQ ID NO: 237249 - DNA, 29 bp, Artificial Sequence
  Description of Artificial Sequence: Synthetic oligonucleotide
tctgagctgtcgaaggactcagcatccag

SEQ ID NO: 237250 - DNA, 28 bp, Artificial Sequence
  Description of Artificial Sequence: Synthetic oligonucleotide
ctgagctgtcgaaggactcagcatccag

SEQ ID NO: 237251 - DNA, 28 bp, Artificial Sequence
  Description of Artificial Sequence: Synthetic oligonucleotide
tgagctgtcgaaggactcagcatccagg

SEQ ID NO: 237252 - DNA, 27 bp, Artificial Sequence
  Description of Artificial Sequence: Synthetic oligonucleotide
gagctgtcgaaggactcagcatccagg

SEQ ID NO: 237253 - DNA, 27 bp, Artificial Sequence
  Description of Artificial Sequence: Synthetic oligonucleotide
agctgtcgaaggactcagcatccaggc

SEQ ID NO: 237254 - DNA, 26 bp, Artificial Sequence
  Description of Artificial Sequence: Synthetic oligonucleotide
gctgtcgaaggactcagcatccaggc

SEQ ID NO: 237255 - DNA, 27 bp, Artificial Sequence
  Description of Artificial Sequence: Synthetic oligonucleotide
ctgtcgaaggactcagcatccaggcct

SEQ ID NO: 237256 - DNA, 30 bp, Artificial Sequence
  Description of Artificial Sequence: Synthetic oligonucleotide
tgtcgaaggactcagcatccaggcctattc

SEQ ID NO: 237257 - DNA, 29 bp, Artificial Sequence
  Description of Artificial Sequence: Synthetic oligonucleotide
gtcgaaggactcagcatccaggcctattc

SEQ ID NO: 237258 - DNA, 32 bp, Artificial Sequence
  Description of Artificial Sequence: Synthetic oligonucleotide
tcgaaggactcagcatccaggcctattcttac

SEQ ID NO: 237259 - DNA, 31 bp, Artificial Sequence
  Description of Artificial Sequence: Synthetic oligonucleotide
cgaaggactcagcatccaggcctattcttac

SEQ ID NO: 237260 - DNA, 36 bp, Artificial Sequence
  Description of Artificial Sequence: Synthetic oligonucleotide
gaaggactcagcatccaggcctattcttactttaac

SEQ ID NO: 237261 - DNA, 38 bp, Artificial Sequence
  Description of Artificial Sequence: Synthetic oligonucleotide
aaggactcagcatccaggcctattcttactttaacttc

SEQ ID NO: 237262 - DNA, 37 bp, Artificial Sequence
  Description of Artificial Sequence: Synthetic oligonucleotide
aggactcagcatccaggcctattcttactttaacttc

SEQ ID NO: 237263 - DNA, 36 bp, Artificial Sequence
  Description of Artificial Sequence: Synthetic oligonucleotide
ggactcagcatccaggcctattcttactttaacttc

SEQ ID NO: 237264 - DNA, 37 bp, Artificial Sequence
  Description of Artificial Sequence: Synthetic oligonucleotide
gactcagcatccaggcctattcttactttaacttcac

SEQ ID NO: 237265 - DNA, 38 bp, Artificial Sequence
  Description of Artificial Sequence: Synthetic oligonucleotide
actcagcatccaggcctattcttactttaacttcacag

SEQ ID NO: 237266 - DNA, 37 bp, Artificial Sequence
  Description of Artificial Sequence: Synthetic oligonucleotide
ctcagcatccaggcctattcttactttaacttcacag

SEQ ID NO: 237267 - DNA, 37 bp, Artificial Sequence
  Description of Artificial Sequence: Synthetic oligonucleotide
tcagcatccaggcctattcttactttaacttcacagc

SEQ ID NO: 237268 - DNA, 36 bp, Artificial Sequence
  Description of Artificial Sequence: Synthetic oligonucleotide
cagcatccaggcctattcttactttaacttcacagc

SEQ ID NO: 237269 - DNA, 37 bp, Artificial Sequence
  Description of Artificial Sequence: Synthetic oligonucleotide
agcatccaggcctattcttactttaacttcacagcag

SEQ ID NO: 237270 - DNA, 36 bp, Artificial Sequence
  Description of Artificial Sequence: Synthetic oligonucleotide
gcatccaggcctattcttactttaacttcacagcag

SEQ ID NO: 237271 - DNA, 38 bp, Artificial Sequence
  Description of Artificial Sequence: Synthetic oligonucleotide
catccaggcctattcttactttaacttcacagcagaac

SEQ ID NO: 237272 - DNA, 38 bp, Artificial Sequence
  Description of Artificial Sequence: Synthetic oligonucleotide
atccaggcctattcttactttaacttcacagcagaacc

SEQ ID NO: 237273 - DNA, 37 bp, Artificial Sequence
  Description of Artificial Sequence: Synthetic oligonucleotide
tccaggcctattcttactttaacttcacagcagaacc

SEQ ID NO: 237274 - DNA, 36 bp, Artificial Sequence
  Description of Artificial Sequence: Synthetic oligonucleotide
ccaggcctattcttactttaacttcacagcagaacc

SEQ ID NO: 237275 - DNA, 38 bp, Artificial Sequence
  Description of Artificial Sequence: Synthetic oligonucleotide
caggcctattcttactttaacttcacagcagaaccttg

SEQ ID NO: 237276 - DNA, 39 bp, Artificial Sequence
  Description of Artificial Sequence: Synthetic oligonucleotide
aggcctattcttactttaacttcacagcagaaccttgtg

SEQ ID NO: 237277 - DNA, 38 bp, Artificial Sequence
  Description of Artificial Sequence: Synthetic oligonucleotide
ggcctattcttactttaacttcacagcagaaccttgtg

SEQ ID NO: 237278 - DNA, 39 bp, Artificial Sequence
  Description of Artificial Sequence: Synthetic oligonucleotide
gcctattcttactttaacttcacagcagaaccttgtgac

SEQ ID NO: 237279 - DNA, 44 bp, Artificial Sequence
  Description of Artificial Sequence: Synthetic oligonucleotide
cctattcttactttaacttcacagcagaaccttgtgacattttg

SEQ ID NO: 237280 - DNA, 45 bp, Artificial Sequence
  Description of Artificial Sequence: Synthetic oligonucleotide
ctattcttactttaacttcacagcagaaccttgtgacattttgtc

SEQ ID NO: 237281 - DNA, 45 bp, Artificial Sequence
  Description of Artificial Sequence: Synthetic oligonucleotide
tattcttactttaacttcacagcagaaccttgtgacattttgtcc

SEQ ID NO: 237282 - DNA, 44 bp, Artificial Sequence
  Description of Artificial Sequence: Synthetic oligonucleotide
attcttactttaacttcacagcagaaccttgtgacattttgtcc

SEQ ID NO: 237283 - DNA, 43 bp, Artificial Sequence
  Description of Artificial Sequence: Synthetic oligonucleotide
ttcttactttaacttcacagcagaaccttgtgacattttgtcc

SEQ ID NO: 237284 - DNA, 42 bp, Artificial Sequence
  Description of Artificial Sequence: Synthetic oligonucleotide
tcttactttaacttcacagcagaaccttgtgacattttgtcc

SEQ ID NO: 237285 - DNA, 41 bp, Artificial Sequence
  Description of Artificial Sequence: Synthetic oligonucleotide
cttactttaacttcacagcagaaccttgtgacattttgtcc

SEQ ID NO: 237286 - DNA, 42 bp, Artificial Sequence
  Description of Artificial Sequence: Synthetic oligonucleotide
ttactttaacttcacagcagaaccttgtgacattttgtcctg

SEQ ID NO: 237287 - DNA, 41 bp, Artificial Sequence
  Description of Artificial Sequence: Synthetic oligonucleotide
tactttaacttcacagcagaaccttgtgacattttgtcctg

SEQ ID NO: 237288 - DNA, 40 bp, Artificial Sequence
  Description of Artificial Sequence: Synthetic oligonucleotide
actttaacttcacagcagaaccttgtgacattttgtcctg

SEQ ID NO: 237289 - DNA, 39 bp, Artificial Sequence
  Description of Artificial Sequence: Synthetic oligonucleotide
ctttaacttcacagcagaaccttgtgacattttgtcctg

SEQ ID NO: 237290 - DNA, 39 bp, Artificial Sequence
  Description of Artificial Sequence: Synthetic oligonucleotide
tttaacttcacagcagaaccttgtgacattttgtcctgc

SEQ ID NO: 237291 - DNA, 38 bp, Artificial Sequence
  Description of Artificial Sequence: Synthetic oligonucleotide
ttaacttcacagcagaaccttgtgacattttgtcctgc

SEQ ID NO: 237292 - DNA, 37 bp, Artificial Sequence
  Description of Artificial Sequence: Synthetic oligonucleotide
taacttcacagcagaaccttgtgacattttgtcctgc

SEQ ID NO: 237293 - DNA, 36 bp, Artificial Sequence
  Description of Artificial Sequence: Synthetic oligonucleotide
aacttcacagcagaaccttgtgacattttgtcctgc

SEQ ID NO: 237294 - DNA, 35 bp, Artificial Sequence
  Description of Artificial Sequence: Synthetic oligonucleotide
acttcacagcagaaccttgtgacattttgtcctgc

SEQ ID NO: 237295 - DNA, 34 bp, Artificial Sequence
  Description of Artificial Sequence: Synthetic oligonucleotide
cttcacagcagaaccttgtgacattttgtcctgc

SEQ ID NO: 237296 - DNA, 37 bp, Artificial Sequence
  Description of Artificial Sequence: Synthetic oligonucleotide
ttcacagcagaaccttgtgacattttgtcctgcattc

SEQ ID NO: 237297 - DNA, 36 bp, Artificial Sequence
  Description of Artificial Sequence: Synthetic oligonucleotide
tcacagcagaaccttgtgacattttgtcctgcattc

SEQ ID NO: 237298 - DNA, 35 bp, Artificial Sequence
  Description of Artificial Sequence: Synthetic oligonucleotide
cacagcagaaccttgtgacattttgtcctgcattc

SEQ ID NO: 237299 - DNA, 36 bp, Artificial Sequence
  Description of Artificial Sequence: Synthetic oligonucleotide
acagcagaaccttgtgacattttgtcctgcattctg

SEQ ID NO: 237300 - DNA, 35 bp, Artificial Sequence
  Description of Artificial Sequence: Synthetic oligonucleotide
cagcagaaccttgtgacattttgtcctgcattctg

SEQ ID NO: 237301 - DNA, 36 bp, Artificial Sequence
  Description of Artificial Sequence: Synthetic oligonucleotide
agcagaaccttgtgacattttgtcctgcattctgac

SEQ ID NO: 237302 - DNA, 35 bp, Artificial Sequence
  Description of Artificial Sequence: Synthetic oligonucleotide
gcagaaccttgtgacattttgtcctgcattctgac

SEQ ID NO: 237303 - DNA, 36 bp, Artificial Sequence
  Description of Artificial Sequence: Synthetic oligonucleotide
cagaaccttgtgacattttgtcctgcattctgactc

SEQ ID NO: 237304 - DNA, 37 bp, Artificial Sequence
  Description of Artificial Sequence: Synthetic oligonucleotide
agaaccttgtgacattttgtcctgcattctgactcac

SEQ ID NO: 237305 - DNA, 36 bp, Artificial Sequence
  Description of Artificial Sequence: Synthetic oligonucleotide
gaaccttgtgacattttgtcctgcattctgactcac

SEQ ID NO: 237306 - DNA, 36 bp, Artificial Sequence
  Description of Artificial Sequence: Synthetic oligonucleotide
aaccttgtgacattttgtcctgcattctgactcacg

SEQ ID NO: 237307 - DNA, 35 bp, Artificial Sequence
  Description of Artificial Sequence: Synthetic oligonucleotide
accttgtgacattttgtcctgcattctgactcacg

SEQ ID NO: 237308 - DNA, 34 bp, Artificial Sequence
  Description of Artificial Sequence: Synthetic oligonucleotide
ccttgtgacattttgtcctgcattctgactcacg

SEQ ID NO: 237309 - DNA, 39 bp, Artificial Sequence
  Description of Artificial Sequence: Synthetic oligonucleotide
cttgtgacattttgtcctgcattctgactcacgtaattg

SEQ ID NO: 237310 - DNA, 40 bp, Artificial Sequence
  Description of Artificial Sequence: Synthetic oligonucleotide
ttgtgacattttgtcctgcattctgactcacgtaattgac

SEQ ID NO: 237311 - DNA, 39 bp, Artificial Sequence
  Description of Artificial Sequence: Synthetic oligonucleotide
tgtgacattttgtcctgcattctgactcacgtaattgac

SEQ ID NO: 237312 - DNA, 38 bp, Artificial Sequence
  Description of Artificial Sequence: Synthetic oligonucleotide
gtgacattttgtcctgcattctgactcacgtaattgac

SEQ ID NO: 237313 - DNA, 38 bp, Artificial Sequence
  Description of Artificial Sequence: Synthetic oligonucleotide
tgacattttgtcctgcattctgactcacgtaattgacc

SEQ ID NO: 237314 - DNA, 37 bp, Artificial Sequence
  Description of Artificial Sequence: Synthetic oligonucleotide
gacattttgtcctgcattctgactcacgtaattgacc

SEQ ID NO: 237315 - DNA, 37 bp, Artificial Sequence
  Description of Artificial Sequence: Synthetic oligonucleotide
acattttgtcctgcattctgactcacgtaattgaccg

SEQ ID NO: 237316 - DNA, 36 bp, Artificial Sequence
  Description of Artificial Sequence: Synthetic oligonucleotide
cattttgtcctgcattctgactcacgtaattgaccg

SEQ ID NO: 237317 - DNA, 36 bp, Artificial Sequence
  Description of Artificial Sequence: Synthetic oligonucleotide
attttgtcctgcattctgactcacgtaattgaccgg

SEQ ID NO: 237318 - DNA, 35 bp, Artificial Sequence
  Description of Artificial Sequence: Synthetic oligonucleotide
ttttgtcctgcattctgactcacgtaattgaccgg

SEQ ID NO: 237319 - DNA, 34 bp, Artificial Sequence
  Description of Artificial Sequence: Synthetic oligonucleotide
tttgtcctgcattctgactcacgtaattgaccgg

SEQ ID NO: 237320 - DNA, 33 bp, Artificial Sequence
  Description of Artificial Sequence: Synthetic oligonucleotide
ttgtcctgcattctgactcacgtaattgaccgg

SEQ ID NO: 237321 - DNA, 32 bp, Artificial Sequence
  Description of Artificial Sequence: Synthetic oligonucleotide
tgtcctgcattctgactcacgtaattgaccgg

SEQ ID NO: 237322 - DNA, 31 bp, Artificial Sequence
  Description of Artificial Sequence: Synthetic oligonucleotide
gtcctgcattctgactcacgtaattgaccgg

SEQ ID NO: 237323 - DNA, 33 bp, Artificial Sequence
  Description of Artificial Sequence: Synthetic oligonucleotide
tcctgcattctgactcacgtaattgaccggtac

SEQ ID NO: 237324 - DNA, 32 bp, Artificial Sequence
  Description of Artificial Sequence: Synthetic oligonucleotide
cctgcattctgactcacgtaattgaccggtac

SEQ ID NO: 237325 - DNA, 33 bp, Artificial Sequence
  Description of Artificial Sequence: Synthetic oligonucleotide
ctgcattctgactcacgtaattgaccggtacac

SEQ ID NO: 237326 - DNA, 34 bp, Artificial Sequence
  Description of Artificial Sequence: Synthetic oligonucleotide
tgcattctgactcacgtaattgaccggtacacag

SEQ ID NO: 237327 - DNA, 33 bp, Artificial Sequence
  Description of Artificial Sequence: Synthetic oligonucleotide
gcattctgactcacgtaattgaccggtacacag

SEQ ID NO: 237328 - DNA, 33 bp, Artificial Sequence
  Description of Artificial Sequence: Synthetic oligonucleotide
cattctgactcacgtaattgaccggtacacagc

SEQ ID NO: 237329 - DNA, 37 bp, Artificial Sequence
  Description of Artificial Sequence: Synthetic oligonucleotide
attctgactcacgtaattgaccggtacacagcatttg

SEQ ID NO: 237330 - DNA, 36 bp, Artificial Sequence
  Description of Artificial Sequence: Synthetic oligonucleotide
ttctgactcacgtaattgaccggtacacagcatttg

SEQ ID NO: 237331 - DNA, 35 bp, Artificial Sequence
  Description of Artificial Sequence: Synthetic oligonucleotide
tctgactcacgtaattgaccggtacacagcatttg

SEQ ID NO: 237332 - DNA, 34 bp, Artificial Sequence
  Description of Artificial Sequence: Synthetic oligonucleotide
ctgactcacgtaattgaccggtacacagcatttg

SEQ ID NO: 237333 - DNA, 34 bp, Artificial Sequence
  Description of Artificial Sequence: Synthetic oligonucleotide
tgactcacgtaattgaccggtacacagcatttgc

SEQ ID NO: 237334 - DNA, 33 bp, Artificial Sequence
  Description of Artificial Sequence: Synthetic oligonucleotide
gactcacgtaattgaccggtacacagcatttgc

SEQ ID NO: 237335 - DNA, 33 bp, Artificial Sequence
  Description of Artificial Sequence: Synthetic oligonucleotide
actcacgtaattgaccggtacacagcatttgcc

SEQ ID NO: 237336 - DNA, 32 bp, Artificial Sequence
  Description of Artificial Sequence: Synthetic oligonucleotide
ctcacgtaattgaccggtacacagcatttgcc

SEQ ID NO: 237337 - DNA, 36 bp, Artificial Sequence
  Description of Artificial Sequence: Synthetic oligonucleotide
tcacgtaattgaccggtacacagcatttgcctattc

SEQ ID NO: 237338 - DNA, 35 bp, Artificial Sequence
  Description of Artificial Sequence: Synthetic oligonucleotide
cacgtaattgaccggtacacagcatttgcctattc

SEQ ID NO: 237339 - DNA, 35 bp, Artificial Sequence
  Description of Artificial Sequence: Synthetic oligonucleotide
acgtaattgaccggtacacagcatttgcctattcg

SEQ ID NO: 237340 - DNA, 34 bp, Artificial Sequence
  Description of Artificial Sequence: Synthetic oligonucleotide
cgtaattgaccggtacacagcatttgcctattcg

SEQ ID NO: 237341 - DNA, 34 bp, Artificial Sequence
  Description of Artificial Sequence: Synthetic oligonucleotide
gtaattgaccggtacacagcatttgcctattcgg

SEQ ID NO: 237342 - DNA, 36 bp, Artificial Sequence
  Description of Artificial Sequence: Synthetic oligonucleotide
taattgaccggtacacagcatttgcctattcggtac

SEQ ID NO: 237343 - DNA, 35 bp, Artificial Sequence
  Description of Artificial Sequence: Synthetic oligonucleotide
aattgaccggtacacagcatttgcctattcggtac

SEQ ID NO: 237344 - DNA, 34 bp, Artificial Sequence
  Description of Artificial Sequence: Synthetic oligonucleotide
attgaccggtacacagcatttgcctattcggtac

SEQ ID NO: 237345 - DNA, 33 bp, Artificial Sequence
  Description of Artificial Sequence: Synthetic oligonucleotide
ttgaccggtacacagcatttgcctattcggtac

SEQ ID NO: 237346 - DNA, 32 bp, Artificial Sequence
  Description of Artificial Sequence: Synthetic oligonucleotide
tgaccggtacacagcatttgcctattcggtac

SEQ ID NO: 237347 - DNA, 31 bp, Artificial Sequence
  Description of Artificial Sequence: Synthetic oligonucleotide
gaccggtacacagcatttgcctattcggtac

SEQ ID NO: 237348 - DNA, 31 bp, Artificial Sequence
  Description of Artificial Sequence: Synthetic oligonucleotide
accggtacacagcatttgcctattcggtacc

SEQ ID NO: 237349 - DNA, 30 bp, Artificial Sequence
  Description of Artificial Sequence: Synthetic oligonucleotide
ccggtacacagcatttgcctattcggtacc

SEQ ID NO: 237350 - DNA, 30 bp, Artificial Sequence
  Description of Artificial Sequence: Synthetic oligonucleotide
cggtacacagcatttgcctattcggtaccc

SEQ ID NO: 237351 - DNA, 30 bp, Artificial Sequence
  Description of Artificial Sequence: Synthetic oligonucleotide
ggtacacagcatttgcctattcggtacccc

SEQ ID NO: 237352 - DNA, 30 bp, Artificial Sequence
  Description of Artificial Sequence: Synthetic oligonucleotide
gtacacagcatttgcctattcggtaccccg

SEQ ID NO: 237353 - DNA, 30 bp, Artificial Sequence
  Description of Artificial Sequence: Synthetic oligonucleotide
tacacagcatttgcctattcggtaccccgc

SEQ ID NO: 237354 - DNA, 29 bp, Artificial Sequence
  Description of Artificial Sequence: Synthetic oligonucleotide
acacagcatttgcctattcggtaccccgc

SEQ ID NO: 237355 - DNA, 28 bp, Artificial Sequence
  Description of Artificial Sequence: Synthetic oligonucleotide
cacagcatttgcctattcggtaccccgc

SEQ ID NO: 237356 - DNA, 30 bp, Artificial Sequence
  Description of Artificial Sequence: Synthetic oligonucleotide
acagcatttgcctattcggtaccccgcaac

SEQ ID NO: 237357 - DNA, 29 bp, Artificial Sequence
  Description of Artificial Sequence: Synthetic oligonucleotide
cagcatttgcctattcggtaccccgcaac

SEQ ID NO: 237358 - DNA, 29 bp, Artificial Sequence
  Description of Artificial Sequence: Synthetic oligonucleotide
agcatttgcctattcggtaccccgcaacg

SEQ ID NO: 237359 - DNA, 28 bp, Artificial Sequence
  Description of Artificial Sequence: Synthetic oligonucleotide
gcatttgcctattcggtaccccgcaacg

SEQ ID NO: 237360 - DNA, 28 bp, Artificial Sequence
  Description of Artificial Sequence: Synthetic oligonucleotide
catttgcctattcggtaccccgcaacgc

SEQ ID NO: 237361 - DNA, 29 bp, Artificial Sequence
  Description of Artificial Sequence: Synthetic oligonucleotide
atttgcctattcggtaccccgcaacgcac

SEQ ID NO: 237362 - DNA, 28 bp, Artificial Sequence
  Description of Artificial Sequence: Synthetic oligonucleotide
tttgcctattcggtaccccgcaacgcac

SEQ ID NO: 237363 - DNA, 27 bp, Artificial Sequence
  Description of Artificial Sequence: Synthetic oligonucleotide
ttgcctattcggtaccccgcaacgcac

SEQ ID NO: 237364 - DNA, 27 bp, Artificial Sequence
  Description of Artificial Sequence: Synthetic oligonucleotide
tgcctattcggtaccccgcaacgcact

SEQ ID NO: 237365 - DNA, 26 bp, Artificial Sequence
  Description of Artificial Sequence: Synthetic oligonucleotide
gcctattcggtaccccgcaacgcact

SEQ ID NO: 237366 - DNA, 26 bp, Artificial Sequence
  Description of Artificial Sequence: Synthetic oligonucleotide
cctattcggtaccccgcaacgcactg

SEQ ID NO: 237367 - DNA, 26 bp, Artificial Sequence
  Description of Artificial Sequence: Synthetic oligonucleotide
ctattcggtaccccgcaacgcactgg

SEQ ID NO: 237368 - DNA, 26 bp, Artificial Sequence
  Description of Artificial Sequence: Synthetic oligonucleotide
tattcggtaccccgcaacgcactggc

SEQ ID NO: 237369 - DNA, 25 bp, Artificial Sequence
  Description of Artificial Sequence: Synthetic oligonucleotide
attcggtaccccgcaacgcactggc

SEQ ID NO: 237370 - DNA, 24 bp, Artificial Sequence
  Description of Artificial Sequence: Synthetic oligonucleotide
ttcggtaccccgcaacgcactggc

SEQ ID NO: 237371 - DNA, 23 bp, Artificial Sequence
  Description of Artificial Sequence: Synthetic oligonucleotide
tcggtaccccgcaacgcactggc

SEQ ID NO: 237372 - DNA, 22 bp, Artificial Sequence
  Description of Artificial Sequence: Synthetic oligonucleotide
cggtaccccgcaacgcactggc

SEQ ID NO: 237373 - DNA, 23 bp, Artificial Sequence
  Description of Artificial Sequence: Synthetic oligonucleotide
ggtaccccgcaacgcactggcct

SEQ ID NO: 237374 - DNA, 24 bp, Artificial Sequence
  Description of Artificial Sequence: Synthetic oligonucleotide
gtaccccgcaacgcactggcctca

SEQ ID NO: 237375 - DNA, 26 bp, Artificial Sequence
  Description of Artificial Sequence: Synthetic oligonucleotide
taccccgcaacgcactggcctcagat

SEQ ID NO: 237376 - DNA, 25 bp, Artificial Sequence
  Description of Artificial Sequence: Synthetic oligonucleotide
accccgcaacgcactggcctcagat

SEQ ID NO: 237377 - DNA, 24 bp, Artificial Sequence
  Description of Artificial Sequence: Synthetic oligonucleotide
ccccgcaacgcactggcctcagat

SEQ ID NO: 237378 - DNA, 25 bp, Artificial Sequence
  Description of Artificial Sequence: Synthetic oligonucleotide
cccgcaacgcactggcctcagatca

SEQ ID NO: 237379 - DNA, 25 bp, Artificial Sequence
  Description of Artificial Sequence: Synthetic oligonucleotide
ccgcaacgcactggcctcagatcag

SEQ ID NO: 237380 - DNA, 26 bp, Artificial Sequence
  Description of Artificial Sequence: Synthetic oligonucleotide
cgcaacgcactggcctcagatcagct

SEQ ID NO: 237381 - DNA, 26 bp, Artificial Sequence
  Description of Artificial Sequence: Synthetic oligonucleotide
gcaacgcactggcctcagatcagctg

SEQ ID NO: 237382 - DNA, 27 bp, Artificial Sequence
  Description of Artificial Sequence: Synthetic oligonucleotide
caacgcactggcctcagatcagctgga

SEQ ID NO: 237383 - DNA, 27 bp, Artificial Sequence
  Description of Artificial Sequence: Synthetic oligonucleotide
aacgcactggcctcagatcagctggag

SEQ ID NO: 237384 - DNA, 27 bp, Artificial Sequence
  Description of Artificial Sequence: Synthetic oligonucleotide
acgcactggcctcagatcagctggaga

SEQ ID NO: 237385 - DNA, 27 bp, Artificial Sequence
  Description of Artificial Sequence: Synthetic oligonucleotide
cgcactggcctcagatcagctggagaa

SEQ ID NO: 237386 - DNA, 28 bp, Artificial Sequence
  Description of Artificial Sequence: Synthetic oligonucleotide
gcactggcctcagatcagctggagaaag

SEQ ID NO: 237387 - DNA, 29 bp, Artificial Sequence
  Description of Artificial Sequence: Synthetic oligonucleotide
cactggcctcagatcagctggagaaagtg

SEQ ID NO: 237388 - DNA, 29 bp, Artificial Sequence
  Description of Artificial Sequence: Synthetic oligonucleotide
actggcctcagatcagctggagaaagtgc

SEQ ID NO: 237389 - DNA, 28 bp, Artificial Sequence
  Description of Artificial Sequence: Synthetic oligonucleotide
ctggcctcagatcagctggagaaagtgc

SEQ ID NO: 237390 - DNA, 29 bp, Artificial Sequence
  Description of Artificial Sequence: Synthetic oligonucleotide
tggcctcagatcagctggagaaagtgctg

SEQ ID NO: 237391 - DNA, 28 bp, Artificial Sequence
  Description of Artificial Sequence: Synthetic oligonucleotide
ggcctcagatcagctggagaaagtgctg

SEQ ID NO: 237392 - DNA, 29 bp, Artificial Sequence
  Description of Artificial Sequence: Synthetic oligonucleotide
gcctcagatcagctggagaaagtgctgtg

SEQ ID NO: 237393 - DNA, 30 bp, Artificial Sequence
  Description of Artificial Sequence: Synthetic oligonucleotide
cctcagatcagctggagaaagtgctgtgtc

SEQ ID NO: 237394 - DNA, 30 bp, Artificial Sequence
  Description of Artificial Sequence: Synthetic oligonucleotide
ctcagatcagctggagaaagtgctgtgtcg

SEQ ID NO: 237395 - DNA, 30 bp, Artificial Sequence
  Description of Artificial Sequence: Synthetic oligonucleotide
tcagatcagctggagaaagtgctgtgtcgc

SEQ ID NO: 237396 - DNA, 29 bp, Artificial Sequence
  Description of Artificial Sequence: Synthetic oligonucleotide
cagatcagctggagaaagtgctgtgtcgc

SEQ ID NO: 237397 - DNA, 29 bp, Artificial Sequence
  Description of Artificial Sequence: Synthetic oligonucleotide
agatcagctggagaaagtgctgtgtcgcg

SEQ ID NO: 237398 - DNA, 28 bp, Artificial Sequence
  Description of Artificial Sequence: Synthetic oligonucleotide
gatcagctggagaaagtgctgtgtcgcg

SEQ ID NO: 237399 - DNA, 29 bp, Artificial Sequence
  Description of Artificial Sequence: Synthetic oligonucleotide
atcagctggagaaagtgctgtgtcgcgtg

SEQ ID NO: 237400 - DNA, 28 bp, Artificial Sequence
  Description of Artificial Sequence: Synthetic oligonucleotide
tcagctggagaaagtgctgtgtcgcgtg

SEQ ID NO: 237401 - DNA, 27 bp, Artificial Sequence
  Description of Artificial Sequence: Synthetic oligonucleotide
cagctggagaaagtgctgtgtcgcgtg

SEQ ID NO: 237402 - DNA, 27 bp, Artificial Sequence
  Description of Artificial Sequence: Synthetic oligonucleotide
agctggagaaagtgctgtgtcgcgtgg

SEQ ID NO: 237403 - DNA, 26 bp, Artificial Sequence
  Description of Artificial Sequence: Synthetic oligonucleotide
gctggagaaagtgctgtgtcgcgtgg

SEQ ID NO: 237404 - DNA, 26 bp, Artificial Sequence
  Description of Artificial Sequence: Synthetic oligonucleotide
ctggagaaagtgctgtgtcgcgtggc

SEQ ID NO: 237405 - DNA, 27 bp, Artificial Sequence
  Description of Artificial Sequence: Synthetic oligonucleotide
tggagaaagtgctgtgtcgcgtggcct

SEQ ID NO: 237406 - DNA, 27 bp, Artificial Sequence
  Description of Artificial Sequence: Synthetic oligonucleotide
ggagaaagtgctgtgtcgcgtggccta

SEQ ID NO: 237407 - DNA, 28 bp, Artificial Sequence
  Description of Artificial Sequence: Synthetic oligonucleotide
gagaaagtgctgtgtcgcgtggcctatg

SEQ ID NO: 237408 - DNA, 28 bp, Artificial Sequence
  Description of Artificial Sequence: Synthetic oligonucleotide
agaaagtgctgtgtcgcgtggcctatgg

SEQ ID NO: 237409 - DNA, 27 bp, Artificial Sequence
  Description of Artificial Sequence: Synthetic oligonucleotide
gaaagtgctgtgtcgcgtggcctatgg

SEQ ID NO: 237410 - DNA, 27 bp, Artificial Sequence
  Description of Artificial Sequence: Synthetic oligonucleotide
aaagtgctgtgtcgcgtggcctatggc

SEQ ID NO: 237411 - DNA, 26 bp, Artificial Sequence
  Description of Artificial Sequence: Synthetic oligonucleotide
aagtgctgtgtcgcgtggcctatggc

SEQ ID NO: 237412 - DNA, 25 bp, Artificial Sequence
  Description of Artificial Sequence: Synthetic oligonucleotide
agtgctgtgtcgcgtggcctatggc

SEQ ID NO: 237413 - DNA, 24 bp, Artificial Sequence
  Description of Artificial Sequence: Synthetic oligonucleotide
gtgctgtgtcgcgtggcctatggc

SEQ ID NO: 237414 - DNA, 25 bp, Artificial Sequence
  Description of Artificial Sequence: Synthetic oligonucleotide
tgctgtgtcgcgtggcctatggcct

SEQ ID NO: 237415 - DNA, 24 bp, Artificial Sequence
  Description of Artificial Sequence: Synthetic oligonucleotide
gctgtgtcgcgtggcctatggcct

SEQ ID NO: 237416 - DNA, 24 bp, Artificial Sequence
  Description of Artificial Sequence: Synthetic oligonucleotide
ctgtgtcgcgtggcctatggcctg

SEQ ID NO: 237417 - DNA, 24 bp, Artificial Sequence
  Description of Artificial Sequence: Synthetic oligonucleotide
tgtgtcgcgtggcctatggcctgg

SEQ ID NO: 237418 - DNA, 23 bp, Artificial Sequence
  Description of Artificial Sequence: Synthetic oligonucleotide
gtgtcgcgtggcctatggcctgg

SEQ ID NO: 237419 - DNA, 24 bp, Artificial Sequence
  Description of Artificial Sequence: Synthetic oligonucleotide
tgtcgcgtggcctatggcctggga

SEQ ID NO: 237420 - DNA, 23 bp, Artificial Sequence
  Description of Artificial Sequence: Synthetic oligonucleotide
gtcgcgtggcctatggcctggga

SEQ ID NO: 237421 - DNA, 24 bp, Artificial Sequence
  Description of Artificial Sequence: Synthetic oligonucleotide
tcgcgtggcctatggcctgggagt

SEQ ID NO: 237422 - DNA, 23 bp, Artificial Sequence
  Description of Artificial Sequence: Synthetic oligonucleotide
cgcgtggcctatggcctgggagt

SEQ ID NO: 237423 - DNA, 23 bp, Artificial Sequence
  Description of Artificial Sequence: Synthetic oligonucleotide
gcgtggcctatggcctgggagtg

SEQ ID NO: 237424 - DNA, 24 bp, Artificial Sequence
  Description of Artificial Sequence: Synthetic oligonucleotide
cgtggcctatggcctgggagtgct

SEQ ID NO: 237425 - DNA, 24 bp, Artificial Sequence
  Description of Artificial Sequence: Synthetic oligonucleotide
gtggcctatggcctgggagtgctg

SEQ ID NO: 237426 - DNA, 24 bp, Artificial Sequence
  Description of Artificial Sequence: Synthetic oligonucleotide
tggcctatggcctgggagtgctgg

SEQ ID NO: 237427 - DNA, 23 bp, Artificial Sequence
  Description of Artificial Sequence: Synthetic oligonucleotide
ggcctatggcctgggagtgctgg

SEQ ID NO: 237428 - DNA, 23 bp, Artificial Sequence
  Description of Artificial Sequence: Synthetic oligonucleotide
gcctatggcctgggagtgctggg

SEQ ID NO: 237429 - DNA, 25 bp, Artificial Sequence
  Description of Artificial Sequence: Synthetic oligonucleotide
cctatggcctgggagtgctgggctt

SEQ ID NO: 237430 - DNA, 27 bp, Artificial Sequence
  Description of Artificial Sequence: Synthetic oligonucleotide
ctatggcctgggagtgctgggcttcat

SEQ ID NO: 237431 - DNA, 27 bp, Artificial Sequence
  Description of Artificial Sequence: Synthetic oligonucleotide
tatggcctgggagtgctgggcttcatc

SEQ ID NO: 237432 - DNA, 26 bp, Artificial Sequence
  Description of Artificial Sequence: Synthetic oligonucleotide
atggcctgggagtgctgggcttcatc

SEQ ID NO: 237433 - DNA, 25 bp, Artificial Sequence
  Description of Artificial Sequence: Synthetic oligonucleotide
tggcctgggagtgctgggcttcatc

SEQ ID NO: 237434 - DNA, 24 bp, Artificial Sequence
  Description of Artificial Sequence: Synthetic oligonucleotide
ggcctgggagtgctgggcttcatc

SEQ ID NO: 237435 - DNA, 25 bp, Artificial Sequence
  Description of Artificial Sequence: Synthetic oligonucleotide
gcctgggagtgctgggcttcatcgt

SEQ ID NO: 237436 - DNA, 25 bp, Artificial Sequence
  Description of Artificial Sequence: Synthetic oligonucleotide
cctgggagtgctgggcttcatcgtg

SEQ ID NO: 237437 - DNA, 25 bp, Artificial Sequence
  Description of Artificial Sequence: Synthetic oligonucleotide
ctgggagtgctgggcttcatcgtgg

SEQ ID NO: 237438 - DNA, 25 bp, Artificial Sequence
  Description of Artificial Sequence: Synthetic oligonucleotide
tgggagtgctgggcttcatcgtggc

SEQ ID NO: 237439 - DNA, 24 bp, Artificial Sequence
  Description of Artificial Sequence: Synthetic oligonucleotide
gggagtgctgggcttcatcgtggc

SEQ ID NO: 237440 - DNA, 27 bp, Artificial Sequence
  Description of Artificial Sequence: Synthetic oligonucleotide
ggagtgctgggcttcatcgtggccatt

SEQ ID NO: 237441 - DNA, 27 bp, Artificial Sequence
  Description of Artificial Sequence: Synthetic oligonucleotide
gagtgctgggcttcatcgtggccattg

SEQ ID NO: 237442 - DNA, 29 bp, Artificial Sequence
  Description of Artificial Sequence: Synthetic oligonucleotide
agtgctgggcttcatcgtggccattgttc

SEQ ID NO: 237443 - DNA, 28 bp, Artificial Sequence
  Description of Artificial Sequence: Synthetic oligonucleotide
gtgctgggcttcatcgtggccattgttc

SEQ ID NO: 237444 - DNA, 29 bp, Artificial Sequence
  Description of Artificial Sequence: Synthetic oligonucleotide
tgctgggcttcatcgtggccattgttctg

SEQ ID NO: 237445 - DNA, 28 bp, Artificial Sequence
  Description of Artificial Sequence: Synthetic oligonucleotide
gctgggcttcatcgtggccattgttctg

SEQ ID NO: 237446 - DNA, 30 bp, Artificial Sequence
  Description of Artificial Sequence: Synthetic oligonucleotide
ctgggcttcatcgtggccattgttctgatc

SEQ ID NO: 237447 - DNA, 32 bp, Artificial Sequence
  Description of Artificial Sequence: Synthetic oligonucleotide
tgggcttcatcgtggccattgttctgatcatc

SEQ ID NO: 237448 - DNA, 31 bp, Artificial Sequence
  Description of Artificial Sequence: Synthetic oligonucleotide
gggcttcatcgtggccattgttctgatcatc

SEQ ID NO: 237449 - DNA, 33 bp, Artificial Sequence
  Description of Artificial Sequence: Synthetic oligonucleotide
ggcttcatcgtggccattgttctgatcatctac

SEQ ID NO: 237450 - DNA, 35 bp, Artificial Sequence
  Description of Artificial Sequence: Synthetic oligonucleotide
gcttcatcgtggccattgttctgatcatctacatc

SEQ ID NO: 237451 - DNA, 35 bp, Artificial Sequence
  Description of Artificial Sequence: Synthetic oligonucleotide
cttcatcgtggccattgttctgatcatctacatcc

SEQ ID NO: 237452 - DNA, 35 bp, Artificial Sequence
  Description of Artificial Sequence: Synthetic oligonucleotide
ttcatcgtggccattgttctgatcatctacatccg

SEQ ID NO: 237453 - DNA, 34 bp, Artificial Sequence
  Description of Artificial Sequence: Synthetic oligonucleotide
tcatcgtggccattgttctgatcatctacatccg

SEQ ID NO: 237454 - DNA, 33 bp, Artificial Sequence
  Description of Artificial Sequence: Synthetic oligonucleotide
catcgtggccattgttctgatcatctacatccg

SEQ ID NO: 237455 - DNA, 33 bp, Artificial Sequence
  Description of Artificial Sequence: Synthetic oligonucleotide
atcgtggccattgttctgatcatctacatccgg

SEQ ID NO: 237456 - DNA, 32 bp, Artificial Sequence
  Description of Artificial Sequence: Synthetic oligonucleotide
tcgtggccattgttctgatcatctacatccgg

SEQ ID NO: 237457 - DNA, 31 bp, Artificial Sequence
  Description of Artificial Sequence: Synthetic oligonucleotide
cgtggccattgttctgatcatctacatccgg

SEQ ID NO: 237458 - DNA, 33 bp, Artificial Sequence
  Description of Artificial Sequence: Synthetic oligonucleotide
gtggccattgttctgatcatctacatccggaag

SEQ ID NO: 237459 - DNA, 33 bp, Artificial Sequence
  Description of Artificial Sequence: Synthetic oligonucleotide
tggccattgttctgatcatctacatccggaagc

SEQ ID NO: 237460 - DNA, 32 bp, Artificial Sequence
  Description of Artificial Sequence: Synthetic oligonucleotide
ggccattgttctgatcatctacatccggaagc

SEQ ID NO: 237461 - DNA, 32 bp, Artificial Sequence
  Description of Artificial Sequence: Synthetic oligonucleotide
gccattgttctgatcatctacatccggaagcg

SEQ ID NO: 237462 - DNA, 34 bp, Artificial Sequence
  Description of Artificial Sequence: Synthetic oligonucleotide
ccattgttctgatcatctacatccggaagcgttg

SEQ ID NO: 237463 - DNA, 34 bp, Artificial Sequence
  Description of Artificial Sequence: Synthetic oligonucleotide
cattgttctgatcatctacatccggaagcgttgc

SEQ ID NO: 237464 - DNA, 35 bp, Artificial Sequence
  Description of Artificial Sequence: Synthetic oligonucleotide
attgttctgatcatctacatccggaagcgttgctc

SEQ ID NO: 237465 - DNA, 34 bp, Artificial Sequence
  Description of Artificial Sequence: Synthetic oligonucleotide
ttgttctgatcatctacatccggaagcgttgctc

SEQ ID NO: 237466 - DNA, 33 bp, Artificial Sequence
  Description of Artificial Sequence: Synthetic oligonucleotide
tgttctgatcatctacatccggaagcgttgctc

SEQ ID NO: 237467 - DNA, 32 bp, Artificial Sequence
  Description of Artificial Sequence: Synthetic oligonucleotide
gttctgatcatctacatccggaagcgttgctc

SEQ ID NO: 237468 - DNA, 33 bp, Artificial Sequence
  Description of Artificial Sequence: Synthetic oligonucleotide
ttctgatcatctacatccggaagcgttgctcag

SEQ ID NO: 237469 - DNA, 32 bp, Artificial Sequence
  Description of Artificial Sequence: Synthetic oligonucleotide
tctgatcatctacatccggaagcgttgctcag

SEQ ID NO: 237470 - DNA, 31 bp, Artificial Sequence
  Description of Artificial Sequence: Synthetic oligonucleotide
ctgatcatctacatccggaagcgttgctcag

SEQ ID NO: 237471 - DNA, 31 bp, Artificial Sequence
  Description of Artificial Sequence: Synthetic oligonucleotide
tgatcatctacatccggaagcgttgctcagg

SEQ ID NO: 237472 - DNA, 30 bp, Artificial Sequence
  Description of Artificial Sequence: Synthetic oligonucleotide
gatcatctacatccggaagcgttgctcagg

SEQ ID NO: 237473 - DNA, 31 bp, Artificial Sequence
  Description of Artificial Sequence: Synthetic oligonucleotide
atcatctacatccggaagcgttgctcaggag

SEQ ID NO: 237474 - DNA, 30 bp, Artificial Sequence
  Description of Artificial Sequence: Synthetic oligonucleotide
tcatctacatccggaagcgttgctcaggag

SEQ ID NO: 237475 - DNA, 29 bp, Artificial Sequence
  Description of Artificial Sequence: Synthetic oligonucleotide
catctacatccggaagcgttgctcaggag

SEQ ID NO: 237476 - DNA, 30 bp, Artificial Sequence
  Description of Artificial Sequence: Synthetic oligonucleotide
atctacatccggaagcgttgctcaggagac

SEQ ID NO: 237477 - DNA, 29 bp, Artificial Sequence
  Description of Artificial Sequence: Synthetic oligonucleotide
tctacatccggaagcgttgctcaggagac

SEQ ID NO: 237478 - DNA, 28 bp, Artificial Sequence
  Description of Artificial Sequence: Synthetic oligonucleotide
ctacatccggaagcgttgctcaggagac

SEQ ID NO: 237479 - DNA, 29 bp, Artificial Sequence
  Description of Artificial Sequence: Synthetic oligonucleotide
tacatccggaagcgttgctcaggagactg

SEQ ID NO: 237480 - DNA, 28 bp, Artificial Sequence
  Description of Artificial Sequence: Synthetic oligonucleotide
acatccggaagcgttgctcaggagactg

SEQ ID NO: 237481 - DNA, 27 bp, Artificial Sequence
  Description of Artificial Sequence: Synthetic oligonucleotide
catccggaagcgttgctcaggagactg

SEQ ID NO: 237482 - DNA, 28 bp, Artificial Sequence
  Description of Artificial Sequence: Synthetic oligonucleotide
atgatcacaatcctgccgcagctgctgg

SEQ ID NO: 237483 - DNA, 27 bp, Artificial Sequence
  Description of Artificial Sequence: Synthetic oligonucleotide
tgatcacaatcctgccgcagctgctgg

SEQ ID NO: 237484 - DNA, 26 bp, Artificial Sequence
  Description of Artificial Sequence: Synthetic oligonucleotide
gatcacaatcctgccgcagctgctgg

SEQ ID NO: 237485 - DNA, 26 bp, Artificial Sequence
  Description of Artificial Sequence: Synthetic oligonucleotide
atcacaatcctgccgcagctgctggg

SEQ ID NO: 237486 - DNA, 25 bp, Artificial Sequence
  Description of Artificial Sequence: Synthetic oligonucleotide
tcacaatcctgccgcagctgctggg

SEQ ID NO: 237487 - DNA, 24 bp, Artificial Sequence
  Description of Artificial Sequence: Synthetic oligonucleotide
cacaatcctgccgcagctgctggg

SEQ ID NO: 237488 - DNA, 24 bp, Artificial Sequence
  Description of Artificial Sequence: Synthetic oligonucleotide
acaatcctgccgcagctgctgggc

SEQ ID NO: 237489 - DNA, 23 bp, Artificial Sequence
  Description of Artificial Sequence: Synthetic oligonucleotide
caatcctgccgcagctgctgggc

SEQ ID NO: 237490 - DNA, 24 bp, Artificial Sequence
  Description of Artificial Sequence: Synthetic oligonucleotide
aatcctgccgcagctgctgggcct

SEQ ID NO: 237491 - DNA, 23 bp, Artificial Sequence
  Description of Artificial Sequence: Synthetic oligonucleotide
atcctgccgcagctgctgggcct

SEQ ID NO: 237492 - DNA, 22 bp, Artificial Sequence
  Description of Artificial Sequence: Synthetic oligonucleotide
tcctgccgcagctgctgggcct

SEQ ID NO: 237493 - DNA, 21 bp, Artificial Sequence
  Description of Artificial Sequence: Synthetic oligonucleotide
cctgccgcagctgctgggcct

SEQ ID NO: 237494 - DNA, 22 bp, Artificial Sequence
  Description of Artificial Sequence: Synthetic oligonucleotide
ctgccgcagctgctgggcctca

SEQ ID NO: 237495 - DNA, 22 bp, Artificial Sequence
  Description of Artificial Sequence: Synthetic oligonucleotide
tgccgcagctgctgggcctcag

SEQ ID NO: 237496 - DNA, 21 bp, Artificial Sequence
  Description of Artificial Sequence: Synthetic oligonucleotide
gccgcagctgctgggcctcag

SEQ ID NO: 237497 - DNA, 21 bp, Artificial Sequence
  Description of Artificial Sequence: Synthetic oligonucleotide
ccgcagctgctgggcctcagc

SEQ ID NO: 237498 - DNA, 22 bp, Artificial Sequence
  Description of Artificial Sequence: Synthetic oligonucleotide
cgcagctgctgggcctcagcct

SEQ ID NO: 237499 - DNA, 22 bp, Artificial Sequence
  Description of Artificial Sequence: Synthetic oligonucleotide
gcagctgctgggcctcagcctg

SEQ ID NO: 237500 - DNA, 22 bp, Artificial Sequence
  Description of Artificial Sequence: Synthetic oligonucleotide
cagctgctgggcctcagcctgc

SEQ ID NO: 237501 - DNA, 22 bp, Artificial Sequence
  Description of Artificial Sequence: Synthetic oligonucleotide
agctgctgggcctcagcctgcg

SEQ ID NO: 237502 - DNA, 21 bp, Artificial Sequence
  Description of Artificial Sequence: Synthetic oligonucleotide
gctgctgggcctcagcctgcg

SEQ ID NO: 237503 - DNA, 22 bp, Artificial Sequence
  Description of Artificial Sequence: Synthetic oligonucleotide
ctgctgggcctcagcctgcgct

SEQ ID NO: 237504 - DNA, 22 bp, Artificial Sequence
  Description of Artificial Sequence: Synthetic oligonucleotide
tgctgggcctcagcctgcgctg

SEQ ID NO: 237505 - DNA, 21 bp, Artificial Sequence
  Description of Artificial Sequence: Synthetic oligonucleotide
gctgggcctcagcctgcgctg

SEQ ID NO: 237506 - DNA, 22 bp, Artificial Sequence
  Description of Artificial Sequence: Synthetic oligonucleotide
ctgggcctcagcctgcgctgca

SEQ ID NO: 237507 - DNA, 23 bp, Artificial Sequence
  Description of Artificial Sequence: Synthetic oligonucleotide
tgggcctcagcctgcgctgcaca

SEQ ID NO: 237508 - DNA, 22 bp, Artificial Sequence
  Description of Artificial Sequence: Synthetic oligonucleotide
gggcctcagcctgcgctgcaca

SEQ ID NO: 237509 - DNA, 22 bp, Artificial Sequence
  Description of Artificial Sequence: Synthetic oligonucleotide
ggcctcagcctgcgctgcacag

SEQ ID NO: 237510 - DNA, 23 bp, Artificial Sequence
  Description of Artificial Sequence: Synthetic oligonucleotide
gcctcagcctgcgctgcacagca

SEQ ID NO: 237511 - DNA, 23 bp, Artificial Sequence
  Description of Artificial Sequence: Synthetic oligonucleotide
cctcagcctgcgctgcacagcag

SEQ ID NO: 237512 - DNA, 24 bp, Artificial Sequence
  Description of Artificial Sequence: Synthetic oligonucleotide
ctcagcctgcgctgcacagcagca

SEQ ID NO: 237513 - DNA, 24 bp, Artificial Sequence
  Description of Artificial Sequence: Synthetic oligonucleotide
tcagcctgcgctgcacagcagcag

SEQ ID NO: 237514 - DNA, 23 bp, Artificial Sequence
  Description of Artificial Sequence: Synthetic oligonucleotide
cagcctgcgctgcacagcagcag

SEQ ID NO: 237515 - DNA, 24 bp, Artificial Sequence
  Description of Artificial Sequence: Synthetic oligonucleotide
agcctgcgctgcacagcagcaggt

SEQ ID NO: 237516 - DNA, 23 bp, Artificial Sequence
  Description of Artificial Sequence: Synthetic oligonucleotide
gcctgcgctgcacagcagcaggt

SEQ ID NO: 237517 - DNA, 23 bp, Artificial Sequence
  Description of Artificial Sequence: Synthetic oligonucleotide
cctgcgctgcacagcagcaggtg

SEQ ID NO: 237518 - DNA, 23 bp, Artificial Sequence
  Description of Artificial Sequence: Synthetic oligonucleotide
ctgcgctgcacagcagcaggtgg

SEQ ID NO: 237519 - DNA, 25 bp, Artificial Sequence
  Description of Artificial Sequence: Synthetic oligonucleotide
tgcgctgcacagcagcaggtgggtt

SEQ ID NO: 237520 - DNA, 24 bp, Artificial Sequence
  Description of Artificial Sequence: Synthetic oligonucleotide
gcgctgcacagcagcaggtgggtt

SEQ ID NO: 237521 - DNA, 24 bp, Artificial Sequence
  Description of Artificial Sequence: Synthetic oligonucleotide
cgctgcacagcagcaggtgggttc

SEQ ID NO: 237522 - DNA, 25 bp, Artificial Sequence
  Description of Artificial Sequence: Synthetic oligonucleotide
gctgcacagcagcaggtgggttcgt

SEQ ID NO: 237523 - DNA, 25 bp, Artificial Sequence
  Description of Artificial Sequence: Synthetic oligonucleotide
ctgcacagcagcaggtgggttcgtg

SEQ ID NO: 237524 - DNA, 25 bp, Artificial Sequence
  Description of Artificial Sequence: Synthetic oligonucleotide
tgcacagcagcaggtgggttcgtgg

SEQ ID NO: 237525 - DNA, 24 bp, Artificial Sequence
  Description of Artificial Sequence: Synthetic oligonucleotide
gcacagcagcaggtgggttcgtgg

SEQ ID NO: 237526 - DNA, 24 bp, Artificial Sequence
  Description of Artificial Sequence: Synthetic oligonucleotide
cacagcagcaggtgggttcgtggc

SEQ ID NO: 237527 - DNA, 24 bp, Artificial Sequence
  Description of Artificial Sequence: Synthetic oligonucleotide
acagcagcaggtgggttcgtggcc

SEQ ID NO: 237528 - DNA, 23 bp, Artificial Sequence
  Description of Artificial Sequence: Synthetic oligonucleotide
cagcagcaggtgggttcgtggcc

SEQ ID NO: 237529 - DNA, 25 bp, Artificial Sequence
  Description of Artificial Sequence: Synthetic oligonucleotide
agcagcaggtgggttcgtggccgat

SEQ ID NO: 237530 - DNA, 24 bp, Artificial Sequence
  Description of Artificial Sequence: Synthetic oligonucleotide
gcagcaggtgggttcgtggccgat

SEQ ID NO: 237531 - DNA, 25 bp, Artificial Sequence
  Description of Artificial Sequence: Synthetic oligonucleotide
cagcaggtgggttcgtggccgatgt

SEQ ID NO: 237532 - DNA, 25 bp, Artificial Sequence
  Description of Artificial Sequence: Synthetic oligonucleotide
agcaggtgggttcgtggccgatgtg

SEQ ID NO: 237533 - DNA, 24 bp, Artificial Sequence
  Description of Artificial Sequence: Synthetic oligonucleotide
gcaggtgggttcgtggccgatgtg

SEQ ID NO: 237534 - DNA, 27 bp, Artificial Sequence
  Description of Artificial Sequence: Synthetic oligonucleotide
caggtgggttcgtggccgatgtggaaa

SEQ ID NO: 237535 - DNA, 27 bp, Artificial Sequence
  Description of Artificial Sequence: Synthetic oligonucleotide
aggtgggttcgtggccgatgtggaaac

SEQ ID NO: 237536 - DNA, 26 bp, Artificial Sequence
  Description of Artificial Sequence: Synthetic oligonucleotide
ggtgggttcgtggccgatgtggaaac

SEQ ID NO: 237537 - DNA, 27 bp, Artificial Sequence
  Description of Artificial Sequence: Synthetic oligonucleotide
gtgggttcgtggccgatgtggaaacca

SEQ ID NO: 237538 - DNA, 27 bp, Artificial Sequence
  Description of Artificial Sequence: Synthetic oligonucleotide
tgggttcgtggccgatgtggaaaccac

SEQ ID NO: 237539 - DNA, 26 bp, Artificial Sequence
  Description of Artificial Sequence: Synthetic oligonucleotide
gggttcgtggccgatgtggaaaccac

SEQ ID NO: 237540 - DNA, 27 bp, Artificial Sequence
  Description of Artificial Sequence: Synthetic oligonucleotide
ggttcgtggccgatgtggaaaccacct

SEQ ID NO: 237541 - DNA, 27 bp, Artificial Sequence
  Description of Artificial Sequence: Synthetic oligonucleotide
gttcgtggccgatgtggaaaccacctg

SEQ ID NO: 237542 - DNA, 28 bp, Artificial Sequence
  Description of Artificial Sequence: Synthetic oligonucleotide
ttcgtggccgatgtggaaaccacctgtc

SEQ ID NO: 237543 - DNA, 27 bp, Artificial Sequence
  Description of Artificial Sequence: Synthetic oligonucleotide
tcgtggccgatgtggaaaccacctgtc

SEQ ID NO: 237544 - DNA, 27 bp, Artificial Sequence
  Description of Artificial Sequence: Synthetic oligonucleotide
cgtggccgatgtggaaaccacctgtct

SEQ ID NO: 237545 - DNA, 27 bp, Artificial Sequence
  Description of Artificial Sequence: Synthetic oligonucleotide
gtggccgatgtggaaaccacctgtctc

SEQ ID NO: 237546 - DNA, 29 bp, Artificial Sequence
  Description of Artificial Sequence: Synthetic oligonucleotide
tggccgatgtggaaaccacctgtctcttg

SEQ ID NO: 237547 - DNA, 28 bp, Artificial Sequence
  Description of Artificial Sequence: Synthetic oligonucleotide
ggccgatgtggaaaccacctgtctcttg

SEQ ID NO: 237548 - DNA, 28 bp, Artificial Sequence
  Description of Artificial Sequence: Synthetic oligonucleotide
gccgatgtggaaaccacctgtctcttgg

SEQ ID NO: 237549 - DNA, 30 bp, Artificial Sequence
  Description of Artificial Sequence: Synthetic oligonucleotide
ccgatgtggaaaccacctgtctcttggatg

SEQ ID NO: 237550 - DNA, 32 bp, Artificial Sequence
  Description of Artificial Sequence: Synthetic oligonucleotide
cgatgtggaaaccacctgtctcttggatgatc

SEQ ID NO: 237551 - DNA, 32 bp, Artificial Sequence
  Description of Artificial Sequence: Synthetic oligonucleotide
gatgtggaaaccacctgtctcttggatgatcc

SEQ ID NO: 237552 - DNA, 33 bp, Artificial Sequence
  Description of Artificial Sequence: Synthetic oligonucleotide
atgtggaaaccacctgtctcttggatgatcctg

SEQ ID NO: 237553 - DNA, 32 bp, Artificial Sequence
  Description of Artificial Sequence: Synthetic oligonucleotide
tgtggaaaccacctgtctcttggatgatcctg

SEQ ID NO: 237554 - DNA, 31 bp, Artificial Sequence
  Description of Artificial Sequence: Synthetic oligonucleotide
gtggaaaccacctgtctcttggatgatcctg

SEQ ID NO: 237555 - DNA, 31 bp, Artificial Sequence
  Description of Artificial Sequence: Synthetic oligonucleotide
tggaaaccacctgtctcttggatgatcctgg

SEQ ID NO: 237556 - DNA, 30 bp, Artificial Sequence
  Description of Artificial Sequence: Synthetic oligonucleotide
ggaaaccacctgtctcttggatgatcctgg

SEQ ID NO: 237557 - DNA, 30 bp, Artificial Sequence
  Description of Artificial Sequence: Synthetic oligonucleotide
gaaaccacctgtctcttggatgatcctggg

SEQ ID NO: 237558 - DNA, 31 bp, Artificial Sequence
  Description of Artificial Sequence: Synthetic oligonucleotide
aaaccacctgtctcttggatgatcctgggac

SEQ ID NO: 237559 - DNA, 30 bp, Artificial Sequence
  Description of Artificial Sequence: Synthetic oligonucleotide
aaccacctgtctcttggatgatcctgggac

SEQ ID NO: 237560 - DNA, 29 bp, Artificial Sequence
  Description of Artificial Sequence: Synthetic oligonucleotide
accacctgtctcttggatgatcctgggac

SEQ ID NO: 237561 - DNA, 28 bp, Artificial Sequence
  Description of Artificial Sequence: Synthetic oligonucleotide
ccacctgtctcttggatgatcctgggac

SEQ ID NO: 237562 - DNA, 29 bp, Artificial Sequence
  Description of Artificial Sequence: Synthetic oligonucleotide
cacctgtctcttggatgatcctgggactc

SEQ ID NO: 237563 - DNA, 29 bp, Artificial Sequence
  Description of Artificial Sequence: Synthetic oligonucleotide
acctgtctcttggatgatcctgggactcg

SEQ ID NO: 237564 - DNA, 28 bp, Artificial Sequence
  Description of Artificial Sequence: Synthetic oligonucleotide
cctgtctcttggatgatcctgggactcg

SEQ ID NO: 237565 - DNA, 31 bp, Artificial Sequence
  Description of Artificial Sequence: Synthetic oligonucleotide
ctgtctcttggatgatcctgggactcgaaag

SEQ ID NO: 237566 - DNA, 31 bp, Artificial Sequence
  Description of Artificial Sequence: Synthetic oligonucleotide
tgtctcttggatgatcctgggactcgaaagg

SEQ ID NO: 237567 - DNA, 30 bp, Artificial Sequence
  Description of Artificial Sequence: Synthetic oligonucleotide
gtctcttggatgatcctgggactcgaaagg

SEQ ID NO: 237568 - DNA, 34 bp, Artificial Sequence
  Description of Artificial Sequence: Synthetic oligonucleotide
tctcttggatgatcctgggactcgaaaggatttg

SEQ ID NO: 237569 - DNA, 33 bp, Artificial Sequence
  Description of Artificial Sequence: Synthetic oligonucleotide
ctcttggatgatcctgggactcgaaaggatttg

SEQ ID NO: 237570 - DNA, 34 bp, Artificial Sequence
  Description of Artificial Sequence: Synthetic oligonucleotide
tcttggatgatcctgggactcgaaaggatttgac

SEQ ID NO: 237571 - DNA, 33 bp, Artificial Sequence
  Description of Artificial Sequence: Synthetic oligonucleotide
cttggatgatcctgggactcgaaaggatttgac

SEQ ID NO: 237572 - DNA, 36 bp, Artificial Sequence
  Description of Artificial Sequence: Synthetic oligonucleotide
ttggatgatcctgggactcgaaaggatttgacatac

SEQ ID NO: 237573 - DNA, 35 bp, Artificial Sequence
  Description of Artificial Sequence: Synthetic oligonucleotide
tggatgatcctgggactcgaaaggatttgacatac

SEQ ID NO: 237574 - DNA, 34 bp, Artificial Sequence
  Description of Artificial Sequence: Synthetic oligonucleotide
ggatgatcctgggactcgaaaggatttgacatac

SEQ ID NO: 237575 - DNA, 35 bp, Artificial Sequence
  Description of Artificial Sequence: Synthetic oligonucleotide
gatgatcctgggactcgaaaggatttgacatactg

SEQ ID NO: 237576 - DNA, 35 bp, Artificial Sequence
  Description of Artificial Sequence: Synthetic oligonucleotide
atgatcctgggactcgaaaggatttgacatactgc

SEQ ID NO: 237577 - DNA, 34 bp, Artificial Sequence
  Description of Artificial Sequence: Synthetic oligonucleotide
tgatcctgggactcgaaaggatttgacatactgc

SEQ ID NO: 237578 - DNA, 33 bp, Artificial Sequence
  Description of Artificial Sequence: Synthetic oligonucleotide
gatcctgggactcgaaaggatttgacatactgc

SEQ ID NO: 237579 - DNA, 35 bp, Artificial Sequence
  Description of Artificial Sequence: Synthetic oligonucleotide
atcctgggactcgaaaggatttgacatactgcttc

SEQ ID NO: 237580 - DNA, 34 bp, Artificial Sequence
  Description of Artificial Sequence: Synthetic oligonucleotide
tcctgggactcgaaaggatttgacatactgcttc

SEQ ID NO: 237581 - DNA, 33 bp, Artificial Sequence
  Description of Artificial Sequence: Synthetic oligonucleotide
cctgggactcgaaaggatttgacatactgcttc

SEQ ID NO: 237582 - DNA, 34 bp, Artificial Sequence
  Description of Artificial Sequence: Synthetic oligonucleotide
ctgggactcgaaaggatttgacatactgcttctc

SEQ ID NO: 237583 - DNA, 34 bp, Artificial Sequence
  Description of Artificial Sequence: Synthetic oligonucleotide
tgggactcgaaaggatttgacatactgcttctcc

SEQ ID NO: 237584 - DNA, 33 bp, Artificial Sequence
  Description of Artificial Sequence: Synthetic oligonucleotide
gggactcgaaaggatttgacatactgcttctcc

SEQ ID NO: 237585 - DNA, 35 bp, Artificial Sequence
  Description of Artificial Sequence: Synthetic oligonucleotide
ggactcgaaaggatttgacatactgcttctccttc

SEQ ID NO: 237586 - DNA, 37 bp, Artificial Sequence
  Description of Artificial Sequence: Synthetic oligonucleotide
gactcgaaaggatttgacatactgcttctccttcatc

SEQ ID NO: 237587 - DNA, 39 bp, Artificial Sequence
  Description of Artificial Sequence: Synthetic oligonucleotide
actcgaaaggatttgacatactgcttctccttcatcaag

SEQ ID NO: 237588 - DNA, 38 bp, Artificial Sequence
  Description of Artificial Sequence: Synthetic oligonucleotide
ctcgaaaggatttgacatactgcttctccttcatcaag

SEQ ID NO: 237589 - DNA, 38 bp, Artificial Sequence
  Description of Artificial Sequence: Synthetic oligonucleotide
tcgaaaggatttgacatactgcttctccttcatcaagg

SEQ ID NO: 237590 - DNA, 37 bp, Artificial Sequence
  Description of Artificial Sequence: Synthetic oligonucleotide
cgaaaggatttgacatactgcttctccttcatcaagg

SEQ ID NO: 237591 - DNA, 39 bp, Artificial Sequence
  Description of Artificial Sequence: Synthetic oligonucleotide
gaaaggatttgacatactgcttctccttcatcaaggatc

SEQ ID NO: 237592 - DNA, 40 bp, Artificial Sequence
  Description of Artificial Sequence: Synthetic oligonucleotide
aaaggatttgacatactgcttctccttcatcaaggatctc

SEQ ID NO: 237593 - DNA, 39 bp, Artificial Sequence
  Description of Artificial Sequence: Synthetic oligonucleotide
aaggatttgacatactgcttctccttcatcaaggatctc

SEQ ID NO: 237594 - DNA, 38 bp, Artificial Sequence
  Description of Artificial Sequence: Synthetic oligonucleotide
aggatttgacatactgcttctccttcatcaaggatctc

SEQ ID NO: 237595 - DNA, 37 bp, Artificial Sequence
  Description of Artificial Sequence: Synthetic oligonucleotide
ggatttgacatactgcttctccttcatcaaggatctc

SEQ ID NO: 237596 - DNA, 37 bp, Artificial Sequence
  Description of Artificial Sequence: Synthetic oligonucleotide
gatttgacatactgcttctccttcatcaaggatctcc

SEQ ID NO: 237597 - DNA, 38 bp, Artificial Sequence
  Description of Artificial Sequence: Synthetic oligonucleotide
atttgacatactgcttctccttcatcaaggatctcctg

SEQ ID NO: 237598 - DNA, 37 bp, Artificial Sequence
  Description of Artificial Sequence: Synthetic oligonucleotide
tttgacatactgcttctccttcatcaaggatctcctg

SEQ ID NO: 237599 - DNA, 36 bp, Artificial Sequence
  Description of Artificial Sequence: Synthetic oligonucleotide
ttgacatactgcttctccttcatcaaggatctcctg

SEQ ID NO: 237600 - DNA, 35 bp, Artificial Sequence
  Description of Artificial Sequence: Synthetic oligonucleotide
tgacatactgcttctccttcatcaaggatctcctg

SEQ ID NO: 237601 - DNA, 34 bp, Artificial Sequence
  Description of Artificial Sequence: Synthetic oligonucleotide
gacatactgcttctccttcatcaaggatctcctg

SEQ ID NO: 237602 - DNA, 35 bp, Artificial Sequence
  Description of Artificial Sequence: Synthetic oligonucleotide
acatactgcttctccttcatcaaggatctcctgac

SEQ ID NO: 237603 - DNA, 34 bp, Artificial Sequence
  Description of Artificial Sequence: Synthetic oligonucleotide
catactgcttctccttcatcaaggatctcctgac

SEQ ID NO: 237604 - DNA, 34 bp, Artificial Sequence
  Description of Artificial Sequence: Synthetic oligonucleotide
atactgcttctccttcatcaaggatctcctgacc

SEQ ID NO: 237605 - DNA, 33 bp, Artificial Sequence
  Description of Artificial Sequence: Synthetic oligonucleotide
tactgcttctccttcatcaaggatctcctgacc

SEQ ID NO: 237606 - DNA, 32 bp, Artificial Sequence
  Description of Artificial Sequence: Synthetic oligonucleotide
actgcttctccttcatcaaggatctcctgacc

SEQ ID NO: 237607 - DNA, 31 bp, Artificial Sequence
  Description of Artificial Sequence: Synthetic oligonucleotide
ctgcttctccttcatcaaggatctcctgacc

SEQ ID NO: 237608 - DNA, 32 bp, Artificial Sequence
  Description of Artificial Sequence: Synthetic oligonucleotide
tgcttctccttcatcaaggatctcctgacctg

SEQ ID NO: 237609 - DNA, 31 bp, Artificial Sequence
  Description of Artificial Sequence: Synthetic oligonucleotide
gcttctccttcatcaaggatctcctgacctg

SEQ ID NO: 237610 - DNA, 31 bp, Artificial Sequence
  Description of Artificial Sequence: Synthetic oligonucleotide
cttctccttcatcaaggatctcctgacctgc

SEQ ID NO: 237611 - DNA, 32 bp, Artificial Sequence
  Description of Artificial Sequence: Synthetic oligonucleotide
ttctccttcatcaaggatctcctgacctgcag

SEQ ID NO: 237612 - DNA, 31 bp, Artificial Sequence
  Description of Artificial Sequence: Synthetic oligonucleotide
tctccttcatcaaggatctcctgacctgcag

SEQ ID NO: 237613 - DNA, 30 bp, Artificial Sequence
  Description of Artificial Sequence: Synthetic oligonucleotide
ctccttcatcaaggatctcctgacctgcag

SEQ ID NO: 237614 - DNA, 30 bp, Artificial Sequence
  Description of Artificial Sequence: Synthetic oligonucleotide
tccttcatcaaggatctcctgacctgcagg

SEQ ID NO: 237615 - DNA, 29 bp, Artificial Sequence
  Description of Artificial Sequence: Synthetic oligonucleotide
ccttcatcaaggatctcctgacctgcagg

SEQ ID NO: 237616 - DNA, 29 bp, Artificial Sequence
  Description of Artificial Sequence: Synthetic oligonucleotide
cttcatcaaggatctcctgacctgcaggg

SEQ ID NO: 237617 - DNA, 31 bp, Artificial Sequence
  Description of Artificial Sequence: Synthetic oligonucleotide
ttcatcaaggatctcctgacctgcagggatc

SEQ ID NO: 237618 - DNA, 30 bp, Artificial Sequence
  Description of Artificial Sequence: Synthetic oligonucleotide
tcatcaaggatctcctgacctgcagggatc

SEQ ID NO: 237619 - DNA, 29 bp, Artificial Sequence
  Description of Artificial Sequence: Synthetic oligonucleotide
catcaaggatctcctgacctgcagggatc

SEQ ID NO: 237620 - DNA, 29 bp, Artificial Sequence
  Description of Artificial Sequence: Synthetic oligonucleotide
atcaaggatctcctgacctgcagggatcc

SEQ ID NO: 237621 - DNA, 28 bp, Artificial Sequence
  Description of Artificial Sequence: Synthetic oligonucleotide
tcaaggatctcctgacctgcagggatcc

SEQ ID NO: 237622 - DNA, 27 bp, Artificial Sequence
  Description of Artificial Sequence: Synthetic oligonucleotide
caaggatctcctgacctgcagggatcc

SEQ ID NO: 237623 - DNA, 28 bp, Artificial Sequence
  Description of Artificial Sequence: Synthetic oligonucleotide
aaggatctcctgacctgcagggatccag

SEQ ID NO: 237624 - DNA, 27 bp, Artificial Sequence
  Description of Artificial Sequence: Synthetic oligonucleotide
aggatctcctgacctgcagggatccag

SEQ ID NO: 237625 - DNA, 27 bp, Artificial Sequence
  Description of Artificial Sequence: Synthetic oligonucleotide
ggatctcctgacctgcagggatccagt

SEQ ID NO: 237626 - DNA, 27 bp, Artificial Sequence
  Description of Artificial Sequence: Synthetic oligonucleotide
gatctcctgacctgcagggatccagtg

SEQ ID NO: 237627 - DNA, 27 bp, Artificial Sequence
  Description of Artificial Sequence: Synthetic oligonucleotide
atctcctgacctgcagggatccagtgg

SEQ ID NO: 237628 - DNA, 27 bp, Artificial Sequence
  Description of Artificial Sequence: Synthetic oligonucleotide
tctcctgacctgcagggatccagtgga

SEQ ID NO: 237629 - DNA, 26 bp, Artificial Sequence
  Description of Artificial Sequence: Synthetic oligonucleotide
ctcctgacctgcagggatccagtgga

SEQ ID NO: 237630 - DNA, 27 bp, Artificial Sequence
  Description of Artificial Sequence: Synthetic oligonucleotide
tcctgacctgcagggatccagtggaga

SEQ ID NO: 237631 - DNA, 27 bp, Artificial Sequence
  Description of Artificial Sequence: Synthetic oligonucleotide
cctgacctgcagggatccagtggagaa

SEQ ID NO: 237632 - DNA, 30 bp, Artificial Sequence
  Description of Artificial Sequence: Synthetic oligonucleotide
ctgacctgcagggatccagtggagaataac

SEQ ID NO: 237633 - DNA, 32 bp, Artificial Sequence
  Description of Artificial Sequence: Synthetic oligonucleotide
tgacctgcagggatccagtggagaataacatg

SEQ ID NO: 237634 - DNA, 31 bp, Artificial Sequence
  Description of Artificial Sequence: Synthetic oligonucleotide
gacctgcagggatccagtggagaataacatg

SEQ ID NO: 237635 - DNA, 31 bp, Artificial Sequence
  Description of Artificial Sequence: Synthetic oligonucleotide
acctgcagggatccagtggagaataacatgg

SEQ ID NO: 237636 - DNA, 30 bp, Artificial Sequence
  Description of Artificial Sequence: Synthetic oligonucleotide
cctgcagggatccagtggagaataacatgg

SEQ ID NO: 237637 - DNA, 30 bp, Artificial Sequence
  Description of Artificial Sequence: Synthetic oligonucleotide
ctgcagggatccagtggagaataacatggc

SEQ ID NO: 237638 - DNA, 30 bp, Artificial Sequence
  Description of Artificial Sequence: Synthetic oligonucleotide
tgcagggatccagtggagaataacatggcc

SEQ ID NO: 237639 - DNA, 29 bp, Artificial Sequence
  Description of Artificial Sequence: Synthetic oligonucleotide
gcagggatccagtggagaataacatggcc

SEQ ID NO: 237640 - DNA, 29 bp, Artificial Sequence
  Description of Artificial Sequence: Synthetic oligonucleotide
cagggatccagtggagaataacatggccc

SEQ ID NO: 237641 - DNA, 29 bp, Artificial Sequence
  Description of Artificial Sequence: Synthetic oligonucleotide
agggatccagtggagaataacatggcccc

SEQ ID NO: 237642 - DNA, 28 bp, Artificial Sequence
  Description of Artificial Sequence: Synthetic oligonucleotide
gggatccagtggagaataacatggcccc

SEQ ID NO: 237643 - DNA, 30 bp, Artificial Sequence
  Description of Artificial Sequence: Synthetic oligonucleotide
ggatccagtggagaataacatggcccctag

SEQ ID NO: 237644 - DNA, 30 bp, Artificial Sequence
  Description of Artificial Sequence: Synthetic oligonucleotide
gatccagtggagaataacatggcccctagc

SEQ ID NO: 237645 - DNA, 30 bp, Artificial Sequence
  Description of Artificial Sequence: Synthetic oligonucleotide
atccagtggagaataacatggcccctagcg

SEQ ID NO: 237646 - DNA, 29 bp, Artificial Sequence
  Description of Artificial Sequence: Synthetic oligonucleotide
tccagtggagaataacatggcccctagcg

SEQ ID NO: 237647 - DNA, 28 bp, Artificial Sequence
  Description of Artificial Sequence: Synthetic oligonucleotide
ccagtggagaataacatggcccctagcg

SEQ ID NO: 237648 - DNA, 33 bp, Artificial Sequence
  Description of Artificial Sequence: Synthetic oligonucleotide
cagtggagaataacatggcccctagcgaatttg

SEQ ID NO: 237649 - DNA, 33 bp, Artificial Sequence
  Description of Artificial Sequence: Synthetic oligonucleotide
agtggagaataacatggcccctagcgaatttgc

SEQ ID NO: 237650 - DNA, 32 bp, Artificial Sequence
  Description of Artificial Sequence: Synthetic oligonucleotide
gtggagaataacatggcccctagcgaatttgc

SEQ ID NO: 237651 - DNA, 32 bp, Artificial Sequence
  Description of Artificial Sequence: Synthetic oligonucleotide
tggagaataacatggcccctagcgaatttgcg

SEQ ID NO: 237652 - DNA, 31 bp, Artificial Sequence
  Description of Artificial Sequence: Synthetic oligonucleotide
ggagaataacatggcccctagcgaatttgcg

SEQ ID NO: 237653 - DNA, 31 bp, Artificial Sequence
  Description of Artificial Sequence: Synthetic oligonucleotide
gagaataacatggcccctagcgaatttgcgg

SEQ ID NO: 237654 - DNA, 32 bp, Artificial Sequence
  Description of Artificial Sequence: Synthetic oligonucleotide
agaataacatggcccctagcgaatttgcggtg

SEQ ID NO: 237655 - DNA, 31 bp, Artificial Sequence
  Description of Artificial Sequence: Synthetic oligonucleotide
gaataacatggcccctagcgaatttgcggtg

SEQ ID NO: 237656 - DNA, 31 bp, Artificial Sequence
  Description of Artificial Sequence: Synthetic oligonucleotide
aataacatggcccctagcgaatttgcggtgc

SEQ ID NO: 237657 - DNA, 30 bp, Artificial Sequence
  Description of Artificial Sequence: Synthetic oligonucleotide
ataacatggcccctagcgaatttgcggtgc

SEQ ID NO: 237658 - DNA, 29 bp, Artificial Sequence
  Description of Artificial Sequence: Synthetic oligonucleotide
taacatggcccctagcgaatttgcggtgc

SEQ ID NO: 237659 - DNA, 28 bp, Artificial Sequence
  Description of Artificial Sequence: Synthetic oligonucleotide
aacatggcccctagcgaatttgcggtgc

SEQ ID NO: 237660 - DNA, 27 bp, Artificial Sequence
  Description of Artificial Sequence: Synthetic oligonucleotide
acatggcccctagcgaatttgcggtgc

SEQ ID NO: 237661 - DNA, 27 bp, Artificial Sequence
  Description of Artificial Sequence: Synthetic oligonucleotide
catggcccctagcgaatttgcggtgct

SEQ ID NO: 237662 - DNA, 27 bp, Artificial Sequence
  Description of Artificial Sequence: Synthetic oligonucleotide
atggcccctagcgaatttgcggtgctg

SEQ ID NO: 237663 - DNA, 27 bp, Artificial Sequence
  Description of Artificial Sequence: Synthetic oligonucleotide
tggcccctagcgaatttgcggtgctga

SEQ ID NO: 237664 - DNA, 27 bp, Artificial Sequence
  Description of Artificial Sequence: Synthetic oligonucleotide
ggcccctagcgaatttgcggtgctgaa

SEQ ID NO: 237665 - DNA, 29 bp, Artificial Sequence
  Description of Artificial Sequence: Synthetic oligonucleotide
gcccctagcgaatttgcggtgctgaaaag

SEQ ID NO: 237666 - DNA, 29 bp, Artificial Sequence
  Description of Artificial Sequence: Synthetic oligonucleotide
cccctagcgaatttgcggtgctgaaaagc

SEQ ID NO: 237667 - DNA, 31 bp, Artificial Sequence
  Description of Artificial Sequence: Synthetic oligonucleotide
ccctagcgaatttgcggtgctgaaaagcttg

SEQ ID NO: 237668 - DNA, 31 bp, Artificial Sequence
  Description of Artificial Sequence: Synthetic oligonucleotide
cctagcgaatttgcggtgctgaaaagcttgg

SEQ ID NO: 237669 - DNA, 31 bp, Artificial Sequence
  Description of Artificial Sequence: Synthetic oligonucleotide
ctagcgaatttgcggtgctgaaaagcttggc

SEQ ID NO: 237670 - DNA, 31 bp, Artificial Sequence
  Description of Artificial Sequence: Synthetic oligonucleotide
tagcgaatttgcggtgctgaaaagcttggcg

SEQ ID NO: 237671 - DNA, 30 bp, Artificial Sequence
  Description of Artificial Sequence: Synthetic oligonucleotide
agcgaatttgcggtgctgaaaagcttggcg

SEQ ID NO: 237672 - DNA, 29 bp, Artificial Sequence
  Description of Artificial Sequence: Synthetic oligonucleotide
gcgaatttgcggtgctgaaaagcttggcg

SEQ ID NO: 237673 - DNA, 32 bp, Artificial Sequence
  Description of Artificial Sequence: Synthetic oligonucleotide
cgaatttgcggtgctgaaaagcttggcgtatg

SEQ ID NO: 237674 - DNA, 33 bp, Artificial Sequence
  Description of Artificial Sequence: Synthetic oligonucleotide
gaatttgcggtgctgaaaagcttggcgtatgtc

SEQ ID NO: 237675 - DNA, 33 bp, Artificial Sequence
  Description of Artificial Sequence: Synthetic oligonucleotide
aatttgcggtgctgaaaagcttggcgtatgtcc

SEQ ID NO: 237676 - DNA, 32 bp, Artificial Sequence
  Description of Artificial Sequence: Synthetic oligonucleotide
atttgcggtgctgaaaagcttggcgtatgtcc

SEQ ID NO: 237677 - DNA, 31 bp, Artificial Sequence
  Description of Artificial Sequence: Synthetic oligonucleotide
tttgcggtgctgaaaagcttggcgtatgtcc

SEQ ID NO: 237678 - DNA, 30 bp, Artificial Sequence
  Description of Artificial Sequence: Synthetic oligonucleotide
ttgcggtgctgaaaagcttggcgtatgtcc

SEQ ID NO: 237679 - DNA, 29 bp, Artificial Sequence
  Description of Artificial Sequence: Synthetic oligonucleotide
tgcggtgctgaaaagcttggcgtatgtcc

SEQ ID NO: 237680 - DNA, 28 bp, Artificial Sequence
  Description of Artificial Sequence: Synthetic oligonucleotide
gcggtgctgaaaagcttggcgtatgtcc

SEQ ID NO: 237681 - DNA, 29 bp, Artificial Sequence
  Description of Artificial Sequence: Synthetic oligonucleotide
cggtgctgaaaagcttggcgtatgtcctc

SEQ ID NO: 237682 - DNA, 30 bp, Artificial Sequence
  Description of Artificial Sequence: Synthetic oligonucleotide
ggtgctgaaaagcttggcgtatgtcctctg

SEQ ID NO: 237683 - DNA, 31 bp, Artificial Sequence
  Description of Artificial Sequence: Synthetic oligonucleotide
gtgctgaaaagcttggcgtatgtcctctgac

SEQ ID NO: 237684 - DNA, 32 bp, Artificial Sequence
  Description of Artificial Sequence: Synthetic oligonucleotide
tgctgaaaagcttggcgtatgtcctctgacag

SEQ ID NO: 237685 - DNA, 31 bp, Artificial Sequence
  Description of Artificial Sequence: Synthetic oligonucleotide
gctgaaaagcttggcgtatgtcctctgacag

SEQ ID NO: 237686 - DNA, 31 bp, Artificial Sequence
  Description of Artificial Sequence: Synthetic oligonucleotide
ctgaaaagcttggcgtatgtcctctgacagc

SEQ ID NO: 237687 - DNA, 32 bp, Artificial Sequence
  Description of Artificial Sequence: Synthetic oligonucleotide
tgaaaagcttggcgtatgtcctctgacagcac

SEQ ID NO: 237688 - DNA, 31 bp, Artificial Sequence
  Description of Artificial Sequence: Synthetic oligonucleotide
gaaaagcttggcgtatgtcctctgacagcac

SEQ ID NO: 237689 - DNA, 31 bp, Artificial Sequence
  Description of Artificial Sequence: Synthetic oligonucleotide
aaaagcttggcgtatgtcctctgacagcacc

SEQ ID NO: 237690 - DNA, 30 bp, Artificial Sequence
  Description of Artificial Sequence: Synthetic oligonucleotide
aaagcttggcgtatgtcctctgacagcacc

SEQ ID NO: 237691 - DNA, 29 bp, Artificial Sequence
  Description of Artificial Sequence: Synthetic oligonucleotide
aagcttggcgtatgtcctctgacagcacc

SEQ ID NO: 237692 - DNA, 28 bp, Artificial Sequence
  Description of Artificial Sequence: Synthetic oligonucleotide
agcttggcgtatgtcctctgacagcacc

SEQ ID NO: 237693 - DNA, 27 bp, Artificial Sequence
  Description of Artificial Sequence: Synthetic oligonucleotide
gcttggcgtatgtcctctgacagcacc

SEQ ID NO: 237694 - DNA, 28 bp, Artificial Sequence
  Description of Artificial Sequence: Synthetic oligonucleotide
cttggcgtatgtcctctgacagcacctg

SEQ ID NO: 237695 - DNA, 30 bp, Artificial Sequence
  Description of Artificial Sequence: Synthetic oligonucleotide
ttggcgtatgtcctctgacagcacctgaac

SEQ ID NO: 237696 - DNA, 29 bp, Artificial Sequence
  Description of Artificial Sequence: Synthetic oligonucleotide
tggcgtatgtcctctgacagcacctgaac

SEQ ID NO: 237697 - DNA, 28 bp, Artificial Sequence
  Description of Artificial Sequence: Synthetic oligonucleotide
ggcgtatgtcctctgacagcacctgaac

SEQ ID NO: 237698 - DNA, 28 bp, Artificial Sequence
  Description of Artificial Sequence: Synthetic oligonucleotide
gcgtatgtcctctgacagcacctgaacc

SEQ ID NO: 237699 - DNA, 33 bp, Artificial Sequence
  Description of Artificial Sequence: Synthetic oligonucleotide
cgtatgtcctctgacagcacctgaaccaaaaac

SEQ ID NO: 237700 - DNA, 34 bp, Artificial Sequence
  Description of Artificial Sequence: Synthetic oligonucleotide
gtatgtcctctgacagcacctgaaccaaaaacac

SEQ ID NO: 237701 - DNA, 35 bp, Artificial Sequence
  Description of Artificial Sequence: Synthetic oligonucleotide
tatgtcctctgacagcacctgaaccaaaaacacac

SEQ ID NO: 237702 - DNA, 34 bp, Artificial Sequence
  Description of Artificial Sequence: Synthetic oligonucleotide
atgtcctctgacagcacctgaaccaaaaacacac

SEQ ID NO: 237703 - DNA, 33 bp, Artificial Sequence
  Description of Artificial Sequence: Synthetic oligonucleotide
tgtcctctgacagcacctgaaccaaaaacacac

SEQ ID NO: 237704 - DNA, 32 bp, Artificial Sequence
  Description of Artificial Sequence: Synthetic oligonucleotide
gtcctctgacagcacctgaaccaaaaacacac

SEQ ID NO: 237705 - DNA, 32 bp, Artificial Sequence
  Description of Artificial Sequence: Synthetic oligonucleotide
tcctctgacagcacctgaaccaaaaacacacc

SEQ ID NO: 237706 - DNA, 31 bp, Artificial Sequence
  Description of Artificial Sequence: Synthetic oligonucleotide
cctctgacagcacctgaaccaaaaacacacc

SEQ ID NO: 237707 - DNA, 31 bp, Artificial Sequence
  Description of Artificial Sequence: Synthetic oligonucleotide
ctctgacagcacctgaaccaaaaacacaccc

SEQ ID NO: 237708 - DNA, 32 bp, Artificial Sequence
  Description of Artificial Sequence: Synthetic oligonucleotide
tctgacagcacctgaaccaaaaacacaccctg

SEQ ID NO: 237709 - DNA, 31 bp, Artificial Sequence
  Description of Artificial Sequence: Synthetic oligonucleotide
ctgacagcacctgaaccaaaaacacaccctg

SEQ ID NO: 237710 - DNA, 33 bp, Artificial Sequence
  Description of Artificial Sequence: Synthetic oligonucleotide
tgacagcacctgaaccaaaaacacaccctgaag

SEQ ID NO: 237711 - DNA, 32 bp, Artificial Sequence
  Description of Artificial Sequence: Synthetic oligonucleotide
gacagcacctgaaccaaaaacacaccctgaag

SEQ ID NO: 237712 - DNA, 32 bp, Artificial Sequence
  Description of Artificial Sequence: Synthetic oligonucleotide
acagcacctgaaccaaaaacacaccctgaagc

SEQ ID NO: 237713 - DNA, 31 bp, Artificial Sequence
  Description of Artificial Sequence: Synthetic oligonucleotide
cagcacctgaaccaaaaacacaccctgaagc

SEQ ID NO: 237714 - DNA, 32 bp, Artificial Sequence
  Description of Artificial Sequence: Synthetic oligonucleotide
agcacctgaaccaaaaacacaccctgaagcag

SEQ ID NO: 237715 - DNA, 31 bp, Artificial Sequence
  Description of Artificial Sequence: Synthetic oligonucleotide
gcacctgaaccaaaaacacaccctgaagcag

SEQ ID NO: 237716 - DNA, 31 bp, Artificial Sequence
  Description of Artificial Sequence: Synthetic oligonucleotide
cacctgaaccaaaaacacaccctgaagcagc

SEQ ID NO: 237717 - DNA, 31 bp, Artificial Sequence
  Description of Artificial Sequence: Synthetic oligonucleotide
acctgaaccaaaaacacaccctgaagcagcg

SEQ ID NO: 237718 - DNA, 30 bp, Artificial Sequence
  Description of Artificial Sequence: Synthetic oligonucleotide
cctgaaccaaaaacacaccctgaagcagcg

SEQ ID NO: 237719 - DNA, 30 bp, Artificial Sequence
  Description of Artificial Sequence: Synthetic oligonucleotide
ctgaaccaaaaacacaccctgaagcagcgc

SEQ ID NO: 237720 - DNA, 32 bp, Artificial Sequence
  Description of Artificial Sequence: Synthetic oligonucleotide
tgaaccaaaaacacaccctgaagcagcgcttc

SEQ ID NO: 237721 - DNA, 31 bp, Artificial Sequence
  Description of Artificial Sequence: Synthetic oligonucleotide
gaaccaaaaacacaccctgaagcagcgcttc

SEQ ID NO: 237722 - DNA, 31 bp, Artificial Sequence
  Description of Artificial Sequence: Synthetic oligonucleotide
aaccaaaaacacaccctgaagcagcgcttcc

SEQ ID NO: 237723 - DNA, 30 bp, Artificial Sequence
  Description of Artificial Sequence: Synthetic oligonucleotide
accaaaaacacaccctgaagcagcgcttcc

SEQ ID NO: 237724 - DNA, 29 bp, Artificial Sequence
  Description of Artificial Sequence: Synthetic oligonucleotide
ccaaaaacacaccctgaagcagcgcttcc

SEQ ID NO: 237725 - DNA, 29 bp, Artificial Sequence
  Description of Artificial Sequence: Synthetic oligonucleotide
caaaaacacaccctgaagcagcgcttccg

SEQ ID NO: 237726 - DNA, 29 bp, Artificial Sequence
  Description of Artificial Sequence: Synthetic oligonucleotide
aaaaacacaccctgaagcagcgcttccgc

SEQ ID NO: 237727 - DNA, 28 bp, Artificial Sequence
  Description of Artificial Sequence: Synthetic oligonucleotide
aaaacacaccctgaagcagcgcttccgc

SEQ ID NO: 237728 - DNA, 27 bp, Artificial Sequence
  Description of Artificial Sequence: Synthetic oligonucleotide
aaacacaccctgaagcagcgcttccgc

SEQ ID NO: 237729 - DNA, 27 bp, Artificial Sequence
  Description of Artificial Sequence: Synthetic oligonucleotide
aacacaccctgaagcagcgcttccgca

SEQ ID NO: 237730 - DNA, 27 bp, Artificial Sequence
  Description of Artificial Sequence: Synthetic oligonucleotide
acacaccctgaagcagcgcttccgcaa

SEQ ID NO: 237731 - DNA, 27 bp, Artificial Sequence
  Description of Artificial Sequence: Synthetic oligonucleotide
cacaccctgaagcagcgcttccgcaat

SEQ ID NO: 237732 - DNA, 27 bp, Artificial Sequence
  Description of Artificial Sequence: Synthetic oligonucleotide
acaccctgaagcagcgcttccgcaatg

SEQ ID NO: 237733 - DNA, 26 bp, Artificial Sequence
  Description of Artificial Sequence: Synthetic oligonucleotide
caccctgaagcagcgcttccgcaatg

SEQ ID NO: 237734 - DNA, 26 bp, Artificial Sequence
  Description of Artificial Sequence: Synthetic oligonucleotide
accctgaagcagcgcttccgcaatgg

SEQ ID NO: 237735 - DNA, 25 bp, Artificial Sequence
  Description of Artificial Sequence: Synthetic oligonucleotide
ccctgaagcagcgcttccgcaatgg

SEQ ID NO: 237736 - DNA, 25 bp, Artificial Sequence
  Description of Artificial Sequence: Synthetic oligonucleotide
cctgaagcagcgcttccgcaatggg

SEQ ID NO: 237737 - DNA, 27 bp, Artificial Sequence
  Description of Artificial Sequence: Synthetic oligonucleotide
ctgaagcagcgcttccgcaatggggtt

SEQ ID NO: 237738 - DNA, 27 bp, Artificial Sequence
  Description of Artificial Sequence: Synthetic oligonucleotide
tgaagcagcgcttccgcaatggggttc

SEQ ID NO: 237739 - DNA, 27 bp, Artificial Sequence
  Description of Artificial Sequence: Synthetic oligonucleotide
gaagcagcgcttccgcaatggggttca

SEQ ID NO: 237740 - DNA, 27 bp, Artificial Sequence
  Description of Artificial Sequence: Synthetic oligonucleotide
aagcagcgcttccgcaatggggttcag

SEQ ID NO: 237741 - DNA, 27 bp, Artificial Sequence
  Description of Artificial Sequence: Synthetic oligonucleotide
agcagcgcttccgcaatggggttcaga

SEQ ID NO: 237742 - DNA, 27 bp, Artificial Sequence
  Description of Artificial Sequence: Synthetic oligonucleotide
gcagcgcttccgcaatggggttcagaa

SEQ ID NO: 237743 - DNA, 29 bp, Artificial Sequence
  Description of Artificial Sequence: Synthetic oligonucleotide
cagcgcttccgcaatggggttcagaattc

SEQ ID NO: 237744 - DNA, 30 bp, Artificial Sequence
  Description of Artificial Sequence: Synthetic oligonucleotide
agcgcttccgcaatggggttcagaattctg

SEQ ID NO: 237745 - DNA, 29 bp, Artificial Sequence
  Description of Artificial Sequence: Synthetic oligonucleotide
gcgcttccgcaatggggttcagaattctg

SEQ ID NO: 237746 - DNA, 29 bp, Artificial Sequence
  Description of Artificial Sequence: Synthetic oligonucleotide
cgcttccgcaatggggttcagaattctgc

SEQ ID NO: 237747 - DNA, 29 bp, Artificial Sequence
  Description of Artificial Sequence: Synthetic oligonucleotide
gcttccgcaatggggttcagaattctgcc

SEQ ID NO: 237748 - DNA, 30 bp, Artificial Sequence
  Description of Artificial Sequence: Synthetic oligonucleotide
cttccgcaatggggttcagaattctgccac

SEQ ID NO: 237749 - DNA, 31 bp, Artificial Sequence
  Description of Artificial Sequence: Synthetic oligonucleotide
ttccgcaatggggttcagaattctgccacac

SEQ ID NO: 237750 - DNA, 30 bp, Artificial Sequence
  Description of Artificial Sequence: Synthetic oligonucleotide
tccgcaatggggttcagaattctgccacac

SEQ ID NO: 237751 - DNA, 29 bp, Artificial Sequence
  Description of Artificial Sequence: Synthetic oligonucleotide
ccgcaatggggttcagaattctgccacac

SEQ ID NO: 237752 - DNA, 30 bp, Artificial Sequence
  Description of Artificial Sequence: Synthetic oligonucleotide
cgcaatggggttcagaattctgccacacag

SEQ ID NO: 237753 - DNA, 31 bp, Artificial Sequence
  Description of Artificial Sequence: Synthetic oligonucleotide
gcaatggggttcagaattctgccacacagac

SEQ ID NO: 237754 - DNA, 31 bp, Artificial Sequence
  Description of Artificial Sequence: Synthetic oligonucleotide
caatggggttcagaattctgccacacagacc

SEQ ID NO: 237755 - DNA, 31 bp, Artificial Sequence
  Description of Artificial Sequence: Synthetic oligonucleotide
aatggggttcagaattctgccacacagaccc

SEQ ID NO: 237756 - DNA, 30 bp, Artificial Sequence
  Description of Artificial Sequence: Synthetic oligonucleotide
atggggttcagaattctgccacacagaccc

SEQ ID NO: 237757 - DNA, 29 bp, Artificial Sequence
  Description of Artificial Sequence: Synthetic oligonucleotide
tggggttcagaattctgccacacagaccc

SEQ ID NO: 237758 - DNA, 28 bp, Artificial Sequence
  Description of Artificial Sequence: Synthetic oligonucleotide
ggggttcagaattctgccacacagaccc

SEQ ID NO: 237759 - DNA, 29 bp, Artificial Sequence
  Description of Artificial Sequence: Synthetic oligonucleotide
gggttcagaattctgccacacagacccag

SEQ ID NO: 237760 - DNA, 29 bp, Artificial Sequence
  Description of Artificial Sequence: Synthetic oligonucleotide
ggttcagaattctgccacacagacccagc

SEQ ID NO: 237761 - DNA, 29 bp, Artificial Sequence
  Description of Artificial Sequence: Synthetic oligonucleotide
gttcagaattctgccacacagacccagcc

SEQ ID NO: 237762 - DNA, 29 bp, Artificial Sequence
  Description of Artificial Sequence: Synthetic oligonucleotide
ttcagaattctgccacacagacccagccc

SEQ ID NO: 237763 - DNA, 28 bp, Artificial Sequence
  Description of Artificial Sequence: Synthetic oligonucleotide
tcagaattctgccacacagacccagccc

SEQ ID NO: 237764 - DNA, 27 bp, Artificial Sequence
  Description of Artificial Sequence: Synthetic oligonucleotide
cagaattctgccacacagacccagccc

SEQ ID NO: 237765 - DNA, 29 bp, Artificial Sequence
  Description of Artificial Sequence: Synthetic oligonucleotide
agaattctgccacacagacccagcccatc

SEQ ID NO: 237766 - DNA, 28 bp, Artificial Sequence
  Description of Artificial Sequence: Synthetic oligonucleotide
gaattctgccacacagacccagcccatc

SEQ ID NO: 237767 - DNA, 29 bp, Artificial Sequence
  Description of Artificial Sequence: Synthetic oligonucleotide
aattctgccacacagacccagcccatctg

SEQ ID NO: 237768 - DNA, 28 bp, Artificial Sequence
  Description of Artificial Sequence: Synthetic oligonucleotide
attctgccacacagacccagcccatctg

SEQ ID NO: 237769 - DNA, 27 bp, Artificial Sequence
  Description of Artificial Sequence: Synthetic oligonucleotide
ttctgccacacagacccagcccatctg

SEQ ID NO: 237770 - DNA, 26 bp, Artificial Sequence
  Description of Artificial Sequence: Synthetic oligonucleotide
tctgccacacagacccagcccatctg

SEQ ID NO: 237771 - DNA, 25 bp, Artificial Sequence
  Description of Artificial Sequence: Synthetic oligonucleotide
ctgccacacagacccagcccatctg

SEQ ID NO: 237772 - DNA, 25 bp, Artificial Sequence
  Description of Artificial Sequence: Synthetic oligonucleotide
tgccacacagacccagcccatctgg

SEQ ID NO: 237773 - DNA, 24 bp, Artificial Sequence
  Description of Artificial Sequence: Synthetic oligonucleotide
gccacacagacccagcccatctgg

SEQ ID NO: 237774 - DNA, 24 bp, Artificial Sequence
  Description of Artificial Sequence: Synthetic oligonucleotide
ccacacagacccagcccatctggg

SEQ ID NO: 237775 - DNA, 26 bp, Artificial Sequence
  Description of Artificial Sequence: Synthetic oligonucleotide
cacacagacccagcccatctggggat

SEQ ID NO: 237776 - DNA, 27 bp, Artificial Sequence
  Description of Artificial Sequence: Synthetic oligonucleotide
acacagacccagcccatctggggatga

SEQ ID NO: 237777 - DNA, 26 bp, Artificial Sequence
  Description of Artificial Sequence: Synthetic oligonucleotide
cacagacccagcccatctggggatga

SEQ ID NO: 237778 - DNA, 27 bp, Artificial Sequence
  Description of Artificial Sequence: Synthetic oligonucleotide
acagacccagcccatctggggatgact

SEQ ID NO: 237779 - DNA, 26 bp, Artificial Sequence
  Description of Artificial Sequence: Synthetic oligonucleotide
cagacccagcccatctggggatgact

SEQ ID NO: 237780 - DNA, 27 bp, Artificial Sequence
  Description of Artificial Sequence: Synthetic oligonucleotide
agacccagcccatctggggatgactga

SEQ ID NO: 237781 - DNA, 26 bp, Artificial Sequence
  Description of Artificial Sequence: Synthetic oligonucleotide
gacccagcccatctggggatgactga

SEQ ID NO: 237782 - DNA, 26 bp, Artificial Sequence
  Description of Artificial Sequence: Synthetic oligonucleotide
acccagcccatctggggatgactgac

SEQ ID NO: 237783 - DNA, 25 bp, Artificial Sequence
  Description of Artificial Sequence: Synthetic oligonucleotide
cccagcccatctggggatgactgac

SEQ ID NO: 237784 - DNA, 27 bp, Artificial Sequence
  Description of Artificial Sequence: Synthetic oligonucleotide
ccagcccatctggggatgactgaccaa

SEQ ID NO: 237785 - DNA, 27 bp, Artificial Sequence
  Description of Artificial Sequence: Synthetic oligonucleotide
cagcccatctggggatgactgaccaag

SEQ ID NO: 237786 - DNA, 28 bp, Artificial Sequence
  Description of Artificial Sequence: Synthetic oligonucleotide
agcccatctggggatgactgaccaagag

SEQ ID NO: 237787 - DNA, 27 bp, Artificial Sequence
  Description of Artificial Sequence: Synthetic oligonucleotide
gcccatctggggatgactgaccaagag

SEQ ID NO: 237788 - DNA, 27 bp, Artificial Sequence
  Description of Artificial Sequence: Synthetic oligonucleotide
cccatctggggatgactgaccaagagg

SEQ ID NO: 237789 - DNA, 28 bp, Artificial Sequence
  Description of Artificial Sequence: Synthetic oligonucleotide
ccatctggggatgactgaccaagaggac

SEQ ID NO: 237790 - DNA, 29 bp, Artificial Sequence
  Description of Artificial Sequence: Synthetic oligonucleotide
catctggggatgactgaccaagaggacac

SEQ ID NO: 237791 - DNA, 29 bp, Artificial Sequence
  Description of Artificial Sequence: Synthetic oligonucleotide
atctggggatgactgaccaagaggacacg

SEQ ID NO: 237792 - DNA, 28 bp, Artificial Sequence
  Description of Artificial Sequence: Synthetic oligonucleotide
tctggggatgactgaccaagaggacacg

SEQ ID NO: 237793 - DNA, 27 bp, Artificial Sequence
  Description of Artificial Sequence: Synthetic oligonucleotide
ctggggatgactgaccaagaggacacg

SEQ ID NO: 237794 - DNA, 27 bp, Artificial Sequence
  Description of Artificial Sequence: Synthetic oligonucleotide
tggggatgactgaccaagaggacacgg

SEQ ID NO: 237795 - DNA, 26 bp, Artificial Sequence
  Description of Artificial Sequence: Synthetic oligonucleotide
ggggatgactgaccaagaggacacgg

SEQ ID NO: 237796 - DNA, 26 bp, Artificial Sequence
  Description of Artificial Sequence: Synthetic oligonucleotide
gggatgactgaccaagaggacacggg

SEQ ID NO: 237797 - DNA, 27 bp, Artificial Sequence
  Description of Artificial Sequence: Synthetic oligonucleotide
ggatgactgaccaagaggacacgggca

SEQ ID NO: 237798 - DNA, 27 bp, Artificial Sequence
  Description of Artificial Sequence: Synthetic oligonucleotide
gatgactgaccaagaggacacgggcac

SEQ ID NO: 237799 - DNA, 27 bp, Artificial Sequence
  Description of Artificial Sequence: Synthetic oligonucleotide
atgactgaccaagaggacacgggcacc

SEQ ID NO: 237800 - DNA, 27 bp, Artificial Sequence
  Description of Artificial Sequence: Synthetic oligonucleotide
tgactgaccaagaggacacgggcacca

SEQ ID NO: 237801 - DNA, 27 bp, Artificial Sequence
  Description of Artificial Sequence: Synthetic oligonucleotide
gactgaccaagaggacacgggcaccat

SEQ ID NO: 237802 - DNA, 27 bp, Artificial Sequence
  Description of Artificial Sequence: Synthetic oligonucleotide
actgaccaagaggacacgggcaccatc

SEQ ID NO: 237803 - DNA, 27 bp, Artificial Sequence
  Description of Artificial Sequence: Synthetic oligonucleotide
ctgaccaagaggacacgggcaccatct

SEQ ID NO: 237804 - DNA, 27 bp, Artificial Sequence
  Description of Artificial Sequence: Synthetic oligonucleotide
tgaccaagaggacacgggcaccatctg

SEQ ID NO: 237805 - DNA, 27 bp, Artificial Sequence
  Description of Artificial Sequence: Synthetic oligonucleotide
gaccaagaggacacgggcaccatctga

SEQ ID NO: 237806 - DNA, 27 bp, Artificial Sequence
  Description of Artificial Sequence: Synthetic oligonucleotide
accaagaggacacgggcaccatctgag

SEQ ID NO: 237807 - DNA, 26 bp, Artificial Sequence
  Description of Artificial Sequence: Synthetic oligonucleotide
ccaagaggacacgggcaccatctgag

SEQ ID NO: 237808 - DNA, 27 bp, Artificial Sequence
  Description of Artificial Sequence: Synthetic oligonucleotide
caagaggacacgggcaccatctgagca

SEQ ID NO: 237809 - DNA, 28 bp, Artificial Sequence
  Description of Artificial Sequence: Synthetic oligonucleotide
aagaggacacgggcaccatctgagcaag

SEQ ID NO: 237810 - DNA, 27 bp, Artificial Sequence
  Description of Artificial Sequence: Synthetic oligonucleotide
agaggacacgggcaccatctgagcaag

SEQ ID NO: 237811 - DNA, 27 bp, Artificial Sequence
  Description of Artificial Sequence: Synthetic oligonucleotide
gaggacacgggcaccatctgagcaagt

SEQ ID NO: 237812 - DNA, 28 bp, Artificial Sequence
  Description of Artificial Sequence: Synthetic oligonucleotide
aggacacgggcaccatctgagcaagtag

SEQ ID NO: 237813 - DNA, 27 bp, Artificial Sequence
  Description of Artificial Sequence: Synthetic oligonucleotide
ggacacgggcaccatctgagcaagtag

SEQ ID NO: 237814 - DNA, 27 bp, Artificial Sequence
  Description of Artificial Sequence: Synthetic oligonucleotide
gacacgggcaccatctgagcaagtagc

SEQ ID NO: 237815 - DNA, 27 bp, Artificial Sequence
  Description of Artificial Sequence: Synthetic oligonucleotide
acacgggcaccatctgagcaagtagcg

SEQ ID NO: 237816 - DNA, 27 bp, Artificial Sequence
  Description of Artificial Sequence: Synthetic oligonucleotide
cacgggcaccatctgagcaagtagcga

SEQ ID NO: 237817 - DNA, 30 bp, Artificial Sequence
  Description of Artificial Sequence: Synthetic oligonucleotide
acgggcaccatctgagcaagtagcgaaaac

SEQ ID NO: 237818 - DNA, 29 bp, Artificial Sequence
  Description of Artificial Sequence: Synthetic oligonucleotide
cgggcaccatctgagcaagtagcgaaaac

SEQ ID NO: 237819 - DNA, 29 bp, Artificial Sequence
  Description of Artificial Sequence: Synthetic oligonucleotide
gggcaccatctgagcaagtagcgaaaacc

SEQ ID NO: 237820 - DNA, 30 bp, Artificial Sequence
  Description of Artificial Sequence: Synthetic oligonucleotide
ggcaccatctgagcaagtagcgaaaaccac

SEQ ID NO: 237821 - DNA, 31 bp, Artificial Sequence
  Description of Artificial Sequence: Synthetic oligonucleotide
gcaccatctgagcaagtagcgaaaaccactg

SEQ ID NO: 237822 - DNA, 31 bp, Artificial Sequence
  Description of Artificial Sequence: Synthetic oligonucleotide
caccatctgagcaagtagcgaaaaccactgc

SEQ ID NO: 237823 - DNA, 37 bp, Artificial Sequence
  Description of Artificial Sequence: Synthetic oligonucleotide
accatctgagcaagtagcgaaaaccactgcttttaac

SEQ ID NO: 237824 - DNA, 36 bp, Artificial Sequence
  Description of Artificial Sequence: Synthetic oligonucleotide
ccatctgagcaagtagcgaaaaccactgcttttaac

SEQ ID NO: 237825 - DNA, 37 bp, Artificial Sequence
  Description of Artificial Sequence: Synthetic oligonucleotide
catctgagcaagtagcgaaaaccactgcttttaacag

SEQ ID NO: 237826 - DNA, 37 bp, Artificial Sequence
  Description of Artificial Sequence: Synthetic oligonucleotide
atctgagcaagtagcgaaaaccactgcttttaacagg

SEQ ID NO: 237827 - DNA, 36 bp, Artificial Sequence
  Description of Artificial Sequence: Synthetic oligonucleotide
tctgagcaagtagcgaaaaccactgcttttaacagg

SEQ ID NO: 237828 - DNA, 35 bp, Artificial Sequence
  Description of Artificial Sequence: Synthetic oligonucleotide
ctgagcaagtagcgaaaaccactgcttttaacagg

SEQ ID NO: 237829 - DNA, 36 bp, Artificial Sequence
  Description of Artificial Sequence: Synthetic oligonucleotide
tgagcaagtagcgaaaaccactgcttttaacaggag

SEQ ID NO: 237830 - DNA, 35 bp, Artificial Sequence
  Description of Artificial Sequence: Synthetic oligonucleotide
gagcaagtagcgaaaaccactgcttttaacaggag

SEQ ID NO: 237831 - DNA, 35 bp, Artificial Sequence
  Description of Artificial Sequence: Synthetic oligonucleotide
agcaagtagcgaaaaccactgcttttaacaggagg

SEQ ID NO: 237832 - DNA, 34 bp, Artificial Sequence
  Description of Artificial Sequence: Synthetic oligonucleotide
gcaagtagcgaaaaccactgcttttaacaggagg

SEQ ID NO: 237833 - DNA, 34 bp, Artificial Sequence
  Description of Artificial Sequence: Synthetic oligonucleotide
caagtagcgaaaaccactgcttttaacaggaggg

SEQ ID NO: 237834 - DNA, 35 bp, Artificial Sequence
  Description of Artificial Sequence: Synthetic oligonucleotide
aagtagcgaaaaccactgcttttaacaggagggag

SEQ ID NO: 237835 - DNA, 34 bp, Artificial Sequence
  Description of Artificial Sequence: Synthetic oligonucleotide
agtagcgaaaaccactgcttttaacaggagggag

SEQ ID NO: 237836 - DNA, 33 bp, Artificial Sequence
  Description of Artificial Sequence: Synthetic oligonucleotide
gtagcgaaaaccactgcttttaacaggagggag

SEQ ID NO: 237837 - DNA, 33 bp, Artificial Sequence
  Description of Artificial Sequence: Synthetic oligonucleotide
tagcgaaaaccactgcttttaacaggagggagc

SEQ ID NO: 237838 - DNA, 32 bp, Artificial Sequence
  Description of Artificial Sequence: Synthetic oligonucleotide
agcgaaaaccactgcttttaacaggagggagc

SEQ ID NO: 237839 - DNA, 31 bp, Artificial Sequence
  Description of Artificial Sequence: Synthetic oligonucleotide
gcgaaaaccactgcttttaacaggagggagc

SEQ ID NO: 237840 - DNA, 31 bp, Artificial Sequence
  Description of Artificial Sequence: Synthetic oligonucleotide
cgaaaaccactgcttttaacaggagggagcc

SEQ ID NO: 237841 - DNA, 32 bp, Artificial Sequence
  Description of Artificial Sequence: Synthetic oligonucleotide
gaaaaccactgcttttaacaggagggagccag

SEQ ID NO: 237842 - DNA, 33 bp, Artificial Sequence
  Description of Artificial Sequence: Synthetic oligonucleotide
aaaaccactgcttttaacaggagggagccagtg

SEQ ID NO: 237843 - DNA, 32 bp, Artificial Sequence
  Description of Artificial Sequence: Synthetic oligonucleotide
aaaccactgcttttaacaggagggagccagtg

SEQ ID NO: 237844 - DNA, 31 bp, Artificial Sequence
  Description of Artificial Sequence: Synthetic oligonucleotide
aaccactgcttttaacaggagggagccagtg

SEQ ID NO: 237845 - DNA, 30 bp, Artificial Sequence
  Description of Artificial Sequence: Synthetic oligonucleotide
accactgcttttaacaggagggagccagtg

SEQ ID NO: 237846 - DNA, 29 bp, Artificial Sequence
  Description of Artificial Sequence: Synthetic oligonucleotide
ccactgcttttaacaggagggagccagtg

SEQ ID NO: 237847 - DNA, 31 bp, Artificial Sequence
  Description of Artificial Sequence: Synthetic oligonucleotide
cactgcttttaacaggagggagccagtgatg

SEQ ID NO: 237848 - DNA, 31 bp, Artificial Sequence
  Description of Artificial Sequence: Synthetic oligonucleotide
actgcttttaacaggagggagccagtgatgc

SEQ ID NO: 237849 - DNA, 30 bp, Artificial Sequence
  Description of Artificial Sequence: Synthetic oligonucleotide
ctgcttttaacaggagggagccagtgatgc

SEQ ID NO: 237850 - DNA, 31 bp, Artificial Sequence
  Description of Artificial Sequence: Synthetic oligonucleotide
tgcttttaacaggagggagccagtgatgctg

SEQ ID NO: 237851 - DNA, 30 bp, Artificial Sequence
  Description of Artificial Sequence: Synthetic oligonucleotide
gcttttaacaggagggagccagtgatgctg

SEQ ID NO: 237852 - DNA, 30 bp, Artificial Sequence
  Description of Artificial Sequence: Synthetic oligonucleotide
cttttaacaggagggagccagtgatgctgc

SEQ ID NO: 237853 - DNA, 30 bp, Artificial Sequence
  Description of Artificial Sequence: Synthetic oligonucleotide
ttttaacaggagggagccagtgatgctgcc

SEQ ID NO: 237854 - DNA, 29 bp, Artificial Sequence
  Description of Artificial Sequence: Synthetic oligonucleotide
tttaacaggagggagccagtgatgctgcc

SEQ ID NO: 237855 - DNA, 28 bp, Artificial Sequence
  Description of Artificial Sequence: Synthetic oligonucleotide
ttaacaggagggagccagtgatgctgcc

SEQ ID NO: 237856 - DNA, 27 bp, Artificial Sequence
  Description of Artificial Sequence: Synthetic oligonucleotide
taacaggagggagccagtgatgctgcc

SEQ ID NO: 237857 - DNA, 26 bp, Artificial Sequence
  Description of Artificial Sequence: Synthetic oligonucleotide
aacaggagggagccagtgatgctgcc

SEQ ID NO: 237858 - DNA, 25 bp, Artificial Sequence
  Description of Artificial Sequence: Synthetic oligonucleotide
acaggagggagccagtgatgctgcc

SEQ ID NO: 237859 - DNA, 24 bp, Artificial Sequence
  Description of Artificial Sequence: Synthetic oligonucleotide
caggagggagccagtgatgctgcc

SEQ ID NO: 237860 - DNA, 25 bp, Artificial Sequence
  Description of Artificial Sequence: Synthetic oligonucleotide
aggagggagccagtgatgctgccct

SEQ ID NO: 237861 - DNA, 24 bp, Artificial Sequence
  Description of Artificial Sequence: Synthetic oligonucleotide
ggagggagccagtgatgctgccct

SEQ ID NO: 237862 - DNA, 24 bp, Artificial Sequence
  Description of Artificial Sequence: Synthetic oligonucleotide
gagggagccagtgatgctgccctg

SEQ ID NO: 237863 - DNA, 27 bp, Artificial Sequence
  Description of Artificial Sequence: Synthetic oligonucleotide
agggagccagtgatgctgccctgctat

SEQ ID NO: 237864 - DNA, 26 bp, Artificial Sequence
  Description of Artificial Sequence: Synthetic oligonucleotide
gggagccagtgatgctgccctgctat

SEQ ID NO: 237865 - DNA, 27 bp, Artificial Sequence
  Description of Artificial Sequence: Synthetic oligonucleotide
ggagccagtgatgctgccctgctatga

SEQ ID NO: 237866 - DNA, 27 bp, Artificial Sequence
  Description of Artificial Sequence: Synthetic oligonucleotide
gagccagtgatgctgccctgctatgag

SEQ ID NO: 237867 - DNA, 28 bp, Artificial Sequence
  Description of Artificial Sequence: Synthetic oligonucleotide
agccagtgatgctgccctgctatgagtg

SEQ ID NO: 237868 - DNA, 27 bp, Artificial Sequence
  Description of Artificial Sequence: Synthetic oligonucleotide
gccagtgatgctgccctgctatgagtg

SEQ ID NO: 237869 - DNA, 27 bp, Artificial Sequence
  Description of Artificial Sequence: Synthetic oligonucleotide
ccagtgatgctgccctgctatgagtgg

SEQ ID NO: 237870 - DNA, 27 bp, Artificial Sequence
  Description of Artificial Sequence: Synthetic oligonucleotide
cagtgatgctgccctgctatgagtggg

SEQ ID NO: 237871 - DNA, 27 bp, Artificial Sequence
  Description of Artificial Sequence: Synthetic oligonucleotide
agtgatgctgccctgctatgagtgggg

SEQ ID NO: 237872 - DNA, 26 bp, Artificial Sequence
  Description of Artificial Sequence: Synthetic oligonucleotide
gtgatgctgccctgctatgagtgggg

SEQ ID NO: 237873 - DNA, 27 bp, Artificial Sequence
  Description of Artificial Sequence: Synthetic oligonucleotide
tgatgctgccctgctatgagtggggct

SEQ ID NO: 237874 - DNA, 27 bp, Artificial Sequence
  Description of Artificial Sequence: Synthetic oligonucleotide
gatgctgccctgctatgagtggggctt

SEQ ID NO: 237875 - DNA, 27 bp, Artificial Sequence
  Description of Artificial Sequence: Synthetic oligonucleotide
atgctgccctgctatgagtggggcttg

SEQ ID NO: 237876 - DNA, 27 bp, Artificial Sequence
  Description of Artificial Sequence: Synthetic oligonucleotide
tgctgccctgctatgagtggggcttgt

SEQ ID NO: 237877 - DNA, 27 bp, Artificial Sequence
  Description of Artificial Sequence: Synthetic oligonucleotide
gctgccctgctatgagtggggcttgta

SEQ ID NO: 237878 - DNA, 28 bp, Artificial Sequence
  Description of Artificial Sequence: Synthetic oligonucleotide
ctgccctgctatgagtggggcttgtatc

SEQ ID NO: 237879 - DNA, 28 bp, Artificial Sequence
  Description of Artificial Sequence: Synthetic oligonucleotide
tgccctgctatgagtggggcttgtatcc

SEQ ID NO: 237880 - DNA, 27 bp, Artificial Sequence
  Description of Artificial Sequence: Synthetic oligonucleotide
gccctgctatgagtggggcttgtatcc

SEQ ID NO: 237881 - DNA, 28 bp, Artificial Sequence
  Description of Artificial Sequence: Synthetic oligonucleotide
ccctgctatgagtggggcttgtatccag

SEQ ID NO: 237882 - DNA, 28 bp, Artificial Sequence
  Description of Artificial Sequence: Synthetic oligonucleotide
cctgctatgagtggggcttgtatccagc

SEQ ID NO: 237883 - DNA, 29 bp, Artificial Sequence
  Description of Artificial Sequence: Synthetic oligonucleotide
ctgctatgagtggggcttgtatccagcac

SEQ ID NO: 237884 - DNA, 31 bp, Artificial Sequence
  Description of Artificial Sequence: Synthetic oligonucleotide
tgctatgagtggggcttgtatccagcacaag

SEQ ID NO: 237885 - DNA, 30 bp, Artificial Sequence
  Description of Artificial Sequence: Synthetic oligonucleotide
gctatgagtggggcttgtatccagcacaag

SEQ ID NO: 237886 - DNA, 31 bp, Artificial Sequence
  Description of Artificial Sequence: Synthetic oligonucleotide
ctatgagtggggcttgtatccagcacaagtg

SEQ ID NO: 237887 - DNA, 32 bp, Artificial Sequence
  Description of Artificial Sequence: Synthetic oligonucleotide
tatgagtggggcttgtatccagcacaagtgac

SEQ ID NO: 237888 - DNA, 31 bp, Artificial Sequence
  Description of Artificial Sequence: Synthetic oligonucleotide
atgagtggggcttgtatccagcacaagtgac

SEQ ID NO: 237889 - DNA, 30 bp, Artificial Sequence
  Description of Artificial Sequence: Synthetic oligonucleotide
tgagtggggcttgtatccagcacaagtgac

SEQ ID NO: 237890 - DNA, 29 bp, Artificial Sequence
  Description of Artificial Sequence: Synthetic oligonucleotide
gagtggggcttgtatccagcacaagtgac

SEQ ID NO: 237891 - DNA, 32 bp, Artificial Sequence
  Description of Artificial Sequence: Synthetic oligonucleotide
agtggggcttgtatccagcacaagtgactaac

SEQ ID NO: 237892 - DNA, 31 bp, Artificial Sequence
  Description of Artificial Sequence: Synthetic oligonucleotide
gtggggcttgtatccagcacaagtgactaac

SEQ ID NO: 237893 - DNA, 32 bp, Artificial Sequence
  Description of Artificial Sequence: Synthetic oligonucleotide
tggggcttgtatccagcacaagtgactaacac

SEQ ID NO: 237894 - DNA, 31 bp, Artificial Sequence
  Description of Artificial Sequence: Synthetic oligonucleotide
ggggcttgtatccagcacaagtgactaacac

SEQ ID NO: 237895 - DNA, 31 bp, Artificial Sequence
  Description of Artificial Sequence: Synthetic oligonucleotide
gggcttgtatccagcacaagtgactaacacg

SEQ ID NO: 237896 - DNA, 32 bp, Artificial Sequence
  Description of Artificial Sequence: Synthetic oligonucleotide
ggcttgtatccagcacaagtgactaacacgtg

SEQ ID NO: 237897 - DNA, 32 bp, Artificial Sequence
  Description of Artificial Sequence: Synthetic oligonucleotide
gcttgtatccagcacaagtgactaacacgtgg

SEQ ID NO: 237898 - DNA, 33 bp, Artificial Sequence
  Description of Artificial Sequence: Synthetic oligonucleotide
cttgtatccagcacaagtgactaacacgtggag

SEQ ID NO: 237899 - DNA, 33 bp, Artificial Sequence
  Description of Artificial Sequence: Synthetic oligonucleotide
ttgtatccagcacaagtgactaacacgtggagc

SEQ ID NO: 237900 - DNA, 32 bp, Artificial Sequence
  Description of Artificial Sequence: Synthetic oligonucleotide
tgtatccagcacaagtgactaacacgtggagc

SEQ ID NO: 237901 - DNA, 31 bp, Artificial Sequence
  Description of Artificial Sequence: Synthetic oligonucleotide
gtatccagcacaagtgactaacacgtggagc

SEQ ID NO: 237902 - DNA, 33 bp, Artificial Sequence
  Description of Artificial Sequence: Synthetic oligonucleotide
tatccagcacaagtgactaacacgtggagcaag

SEQ ID NO: 237903 - DNA, 32 bp, Artificial Sequence
  Description of Artificial Sequence: Synthetic oligonucleotide
atccagcacaagtgactaacacgtggagcaag

SEQ ID NO: 237904 - DNA, 31 bp, Artificial Sequence
  Description of Artificial Sequence: Synthetic oligonucleotide
tccagcacaagtgactaacacgtggagcaag

SEQ ID NO: 237905 - DNA, 30 bp, Artificial Sequence
  Description of Artificial Sequence: Synthetic oligonucleotide
ccagcacaagtgactaacacgtggagcaag

SEQ ID NO: 237906 - DNA, 32 bp, Artificial Sequence
  Description of Artificial Sequence: Synthetic oligonucleotide
cagcacaagtgactaacacgtggagcaagaac

SEQ ID NO: 237907 - DNA, 32 bp, Artificial Sequence
  Description of Artificial Sequence: Synthetic oligonucleotide
agcacaagtgactaacacgtggagcaagaacg

SEQ ID NO: 237908 - DNA, 31 bp, Artificial Sequence
  Description of Artificial Sequence: Synthetic oligonucleotide
gcacaagtgactaacacgtggagcaagaacg

SEQ ID NO: 237909 - DNA, 31 bp, Artificial Sequence
  Description of Artificial Sequence: Synthetic oligonucleotide
cacaagtgactaacacgtggagcaagaacgg

SEQ ID NO: 237910 - DNA, 31 bp, Artificial Sequence
  Description of Artificial Sequence: Synthetic oligonucleotide
acaagtgactaacacgtggagcaagaacggg

SEQ ID NO: 237911 - DNA, 30 bp, Artificial Sequence
  Description of Artificial Sequence: Synthetic oligonucleotide
caagtgactaacacgtggagcaagaacggg

SEQ ID NO: 237912 - DNA, 32 bp, Artificial Sequence
  Description of Artificial Sequence: Synthetic oligonucleotide
aagtgactaacacgtggagcaagaacgggtag

SEQ ID NO: 237913 - DNA, 31 bp, Artificial Sequence
  Description of Artificial Sequence: Synthetic oligonucleotide
agtgactaacacgtggagcaagaacgggtag

SEQ ID NO: 237914 - DNA, 30 bp, Artificial Sequence
  Description of Artificial Sequence: Synthetic oligonucleotide
gtgactaacacgtggagcaagaacgggtag

SEQ ID NO: 237915 - DNA, 30 bp, Artificial Sequence
  Description of Artificial Sequence: Synthetic oligonucleotide
tgactaacacgtggagcaagaacgggtagc

SEQ ID NO: 237916 - DNA, 29 bp, Artificial Sequence
  Description of Artificial Sequence: Synthetic oligonucleotide
gactaacacgtggagcaagaacgggtagc

SEQ ID NO: 237917 - DNA, 31 bp, Artificial Sequence
  Description of Artificial Sequence: Synthetic oligonucleotide
actaacacgtggagcaagaacgggtagcttg

SEQ ID NO: 237918 - DNA, 30 bp, Artificial Sequence
  Description of Artificial Sequence: Synthetic oligonucleotide
ctaacacgtggagcaagaacgggtagcttg

SEQ ID NO: 237919 - DNA, 31 bp, Artificial Sequence
  Description of Artificial Sequence: Synthetic oligonucleotide
taacacgtggagcaagaacgggtagcttgtc

SEQ ID NO: 237920 - DNA, 30 bp, Artificial Sequence
  Description of Artificial Sequence: Synthetic oligonucleotide
aacacgtggagcaagaacgggtagcttgtc

SEQ ID NO: 237921 - DNA, 29 bp, Artificial Sequence
  Description of Artificial Sequence: Synthetic oligonucleotide
acacgtggagcaagaacgggtagcttgtc

SEQ ID NO: 237922 - DNA, 28 bp, Artificial Sequence
  Description of Artificial Sequence: Synthetic oligonucleotide
cacgtggagcaagaacgggtagcttgtc

SEQ ID NO: 237923 - DNA, 30 bp, Artificial Sequence
  Description of Artificial Sequence: Synthetic oligonucleotide
acgtggagcaagaacgggtagcttgtcaag

SEQ ID NO: 237924 - DNA, 29 bp, Artificial Sequence
  Description of Artificial Sequence: Synthetic oligonucleotide
cgtggagcaagaacgggtagcttgtcaag

SEQ ID NO: 237925 - DNA, 29 bp, Artificial Sequence
  Description of Artificial Sequence: Synthetic oligonucleotide
gtggagcaagaacgggtagcttgtcaagc

SEQ ID NO: 237926 - DNA, 29 bp, Artificial Sequence
  Description of Artificial Sequence: Synthetic oligonucleotide
tggagcaagaacgggtagcttgtcaagcc

SEQ ID NO: 237927 - DNA, 28 bp, Artificial Sequence
  Description of Artificial Sequence: Synthetic oligonucleotide
ggagcaagaacgggtagcttgtcaagcc

SEQ ID NO: 237928 - DNA, 29 bp, Artificial Sequence
  Description of Artificial Sequence: Synthetic oligonucleotide
gagcaagaacgggtagcttgtcaagcctc

SEQ ID NO: 237929 - DNA, 30 bp, Artificial Sequence
  Description of Artificial Sequence: Synthetic oligonucleotide
agcaagaacgggtagcttgtcaagcctcac

SEQ ID NO: 237930 - DNA, 29 bp, Artificial Sequence
  Description of Artificial Sequence: Synthetic oligonucleotide
gcaagaacgggtagcttgtcaagcctcac

SEQ ID NO: 237931 - DNA, 30 bp, Artificial Sequence
  Description of Artificial Sequence: Synthetic oligonucleotide
caagaacgggtagcttgtcaagcctcacag

SEQ ID NO: 237932 - DNA, 30 bp, Artificial Sequence
  Description of Artificial Sequence: Synthetic oligonucleotide
aagaacgggtagcttgtcaagcctcacagg

SEQ ID NO: 237933 - DNA, 29 bp, Artificial Sequence
  Description of Artificial Sequence: Synthetic oligonucleotide
agaacgggtagcttgtcaagcctcacagg

SEQ ID NO: 237934 - DNA, 28 bp, Artificial Sequence
  Description of Artificial Sequence: Synthetic oligonucleotide
gaacgggtagcttgtcaagcctcacagg

SEQ ID NO: 237935 - DNA, 29 bp, Artificial Sequence
  Description of Artificial Sequence: Synthetic oligonucleotide
aacgggtagcttgtcaagcctcacaggag

SEQ ID NO: 237936 - DNA, 28 bp, Artificial Sequence
  Description of Artificial Sequence: Synthetic oligonucleotide
acgggtagcttgtcaagcctcacaggag

SEQ ID NO: 237937 - DNA, 27 bp, Artificial Sequence
  Description of Artificial Sequence: Synthetic oligonucleotide
cgggtagcttgtcaagcctcacaggag

SEQ ID NO: 237938 - DNA, 28 bp, Artificial Sequence
  Description of Artificial Sequence: Synthetic oligonucleotide
gggtagcttgtcaagcctcacaggagtg

SEQ ID NO: 237939 - DNA, 28 bp, Artificial Sequence
  Description of Artificial Sequence: Synthetic oligonucleotide
ggtagcttgtcaagcctcacaggagtgc

SEQ ID NO: 237940 - DNA, 28 bp, Artificial Sequence
  Description of Artificial Sequence: Synthetic oligonucleotide
gtagcttgtcaagcctcacaggagtgcg

SEQ ID NO: 237941 - DNA, 28 bp, Artificial Sequence
  Description of Artificial Sequence: Synthetic oligonucleotide
tagcttgtcaagcctcacaggagtgcgc

SEQ ID NO: 237942 - DNA, 27 bp, Artificial Sequence
  Description of Artificial Sequence: Synthetic oligonucleotide
agcttgtcaagcctcacaggagtgcgc

SEQ ID NO: 237943 - DNA, 27 bp, Artificial Sequence
  Description of Artificial Sequence: Synthetic oligonucleotide
gcttgtcaagcctcacaggagtgcgca

SEQ ID NO: 237944 - DNA, 27 bp, Artificial Sequence
  Description of Artificial Sequence: Synthetic oligonucleotide
cttgtcaagcctcacaggagtgcgcac

SEQ ID NO: 237945 - DNA, 29 bp, Artificial Sequence
  Description of Artificial Sequence: Synthetic oligonucleotide
ttgtcaagcctcacaggagtgcgcactag

SEQ ID NO: 237946 - DNA, 28 bp, Artificial Sequence
  Description of Artificial Sequence: Synthetic oligonucleotide
tgtcaagcctcacaggagtgcgcactag

SEQ ID NO: 237947 - DNA, 27 bp, Artificial Sequence
  Description of Artificial Sequence: Synthetic oligonucleotide
gtcaagcctcacaggagtgcgcactag

SEQ ID NO: 237948 - DNA, 28 bp, Artificial Sequence
  Description of Artificial Sequence: Synthetic oligonucleotide
tcaagcctcacaggagtgcgcactagac

SEQ ID NO: 237949 - DNA, 27 bp, Artificial Sequence
  Description of Artificial Sequence: Synthetic oligonucleotide
caagcctcacaggagtgcgcactagac

SEQ ID NO: 237950 - DNA, 28 bp, Artificial Sequence
  Description of Artificial Sequence: Synthetic oligonucleotide
aagcctcacaggagtgcgcactagactg

SEQ ID NO: 237951 - DNA, 27 bp, Artificial Sequence
  Description of Artificial Sequence: Synthetic oligonucleotide
agcctcacaggagtgcgcactagactg

SEQ ID NO: 237952 - DNA, 26 bp, Artificial Sequence
  Description of Artificial Sequence: Synthetic oligonucleotide
gcctcacaggagtgcgcactagactg

SEQ ID NO: 237953 - DNA, 26 bp, Artificial Sequence
  Description of Artificial Sequence: Synthetic oligonucleotide
cctcacaggagtgcgcactagactgc

SEQ ID NO: 237954 - DNA, 26 bp, Artificial Sequence
  Description of Artificial Sequence: Synthetic oligonucleotide
ctcacaggagtgcgcactagactgcc

SEQ ID NO: 237955 - DNA, 27 bp, Artificial Sequence
  Description of Artificial Sequence: Synthetic oligonucleotide
tcacaggagtgcgcactagactgccct

SEQ ID NO: 237956 - DNA, 26 bp, Artificial Sequence
  Description of Artificial Sequence: Synthetic oligonucleotide
cacaggagtgcgcactagactgccct

SEQ ID NO: 237957 - DNA, 26 bp, Artificial Sequence
  Description of Artificial Sequence: Synthetic oligonucleotide
acaggagtgcgcactagactgccctg

SEQ ID NO: 237958 - DNA, 25 bp, Artificial Sequence
  Description of Artificial Sequence: Synthetic oligonucleotide
caggagtgcgcactagactgccctg

SEQ ID NO: 237959 - DNA, 25 bp, Artificial Sequence
  Description of Artificial Sequence: Synthetic oligonucleotide
aggagtgcgcactagactgccctgc

SEQ ID NO: 237960 - DNA, 24 bp, Artificial Sequence
  Description of Artificial Sequence: Synthetic oligonucleotide
ggagtgcgcactagactgccctgc

SEQ ID NO: 237961 - DNA, 24 bp, Artificial Sequence
  Description of Artificial Sequence: Synthetic oligonucleotide
gagtgcgcactagactgccctgcc

SEQ ID NO: 237962 - DNA, 27 bp, Artificial Sequence
  Description of Artificial Sequence: Synthetic oligonucleotide
agtgcgcactagactgccctgcccaat

SEQ ID NO: 237963 - DNA, 26 bp, Artificial Sequence
  Description of Artificial Sequence: Synthetic oligonucleotide
gtgcgcactagactgccctgcccaat

SEQ ID NO: 237964 - DNA, 26 bp, Artificial Sequence
  Description of Artificial Sequence: Synthetic oligonucleotide
tgcgcactagactgccctgcccaatg

SEQ ID NO: 237965 - DNA, 25 bp, Artificial Sequence
  Description of Artificial Sequence: Synthetic oligonucleotide
gcgcactagactgccctgcccaatg

SEQ ID NO: 237966 - DNA, 26 bp, Artificial Sequence
  Description of Artificial Sequence: Synthetic oligonucleotide
cgcactagactgccctgcccaatggt

SEQ ID NO: 237967 - DNA, 27 bp, Artificial Sequence
  Description of Artificial Sequence: Synthetic oligonucleotide
gcactagactgccctgcccaatggtga

SEQ ID NO: 237968 - DNA, 27 bp, Artificial Sequence
  Description of Artificial Sequence: Synthetic oligonucleotide
cactagactgccctgcccaatggtgac

SEQ ID NO: 237969 - DNA, 28 bp, Artificial Sequence
  Description of Artificial Sequence: Synthetic oligonucleotide
actagactgccctgcccaatggtgactg

SEQ ID NO: 237970 - DNA, 27 bp, Artificial Sequence
  Description of Artificial Sequence: Synthetic oligonucleotide
ctagactgccctgcccaatggtgactg

SEQ ID NO: 237971 - DNA, 27 bp, Artificial Sequence
  Description of Artificial Sequence: Synthetic oligonucleotide
tagactgccctgcccaatggtgactgg

SEQ ID NO: 237972 - DNA, 27 bp, Artificial Sequence
  Description of Artificial Sequence: Synthetic oligonucleotide
agactgccctgcccaatggtgactgga

SEQ ID NO: 237973 - DNA, 26 bp, Artificial Sequence
  Description of Artificial Sequence: Synthetic oligonucleotide
gactgccctgcccaatggtgactgga

SEQ ID NO: 237974 - DNA, 27 bp, Artificial Sequence
  Description of Artificial Sequence: Synthetic oligonucleotide
actgccctgcccaatggtgactggaca

SEQ ID NO: 237975 - DNA, 27 bp, Artificial Sequence
  Description of Artificial Sequence: Synthetic oligonucleotide
ctgccctgcccaatggtgactggacaa

SEQ ID NO: 237976 - DNA, 28 bp, Artificial Sequence
  Description of Artificial Sequence: Synthetic oligonucleotide
tgccctgcccaatggtgactggacaaac

SEQ ID NO: 237977 - DNA, 27 bp, Artificial Sequence
  Description of Artificial Sequence: Synthetic oligonucleotide
gccctgcccaatggtgactggacaaac

SEQ ID NO: 237978 - DNA, 27 bp, Artificial Sequence
  Description of Artificial Sequence: Synthetic oligonucleotide
ccctgcccaatggtgactggacaaacc

SEQ ID NO: 237979 - DNA, 28 bp, Artificial Sequence
  Description of Artificial Sequence: Synthetic oligonucleotide
cctgcccaatggtgactggacaaaccag

SEQ ID NO: 237980 - DNA, 29 bp, Artificial Sequence
  Description of Artificial Sequence: Synthetic oligonucleotide
ctgcccaatggtgactggacaaaccagac

SEQ ID NO: 237981 - DNA, 29 bp, Artificial Sequence
  Description of Artificial Sequence: Synthetic oligonucleotide
tgcccaatggtgactggacaaaccagacc

SEQ ID NO: 237982 - DNA, 28 bp, Artificial Sequence
  Description of Artificial Sequence: Synthetic oligonucleotide
gcccaatggtgactggacaaaccagacc

SEQ ID NO: 237983 - DNA, 28 bp, Artificial Sequence
  Description of Artificial Sequence: Synthetic oligonucleotide
cccaatggtgactggacaaaccagaccc

SEQ ID NO: 237984 - DNA, 29 bp, Artificial Sequence
  Description of Artificial Sequence: Synthetic oligonucleotide
ccaatggtgactggacaaaccagacccac

SEQ ID NO: 237985 - DNA, 30 bp, Artificial Sequence
  Description of Artificial Sequence: Synthetic oligonucleotide
caatggtgactggacaaaccagacccactc

SEQ ID NO: 237986 - DNA, 30 bp, Artificial Sequence
  Description of Artificial Sequence: Synthetic oligonucleotide
aatggtgactggacaaaccagacccactcc

SEQ ID NO: 237987 - DNA, 29 bp, Artificial Sequence
  Description of Artificial Sequence: Synthetic oligonucleotide
atggtgactggacaaaccagacccactcc

SEQ ID NO: 237988 - DNA, 28 bp, Artificial Sequence
  Description of Artificial Sequence: Synthetic oligonucleotide
tggtgactggacaaaccagacccactcc

SEQ ID NO: 237989 - DNA, 27 bp, Artificial Sequence
  Description of Artificial Sequence: Synthetic oligonucleotide
ggtgactggacaaaccagacccactcc

SEQ ID NO: 237990 - DNA, 27 bp, Artificial Sequence
  Description of Artificial Sequence: Synthetic oligonucleotide
gtgactggacaaaccagacccactccc

SEQ ID NO: 237991 - DNA, 32 bp, Artificial Sequence
  Description of Artificial Sequence: Synthetic oligonucleotide
tgactggacaaaccagacccactcccattttg

SEQ ID NO: 237992 - DNA, 31 bp, Artificial Sequence
  Description of Artificial Sequence: Synthetic oligonucleotide
gactggacaaaccagacccactcccattttg

SEQ ID NO: 237993 - DNA, 31 bp, Artificial Sequence
  Description of Artificial Sequence: Synthetic oligonucleotide
actggacaaaccagacccactcccattttgc

SEQ ID NO: 237994 - DNA, 30 bp, Artificial Sequence
  Description of Artificial Sequence: Synthetic oligonucleotide
ctggacaaaccagacccactcccattttgc

SEQ ID NO: 237995 - DNA, 30 bp, Artificial Sequence
  Description of Artificial Sequence: Synthetic oligonucleotide
tggacaaaccagacccactcccattttgcc

SEQ ID NO: 237996 - DNA, 29 bp, Artificial Sequence
  Description of Artificial Sequence: Synthetic oligonucleotide
ggacaaaccagacccactcccattttgcc

SEQ ID NO: 237997 - DNA, 33 bp, Artificial Sequence
  Description of Artificial Sequence: Synthetic oligonucleotide
gacaaaccagacccactcccattttgccttaac

SEQ ID NO: 237998 - DNA, 33 bp, Artificial Sequence
  Description of Artificial Sequence: Synthetic oligonucleotide
acaaaccagacccactcccattttgccttaacc

SEQ ID NO: 237999 - DNA, 32 bp, Artificial Sequence
  Description of Artificial Sequence: Synthetic oligonucleotide
caaaccagacccactcccattttgccttaacc

SEQ ID NO: 238000 - DNA, 32 bp, Artificial Sequence
  Description of Artificial Sequence: Synthetic oligonucleotide
aaaccagacccactcccattttgccttaaccg

SEQ ID NO: 238001 - DNA, 31 bp, Artificial Sequence
  Description of Artificial Sequence: Synthetic oligonucleotide
aaccagacccactcccattttgccttaaccg

SEQ ID NO: 238002 - DNA, 30 bp, Artificial Sequence
  Description of Artificial Sequence: Synthetic oligonucleotide
accagacccactcccattttgccttaaccg

SEQ ID NO: 238003 - DNA, 29 bp, Artificial Sequence
  Description of Artificial Sequence: Synthetic oligonucleotide
ccagacccactcccattttgccttaaccg

SEQ ID NO: 238004 - DNA, 29 bp, Artificial Sequence
  Description of Artificial Sequence: Synthetic oligonucleotide
cagacccactcccattttgccttaaccgc

SEQ ID NO: 238005 - DNA, 29 bp, Artificial Sequence
  Description of Artificial Sequence: Synthetic oligonucleotide
agacccactcccattttgccttaaccgcc

SEQ ID NO: 238006 - DNA, 28 bp, Artificial Sequence
  Description of Artificial Sequence: Synthetic oligonucleotide
gacccactcccattttgccttaaccgcc

SEQ ID NO: 238007 - DNA, 29 bp, Artificial Sequence
  Description of Artificial Sequence: Synthetic oligonucleotide
acccactcccattttgccttaaccgcctc

SEQ ID NO: 238008 - DNA, 28 bp, Artificial Sequence
  Description of Artificial Sequence: Synthetic oligonucleotide
cccactcccattttgccttaaccgcctc

SEQ ID NO: 238009 - DNA, 31 bp, Artificial Sequence
  Description of Artificial Sequence: Synthetic oligonucleotide
ccactcccattttgccttaaccgcctcttac

SEQ ID NO: 238010 - DNA, 31 bp, Artificial Sequence
  Description of Artificial Sequence: Synthetic oligonucleotide
cactcccattttgccttaaccgcctcttacg

SEQ ID NO: 238011 - DNA, 31 bp, Artificial Sequence
  Description of Artificial Sequence: Synthetic oligonucleotide
actcccattttgccttaaccgcctcttacgc

SEQ ID NO: 238012 - DNA, 30 bp, Artificial Sequence
  Description of Artificial Sequence: Synthetic oligonucleotide
ctcccattttgccttaaccgcctcttacgc

SEQ ID NO: 238013 - DNA, 30 bp, Artificial Sequence
  Description of Artificial Sequence: Synthetic oligonucleotide
tcccattttgccttaaccgcctcttacgcg

SEQ ID NO: 238014 - DNA, 29 bp, Artificial Sequence
  Description of Artificial Sequence: Synthetic oligonucleotide
cccattttgccttaaccgcctcttacgcg

SEQ ID NO: 238015 - DNA, 29 bp, Artificial Sequence
  Description of Artificial Sequence: Synthetic oligonucleotide
ccattttgccttaaccgcctcttacgcgg

SEQ ID NO: 238016 - DNA, 30 bp, Artificial Sequence
  Description of Artificial Sequence: Synthetic oligonucleotide
cattttgccttaaccgcctcttacgcggac

SEQ ID NO: 238017 - DNA, 31 bp, Artificial Sequence
  Description of Artificial Sequence: Synthetic oligonucleotide
attttgccttaaccgcctcttacgcggacac

SEQ ID NO: 238018 - DNA, 30 bp, Artificial Sequence
  Description of Artificial Sequence: Synthetic oligonucleotide
ttttgccttaaccgcctcttacgcggacac

SEQ ID NO: 238019 - DNA, 29 bp, Artificial Sequence
  Description of Artificial Sequence: Synthetic oligonucleotide
tttgccttaaccgcctcttacgcggacac

SEQ ID NO: 238020 - DNA, 28 bp, Artificial Sequence
  Description of Artificial Sequence: Synthetic oligonucleotide
ttgccttaaccgcctcttacgcggacac

SEQ ID NO: 238021 - DNA, 27 bp, Artificial Sequence
  Description of Artificial Sequence: Synthetic oligonucleotide
tgccttaaccgcctcttacgcggacac

SEQ ID NO: 238022 - DNA, 27 bp, Artificial Sequence
  Description of Artificial Sequence: Synthetic oligonucleotide
gccttaaccgcctcttacgcggacact

SEQ ID NO: 238023 - DNA, 29 bp, Artificial Sequence
  Description of Artificial Sequence: Synthetic oligonucleotide
ccttaaccgcctcttacgcggacacttag

SEQ ID NO: 238024 - DNA, 30 bp, Artificial Sequence
  Description of Artificial Sequence: Synthetic oligonucleotide
cttaaccgcctcttacgcggacacttagac

SEQ ID NO: 238025 - DNA, 30 bp, Artificial Sequence
  Description of Artificial Sequence: Synthetic oligonucleotide
ttaaccgcctcttacgcggacacttagacc

SEQ ID NO: 238026 - DNA, 29 bp, Artificial Sequence
  Description of Artificial Sequence: Synthetic oligonucleotide
taaccgcctcttacgcggacacttagacc

SEQ ID NO: 238027 - DNA, 28 bp, Artificial Sequence
  Description of Artificial Sequence: Synthetic oligonucleotide
aaccgcctcttacgcggacacttagacc

SEQ ID NO: 238028 - DNA, 27 bp, Artificial Sequence
  Description of Artificial Sequence: Synthetic oligonucleotide
accgcctcttacgcggacacttagacc

SEQ ID NO: 238029 - DNA, 27 bp, Artificial Sequence
  Description of Artificial Sequence: Synthetic oligonucleotide
ccgcctcttacgcggacacttagacct

SEQ ID NO: 238030 - DNA, 27 bp, Artificial Sequence
  Description of Artificial Sequence: Synthetic oligonucleotide
cgcctcttacgcggacacttagacctg

SEQ ID NO: 238031 - DNA, 28 bp, Artificial Sequence
  Description of Artificial Sequence: Synthetic oligonucleotide
gcctcttacgcggacacttagacctgtg

SEQ ID NO: 238032 - DNA, 29 bp, Artificial Sequence
  Description of Artificial Sequence: Synthetic oligonucleotide
cctcttacgcggacacttagacctgtgtg

SEQ ID NO: 238033 - DNA, 29 bp, Artificial Sequence
  Description of Artificial Sequence: Synthetic oligonucleotide
ctcttacgcggacacttagacctgtgtgc

SEQ ID NO: 238034 - DNA, 31 bp, Artificial Sequence
  Description of Artificial Sequence: Synthetic oligonucleotide
tcttacgcggacacttagacctgtgtgctag

SEQ ID NO: 238035 - DNA, 30 bp, Artificial Sequence
  Description of Artificial Sequence: Synthetic oligonucleotide
cttacgcggacacttagacctgtgtgctag

SEQ ID NO: 238036 - DNA, 31 bp, Artificial Sequence
  Description of Artificial Sequence: Synthetic oligonucleotide
ttacgcggacacttagacctgtgtgctagag

SEQ ID NO: 238037 - DNA, 30 bp, Artificial Sequence
  Description of Artificial Sequence: Synthetic oligonucleotide
tacgcggacacttagacctgtgtgctagag

SEQ ID NO: 238038 - DNA, 29 bp, Artificial Sequence
  Description of Artificial Sequence: Synthetic oligonucleotide
acgcggacacttagacctgtgtgctagag

SEQ ID NO: 238039 - DNA, 28 bp, Artificial Sequence
  Description of Artificial Sequence: Synthetic oligonucleotide
cgcggacacttagacctgtgtgctagag

SEQ ID NO: 238040 - DNA, 28 bp, Artificial Sequence
  Description of Artificial Sequence: Synthetic oligonucleotide
gcggacacttagacctgtgtgctagagc

SEQ ID NO: 238041 - DNA, 29 bp, Artificial Sequence
  Description of Artificial Sequence: Synthetic oligonucleotide
cggacacttagacctgtgtgctagagcac

SEQ ID NO: 238042 - DNA, 32 bp, Artificial Sequence
  Description of Artificial Sequence: Synthetic oligonucleotide
ggacacttagacctgtgtgctagagcacaatg

SEQ ID NO: 238043 - DNA, 32 bp, Artificial Sequence
  Description of Artificial Sequence: Synthetic oligonucleotide
gacacttagacctgtgtgctagagcacaatgg

SEQ ID NO: 238044 - DNA, 32 bp, Artificial Sequence
  Description of Artificial Sequence: Synthetic oligonucleotide
acacttagacctgtgtgctagagcacaatggg

SEQ ID NO: 238045 - DNA, 31 bp, Artificial Sequence
  Description of Artificial Sequence: Synthetic oligonucleotide
cacttagacctgtgtgctagagcacaatggg

SEQ ID NO: 238046 - DNA, 31 bp, Artificial Sequence
  Description of Artificial Sequence: Synthetic oligonucleotide
acttagacctgtgtgctagagcacaatgggg

SEQ ID NO: 238047 - DNA, 30 bp, Artificial Sequence
  Description of Artificial Sequence: Synthetic oligonucleotide
cttagacctgtgtgctagagcacaatgggg

SEQ ID NO: 238048 - DNA, 30 bp, Artificial Sequence
  Description of Artificial Sequence: Synthetic oligonucleotide
ttagacctgtgtgctagagcacaatggggc

SEQ ID NO: 238049 - DNA, 29 bp, Artificial Sequence
  Description of Artificial Sequence: Synthetic oligonucleotide
tagacctgtgtgctagagcacaatggggc

SEQ ID NO: 238050 - DNA, 28 bp, Artificial Sequence
  Description of Artificial Sequence: Synthetic oligonucleotide
agacctgtgtgctagagcacaatggggc

SEQ ID NO: 238051 - DNA, 27 bp, Artificial Sequence
  Description of Artificial Sequence: Synthetic oligonucleotide
gacctgtgtgctagagcacaatggggc

SEQ ID NO: 238052 - DNA, 28 bp, Artificial Sequence
  Description of Artificial Sequence: Synthetic oligonucleotide
acctgtgtgctagagcacaatggggctc

SEQ ID NO: 238053 - DNA, 27 bp, Artificial Sequence
  Description of Artificial Sequence: Synthetic oligonucleotide
cctgtgtgctagagcacaatggggctc

SEQ ID NO: 238054 - DNA, 27 bp, Artificial Sequence
  Description of Artificial Sequence: Synthetic oligonucleotide
ctgtgtgctagagcacaatggggctcc

SEQ ID NO: 238055 - DNA, 28 bp, Artificial Sequence
  Description of Artificial Sequence: Synthetic oligonucleotide
tgtgtgctagagcacaatggggctccag

SEQ ID NO: 238056 - DNA, 27 bp, Artificial Sequence
  Description of Artificial Sequence: Synthetic oligonucleotide
gtgtgctagagcacaatggggctccag

SEQ ID NO: 238057 - DNA, 28 bp, Artificial Sequence
  Description of Artificial Sequence: Synthetic oligonucleotide
tgtgctagagcacaatggggctccagag

SEQ ID NO: 238058 - DNA, 27 bp, Artificial Sequence
  Description of Artificial Sequence: Synthetic oligonucleotide
gtgctagagcacaatggggctccagag

SEQ ID NO: 238059 - DNA, 27 bp, Artificial Sequence
  Description of Artificial Sequence: Synthetic oligonucleotide
tgctagagcacaatggggctccagagc

SEQ ID NO: 238060 - DNA, 26 bp, Artificial Sequence
  Description of Artificial Sequence: Synthetic oligonucleotide
gctagagcacaatggggctccagagc

SEQ ID NO: 238061 - DNA, 26 bp, Artificial Sequence
  Description of Artificial Sequence: Synthetic oligonucleotide
ctagagcacaatggggctccagagcc

SEQ ID NO: 238062 - DNA, 27 bp, Artificial Sequence
  Description of Artificial Sequence: Synthetic oligonucleotide
tagagcacaatggggctccagagccca

SEQ ID NO: 238063 - DNA, 27 bp, Artificial Sequence
  Description of Artificial Sequence: Synthetic oligonucleotide
agagcacaatggggctccagagcccat

SEQ ID NO: 238064 - DNA, 26 bp, Artificial Sequence
  Description of Artificial Sequence: Synthetic oligonucleotide
gagcacaatggggctccagagcccat

SEQ ID NO: 238065 - DNA, 26 bp, Artificial Sequence
  Description of Artificial Sequence: Synthetic oligonucleotide
agcacaatggggctccagagcccatc

SEQ ID NO: 238066 - DNA, 25 bp, Artificial Sequence
  Description of Artificial Sequence: Synthetic oligonucleotide
gcacaatggggctccagagcccatc

SEQ ID NO: 238067 - DNA, 27 bp, Artificial Sequence
  Description of Artificial Sequence: Synthetic oligonucleotide
cacaatggggctccagagcccatcgtt

SEQ ID NO: 238068 - DNA, 27 bp, Artificial Sequence
  Description of Artificial Sequence: Synthetic oligonucleotide
acaatggggctccagagcccatcgttc

SEQ ID NO: 238069 - DNA, 26 bp, Artificial Sequence
  Description of Artificial Sequence: Synthetic oligonucleotide
caatggggctccagagcccatcgttc

SEQ ID NO: 238070 - DNA, 26 bp, Artificial Sequence
  Description of Artificial Sequence: Synthetic oligonucleotide
aatggggctccagagcccatcgttcg

SEQ ID NO: 238071 - DNA, 25 bp, Artificial Sequence
  Description of Artificial Sequence: Synthetic oligonucleotide
atggggctccagagcccatcgttcg

SEQ ID NO: 238072 - DNA, 24 bp, Artificial Sequence
  Description of Artificial Sequence: Synthetic oligonucleotide
tggggctccagagcccatcgttcg

SEQ ID NO: 238073 - DNA, 23 bp, Artificial Sequence
  Description of Artificial Sequence: Synthetic oligonucleotide
ggggctccagagcccatcgttcg

SEQ ID NO: 238074 - DNA, 23 bp, Artificial Sequence
  Description of Artificial Sequence: Synthetic oligonucleotide
gggctccagagcccatcgttcgg

SEQ ID NO: 238075 - DNA, 24 bp, Artificial Sequence
  Description of Artificial Sequence: Synthetic oligonucleotide
ggctccagagcccatcgttcggga

SEQ ID NO: 238076 - DNA, 25 bp, Artificial Sequence
  Description of Artificial Sequence: Synthetic oligonucleotide
gctccagagcccatcgttcgggact

SEQ ID NO: 238077 - DNA, 25 bp, Artificial Sequence
  Description of Artificial Sequence: Synthetic oligonucleotide
ctccagagcccatcgttcgggactc

SEQ ID NO: 238078 - DNA, 26 bp, Artificial Sequence
  Description of Artificial Sequence: Synthetic oligonucleotide
tccagagcccatcgttcgggactcga

SEQ ID NO: 238079 - DNA, 25 bp, Artificial Sequence
  Description of Artificial Sequence: Synthetic oligonucleotide
ccagagcccatcgttcgggactcga

SEQ ID NO: 238080 - DNA, 26 bp, Artificial Sequence
  Description of Artificial Sequence: Synthetic oligonucleotide
cagagcccatcgttcgggactcgaca

SEQ ID NO: 238081 - DNA, 26 bp, Artificial Sequence
  Description of Artificial Sequence: Synthetic oligonucleotide
agagcccatcgttcgggactcgacac

SEQ ID NO: 238082 - DNA, 25 bp, Artificial Sequence
  Description of Artificial Sequence: Synthetic oligonucleotide
gagcccatcgttcgggactcgacac

SEQ ID NO: 238083 - DNA, 26 bp, Artificial Sequence
  Description of Artificial Sequence: Synthetic oligonucleotide
agcccatcgttcgggactcgacacct

SEQ ID NO: 238084 - DNA, 25 bp, Artificial Sequence
  Description of Artificial Sequence: Synthetic oligonucleotide
gcccatcgttcgggactcgacacct

SEQ ID NO: 238085 - DNA, 25 bp, Artificial Sequence
  Description of Artificial Sequence: Synthetic oligonucleotide
cccatcgttcgggactcgacacctg

SEQ ID NO: 238086 - DNA, 25 bp, Artificial Sequence
  Description of Artificial Sequence: Synthetic oligonucleotide
ccatcgttcgggactcgacacctgg

SEQ ID NO: 238087 - DNA, 25 bp, Artificial Sequence
  Description of Artificial Sequence: Synthetic oligonucleotide
catcgttcgggactcgacacctggc

SEQ ID NO: 238088 - DNA, 26 bp, Artificial Sequence
  Description of Artificial Sequence: Synthetic oligonucleotide
atcgttcgggactcgacacctggcct

SEQ ID NO: 238089 - DNA, 25 bp, Artificial Sequence
  Description of Artificial Sequence: Synthetic oligonucleotide
tcgttcgggactcgacacctggcct

SEQ ID NO: 238090 - DNA, 24 bp, Artificial Sequence
  Description of Artificial Sequence: Synthetic oligonucleotide
cgttcgggactcgacacctggcct

SEQ ID NO: 238091 - DNA, 25 bp, Artificial Sequence
  Description of Artificial Sequence: Synthetic oligonucleotide
gttcgggactcgacacctggcctgt

SEQ ID NO: 238092 - DNA, 25 bp, Artificial Sequence
  Description of Artificial Sequence: Synthetic oligonucleotide
ttcgggactcgacacctggcctgtc

SEQ ID NO: 238093 - DNA, 24 bp, Artificial Sequence
  Description of Artificial Sequence: Synthetic oligonucleotide
tcgggactcgacacctggcctgtc

SEQ ID NO: 238094 - DNA, 23 bp, Artificial Sequence
  Description of Artificial Sequence: Synthetic oligonucleotide
cgggactcgacacctggcctgtc

SEQ ID NO: 238095 - DNA, 23 bp, Artificial Sequence
  Description of Artificial Sequence: Synthetic oligonucleotide
gggactcgacacctggcctgtcc

SEQ ID NO: 238096 - DNA, 23 bp, Artificial Sequence
  Description of Artificial Sequence: Synthetic oligonucleotide
ggactcgacacctggcctgtccc

SEQ ID NO: 238097 - DNA, 23 bp, Artificial Sequence
  Description of Artificial Sequence: Synthetic oligonucleotide
gactcgacacctggcctgtcccc

SEQ ID NO: 238098 - DNA, 25 bp, Artificial Sequence
  Description of Artificial Sequence: Synthetic oligonucleotide
actcgacacctggcctgtccccctt

SEQ ID NO: 238099 - DNA, 24 bp, Artificial Sequence
  Description of Artificial Sequence: Synthetic oligonucleotide
ctcgacacctggcctgtccccctt

SEQ ID NO: 238100 - DNA, 24 bp, Artificial Sequence
  Description of Artificial Sequence: Synthetic oligonucleotide
tcgacacctggcctgtcccccttg

SEQ ID NO: 238101 - DNA, 23 bp, Artificial Sequence
  Description of Artificial Sequence: Synthetic oligonucleotide
cgacacctggcctgtcccccttg

SEQ ID NO: 238102 - DNA, 24 bp, Artificial Sequence
  Description of Artificial Sequence: Synthetic oligonucleotide
gacacctggcctgtcccccttgca

SEQ ID NO: 238103 - DNA, 25 bp, Artificial Sequence
  Description of Artificial Sequence: Synthetic oligonucleotide
acacctggcctgtcccccttgcaga

SEQ ID NO: 238104 - DNA, 24 bp, Artificial Sequence
  Description of Artificial Sequence: Synthetic oligonucleotide
cacctggcctgtcccccttgcaga

SEQ ID NO: 238105 - DNA, 24 bp, Artificial Sequence
  Description of Artificial Sequence: Synthetic oligonucleotide
acctggcctgtcccccttgcagac

SEQ ID NO: 238106 - DNA, 23 bp, Artificial Sequence
  Description of Artificial Sequence: Synthetic oligonucleotide
cctggcctgtcccccttgcagac

SEQ ID NO: 238107 - DNA, 23 bp, Artificial Sequence
  Description of Artificial Sequence: Synthetic oligonucleotide
ctggcctgtcccccttgcagacc

SEQ ID NO: 238108 - DNA, 24 bp, Artificial Sequence
  Description of Artificial Sequence: Synthetic oligonucleotide
tggcctgtcccccttgcagaccca

SEQ ID NO: 238109 - DNA, 23 bp, Artificial Sequence
  Description of Artificial Sequence: Synthetic oligonucleotide
ggcctgtcccccttgcagaccca

SEQ ID NO: 238110 - DNA, 25 bp, Artificial Sequence
  Description of Artificial Sequence: Synthetic oligonucleotide
gcctgtcccccttgcagacccagaa

SEQ ID NO: 238111 - DNA, 25 bp, Artificial Sequence
  Description of Artificial Sequence: Synthetic oligonucleotide
cctgtcccccttgcagacccagaag

SEQ ID NO: 238112 - DNA, 27 bp, Artificial Sequence
  Description of Artificial Sequence: Synthetic oligonucleotide
ctgtcccccttgcagacccagaaggtt

SEQ ID NO: 238113 - DNA, 28 bp, Artificial Sequence
  Description of Artificial Sequence: Synthetic oligonucleotide
tgtcccccttgcagacccagaaggtttc

SEQ ID NO: 238114 - DNA, 27 bp, Artificial Sequence
  Description of Artificial Sequence: Synthetic oligonucleotide
gtcccccttgcagacccagaaggtttc

SEQ ID NO: 238115 - DNA, 28 bp, Artificial Sequence
  Description of Artificial Sequence: Synthetic oligonucleotide
tcccccttgcagacccagaaggtttcag

SEQ ID NO: 238116 - DNA, 27 bp, Artificial Sequence
  Description of Artificial Sequence: Synthetic oligonucleotide
cccccttgcagacccagaaggtttcag

SEQ ID NO: 238117 - DNA, 28 bp, Artificial Sequence
  Description of Artificial Sequence: Synthetic oligonucleotide
ccccttgcagacccagaaggtttcagtg

SEQ ID NO: 238118 - DNA, 29 bp, Artificial Sequence
  Description of Artificial Sequence: Synthetic oligonucleotide
cccttgcagacccagaaggtttcagtgtc

SEQ ID NO: 238119 - DNA, 30 bp, Artificial Sequence
  Description of Artificial Sequence: Synthetic oligonucleotide
ccttgcagacccagaaggtttcagtgtctg

SEQ ID NO: 238120 - DNA, 30 bp, Artificial Sequence
  Description of Artificial Sequence: Synthetic oligonucleotide
cttgcagacccagaaggtttcagtgtctgc

SEQ ID NO: 238121 - DNA, 31 bp, Artificial Sequence
  Description of Artificial Sequence: Synthetic oligonucleotide
ttgcagacccagaaggtttcagtgtctgcac

SEQ ID NO: 238122 - DNA, 30 bp, Artificial Sequence
  Description of Artificial Sequence: Synthetic oligonucleotide
tgcagacccagaaggtttcagtgtctgcac

SEQ ID NO: 238123 - DNA, 29 bp, Artificial Sequence
  Description of Artificial Sequence: Synthetic oligonucleotide
gcagacccagaaggtttcagtgtctgcac

SEQ ID NO: 238124 - DNA, 30 bp, Artificial Sequence
  Description of Artificial Sequence: Synthetic oligonucleotide
cagacccagaaggtttcagtgtctgcactg

SEQ ID NO: 238125 - DNA, 31 bp, Artificial Sequence
  Description of Artificial Sequence: Synthetic oligonucleotide
agacccagaaggtttcagtgtctgcactgac

SEQ ID NO: 238126 - DNA, 30 bp, Artificial Sequence
  Description of Artificial Sequence: Synthetic oligonucleotide
gacccagaaggtttcagtgtctgcactgac

SEQ ID NO: 238127 - DNA, 31 bp, Artificial Sequence
  Description of Artificial Sequence: Synthetic oligonucleotide
acccagaaggtttcagtgtctgcactgactc

SEQ ID NO: 238128 - DNA, 30 bp, Artificial Sequence
  Description of Artificial Sequence: Synthetic oligonucleotide
cccagaaggtttcagtgtctgcactgactc

SEQ ID NO: 238129 - DNA, 31 bp, Artificial Sequence
  Description of Artificial Sequence: Synthetic oligonucleotide
ccagaaggtttcagtgtctgcactgactctg

SEQ ID NO: 238130 - DNA, 31 bp, Artificial Sequence
  Description of Artificial Sequence: Synthetic oligonucleotide
cagaaggtttcagtgtctgcactgactctgg

SEQ ID NO: 238131 - DNA, 31 bp, Artificial Sequence
  Description of Artificial Sequence: Synthetic oligonucleotide
agaaggtttcagtgtctgcactgactctggc

SEQ ID NO: 238132 - DNA, 30 bp, Artificial Sequence
  Description of Artificial Sequence: Synthetic oligonucleotide
gaaggtttcagtgtctgcactgactctggc

SEQ ID NO: 238133 - DNA, 30 bp, Artificial Sequence
  Description of Artificial Sequence: Synthetic oligonucleotide
aaggtttcagtgtctgcactgactctggcc

SEQ ID NO: 238134 - DNA, 29 bp, Artificial Sequence
  Description of Artificial Sequence: Synthetic oligonucleotide
aggtttcagtgtctgcactgactctggcc

SEQ ID NO: 238135 - DNA, 28 bp, Artificial Sequence
  Description of Artificial Sequence: Synthetic oligonucleotide
ggtttcagtgtctgcactgactctggcc

SEQ ID NO: 238136 - DNA, 28 bp, Artificial Sequence
  Description of Artificial Sequence: Synthetic oligonucleotide
gtttcagtgtctgcactgactctggccc

SEQ ID NO: 238137 - DNA, 29 bp, Artificial Sequence
  Description of Artificial Sequence: Synthetic oligonucleotide
tttcagtgtctgcactgactctggccctg

SEQ ID NO: 238138 - DNA, 28 bp, Artificial Sequence
  Description of Artificial Sequence: Synthetic oligonucleotide
ttcagtgtctgcactgactctggccctg

SEQ ID NO: 238139 - DNA, 27 bp, Artificial Sequence
  Description of Artificial Sequence: Synthetic oligonucleotide
tcagtgtctgcactgactctggccctg

SEQ ID NO: 238140 - DNA, 26 bp, Artificial Sequence
  Description of Artificial Sequence: Synthetic oligonucleotide
cagtgtctgcactgactctggccctg

SEQ ID NO: 238141 - DNA, 26 bp, Artificial Sequence
  Description of Artificial Sequence: Synthetic oligonucleotide
agtgtctgcactgactctggccctgg

SEQ ID NO: 238142 - DNA, 25 bp, Artificial Sequence
  Description of Artificial Sequence: Synthetic oligonucleotide
gtgtctgcactgactctggccctgg

SEQ ID NO: 238143 - DNA, 25 bp, Artificial Sequence
  Description of Artificial Sequence: Synthetic oligonucleotide
tgtctgcactgactctggccctggg

SEQ ID NO: 238144 - DNA, 24 bp, Artificial Sequence
  Description of Artificial Sequence: Synthetic oligonucleotide
gtctgcactgactctggccctggg

SEQ ID NO: 238145 - DNA, 24 bp, Artificial Sequence
  Description of Artificial Sequence: Synthetic oligonucleotide
tctgcactgactctggccctgggc

SEQ ID NO: 238146 - DNA, 23 bp, Artificial Sequence
  Description of Artificial Sequence: Synthetic oligonucleotide
ctgcactgactctggccctgggc

SEQ ID NO: 238147 - DNA, 24 bp, Artificial Sequence
  Description of Artificial Sequence: Synthetic oligonucleotide
tgcactgactctggccctgggcct

SEQ ID NO: 238148 - DNA, 23 bp, Artificial Sequence
  Description of Artificial Sequence: Synthetic oligonucleotide
gcactgactctggccctgggcct

SEQ ID NO: 238149 - DNA, 25 bp, Artificial Sequence
  Description of Artificial Sequence: Synthetic oligonucleotide
cactgactctggccctgggcctgat

SEQ ID NO: 238150 - DNA, 27 bp, Artificial Sequence
  Description of Artificial Sequence: Synthetic oligonucleotide
actgactctggccctgggcctgatcat

SEQ ID NO: 238151 - DNA, 26 bp, Artificial Sequence
  Description of Artificial Sequence: Synthetic oligonucleotide
ctgactctggccctgggcctgatcat

SEQ ID NO: 238152 - DNA, 27 bp, Artificial Sequence
  Description of Artificial Sequence: Synthetic oligonucleotide
tgactctggccctgggcctgatcatct

SEQ ID NO: 238153 - DNA, 27 bp, Artificial Sequence
  Description of Artificial Sequence: Synthetic oligonucleotide
gactctggccctgggcctgatcatctt

SEQ ID NO: 238154 - DNA, 27 bp, Artificial Sequence
  Description of Artificial Sequence: Synthetic oligonucleotide
actctggccctgggcctgatcatcttc

SEQ ID NO: 238155 - DNA, 27 bp, Artificial Sequence
  Description of Artificial Sequence: Synthetic oligonucleotide
ctctggccctgggcctgatcatcttca

SEQ ID NO: 238156 - DNA, 27 bp, Artificial Sequence
  Description of Artificial Sequence: Synthetic oligonucleotide
tctggccctgggcctgatcatcttcac

SEQ ID NO: 238157 - DNA, 27 bp, Artificial Sequence
  Description of Artificial Sequence: Synthetic oligonucleotide
ctggccctgggcctgatcatcttcact

SEQ ID NO: 238158 - DNA, 27 bp, Artificial Sequence
  Description of Artificial Sequence: Synthetic oligonucleotide
tggccctgggcctgatcatcttcactc

SEQ ID NO: 238159 - DNA, 27 bp, Artificial Sequence
  Description of Artificial Sequence: Synthetic oligonucleotide
ggccctgggcctgatcatcttcactct

SEQ ID NO: 238160 - DNA, 28 bp, Artificial Sequence
  Description of Artificial Sequence: Synthetic oligonucleotide
gccctgggcctgatcatcttcactcttg

SEQ ID NO: 238161 - DNA, 28 bp, Artificial Sequence
  Description of Artificial Sequence: Synthetic oligonucleotide
ccctgggcctgatcatcttcactcttgg

SEQ ID NO: 238162 - DNA, 29 bp, Artificial Sequence
  Description of Artificial Sequence: Synthetic oligonucleotide
cctgggcctgatcatcttcactcttggtg

SEQ ID NO: 238163 - DNA, 30 bp, Artificial Sequence
  Description of Artificial Sequence: Synthetic oligonucleotide
ctgggcctgatcatcttcactcttggtgag

SEQ ID NO: 238164 - DNA, 32 bp, Artificial Sequence
  Description of Artificial Sequence: Synthetic oligonucleotide
tgggcctgatcatcttcactcttggtgagatc

SEQ ID NO: 238165 - DNA, 31 bp, Artificial Sequence
  Description of Artificial Sequence: Synthetic oligonucleotide
gggcctgatcatcttcactcttggtgagatc

SEQ ID NO: 238166 - DNA, 32 bp, Artificial Sequence
  Description of Artificial Sequence: Synthetic oligonucleotide
ggcctgatcatcttcactcttggtgagatcag

SEQ ID NO: 238167 - DNA, 32 bp, Artificial Sequence
  Description of Artificial Sequence: Synthetic oligonucleotide
gcctgatcatcttcactcttggtgagatcagc

SEQ ID NO: 238168 - DNA, 33 bp, Artificial Sequence
  Description of Artificial Sequence: Synthetic oligonucleotide
cctgatcatcttcactcttggtgagatcagctg

SEQ ID NO: 238169 - DNA, 33 bp, Artificial Sequence
  Description of Artificial Sequence: Synthetic oligonucleotide
ctgatcatcttcactcttggtgagatcagctgc

SEQ ID NO: 238170 - DNA, 33 bp, Artificial Sequence
  Description of Artificial Sequence: Synthetic oligonucleotide
tgatcatcttcactcttggtgagatcagctgcc

SEQ ID NO: 238171 - DNA, 32 bp, Artificial Sequence
  Description of Artificial Sequence: Synthetic oligonucleotide
gatcatcttcactcttggtgagatcagctgcc

SEQ ID NO: 238172 - DNA, 32 bp, Artificial Sequence
  Description of Artificial Sequence: Synthetic oligonucleotide
atcatcttcactcttggtgagatcagctgccg

SEQ ID NO: 238173 - DNA, 31 bp, Artificial Sequence
  Description of Artificial Sequence: Synthetic oligonucleotide
tcatcttcactcttggtgagatcagctgccg

SEQ ID NO: 238174 - DNA, 30 bp, Artificial Sequence
  Description of Artificial Sequence: Synthetic oligonucleotide
catcttcactcttggtgagatcagctgccg

SEQ ID NO: 238175 - DNA, 30 bp, Artificial Sequence
  Description of Artificial Sequence: Synthetic oligonucleotide
atcttcactcttggtgagatcagctgccgg

SEQ ID NO: 238176 - DNA, 29 bp, Artificial Sequence
  Description of Artificial Sequence: Synthetic oligonucleotide
tcttcactcttggtgagatcagctgccgg

SEQ ID NO: 238177 - DNA, 28 bp, Artificial Sequence
  Description of Artificial Sequence: Synthetic oligonucleotide
cttcactcttggtgagatcagctgccgg

SEQ ID NO: 238178 - DNA, 29 bp, Artificial Sequence
  Description of Artificial Sequence: Synthetic oligonucleotide
ttcactcttggtgagatcagctgccggag

SEQ ID NO: 238179 - DNA, 28 bp, Artificial Sequence
  Description of Artificial Sequence: Synthetic oligonucleotide
tcactcttggtgagatcagctgccggag

SEQ ID NO: 238180 - DNA, 27 bp, Artificial Sequence
  Description of Artificial Sequence: Synthetic oligonucleotide
cactcttggtgagatcagctgccggag

SEQ ID NO: 238181 - DNA, 28 bp, Artificial Sequence
  Description of Artificial Sequence: Synthetic oligonucleotide
actcttggtgagatcagctgccggagag

SEQ ID NO: 238182 - DNA, 27 bp, Artificial Sequence
  Description of Artificial Sequence: Synthetic oligonucleotide
ctcttggtgagatcagctgccggagag

SEQ ID NO: 238183 - DNA, 27 bp, Artificial Sequence
  Description of Artificial Sequence: Synthetic oligonucleotide
tcttggtgagatcagctgccggagagc

SEQ ID NO: 238184 - DNA, 27 bp, Artificial Sequence
  Description of Artificial Sequence: Synthetic oligonucleotide
cttggtgagatcagctgccggagagct

SEQ ID NO: 238185 - DNA, 27 bp, Artificial Sequence
  Description of Artificial Sequence: Synthetic oligonucleotide
ttggtgagatcagctgccggagagctc

SEQ ID NO: 238186 - DNA, 26 bp, Artificial Sequence
  Description of Artificial Sequence: Synthetic oligonucleotide
tggtgagatcagctgccggagagctc

SEQ ID NO: 238187 - DNA, 25 bp, Artificial Sequence
  Description of Artificial Sequence: Synthetic oligonucleotide
ggtgagatcagctgccggagagctc

SEQ ID NO: 238188 - DNA, 25 bp, Artificial Sequence
  Description of Artificial Sequence: Synthetic oligonucleotide
gtgagatcagctgccggagagctcg

SEQ ID NO: 238189 - DNA, 25 bp, Artificial Sequence
  Description of Artificial Sequence: Synthetic oligonucleotide
tgagatcagctgccggagagctcgc

SEQ ID NO: 238190 - DNA, 24 bp, Artificial Sequence
  Description of Artificial Sequence: Synthetic oligonucleotide
gagatcagctgccggagagctcgc

SEQ ID NO: 238191 - DNA, 25 bp, Artificial Sequence
  Description of Artificial Sequence: Synthetic oligonucleotide
agatcagctgccggagagctcgcca

SEQ ID NO: 238192 - DNA, 24 bp, Artificial Sequence
  Description of Artificial Sequence: Synthetic oligonucleotide
gatcagctgccggagagctcgcca

SEQ ID NO: 238193 - DNA, 25 bp, Artificial Sequence
  Description of Artificial Sequence: Synthetic oligonucleotide
atcagctgccggagagctcgccact

SEQ ID NO: 238194 - DNA, 24 bp, Artificial Sequence
  Description of Artificial Sequence: Synthetic oligonucleotide
tcagctgccggagagctcgccact

SEQ ID NO: 238195 - DNA, 23 bp, Artificial Sequence
  Description of Artificial Sequence: Synthetic oligonucleotide
cagctgccggagagctcgccact

SEQ ID NO: 238196 - DNA, 25 bp, Artificial Sequence
  Description of Artificial Sequence: Synthetic oligonucleotide
agctgccggagagctcgccactcta

SEQ ID NO: 238197 - DNA, 24 bp, Artificial Sequence
  Description of Artificial Sequence: Synthetic oligonucleotide
gctgccggagagctcgccactcta

SEQ ID NO: 238198 - DNA, 27 bp, Artificial Sequence
  Description of Artificial Sequence: Synthetic oligonucleotide
ctgccggagagctcgccactctactta

SEQ ID NO: 238199 - DNA, 27 bp, Artificial Sequence
  Description of Artificial Sequence: Synthetic oligonucleotide
tgccggagagctcgccactctacttac

SEQ ID NO: 238200 - DNA, 27 bp, Artificial Sequence
  Description of Artificial Sequence: Synthetic oligonucleotide
gccggagagctcgccactctacttaca

SEQ ID NO: 238201 - DNA, 27 bp, Artificial Sequence
  Description of Artificial Sequence: Synthetic oligonucleotide
ccggagagctcgccactctacttacac

SEQ ID NO: 238202 - DNA, 28 bp, Artificial Sequence
  Description of Artificial Sequence: Synthetic oligonucleotide
cggagagctcgccactctacttacactc

SEQ ID NO: 238203 - DNA, 28 bp, Artificial Sequence
  Description of Artificial Sequence: Synthetic oligonucleotide
ggagagctcgccactctacttacactcc

SEQ ID NO: 238204 - DNA, 29 bp, Artificial Sequence
  Description of Artificial Sequence: Synthetic oligonucleotide
gagagctcgccactctacttacactccac

SEQ ID NO: 238205 - DNA, 31 bp, Artificial Sequence
  Description of Artificial Sequence: Synthetic oligonucleotide
agagctcgccactctacttacactccacttc

SEQ ID NO: 238206 - DNA, 30 bp, Artificial Sequence
  Description of Artificial Sequence: Synthetic oligonucleotide
gagctcgccactctacttacactccacttc

SEQ ID NO: 238207 - DNA, 30 bp, Artificial Sequence
  Description of Artificial Sequence: Synthetic oligonucleotide
agctcgccactctacttacactccacttcc

SEQ ID NO: 238208 - DNA, 29 bp, Artificial Sequence
  Description of Artificial Sequence: Synthetic oligonucleotide
gctcgccactctacttacactccacttcc

SEQ ID NO: 238209 - DNA, 30 bp, Artificial Sequence
  Description of Artificial Sequence: Synthetic oligonucleotide
ctcgccactctacttacactccacttcctg

SEQ ID NO: 238210 - DNA, 30 bp, Artificial Sequence
  Description of Artificial Sequence: Synthetic oligonucleotide
tcgccactctacttacactccacttcctgg

SEQ ID NO: 238211 - DNA, 29 bp, Artificial Sequence
  Description of Artificial Sequence: Synthetic oligonucleotide
cgccactctacttacactccacttcctgg

SEQ ID NO: 238212 - DNA, 29 bp, Artificial Sequence
  Description of Artificial Sequence: Synthetic oligonucleotide
gccactctacttacactccacttcctggg

SEQ ID NO: 238213 - DNA, 30 bp, Artificial Sequence
  Description of Artificial Sequence: Synthetic oligonucleotide
ccactctacttacactccacttcctgggac

SEQ ID NO: 238214 - DNA, 30 bp, Artificial Sequence
  Description of Artificial Sequence: Synthetic oligonucleotide
cactctacttacactccacttcctgggacc

SEQ ID NO: 238215 - DNA, 37 bp, Artificial Sequence
  Description of Artificial Sequence: Synthetic oligonucleotide
actctacttacactccacttcctgggaccaattattg

SEQ ID NO: 238216 - DNA, 36 bp, Artificial Sequence
  Description of Artificial Sequence: Synthetic oligonucleotide
ctctacttacactccacttcctgggaccaattattg

SEQ ID NO: 238217 - DNA, 37 bp, Artificial Sequence
  Description of Artificial Sequence: Synthetic oligonucleotide
tctacttacactccacttcctgggaccaattattgag

SEQ ID NO: 238218 - DNA, 36 bp, Artificial Sequence
  Description of Artificial Sequence: Synthetic oligonucleotide
ctacttacactccacttcctgggaccaattattgag

SEQ ID NO: 238219 - DNA, 38 bp, Artificial Sequence
  Description of Artificial Sequence: Synthetic oligonucleotide
tacttacactccacttcctgggaccaattattgagaag

SEQ ID NO: 238220 - DNA, 37 bp, Artificial Sequence
  Description of Artificial Sequence: Synthetic oligonucleotide
acttacactccacttcctgggaccaattattgagaag

SEQ ID NO: 238221 - DNA, 36 bp, Artificial Sequence
  Description of Artificial Sequence: Synthetic oligonucleotide
cttacactccacttcctgggaccaattattgagaag

SEQ ID NO: 238222 - DNA, 36 bp, Artificial Sequence
  Description of Artificial Sequence: Synthetic oligonucleotide
ttacactccacttcctgggaccaattattgagaagg

SEQ ID NO: 238223 - DNA, 35 bp, Artificial Sequence
  Description of Artificial Sequence: Synthetic oligonucleotide
tacactccacttcctgggaccaattattgagaagg

SEQ ID NO: 238224 - DNA, 34 bp, Artificial Sequence
  Description of Artificial Sequence: Synthetic oligonucleotide
acactccacttcctgggaccaattattgagaagg

SEQ ID NO: 238225 - DNA, 33 bp, Artificial Sequence
  Description of Artificial Sequence: Synthetic oligonucleotide
cactccacttcctgggaccaattattgagaagg

SEQ ID NO: 238226 - DNA, 35 bp, Artificial Sequence
  Description of Artificial Sequence: Synthetic oligonucleotide
actccacttcctgggaccaattattgagaaggatg

SEQ ID NO: 238227 - DNA, 34 bp, Artificial Sequence
  Description of Artificial Sequence: Synthetic oligonucleotide
ctccacttcctgggaccaattattgagaaggatg

SEQ ID NO: 238228 - DNA, 34 bp, Artificial Sequence
  Description of Artificial Sequence: Synthetic oligonucleotide
tccacttcctgggaccaattattgagaaggatgc

SEQ ID NO: 238229 - DNA, 33 bp, Artificial Sequence
  Description of Artificial Sequence: Synthetic oligonucleotide
ccacttcctgggaccaattattgagaaggatgc

SEQ ID NO: 238230 - DNA, 33 bp, Artificial Sequence
  Description of Artificial Sequence: Synthetic oligonucleotide
cacttcctgggaccaattattgagaaggatgcc

SEQ ID NO: 238231 - DNA, 34 bp, Artificial Sequence
  Description of Artificial Sequence: Synthetic oligonucleotide
acttcctgggaccaattattgagaaggatgccac

SEQ ID NO: 238232 - DNA, 33 bp, Artificial Sequence
  Description of Artificial Sequence: Synthetic oligonucleotide
cttcctgggaccaattattgagaaggatgccac

SEQ ID NO: 238233 - DNA, 37 bp, Artificial Sequence
  Description of Artificial Sequence: Synthetic oligonucleotide
ttcctgggaccaattattgagaaggatgccacatttc

SEQ ID NO: 238234 - DNA, 36 bp, Artificial Sequence
  Description of Artificial Sequence: Synthetic oligonucleotide
tcctgggaccaattattgagaaggatgccacatttc

SEQ ID NO: 238235 - DNA, 35 bp, Artificial Sequence
  Description of Artificial Sequence: Synthetic oligonucleotide
cctgggaccaattattgagaaggatgccacatttc

SEQ ID NO: 238236 - DNA, 35 bp, Artificial Sequence
  Description of Artificial Sequence: Synthetic oligonucleotide
ctgggaccaattattgagaaggatgccacatttcc

SEQ ID NO: 238237 - DNA, 37 bp, Artificial Sequence
  Description of Artificial Sequence: Synthetic oligonucleotide
tgggaccaattattgagaaggatgccacatttccaag

SEQ ID NO: 238238 - DNA, 24 bp, Artificial Sequence
  Description of Artificial Sequence: Synthetic oligonucleotide
atggccctctgagcagggcaggtc

SEQ ID NO: 238239 - DNA, 23 bp, Artificial Sequence
  Description of Artificial Sequence: Synthetic oligonucleotide
tggccctctgagcagggcaggtc

SEQ ID NO: 238240 - DNA, 22 bp, Artificial Sequence
  Description of Artificial Sequence: Synthetic oligonucleotide
ggccctctgagcagggcaggtc

SEQ ID NO: 238241 - DNA, 23 bp, Artificial Sequence
  Description of Artificial Sequence: Synthetic oligonucleotide
gccctctgagcagggcaggtcct

SEQ ID NO: 238242 - DNA, 23 bp, Artificial Sequence
  Description of Artificial Sequence: Synthetic oligonucleotide
ccctctgagcagggcaggtcctg

SEQ ID NO: 238243 - DNA, 23 bp, Artificial Sequence
  Description of Artificial Sequence: Synthetic oligonucleotide
cctctgagcagggcaggtcctgg

SEQ ID NO: 238244 - DNA, 23 bp, Artificial Sequence
  Description of Artificial Sequence: Synthetic oligonucleotide
ctctgagcagggcaggtcctggg

SEQ ID NO: 238245 - DNA, 25 bp, Artificial Sequence
  Description of Artificial Sequence: Synthetic oligonucleotide
tctgagcagggcaggtcctgggctt

SEQ ID NO: 238246 - DNA, 24 bp, Artificial Sequence
  Description of Artificial Sequence: Synthetic oligonucleotide
ctgagcagggcaggtcctgggctt

SEQ ID NO: 238247 - DNA, 24 bp, Artificial Sequence
  Description of Artificial Sequence: Synthetic oligonucleotide
tgagcagggcaggtcctgggcttc

SEQ ID NO: 238248 - DNA, 23 bp, Artificial Sequence
  Description of Artificial Sequence: Synthetic oligonucleotide
gagcagggcaggtcctgggcttc

SEQ ID NO: 238249 - DNA, 24 bp, Artificial Sequence
  Description of Artificial Sequence: Synthetic oligonucleotide
agcagggcaggtcctgggcttcca

SEQ ID NO: 238250 - DNA, 23 bp, Artificial Sequence
  Description of Artificial Sequence: Synthetic oligonucleotide
gcagggcaggtcctgggcttcca

SEQ ID NO: 238251 - DNA, 24 bp, Artificial Sequence
  Description of Artificial Sequence: Synthetic oligonucleotide
cagggcaggtcctgggcttccaca

SEQ ID NO: 238252 - DNA, 24 bp, Artificial Sequence
  Description of Artificial Sequence: Synthetic oligonucleotide
agggcaggtcctgggcttccacac

SEQ ID NO: 238253 - DNA, 23 bp, Artificial Sequence
  Description of Artificial Sequence: Synthetic oligonucleotide
gggcaggtcctgggcttccacac

SEQ ID NO: 238254 - DNA, 23 bp, Artificial Sequence
  Description of Artificial Sequence: Synthetic oligonucleotide
ggcaggtcctgggcttccacacc

SEQ ID NO: 238255 - DNA, 24 bp, Artificial Sequence
  Description of Artificial Sequence: Synthetic oligonucleotide
gcaggtcctgggcttccacaccgt

SEQ ID NO: 238256 - DNA, 26 bp, Artificial Sequence
  Description of Artificial Sequence: Synthetic oligonucleotide
caggtcctgggcttccacaccgtgat

SEQ ID NO: 238257 - DNA, 27 bp, Artificial Sequence
  Description of Artificial Sequence: Synthetic oligonucleotide
aggtcctgggcttccacaccgtgatga

SEQ ID NO: 238258 - DNA, 26 bp, Artificial Sequence
  Description of Artificial Sequence: Synthetic oligonucleotide
ggtcctgggcttccacaccgtgatga

SEQ ID NO: 238259 - DNA, 26 bp, Artificial Sequence
  Description of Artificial Sequence: Synthetic oligonucleotide
gtcctgggcttccacaccgtgatgac

SEQ ID NO: 238260 - DNA, 26 bp, Artificial Sequence
  Description of Artificial Sequence: Synthetic oligonucleotide
tcctgggcttccacaccgtgatgacc

SEQ ID NO: 238261 - DNA, 25 bp, Artificial Sequence
  Description of Artificial Sequence: Synthetic oligonucleotide
cctgggcttccacaccgtgatgacc

SEQ ID NO: 238262 - DNA, 26 bp, Artificial Sequence
  Description of Artificial Sequence: Synthetic oligonucleotide
ctgggcttccacaccgtgatgaccca

SEQ ID NO: 238263 - DNA, 26 bp, Artificial Sequence
  Description of Artificial Sequence: Synthetic oligonucleotide
tgggcttccacaccgtgatgacccac

SEQ ID NO: 238264 - DNA, 25 bp, Artificial Sequence
  Description of Artificial Sequence: Synthetic oligonucleotide
gggcttccacaccgtgatgacccac

SEQ ID NO: 238265 - DNA, 26 bp, Artificial Sequence
  Description of Artificial Sequence: Synthetic oligonucleotide
ggcttccacaccgtgatgacccacct

SEQ ID NO: 238266 - DNA, 27 bp, Artificial Sequence
  Description of Artificial Sequence: Synthetic oligonucleotide
gcttccacaccgtgatgacccacctga

SEQ ID NO: 238267 - DNA, 27 bp, Artificial Sequence
  Description of Artificial Sequence: Synthetic oligonucleotide
cttccacaccgtgatgacccacctgag

SEQ ID NO: 238268 - DNA, 27 bp, Artificial Sequence
  Description of Artificial Sequence: Synthetic oligonucleotide
ttccacaccgtgatgacccacctgagc

SEQ ID NO: 238269 - DNA, 26 bp, Artificial Sequence
  Description of Artificial Sequence: Synthetic oligonucleotide
tccacaccgtgatgacccacctgagc

SEQ ID NO: 238270 - DNA, 25 bp, Artificial Sequence
  Description of Artificial Sequence: Synthetic oligonucleotide
ccacaccgtgatgacccacctgagc

SEQ ID NO: 238271 - DNA, 25 bp, Artificial Sequence
  Description of Artificial Sequence: Synthetic oligonucleotide
cacaccgtgatgacccacctgagcc

SEQ ID NO: 238272 - DNA, 25 bp, Artificial Sequence
  Description of Artificial Sequence: Synthetic oligonucleotide
acaccgtgatgacccacctgagccc

SEQ ID NO: 238273 - DNA, 24 bp, Artificial Sequence
  Description of Artificial Sequence: Synthetic oligonucleotide
caccgtgatgacccacctgagccc

SEQ ID NO: 238274 - DNA, 24 bp, Artificial Sequence
  Description of Artificial Sequence: Synthetic oligonucleotide
accgtgatgacccacctgagcccc

SEQ ID NO: 238275 - DNA, 23 bp, Artificial Sequence
  Description of Artificial Sequence: Synthetic oligonucleotide
ccgtgatgacccacctgagcccc

SEQ ID NO: 238276 - DNA, 24 bp, Artificial Sequence
  Description of Artificial Sequence: Synthetic oligonucleotide
cgtgatgacccacctgagccccca

SEQ ID NO: 238277 - DNA, 24 bp, Artificial Sequence
  Description of Artificial Sequence: Synthetic oligonucleotide
gtgatgacccacctgagcccccag

SEQ ID NO: 238278 - DNA, 25 bp, Artificial Sequence
  Description of Artificial Sequence: Synthetic oligonucleotide
tgatgacccacctgagcccccagga

SEQ ID NO: 238279 - DNA, 24 bp, Artificial Sequence
  Description of Artificial Sequence: Synthetic oligonucleotide
gatgacccacctgagcccccagga

SEQ ID NO: 238280 - DNA, 24 bp, Artificial Sequence
  Description of Artificial Sequence: Synthetic oligonucleotide
atgacccacctgagcccccaggag

SEQ ID NO: 238281 - DNA, 23 bp, Artificial Sequence
  Description of Artificial Sequence: Synthetic oligonucleotide
tgacccacctgagcccccaggag

SEQ ID NO: 238282 - DNA, 22 bp, Artificial Sequence
  Description of Artificial Sequence: Synthetic oligonucleotide
gacccacctgagcccccaggag

SEQ ID NO: 238283 - DNA, 22 bp, Artificial Sequence
  Description of Artificial Sequence: Synthetic oligonucleotide
acccacctgagcccccaggagg

SEQ ID NO: 238284 - DNA, 21 bp, Artificial Sequence
  Description of Artificial Sequence: Synthetic oligonucleotide
cccacctgagcccccaggagg

SEQ ID NO: 238285 - DNA, 22 bp, Artificial Sequence
  Description of Artificial Sequence: Synthetic oligonucleotide
ccacctgagcccccaggaggca

SEQ ID NO: 238286 - DNA, 22 bp, Artificial Sequence
  Description of Artificial Sequence: Synthetic oligonucleotide
cacctgagcccccaggaggcac

SEQ ID NO: 238287 - DNA, 22 bp, Artificial Sequence
  Description of Artificial Sequence: Synthetic oligonucleotide
acctgagcccccaggaggcacg

SEQ ID NO: 238288 - DNA, 21 bp, Artificial Sequence
  Description of Artificial Sequence: Synthetic oligonucleotide
cctgagcccccaggaggcacg

SEQ ID NO: 238289 - DNA, 21 bp, Artificial Sequence
  Description of Artificial Sequence: Synthetic oligonucleotide
ctgagcccccaggaggcacgg

SEQ ID NO: 238290 - DNA, 21 bp, Artificial Sequence
  Description of Artificial Sequence: Synthetic oligonucleotide
tgagcccccaggaggcacggg

SEQ ID NO: 238291 - DNA, 20 bp, Artificial Sequence
  Description of Artificial Sequence: Synthetic oligonucleotide
gagcccccaggaggcacggg

SEQ ID NO: 238292 - DNA, 20 bp, Artificial Sequence
  Description of Artificial Sequence: Synthetic oligonucleotide
agcccccaggaggcacgggc

SEQ ID NO: 238293 - DNA, 20 bp, Artificial Sequence
  Description of Artificial Sequence: Synthetic oligonucleotide
gcccccaggaggcacgggct

SEQ ID NO: 238294 - DNA, 20 bp, Artificial Sequence
  Description of Artificial Sequence: Synthetic oligonucleotide
cccccaggaggcacgggcca

SEQ ID NO: 238295 - DNA, 20 bp, Artificial Sequence
  Description of Artificial Sequence: Synthetic oligonucleotide
ccccaggaggcacgggccac

SEQ ID NO: 238296 - DNA, 22 bp, Artificial Sequence
  Description of Artificial Sequence: Synthetic oligonucleotide
cccaggaggcacgggccaccat

SEQ ID NO: 238297 - DNA, 22 bp, Artificial Sequence
  Description of Artificial Sequence: Synthetic oligonucleotide
ccaggaggcacgggccaccatg

SEQ ID NO: 238298 - DNA, 22 bp, Artificial Sequence
  Description of Artificial Sequence: Synthetic oligonucleotide
caggaggcacgggccaccatgg

SEQ ID NO: 238299 - DNA, 23 bp, Artificial Sequence
  Description of Artificial Sequence: Synthetic oligonucleotide
aggaggcacgggccaccatggct

SEQ ID NO: 238300 - DNA, 22 bp, Artificial Sequence
  Description of Artificial Sequence: Synthetic oligonucleotide
ggaggcacgggccaccatggct

SEQ ID NO: 238301 - DNA, 23 bp, Artificial Sequence
  Description of Artificial Sequence: Synthetic oligonucleotide
gaggcacgggccaccatggctga

SEQ ID NO: 238302 - DNA, 23 bp, Artificial Sequence
  Description of Artificial Sequence: Synthetic oligonucleotide
aggcacgggccaccatggctgac

SEQ ID NO: 238303 - DNA, 22 bp, Artificial Sequence
  Description of Artificial Sequence: Synthetic oligonucleotide
ggcacgggccaccatggctgac

SEQ ID NO: 238304 - DNA, 23 bp, Artificial Sequence
  Description of Artificial Sequence: Synthetic oligonucleotide
gcacgggccaccatggctgacca

SEQ ID NO: 238305 - DNA, 25 bp, Artificial Sequence
  Description of Artificial Sequence: Synthetic oligonucleotide
cacgggccaccatggctgaccagat

SEQ ID NO: 238306 - DNA, 25 bp, Artificial Sequence
  Description of Artificial Sequence: Synthetic oligonucleotide
acgggccaccatggctgaccagatg

SEQ ID NO: 238307 - DNA, 24 bp, Artificial Sequence
  Description of Artificial Sequence: Synthetic oligonucleotide
cgggccaccatggctgaccagatg

SEQ ID NO: 238308 - DNA, 24 bp, Artificial Sequence
  Description of Artificial Sequence: Synthetic oligonucleotide
gggccaccatggctgaccagatgg

SEQ ID NO: 238309 - DNA, 24 bp, Artificial Sequence
  Description of Artificial Sequence: Synthetic oligonucleotide
ggccaccatggctgaccagatggg

SEQ ID NO: 238310 - DNA, 25 bp, Artificial Sequence
  Description of Artificial Sequence: Synthetic oligonucleotide
gccaccatggctgaccagatgggct

SEQ ID NO: 238311 - DNA, 25 bp, Artificial Sequence
  Description of Artificial Sequence: Synthetic oligonucleotide
ccaccatggctgaccagatgggctc

SEQ ID NO: 238312 - DNA, 27 bp, Artificial Sequence
  Description of Artificial Sequence: Synthetic oligonucleotide
caccatggctgaccagatgggctccaa

SEQ ID NO: 238313 - DNA, 27 bp, Artificial Sequence
  Description of Artificial Sequence: Synthetic oligonucleotide
accatggctgaccagatgggctccaac

SEQ ID NO: 238314 - DNA, 26 bp, Artificial Sequence
  Description of Artificial Sequence: Synthetic oligonucleotide
ccatggctgaccagatgggctccaac

SEQ ID NO: 238315 - DNA, 26 bp, Artificial Sequence
  Description of Artificial Sequence: Synthetic oligonucleotide
catggctgaccagatgggctccaacg

SEQ ID NO: 238316 - DNA, 27 bp, Artificial Sequence
  Description of Artificial Sequence: Synthetic oligonucleotide
atggctgaccagatgggctccaacgga

SEQ ID NO: 238317 - DNA, 26 bp, Artificial Sequence
  Description of Artificial Sequence: Synthetic oligonucleotide
tggctgaccagatgggctccaacgga

SEQ ID NO: 238318 - DNA, 25 bp, Artificial Sequence
  Description of Artificial Sequence: Synthetic oligonucleotide
ggctgaccagatgggctccaacgga

SEQ ID NO: 238319 - DNA, 25 bp, Artificial Sequence
  Description of Artificial Sequence: Synthetic oligonucleotide
gctgaccagatgggctccaacggac

SEQ ID NO: 238320 - DNA, 25 bp, Artificial Sequence
  Description of Artificial Sequence: Synthetic oligonucleotide
ctgaccagatgggctccaacggacc

SEQ ID NO: 238321 - DNA, 25 bp, Artificial Sequence
  Description of Artificial Sequence: Synthetic oligonucleotide
tgaccagatgggctccaacggaccc

SEQ ID NO: 238322 - DNA, 24 bp, Artificial Sequence
  Description of Artificial Sequence: Synthetic oligonucleotide
gaccagatgggctccaacggaccc

SEQ ID NO: 238323 - DNA, 24 bp, Artificial Sequence
  Description of Artificial Sequence: Synthetic oligonucleotide
accagatgggctccaacggacccg

SEQ ID NO: 238324 - DNA, 23 bp, Artificial Sequence
  Description of Artificial Sequence: Synthetic oligonucleotide
ccagatgggctccaacggacccg

SEQ ID NO: 238325 - DNA, 23 bp, Artificial Sequence
  Description of Artificial Sequence: Synthetic oligonucleotide
cagatgggctccaacggacccgg

SEQ ID NO: 238326 - DNA, 25 bp, Artificial Sequence
  Description of Artificial Sequence: Synthetic oligonucleotide
agatgggctccaacggacccggctt

SEQ ID NO: 238327 - DNA, 24 bp, Artificial Sequence
  Description of Artificial Sequence: Synthetic oligonucleotide
gatgggctccaacggacccggctt

SEQ ID NO: 238328 - DNA, 26 bp, Artificial Sequence
  Description of Artificial Sequence: Synthetic oligonucleotide
atgggctccaacggacccggcttcta

SEQ ID NO: 238329 - DNA, 25 bp, Artificial Sequence
  Description of Artificial Sequence: Synthetic oligonucleotide
tgggctccaacggacccggcttcta

SEQ ID NO: 238330 - DNA, 24 bp, Artificial Sequence
  Description of Artificial Sequence: Synthetic oligonucleotide
gggctccaacggacccggcttcta

SEQ ID NO: 238331 - DNA, 24 bp, Artificial Sequence
  Description of Artificial Sequence: Synthetic oligonucleotide
ggctccaacggacccggcttctac

SEQ ID NO: 238332 - DNA, 25 bp, Artificial Sequence
  Description of Artificial Sequence: Synthetic oligonucleotide
gctccaacggacccggcttctacca

SEQ ID NO: 238333 - DNA, 26 bp, Artificial Sequence
  Description of Artificial Sequence: Synthetic oligonucleotide
ctccaacggacccggcttctaccact

SEQ ID NO: 238334 - DNA, 27 bp, Artificial Sequence
  Description of Artificial Sequence: Synthetic oligonucleotide
tccaacggacccggcttctaccactct

SEQ ID NO: 238335 - DNA, 27 bp, Artificial Sequence
  Description of Artificial Sequence: Synthetic oligonucleotide
ccaacggacccggcttctaccactctt

SEQ ID NO: 238336 - DNA, 28 bp, Artificial Sequence
  Description of Artificial Sequence: Synthetic oligonucleotide
caacggacccggcttctaccactcttac

SEQ ID NO: 238337 - DNA, 28 bp, Artificial Sequence
  Description of Artificial Sequence: Synthetic oligonucleotide
aacggacccggcttctaccactcttacg

SEQ ID NO: 238338 - DNA, 27 bp, Artificial Sequence
  Description of Artificial Sequence: Synthetic oligonucleotide
acggacccggcttctaccactcttacg

SEQ ID NO: 238339 - DNA, 26 bp, Artificial Sequence
  Description of Artificial Sequence: Synthetic oligonucleotide
cggacccggcttctaccactcttacg

SEQ ID NO: 238340 - DNA, 26 bp, Artificial Sequence
  Description of Artificial Sequence: Synthetic oligonucleotide
ggacccggcttctaccactcttacgg

SEQ ID NO: 238341 - DNA, 26 bp, Artificial Sequence
  Description of Artificial Sequence: Synthetic oligonucleotide
gacccggcttctaccactcttacggc

SEQ ID NO: 238342 - DNA, 26 bp, Artificial Sequence
  Description of Artificial Sequence: Synthetic oligonucleotide
acccggcttctaccactcttacggcc

SEQ ID NO: 238343 - DNA, 25 bp, Artificial Sequence
  Description of Artificial Sequence: Synthetic oligonucleotide
cccggcttctaccactcttacggcc

SEQ ID NO: 238344 - DNA, 25 bp, Artificial Sequence
  Description of Artificial Sequence: Synthetic oligonucleotide
ccggcttctaccactcttacggccc

SEQ ID NO: 238345 - DNA, 26 bp, Artificial Sequence
  Description of Artificial Sequence: Synthetic oligonucleotide
cggcttctaccactcttacggcccct

SEQ ID NO: 238346 - DNA, 26 bp, Artificial Sequence
  Description of Artificial Sequence: Synthetic oligonucleotide
ggcttctaccactcttacggcccctc

SEQ ID NO: 238347 - DNA, 26 bp, Artificial Sequence
  Description of Artificial Sequence: Synthetic oligonucleotide
gcttctaccactcttacggcccctcg

SEQ ID NO: 238348 - DNA, 26 bp, Artificial Sequence
  Description of Artificial Sequence: Synthetic oligonucleotide
cttctaccactcttacggcccctcgg

SEQ ID NO: 238349 - DNA, 26 bp, Artificial Sequence
  Description of Artificial Sequence: Synthetic oligonucleotide
ttctaccactcttacggcccctcggg

SEQ ID NO: 238350 - DNA, 25 bp, Artificial Sequence
  Description of Artificial Sequence: Synthetic oligonucleotide
tctaccactcttacggcccctcggg

SEQ ID NO: 238351 - DNA, 24 bp, Artificial Sequence
  Description of Artificial Sequence: Synthetic oligonucleotide
ctaccactcttacggcccctcggg

SEQ ID NO: 238352 - DNA, 24 bp, Artificial Sequence
  Description of Artificial Sequence: Synthetic oligonucleotide
taccactcttacggcccctcgggc

SEQ ID NO: 238353 - DNA, 23 bp, Artificial Sequence
  Description of Artificial Sequence: Synthetic oligonucleotide
accactcttacggcccctcgggc

SEQ ID NO: 238354 - DNA, 22 bp, Artificial Sequence
  Description of Artificial Sequence: Synthetic oligonucleotide
ccactcttacggcccctcgggc

SEQ ID NO: 238355 - DNA, 23 bp, Artificial Sequence
  Description of Artificial Sequence: Synthetic oligonucleotide
cactcttacggcccctcgggcct

SEQ ID NO: 238356 - DNA, 25 bp, Artificial Sequence
  Description of Artificial Sequence: Synthetic oligonucleotide
actcttacggcccctcgggcctgtt

SEQ ID NO: 238357 - DNA, 24 bp, Artificial Sequence
  Description of Artificial Sequence: Synthetic oligonucleotide
ctcttacggcccctcgggcctgtt

SEQ ID NO: 238358 - DNA, 25 bp, Artificial Sequence
  Description of Artificial Sequence: Synthetic oligonucleotide
tcttacggcccctcgggcctgttca

SEQ ID NO: 238359 - DNA, 24 bp, Artificial Sequence
  Description of Artificial Sequence: Synthetic oligonucleotide
cttacggcccctcgggcctgttca

SEQ ID NO: 238360 - DNA, 24 bp, Artificial Sequence
  Description of Artificial Sequence: Synthetic oligonucleotide
ttacggcccctcgggcctgttcac

SEQ ID NO: 238361 - DNA, 23 bp, Artificial Sequence
  Description of Artificial Sequence: Synthetic oligonucleotide
tacggcccctcgggcctgttcac

SEQ ID NO: 238362 - DNA, 22 bp, Artificial Sequence
  Description of Artificial Sequence: Synthetic oligonucleotide
acggcccctcgggcctgttcac

SEQ ID NO: 238363 - DNA, 21 bp, Artificial Sequence
  Description of Artificial Sequence: Synthetic oligonucleotide
cggcccctcgggcctgttcac

SEQ ID NO: 238364 - DNA, 21 bp, Artificial Sequence
  Description of Artificial Sequence: Synthetic oligonucleotide
ggcccctcgggcctgttcacc

SEQ ID NO: 238365 - DNA, 23 bp, Artificial Sequence
  Description of Artificial Sequence: Synthetic oligonucleotide
gcccctcgggcctgttcacccaa

SEQ ID NO: 238366 - DNA, 27 bp, Artificial Sequence
  Description of Artificial Sequence: Synthetic oligonucleotide
cccctcgggcctgttcacccaagaatt

SEQ ID NO: 238367 - DNA, 28 bp, Artificial Sequence
  Description of Artificial Sequence: Synthetic oligonucleotide
ccctcgggcctgttcacccaagaatttg

SEQ ID NO: 238368 - DNA, 30 bp, Artificial Sequence
  Description of Artificial Sequence: Synthetic oligonucleotide
cctcgggcctgttcacccaagaatttgatc

SEQ ID NO: 238369 - DNA, 31 bp, Artificial Sequence
  Description of Artificial Sequence: Synthetic oligonucleotide
ctcgggcctgttcacccaagaatttgatcag

SEQ ID NO: 238370 - DNA, 31 bp, Artificial Sequence
  Description of Artificial Sequence: Synthetic oligonucleotide
tcgggcctgttcacccaagaatttgatcagg

SEQ ID NO: 238371 - DNA, 30 bp, Artificial Sequence
  Description of Artificial Sequence: Synthetic oligonucleotide
cgggcctgttcacccaagaatttgatcagg

SEQ ID NO: 238372 - DNA, 32 bp, Artificial Sequence
  Description of Artificial Sequence: Synthetic oligonucleotide
gggcctgttcacccaagaatttgatcaggaac

SEQ ID NO: 238373 - DNA, 33 bp, Artificial Sequence
  Description of Artificial Sequence: Synthetic oligonucleotide
ggcctgttcacccaagaatttgatcaggaacag

SEQ ID NO: 238374 - DNA, 33 bp, Artificial Sequence
  Description of Artificial Sequence: Synthetic oligonucleotide
gcctgttcacccaagaatttgatcaggaacagc

SEQ ID NO: 238375 - DNA, 34 bp, Artificial Sequence
  Description of Artificial Sequence: Synthetic oligonucleotide
cctgttcacccaagaatttgatcaggaacagcag

SEQ ID NO: 238376 - DNA, 36 bp, Artificial Sequence
  Description of Artificial Sequence: Synthetic oligonucleotide
ctgttcacccaagaatttgatcaggaacagcagttc

SEQ ID NO: 238377 - DNA, 37 bp, Artificial Sequence
  Description of Artificial Sequence: Synthetic oligonucleotide
tgttcacccaagaatttgatcaggaacagcagttctc

SEQ ID NO: 238378 - DNA, 36 bp, Artificial Sequence
  Description of Artificial Sequence: Synthetic oligonucleotide
gttcacccaagaatttgatcaggaacagcagttctc

SEQ ID NO: 238379 - DNA, 37 bp, Artificial Sequence
  Description of Artificial Sequence: Synthetic oligonucleotide
ttcacccaagaatttgatcaggaacagcagttctctg

SEQ ID NO: 238380 - DNA, 36 bp, Artificial Sequence
  Description of Artificial Sequence: Synthetic oligonucleotide
tcacccaagaatttgatcaggaacagcagttctctg

SEQ ID NO: 238381 - DNA, 35 bp, Artificial Sequence
  Description of Artificial Sequence: Synthetic oligonucleotide
cacccaagaatttgatcaggaacagcagttctctg

SEQ ID NO: 238382 - DNA, 36 bp, Artificial Sequence
  Description of Artificial Sequence: Synthetic oligonucleotide
acccaagaatttgatcaggaacagcagttctctgtc

SEQ ID NO: 238383 - DNA, 35 bp, Artificial Sequence
  Description of Artificial Sequence: Synthetic oligonucleotide
cccaagaatttgatcaggaacagcagttctctgtc

SEQ ID NO: 238384 - DNA, 35 bp, Artificial Sequence
  Description of Artificial Sequence: Synthetic oligonucleotide
ccaagaatttgatcaggaacagcagttctctgtcg

SEQ ID NO: 238385 - DNA, 36 bp, Artificial Sequence
  Description of Artificial Sequence: Synthetic oligonucleotide
caagaatttgatcaggaacagcagttctctgtcgac

SEQ ID NO: 238386 - DNA, 36 bp, Artificial Sequence
  Description of Artificial Sequence: Synthetic oligonucleotide
aagaatttgatcaggaacagcagttctctgtcgacc

SEQ ID NO: 238387 - DNA, 35 bp, Artificial Sequence
  Description of Artificial Sequence: Synthetic oligonucleotide
agaatttgatcaggaacagcagttctctgtcgacc

SEQ ID NO: 238388 - DNA, 34 bp, Artificial Sequence
  Description of Artificial Sequence: Synthetic oligonucleotide
gaatttgatcaggaacagcagttctctgtcgacc

SEQ ID NO: 238389 - DNA, 35 bp, Artificial Sequence
  Description of Artificial Sequence: Synthetic oligonucleotide
aatttgatcaggaacagcagttctctgtcgacctg

SEQ ID NO: 238390 - DNA, 34 bp, Artificial Sequence
  Description of Artificial Sequence: Synthetic oligonucleotide
atttgatcaggaacagcagttctctgtcgacctg

SEQ ID NO: 238391 - DNA, 33 bp, Artificial Sequence
  Description of Artificial Sequence: Synthetic oligonucleotide
tttgatcaggaacagcagttctctgtcgacctg

SEQ ID NO: 238392 - DNA, 32 bp, Artificial Sequence
  Description of Artificial Sequence: Synthetic oligonucleotide
ttgatcaggaacagcagttctctgtcgacctg

SEQ ID NO: 238393 - DNA, 31 bp, Artificial Sequence
  Description of Artificial Sequence: Synthetic oligonucleotide
tgatcaggaacagcagttctctgtcgacctg

SEQ ID NO: 238394 - DNA, 30 bp, Artificial Sequence
  Description of Artificial Sequence: Synthetic oligonucleotide
gatcaggaacagcagttctctgtcgacctg

SEQ ID NO: 238395 - DNA, 32 bp, Artificial Sequence
  Description of Artificial Sequence: Synthetic oligonucleotide
atcaggaacagcagttctctgtcgacctgaag

SEQ ID NO: 238396 - DNA, 31 bp, Artificial Sequence
  Description of Artificial Sequence: Synthetic oligonucleotide
tcaggaacagcagttctctgtcgacctgaag

SEQ ID NO: 238397 - DNA, 30 bp, Artificial Sequence
  Description of Artificial Sequence: Synthetic oligonucleotide
caggaacagcagttctctgtcgacctgaag

SEQ ID NO: 238398 - DNA, 34 bp, Artificial Sequence
  Description of Artificial Sequence: Synthetic oligonucleotide
aggaacagcagttctctgtcgacctgaagtaaag

SEQ ID NO: 238399 - DNA, 33 bp, Artificial Sequence
  Description of Artificial Sequence: Synthetic oligonucleotide
ggaacagcagttctctgtcgacctgaagtaaag

SEQ ID NO: 238400 - DNA, 33 bp, Artificial Sequence
  Description of Artificial Sequence: Synthetic oligonucleotide
gaacagcagttctctgtcgacctgaagtaaagc

SEQ ID NO: 238401 - DNA, 33 bp, Artificial Sequence
  Description of Artificial Sequence: Synthetic oligonucleotide
aacagcagttctctgtcgacctgaagtaaagcg

SEQ ID NO: 238402 - DNA, 32 bp, Artificial Sequence
  Description of Artificial Sequence: Synthetic oligonucleotide
acagcagttctctgtcgacctgaagtaaagcg

SEQ ID NO: 238403 - DNA, 31 bp, Artificial Sequence
  Description of Artificial Sequence: Synthetic oligonucleotide
cagcagttctctgtcgacctgaagtaaagcg

SEQ ID NO: 238404 - DNA, 32 bp, Artificial Sequence
  Description of Artificial Sequence: Synthetic oligonucleotide
agcagttctctgtcgacctgaagtaaagcgag

SEQ ID NO: 238405 - DNA, 31 bp, Artificial Sequence
  Description of Artificial Sequence: Synthetic oligonucleotide
gcagttctctgtcgacctgaagtaaagcgag

SEQ ID NO: 238406 - DNA, 31 bp, Artificial Sequence
  Description of Artificial Sequence: Synthetic oligonucleotide
cagttctctgtcgacctgaagtaaagcgagg

SEQ ID NO: 238407 - DNA, 31 bp, Artificial Sequence
  Description of Artificial Sequence: Synthetic oligonucleotide
agttctctgtcgacctgaagtaaagcgaggg

SEQ ID NO: 238408 - DNA, 30 bp, Artificial Sequence
  Description of Artificial Sequence: Synthetic oligonucleotide
gttctctgtcgacctgaagtaaagcgaggg

SEQ ID NO: 238409 - DNA, 30 bp, Artificial Sequence
  Description of Artificial Sequence: Synthetic oligonucleotide
ttctctgtcgacctgaagtaaagcgagggc

SEQ ID NO: 238410 - DNA, 29 bp, Artificial Sequence
  Description of Artificial Sequence: Synthetic oligonucleotide
tctctgtcgacctgaagtaaagcgagggc

SEQ ID NO: 238411 - DNA, 28 bp, Artificial Sequence
  Description of Artificial Sequence: Synthetic oligonucleotide
ctctgtcgacctgaagtaaagcgagggc

SEQ ID NO: 238412 - DNA, 28 bp, Artificial Sequence
  Description of Artificial Sequence: Synthetic oligonucleotide
tctgtcgacctgaagtaaagcgagggcg

SEQ ID NO: 238413 - DNA, 27 bp, Artificial Sequence
  Description of Artificial Sequence: Synthetic oligonucleotide
ctgtcgacctgaagtaaagcgagggcg

SEQ ID NO: 238414 - DNA, 28 bp, Artificial Sequence
  Description of Artificial Sequence: Synthetic oligonucleotide
tgtcgacctgaagtaaagcgagggcgtg

SEQ ID NO: 238415 - DNA, 27 bp, Artificial Sequence
  Description of Artificial Sequence: Synthetic oligonucleotide
gtcgacctgaagtaaagcgagggcgtg

SEQ ID NO: 238416 - DNA, 28 bp, Artificial Sequence
  Description of Artificial Sequence: Synthetic oligonucleotide
tcgacctgaagtaaagcgagggcgtgtg

SEQ ID NO: 238417 - DNA, 27 bp, Artificial Sequence
  Description of Artificial Sequence: Synthetic oligonucleotide
cgacctgaagtaaagcgagggcgtgtg

SEQ ID NO: 238418 - DNA, 27 bp, Artificial Sequence
  Description of Artificial Sequence: Synthetic oligonucleotide
gacctgaagtaaagcgagggcgtgtgg

SEQ ID NO: 238419 - DNA, 27 bp, Artificial Sequence
  Description of Artificial Sequence: Synthetic oligonucleotide
acctgaagtaaagcgagggcgtgtggc

SEQ ID NO: 238420 - DNA, 26 bp, Artificial Sequence
  Description of Artificial Sequence: Synthetic oligonucleotide
cctgaagtaaagcgagggcgtgtggc

SEQ ID NO: 238421 - DNA, 27 bp, Artificial Sequence
  Description of Artificial Sequence: Synthetic oligonucleotide
ctgaagtaaagcgagggcgtgtggcga

SEQ ID NO: 238422 - DNA, 27 bp, Artificial Sequence
  Description of Artificial Sequence: Synthetic oligonucleotide
tgaagtaaagcgagggcgtgtggcgac

SEQ ID NO: 238423 - DNA, 27 bp, Artificial Sequence
  Description of Artificial Sequence: Synthetic oligonucleotide
gaagtaaagcgagggcgtgtggcgact

SEQ ID NO: 238424 - DNA, 27 bp, Artificial Sequence
  Description of Artificial Sequence: Synthetic oligonucleotide
aagtaaagcgagggcgtgtggcgactg

SEQ ID NO: 238425 - DNA, 26 bp, Artificial Sequence
  Description of Artificial Sequence: Synthetic oligonucleotide
agtaaagcgagggcgtgtggcgactg

SEQ ID NO: 238426 - DNA, 25 bp, Artificial Sequence
  Description of Artificial Sequence: Synthetic oligonucleotide
gtaaagcgagggcgtgtggcgactg

SEQ ID NO: 238427 - DNA, 25 bp, Artificial Sequence
  Description of Artificial Sequence: Synthetic oligonucleotide
taaagcgagggcgtgtggcgactgc

SEQ ID NO: 238428 - DNA, 24 bp, Artificial Sequence
  Description of Artificial Sequence: Synthetic oligonucleotide
aaagcgagggcgtgtggcgactgc

SEQ ID NO: 238429 - DNA, 23 bp, Artificial Sequence
  Description of Artificial Sequence: Synthetic oligonucleotide
aagcgagggcgtgtggcgactgc

SEQ ID NO: 238430 - DNA, 22 bp, Artificial Sequence
  Description of Artificial Sequence: Synthetic oligonucleotide
agcgagggcgtgtggcgactgc

SEQ ID NO: 238431 - DNA, 21 bp, Artificial Sequence
  Description of Artificial Sequence: Synthetic oligonucleotide
gcgagggcgtgtggcgactgc

SEQ ID NO: 238432 - DNA, 22 bp, Artificial Sequence
  Description of Artificial Sequence: Synthetic oligonucleotide
cgagggcgtgtggcgactgcct

SEQ ID NO: 238433 - DNA, 23 bp, Artificial Sequence
  Description of Artificial Sequence: Synthetic oligonucleotide
gagggcgtgtggcgactgcctga

SEQ ID NO: 238434 - DNA, 26 bp, Artificial Sequence
  Description of Artificial Sequence: Synthetic oligonucleotide
agggcgtgtggcgactgcctgagatt

SEQ ID NO: 238435 - DNA, 25 bp, Artificial Sequence
  Description of Artificial Sequence: Synthetic oligonucleotide
gggcgtgtggcgactgcctgagatt

SEQ ID NO: 238436 - DNA, 25 bp, Artificial Sequence
  Description of Artificial Sequence: Synthetic oligonucleotide
ggcgtgtggcgactgcctgagattg

SEQ ID NO: 238437 - DNA, 26 bp, Artificial Sequence
  Description of Artificial Sequence: Synthetic oligonucleotide
gcgtgtggcgactgcctgagattggt

SEQ ID NO: 238438 - DNA, 27 bp, Artificial Sequence
  Description of Artificial Sequence: Synthetic oligonucleotide
cgtgtggcgactgcctgagattggtga

SEQ ID NO: 238439 - DNA, 27 bp, Artificial Sequence
  Description of Artificial Sequence: Synthetic oligonucleotide
gtgtggcgactgcctgagattggtgac

SEQ ID NO: 238440 - DNA, 30 bp, Artificial Sequence
  Description of Artificial Sequence: Synthetic oligonucleotide
tgtggcgactgcctgagattggtgactatg

SEQ ID NO: 238441 - DNA, 29 bp, Artificial Sequence
  Description of Artificial Sequence: Synthetic oligonucleotide
gtggcgactgcctgagattggtgactatg

SEQ ID NO: 238442 - DNA, 29 bp, Artificial Sequence
  Description of Artificial Sequence: Synthetic oligonucleotide
tggcgactgcctgagattggtgactatgc

SEQ ID NO: 238443 - DNA, 28 bp, Artificial Sequence
  Description of Artificial Sequence: Synthetic oligonucleotide
ggcgactgcctgagattggtgactatgc

SEQ ID NO: 238444 - DNA, 28 bp, Artificial Sequence
  Description of Artificial Sequence: Synthetic oligonucleotide
gcgactgcctgagattggtgactatgcc

SEQ ID NO: 238445 - DNA, 28 bp, Artificial Sequence
  Description of Artificial Sequence: Synthetic oligonucleotide
cgactgcctgagattggtgactatgccc

SEQ ID NO: 238446 - DNA, 28 bp, Artificial Sequence
  Description of Artificial Sequence: Synthetic oligonucleotide
gactgcctgagattggtgactatgcccg

SEQ ID NO: 238447 - DNA, 28 bp, Artificial Sequence
  Description of Artificial Sequence: Synthetic oligonucleotide
actgcctgagattggtgactatgcccgc

SEQ ID NO: 238448 - DNA, 27 bp, Artificial Sequence
  Description of Artificial Sequence: Synthetic oligonucleotide
ctgcctgagattggtgactatgcccgc

SEQ ID NO: 238449 - DNA, 30 bp, Artificial Sequence
  Description of Artificial Sequence: Synthetic oligonucleotide
tgcctgagattggtgactatgcccgcttag

SEQ ID NO: 238450 - DNA, 29 bp, Artificial Sequence
  Description of Artificial Sequence: Synthetic oligonucleotide
gcctgagattggtgactatgcccgcttag

SEQ ID NO: 238451 - DNA, 30 bp, Artificial Sequence
  Description of Artificial Sequence: Synthetic oligonucleotide
cctgagattggtgactatgcccgcttagac

SEQ ID NO: 238452 - DNA, 30 bp, Artificial Sequence
  Description of Artificial Sequence: Synthetic oligonucleotide
ctgagattggtgactatgcccgcttagacc

SEQ ID NO: 238453 - DNA, 30 bp, Artificial Sequence
  Description of Artificial Sequence: Synthetic oligonucleotide
tgagattggtgactatgcccgcttagaccc

SEQ ID NO: 238454 - DNA, 29 bp, Artificial Sequence
  Description of Artificial Sequence: Synthetic oligonucleotide
gagattggtgactatgcccgcttagaccc

SEQ ID NO: 238455 - DNA, 29 bp, Artificial Sequence
  Description of Artificial Sequence: Synthetic oligonucleotide
agattggtgactatgcccgcttagacccg

SEQ ID NO: 238456 - DNA, 28 bp, Artificial Sequence
  Description of Artificial Sequence: Synthetic oligonucleotide
gattggtgactatgcccgcttagacccg

SEQ ID NO: 238457 - DNA, 28 bp, Artificial Sequence
  Description of Artificial Sequence: Synthetic oligonucleotide
attggtgactatgcccgcttagacccgc

SEQ ID NO: 238458 - DNA, 27 bp, Artificial Sequence
  Description of Artificial Sequence: Synthetic oligonucleotide
ttggtgactatgcccgcttagacccgc

SEQ ID NO: 238459 - DNA, 27 bp, Artificial Sequence
  Description of Artificial Sequence: Synthetic oligonucleotide
tggtgactatgcccgcttagacccgca

SEQ ID NO: 238460 - DNA, 26 bp, Artificial Sequence
  Description of Artificial Sequence: Synthetic oligonucleotide
ggtgactatgcccgcttagacccgca

SEQ ID NO: 238461 - DNA, 26 bp, Artificial Sequence
  Description of Artificial Sequence: Synthetic oligonucleotide
gtgactatgcccgcttagacccgcag

SEQ ID NO: 238462 - DNA, 26 bp, Artificial Sequence
  Description of Artificial Sequence: Synthetic oligonucleotide
tgactatgcccgcttagacccgcagc

SEQ ID NO: 238463 - DNA, 25 bp, Artificial Sequence
  Description of Artificial Sequence: Synthetic oligonucleotide
gactatgcccgcttagacccgcagc

SEQ ID NO: 238464 - DNA, 26 bp, Artificial Sequence
  Description of Artificial Sequence: Synthetic oligonucleotide
actatgcccgcttagacccgcagcgt

SEQ ID NO: 238465 - DNA, 25 bp, Artificial Sequence
  Description of Artificial Sequence: Synthetic oligonucleotide
ctatgcccgcttagacccgcagcgt

SEQ ID NO: 238466 - DNA, 25 bp, Artificial Sequence
  Description of Artificial Sequence: Synthetic oligonucleotide
tatgcccgcttagacccgcagcgtg

SEQ ID NO: 238467 - DNA, 24 bp, Artificial Sequence
  Description of Artificial Sequence: Synthetic oligonucleotide
atgcccgcttagacccgcagcgtg

SEQ ID NO: 238468 - DNA, 23 bp, Artificial Sequence
  Description of Artificial Sequence: Synthetic oligonucleotide
tgcccgcttagacccgcagcgtg

SEQ ID NO: 238469 - DNA, 22 bp, Artificial Sequence
  Description of Artificial Sequence: Synthetic oligonucleotide
gcccgcttagacccgcagcgtg

SEQ ID NO: 238470 - DNA, 22 bp, Artificial Sequence
  Description of Artificial Sequence: Synthetic oligonucleotide
cccgcttagacccgcagcgtgg

SEQ ID NO: 238471 - DNA, 22 bp, Artificial Sequence
  Description of Artificial Sequence: Synthetic oligonucleotide
ccgcttagacccgcagcgtggg

SEQ ID NO: 238472 - DNA, 23 bp, Artificial Sequence
  Description of Artificial Sequence: Synthetic oligonucleotide
cgcttagacccgcagcgtgggct

SEQ ID NO: 238473 - DNA, 23 bp, Artificial Sequence
  Description of Artificial Sequence: Synthetic oligonucleotide
gcttagacccgcagcgtgggctg

SEQ ID NO: 238474 - DNA, 23 bp, Artificial Sequence
  Description of Artificial Sequence: Synthetic oligonucleotide
cttagacccgcagcgtgggctgg

SEQ ID NO: 238475 - DNA, 23 bp, Artificial Sequence
  Description of Artificial Sequence: Synthetic oligonucleotide
ttagacccgcagcgtgggctggg

SEQ ID NO: 238476 - DNA, 22 bp, Artificial Sequence
  Description of Artificial Sequence: Synthetic oligonucleotide
tagacccgcagcgtgggctggg

SEQ ID NO: 238477 - DNA, 21 bp, Artificial Sequence
  Description of Artificial Sequence: Synthetic oligonucleotide
agacccgcagcgtgggctggg

SEQ ID NO: 238478 - DNA, 20 bp, Artificial Sequence
  Description of Artificial Sequence: Synthetic oligonucleotide
gacccgcagcgtgggctggg

SEQ ID NO: 238479 - DNA, 20 bp, Artificial Sequence
  Description of Artificial Sequence: Synthetic oligonucleotide
acccgcagcgtgggctgggc

SEQ ID NO: 238480 - DNA, 20 bp, Artificial Sequence
  Description of Artificial Sequence: Synthetic oligonucleotide
cccgcagcgtgggctgggct

SEQ ID NO: 238481 - DNA, 20 bp, Artificial Sequence
  Description of Artificial Sequence: Synthetic oligonucleotide
ccgcagcgtgggctgggcgt

SEQ ID NO: 238482 - DNA, 20 bp, Artificial Sequence
  Description of Artificial Sequence: Synthetic oligonucleotide
cgcagcgtgggctgggcggt

SEQ ID NO: 238483 - DNA, 21 bp, Artificial Sequence
  Description of Artificial Sequence: Synthetic oligonucleotide
gcagcgtgggctgggcggcat

SEQ ID NO: 238484 - DNA, 21 bp, Artificial Sequence
  Description of Artificial Sequence: Synthetic oligonucleotide
cagcgtgggctgggcggcatc

SEQ ID NO: 238485 - DNA, 21 bp, Artificial Sequence
  Description of Artificial Sequence: Synthetic oligonucleotide
agcgtgggctgggcggcatcg

SEQ ID NO: 238486 - DNA, 20 bp, Artificial Sequence
  Description of Artificial Sequence: Synthetic oligonucleotide
gcgtgggctgggcggcatcg

SEQ ID NO: 238487 - DNA, 20 bp, Artificial Sequence
  Description of Artificial Sequence: Synthetic oligonucleotide
cgtgggctgggcggcatcgc

SEQ ID NO: 238488 - DNA, 20 bp, Artificial Sequence
  Description of Artificial Sequence: Synthetic oligonucleotide
gtgggctgggcggcatcgcg

SEQ ID NO: 238489 - DNA, 20 bp, Artificial Sequence
  Description of Artificial Sequence: Synthetic oligonucleotide
tgggctgggcggcatcgcgg

SEQ ID NO: 238490 - DNA, 20 bp, Artificial Sequence
  Description of Artificial Sequence: Synthetic oligonucleotide
gggctgggcggcatcgcggt

SEQ ID NO: 238491 - DNA, 22 bp, Artificial Sequence
  Description of Artificial Sequence: Synthetic oligonucleotide
ggctgggcggcatcgcggcaat

SEQ ID NO: 238492 - DNA, 25 bp, Artificial Sequence
  Description of Artificial Sequence: Synthetic oligonucleotide
gctgggcggcatcgcggcaatcaaa

SEQ ID NO: 238493 - DNA, 25 bp, Artificial Sequence
  Description of Artificial Sequence: Synthetic oligonucleotide
ctgggcggcatcgcggcaatcaaac

SEQ ID NO: 238494 - DNA, 25 bp, Artificial Sequence
  Description of Artificial Sequence: Synthetic oligonucleotide
tgggcggcatcgcggcaatcaaacc

SEQ ID NO: 238495 - DNA, 24 bp, Artificial Sequence
  Description of Artificial Sequence: Synthetic oligonucleotide
gggcggcatcgcggcaatcaaacc

SEQ ID NO: 238496 - DNA, 24 bp, Artificial Sequence
  Description of Artificial Sequence: Synthetic oligonucleotide
ggcggcatcgcggcaatcaaaccc

SEQ ID NO: 238497 - DNA, 26 bp, Artificial Sequence
  Description of Artificial Sequence: Synthetic oligonucleotide
gcggcatcgcggcaatcaaaccccat

SEQ ID NO: 238498 - DNA, 27 bp, Artificial Sequence
  Description of Artificial Sequence: Synthetic oligonucleotide
cggcatcgcggcaatcaaaccccatct

SEQ ID NO: 238499 - DNA, 27 bp, Artificial Sequence
  Description of Artificial Sequence: Synthetic oligonucleotide
ggcatcgcggcaatcaaaccccatctg

SEQ ID NO: 238500 - DNA, 27 bp, Artificial Sequence
  Description of Artificial Sequence: Synthetic oligonucleotide
gcatcgcggcaatcaaaccccatctgg

SEQ ID NO: 238501 - DNA, 28 bp, Artificial Sequence
  Description of Artificial Sequence: Synthetic oligonucleotide
catcgcggcaatcaaaccccatctggtc

SEQ ID NO: 238502 - DNA, 30 bp, Artificial Sequence
  Description of Artificial Sequence: Synthetic oligonucleotide
atcgcggcaatcaaaccccatctggtcatc

SEQ ID NO: 238503 - DNA, 29 bp, Artificial Sequence
  Description of Artificial Sequence: Synthetic oligonucleotide
tcgcggcaatcaaaccccatctggtcatc

SEQ ID NO: 238504 - DNA, 28 bp, Artificial Sequence
  Description of Artificial Sequence: Synthetic oligonucleotide
cgcggcaatcaaaccccatctggtcatc

SEQ ID NO: 238505 - DNA, 28 bp, Artificial Sequence
  Description of Artificial Sequence: Synthetic oligonucleotide
gcggcaatcaaaccccatctggtcatcc

SEQ ID NO: 238506 - DNA, 29 bp, Artificial Sequence
  Description of Artificial Sequence: Synthetic oligonucleotide
cggcaatcaaaccccatctggtcatcctg

SEQ ID NO: 238507 - DNA, 29 bp, Artificial Sequence
  Description of Artificial Sequence: Synthetic oligonucleotide
ggcaatcaaaccccatctggtcatcctgg

SEQ ID NO: 238508 - DNA, 30 bp, Artificial Sequence
  Description of Artificial Sequence: Synthetic oligonucleotide
gcaatcaaaccccatctggtcatcctggtc

SEQ ID NO: 238509 - DNA, 30 bp, Artificial Sequence
  Description of Artificial Sequence: Synthetic oligonucleotide
caatcaaaccccatctggtcatcctggtcg

SEQ ID NO: 238510 - DNA, 31 bp, Artificial Sequence
  Description of Artificial Sequence: Synthetic oligonucleotide
aatcaaaccccatctggtcatcctggtcgag

SEQ ID NO: 238511 - DNA, 30 bp, Artificial Sequence
  Description of Artificial Sequence: Synthetic oligonucleotide
atcaaaccccatctggtcatcctggtcgag

SEQ ID NO: 238512 - DNA, 29 bp, Artificial Sequence
  Description of Artificial Sequence: Synthetic oligonucleotide
tcaaaccccatctggtcatcctggtcgag

SEQ ID NO: 238513 - DNA, 28 bp, Artificial Sequence
  Description of Artificial Sequence: Synthetic oligonucleotide
caaaccccatctggtcatcctggtcgag

SEQ ID NO: 238514 - DNA, 28 bp, Artificial Sequence
  Description of Artificial Sequence: Synthetic oligonucleotide
aaaccccatctggtcatcctggtcgagc

SEQ ID NO: 238515 - DNA, 27 bp, Artificial Sequence
  Description of Artificial Sequence: Synthetic oligonucleotide
aaccccatctggtcatcctggtcgagc

SEQ ID NO: 238516 - DNA, 26 bp, Artificial Sequence
  Description of Artificial Sequence: Synthetic oligonucleotide
accccatctggtcatcctggtcgagc

SEQ ID NO: 238517 - DNA, 25 bp, Artificial Sequence
  Description of Artificial Sequence: Synthetic oligonucleotide
ccccatctggtcatcctggtcgagc

SEQ ID NO: 238518 - DNA, 25 bp, Artificial Sequence
  Description of Artificial Sequence: Synthetic oligonucleotide
cccatctggtcatcctggtcgagcg

SEQ ID NO: 238519 - DNA, 26 bp, Artificial Sequence
  Description of Artificial Sequence: Synthetic oligonucleotide
ccatctggtcatcctggtcgagcgct

SEQ ID NO: 238520 - DNA, 26 bp, Artificial Sequence
  Description of Artificial Sequence: Synthetic oligonucleotide
catctggtcatcctggtcgagcgctc

SEQ ID NO: 238521 - DNA, 27 bp, Artificial Sequence
  Description of Artificial Sequence: Synthetic oligonucleotide
atctggtcatcctggtcgagcgctcct

SEQ ID NO: 238522 - DNA, 27 bp, Artificial Sequence
  Description of Artificial Sequence: Synthetic oligonucleotide
tctggtcatcctggtcgagcgctccta

SEQ ID NO: 238523 - DNA, 26 bp, Artificial Sequence
  Description of Artificial Sequence: Synthetic oligonucleotide
ctggtcatcctggtcgagcgctccta

SEQ ID NO: 238524 - DNA, 26 bp, Artificial Sequence
  Description of Artificial Sequence: Synthetic oligonucleotide
tggtcatcctggtcgagcgctcctac

SEQ ID NO: 238525 - DNA, 25 bp, Artificial Sequence
  Description of Artificial Sequence: Synthetic oligonucleotide
ggtcatcctggtcgagcgctcctac

SEQ ID NO: 238526 - DNA, 25 bp, Artificial Sequence
  Description of Artificial Sequence: Synthetic oligonucleotide
gtcatcctggtcgagcgctcctacc

SEQ ID NO: 238527 - DNA, 25 bp, Artificial Sequence
  Description of Artificial Sequence: Synthetic oligonucleotide
tcatcctggtcgagcgctcctaccg

SEQ ID NO: 238528 - DNA, 24 bp, Artificial Sequence
  Description of Artificial Sequence: Synthetic oligonucleotide
catcctggtcgagcgctcctaccg

SEQ ID NO: 238529 - DNA, 25 bp, Artificial Sequence
  Description of Artificial Sequence: Synthetic oligonucleotide
atcctggtcgagcgctcctaccgca

SEQ ID NO: 238530 - DNA, 24 bp, Artificial Sequence
  Description of Artificial Sequence: Synthetic oligonucleotide
tcctggtcgagcgctcctaccgca

SEQ ID NO: 238531 - DNA, 23 bp, Artificial Sequence
  Description of Artificial Sequence: Synthetic oligonucleotide
cctggtcgagcgctcctaccgca

SEQ ID NO: 238532 - DNA, 23 bp, Artificial Sequence
  Description of Artificial Sequence: Synthetic oligonucleotide
ctggtcgagcgctcctaccgcag

SEQ ID NO: 238533 - DNA, 24 bp, Artificial Sequence
  Description of Artificial Sequence: Synthetic oligonucleotide
tggtcgagcgctcctaccgcagca

SEQ ID NO: 238534 - DNA, 23 bp, Artificial Sequence
  Description of Artificial Sequence: Synthetic oligonucleotide
ggtcgagcgctcctaccgcagca

SEQ ID NO: 238535 - DNA, 24 bp, Artificial Sequence
  Description of Artificial Sequence: Synthetic oligonucleotide
gtcgagcgctcctaccgcagcaca

SEQ ID NO: 238536 - DNA, 24 bp, Artificial Sequence
  Description of Artificial Sequence: Synthetic oligonucleotide
tcgagcgctcctaccgcagcacag

SEQ ID NO: 238537 - DNA, 23 bp, Artificial Sequence
  Description of Artificial Sequence: Synthetic oligonucleotide
cgagcgctcctaccgcagcacag

SEQ ID NO: 238538 - DNA, 23 bp, Artificial Sequence
  Description of Artificial Sequence: Synthetic oligonucleotide
gagcgctcctaccgcagcacagc

SEQ ID NO: 238539 - DNA, 25 bp, Artificial Sequence
  Description of Artificial Sequence: Synthetic oligonucleotide
agcgctcctaccgcagcacagccat

SEQ ID NO: 238540 - DNA, 24 bp, Artificial Sequence
  Description of Artificial Sequence: Synthetic oligonucleotide
gcgctcctaccgcagcacagccat

SEQ ID NO: 238541 - DNA, 26 bp, Artificial Sequence
  Description of Artificial Sequence: Synthetic oligonucleotide
cgctcctaccgcagcacagccatcaa

SEQ ID NO: 238542 - DNA, 26 bp, Artificial Sequence
  Description of Artificial Sequence: Synthetic oligonucleotide
gctcctaccgcagcacagccatcaag

SEQ ID NO: 238543 - DNA, 27 bp, Artificial Sequence
  Description of Artificial Sequence: Synthetic oligonucleotide
ctcctaccgcagcacagccatcaaggt

SEQ ID NO: 238544 - DNA, 27 bp, Artificial Sequence
  Description of Artificial Sequence: Synthetic oligonucleotide
tcctaccgcagcacagccatcaaggtg

SEQ ID NO: 238545 - DNA, 26 bp, Artificial Sequence
  Description of Artificial Sequence: Synthetic oligonucleotide
cctaccgcagcacagccatcaaggtg

SEQ ID NO: 238546 - DNA, 26 bp, Artificial Sequence
  Description of Artificial Sequence: Synthetic oligonucleotide
ctaccgcagcacagccatcaaggtgc

SEQ ID NO: 238547 - DNA, 27 bp, Artificial Sequence
  Description of Artificial Sequence: Synthetic oligonucleotide
taccgcagcacagccatcaaggtgcct

SEQ ID NO: 238548 - DNA, 26 bp, Artificial Sequence
  Description of Artificial Sequence: Synthetic oligonucleotide
accgcagcacagccatcaaggtgcct

SEQ ID NO: 238549 - DNA, 25 bp, Artificial Sequence
  Description of Artificial Sequence: Synthetic oligonucleotide
ccgcagcacagccatcaaggtgcct

SEQ ID NO: 238550 - DNA, 25 bp, Artificial Sequence
  Description of Artificial Sequence: Synthetic oligonucleotide
cgcagcacagccatcaaggtgcctc

SEQ ID NO: 238551 - DNA, 26 bp, Artificial Sequence
  Description of Artificial Sequence: Synthetic oligonucleotide
gcagcacagccatcaaggtgcctcca

SEQ ID NO: 238552 - DNA, 26 bp, Artificial Sequence
  Description of Artificial Sequence: Synthetic oligonucleotide
cagcacagccatcaaggtgcctccag

SEQ ID NO: 238553 - DNA, 26 bp, Artificial Sequence
  Description of Artificial Sequence: Synthetic oligonucleotide
agcacagccatcaaggtgcctccagg

SEQ ID NO: 238554 - DNA, 25 bp, Artificial Sequence
  Description of Artificial Sequence: Synthetic oligonucleotide
gcacagccatcaaggtgcctccagg

SEQ ID NO: 238555 - DNA, 25 bp, Artificial Sequence
  Description of Artificial Sequence: Synthetic oligonucleotide
cacagccatcaaggtgcctccaggg

SEQ ID NO: 238556 - DNA, 26 bp, Artificial Sequence
  Description of Artificial Sequence: Synthetic oligonucleotide
acagccatcaaggtgcctccaggggt

SEQ ID NO: 238557 - DNA, 25 bp, Artificial Sequence
  Description of Artificial Sequence: Synthetic oligonucleotide
cagccatcaaggtgcctccaggggt

SEQ ID NO: 238558 - DNA, 26 bp, Artificial Sequence
  Description of Artificial Sequence: Synthetic oligonucleotide
agccatcaaggtgcctccaggggtga

SEQ ID NO: 238559 - DNA, 25 bp, Artificial Sequence
  Description of Artificial Sequence: Synthetic oligonucleotide
gccatcaaggtgcctccaggggtga

SEQ ID NO: 238560 - DNA, 25 bp, Artificial Sequence
  Description of Artificial Sequence: Synthetic oligonucleotide
ccatcaaggtgcctccaggggtgac

SEQ ID NO: 238561 - DNA, 25 bp, Artificial Sequence
  Description of Artificial Sequence: Synthetic oligonucleotide
catcaaggtgcctccaggggtgacc

SEQ ID NO: 238562 - DNA, 26 bp, Artificial Sequence
  Description of Artificial Sequence: Synthetic oligonucleotide
atcaaggtgcctccaggggtgaccga

SEQ ID NO: 238563 - DNA, 25 bp, Artificial Sequence
  Description of Artificial Sequence: Synthetic oligonucleotide
tcaaggtgcctccaggggtgaccga

SEQ ID NO: 238564 - DNA, 24 bp, Artificial Sequence
  Description of Artificial Sequence: Synthetic oligonucleotide
caaggtgcctccaggggtgaccga

SEQ ID NO: 238565 - DNA, 24 bp, Artificial Sequence
  Description of Artificial Sequence: Synthetic oligonucleotide
aaggtgcctccaggggtgaccgag

SEQ ID NO: 238566 - DNA, 23 bp, Artificial Sequence
  Description of Artificial Sequence: Synthetic oligonucleotide
aggtgcctccaggggtgaccgag

SEQ ID NO: 238567 - DNA, 22 bp, Artificial Sequence
  Description of Artificial Sequence: Synthetic oligonucleotide
ggtgcctccaggggtgaccgag

SEQ ID NO: 238568 - DNA, 23 bp, Artificial Sequence
  Description of Artificial Sequence: Synthetic oligonucleotide
gtgcctccaggggtgaccgagct

SEQ ID NO: 238569 - DNA, 23 bp, Artificial Sequence
  Description of Artificial Sequence: Synthetic oligonucleotide
tgcctccaggggtgaccgagctc

SEQ ID NO: 238570 - DNA, 22 bp, Artificial Sequence
  Description of Artificial Sequence: Synthetic oligonucleotide
gcctccaggggtgaccgagctc

SEQ ID NO: 238571 - DNA, 22 bp, Artificial Sequence
  Description of Artificial Sequence: Synthetic oligonucleotide
cctccaggggtgaccgagctcc

SEQ ID NO: 238572 - DNA, 22 bp, Artificial Sequence
  Description of Artificial Sequence: Synthetic oligonucleotide
ctccaggggtgaccgagctccc

SEQ ID NO: 238573 - DNA, 24 bp, Artificial Sequence
  Description of Artificial Sequence: Synthetic oligonucleotide
tccaggggtgaccgagctccccaa

SEQ ID NO: 238574 - DNA, 23 bp, Artificial Sequence
  Description of Artificial Sequence: Synthetic oligonucleotide
ccaggggtgaccgagctccccaa

SEQ ID NO: 238575 - DNA, 24 bp, Artificial Sequence
  Description of Artificial Sequence: Synthetic oligonucleotide
caggggtgaccgagctccccaact

SEQ ID NO: 238576 - DNA, 25 bp, Artificial Sequence
  Description of Artificial Sequence: Synthetic oligonucleotide
aggggtgaccgagctccccaactct

SEQ ID NO: 238577 - DNA, 24 bp, Artificial Sequence
  Description of Artificial Sequence: Synthetic oligonucleotide
ggggtgaccgagctccccaactct

SEQ ID NO: 238578 - DNA, 24 bp, Artificial Sequence
  Description of Artificial Sequence: Synthetic oligonucleotide
gggtgaccgagctccccaactctc

SEQ ID NO: 238579 - DNA, 24 bp, Artificial Sequence
  Description of Artificial Sequence: Synthetic oligonucleotide
ggtgaccgagctccccaactctcg

SEQ ID NO: 238580 - DNA, 24 bp, Artificial Sequence
  Description of Artificial Sequence: Synthetic oligonucleotide
gtgaccgagctccccaactctcgg

SEQ ID NO: 238581 - DNA, 25 bp, Artificial Sequence
  Description of Artificial Sequence: Synthetic oligonucleotide
tgaccgagctccccaactctcgggt

SEQ ID NO: 238582 - DNA, 24 bp, Artificial Sequence
  Description of Artificial Sequence: Synthetic oligonucleotide
gaccgagctccccaactctcgggt

SEQ ID NO: 238583 - DNA, 24 bp, Artificial Sequence
  Description of Artificial Sequence: Synthetic oligonucleotide
accgagctccccaactctcgggtg

SEQ ID NO: 238584 - DNA, 23 bp, Artificial Sequence
  Description of Artificial Sequence: Synthetic oligonucleotide
ccgagctccccaactctcgggtg

SEQ ID NO: 238585 - DNA, 24 bp, Artificial Sequence
  Description of Artificial Sequence: Synthetic oligonucleotide
cgagctccccaactctcgggtgca

SEQ ID NO: 238586 - DNA, 24 bp, Artificial Sequence
  Description of Artificial Sequence: Synthetic oligonucleotide
gagctccccaactctcgggtgcag

SEQ ID NO: 238587 - DNA, 25 bp, Artificial Sequence
  Description of Artificial Sequence: Synthetic oligonucleotide
agctccccaactctcgggtgcagct

SEQ ID NO: 238588 - DNA, 24 bp, Artificial Sequence
  Description of Artificial Sequence: Synthetic oligonucleotide
gctccccaactctcgggtgcagct

SEQ ID NO: 238589 - DNA, 24 bp, Artificial Sequence
  Description of Artificial Sequence: Synthetic oligonucleotide
ctccccaactctcgggtgcagctg

SEQ ID NO: 238590 - DNA, 24 bp, Artificial Sequence
  Description of Artificial Sequence: Synthetic oligonucleotide
tccccaactctcgggtgcagctgg

SEQ ID NO: 238591 - DNA, 23 bp, Artificial Sequence
  Description of Artificial Sequence: Synthetic oligonucleotide
ccccaactctcgggtgcagctgg

SEQ ID NO: 238592 - DNA, 23 bp, Artificial Sequence
  Description of Artificial Sequence: Synthetic oligonucleotide
cccaactctcgggtgcagctggg

SEQ ID NO: 238593 - DNA, 23 bp, Artificial Sequence
  Description of Artificial Sequence: Synthetic oligonucleotide
ccaactctcgggtgcagctgggc

SEQ ID NO: 238594 - DNA, 24 bp, Artificial Sequence
  Description of Artificial Sequence: Synthetic oligonucleotide
caactctcgggtgcagctgggcct

SEQ ID NO: 238595 - DNA, 24 bp, Artificial Sequence
  Description of Artificial Sequence: Synthetic oligonucleotide
aactctcgggtgcagctgggcctg

SEQ ID NO: 238596 - DNA, 23 bp, Artificial Sequence
  Description of Artificial Sequence: Synthetic oligonucleotide
actctcgggtgcagctgggcctg

SEQ ID NO: 238597 - DNA, 22 bp, Artificial Sequence
  Description of Artificial Sequence: Synthetic oligonucleotide
ctctcgggtgcagctgggcctg

SEQ ID NO: 238598 - DNA, 22 bp, Artificial Sequence
  Description of Artificial Sequence: Synthetic oligonucleotide
tctcgggtgcagctgggcctgc

SEQ ID NO: 238599 - DNA, 21 bp, Artificial Sequence
  Description of Artificial Sequence: Synthetic oligonucleotide
ctcgggtgcagctgggcctgc

SEQ ID NO: 238600 - DNA, 21 bp, Artificial Sequence
  Description of Artificial Sequence: Synthetic oligonucleotide
tcgggtgcagctgggcctgcc

SEQ ID NO: 238601 - DNA, 20 bp, Artificial Sequence
  Description of Artificial Sequence: Synthetic oligonucleotide
cgggtgcagctgggcctgcc

SEQ ID NO: 238602 - DNA, 22 bp, Artificial Sequence
  Description of Artificial Sequence: Synthetic oligonucleotide
gggtgcagctgggcctgcccaa

SEQ ID NO: 238603 - DNA, 24 bp, Artificial Sequence
  Description of Artificial Sequence: Synthetic oligonucleotide
ggtgcagctgggcctgcccaacat

SEQ ID NO: 238604 - DNA, 24 bp, Artificial Sequence
  Description of Artificial Sequence: Synthetic oligonucleotide
gtgcagctgggcctgcccaacatg

SEQ ID NO: 238605 - DNA, 25 bp, Artificial Sequence
  Description of Artificial Sequence: Synthetic oligonucleotide
tgcagctgggcctgcccaacatgct

SEQ ID NO: 238606 - DNA, 24 bp, Artificial Sequence
  Description of Artificial Sequence: Synthetic oligonucleotide
gcagctgggcctgcccaacatgct

SEQ ID NO: 238607 - DNA, 26 bp, Artificial Sequence
  Description of Artificial Sequence: Synthetic oligonucleotide
cagctgggcctgcccaacatgctcat

SEQ ID NO: 238608 - DNA, 27 bp, Artificial Sequence
  Description of Artificial Sequence: Synthetic oligonucleotide
agctgggcctgcccaacatgctcatct

SEQ ID NO: 238609 - DNA, 26 bp, Artificial Sequence
  Description of Artificial Sequence: Synthetic oligonucleotide
gctgggcctgcccaacatgctcatct

SEQ ID NO: 238610 - DNA, 26 bp, Artificial Sequence
  Description of Artificial Sequence: Synthetic oligonucleotide
ctgggcctgcccaacatgctcatctg

SEQ ID NO: 238611 - DNA, 27 bp, Artificial Sequence
  Description of Artificial Sequence: Synthetic oligonucleotide
tgggcctgcccaacatgctcatctgct

SEQ ID NO: 238612 - DNA, 27 bp, Artificial Sequence
  Description of Artificial Sequence: Synthetic oligonucleotide
gggcctgcccaacatgctcatctgctt

SEQ ID NO: 238613 - DNA, 27 bp, Artificial Sequence
  Description of Artificial Sequence: Synthetic oligonucleotide
ggcctgcccaacatgctcatctgcttc

SEQ ID NO: 238614 - DNA, 27 bp, Artificial Sequence
  Description of Artificial Sequence: Synthetic oligonucleotide
gcctgcccaacatgctcatctgcttcg

SEQ ID NO: 238615 - DNA, 28 bp, Artificial Sequence
  Description of Artificial Sequence: Synthetic oligonucleotide
cctgcccaacatgctcatctgcttcgtg

SEQ ID NO: 238616 - DNA, 28 bp, Artificial Sequence
  Description of Artificial Sequence: Synthetic oligonucleotide
ctgcccaacatgctcatctgcttcgtgg

SEQ ID NO: 238617 - DNA, 29 bp, Artificial Sequence
  Description of Artificial Sequence: Synthetic oligonucleotide
tgcccaacatgctcatctgcttcgtggac

SEQ ID NO: 238618 - DNA, 28 bp, Artificial Sequence
  Description of Artificial Sequence: Synthetic oligonucleotide
gcccaacatgctcatctgcttcgtggac

SEQ ID NO: 238619 - DNA, 30 bp, Artificial Sequence
  Description of Artificial Sequence: Synthetic oligonucleotide
cccaacatgctcatctgcttcgtggacatc

SEQ ID NO: 238620 - DNA, 32 bp, Artificial Sequence
  Description of Artificial Sequence: Synthetic oligonucleotide
ccaacatgctcatctgcttcgtggacatcatc

SEQ ID NO: 238621 - DNA, 34 bp, Artificial Sequence
  Description of Artificial Sequence: Synthetic oligonucleotide
caacatgctcatctgcttcgtggacatcatcttc

SEQ ID NO: 238622 - DNA, 34 bp, Artificial Sequence
  Description of Artificial Sequence: Synthetic oligonucleotide
aacatgctcatctgcttcgtggacatcatcttcc

SEQ ID NO: 238623 - DNA, 33 bp, Artificial Sequence
  Description of Artificial Sequence: Synthetic oligonucleotide
acatgctcatctgcttcgtggacatcatcttcc

SEQ ID NO: 238624 - DNA, 32 bp, Artificial Sequence
  Description of Artificial Sequence: Synthetic oligonucleotide
catgctcatctgcttcgtggacatcatcttcc

SEQ ID NO: 238625 - DNA, 32 bp, Artificial Sequence
  Description of Artificial Sequence: Synthetic oligonucleotide
atgctcatctgcttcgtggacatcatcttccc

SEQ ID NO: 238626 - DNA, 31 bp, Artificial Sequence
  Description of Artificial Sequence: Synthetic oligonucleotide
tgctcatctgcttcgtggacatcatcttccc

SEQ ID NO: 238627 - DNA, 30 bp, Artificial Sequence
  Description of Artificial Sequence: Synthetic oligonucleotide
gctcatctgcttcgtggacatcatcttccc

SEQ ID NO: 238628 - DNA, 30 bp, Artificial Sequence
  Description of Artificial Sequence: Synthetic oligonucleotide
ctcatctgcttcgtggacatcatcttcccg

SEQ ID NO: 238629 - DNA, 30 bp, Artificial Sequence
  Description of Artificial Sequence: Synthetic oligonucleotide
tcatctgcttcgtggacatcatcttcccgc

SEQ ID NO: 238630 - DNA, 29 bp, Artificial Sequence
  Description of Artificial Sequence: Synthetic oligonucleotide
catctgcttcgtggacatcatcttcccgc

SEQ ID NO: 238631 - DNA, 29 bp, Artificial Sequence
  Description of Artificial Sequence: Synthetic oligonucleotide
atctgcttcgtggacatcatcttcccgcc

SEQ ID NO: 238632 - DNA, 28 bp, Artificial Sequence
  Description of Artificial Sequence: Synthetic oligonucleotide
tctgcttcgtggacatcatcttcccgcc

SEQ ID NO: 238633 - DNA, 27 bp, Artificial Sequence
  Description of Artificial Sequence: Synthetic oligonucleotide
ctgcttcgtggacatcatcttcccgcc

SEQ ID NO: 238634 - DNA, 28 bp, Artificial Sequence
  Description of Artificial Sequence: Synthetic oligonucleotide
tgcttcgtggacatcatcttcccgcctg

SEQ ID NO: 238635 - DNA, 27 bp, Artificial Sequence
  Description of Artificial Sequence: Synthetic oligonucleotide
gcttcgtggacatcatcttcccgcctg

SEQ ID NO: 238636 - DNA, 28 bp, Artificial Sequence
  Description of Artificial Sequence: Synthetic oligonucleotide
cttcgtggacatcatcttcccgcctgtg

SEQ ID NO: 238637 - DNA, 30 bp, Artificial Sequence
  Description of Artificial Sequence: Synthetic oligonucleotide
ttcgtggacatcatcttcccgcctgtgatc

SEQ ID NO: 238638 - DNA, 29 bp, Artificial Sequence
  Description of Artificial Sequence: Synthetic oligonucleotide
tcgtggacatcatcttcccgcctgtgatc

SEQ ID NO: 238639 - DNA, 28 bp, Artificial Sequence
  Description of Artificial Sequence: Synthetic oligonucleotide
cgtggacatcatcttcccgcctgtgatc

SEQ ID NO: 238640 - DNA, 33 bp, Artificial Sequence
  Description of Artificial Sequence: Synthetic oligonucleotide
gtggacatcatcttcccgcctgtgatctatatc

SEQ ID NO: 238641 - DNA, 34 bp, Artificial Sequence
  Description of Artificial Sequence: Synthetic oligonucleotide
tggacatcatcttcccgcctgtgatctatatcac

SEQ ID NO: 238642 - DNA, 33 bp, Artificial Sequence
  Description of Artificial Sequence: Synthetic oligonucleotide
ggacatcatcttcccgcctgtgatctatatcac

SEQ ID NO: 238643 - DNA, 33 bp, Artificial Sequence
  Description of Artificial Sequence: Synthetic oligonucleotide
gacatcatcttcccgcctgtgatctatatcacc

SEQ ID NO: 238644 - DNA, 34 bp, Artificial Sequence
  Description of Artificial Sequence: Synthetic oligonucleotide
acatcatcttcccgcctgtgatctatatcacctc

SEQ ID NO: 238645 - DNA, 33 bp, Artificial Sequence
  Description of Artificial Sequence: Synthetic oligonucleotide
catcatcttcccgcctgtgatctatatcacctc

SEQ ID NO: 238646 - DNA, 33 bp, Artificial Sequence
  Description of Artificial Sequence: Synthetic oligonucleotide
atcatcttcccgcctgtgatctatatcacctcg

SEQ ID NO: 238647 - DNA, 32 bp, Artificial Sequence
  Description of Artificial Sequence: Synthetic oligonucleotide
tcatcttcccgcctgtgatctatatcacctcg

SEQ ID NO: 238648 - DNA, 31 bp, Artificial Sequence
  Description of Artificial Sequence: Synthetic oligonucleotide
catcttcccgcctgtgatctatatcacctcg

SEQ ID NO: 238649 - DNA, 31 bp, Artificial Sequence
  Description of Artificial Sequence: Synthetic oligonucleotide
atcttcccgcctgtgatctatatcacctcgc

SEQ ID NO: 238650 - DNA, 30 bp, Artificial Sequence
  Description of Artificial Sequence: Synthetic oligonucleotide
tcttcccgcctgtgatctatatcacctcgc

SEQ ID NO: 238651 - DNA, 29 bp, Artificial Sequence
  Description of Artificial Sequence: Synthetic oligonucleotide
cttcccgcctgtgatctatatcacctcgc

SEQ ID NO: 238652 - DNA, 31 bp, Artificial Sequence
  Description of Artificial Sequence: Synthetic oligonucleotide
ttcccgcctgtgatctatatcacctcgctac

SEQ ID NO: 238653 - DNA, 30 bp, Artificial Sequence
  Description of Artificial Sequence: Synthetic oligonucleotide
tcccgcctgtgatctatatcacctcgctac

SEQ ID NO: 238654 - DNA, 29 bp, Artificial Sequence
  Description of Artificial Sequence: Synthetic oligonucleotide
cccgcctgtgatctatatcacctcgctac

SEQ ID NO: 238655 - DNA, 29 bp, Artificial Sequence
  Description of Artificial Sequence: Synthetic oligonucleotide
ccgcctgtgatctatatcacctcgctacg

SEQ ID NO: 238656 - DNA, 29 bp, Artificial Sequence
  Description of Artificial Sequence: Synthetic oligonucleotide
cgcctgtgatctatatcacctcgctacgc

SEQ ID NO: 238657 - DNA, 31 bp, Artificial Sequence
  Description of Artificial Sequence: Synthetic oligonucleotide
gcctgtgatctatatcacctcgctacgcaag

SEQ ID NO: 238658 - DNA, 31 bp, Artificial Sequence
  Description of Artificial Sequence: Synthetic oligonucleotide
cctgtgatctatatcacctcgctacgcaagg

SEQ ID NO: 238659 - DNA, 31 bp, Artificial Sequence
  Description of Artificial Sequence: Synthetic oligonucleotide
ctgtgatctatatcacctcgctacgcaaggg

SEQ ID NO: 238660 - DNA, 31 bp, Artificial Sequence
  Description of Artificial Sequence: Synthetic oligonucleotide
tgtgatctatatcacctcgctacgcaagggc

SEQ ID NO: 238661 - DNA, 30 bp, Artificial Sequence
  Description of Artificial Sequence: Synthetic oligonucleotide
gtgatctatatcacctcgctacgcaagggc

SEQ ID NO: 238662 - DNA, 30 bp, Artificial Sequence
  Description of Artificial Sequence: Synthetic oligonucleotide
tgatctatatcacctcgctacgcaagggcc

SEQ ID NO: 238663 - DNA, 29 bp, Artificial Sequence
  Description of Artificial Sequence: Synthetic oligonucleotide
gatctatatcacctcgctacgcaagggcc

SEQ ID NO: 238664 - DNA, 32 bp, Artificial Sequence
  Description of Artificial Sequence: Synthetic oligonucleotide
atctatatcacctcgctacgcaagggccaaac

SEQ ID NO: 238665 - DNA, 31 bp, Artificial Sequence
  Description of Artificial Sequence: Synthetic oligonucleotide
tctatatcacctcgctacgcaagggccaaac

SEQ ID NO: 238666 - DNA, 30 bp, Artificial Sequence
  Description of Artificial Sequence: Synthetic oligonucleotide
ctatatcacctcgctacgcaagggccaaac

SEQ ID NO: 238667 - DNA, 31 bp, Artificial Sequence
  Description of Artificial Sequence: Synthetic oligonucleotide
tatatcacctcgctacgcaagggccaaactc

SEQ ID NO: 238668 - DNA, 30 bp, Artificial Sequence
  Description of Artificial Sequence: Synthetic oligonucleotide
atatcacctcgctacgcaagggccaaactc

SEQ ID NO: 238669 - DNA, 29 bp, Artificial Sequence
  Description of Artificial Sequence: Synthetic oligonucleotide
tatcacctcgctacgcaagggccaaactc

SEQ ID NO: 238670 - DNA, 28 bp, Artificial Sequence
  Description of Artificial Sequence: Synthetic oligonucleotide
atcacctcgctacgcaagggccaaactc

SEQ ID NO: 238671 - DNA, 27 bp, Artificial Sequence
  Description of Artificial Sequence: Synthetic oligonucleotide
tcacctcgctacgcaagggccaaactc

SEQ ID NO: 238672 - DNA, 27 bp, Artificial Sequence
  Description of Artificial Sequence: Synthetic oligonucleotide
cacctcgctacgcaagggccaaactct

SEQ ID NO: 238673 - DNA, 27 bp, Artificial Sequence
  Description of Artificial Sequence: Synthetic oligonucleotide
acctcgctacgcaagggccaaactctc

SEQ ID NO: 238674 - DNA, 27 bp, Artificial Sequence
  Description of Artificial Sequence: Synthetic oligonucleotide
cctcgctacgcaagggccaaactctca

SEQ ID NO: 238675 - DNA, 27 bp, Artificial Sequence
  Description of Artificial Sequence: Synthetic oligonucleotide
ctcgctacgcaagggccaaactctcac

SEQ ID NO: 238676 - DNA, 28 bp, Artificial Sequence
  Description of Artificial Sequence: Synthetic oligonucleotide
tcgctacgcaagggccaaactctcactg

SEQ ID NO: 238677 - DNA, 27 bp, Artificial Sequence
  Description of Artificial Sequence: Synthetic oligonucleotide
cgctacgcaagggccaaactctcactg

SEQ ID NO: 238678 - DNA, 28 bp, Artificial Sequence
  Description of Artificial Sequence: Synthetic oligonucleotide
gctacgcaagggccaaactctcactgag

SEQ ID NO: 238679 - DNA, 28 bp, Artificial Sequence
  Description of Artificial Sequence: Synthetic oligonucleotide
ctacgcaagggccaaactctcactgagg

SEQ ID NO: 238680 - DNA, 28 bp, Artificial Sequence
  Description of Artificial Sequence: Synthetic oligonucleotide
tacgcaagggccaaactctcactgaggc

SEQ ID NO: 238681 - DNA, 27 bp, Artificial Sequence
  Description of Artificial Sequence: Synthetic oligonucleotide
acgcaagggccaaactctcactgaggc

SEQ ID NO: 238682 - DNA, 27 bp, Artificial Sequence
  Description of Artificial Sequence: Synthetic oligonucleotide
cgcaagggccaaactctcactgaggca

SEQ ID NO: 238683 - DNA, 27 bp, Artificial Sequence
  Description of Artificial Sequence: Synthetic oligonucleotide
gcaagggccaaactctcactgaggcag

SEQ ID NO: 238684 - DNA, 28 bp, Artificial Sequence
  Description of Artificial Sequence: Synthetic oligonucleotide
caagggccaaactctcactgaggcagtg

SEQ ID NO: 238685 - DNA, 28 bp, Artificial Sequence
  Description of Artificial Sequence: Synthetic oligonucleotide
aagggccaaactctcactgaggcagtgg

SEQ ID NO: 238686 - DNA, 27 bp, Artificial Sequence
  Description of Artificial Sequence: Synthetic oligonucleotide
agggccaaactctcactgaggcagtgg

SEQ ID NO: 238687 - DNA, 26 bp, Artificial Sequence
  Description of Artificial Sequence: Synthetic oligonucleotide
gggccaaactctcactgaggcagtgg

SEQ ID NO: 238688 - DNA, 26 bp, Artificial Sequence
  Description of Artificial Sequence: Synthetic oligonucleotide
ggccaaactctcactgaggcagtggc

SEQ ID NO: 238689 - DNA, 26 bp, Artificial Sequence
  Description of Artificial Sequence: Synthetic oligonucleotide
gccaaactctcactgaggcagtggcc

SEQ ID NO: 238690 - DNA, 27 bp, Artificial Sequence
  Description of Artificial Sequence: Synthetic oligonucleotide
ccaaactctcactgaggcagtggccca

SEQ ID NO: 238691 - DNA, 27 bp, Artificial Sequence
  Description of Artificial Sequence: Synthetic oligonucleotide
caaactctcactgaggcagtggcccac

SEQ ID NO: 238692 - DNA, 28 bp, Artificial Sequence
  Description of Artificial Sequence: Synthetic oligonucleotide
aaactctcactgaggcagtggcccacac

SEQ ID NO: 238693 - DNA, 27 bp, Artificial Sequence
  Description of Artificial Sequence: Synthetic oligonucleotide
aactctcactgaggcagtggcccacac

SEQ ID NO: 238694 - DNA, 26 bp, Artificial Sequence
  Description of Artificial Sequence: Synthetic oligonucleotide
actctcactgaggcagtggcccacac

SEQ ID NO: 238695 - DNA, 25 bp, Artificial Sequence
  Description of Artificial Sequence: Synthetic oligonucleotide
ctctcactgaggcagtggcccacac

SEQ ID NO: 238696 - DNA, 26 bp, Artificial Sequence
  Description of Artificial Sequence: Synthetic oligonucleotide
tctcactgaggcagtggcccacacca

SEQ ID NO: 238697 - DNA, 25 bp, Artificial Sequence
  Description of Artificial Sequence: Synthetic oligonucleotide
ctcactgaggcagtggcccacacca

SEQ ID NO: 238698 - DNA, 25 bp, Artificial Sequence
  Description of Artificial Sequence: Synthetic oligonucleotide
tcactgaggcagtggcccacaccag

SEQ ID NO: 238699 - DNA, 24 bp, Artificial Sequence
  Description of Artificial Sequence: Synthetic oligonucleotide
cactgaggcagtggcccacaccag

SEQ ID NO: 238700 - DNA, 26 bp, Artificial Sequence
  Description of Artificial Sequence: Synthetic oligonucleotide
actgaggcagtggcccacaccagctt

SEQ ID NO: 238701 - DNA, 25 bp, Artificial Sequence
  Description of Artificial Sequence: Synthetic oligonucleotide
ctgaggcagtggcccacaccagctt

SEQ ID NO: 238702 - DNA, 27 bp, Artificial Sequence
  Description of Artificial Sequence: Synthetic oligonucleotide
tgaggcagtggcccacaccagcttcaa

SEQ ID NO: 238703 - DNA, 27 bp, Artificial Sequence
  Description of Artificial Sequence: Synthetic oligonucleotide
gaggcagtggcccacaccagcttcaat

SEQ ID NO: 238704 - DNA, 28 bp, Artificial Sequence
  Description of Artificial Sequence: Synthetic oligonucleotide
aggcagtggcccacaccagcttcaattc

SEQ ID NO: 238705 - DNA, 27 bp, Artificial Sequence
  Description of Artificial Sequence: Synthetic oligonucleotide
ggcagtggcccacaccagcttcaattc

SEQ ID NO: 238706 - DNA, 27 bp, Artificial Sequence
  Description of Artificial Sequence: Synthetic oligonucleotide
gcagtggcccacaccagcttcaattcc

SEQ ID NO: 238707 - DNA, 27 bp, Artificial Sequence
  Description of Artificial Sequence: Synthetic oligonucleotide
cagtggcccacaccagcttcaattccc

SEQ ID NO: 238708 - DNA, 28 bp, Artificial Sequence
  Description of Artificial Sequence: Synthetic oligonucleotide
agtggcccacaccagcttcaattcccag

SEQ ID NO: 238709 - DNA, 27 bp, Artificial Sequence
  Description of Artificial Sequence: Synthetic oligonucleotide
gtggcccacaccagcttcaattcccag

SEQ ID NO: 238710 - DNA, 27 bp, Artificial Sequence
  Description of Artificial Sequence: Synthetic oligonucleotide
tggcccacaccagcttcaattcccagc

SEQ ID NO: 238711 - DNA, 26 bp, Artificial Sequence
  Description of Artificial Sequence: Synthetic oligonucleotide
ggcccacaccagcttcaattcccagc

SEQ ID NO: 238712 - DNA, 27 bp, Artificial Sequence
  Description of Artificial Sequence: Synthetic oligonucleotide
gcccacaccagcttcaattcccagcgt

SEQ ID NO: 238713 - DNA, 27 bp, Artificial Sequence
  Description of Artificial Sequence: Synthetic oligonucleotide
cccacaccagcttcaattcccagcgtg

SEQ ID NO: 238714 - DNA, 28 bp, Artificial Sequence
  Description of Artificial Sequence: Synthetic oligonucleotide
ccacaccagcttcaattcccagcgtgac

SEQ ID NO: 238715 - DNA, 28 bp, Artificial Sequence
  Description of Artificial Sequence: Synthetic oligonucleotide
cacaccagcttcaattcccagcgtgacc

SEQ ID NO: 238716 - DNA, 32 bp, Artificial Sequence
  Description of Artificial Sequence: Synthetic oligonucleotide
acaccagcttcaattcccagcgtgaccatttc

SEQ ID NO: 238717 - DNA, 31 bp, Artificial Sequence
  Description of Artificial Sequence: Synthetic oligonucleotide
caccagcttcaattcccagcgtgaccatttc

SEQ ID NO: 238718 - DNA, 33 bp, Artificial Sequence
  Description of Artificial Sequence: Synthetic oligonucleotide
accagcttcaattcccagcgtgaccatttcttc

SEQ ID NO: 238719 - DNA, 32 bp, Artificial Sequence
  Description of Artificial Sequence: Synthetic oligonucleotide
ccagcttcaattcccagcgtgaccatttcttc

SEQ ID NO: 238720 - DNA, 32 bp, Artificial Sequence
  Description of Artificial Sequence: Synthetic oligonucleotide
cagcttcaattcccagcgtgaccatttcttcc

SEQ ID NO: 238721 - DNA, 32 bp, Artificial Sequence
  Description of Artificial Sequence: Synthetic oligonucleotide
agcttcaattcccagcgtgaccatttcttccg

SEQ ID NO: 238722 - DNA, 31 bp, Artificial Sequence
  Description of Artificial Sequence: Synthetic oligonucleotide
gcttcaattcccagcgtgaccatttcttccg

SEQ ID NO: 238723 - DNA, 31 bp, Artificial Sequence
  Description of Artificial Sequence: Synthetic oligonucleotide
cttcaattcccagcgtgaccatttcttccgc

SEQ ID NO: 238724 - DNA, 33 bp, Artificial Sequence
  Description of Artificial Sequence: Synthetic oligonucleotide
ttcaattcccagcgtgaccatttcttccgcaag

SEQ ID NO: 238725 - DNA, 32 bp, Artificial Sequence
  Description of Artificial Sequence: Synthetic oligonucleotide
tcaattcccagcgtgaccatttcttccgcaag

SEQ ID NO: 238726 - DNA, 31 bp, Artificial Sequence
  Description of Artificial Sequence: Synthetic oligonucleotide
caattcccagcgtgaccatttcttccgcaag

SEQ ID NO: 238727 - DNA, 33 bp, Artificial Sequence
  Description of Artificial Sequence: Synthetic oligonucleotide
aattcccagcgtgaccatttcttccgcaagatc

SEQ ID NO: 238728 - DNA, 32 bp, Artificial Sequence
  Description of Artificial Sequence: Synthetic oligonucleotide
attcccagcgtgaccatttcttccgcaagatc

SEQ ID NO: 238729 - DNA, 31 bp, Artificial Sequence
  Description of Artificial Sequence: Synthetic oligonucleotide
ttcccagcgtgaccatttcttccgcaagatc

SEQ ID NO: 238730 - DNA, 30 bp, Artificial Sequence
  Description of Artificial Sequence: Synthetic oligonucleotide
tcccagcgtgaccatttcttccgcaagatc

SEQ ID NO: 238731 - DNA, 29 bp, Artificial Sequence
  Description of Artificial Sequence: Synthetic oligonucleotide
cccagcgtgaccatttcttccgcaagatc

SEQ ID NO: 238732 - DNA, 29 bp, Artificial Sequence
  Description of Artificial Sequence: Synthetic oligonucleotide
ccagcgtgaccatttcttccgcaagatcc

SEQ ID NO: 238733 - DNA, 30 bp, Artificial Sequence
  Description of Artificial Sequence: Synthetic oligonucleotide
cagcgtgaccatttcttccgcaagatccac

SEQ ID NO: 238734 - DNA, 32 bp, Artificial Sequence
  Description of Artificial Sequence: Synthetic oligonucleotide
agcgtgaccatttcttccgcaagatccactac

SEQ ID NO: 238735 - DNA, 31 bp, Artificial Sequence
  Description of Artificial Sequence: Synthetic oligonucleotide
gcgtgaccatttcttccgcaagatccactac

SEQ ID NO: 238736 - DNA, 31 bp, Artificial Sequence
  Description of Artificial Sequence: Synthetic oligonucleotide
cgtgaccatttcttccgcaagatccactacc

SEQ ID NO: 238737 - DNA, 32 bp, Artificial Sequence
  Description of Artificial Sequence: Synthetic oligonucleotide
gtgaccatttcttccgcaagatccactaccag

SEQ ID NO: 238738 - DNA, 32 bp, Artificial Sequence
  Description of Artificial Sequence: Synthetic oligonucleotide
tgaccatttcttccgcaagatccactaccagc

SEQ ID NO: 238739 - DNA, 31 bp, Artificial Sequence
  Description of Artificial Sequence: Synthetic oligonucleotide
gaccatttcttccgcaagatccactaccagc

SEQ ID NO: 238740 - DNA, 31 bp, Artificial Sequence
  Description of Artificial Sequence: Synthetic oligonucleotide
accatttcttccgcaagatccactaccagcc

SEQ ID NO: 238741 - DNA, 30 bp, Artificial Sequence
  Description of Artificial Sequence: Synthetic oligonucleotide
ccatttcttccgcaagatccactaccagcc

SEQ ID NO: 238742 - DNA, 30 bp, Artificial Sequence
  Description of Artificial Sequence: Synthetic oligonucleotide
catttcttccgcaagatccactaccagccc

SEQ ID NO: 238743 - DNA, 32 bp, Artificial Sequence
  Description of Artificial Sequence: Synthetic oligonucleotide
atttcttccgcaagatccactaccagcccttc

SEQ ID NO: 238744 - DNA, 31 bp, Artificial Sequence
  Description of Artificial Sequence: Synthetic oligonucleotide
tttcttccgcaagatccactaccagcccttc

SEQ ID NO: 238745 - DNA, 30 bp, Artificial Sequence
  Description of Artificial Sequence: Synthetic oligonucleotide
ttcttccgcaagatccactaccagcccttc

SEQ ID NO: 238746 - DNA, 29 bp, Artificial Sequence
  Description of Artificial Sequence: Synthetic oligonucleotide
tcttccgcaagatccactaccagcccttc

SEQ ID NO: 238747 - DNA, 28 bp, Artificial Sequence
  Description of Artificial Sequence: Synthetic oligonucleotide
cttccgcaagatccactaccagcccttc

SEQ ID NO: 238748 - DNA, 28 bp, Artificial Sequence
  Description of Artificial Sequence: Synthetic oligonucleotide
ttccgcaagatccactaccagcccttcg

SEQ ID NO: 238749 - DNA, 27 bp, Artificial Sequence
  Description of Artificial Sequence: Synthetic oligonucleotide
tccgcaagatccactaccagcccttcg

SEQ ID NO: 238750 - DNA, 27 bp, Artificial Sequence
  Description of Artificial Sequence: Synthetic oligonucleotide
ccgcaagatccactaccagcccttcgt

SEQ ID NO: 238751 - DNA, 27 bp, Artificial Sequence
  Description of Artificial Sequence: Synthetic oligonucleotide
cgcaagatccactaccagcccttcgtc

SEQ ID NO: 238752 - DNA, 27 bp, Artificial Sequence
  Description of Artificial Sequence: Synthetic oligonucleotide
gcaagatccactaccagcccttcgtcc

SEQ ID NO: 238753 - DNA, 27 bp, Artificial Sequence
  Description of Artificial Sequence: Synthetic oligonucleotide
caagatccactaccagcccttcgtccc

SEQ ID NO: 238754 - DNA, 27 bp, Artificial Sequence
  Description of Artificial Sequence: Synthetic oligonucleotide
aagatccactaccagcccttcgtcccc

SEQ ID NO: 238755 - DNA, 27 bp, Artificial Sequence
  Description of Artificial Sequence: Synthetic oligonucleotide
agatccactaccagcccttcgtcccct

SEQ ID NO: 238756 - DNA, 26 bp, Artificial Sequence
  Description of Artificial Sequence: Synthetic oligonucleotide
gatccactaccagcccttcgtcccct

SEQ ID NO: 238757 - DNA, 27 bp, Artificial Sequence
  Description of Artificial Sequence: Synthetic oligonucleotide
atccactaccagcccttcgtcccctca

SEQ ID NO: 238758 - DNA, 26 bp, Artificial Sequence
  Description of Artificial Sequence: Synthetic oligonucleotide
tccactaccagcccttcgtcccctca

SEQ ID NO: 238759 - DNA, 25 bp, Artificial Sequence
  Description of Artificial Sequence: Synthetic oligonucleotide
ccactaccagcccttcgtcccctca

SEQ ID NO: 238760 - DNA, 25 bp, Artificial Sequence
  Description of Artificial Sequence: Synthetic oligonucleotide
cactaccagcccttcgtcccctcag

SEQ ID NO: 238761 - DNA, 25 bp, Artificial Sequence
  Description of Artificial Sequence: Synthetic oligonucleotide
actaccagcccttcgtcccctcagc

SEQ ID NO: 238762 - DNA, 24 bp, Artificial Sequence
  Description of Artificial Sequence: Synthetic oligonucleotide
ctaccagcccttcgtcccctcagc

SEQ ID NO: 238763 - DNA, 24 bp, Artificial Sequence
  Description of Artificial Sequence: Synthetic oligonucleotide
taccagcccttcgtcccctcagcc

SEQ ID NO: 238764 - DNA, 23 bp, Artificial Sequence
  Description of Artificial Sequence: Synthetic oligonucleotide
accagcccttcgtcccctcagcc

SEQ ID NO: 238765 - DNA, 22 bp, Artificial Sequence
  Description of Artificial Sequence: Synthetic oligonucleotide
ccagcccttcgtcccctcagcc

SEQ ID NO: 238766 - DNA, 23 bp, Artificial Sequence
  Description of Artificial Sequence: Synthetic oligonucleotide
cagcccttcgtcccctcagccca

SEQ ID NO: 238767 - DNA, 23 bp, Artificial Sequence
  Description of Artificial Sequence: Synthetic oligonucleotide
agcccttcgtcccctcagcccag

SEQ ID NO: 238768 - DNA, 22 bp, Artificial Sequence
  Description of Artificial Sequence: Synthetic oligonucleotide
gcccttcgtcccctcagcccag

SEQ ID NO: 238769 - DNA, 23 bp, Artificial Sequence
  Description of Artificial Sequence: Synthetic oligonucleotide
cccttcgtcccctcagcccagga

SEQ ID NO: 238770 - DNA, 23 bp, Artificial Sequence
  Description of Artificial Sequence: Synthetic oligonucleotide
ccttcgtcccctcagcccaggac

SEQ ID NO: 238771 - DNA, 24 bp, Artificial Sequence
  Description of Artificial Sequence: Synthetic oligonucleotide
cttcgtcccctcagcccaggacgt

SEQ ID NO: 238772 - DNA, 27 bp, Artificial Sequence
  Description of Artificial Sequence: Synthetic oligonucleotide
ttcgtcccctcagcccaggacgtcttt

SEQ ID NO: 238773 - DNA, 26 bp, Artificial Sequence
  Description of Artificial Sequence: Synthetic oligonucleotide
tcgtcccctcagcccaggacgtcttt

SEQ ID NO: 238774 - DNA, 25 bp, Artificial Sequence
  Description of Artificial Sequence: Synthetic oligonucleotide
cgtcccctcagcccaggacgtcttt

SEQ ID NO: 238775 - DNA, 26 bp, Artificial Sequence
  Description of Artificial Sequence: Synthetic oligonucleotide
gtcccctcagcccaggacgtctttga

SEQ ID NO: 238776 - DNA, 27 bp, Artificial Sequence
  Description of Artificial Sequence: Synthetic oligonucleotide
tcccctcagcccaggacgtctttgact

SEQ ID NO: 238777 - DNA, 26 bp, Artificial Sequence
  Description of Artificial Sequence: Synthetic oligonucleotide
cccctcagcccaggacgtctttgact

SEQ ID NO: 238778 - DNA, 26 bp, Artificial Sequence
  Description of Artificial Sequence: Synthetic oligonucleotide
ccctcagcccaggacgtctttgactg

SEQ ID NO: 238779 - DNA, 26 bp, Artificial Sequence
  Description of Artificial Sequence: Synthetic oligonucleotide
cctcagcccaggacgtctttgactgc

SEQ ID NO: 238780 - DNA, 27 bp, Artificial Sequence
  Description of Artificial Sequence: Synthetic oligonucleotide
ctcagcccaggacgtctttgactgcca

SEQ ID NO: 238781 - DNA, 27 bp, Artificial Sequence
  Description of Artificial Sequence: Synthetic oligonucleotide
tcagcccaggacgtctttgactgccac

SEQ ID NO: 238782 - DNA, 26 bp, Artificial Sequence
  Description of Artificial Sequence: Synthetic oligonucleotide
cagcccaggacgtctttgactgccac

SEQ ID NO: 238783 - DNA, 27 bp, Artificial Sequence
  Description of Artificial Sequence: Synthetic oligonucleotide
agcccaggacgtctttgactgccacgt

SEQ ID NO: 238784 - DNA, 26 bp, Artificial Sequence
  Description of Artificial Sequence: Synthetic oligonucleotide
gcccaggacgtctttgactgccacgt

SEQ ID NO: 238785 - DNA, 26 bp, Artificial Sequence
  Description of Artificial Sequence: Synthetic oligonucleotide
cccaggacgtctttgactgccacgtg

SEQ ID NO: 238786 - DNA, 27 bp, Artificial Sequence
  Description of Artificial Sequence: Synthetic oligonucleotide
ccaggacgtctttgactgccacgtgga

SEQ ID NO: 238787 - DNA, 27 bp, Artificial Sequence
  Description of Artificial Sequence: Synthetic oligonucleotide
caggacgtctttgactgccacgtggag

SEQ ID NO: 238788 - DNA, 27 bp, Artificial Sequence
  Description of Artificial Sequence: Synthetic oligonucleotide
aggacgtctttgactgccacgtggagc

SEQ ID NO: 238789 - DNA, 27 bp, Artificial Sequence
  Description of Artificial Sequence: Synthetic oligonucleotide
ggacgtctttgactgccacgtggagca

SEQ ID NO: 238790 - DNA, 27 bp, Artificial Sequence
  Description of Artificial Sequence: Synthetic oligonucleotide
gacgtctttgactgccacgtggagcac

SEQ ID NO: 238791 - DNA, 28 bp, Artificial Sequence
  Description of Artificial Sequence: Synthetic oligonucleotide
acgtctttgactgccacgtggagcacag

SEQ ID NO: 238792 - DNA, 27 bp, Artificial Sequence
  Description of Artificial Sequence: Synthetic oligonucleotide
cgtctttgactgccacgtggagcacag

SEQ ID NO: 238793 - DNA, 27 bp, Artificial Sequence
  Description of Artificial Sequence: Synthetic oligonucleotide
gtctttgactgccacgtggagcacagg

SEQ ID NO: 238794 - DNA, 27 bp, Artificial Sequence
  Description of Artificial Sequence: Synthetic oligonucleotide
tctttgactgccacgtggagcacaggg

SEQ ID NO: 238795 - DNA, 26 bp, Artificial Sequence
  Description of Artificial Sequence: Synthetic oligonucleotide
ctttgactgccacgtggagcacaggg

SEQ ID NO: 238796 - DNA, 26 bp, Artificial Sequence
  Description of Artificial Sequence: Synthetic oligonucleotide
tttgactgccacgtggagcacagggg

SEQ ID NO: 238797 - DNA, 25 bp, Artificial Sequence
  Description of Artificial Sequence: Synthetic oligonucleotide
ttgactgccacgtggagcacagggg

SEQ ID NO: 238798 - DNA, 24 bp, Artificial Sequence
  Description of Artificial Sequence: Synthetic oligonucleotide
tgactgccacgtggagcacagggg

SEQ ID NO: 238799 - DNA, 23 bp, Artificial Sequence
  Description of Artificial Sequence: Synthetic oligonucleotide
gactgccacgtggagcacagggg

SEQ ID NO: 238800 - DNA, 23 bp, Artificial Sequence
  Description of Artificial Sequence: Synthetic oligonucleotide
actgccacgtggagcacaggggc

SEQ ID NO: 238801 - DNA, 22 bp, Artificial Sequence
  Description of Artificial Sequence: Synthetic oligonucleotide
ctgccacgtggagcacaggggc

SEQ ID NO: 238802 - DNA, 23 bp, Artificial Sequence
  Description of Artificial Sequence: Synthetic oligonucleotide
tgccacgtggagcacaggggcct

SEQ ID NO: 238803 - DNA, 22 bp, Artificial Sequence
  Description of Artificial Sequence: Synthetic oligonucleotide
gccacgtggagcacaggggcct

SEQ ID NO: 238804 - DNA, 22 bp, Artificial Sequence
  Description of Artificial Sequence: Synthetic oligonucleotide
ccacgtggagcacaggggcctg

SEQ ID NO: 238805 - DNA, 24 bp, Artificial Sequence
  Description of Artificial Sequence: Synthetic oligonucleotide
cacgtggagcacaggggcctggtt

SEQ ID NO: 238806 - DNA, 24 bp, Artificial Sequence
  Description of Artificial Sequence: Synthetic oligonucleotide
acgtggagcacaggggcctggttg

SEQ ID NO: 238807 - DNA, 23 bp, Artificial Sequence
  Description of Artificial Sequence: Synthetic oligonucleotide
cgtggagcacaggggcctggttg

SEQ ID NO: 238808 - DNA, 23 bp, Artificial Sequence
  Description of Artificial Sequence: Synthetic oligonucleotide
gtggagcacaggggcctggttgc

SEQ ID NO: 238809 - DNA, 23 bp, Artificial Sequence
  Description of Artificial Sequence: Synthetic oligonucleotide
tggagcacaggggcctggttgcg

SEQ ID NO: 238810 - DNA, 22 bp, Artificial Sequence
  Description of Artificial Sequence: Synthetic oligonucleotide
ggagcacaggggcctggttgcg

SEQ ID NO: 238811 - DNA, 22 bp, Artificial Sequence
  Description of Artificial Sequence: Synthetic oligonucleotide
gagcacaggggcctggttgcgc

SEQ ID NO: 238812 - DNA, 23 bp, Artificial Sequence
  Description of Artificial Sequence: Synthetic oligonucleotide
agcacaggggcctggttgcgcca

SEQ ID NO: 238813 - DNA, 22 bp, Artificial Sequence
  Description of Artificial Sequence: Synthetic oligonucleotide
gcacaggggcctggttgcgcca

SEQ ID NO: 238814 - DNA, 23 bp, Artificial Sequence
  Description of Artificial Sequence: Synthetic oligonucleotide
cacaggggcctggttgcgccact

SEQ ID NO: 238815 - DNA, 23 bp, Artificial Sequence
  Description of Artificial Sequence: Synthetic oligonucleotide
acaggggcctggttgcgccactg

SEQ ID NO: 238816 - DNA, 22 bp, Artificial Sequence
  Description of Artificial Sequence: Synthetic oligonucleotide
caggggcctggttgcgccactg

SEQ ID NO: 238817 - DNA, 23 bp, Artificial Sequence
  Description of Artificial Sequence: Synthetic oligonucleotide
aggggcctggttgcgccactgct

SEQ ID NO: 238818 - DNA, 22 bp, Artificial Sequence
  Description of Artificial Sequence: Synthetic oligonucleotide
ggggcctggttgcgccactgct

SEQ ID NO: 238819 - DNA, 23 bp, Artificial Sequence
  Description of Artificial Sequence: Synthetic oligonucleotide
gggcctggttgcgccactgctca

SEQ ID NO: 238820 - DNA, 23 bp, Artificial Sequence
  Description of Artificial Sequence: Synthetic oligonucleotide
ggcctggttgcgccactgctcag

SEQ ID NO: 238821 - DNA, 23 bp, Artificial Sequence
  Description of Artificial Sequence: Synthetic oligonucleotide
gcctggttgcgccactgctcagg

SEQ ID NO: 238822 - DNA, 26 bp, Artificial Sequence
  Description of Artificial Sequence: Synthetic oligonucleotide
cctggttgcgccactgctcaggcata

SEQ ID NO: 238823 - DNA, 26 bp, Artificial Sequence
  Description of Artificial Sequence: Synthetic oligonucleotide
ctggttgcgccactgctcaggcatag

SEQ ID NO: 238824 - DNA, 26 bp, Artificial Sequence
  Description of Artificial Sequence: Synthetic oligonucleotide
tggttgcgccactgctcaggcatagg

SEQ ID NO: 238825 - DNA, 25 bp, Artificial Sequence
  Description of Artificial Sequence: Synthetic oligonucleotide
ggttgcgccactgctcaggcatagg

SEQ ID NO: 238826 - DNA, 26 bp, Artificial Sequence
  Description of Artificial Sequence: Synthetic oligonucleotide
gttgcgccactgctcaggcataggga

SEQ ID NO: 238827 - DNA, 26 bp, Artificial Sequence
  Description of Artificial Sequence: Synthetic oligonucleotide
ttgcgccactgctcaggcatagggag

SEQ ID NO: 238828 - DNA, 25 bp, Artificial Sequence
  Description of Artificial Sequence: Synthetic oligonucleotide
tgcgccactgctcaggcatagggag

SEQ ID NO: 238829 - DNA, 24 bp, Artificial Sequence
  Description of Artificial Sequence: Synthetic oligonucleotide
gcgccactgctcaggcatagggag

SEQ ID NO: 238830 - DNA, 25 bp, Artificial Sequence
  Description of Artificial Sequence: Synthetic oligonucleotide
cgccactgctcaggcatagggagct

SEQ ID NO: 238831 - DNA, 25 bp, Artificial Sequence
  Description of Artificial Sequence: Synthetic oligonucleotide
gccactgctcaggcatagggagctc

SEQ ID NO: 238832 - DNA, 26 bp, Artificial Sequence
  Description of Artificial Sequence: Synthetic oligonucleotide
ccactgctcaggcatagggagctcct

SEQ ID NO: 238833 - DNA, 26 bp, Artificial Sequence
  Description of Artificial Sequence: Synthetic oligonucleotide
cactgctcaggcatagggagctcctg

SEQ ID NO: 238834 - DNA, 27 bp, Artificial Sequence
  Description of Artificial Sequence: Synthetic oligonucleotide
actgctcaggcatagggagctcctggt

SEQ ID NO: 238835 - DNA, 26 bp, Artificial Sequence
  Description of Artificial Sequence: Synthetic oligonucleotide
ctgctcaggcatagggagctcctggt

SEQ ID NO: 238836 - DNA, 26 bp, Artificial Sequence
  Description of Artificial Sequence: Synthetic oligonucleotide
tgctcaggcatagggagctcctggtg

SEQ ID NO: 238837 - DNA, 25 bp, Artificial Sequence
  Description of Artificial Sequence: Synthetic oligonucleotide
gctcaggcatagggagctcctggtg

SEQ ID NO: 238838 - DNA, 25 bp, Artificial Sequence
  Description of Artificial Sequence: Synthetic oligonucleotide
ctcaggcatagggagctcctggtgc

SEQ ID NO: 238839 - DNA, 27 bp, Artificial Sequence
  Description of Artificial Sequence: Synthetic oligonucleotide
tcaggcatagggagctcctggtgccta

SEQ ID NO: 238840 - DNA, 27 bp, Artificial Sequence
  Description of Artificial Sequence: Synthetic oligonucleotide
caggcatagggagctcctggtgcctat

SEQ ID NO: 238841 - DNA, 28 bp, Artificial Sequence
  Description of Artificial Sequence: Synthetic oligonucleotide
aggcatagggagctcctggtgcctatac

SEQ ID NO: 238842 - DNA, 27 bp, Artificial Sequence
  Description of Artificial Sequence: Synthetic oligonucleotide
ggcatagggagctcctggtgcctatac

SEQ ID NO: 238843 - DNA, 27 bp, Artificial Sequence
  Description of Artificial Sequence: Synthetic oligonucleotide
gcatagggagctcctggtgcctatacc

SEQ ID NO: 238844 - DNA, 28 bp, Artificial Sequence
  Description of Artificial Sequence: Synthetic oligonucleotide
catagggagctcctggtgcctataccac

SEQ ID NO: 238845 - DNA, 28 bp, Artificial Sequence
  Description of Artificial Sequence: Synthetic oligonucleotide
atagggagctcctggtgcctataccacc

SEQ ID NO: 238846 - DNA, 27 bp, Artificial Sequence
  Description of Artificial Sequence: Synthetic oligonucleotide
tagggagctcctggtgcctataccacc

SEQ ID NO: 238847 - DNA, 27 bp, Artificial Sequence
  Description of Artificial Sequence: Synthetic oligonucleotide
agggagctcctggtgcctataccacca

SEQ ID NO: 238848 - DNA, 26 bp, Artificial Sequence
  Description of Artificial Sequence: Synthetic oligonucleotide
gggagctcctggtgcctataccacca

SEQ ID NO: 238849 - DNA, 26 bp, Artificial Sequence
  Description of Artificial Sequence: Synthetic oligonucleotide
ggagctcctggtgcctataccaccac

SEQ ID NO: 238850 - DNA, 27 bp, Artificial Sequence
  Description of Artificial Sequence: Synthetic oligonucleotide
gagctcctggtgcctataccaccacca

SEQ ID NO: 238851 - DNA, 27 bp, Artificial Sequence
  Description of Artificial Sequence: Synthetic oligonucleotide
agctcctggtgcctataccaccaccac

SEQ ID NO: 238852 - DNA, 27 bp, Artificial Sequence
  Description of Artificial Sequence: Synthetic oligonucleotide
gctcctggtgcctataccaccaccaca

SEQ ID NO: 238853 - DNA, 28 bp, Artificial Sequence
  Description of Artificial Sequence: Synthetic oligonucleotide
ctcctggtgcctataccaccaccacatg

SEQ ID NO: 238854 - DNA, 28 bp, Artificial Sequence
  Description of Artificial Sequence: Synthetic oligonucleotide
tcctggtgcctataccaccaccacatgc

SEQ ID NO: 238855 - DNA, 27 bp, Artificial Sequence
  Description of Artificial Sequence: Synthetic oligonucleotide
cctggtgcctataccaccaccacatgc

SEQ ID NO: 238856 - DNA, 27 bp, Artificial Sequence
  Description of Artificial Sequence: Synthetic oligonucleotide
ctggtgcctataccaccaccacatgcc

SEQ ID NO: 238857 - DNA, 29 bp, Artificial Sequence
  Description of Artificial Sequence: Synthetic oligonucleotide
tggtgcctataccaccaccacatgccatg

SEQ ID NO: 238858 - DNA, 28 bp, Artificial Sequence
  Description of Artificial Sequence: Synthetic oligonucleotide
ggtgcctataccaccaccacatgccatg

SEQ ID NO: 238859 - DNA, 28 bp, Artificial Sequence
  Description of Artificial Sequence: Synthetic oligonucleotide
gtgcctataccaccaccacatgccatgg

SEQ ID NO: 238860 - DNA, 29 bp, Artificial Sequence
  Description of Artificial Sequence: Synthetic oligonucleotide
tgcctataccaccaccacatgccatggtg

SEQ ID NO: 238861 - DNA, 28 bp, Artificial Sequence
  Description of Artificial Sequence: Synthetic oligonucleotide
gcctataccaccaccacatgccatggtg

SEQ ID NO: 238862 - DNA, 29 bp, Artificial Sequence
  Description of Artificial Sequence: Synthetic oligonucleotide
cctataccaccaccacatgccatggtgac

SEQ ID NO: 238863 - DNA, 29 bp, Artificial Sequence
  Description of Artificial Sequence: Synthetic oligonucleotide
ctataccaccaccacatgccatggtgacc

SEQ ID NO: 238864 - DNA, 29 bp, Artificial Sequence
  Description of Artificial Sequence: Synthetic oligonucleotide
tataccaccaccacatgccatggtgaccc

SEQ ID NO: 238865 - DNA, 28 bp, Artificial Sequence
  Description of Artificial Sequence: Synthetic oligonucleotide
ataccaccaccacatgccatggtgaccc

SEQ ID NO: 238866 - DNA, 27 bp, Artificial Sequence
  Description of Artificial Sequence: Synthetic oligonucleotide
taccaccaccacatgccatggtgaccc

SEQ ID NO: 238867 - DNA, 27 bp, Artificial Sequence
  Description of Artificial Sequence: Synthetic oligonucleotide
accaccaccacatgccatggtgaccct

SEQ ID NO: 238868 - DNA, 26 bp, Artificial Sequence
  Description of Artificial Sequence: Synthetic oligonucleotide
ccaccaccacatgccatggtgaccct

SEQ ID NO: 238869 - DNA, 26 bp, Artificial Sequence
  Description of Artificial Sequence: Synthetic oligonucleotide
caccaccacatgccatggtgaccctg

SEQ ID NO: 238870 - DNA, 27 bp, Artificial Sequence
  Description of Artificial Sequence: Synthetic oligonucleotide
accaccacatgccatggtgaccctggt

SEQ ID NO: 238871 - DNA, 26 bp, Artificial Sequence
  Description of Artificial Sequence: Synthetic oligonucleotide
ccaccacatgccatggtgaccctggt

SEQ ID NO: 238872 - DNA, 27 bp, Artificial Sequence
  Description of Artificial Sequence: Synthetic oligonucleotide
caccacatgccatggtgaccctggtgt

SEQ ID NO: 238873 - DNA, 27 bp, Artificial Sequence
  Description of Artificial Sequence: Synthetic oligonucleotide
accacatgccatggtgaccctggtgtg

SEQ ID NO: 238874 - DNA, 27 bp, Artificial Sequence
  Description of Artificial Sequence: Synthetic oligonucleotide
ccacatgccatggtgaccctggtgtgt

SEQ ID NO: 238875 - DNA, 27 bp, Artificial Sequence
  Description of Artificial Sequence: Synthetic oligonucleotide
cacatgccatggtgaccctggtgtgtg

SEQ ID NO: 238876 - DNA, 27 bp, Artificial Sequence
  Description of Artificial Sequence: Synthetic oligonucleotide
acatgccatggtgaccctggtgtgtgc

SEQ ID NO: 238877 - DNA, 26 bp, Artificial Sequence
  Description of Artificial Sequence: Synthetic oligonucleotide
catgccatggtgaccctggtgtgtgc

SEQ ID NO: 238878 - DNA, 26 bp, Artificial Sequence
  Description of Artificial Sequence: Synthetic oligonucleotide
atgccatggtgaccctggtgtgtgcc

SEQ ID NO: 238879 - DNA, 25 bp, Artificial Sequence
  Description of Artificial Sequence: Synthetic oligonucleotide
tgccatggtgaccctggtgtgtgcc

SEQ ID NO: 238880 - DNA, 24 bp, Artificial Sequence
  Description of Artificial Sequence: Synthetic oligonucleotide
gccatggtgaccctggtgtgtgcc

SEQ ID NO: 238881 - DNA, 25 bp, Artificial Sequence
  Description of Artificial Sequence: Synthetic oligonucleotide
ccatggtgaccctggtgtgtgccct

SEQ ID NO: 238882 - DNA, 25 bp, Artificial Sequence
  Description of Artificial Sequence: Synthetic oligonucleotide
catggtgaccctggtgtgtgccctg

SEQ ID NO: 238883 - DNA, 25 bp, Artificial Sequence
  Description of Artificial Sequence: Synthetic oligonucleotide
atggtgaccctggtgtgtgccctgc

SEQ ID NO: 238884 - DNA, 24 bp, Artificial Sequence
  Description of Artificial Sequence: Synthetic oligonucleotide
tggtgaccctggtgtgtgccctgc

SEQ ID NO: 238885 - DNA, 23 bp, Artificial Sequence
  Description of Artificial Sequence: Synthetic oligonucleotide
ggtgaccctggtgtgtgccctgc

SEQ ID NO: 238886 - DNA, 24 bp, Artificial Sequence
  Description of Artificial Sequence: Synthetic oligonucleotide
gtgaccctggtgtgtgccctgcgt

SEQ ID NO: 238887 - DNA, 25 bp, Artificial Sequence
  Description of Artificial Sequence: Synthetic oligonucleotide
tgaccctggtgtgtgccctgcgtct

SEQ ID NO: 238888 - DNA, 24 bp, Artificial Sequence
  Description of Artificial Sequence: Synthetic oligonucleotide
gaccctggtgtgtgccctgcgtct

SEQ ID NO: 238889 - DNA, 24 bp, Artificial Sequence
  Description of Artificial Sequence: Synthetic oligonucleotide
accctggtgtgtgccctgcgtctg

SEQ ID NO: 238890 - DNA, 23 bp, Artificial Sequence
  Description of Artificial Sequence: Synthetic oligonucleotide
ccctggtgtgtgccctgcgtctg

SEQ ID NO: 238891 - DNA, 23 bp, Artificial Sequence
  Description of Artificial Sequence: Synthetic oligonucleotide
cctggtgtgtgccctgcgtctgg

SEQ ID NO: 238892 - DNA, 23 bp, Artificial Sequence
  Description of Artificial Sequence: Synthetic oligonucleotide
ctggtgtgtgccctgcgtctggc

SEQ ID NO: 238893 - DNA, 25 bp, Artificial Sequence
  Description of Artificial Sequence: Synthetic oligonucleotide
tggtgtgtgccctgcgtctggccaa

SEQ ID NO: 238894 - DNA, 24 bp, Artificial Sequence
  Description of Artificial Sequence: Synthetic oligonucleotide
ggtgtgtgccctgcgtctggccaa

SEQ ID NO: 238895 - DNA, 24 bp, Artificial Sequence
  Description of Artificial Sequence: Synthetic oligonucleotide
gtgtgtgccctgcgtctggccaac

SEQ ID NO: 238896 - DNA, 24 bp, Artificial Sequence
  Description of Artificial Sequence: Synthetic oligonucleotide
tgtgtgccctgcgtctggccaacg

SEQ ID NO: 238897 - DNA, 23 bp, Artificial Sequence
  Description of Artificial Sequence: Synthetic oligonucleotide
gtgtgccctgcgtctggccaacg

SEQ ID NO: 238898 - DNA, 23 bp, Artificial Sequence
  Description of Artificial Sequence: Synthetic oligonucleotide
tgtgccctgcgtctggccaacgg

SEQ ID NO: 238899 - DNA, 22 bp, Artificial Sequence
  Description of Artificial Sequence: Synthetic oligonucleotide
gtgccctgcgtctggccaacgg

SEQ ID NO: 238900 - DNA, 22 bp, Artificial Sequence
  Description of Artificial Sequence: Synthetic oligonucleotide
tgccctgcgtctggccaacggc

SEQ ID NO: 238901 - DNA, 21 bp, Artificial Sequence
  Description of Artificial Sequence: Synthetic oligonucleotide
gccctgcgtctggccaacggc

SEQ ID NO: 238902 - DNA, 22 bp, Artificial Sequence
  Description of Artificial Sequence: Synthetic oligonucleotide
ccctgcgtctggccaacggcct

SEQ ID NO: 238903 - DNA, 22 bp, Artificial Sequence
  Description of Artificial Sequence: Synthetic oligonucleotide
cctgcgtctggccaacggcctg

SEQ ID NO: 238904 - DNA, 23 bp, Artificial Sequence
  Description of Artificial Sequence: Synthetic oligonucleotide
ctgcgtctggccaacggcctggt

SEQ ID NO: 238905 - DNA, 23 bp, Artificial Sequence
  Description of Artificial Sequence: Synthetic oligonucleotide
tgcgtctggccaacggcctggtc

SEQ ID NO: 238906 - DNA, 22 bp, Artificial Sequence
  Description of Artificial Sequence: Synthetic oligonucleotide
gcgtctggccaacggcctggtc

SEQ ID NO: 238907 - DNA, 22 bp, Artificial Sequence
  Description of Artificial Sequence: Synthetic oligonucleotide
cgtctggccaacggcctggtcg

SEQ ID NO: 238908 - DNA, 22 bp, Artificial Sequence
  Description of Artificial Sequence: Synthetic oligonucleotide
gtctggccaacggcctggtcgg

SEQ ID NO: 238909 - DNA, 24 bp, Artificial Sequence
  Description of Artificial Sequence: Synthetic oligonucleotide
tctggccaacggcctggtcggctt

SEQ ID NO: 238910 - DNA, 23 bp, Artificial Sequence
  Description of Artificial Sequence: Synthetic oligonucleotide
ctggccaacggcctggtcggctt

SEQ ID NO: 238911 - DNA, 23 bp, Artificial Sequence
  Description of Artificial Sequence: Synthetic oligonucleotide
tggccaacggcctggtcggcttc

SEQ ID NO: 238912 - DNA, 22 bp, Artificial Sequence
  Description of Artificial Sequence: Synthetic oligonucleotide
ggccaacggcctggtcggcttc

SEQ ID NO: 238913 - DNA, 23 bp, Artificial Sequence
  Description of Artificial Sequence: Synthetic oligonucleotide
gccaacggcctggtcggcttcct

SEQ ID NO: 238914 - DNA, 23 bp, Artificial Sequence
  Description of Artificial Sequence: Synthetic oligonucleotide
ccaacggcctggtcggcttcctc

SEQ ID NO: 238915 - DNA, 24 bp, Artificial Sequence
  Description of Artificial Sequence: Synthetic oligonucleotide
caacggcctggtcggcttcctcct

SEQ ID NO: 238916 - DNA, 24 bp, Artificial Sequence
  Description of Artificial Sequence: Synthetic oligonucleotide
aacggcctggtcggcttcctcctg

SEQ ID NO: 238917 - DNA, 23 bp, Artificial Sequence
  Description of Artificial Sequence: Synthetic oligonucleotide
acggcctggtcggcttcctcctg

SEQ ID NO: 238918 - DNA, 22 bp, Artificial Sequence
  Description of Artificial Sequence: Synthetic oligonucleotide
cggcctggtcggcttcctcctg

SEQ ID NO: 238919 - DNA, 22 bp, Artificial Sequence
  Description of Artificial Sequence: Synthetic oligonucleotide
ggcctggtcggcttcctcctgg

SEQ ID NO: 238920 - DNA, 22 bp, Artificial Sequence
  Description of Artificial Sequence: Synthetic oligonucleotide
gcctggtcggcttcctcctggg

SEQ ID NO: 238921 - DNA, 23 bp, Artificial Sequence
  Description of Artificial Sequence: Synthetic oligonucleotide
cctggtcggcttcctcctgggca

SEQ ID NO: 238922 - DNA, 23 bp, Artificial Sequence
  Description of Artificial Sequence: Synthetic oligonucleotide
ctggtcggcttcctcctgggcac

SEQ ID NO: 238923 - DNA, 23 bp, Artificial Sequence
  Description of Artificial Sequence: Synthetic oligonucleotide
tggtcggcttcctcctgggcacc

SEQ ID NO: 238924 - DNA, 22 bp, Artificial Sequence
  Description of Artificial Sequence: Synthetic oligonucleotide
ggtcggcttcctcctgggcacc

SEQ ID NO: 238925 - DNA, 23 bp, Artificial Sequence
  Description of Artificial Sequence: Synthetic oligonucleotide
gtcggcttcctcctgggcaccga

SEQ ID NO: 238926 - DNA, 23 bp, Artificial Sequence
  Description of Artificial Sequence: Synthetic oligonucleotide
tcggcttcctcctgggcaccgac

SEQ ID NO: 238927 - DNA, 22 bp, Artificial Sequence
  Description of Artificial Sequence: Synthetic oligonucleotide
cggcttcctcctgggcaccgac

SEQ ID NO: 238928 - DNA, 23 bp, Artificial Sequence
  Description of Artificial Sequence: Synthetic oligonucleotide
ggcttcctcctgggcaccgacct

SEQ ID NO: 238929 - DNA, 25 bp, Artificial Sequence
  Description of Artificial Sequence: Synthetic oligonucleotide
gcttcctcctgggcaccgacctcat

SEQ ID NO: 238930 - DNA, 27 bp, Artificial Sequence
  Description of Artificial Sequence: Synthetic oligonucleotide
cttcctcctgggcaccgacctcatcat

SEQ ID NO: 238931 - DNA, 27 bp, Artificial Sequence
  Description of Artificial Sequence: Synthetic oligonucleotide
ttcctcctgggcaccgacctcatcatg

SEQ ID NO: 238932 - DNA, 27 bp, Artificial Sequence
  Description of Artificial Sequence: Synthetic oligonucleotide
tcctcctgggcaccgacctcatcatga

SEQ ID NO: 238933 - DNA, 27 bp, Artificial Sequence
  Description of Artificial Sequence: Synthetic oligonucleotide
cctcctgggcaccgacctcatcatgat

SEQ ID NO: 238934 - DNA, 27 bp, Artificial Sequence
  Description of Artificial Sequence: Synthetic oligonucleotide
ctcctgggcaccgacctcatcatgatg

SEQ ID NO: 238935 - DNA, 27 bp, Artificial Sequence
  Description of Artificial Sequence: Synthetic oligonucleotide
tcctgggcaccgacctcatcatgatgg

SEQ ID NO: 238936 - DNA, 26 bp, Artificial Sequence
  Description of Artificial Sequence: Synthetic oligonucleotide
cctgggcaccgacctcatcatgatgg

SEQ ID NO: 238937 - DNA, 26 bp, Artificial Sequence
  Description of Artificial Sequence: Synthetic oligonucleotide
ctgggcaccgacctcatcatgatggg

SEQ ID NO: 238938 - DNA, 27 bp, Artificial Sequence
  Description of Artificial Sequence: Synthetic oligonucleotide
tgggcaccgacctcatcatgatgggca

SEQ ID NO: 238939 - DNA, 26 bp, Artificial Sequence
  Description of Artificial Sequence: Synthetic oligonucleotide
gggcaccgacctcatcatgatgggca

SEQ ID NO: 238940 - DNA, 27 bp, Artificial Sequence
  Description of Artificial Sequence: Synthetic oligonucleotide
ggcaccgacctcatcatgatgggcaca

SEQ ID NO: 238941 - DNA, 30 bp, Artificial Sequence
  Description of Artificial Sequence: Synthetic oligonucleotide
gcaccgacctcatcatgatgggcacaaatg

SEQ ID NO: 238942 - DNA, 31 bp, Artificial Sequence
  Description of Artificial Sequence: Synthetic oligonucleotide
caccgacctcatcatgatgggcacaaatgtg

SEQ ID NO: 238943 - DNA, 32 bp, Artificial Sequence
  Description of Artificial Sequence: Synthetic oligonucleotide
accgacctcatcatgatgggcacaaatgtgtc

SEQ ID NO: 238944 - DNA, 31 bp, Artificial Sequence
  Description of Artificial Sequence: Synthetic oligonucleotide
ccgacctcatcatgatgggcacaaatgtgtc

SEQ ID NO: 238945 - DNA, 31 bp, Artificial Sequence
  Description of Artificial Sequence: Synthetic oligonucleotide
cgacctcatcatgatgggcacaaatgtgtcc

SEQ ID NO: 238946 - DNA, 32 bp, Artificial Sequence
  Description of Artificial Sequence: Synthetic oligonucleotide
gacctcatcatgatgggcacaaatgtgtccac

SEQ ID NO: 238947 - DNA, 33 bp, Artificial Sequence
  Description of Artificial Sequence: Synthetic oligonucleotide
acctcatcatgatgggcacaaatgtgtccactg

SEQ ID NO: 238948 - DNA, 32 bp, Artificial Sequence
  Description of Artificial Sequence: Synthetic oligonucleotide
cctcatcatgatgggcacaaatgtgtccactg

SEQ ID NO: 238949 - DNA, 33 bp, Artificial Sequence
  Description of Artificial Sequence: Synthetic oligonucleotide
ctcatcatgatgggcacaaatgtgtccactgtc

SEQ ID NO: 238950 - DNA, 33 bp, Artificial Sequence
  Description of Artificial Sequence: Synthetic oligonucleotide
tcatcatgatgggcacaaatgtgtccactgtcc

SEQ ID NO: 238951 - DNA, 32 bp, Artificial Sequence
  Description of Artificial Sequence: Synthetic oligonucleotide
catcatgatgggcacaaatgtgtccactgtcc

SEQ ID NO: 238952 - DNA, 32 bp, Artificial Sequence
  Description of Artificial Sequence: Synthetic oligonucleotide
atcatgatgggcacaaatgtgtccactgtccc

SEQ ID NO: 238953 - DNA, 31 bp, Artificial Sequence
  Description of Artificial Sequence: Synthetic oligonucleotide
tcatgatgggcacaaatgtgtccactgtccc

SEQ ID NO: 238954 - DNA, 30 bp, Artificial Sequence
  Description of Artificial Sequence: Synthetic oligonucleotide
catgatgggcacaaatgtgtccactgtccc

SEQ ID NO: 238955 - DNA, 30 bp, Artificial Sequence
  Description of Artificial Sequence: Synthetic oligonucleotide
atgatgggcacaaatgtgtccactgtcccc

SEQ ID NO: 238956 - DNA, 29 bp, Artificial Sequence
  Description of Artificial Sequence: Synthetic oligonucleotide
tgatgggcacaaatgtgtccactgtcccc

SEQ ID NO: 238957 - DNA, 28 bp, Artificial Sequence
  Description of Artificial Sequence: Synthetic oligonucleotide
gatgggcacaaatgtgtccactgtcccc

SEQ ID NO: 238958 - DNA, 29 bp, Artificial Sequence
  Description of Artificial Sequence: Synthetic oligonucleotide
atgggcacaaatgtgtccactgtccccag

SEQ ID NO: 238959 - DNA, 28 bp, Artificial Sequence
  Description of Artificial Sequence: Synthetic oligonucleotide
tgggcacaaatgtgtccactgtccccag

SEQ ID NO: 238960 - DNA, 27 bp, Artificial Sequence
  Description of Artificial Sequence: Synthetic oligonucleotide
gggcacaaatgtgtccactgtccccag

SEQ ID NO: 238961 - DNA, 27 bp, Artificial Sequence
  Description of Artificial Sequence: Synthetic oligonucleotide
ggcacaaatgtgtccactgtccccagc

SEQ ID NO: 238962 - DNA, 31 bp, Artificial Sequence
  Description of Artificial Sequence: Synthetic oligonucleotide
gcacaaatgtgtccactgtccccagctaatg

SEQ ID NO: 238963 - DNA, 33 bp, Artificial Sequence
  Description of Artificial Sequence: Synthetic oligonucleotide
cacaaatgtgtccactgtccccagctaatgatc

SEQ ID NO: 238964 - DNA, 33 bp, Artificial Sequence
  Description of Artificial Sequence: Synthetic oligonucleotide
acaaatgtgtccactgtccccagctaatgatcc

SEQ ID NO: 238965 - DNA, 32 bp, Artificial Sequence
  Description of Artificial Sequence: Synthetic oligonucleotide
caaatgtgtccactgtccccagctaatgatcc

SEQ ID NO: 238966 - DNA, 34 bp, Artificial Sequence
  Description of Artificial Sequence: Synthetic oligonucleotide
aaatgtgtccactgtccccagctaatgatccatc

SEQ ID NO: 238967 - DNA, 33 bp, Artificial Sequence
  Description of Artificial Sequence: Synthetic oligonucleotide
aatgtgtccactgtccccagctaatgatccatc

SEQ ID NO: 238968 - DNA, 32 bp, Artificial Sequence
  Description of Artificial Sequence: Synthetic oligonucleotide
atgtgtccactgtccccagctaatgatccatc

SEQ ID NO: 238969 - DNA, 31 bp, Artificial Sequence
  Description of Artificial Sequence: Synthetic oligonucleotide
tgtgtccactgtccccagctaatgatccatc

SEQ ID NO: 238970 - DNA, 30 bp, Artificial Sequence
  Description of Artificial Sequence: Synthetic oligonucleotide
gtgtccactgtccccagctaatgatccatc

SEQ ID NO: 238971 - DNA, 31 bp, Artificial Sequence
  Description of Artificial Sequence: Synthetic oligonucleotide
tgtccactgtccccagctaatgatccatctg

SEQ ID NO: 238972 - DNA, 30 bp, Artificial Sequence
  Description of Artificial Sequence: Synthetic oligonucleotide
gtccactgtccccagctaatgatccatctg

SEQ ID NO: 238973 - DNA, 31 bp, Artificial Sequence
  Description of Artificial Sequence: Synthetic oligonucleotide
tccactgtccccagctaatgatccatctgag

SEQ ID NO: 238974 - DNA, 30 bp, Artificial Sequence
  Description of Artificial Sequence: Synthetic oligonucleotide
ccactgtccccagctaatgatccatctgag

SEQ ID NO: 238975 - DNA, 31 bp, Artificial Sequence
  Description of Artificial Sequence: Synthetic oligonucleotide
cactgtccccagctaatgatccatctgagag

SEQ ID NO: 238976 - DNA, 35 bp, Artificial Sequence
  Description of Artificial Sequence: Synthetic oligonucleotide
actgtccccagctaatgatccatctgagagatatg

SEQ ID NO: 238977 - DNA, 34 bp, Artificial Sequence
  Description of Artificial Sequence: Synthetic oligonucleotide
ctgtccccagctaatgatccatctgagagatatg

SEQ ID NO: 238978 - DNA, 35 bp, Artificial Sequence
  Description of Artificial Sequence: Synthetic oligonucleotide
tgtccccagctaatgatccatctgagagatatgac

SEQ ID NO: 238979 - DNA, 34 bp, Artificial Sequence
  Description of Artificial Sequence: Synthetic oligonucleotide
gtccccagctaatgatccatctgagagatatgac

SEQ ID NO: 238980 - DNA, 36 bp, Artificial Sequence
  Description of Artificial Sequence: Synthetic oligonucleotide
tccccagctaatgatccatctgagagatatgacttg

SEQ ID NO: 238981 - DNA, 35 bp, Artificial Sequence
  Description of Artificial Sequence: Synthetic oligonucleotide
ccccagctaatgatccatctgagagatatgacttg

SEQ ID NO: 238982 - DNA, 36 bp, Artificial Sequence
  Description of Artificial Sequence: Synthetic oligonucleotide
cccagctaatgatccatctgagagatatgacttgtc

SEQ ID NO: 238983 - DNA, 36 bp, Artificial Sequence
  Description of Artificial Sequence: Synthetic oligonucleotide
ccagctaatgatccatctgagagatatgacttgtcg

SEQ ID NO: 238984 - DNA, 36 bp, Artificial Sequence
  Description of Artificial Sequence: Synthetic oligonucleotide
cagctaatgatccatctgagagatatgacttgtcgg

SEQ ID NO: 238985 - DNA, 37 bp, Artificial Sequence
  Description of Artificial Sequence: Synthetic oligonucleotide
agctaatgatccatctgagagatatgacttgtcggag

SEQ ID NO: 238986 - DNA, 36 bp, Artificial Sequence
  Description of Artificial Sequence: Synthetic oligonucleotide
gctaatgatccatctgagagatatgacttgtcggag

SEQ ID NO: 238987 - DNA, 37 bp, Artificial Sequence
  Description of Artificial Sequence: Synthetic oligonucleotide
ctaatgatccatctgagagatatgacttgtcggagac

SEQ ID NO: 238988 - DNA, 38 bp, Artificial Sequence
  Description of Artificial Sequence: Synthetic oligonucleotide
taatgatccatctgagagatatgacttgtcggagacac

SEQ ID NO: 238989 - DNA, 37 bp, Artificial Sequence
  Description of Artificial Sequence: Synthetic oligonucleotide
aatgatccatctgagagatatgacttgtcggagacac

SEQ ID NO: 238990 - DNA, 36 bp, Artificial Sequence
  Description of Artificial Sequence: Synthetic oligonucleotide
atgatccatctgagagatatgacttgtcggagacac

SEQ ID NO: 238991 - DNA, 35 bp, Artificial Sequence
  Description of Artificial Sequence: Synthetic oligonucleotide
tgatccatctgagagatatgacttgtcggagacac

SEQ ID NO: 238992 - DNA, 34 bp, Artificial Sequence
  Description of Artificial Sequence: Synthetic oligonucleotide
gatccatctgagagatatgacttgtcggagacac

SEQ ID NO: 238993 - DNA, 34 bp, Artificial Sequence
  Description of Artificial Sequence: Synthetic oligonucleotide
atccatctgagagatatgacttgtcggagacacc

SEQ ID NO: 238994 - DNA, 33 bp, Artificial Sequence
  Description of Artificial Sequence: Synthetic oligonucleotide
tccatctgagagatatgacttgtcggagacacc

SEQ ID NO: 238995 - DNA, 32 bp, Artificial Sequence
  Description of Artificial Sequence: Synthetic oligonucleotide
ccatctgagagatatgacttgtcggagacacc

SEQ ID NO: 238996 - DNA, 32 bp, Artificial Sequence
  Description of Artificial Sequence: Synthetic oligonucleotide
catctgagagatatgacttgtcggagacaccg

SEQ ID NO: 238997 - DNA, 33 bp, Artificial Sequence
  Description of Artificial Sequence: Synthetic oligonucleotide
atctgagagatatgacttgtcggagacaccgtg

SEQ ID NO: 238998 - DNA, 32 bp, Artificial Sequence
  Description of Artificial Sequence: Synthetic oligonucleotide
tctgagagatatgacttgtcggagacaccgtg

SEQ ID NO: 238999 - DNA, 31 bp, Artificial Sequence
  Description of Artificial Sequence: Synthetic oligonucleotide
ctgagagatatgacttgtcggagacaccgtg

SEQ ID NO: 239000 - DNA, 31 bp, Artificial Sequence
  Description of Artificial Sequence: Synthetic oligonucleotide
tgagagatatgacttgtcggagacaccgtgc

SEQ ID NO: 239001 - DNA, 30 bp, Artificial Sequence
  Description of Artificial Sequence: Synthetic oligonucleotide
gagagatatgacttgtcggagacaccgtgc

SEQ ID NO: 239002 - DNA, 31 bp, Artificial Sequence
  Description of Artificial Sequence: Synthetic oligonucleotide
agagatatgacttgtcggagacaccgtgcag

SEQ ID NO: 239003 - DNA, 30 bp, Artificial Sequence
  Description of Artificial Sequence: Synthetic oligonucleotide
gagatatgacttgtcggagacaccgtgcag

SEQ ID NO: 239004 - DNA, 32 bp, Artificial Sequence
  Description of Artificial Sequence: Synthetic oligonucleotide
agatatgacttgtcggagacaccgtgcagatc

SEQ ID NO: 239005 - DNA, 31 bp, Artificial Sequence
  Description of Artificial Sequence: Synthetic oligonucleotide
gatatgacttgtcggagacaccgtgcagatc

SEQ ID NO: 239006 - DNA, 31 bp, Artificial Sequence
  Description of Artificial Sequence: Synthetic oligonucleotide
atatgacttgtcggagacaccgtgcagatcc

SEQ ID NO: 239007 - DNA, 30 bp, Artificial Sequence
  Description of Artificial Sequence: Synthetic oligonucleotide
tatgacttgtcggagacaccgtgcagatcc

SEQ ID NO: 239008 - DNA, 29 bp, Artificial Sequence
  Description of Artificial Sequence: Synthetic oligonucleotide
atgacttgtcggagacaccgtgcagatcc

SEQ ID NO: 239009 - DNA, 28 bp, Artificial Sequence
  Description of Artificial Sequence: Synthetic oligonucleotide
tgacttgtcggagacaccgtgcagatcc

SEQ ID NO: 239010 - DNA, 27 bp, Artificial Sequence
  Description of Artificial Sequence: Synthetic oligonucleotide
gacttgtcggagacaccgtgcagatcc

SEQ ID NO: 239011 - DNA, 28 bp, Artificial Sequence
  Description of Artificial Sequence: Synthetic oligonucleotide
acttgtcggagacaccgtgcagatccac

SEQ ID NO: 239012 - DNA, 27 bp, Artificial Sequence
  Description of Artificial Sequence: Synthetic oligonucleotide
cttgtcggagacaccgtgcagatccac

SEQ ID NO: 239013 - DNA, 29 bp, Artificial Sequence
  Description of Artificial Sequence: Synthetic oligonucleotide
ttgtcggagacaccgtgcagatccacatg

SEQ ID NO: 239014 - DNA, 28 bp, Artificial Sequence
  Description of Artificial Sequence: Synthetic oligonucleotide
tgtcggagacaccgtgcagatccacatg

SEQ ID NO: 239015 - DNA, 27 bp, Artificial Sequence
  Description of Artificial Sequence: Synthetic oligonucleotide
gtcggagacaccgtgcagatccacatg

SEQ ID NO: 239016 - DNA, 27 bp, Artificial Sequence
  Description of Artificial Sequence: Synthetic oligonucleotide
tcggagacaccgtgcagatccacatgg

SEQ ID NO: 239017 - DNA, 26 bp, Artificial Sequence
  Description of Artificial Sequence: Synthetic oligonucleotide
cggagacaccgtgcagatccacatgg

SEQ ID NO: 239018 - DNA, 27 bp, Artificial Sequence
  Description of Artificial Sequence: Synthetic oligonucleotide
ggagacaccgtgcagatccacatgggt

SEQ ID NO: 239019 - DNA, 29 bp, Artificial Sequence
  Description of Artificial Sequence: Synthetic oligonucleotide
gagacaccgtgcagatccacatgggtttc

SEQ ID NO: 239020 - DNA, 30 bp, Artificial Sequence
  Description of Artificial Sequence: Synthetic oligonucleotide
agacaccgtgcagatccacatgggtttctg

SEQ ID NO: 239021 - DNA, 29 bp, Artificial Sequence
  Description of Artificial Sequence: Synthetic oligonucleotide
gacaccgtgcagatccacatgggtttctg

SEQ ID NO: 239022 - DNA, 30 bp, Artificial Sequence
  Description of Artificial Sequence: Synthetic oligonucleotide
acaccgtgcagatccacatgggtttctgac

SEQ ID NO: 239023 - DNA, 29 bp, Artificial Sequence
  Description of Artificial Sequence: Synthetic oligonucleotide
caccgtgcagatccacatgggtttctgac

SEQ ID NO: 239024 - DNA, 30 bp, Artificial Sequence
  Description of Artificial Sequence: Synthetic oligonucleotide
accgtgcagatccacatgggtttctgacag

SEQ ID NO: 239025 - DNA, 29 bp, Artificial Sequence
  Description of Artificial Sequence: Synthetic oligonucleotide
ccgtgcagatccacatgggtttctgacag

SEQ ID NO: 239026 - DNA, 29 bp, Artificial Sequence
  Description of Artificial Sequence: Synthetic oligonucleotide
cgtgcagatccacatgggtttctgacagc

SEQ ID NO: 239027 - DNA, 29 bp, Artificial Sequence
  Description of Artificial Sequence: Synthetic oligonucleotide
gtgcagatccacatgggtttctgacagcc

SEQ ID NO: 239028 - DNA, 29 bp, Artificial Sequence
  Description of Artificial Sequence: Synthetic oligonucleotide
tgcagatccacatgggtttctgacagccc

SEQ ID NO: 239029 - DNA, 28 bp, Artificial Sequence
  Description of Artificial Sequence: Synthetic oligonucleotide
gcagatccacatgggtttctgacagccc

SEQ ID NO: 239030 - DNA, 28 bp, Artificial Sequence
  Description of Artificial Sequence: Synthetic oligonucleotide
cagatccacatgggtttctgacagcccg

SEQ ID NO: 239031 - DNA, 29 bp, Artificial Sequence
  Description of Artificial Sequence: Synthetic oligonucleotide
agatccacatgggtttctgacagcccgtg

SEQ ID NO: 239032 - DNA, 28 bp, Artificial Sequence
  Description of Artificial Sequence: Synthetic oligonucleotide
gatccacatgggtttctgacagcccgtg

SEQ ID NO: 239033 - DNA, 28 bp, Artificial Sequence
  Description of Artificial Sequence: Synthetic oligonucleotide
atccacatgggtttctgacagcccgtgc

SEQ ID NO: 239034 - DNA, 27 bp, Artificial Sequence
  Description of Artificial Sequence: Synthetic oligonucleotide
tccacatgggtttctgacagcccgtgc

SEQ ID NO: 239035 - DNA, 26 bp, Artificial Sequence
  Description of Artificial Sequence: Synthetic oligonucleotide
ccacatgggtttctgacagcccgtgc

SEQ ID NO: 239036 - DNA, 27 bp, Artificial Sequence
  Description of Artificial Sequence: Synthetic oligonucleotide
cacatgggtttctgacagcccgtgcgt

SEQ ID NO: 239037 - DNA, 27 bp, Artificial Sequence
  Description of Artificial Sequence: Synthetic oligonucleotide
acatgggtttctgacagcccgtgcgtg

SEQ ID NO: 239038 - DNA, 26 bp, Artificial Sequence
  Description of Artificial Sequence: Synthetic oligonucleotide
catgggtttctgacagcccgtgcgtg

SEQ ID NO: 239039 - DNA, 27 bp, Artificial Sequence
  Description of Artificial Sequence: Synthetic oligonucleotide
atgggtttctgacagcccgtgcgtgct

SEQ ID NO: 239040 - DNA, 26 bp, Artificial Sequence
  Description of Artificial Sequence: Synthetic oligonucleotide
tgggtttctgacagcccgtgcgtgct

SEQ ID NO: 239041 - DNA, 25 bp, Artificial Sequence
  Description of Artificial Sequence: Synthetic oligonucleotide
gggtttctgacagcccgtgcgtgct

SEQ ID NO: 239042 - DNA, 26 bp, Artificial Sequence
  Description of Artificial Sequence: Synthetic oligonucleotide
ggtttctgacagcccgtgcgtgctct

SEQ ID NO: 239043 - DNA, 27 bp, Artificial Sequence
  Description of Artificial Sequence: Synthetic oligonucleotide
gtttctgacagcccgtgcgtgctctgt

SEQ ID NO: 239044 - DNA, 27 bp, Artificial Sequence
  Description of Artificial Sequence: Synthetic oligonucleotide
tttctgacagcccgtgcgtgctctgtg

SEQ ID NO: 239045 - DNA, 26 bp, Artificial Sequence
  Description of Artificial Sequence: Synthetic oligonucleotide
ttctgacagcccgtgcgtgctctgtg

SEQ ID NO: 239046 - DNA, 25 bp, Artificial Sequence
  Description of Artificial Sequence: Synthetic oligonucleotide
tctgacagcccgtgcgtgctctgtg

SEQ ID NO: 239047 - DNA, 24 bp, Artificial Sequence
  Description of Artificial Sequence: Synthetic oligonucleotide
ctgacagcccgtgcgtgctctgtg

SEQ ID NO: 239048 - DNA, 24 bp, Artificial Sequence
  Description of Artificial Sequence: Synthetic oligonucleotide
tgacagcccgtgcgtgctctgtgc

SEQ ID NO: 239049 - DNA, 23 bp, Artificial Sequence
  Description of Artificial Sequence: Synthetic oligonucleotide
gacagcccgtgcgtgctctgtgc

SEQ ID NO: 239050 - DNA, 23 bp, Artificial Sequence
  Description of Artificial Sequence: Synthetic oligonucleotide
acagcccgtgcgtgctctgtgcc

SEQ ID NO: 239051 - DNA, 22 bp, Artificial Sequence
  Description of Artificial Sequence: Synthetic oligonucleotide
cagcccgtgcgtgctctgtgcc

SEQ ID NO: 239052 - DNA, 27 bp, Artificial Sequence
  Description of Artificial Sequence: Synthetic oligonucleotide
agcccgtgcgtgctctgtgccctttta

SEQ ID NO: 239053 - DNA, 26 bp, Artificial Sequence
  Description of Artificial Sequence: Synthetic oligonucleotide
gcccgtgcgtgctctgtgccctttta

SEQ ID NO: 239054 - DNA, 27 bp, Artificial Sequence
  Description of Artificial Sequence: Synthetic oligonucleotide
cccgtgcgtgctctgtgcccttttagt

SEQ ID NO: 239055 - DNA, 27 bp, Artificial Sequence
  Description of Artificial Sequence: Synthetic oligonucleotide
ccgtgcgtgctctgtgcccttttagtg

SEQ ID NO: 239056 - DNA, 27 bp, Artificial Sequence
  Description of Artificial Sequence: Synthetic oligonucleotide
cgtgcgtgctctgtgcccttttagtgc

SEQ ID NO: 239057 - DNA, 29 bp, Artificial Sequence
  Description of Artificial Sequence: Synthetic oligonucleotide
gtgcgtgctctgtgcccttttagtgcatc

SEQ ID NO: 239058 - DNA, 29 bp, Artificial Sequence
  Description of Artificial Sequence: Synthetic oligonucleotide
tgcgtgctctgtgcccttttagtgcatcc

SEQ ID NO: 239059 - DNA, 28 bp, Artificial Sequence
  Description of Artificial Sequence: Synthetic oligonucleotide
gcgtgctctgtgcccttttagtgcatcc

SEQ ID NO: 239060 - DNA, 28 bp, Artificial Sequence
  Description of Artificial Sequence: Synthetic oligonucleotide
cgtgctctgtgcccttttagtgcatccg

SEQ ID NO: 239061 - DNA, 28 bp, Artificial Sequence
  Description of Artificial Sequence: Synthetic oligonucleotide
gtgctctgtgcccttttagtgcatccgg

SEQ ID NO: 239062 - DNA, 28 bp, Artificial Sequence
  Description of Artificial Sequence: Synthetic oligonucleotide
tgctctgtgcccttttagtgcatccggc

SEQ ID NO: 239063 - DNA, 27 bp, Artificial Sequence
  Description of Artificial Sequence: Synthetic oligonucleotide
gctctgtgcccttttagtgcatccggc

SEQ ID NO: 239064 - DNA, 28 bp, Artificial Sequence
  Description of Artificial Sequence: Synthetic oligonucleotide
ctctgtgcccttttagtgcatccggctg

SEQ ID NO: 239065 - DNA, 29 bp, Artificial Sequence
  Description of Artificial Sequence: Synthetic oligonucleotide
tctgtgcccttttagtgcatccggctgtg

SEQ ID NO: 239066 - DNA, 28 bp, Artificial Sequence
  Description of Artificial Sequence: Synthetic oligonucleotide
ctgtgcccttttagtgcatccggctgtg

SEQ ID NO: 239067 - DNA, 28 bp, Artificial Sequence
  Description of Artificial Sequence: Synthetic oligonucleotide
tgtgcccttttagtgcatccggctgtgc

SEQ ID NO: 239068 - DNA, 27 bp, Artificial Sequence
  Description of Artificial Sequence: Synthetic oligonucleotide
gtgcccttttagtgcatccggctgtgc

SEQ ID NO: 239069 - DNA, 28 bp, Artificial Sequence
  Description of Artificial Sequence: Synthetic oligonucleotide
tgcccttttagtgcatccggctgtgctg

SEQ ID NO: 239070 - DNA, 27 bp, Artificial Sequence
  Description of Artificial Sequence: Synthetic oligonucleotide
gcccttttagtgcatccggctgtgctg

SEQ ID NO: 239071 - DNA, 28 bp, Artificial Sequence
  Description of Artificial Sequence: Synthetic oligonucleotide
cccttttagtgcatccggctgtgctgtc

SEQ ID NO: 239072 - DNA, 31 bp, Artificial Sequence
  Description of Artificial Sequence: Synthetic oligonucleotide
ccttttagtgcatccggctgtgctgtctttg

SEQ ID NO: 239073 - DNA, 32 bp, Artificial Sequence
  Description of Artificial Sequence: Synthetic oligonucleotide
cttttagtgcatccggctgtgctgtctttgag

SEQ ID NO: 239074 - DNA, 33 bp, Artificial Sequence
  Description of Artificial Sequence: Synthetic oligonucleotide
ttttagtgcatccggctgtgctgtctttgagtg

SEQ ID NO: 239075 - DNA, 32 bp, Artificial Sequence
  Description of Artificial Sequence: Synthetic oligonucleotide
tttagtgcatccggctgtgctgtctttgagtg

SEQ ID NO: 239076 - DNA, 31 bp, Artificial Sequence
  Description of Artificial Sequence: Synthetic oligonucleotide
ttagtgcatccggctgtgctgtctttgagtg

SEQ ID NO: 239077 - DNA, 30 bp, Artificial Sequence
  Description of Artificial Sequence: Synthetic oligonucleotide
tagtgcatccggctgtgctgtctttgagtg

SEQ ID NO: 239078 - DNA, 29 bp, Artificial Sequence
  Description of Artificial Sequence: Synthetic oligonucleotide
agtgcatccggctgtgctgtctttgagtg

SEQ ID NO: 239079 - DNA, 28 bp, Artificial Sequence
  Description of Artificial Sequence: Synthetic oligonucleotide
gtgcatccggctgtgctgtctttgagtg

SEQ ID NO: 239080 - DNA, 28 bp, Artificial Sequence
  Description of Artificial Sequence: Synthetic oligonucleotide
tgcatccggctgtgctgtctttgagtgc

SEQ ID NO: 239081 - DNA, 27 bp, Artificial Sequence
  Description of Artificial Sequence: Synthetic oligonucleotide
gcatccggctgtgctgtctttgagtgc

SEQ ID NO: 239082 - DNA, 27 bp, Artificial Sequence
  Description of Artificial Sequence: Synthetic oligonucleotide
catccggctgtgctgtctttgagtgcg

SEQ ID NO: 239083 - DNA, 29 bp, Artificial Sequence
  Description of Artificial Sequence: Synthetic oligonucleotide
atccggctgtgctgtctttgagtgcgatc

SEQ ID NO: 239084 - DNA, 28 bp, Artificial Sequence
  Description of Artificial Sequence: Synthetic oligonucleotide
tccggctgtgctgtctttgagtgcgatc

SEQ ID NO: 239085 - DNA, 27 bp, Artificial Sequence
  Description of Artificial Sequence: Synthetic oligonucleotide
ccggctgtgctgtctttgagtgcgatc

SEQ ID NO: 239086 - DNA, 29 bp, Artificial Sequence
  Description of Artificial Sequence: Synthetic oligonucleotide
cggctgtgctgtctttgagtgcgatcaac

SEQ ID NO: 239087 - DNA, 31 bp, Artificial Sequence
  Description of Artificial Sequence: Synthetic oligonucleotide
ggctgtgctgtctttgagtgcgatcaacatg

SEQ ID NO: 239088 - DNA, 32 bp, Artificial Sequence
  Description of Artificial Sequence: Synthetic oligonucleotide
gctgtgctgtctttgagtgcgatcaacatgtg

SEQ ID NO: 239089 - DNA, 33 bp, Artificial Sequence
  Description of Artificial Sequence: Synthetic oligonucleotide
ctgtgctgtctttgagtgcgatcaacatgtgtc

SEQ ID NO: 239090 - DNA, 33 bp, Artificial Sequence
  Description of Artificial Sequence: Synthetic oligonucleotide
tgtgctgtctttgagtgcgatcaacatgtgtcc

SEQ ID NO: 239091 - DNA, 32 bp, Artificial Sequence
  Description of Artificial Sequence: Synthetic oligonucleotide
gtgctgtctttgagtgcgatcaacatgtgtcc

SEQ ID NO: 239092 - DNA, 34 bp, Artificial Sequence
  Description of Artificial Sequence: Synthetic oligonucleotide
tgctgtctttgagtgcgatcaacatgtgtcctac

SEQ ID NO: 239093 - DNA, 33 bp, Artificial Sequence
  Description of Artificial Sequence: Synthetic oligonucleotide
gctgtctttgagtgcgatcaacatgtgtcctac

SEQ ID NO: 239094 - DNA, 33 bp, Artificial Sequence
  Description of Artificial Sequence: Synthetic oligonucleotide
ctgtctttgagtgcgatcaacatgtgtcctacg

SEQ ID NO: 239095 - DNA, 33 bp, Artificial Sequence
  Description of Artificial Sequence: Synthetic oligonucleotide
tgtctttgagtgcgatcaacatgtgtcctacgc

SEQ ID NO: 239096 - DNA, 32 bp, Artificial Sequence
  Description of Artificial Sequence: Synthetic oligonucleotide
gtctttgagtgcgatcaacatgtgtcctacgc

SEQ ID NO: 239097 - DNA, 32 bp, Artificial Sequence
  Description of Artificial Sequence: Synthetic oligonucleotide
tctttgagtgcgatcaacatgtgtcctacgcg

SEQ ID NO: 239098 - DNA, 31 bp, Artificial Sequence
  Description of Artificial Sequence: Synthetic oligonucleotide
ctttgagtgcgatcaacatgtgtcctacgcg

SEQ ID NO: 239099 - DNA, 32 bp, Artificial Sequence
  Description of Artificial Sequence: Synthetic oligonucleotide
tttgagtgcgatcaacatgtgtcctacgcgtc

SEQ ID NO: 239100 - DNA, 31 bp, Artificial Sequence
  Description of Artificial Sequence: Synthetic oligonucleotide
ttgagtgcgatcaacatgtgtcctacgcgtc

SEQ ID NO: 239101 - DNA, 30 bp, Artificial Sequence
  Description of Artificial Sequence: Synthetic oligonucleotide
tgagtgcgatcaacatgtgtcctacgcgtc

SEQ ID NO: 239102 - DNA, 29 bp, Artificial Sequence
  Description of Artificial Sequence: Synthetic oligonucleotide
gagtgcgatcaacatgtgtcctacgcgtc

SEQ ID NO: 239103 - DNA, 29 bp, Artificial Sequence
  Description of Artificial Sequence: Synthetic oligonucleotide
agtgcgatcaacatgtgtcctacgcgtcc

SEQ ID NO: 239104 - DNA, 28 bp, Artificial Sequence
  Description of Artificial Sequence: Synthetic oligonucleotide
gtgcgatcaacatgtgtcctacgcgtcc

SEQ ID NO: 239105 - DNA, 28 bp, Artificial Sequence
  Description of Artificial Sequence: Synthetic oligonucleotide
tgcgatcaacatgtgtcctacgcgtccc

SEQ ID NO: 239106 - DNA, 27 bp, Artificial Sequence
  Description of Artificial Sequence: Synthetic oligonucleotide
gcgatcaacatgtgtcctacgcgtccc

SEQ ID NO: 239107 - DNA, 27 bp, Artificial Sequence
  Description of Artificial Sequence: Synthetic oligonucleotide
cgatcaacatgtgtcctacgcgtcccc

SEQ ID NO: 239108 - DNA, 28 bp, Artificial Sequence
  Description of Artificial Sequence: Synthetic oligonucleotide
gatcaacatgtgtcctacgcgtcccctc

SEQ ID NO: 239109 - DNA, 34 bp, Artificial Sequence
  Description of Artificial Sequence: Synthetic oligonucleotide
atcaacatgtgtcctacgcgtcccctctattttg

SEQ ID NO: 239110 - DNA, 33 bp, Artificial Sequence
  Description of Artificial Sequence: Synthetic oligonucleotide
tcaacatgtgtcctacgcgtcccctctattttg

SEQ ID NO: 239111 - DNA, 32 bp, Artificial Sequence
  Description of Artificial Sequence: Synthetic oligonucleotide
caacatgtgtcctacgcgtcccctctattttg

SEQ ID NO: 239112 - DNA, 32 bp, Artificial Sequence
  Description of Artificial Sequence: Synthetic oligonucleotide
aacatgtgtcctacgcgtcccctctattttgg

SEQ ID NO: 239113 - DNA, 31 bp, Artificial Sequence
  Description of Artificial Sequence: Synthetic oligonucleotide
acatgtgtcctacgcgtcccctctattttgg

SEQ ID NO: 239114 - DNA, 30 bp, Artificial Sequence
  Description of Artificial Sequence: Synthetic oligonucleotide
catgtgtcctacgcgtcccctctattttgg

SEQ ID NO: 239115 - DNA, 30 bp, Artificial Sequence
  Description of Artificial Sequence: Synthetic oligonucleotide
atgtgtcctacgcgtcccctctattttggc

SEQ ID NO: 239116 - DNA, 29 bp, Artificial Sequence
  Description of Artificial Sequence: Synthetic oligonucleotide
tgtgtcctacgcgtcccctctattttggc

SEQ ID NO: 239117 - DNA, 28 bp, Artificial Sequence
  Description of Artificial Sequence: Synthetic oligonucleotide
gtgtcctacgcgtcccctctattttggc

SEQ ID NO: 239118 - DNA, 28 bp, Artificial Sequence
  Description of Artificial Sequence: Synthetic oligonucleotide
tgtcctacgcgtcccctctattttggcc

SEQ ID NO: 239119 - DNA, 27 bp, Artificial Sequence
  Description of Artificial Sequence: Synthetic oligonucleotide
gtcctacgcgtcccctctattttggcc

SEQ ID NO: 239120 - DNA, 27 bp, Artificial Sequence
  Description of Artificial Sequence: Synthetic oligonucleotide
tcctacgcgtcccctctattttggccc

SEQ ID NO: 239121 - DNA, 26 bp, Artificial Sequence
  Description of Artificial Sequence: Synthetic oligonucleotide
cctacgcgtcccctctattttggccc

SEQ ID NO: 239122 - DNA, 27 bp, Artificial Sequence
  Description of Artificial Sequence: Synthetic oligonucleotide
ctacgcgtcccctctattttggcccga

SEQ ID NO: 239123 - DNA, 27 bp, Artificial Sequence
  Description of Artificial Sequence: Synthetic oligonucleotide
tacgcgtcccctctattttggcccgag

SEQ ID NO: 239124 - DNA, 27 bp, Artificial Sequence
  Description of Artificial Sequence: Synthetic oligonucleotide
acgcgtcccctctattttggcccgagt

SEQ ID NO: 239125 - DNA, 27 bp, Artificial Sequence
  Description of Artificial Sequence: Synthetic oligonucleotide
cgcgtcccctctattttggcccgagta

SEQ ID NO: 239126 - DNA, 29 bp, Artificial Sequence
  Description of Artificial Sequence: Synthetic oligonucleotide
gcgtcccctctattttggcccgagtattc

SEQ ID NO: 239127 - DNA, 31 bp, Artificial Sequence
  Description of Artificial Sequence: Synthetic oligonucleotide
cgtcccctctattttggcccgagtattcatc

SEQ ID NO: 239128 - DNA, 31 bp, Artificial Sequence
  Description of Artificial Sequence: Synthetic oligonucleotide
gtcccctctattttggcccgagtattcatcg

SEQ ID NO: 239129 - DNA, 31 bp, Artificial Sequence
  Description of Artificial Sequence: Synthetic oligonucleotide
tcccctctattttggcccgagtattcatcgc

SEQ ID NO: 239130 - DNA, 30 bp, Artificial Sequence
  Description of Artificial Sequence: Synthetic oligonucleotide
cccctctattttggcccgagtattcatcgc

SEQ ID NO: 239131 - DNA, 31 bp, Artificial Sequence
  Description of Artificial Sequence: Synthetic oligonucleotide
ccctctattttggcccgagtattcatcgcag

SEQ ID NO: 239132 - DNA, 31 bp, Artificial Sequence
  Description of Artificial Sequence: Synthetic oligonucleotide
cctctattttggcccgagtattcatcgcagg

SEQ ID NO: 239133 - DNA, 31 bp, Artificial Sequence
  Description of Artificial Sequence: Synthetic oligonucleotide
ctctattttggcccgagtattcatcgcaggg

SEQ ID NO: 239134 - DNA, 34 bp, Artificial Sequence
  Description of Artificial Sequence: Synthetic oligonucleotide
tctattttggcccgagtattcatcgcagggtttc

SEQ ID NO: 239135 - DNA, 33 bp, Artificial Sequence
  Description of Artificial Sequence: Synthetic oligonucleotide
ctattttggcccgagtattcatcgcagggtttc

SEQ ID NO: 239136 - DNA, 35 bp, Artificial Sequence
  Description of Artificial Sequence: Synthetic oligonucleotide
tattttggcccgagtattcatcgcagggtttcttg

SEQ ID NO: 239137 - DNA, 34 bp, Artificial Sequence
  Description of Artificial Sequence: Synthetic oligonucleotide
attttggcccgagtattcatcgcagggtttcttg

SEQ ID NO: 239138 - DNA, 33 bp, Artificial Sequence
  Description of Artificial Sequence: Synthetic oligonucleotide
ttttggcccgagtattcatcgcagggtttcttg

SEQ ID NO: 239139 - DNA, 32 bp, Artificial Sequence
  Description of Artificial Sequence: Synthetic oligonucleotide
tttggcccgagtattcatcgcagggtttcttg

SEQ ID NO: 239140 - DNA, 31 bp, Artificial Sequence
  Description of Artificial Sequence: Synthetic oligonucleotide
ttggcccgagtattcatcgcagggtttcttg

SEQ ID NO: 239141 - DNA, 30 bp, Artificial Sequence
  Description of Artificial Sequence: Synthetic oligonucleotide
tggcccgagtattcatcgcagggtttcttg

SEQ ID NO: 239142 - DNA, 29 bp, Artificial Sequence
  Description of Artificial Sequence: Synthetic oligonucleotide
ggcccgagtattcatcgcagggtttcttg

SEQ ID NO: 239143 - DNA, 29 bp, Artificial Sequence
  Description of Artificial Sequence: Synthetic oligonucleotide
gcccgagtattcatcgcagggtttcttgg

SEQ ID NO: 239144 - DNA, 30 bp, Artificial Sequence
  Description of Artificial Sequence: Synthetic oligonucleotide
cccgagtattcatcgcagggtttcttggac

SEQ ID NO: 239145 - DNA, 31 bp, Artificial Sequence
  Description of Artificial Sequence: Synthetic oligonucleotide
ccgagtattcatcgcagggtttcttggacac

SEQ ID NO: 239146 - DNA, 31 bp, Artificial Sequence
  Description of Artificial Sequence: Synthetic oligonucleotide
cgagtattcatcgcagggtttcttggacacc

SEQ ID NO: 239147 - DNA, 33 bp, Artificial Sequence
  Description of Artificial Sequence: Synthetic oligonucleotide
gagtattcatcgcagggtttcttggacaccaac

SEQ ID NO: 239148 - DNA, 35 bp, Artificial Sequence
  Description of Artificial Sequence: Synthetic oligonucleotide
agtattcatcgcagggtttcttggacaccaactag

SEQ ID NO: 239149 - DNA, 34 bp, Artificial Sequence
  Description of Artificial Sequence: Synthetic oligonucleotide
gtattcatcgcagggtttcttggacaccaactag

SEQ ID NO: 239150 - DNA, 34 bp, Artificial Sequence
  Description of Artificial Sequence: Synthetic oligonucleotide
tattcatcgcagggtttcttggacaccaactagc

SEQ ID NO: 239151 - DNA, 33 bp, Artificial Sequence
  Description of Artificial Sequence: Synthetic oligonucleotide
attcatcgcagggtttcttggacaccaactagc

SEQ ID NO: 239152 - DNA, 32 bp, Artificial Sequence
  Description of Artificial Sequence: Synthetic oligonucleotide
ttcatcgcagggtttcttggacaccaactagc

SEQ ID NO: 239153 - DNA, 31 bp, Artificial Sequence
  Description of Artificial Sequence: Synthetic oligonucleotide
tcatcgcagggtttcttggacaccaactagc

SEQ ID NO: 239154 - DNA, 30 bp, Artificial Sequence
  Description of Artificial Sequence: Synthetic oligonucleotide
catcgcagggtttcttggacaccaactagc

SEQ ID NO: 239155 - DNA, 32 bp, Artificial Sequence
  Description of Artificial Sequence: Synthetic oligonucleotide
atcgcagggtttcttggacaccaactagcttc

SEQ ID NO: 239156 - DNA, 31 bp, Artificial Sequence
  Description of Artificial Sequence: Synthetic oligonucleotide
tcgcagggtttcttggacaccaactagcttc

SEQ ID NO: 239157 - DNA, 30 bp, Artificial Sequence
  Description of Artificial Sequence: Synthetic oligonucleotide
cgcagggtttcttggacaccaactagcttc

SEQ ID NO: 239158 - DNA, 30 bp, Artificial Sequence
  Description of Artificial Sequence: Synthetic oligonucleotide
gcagggtttcttggacaccaactagcttcg

SEQ ID NO: 239159 - DNA, 30 bp, Artificial Sequence
  Description of Artificial Sequence: Synthetic oligonucleotide
cagggtttcttggacaccaactagcttcgc

SEQ ID NO: 239160 - DNA, 32 bp, Artificial Sequence
  Description of Artificial Sequence: Synthetic oligonucleotide
agggtttcttggacaccaactagcttcgcttc

SEQ ID NO: 239161 - DNA, 31 bp, Artificial Sequence
  Description of Artificial Sequence: Synthetic oligonucleotide
gggtttcttggacaccaactagcttcgcttc

SEQ ID NO: 239162 - DNA, 31 bp, Artificial Sequence
  Description of Artificial Sequence: Synthetic oligonucleotide
ggtttcttggacaccaactagcttcgcttcc

SEQ ID NO: 239163 - DNA, 31 bp, Artificial Sequence
  Description of Artificial Sequence: Synthetic oligonucleotide
gtttcttggacaccaactagcttcgcttccc

SEQ ID NO: 239164 - DNA, 34 bp, Artificial Sequence
  Description of Artificial Sequence: Synthetic oligonucleotide
tttcttggacaccaactagcttcgcttcccattg

SEQ ID NO: 239165 - DNA, 33 bp, Artificial Sequence
  Description of Artificial Sequence: Synthetic oligonucleotide
ttcttggacaccaactagcttcgcttcccattg

SEQ ID NO: 239166 - DNA, 32 bp, Artificial Sequence
  Description of Artificial Sequence: Synthetic oligonucleotide
tcttggacaccaactagcttcgcttcccattg

SEQ ID NO: 239167 - DNA, 31 bp, Artificial Sequence
  Description of Artificial Sequence: Synthetic oligonucleotide
cttggacaccaactagcttcgcttcccattg

SEQ ID NO: 239168 - DNA, 33 bp, Artificial Sequence
  Description of Artificial Sequence: Synthetic oligonucleotide
ttggacaccaactagcttcgcttcccattgaac

SEQ ID NO: 239169 - DNA, 32 bp, Artificial Sequence
  Description of Artificial Sequence: Synthetic oligonucleotide
tggacaccaactagcttcgcttcccattgaac

SEQ ID NO: 239170 - DNA, 31 bp, Artificial Sequence
  Description of Artificial Sequence: Synthetic oligonucleotide
ggacaccaactagcttcgcttcccattgaac

SEQ ID NO: 239171 - DNA, 32 bp, Artificial Sequence
  Description of Artificial Sequence: Synthetic oligonucleotide
gacaccaactagcttcgcttcccattgaacac

SEQ ID NO: 239172 - DNA, 35 bp, Artificial Sequence
  Description of Artificial Sequence: Synthetic oligonucleotide
acaccaactagcttcgcttcccattgaacacaaac

SEQ ID NO: 239173 - DNA, 34 bp, Artificial Sequence
  Description of Artificial Sequence: Synthetic oligonucleotide
caccaactagcttcgcttcccattgaacacaaac

SEQ ID NO: 239174 - DNA, 35 bp, Artificial Sequence
  Description of Artificial Sequence: Synthetic oligonucleotide
accaactagcttcgcttcccattgaacacaaactc

SEQ ID NO: 239175 - DNA, 34 bp, Artificial Sequence
  Description of Artificial Sequence: Synthetic oligonucleotide
ccaactagcttcgcttcccattgaacacaaactc

SEQ ID NO: 239176 - DNA, 35 bp, Artificial Sequence
  Description of Artificial Sequence: Synthetic oligonucleotide
caactagcttcgcttcccattgaacacaaactcac

SEQ ID NO: 239177 - DNA, 38 bp, Artificial Sequence
  Description of Artificial Sequence: Synthetic oligonucleotide
aactagcttcgcttcccattgaacacaaactcacattc

SEQ ID NO: 239178 - DNA, 37 bp, Artificial Sequence
  Description of Artificial Sequence: Synthetic oligonucleotide
actagcttcgcttcccattgaacacaaactcacattc

SEQ ID NO: 239179 - DNA, 36 bp, Artificial Sequence
  Description of Artificial Sequence: Synthetic oligonucleotide
ctagcttcgcttcccattgaacacaaactcacattc

SEQ ID NO: 239180 - DNA, 38 bp, Artificial Sequence
  Description of Artificial Sequence: Synthetic oligonucleotide
tagcttcgcttcccattgaacacaaactcacattcttc

SEQ ID NO: 239181 - DNA, 37 bp, Artificial Sequence
  Description of Artificial Sequence: Synthetic oligonucleotide
agcttcgcttcccattgaacacaaactcacattcttc

SEQ ID NO: 239182 - DNA, 36 bp, Artificial Sequence
  Description of Artificial Sequence: Synthetic oligonucleotide
gcttcgcttcccattgaacacaaactcacattcttc

SEQ ID NO: 239183 - DNA, 36 bp, Artificial Sequence
  Description of Artificial Sequence: Synthetic oligonucleotide
cttcgcttcccattgaacacaaactcacattcttcc

SEQ ID NO: 239184 - DNA, 37 bp, Artificial Sequence
  Description of Artificial Sequence: Synthetic oligonucleotide
ttcgcttcccattgaacacaaactcacattcttcctc

SEQ ID NO: 239185 - DNA, 36 bp, Artificial Sequence
  Description of Artificial Sequence: Synthetic oligonucleotide
tcgcttcccattgaacacaaactcacattcttcctc

SEQ ID NO: 239186 - DNA, 35 bp, Artificial Sequence
  Description of Artificial Sequence: Synthetic oligonucleotide
cgcttcccattgaacacaaactcacattcttcctc

SEQ ID NO: 239187 - DNA, 37 bp, Artificial Sequence
  Description of Artificial Sequence: Synthetic oligonucleotide
gcttcccattgaacacaaactcacattcttcctctac

SEQ ID NO: 239188 - DNA, 37 bp, Artificial Sequence
  Description of Artificial Sequence: Synthetic oligonucleotide
cttcccattgaacacaaactcacattcttcctctacc

SEQ ID NO: 239189 - DNA, 37 bp, Artificial Sequence
  Description of Artificial Sequence: Synthetic oligonucleotide
ttcccattgaacacaaactcacattcttcctctaccc

SEQ ID NO: 239190 - DNA, 36 bp, Artificial Sequence
  Description of Artificial Sequence: Synthetic oligonucleotide
tcccattgaacacaaactcacattcttcctctaccc

SEQ ID NO: 239191 - DNA, 35 bp, Artificial Sequence
  Description of Artificial Sequence: Synthetic oligonucleotide
cccattgaacacaaactcacattcttcctctaccc

SEQ ID NO: 239192 - DNA, 38 bp, Artificial Sequence
  Description of Artificial Sequence: Synthetic oligonucleotide
ccattgaacacaaactcacattcttcctctacccatag

SEQ ID NO: 239193 - DNA, 38 bp, Artificial Sequence
  Description of Artificial Sequence: Synthetic oligonucleotide
cattgaacacaaactcacattcttcctctacccatagc

SEQ ID NO: 239194 - DNA, 39 bp, Artificial Sequence
  Description of Artificial Sequence: Synthetic oligonucleotide
attgaacacaaactcacattcttcctctacccatagctc

SEQ ID NO: 239195 - DNA, 38 bp, Artificial Sequence
  Description of Artificial Sequence: Synthetic oligonucleotide
ttgaacacaaactcacattcttcctctacccatagctc

SEQ ID NO: 239196 - DNA, 37 bp, Artificial Sequence
  Description of Artificial Sequence: Synthetic oligonucleotide
tgaacacaaactcacattcttcctctacccatagctc

SEQ ID NO: 239197 - DNA, 36 bp, Artificial Sequence
  Description of Artificial Sequence: Synthetic oligonucleotide
gaacacaaactcacattcttcctctacccatagctc

SEQ ID NO: 239198 - DNA, 37 bp, Artificial Sequence
  Description of Artificial Sequence: Synthetic oligonucleotide
aacacaaactcacattcttcctctacccatagctctg

SEQ ID NO: 239199 - DNA, 36 bp, Artificial Sequence
  Description of Artificial Sequence: Synthetic oligonucleotide
acacaaactcacattcttcctctacccatagctctg

SEQ ID NO: 239200 - DNA, 35 bp, Artificial Sequence
  Description of Artificial Sequence: Synthetic oligonucleotide
cacaaactcacattcttcctctacccatagctctg

SEQ ID NO: 239201 - DNA, 35 bp, Artificial Sequence
  Description of Artificial Sequence: Synthetic oligonucleotide
acaaactcacattcttcctctacccatagctctgg

SEQ ID NO: 239202 - DNA, 34 bp, Artificial Sequence
  Description of Artificial Sequence: Synthetic oligonucleotide
caaactcacattcttcctctacccatagctctgg

SEQ ID NO: 239203 - DNA, 34 bp, Artificial Sequence
  Description of Artificial Sequence: Synthetic oligonucleotide
aaactcacattcttcctctacccatagctctggc

SEQ ID NO: 239204 - DNA, 33 bp, Artificial Sequence
  Description of Artificial Sequence: Synthetic oligonucleotide
aactcacattcttcctctacccatagctctggc

SEQ ID NO: 239205 - DNA, 32 bp, Artificial Sequence
  Description of Artificial Sequence: Synthetic oligonucleotide
actcacattcttcctctacccatagctctggc

SEQ ID NO: 239206 - DNA, 31 bp, Artificial Sequence
  Description of Artificial Sequence: Synthetic oligonucleotide
ctcacattcttcctctacccatagctctggc

SEQ ID NO: 239207 - DNA, 32 bp, Artificial Sequence
  Description of Artificial Sequence: Synthetic oligonucleotide
tcacattcttcctctacccatagctctggcag

SEQ ID NO: 239208 - DNA, 31 bp, Artificial Sequence
  Description of Artificial Sequence: Synthetic oligonucleotide
cacattcttcctctacccatagctctggcag

SEQ ID NO: 239209 - DNA, 31 bp, Artificial Sequence
  Description of Artificial Sequence: Synthetic oligonucleotide
acattcttcctctacccatagctctggcagg

SEQ ID NO: 239210 - DNA, 30 bp, Artificial Sequence
  Description of Artificial Sequence: Synthetic oligonucleotide
cattcttcctctacccatagctctggcagg

SEQ ID NO: 239211 - DNA, 30 bp, Artificial Sequence
  Description of Artificial Sequence: Synthetic oligonucleotide
attcttcctctacccatagctctggcaggc

SEQ ID NO: 239212 - DNA, 29 bp, Artificial Sequence
  Description of Artificial Sequence: Synthetic oligonucleotide
ttcttcctctacccatagctctggcaggc

SEQ ID NO: 239213 - DNA, 28 bp, Artificial Sequence
  Description of Artificial Sequence: Synthetic oligonucleotide
tcttcctctacccatagctctggcaggc

SEQ ID NO: 239214 - DNA, 27 bp, Artificial Sequence
  Description of Artificial Sequence: Synthetic oligonucleotide
cttcctctacccatagctctggcaggc

SEQ ID NO: 239215 - DNA, 28 bp, Artificial Sequence
  Description of Artificial Sequence: Synthetic oligonucleotide
ttcctctacccatagctctggcaggcag

SEQ ID NO: 239216 - DNA, 27 bp, Artificial Sequence
  Description of Artificial Sequence: Synthetic oligonucleotide
tcctctacccatagctctggcaggcag

SEQ ID NO: 239217 - DNA, 26 bp, Artificial Sequence
  Description of Artificial Sequence: Synthetic oligonucleotide
cctctacccatagctctggcaggcag

SEQ ID NO: 239218 - DNA, 27 bp, Artificial Sequence
  Description of Artificial Sequence: Synthetic oligonucleotide
ctctacccatagctctggcaggcagca

SEQ ID NO: 239219 - DNA, 27 bp, Artificial Sequence
  Description of Artificial Sequence: Synthetic oligonucleotide
tctacccatagctctggcaggcagcac

SEQ ID NO: 239220 - DNA, 27 bp, Artificial Sequence
  Description of Artificial Sequence: Synthetic oligonucleotide
ctacccatagctctggcaggcagcact

SEQ ID NO: 239221 - DNA, 31 bp, Artificial Sequence
  Description of Artificial Sequence: Synthetic oligonucleotide
tacccatagctctggcaggcagcacttaatg

SEQ ID NO: 239222 - DNA, 30 bp, Artificial Sequence
  Description of Artificial Sequence: Synthetic oligonucleotide
acccatagctctggcaggcagcacttaatg

SEQ ID NO: 239223 - DNA, 29 bp, Artificial Sequence
  Description of Artificial Sequence: Synthetic oligonucleotide
cccatagctctggcaggcagcacttaatg

SEQ ID NO: 239224 - DNA, 29 bp, Artificial Sequence
  Description of Artificial Sequence: Synthetic oligonucleotide
ccatagctctggcaggcagcacttaatgc

SEQ ID NO: 239225 - DNA, 32 bp, Artificial Sequence
  Description of Artificial Sequence: Synthetic oligonucleotide
catagctctggcaggcagcacttaatgctttg

SEQ ID NO: 239226 - DNA, 32 bp, Artificial Sequence
  Description of Artificial Sequence: Synthetic oligonucleotide
atagctctggcaggcagcacttaatgctttgc

SEQ ID NO: 239227 - DNA, 31 bp, Artificial Sequence
  Description of Artificial Sequence: Synthetic oligonucleotide
tagctctggcaggcagcacttaatgctttgc

SEQ ID NO: 239228 - DNA, 30 bp, Artificial Sequence
  Description of Artificial Sequence: Synthetic oligonucleotide
agctctggcaggcagcacttaatgctttgc

SEQ ID NO: 239229 - DNA, 29 bp, Artificial Sequence
  Description of Artificial Sequence: Synthetic oligonucleotide
gctctggcaggcagcacttaatgctttgc

SEQ ID NO: 239230 - DNA, 30 bp, Artificial Sequence
  Description of Artificial Sequence: Synthetic oligonucleotide
ctctggcaggcagcacttaatgctttgctg

SEQ ID NO: 239231 - DNA, 30 bp, Artificial Sequence
  Description of Artificial Sequence: Synthetic oligonucleotide
tctggcaggcagcacttaatgctttgctgg

SEQ ID NO: 239232 - DNA, 29 bp, Artificial Sequence
  Description of Artificial Sequence: Synthetic oligonucleotide
ctggcaggcagcacttaatgctttgctgg

SEQ ID NO: 239233 - DNA, 30 bp, Artificial Sequence
  Description of Artificial Sequence: Synthetic oligonucleotide
tggcaggcagcacttaatgctttgctggtg

SEQ ID NO: 239234 - DNA, 29 bp, Artificial Sequence
  Description of Artificial Sequence: Synthetic oligonucleotide
ggcaggcagcacttaatgctttgctggtg

SEQ ID NO: 239235 - DNA, 32 bp, Artificial Sequence
  Description of Artificial Sequence: Synthetic oligonucleotide
gcaggcagcacttaatgctttgctggtgtttg

SEQ ID NO: 239236 - DNA, 32 bp, Artificial Sequence
  Description of Artificial Sequence: Synthetic oligonucleotide
caggcagcacttaatgctttgctggtgtttgg

SEQ ID NO: 239237 - DNA, 24 bp, Artificial Sequence
  Description of Artificial Sequence: Synthetic oligonucleotide
atgggttctcggtgggtccgctgg

SEQ ID NO: 239238 - DNA, 23 bp, Artificial Sequence
  Description of Artificial Sequence: Synthetic oligonucleotide
tgggttctcggtgggtccgctgg

SEQ ID NO: 239239 - DNA, 22 bp, Artificial Sequence
  Description of Artificial Sequence: Synthetic oligonucleotide
gggttctcggtgggtccgctgg

SEQ ID NO: 239240 - DNA, 23 bp, Artificial Sequence
  Description of Artificial Sequence: Synthetic oligonucleotide
ggttctcggtgggtccgctgggt

SEQ ID NO: 239241 - DNA, 23 bp, Artificial Sequence
  Description of Artificial Sequence: Synthetic oligonucleotide
gttctcggtgggtccgctgggtg

SEQ ID NO: 239242 - DNA, 24 bp, Artificial Sequence
  Description of Artificial Sequence: Synthetic oligonucleotide
ttctcggtgggtccgctgggtggt

SEQ ID NO: 239243 - DNA, 23 bp, Artificial Sequence
  Description of Artificial Sequence: Synthetic oligonucleotide
tctcggtgggtccgctgggtggt

SEQ ID NO: 239244 - DNA, 22 bp, Artificial Sequence
  Description of Artificial Sequence: Synthetic oligonucleotide
ctcggtgggtccgctgggtggt

SEQ ID NO: 239245 - DNA, 22 bp, Artificial Sequence
  Description of Artificial Sequence: Synthetic oligonucleotide
tcggtgggtccgctgggtggtc

SEQ ID NO: 239246 - DNA, 21 bp, Artificial Sequence
  Description of Artificial Sequence: Synthetic oligonucleotide
cggtgggtccgctgggtggtc

SEQ ID NO: 239247 - DNA, 21 bp, Artificial Sequence
  Description of Artificial Sequence: Synthetic oligonucleotide
ggtgggtccgctgggtggtcg

SEQ ID NO: 239248 - DNA, 22 bp, Artificial Sequence
  Description of Artificial Sequence: Synthetic oligonucleotide
gtgggtccgctgggtggtcgct

SEQ ID NO: 239249 - DNA, 23 bp, Artificial Sequence
  Description of Artificial Sequence: Synthetic oligonucleotide
tgggtccgctgggtggtcgctct

SEQ ID NO: 239250 - DNA, 22 bp, Artificial Sequence
  Description of Artificial Sequence: Synthetic oligonucleotide
gggtccgctgggtggtcgctct

SEQ ID NO: 239251 - DNA, 22 bp, Artificial Sequence
  Description of Artificial Sequence: Synthetic oligonucleotide
ggtccgctgggtggtcgctctg

SEQ ID NO: 239252 - DNA, 24 bp, Artificial Sequence
  Description of Artificial Sequence: Synthetic oligonucleotide
gtccgctgggtggtcgctctgcta

SEQ ID NO: 239253 - DNA, 25 bp, Artificial Sequence
  Description of Artificial Sequence: Synthetic oligonucleotide
tccgctgggtggtcgctctgctact

SEQ ID NO: 239254 - DNA, 24 bp, Artificial Sequence
  Description of Artificial Sequence: Synthetic oligonucleotide
ccgctgggtggtcgctctgctact

SEQ ID NO: 239255 - DNA, 27 bp, Artificial Sequence
  Description of Artificial Sequence: Synthetic oligonucleotide
cgctgggtggtcgctctgctactgaat

SEQ ID NO: 239256 - DNA, 27 bp, Artificial Sequence
  Description of Artificial Sequence: Synthetic oligonucleotide
gctgggtggtcgctctgctactgaatc

SEQ ID NO: 239257 - DNA, 28 bp, Artificial Sequence
  Description of Artificial Sequence: Synthetic oligonucleotide
ctgggtggtcgctctgctactgaatctg

SEQ ID NO: 239258 - DNA, 29 bp, Artificial Sequence
  Description of Artificial Sequence: Synthetic oligonucleotide
tgggtggtcgctctgctactgaatctgag

SEQ ID NO: 239259 - DNA, 28 bp, Artificial Sequence
  Description of Artificial Sequence: Synthetic oligonucleotide
gggtggtcgctctgctactgaatctgag

SEQ ID NO: 239260 - DNA, 28 bp, Artificial Sequence
  Description of Artificial Sequence: Synthetic oligonucleotide
ggtggtcgctctgctactgaatctgagc

SEQ ID NO: 239261 - DNA, 28 bp, Artificial Sequence
  Description of Artificial Sequence: Synthetic oligonucleotide
gtggtcgctctgctactgaatctgagcc

SEQ ID NO: 239262 - DNA, 28 bp, Artificial Sequence
  Description of Artificial Sequence: Synthetic oligonucleotide
tggtcgctctgctactgaatctgagccg

SEQ ID NO: 239263 - DNA, 27 bp, Artificial Sequence
  Description of Artificial Sequence: Synthetic oligonucleotide
ggtcgctctgctactgaatctgagccg

SEQ ID NO: 239264 - DNA, 28 bp, Artificial Sequence
  Description of Artificial Sequence: Synthetic oligonucleotide
gtcgctctgctactgaatctgagccgac

SEQ ID NO: 239265 - DNA, 29 bp, Artificial Sequence
  Description of Artificial Sequence: Synthetic oligonucleotide
tcgctctgctactgaatctgagccgactg

SEQ ID NO: 239266 - DNA, 28 bp, Artificial Sequence
  Description of Artificial Sequence: Synthetic oligonucleotide
cgctctgctactgaatctgagccgactg

SEQ ID NO: 239267 - DNA, 28 bp, Artificial Sequence
  Description of Artificial Sequence: Synthetic oligonucleotide
gctctgctactgaatctgagccgactgg

SEQ ID NO: 239268 - DNA, 31 bp, Artificial Sequence
  Description of Artificial Sequence: Synthetic oligonucleotide
ctctgctactgaatctgagccgactggaatc

SEQ ID NO: 239269 - DNA, 31 bp, Artificial Sequence
  Description of Artificial Sequence: Synthetic oligonucleotide
tctgctactgaatctgagccgactggaatcc

SEQ ID NO: 239270 - DNA, 30 bp, Artificial Sequence
  Description of Artificial Sequence: Synthetic oligonucleotide
ctgctactgaatctgagccgactggaatcc

SEQ ID NO: 239271 - DNA, 31 bp, Artificial Sequence
  Description of Artificial Sequence: Synthetic oligonucleotide
tgctactgaatctgagccgactggaatcctc

SEQ ID NO: 239272 - DNA, 30 bp, Artificial Sequence
  Description of Artificial Sequence: Synthetic oligonucleotide
gctactgaatctgagccgactggaatcctc

SEQ ID NO: 239273 - DNA, 30 bp, Artificial Sequence
  Description of Artificial Sequence: Synthetic oligonucleotide
ctactgaatctgagccgactggaatcctcc

SEQ ID NO: 239274 - DNA, 32 bp, Artificial Sequence
  Description of Artificial Sequence: Synthetic oligonucleotide
tactgaatctgagccgactggaatcctccatg

SEQ ID NO: 239275 - DNA, 31 bp, Artificial Sequence
  Description of Artificial Sequence: Synthetic oligonucleotide
actgaatctgagccgactggaatcctccatg

SEQ ID NO: 239276 - DNA, 30 bp, Artificial Sequence
  Description of Artificial Sequence: Synthetic oligonucleotide
ctgaatctgagccgactggaatcctccatg

SEQ ID NO: 239277 - DNA, 31 bp, Artificial Sequence
  Description of Artificial Sequence: Synthetic oligonucleotide
tgaatctgagccgactggaatcctccatgtc

SEQ ID NO: 239278 - DNA, 30 bp, Artificial Sequence
  Description of Artificial Sequence: Synthetic oligonucleotide
gaatctgagccgactggaatcctccatgtc

SEQ ID NO: 239279 - DNA, 31 bp, Artificial Sequence
  Description of Artificial Sequence: Synthetic oligonucleotide
aatctgagccgactggaatcctccatgtctc

SEQ ID NO: 239280 - DNA, 30 bp, Artificial Sequence
  Description of Artificial Sequence: Synthetic oligonucleotide
atctgagccgactggaatcctccatgtctc

SEQ ID NO: 239281 - DNA, 29 bp, Artificial Sequence
  Description of Artificial Sequence: Synthetic oligonucleotide
tctgagccgactggaatcctccatgtctc

SEQ ID NO: 239282 - DNA, 28 bp, Artificial Sequence
  Description of Artificial Sequence: Synthetic oligonucleotide
ctgagccgactggaatcctccatgtctc

SEQ ID NO: 239283 - DNA, 30 bp, Artificial Sequence
  Description of Artificial Sequence: Synthetic oligonucleotide
tgagccgactggaatcctccatgtctcaag

SEQ ID NO: 239284 - DNA, 29 bp, Artificial Sequence
  Description of Artificial Sequence: Synthetic oligonucleotide
gagccgactggaatcctccatgtctcaag

SEQ ID NO: 239285 - DNA, 29 bp, Artificial Sequence
  Description of Artificial Sequence: Synthetic oligonucleotide
agccgactggaatcctccatgtctcaagg

SEQ ID NO: 239286 - DNA, 28 bp, Artificial Sequence
  Description of Artificial Sequence: Synthetic oligonucleotide
gccgactggaatcctccatgtctcaagg

SEQ ID NO: 239287 - DNA, 28 bp, Artificial Sequence
  Description of Artificial Sequence: Synthetic oligonucleotide
ccgactggaatcctccatgtctcaaggc

SEQ ID NO: 239288 - DNA, 29 bp, Artificial Sequence
  Description of Artificial Sequence: Synthetic oligonucleotide
cgactggaatcctccatgtctcaaggcag

SEQ ID NO: 239289 - DNA, 30 bp, Artificial Sequence
  Description of Artificial Sequence: Synthetic oligonucleotide
gactggaatcctccatgtctcaaggcagag

SEQ ID NO: 239290 - DNA, 31 bp, Artificial Sequence
  Description of Artificial Sequence: Synthetic oligonucleotide
actggaatcctccatgtctcaaggcagagac

SEQ ID NO: 239291 - DNA, 30 bp, Artificial Sequence
  Description of Artificial Sequence: Synthetic oligonucleotide
ctggaatcctccatgtctcaaggcagagac

SEQ ID NO: 239292 - DNA, 31 bp, Artificial Sequence
  Description of Artificial Sequence: Synthetic oligonucleotide
tggaatcctccatgtctcaaggcagagactc

SEQ ID NO: 239293 - DNA, 30 bp, Artificial Sequence
  Description of Artificial Sequence: Synthetic oligonucleotide
ggaatcctccatgtctcaaggcagagactc

SEQ ID NO: 239294 - DNA, 31 bp, Artificial Sequence
  Description of Artificial Sequence: Synthetic oligonucleotide
gaatcctccatgtctcaaggcagagactctc

SEQ ID NO: 239295 - DNA, 31 bp, Artificial Sequence
  Description of Artificial Sequence: Synthetic oligonucleotide
aatcctccatgtctcaaggcagagactctcc

SEQ ID NO: 239296 - DNA, 30 bp, Artificial Sequence
  Description of Artificial Sequence: Synthetic oligonucleotide
atcctccatgtctcaaggcagagactctcc

SEQ ID NO: 239297 - DNA, 29 bp, Artificial Sequence
  Description of Artificial Sequence: Synthetic oligonucleotide
tcctccatgtctcaaggcagagactctcc

SEQ ID NO: 239298 - DNA, 28 bp, Artificial Sequence
  Description of Artificial Sequence: Synthetic oligonucleotide
cctccatgtctcaaggcagagactctcc

SEQ ID NO: 239299 - DNA, 29 bp, Artificial Sequence
  Description of Artificial Sequence: Synthetic oligonucleotide
ctccatgtctcaaggcagagactctcctg

SEQ ID NO: 239300 - DNA, 31 bp, Artificial Sequence
  Description of Artificial Sequence: Synthetic oligonucleotide
tccatgtctcaaggcagagactctcctgaag

SEQ ID NO: 239301 - DNA, 30 bp, Artificial Sequence
  Description of Artificial Sequence: Synthetic oligonucleotide
ccatgtctcaaggcagagactctcctgaag

SEQ ID NO: 239302 - DNA, 35 bp, Artificial Sequence
  Description of Artificial Sequence: Synthetic oligonucleotide
catgtctcaaggcagagactctcctgaagattttc

SEQ ID NO: 239303 - DNA, 36 bp, Artificial Sequence
  Description of Artificial Sequence: Synthetic oligonucleotide
atgtctcaaggcagagactctcctgaagattttctg

SEQ ID NO: 239304 - DNA, 35 bp, Artificial Sequence
  Description of Artificial Sequence: Synthetic oligonucleotide
tgtctcaaggcagagactctcctgaagattttctg

SEQ ID NO: 239305 - DNA, 34 bp, Artificial Sequence
  Description of Artificial Sequence: Synthetic oligonucleotide
gtctcaaggcagagactctcctgaagattttctg

SEQ ID NO: 239306 - DNA, 37 bp, Artificial Sequence
  Description of Artificial Sequence: Synthetic oligonucleotide
tctcaaggcagagactctcctgaagattttctgattc

SEQ ID NO: 239307 - DNA, 36 bp, Artificial Sequence
  Description of Artificial Sequence: Synthetic oligonucleotide
ctcaaggcagagactctcctgaagattttctgattc

SEQ ID NO: 239308 - DNA, 37 bp, Artificial Sequence
  Description of Artificial Sequence: Synthetic oligonucleotide
tcaaggcagagactctcctgaagattttctgattcag

SEQ ID NO: 239309 - DNA, 36 bp, Artificial Sequence
  Description of Artificial Sequence: Synthetic oligonucleotide
caaggcagagactctcctgaagattttctgattcag

SEQ ID NO: 239310 - DNA, 36 bp, Artificial Sequence
  Description of Artificial Sequence: Synthetic oligonucleotide
aaggcagagactctcctgaagattttctgattcagg

SEQ ID NO: 239311 - DNA, 35 bp, Artificial Sequence
  Description of Artificial Sequence: Synthetic oligonucleotide
aggcagagactctcctgaagattttctgattcagg

SEQ ID NO: 239312 - DNA, 34 bp, Artificial Sequence
  Description of Artificial Sequence: Synthetic oligonucleotide
ggcagagactctcctgaagattttctgattcagg

SEQ ID NO: 239313 - DNA, 34 bp, Artificial Sequence
  Description of Artificial Sequence: Synthetic oligonucleotide
gcagagactctcctgaagattttctgattcaggg

SEQ ID NO: 239314 - DNA, 37 bp, Artificial Sequence
  Description of Artificial Sequence: Synthetic oligonucleotide
cagagactctcctgaagattttctgattcagggaaag

SEQ ID NO: 239315 - DNA, 37 bp, Artificial Sequence
  Description of Artificial Sequence: Synthetic oligonucleotide
agagactctcctgaagattttctgattcagggaaagg

SEQ ID NO: 239316 - DNA, 36 bp, Artificial Sequence
  Description of Artificial Sequence: Synthetic oligonucleotide
gagactctcctgaagattttctgattcagggaaagg

SEQ ID NO: 239317 - DNA, 36 bp, Artificial Sequence
  Description of Artificial Sequence: Synthetic oligonucleotide
agactctcctgaagattttctgattcagggaaaggc

SEQ ID NO: 239318 - DNA, 35 bp, Artificial Sequence
  Description of Artificial Sequence: Synthetic oligonucleotide
gactctcctgaagattttctgattcagggaaaggc

SEQ ID NO: 239319 - DNA, 36 bp, Artificial Sequence
  Description of Artificial Sequence: Synthetic oligonucleotide
actctcctgaagattttctgattcagggaaaggctg

SEQ ID NO: 239320 - DNA, 35 bp, Artificial Sequence
  Description of Artificial Sequence: Synthetic oligonucleotide
ctctcctgaagattttctgattcagggaaaggctg

SEQ ID NO: 239321 - DNA, 36 bp, Artificial Sequence
  Description of Artificial Sequence: Synthetic oligonucleotide
tctcctgaagattttctgattcagggaaaggctgag

SEQ ID NO: 239322 - DNA, 35 bp, Artificial Sequence
  Description of Artificial Sequence: Synthetic oligonucleotide
ctcctgaagattttctgattcagggaaaggctgag

SEQ ID NO: 239323 - DNA, 36 bp, Artificial Sequence
  Description of Artificial Sequence: Synthetic oligonucleotide
tcctgaagattttctgattcagggaaaggctgagtg

SEQ ID NO: 239324 - DNA, 35 bp, Artificial Sequence
  Description of Artificial Sequence: Synthetic oligonucleotide
cctgaagattttctgattcagggaaaggctgagtg

SEQ ID NO: 239325 - DNA, 38 bp, Artificial Sequence
  Description of Artificial Sequence: Synthetic oligonucleotide
ctgaagattttctgattcagggaaaggctgagtgttac

SEQ ID NO: 239326 - DNA, 40 bp, Artificial Sequence
  Description of Artificial Sequence: Synthetic oligonucleotide
tgaagattttctgattcagggaaaggctgagtgttacttc

SEQ ID NO: 239327 - DNA, 39 bp, Artificial Sequence
  Description of Artificial Sequence: Synthetic oligonucleotide
gaagattttctgattcagggaaaggctgagtgttacttc

SEQ ID NO: 239328 - DNA, 40 bp, Artificial Sequence
  Description of Artificial Sequence: Synthetic oligonucleotide
aagattttctgattcagggaaaggctgagtgttacttctc

SEQ ID NO: 239329 - DNA, 39 bp, Artificial Sequence
  Description of Artificial Sequence: Synthetic oligonucleotide
agattttctgattcagggaaaggctgagtgttacttctc

SEQ ID NO: 239330 - DNA, 38 bp, Artificial Sequence
  Description of Artificial Sequence: Synthetic oligonucleotide
gattttctgattcagggaaaggctgagtgttacttctc

SEQ ID NO: 239331 - DNA, 38 bp, Artificial Sequence
  Description of Artificial Sequence: Synthetic oligonucleotide
attttctgattcagggaaaggctgagtgttacttctcc

SEQ ID NO: 239332 - DNA, 37 bp, Artificial Sequence
  Description of Artificial Sequence: Synthetic oligonucleotide
ttttctgattcagggaaaggctgagtgttacttctcc

SEQ ID NO: 239333 - DNA, 36 bp, Artificial Sequence
  Description of Artificial Sequence: Synthetic oligonucleotide
tttctgattcagggaaaggctgagtgttacttctcc

SEQ ID NO: 239334 - DNA, 35 bp, Artificial Sequence
  Description of Artificial Sequence: Synthetic oligonucleotide
ttctgattcagggaaaggctgagtgttacttctcc

SEQ ID NO: 239335 - DNA, 34 bp, Artificial Sequence
  Description of Artificial Sequence: Synthetic oligonucleotide
tctgattcagggaaaggctgagtgttacttctcc

SEQ ID NO: 239336 - DNA, 33 bp, Artificial Sequence
  Description of Artificial Sequence: Synthetic oligonucleotide
ctgattcagggaaaggctgagtgttacttctcc

SEQ ID NO: 239337 - DNA, 35 bp, Artificial Sequence
  Description of Artificial Sequence: Synthetic oligonucleotide
tgattcagggaaaggctgagtgttacttctccaac

SEQ ID NO: 239338 - DNA, 34 bp, Artificial Sequence
  Description of Artificial Sequence: Synthetic oligonucleotide
gattcagggaaaggctgagtgttacttctccaac

SEQ ID NO: 239339 - DNA, 34 bp, Artificial Sequence
  Description of Artificial Sequence: Synthetic oligonucleotide
attcagggaaaggctgagtgttacttctccaacg

SEQ ID NO: 239340 - DNA, 33 bp, Artificial Sequence
  Description of Artificial Sequence: Synthetic oligonucleotide
ttcagggaaaggctgagtgttacttctccaacg

SEQ ID NO: 239341 - DNA, 32 bp, Artificial Sequence
  Description of Artificial Sequence: Synthetic oligonucleotide
tcagggaaaggctgagtgttacttctccaacg

SEQ ID NO: 239342 - DNA, 31 bp, Artificial Sequence
  Description of Artificial Sequence: Synthetic oligonucleotide
cagggaaaggctgagtgttacttctccaacg

SEQ ID NO: 239343 - DNA, 31 bp, Artificial Sequence
  Description of Artificial Sequence: Synthetic oligonucleotide
agggaaaggctgagtgttacttctccaacgg

SEQ ID NO: 239344 - DNA, 30 bp, Artificial Sequence
  Description of Artificial Sequence: Synthetic oligonucleotide
gggaaaggctgagtgttacttctccaacgg

SEQ ID NO: 239345 - DNA, 30 bp, Artificial Sequence
  Description of Artificial Sequence: Synthetic oligonucleotide
ggaaaggctgagtgttacttctccaacggg

SEQ ID NO: 239346 - DNA, 31 bp, Artificial Sequence
  Description of Artificial Sequence: Synthetic oligonucleotide
gaaaggctgagtgttacttctccaacgggag

SEQ ID NO: 239347 - DNA, 32 bp, Artificial Sequence
  Description of Artificial Sequence: Synthetic oligonucleotide
aaaggctgagtgttacttctccaacgggagag

SEQ ID NO: 239348 - DNA, 31 bp, Artificial Sequence
  Description of Artificial Sequence: Synthetic oligonucleotide
aaggctgagtgttacttctccaacgggagag

SEQ ID NO: 239349 - DNA, 30 bp, Artificial Sequence
  Description of Artificial Sequence: Synthetic oligonucleotide
aggctgagtgttacttctccaacgggagag

SEQ ID NO: 239350 - DNA, 29 bp, Artificial Sequence
  Description of Artificial Sequence: Synthetic oligonucleotide
ggctgagtgttacttctccaacgggagag

SEQ ID NO: 239351 - DNA, 33 bp, Artificial Sequence
  Description of Artificial Sequence: Synthetic oligonucleotide
gctgagtgttacttctccaacgggagagaaaag

SEQ ID NO: 239352 - DNA, 33 bp, Artificial Sequence
  Description of Artificial Sequence: Synthetic oligonucleotide
ctgagtgttacttctccaacgggagagaaaagg

SEQ ID NO: 239353 - DNA, 34 bp, Artificial Sequence
  Description of Artificial Sequence: Synthetic oligonucleotide
tgagtgttacttctccaacgggagagaaaaggtc

SEQ ID NO: 239354 - DNA, 33 bp, Artificial Sequence
  Description of Artificial Sequence: Synthetic oligonucleotide
gagtgttacttctccaacgggagagaaaaggtc

SEQ ID NO: 239355 - DNA, 33 bp, Artificial Sequence
  Description of Artificial Sequence: Synthetic oligonucleotide
agtgttacttctccaacgggagagaaaaggtcc

SEQ ID NO: 239356 - DNA, 32 bp, Artificial Sequence
  Description of Artificial Sequence: Synthetic oligonucleotide
gtgttacttctccaacgggagagaaaaggtcc

SEQ ID NO: 239357 - DNA, 33 bp, Artificial Sequence
  Description of Artificial Sequence: Synthetic oligonucleotide
tgttacttctccaacgggagagaaaaggtccag

SEQ ID NO: 239358 - DNA, 32 bp, Artificial Sequence
  Description of Artificial Sequence: Synthetic oligonucleotide
gttacttctccaacgggagagaaaaggtccag

SEQ ID NO: 239359 - DNA, 35 bp, Artificial Sequence
  Description of Artificial Sequence: Synthetic oligonucleotide
ttacttctccaacgggagagaaaaggtccagtttg

SEQ ID NO: 239360 - DNA, 34 bp, Artificial Sequence
  Description of Artificial Sequence: Synthetic oligonucleotide
tacttctccaacgggagagaaaaggtccagtttg

SEQ ID NO: 239361 - DNA, 33 bp, Artificial Sequence
  Description of Artificial Sequence: Synthetic oligonucleotide
acttctccaacgggagagaaaaggtccagtttg

SEQ ID NO: 239362 - DNA, 32 bp, Artificial Sequence
  Description of Artificial Sequence: Synthetic oligonucleotide
cttctccaacgggagagaaaaggtccagtttg

SEQ ID NO: 239363 - DNA, 33 bp, Artificial Sequence
  Description of Artificial Sequence: Synthetic oligonucleotide
ttctccaacgggagagaaaaggtccagtttgtg

SEQ ID NO: 239364 - DNA, 32 bp, Artificial Sequence
  Description of Artificial Sequence: Synthetic oligonucleotide
tctccaacgggagagaaaaggtccagtttgtg

SEQ ID NO: 239365 - DNA, 31 bp, Artificial Sequence
  Description of Artificial Sequence: Synthetic oligonucleotide
ctccaacgggagagaaaaggtccagtttgtg

SEQ ID NO: 239366 - DNA, 31 bp, Artificial Sequence
  Description of Artificial Sequence: Synthetic oligonucleotide
tccaacgggagagaaaaggtccagtttgtgc

SEQ ID NO: 239367 - DNA, 30 bp, Artificial Sequence
  Description of Artificial Sequence: Synthetic oligonucleotide
ccaacgggagagaaaaggtccagtttgtgc

SEQ ID NO: 239368 - DNA, 31 bp, Artificial Sequence
  Description of Artificial Sequence: Synthetic oligonucleotide
caacgggagagaaaaggtccagtttgtgctc

SEQ ID NO: 239369 - DNA, 32 bp, Artificial Sequence
  Description of Artificial Sequence: Synthetic oligonucleotide
aacgggagagaaaaggtccagtttgtgctcag

SEQ ID NO: 239370 - DNA, 31 bp, Artificial Sequence
  Description of Artificial Sequence: Synthetic oligonucleotide
acgggagagaaaaggtccagtttgtgctcag

SEQ ID NO: 239371 - DNA, 30 bp, Artificial Sequence
  Description of Artificial Sequence: Synthetic oligonucleotide
cgggagagaaaaggtccagtttgtgctcag

SEQ ID NO: 239372 - DNA, 33 bp, Artificial Sequence
  Description of Artificial Sequence: Synthetic oligonucleotide
gggagagaaaaggtccagtttgtgctcagattc

SEQ ID NO: 239373 - DNA, 35 bp, Artificial Sequence
  Description of Artificial Sequence: Synthetic oligonucleotide
ggagagaaaaggtccagtttgtgctcagattcaac

SEQ ID NO: 239374 - DNA, 40 bp, Artificial Sequence
  Description of Artificial Sequence: Synthetic oligonucleotide
gagagaaaaggtccagtttgtgctcagattcaactttaac

SEQ ID NO: 239375 - DNA, 42 bp, Artificial Sequence
  Description of Artificial Sequence: Synthetic oligonucleotide
agagaaaaggtccagtttgtgctcagattcaactttaacttc

SEQ ID NO: 239376 - DNA, 41 bp, Artificial Sequence
  Description of Artificial Sequence: Synthetic oligonucleotide
gagaaaaggtccagtttgtgctcagattcaactttaacttc

SEQ ID NO: 239377 - DNA, 41 bp, Artificial Sequence
  Description of Artificial Sequence: Synthetic oligonucleotide
agaaaaggtccagtttgtgctcagattcaactttaacttcg

SEQ ID NO: 239378 - DNA, 40 bp, Artificial Sequence
  Description of Artificial Sequence: Synthetic oligonucleotide
gaaaaggtccagtttgtgctcagattcaactttaacttcg

SEQ ID NO: 239379 - DNA, 41 bp, Artificial Sequence
  Description of Artificial Sequence: Synthetic oligonucleotide
aaaaggtccagtttgtgctcagattcaactttaacttcgag

SEQ ID NO: 239380 - DNA, 40 bp, Artificial Sequence
  Description of Artificial Sequence: Synthetic oligonucleotide
aaaggtccagtttgtgctcagattcaactttaacttcgag

SEQ ID NO: 239381 - DNA, 39 bp, Artificial Sequence
  Description of Artificial Sequence: Synthetic oligonucleotide
aaggtccagtttgtgctcagattcaactttaacttcgag

SEQ ID NO: 239382 - DNA, 38 bp, Artificial Sequence
  Description of Artificial Sequence: Synthetic oligonucleotide
aggtccagtttgtgctcagattcaactttaacttcgag

SEQ ID NO: 239383 - DNA, 37 bp, Artificial Sequence
  Description of Artificial Sequence: Synthetic oligonucleotide
ggtccagtttgtgctcagattcaactttaacttcgag

SEQ ID NO: 239384 - DNA, 37 bp, Artificial Sequence
  Description of Artificial Sequence: Synthetic oligonucleotide
gtccagtttgtgctcagattcaactttaacttcgagg

SEQ ID NO: 239385 - DNA, 38 bp, Artificial Sequence
  Description of Artificial Sequence: Synthetic oligonucleotide
tccagtttgtgctcagattcaactttaacttcgaggag

SEQ ID NO: 239386 - DNA, 37 bp, Artificial Sequence
  Description of Artificial Sequence: Synthetic oligonucleotide
ccagtttgtgctcagattcaactttaacttcgaggag

SEQ ID NO: 239387 - DNA, 40 bp, Artificial Sequence
  Description of Artificial Sequence: Synthetic oligonucleotide
cagtttgtgctcagattcaactttaacttcgaggagtatc

SEQ ID NO: 239388 - DNA, 42 bp, Artificial Sequence
  Description of Artificial Sequence: Synthetic oligonucleotide
agtttgtgctcagattcaactttaacttcgaggagtatctac

SEQ ID NO: 239389 - DNA, 41 bp, Artificial Sequence
  Description of Artificial Sequence: Synthetic oligonucleotide
gtttgtgctcagattcaactttaacttcgaggagtatctac

SEQ ID NO: 239390 - DNA, 41 bp, Artificial Sequence
  Description of Artificial Sequence: Synthetic oligonucleotide
tttgtgctcagattcaactttaacttcgaggagtatctacg

SEQ ID NO: 239391 - DNA, 40 bp, Artificial Sequence
  Description of Artificial Sequence: Synthetic oligonucleotide
ttgtgctcagattcaactttaacttcgaggagtatctacg

SEQ ID NO: 239392 - DNA, 39 bp, Artificial Sequence
  Description of Artificial Sequence: Synthetic oligonucleotide
tgtgctcagattcaactttaacttcgaggagtatctacg

SEQ ID NO: 239393 - DNA, 38 bp, Artificial Sequence
  Description of Artificial Sequence: Synthetic oligonucleotide
gtgctcagattcaactttaacttcgaggagtatctacg

SEQ ID NO: 239394 - DNA, 41 bp, Artificial Sequence
  Description of Artificial Sequence: Synthetic oligonucleotide
tgctcagattcaactttaacttcgaggagtatctacgtttc

SEQ ID NO: 239395 - DNA, 40 bp, Artificial Sequence
  Description of Artificial Sequence: Synthetic oligonucleotide
gctcagattcaactttaacttcgaggagtatctacgtttc

SEQ ID NO: 239396 - DNA, 40 bp, Artificial Sequence
  Description of Artificial Sequence: Synthetic oligonucleotide
ctcagattcaactttaacttcgaggagtatctacgtttcg

SEQ ID NO: 239397 - DNA, 41 bp, Artificial Sequence
  Description of Artificial Sequence: Synthetic oligonucleotide
tcagattcaactttaacttcgaggagtatctacgtttcgtc

SEQ ID NO: 239398 - DNA, 40 bp, Artificial Sequence
  Description of Artificial Sequence: Synthetic oligonucleotide
cagattcaactttaacttcgaggagtatctacgtttcgtc

SEQ ID NO: 239399 - DNA, 41 bp, Artificial Sequence
  Description of Artificial Sequence: Synthetic oligonucleotide
agattcaactttaacttcgaggagtatctacgtttcgtcag

SEQ ID NO: 239400 - DNA, 40 bp, Artificial Sequence
  Description of Artificial Sequence: Synthetic oligonucleotide
gattcaactttaacttcgaggagtatctacgtttcgtcag

SEQ ID NO: 239401 - DNA, 41 bp, Artificial Sequence
  Description of Artificial Sequence: Synthetic oligonucleotide
attcaactttaacttcgaggagtatctacgtttcgtcagtg

SEQ ID NO: 239402 - DNA, 40 bp, Artificial Sequence
  Description of Artificial Sequence: Synthetic oligonucleotide
ttcaactttaacttcgaggagtatctacgtttcgtcagtg

SEQ ID NO: 239403 - DNA, 39 bp, Artificial Sequence
  Description of Artificial Sequence: Synthetic oligonucleotide
tcaactttaacttcgaggagtatctacgtttcgtcagtg

SEQ ID NO: 239404 - DNA, 38 bp, Artificial Sequence
  Description of Artificial Sequence: Synthetic oligonucleotide
caactttaacttcgaggagtatctacgtttcgtcagtg

SEQ ID NO: 239405 - DNA, 40 bp, Artificial Sequence
  Description of Artificial Sequence: Synthetic oligonucleotide
aactttaacttcgaggagtatctacgtttcgtcagtgatg

SEQ ID NO: 239406 - DNA, 39 bp, Artificial Sequence
  Description of Artificial Sequence: Synthetic oligonucleotide
actttaacttcgaggagtatctacgtttcgtcagtgatg

SEQ ID NO: 239407 - DNA, 38 bp, Artificial Sequence
  Description of Artificial Sequence: Synthetic oligonucleotide
ctttaacttcgaggagtatctacgtttcgtcagtgatg

SEQ ID NO: 239408 - DNA, 39 bp, Artificial Sequence
  Description of Artificial Sequence: Synthetic oligonucleotide
tttaacttcgaggagtatctacgtttcgtcagtgatgtc

SEQ ID NO: 239409 - DNA, 38 bp, Artificial Sequence
  Description of Artificial Sequence: Synthetic oligonucleotide
ttaacttcgaggagtatctacgtttcgtcagtgatgtc

SEQ ID NO: 239410 - DNA, 37 bp, Artificial Sequence
  Description of Artificial Sequence: Synthetic oligonucleotide
taacttcgaggagtatctacgtttcgtcagtgatgtc

SEQ ID NO: 239411 - DNA, 36 bp, Artificial Sequence
  Description of Artificial Sequence: Synthetic oligonucleotide
aacttcgaggagtatctacgtttcgtcagtgatgtc

SEQ ID NO: 239412 - DNA, 35 bp, Artificial Sequence
  Description of Artificial Sequence: Synthetic oligonucleotide
acttcgaggagtatctacgtttcgtcagtgatgtc

SEQ ID NO: 239413 - DNA, 34 bp, Artificial Sequence
  Description of Artificial Sequence: Synthetic oligonucleotide
cttcgaggagtatctacgtttcgtcagtgatgtc

SEQ ID NO: 239414 - DNA, 34 bp, Artificial Sequence
  Description of Artificial Sequence: Synthetic oligonucleotide
ttcgaggagtatctacgtttcgtcagtgatgtcg

SEQ ID NO: 239415 - DNA, 33 bp, Artificial Sequence
  Description of Artificial Sequence: Synthetic oligonucleotide
tcgaggagtatctacgtttcgtcagtgatgtcg

SEQ ID NO: 239416 - DNA, 32 bp, Artificial Sequence
  Description of Artificial Sequence: Synthetic oligonucleotide
cgaggagtatctacgtttcgtcagtgatgtcg

SEQ ID NO: 239417 - DNA, 32 bp, Artificial Sequence
  Description of Artificial Sequence: Synthetic oligonucleotide
gaggagtatctacgtttcgtcagtgatgtcgg

SEQ ID NO: 239418 - DNA, 32 bp, Artificial Sequence
  Description of Artificial Sequence: Synthetic oligonucleotide
aggagtatctacgtttcgtcagtgatgtcggg

SEQ ID NO: 239419 - DNA, 31 bp, Artificial Sequence
  Description of Artificial Sequence: Synthetic oligonucleotide
ggagtatctacgtttcgtcagtgatgtcggg

SEQ ID NO: 239420 - DNA, 33 bp, Artificial Sequence
  Description of Artificial Sequence: Synthetic oligonucleotide
gagtatctacgtttcgtcagtgatgtcgggatg

SEQ ID NO: 239421 - DNA, 36 bp, Artificial Sequence
  Description of Artificial Sequence: Synthetic oligonucleotide
agtatctacgtttcgtcagtgatgtcgggatgtttc

SEQ ID NO: 239422 - DNA, 35 bp, Artificial Sequence
  Description of Artificial Sequence: Synthetic oligonucleotide
gtatctacgtttcgtcagtgatgtcgggatgtttc

SEQ ID NO: 239423 - DNA, 36 bp, Artificial Sequence
  Description of Artificial Sequence: Synthetic oligonucleotide
tatctacgtttcgtcagtgatgtcgggatgtttctg

SEQ ID NO: 239424 - DNA, 35 bp, Artificial Sequence
  Description of Artificial Sequence: Synthetic oligonucleotide
atctacgtttcgtcagtgatgtcgggatgtttctg

SEQ ID NO: 239425 - DNA, 34 bp, Artificial Sequence
  Description of Artificial Sequence: Synthetic oligonucleotide
tctacgtttcgtcagtgatgtcgggatgtttctg

SEQ ID NO: 239426 - DNA, 33 bp, Artificial Sequence
  Description of Artificial Sequence: Synthetic oligonucleotide
ctacgtttcgtcagtgatgtcgggatgtttctg

SEQ ID NO: 239427 - DNA, 33 bp, Artificial Sequence
  Description of Artificial Sequence: Synthetic oligonucleotide
tacgtttcgtcagtgatgtcgggatgtttctgg

SEQ ID NO: 239428 - DNA, 32 bp, Artificial Sequence
  Description of Artificial Sequence: Synthetic oligonucleotide
acgtttcgtcagtgatgtcgggatgtttctgg

SEQ ID NO: 239429 - DNA, 31 bp, Artificial Sequence
  Description of Artificial Sequence: Synthetic oligonucleotide
cgtttcgtcagtgatgtcgggatgtttctgg

SEQ ID NO: 239430 - DNA, 31 bp, Artificial Sequence
  Description of Artificial Sequence: Synthetic oligonucleotide
gtttcgtcagtgatgtcgggatgtttctggc

SEQ ID NO: 239431 - DNA, 34 bp, Artificial Sequence
  Description of Artificial Sequence: Synthetic oligonucleotide
tttcgtcagtgatgtcgggatgtttctggcattg

SEQ ID NO: 239432 - DNA, 33 bp, Artificial Sequence
  Description of Artificial Sequence: Synthetic oligonucleotide
ttcgtcagtgatgtcgggatgtttctggcattg

SEQ ID NO: 239433 - DNA, 32 bp, Artificial Sequence
  Description of Artificial Sequence: Synthetic oligonucleotide
tcgtcagtgatgtcgggatgtttctggcattg

SEQ ID NO: 239434 - DNA, 31 bp, Artificial Sequence
  Description of Artificial Sequence: Synthetic oligonucleotide
cgtcagtgatgtcgggatgtttctggcattg

SEQ ID NO: 239435 - DNA, 32 bp, Artificial Sequence
  Description of Artificial Sequence: Synthetic oligonucleotide
gtcagtgatgtcgggatgtttctggcattgag

SEQ ID NO: 239436 - DNA, 32 bp, Artificial Sequence
  Description of Artificial Sequence: Synthetic oligonucleotide
tcagtgatgtcgggatgtttctggcattgagc

SEQ ID NO: 239437 - DNA, 31 bp, Artificial Sequence
  Description of Artificial Sequence: Synthetic oligonucleotide
cagtgatgtcgggatgtttctggcattgagc

SEQ ID NO: 239438 - DNA, 33 bp, Artificial Sequence
  Description of Artificial Sequence: Synthetic oligonucleotide
agtgatgtcgggatgtttctggcattgagcaag

SEQ ID NO: 239439 - DNA, 32 bp, Artificial Sequence
  Description of Artificial Sequence: Synthetic oligonucleotide
gtgatgtcgggatgtttctggcattgagcaag

SEQ ID NO: 239440 - DNA, 32 bp, Artificial Sequence
  Description of Artificial Sequence: Synthetic oligonucleotide
tgatgtcgggatgtttctggcattgagcaagc

SEQ ID NO: 239441 - DNA, 31 bp, Artificial Sequence
  Description of Artificial Sequence: Synthetic oligonucleotide
gatgtcgggatgtttctggcattgagcaagc

SEQ ID NO: 239442 - DNA, 32 bp, Artificial Sequence
  Description of Artificial Sequence: Synthetic oligonucleotide
atgtcgggatgtttctggcattgagcaagctg

SEQ ID NO: 239443 - DNA, 31 bp, Artificial Sequence
  Description of Artificial Sequence: Synthetic oligonucleotide
tgtcgggatgtttctggcattgagcaagctg

SEQ ID NO: 239444 - DNA, 30 bp, Artificial Sequence
  Description of Artificial Sequence: Synthetic oligonucleotide
gtcgggatgtttctggcattgagcaagctg

SEQ ID NO: 239445 - DNA, 30 bp, Artificial Sequence
  Description of Artificial Sequence: Synthetic oligonucleotide
tcgggatgtttctggcattgagcaagctgg

SEQ ID NO: 239446 - DNA, 29 bp, Artificial Sequence
  Description of Artificial Sequence: Synthetic oligonucleotide
cgggatgtttctggcattgagcaagctgg

SEQ ID NO: 239447 - DNA, 29 bp, Artificial Sequence
  Description of Artificial Sequence: Synthetic oligonucleotide
gggatgtttctggcattgagcaagctggg

SEQ ID NO: 239448 - DNA, 29 bp, Artificial Sequence
  Description of Artificial Sequence: Synthetic oligonucleotide
ggatgtttctggcattgagcaagctgggc

SEQ ID NO: 239449 - DNA, 29 bp, Artificial Sequence
  Description of Artificial Sequence: Synthetic oligonucleotide
gatgtttctggcattgagcaagctgggcc

SEQ ID NO: 239450 - DNA, 30 bp, Artificial Sequence
  Description of Artificial Sequence: Synthetic oligonucleotide
atgtttctggcattgagcaagctgggccag

SEQ ID NO: 239451 - DNA, 29 bp, Artificial Sequence
  Description of Artificial Sequence: Synthetic oligonucleotide
tgtttctggcattgagcaagctgggccag

SEQ ID NO: 239452 - DNA, 28 bp, Artificial Sequence
  Description of Artificial Sequence: Synthetic oligonucleotide
gtttctggcattgagcaagctgggccag

SEQ ID NO: 239453 - DNA, 28 bp, Artificial Sequence
  Description of Artificial Sequence: Synthetic oligonucleotide
tttctggcattgagcaagctgggccagc

SEQ ID NO: 239454 - DNA, 27 bp, Artificial Sequence
  Description of Artificial Sequence: Synthetic oligonucleotide
ttctggcattgagcaagctgggccagc

SEQ ID NO: 239455 - DNA, 26 bp, Artificial Sequence
  Description of Artificial Sequence: Synthetic oligonucleotide
tctggcattgagcaagctgggccagc

SEQ ID NO: 239456 - DNA, 25 bp, Artificial Sequence
  Description of Artificial Sequence: Synthetic oligonucleotide
ctggcattgagcaagctgggccagc

SEQ ID NO: 239457 - DNA, 26 bp, Artificial Sequence
  Description of Artificial Sequence: Synthetic oligonucleotide
tggcattgagcaagctgggccagcca

SEQ ID NO: 239458 - DNA, 25 bp, Artificial Sequence
  Description of Artificial Sequence: Synthetic oligonucleotide
ggcattgagcaagctgggccagcca

SEQ ID NO: 239459 - DNA, 27 bp, Artificial Sequence
  Description of Artificial Sequence: Synthetic oligonucleotide
gcattgagcaagctgggccagccagat

SEQ ID NO: 239460 - DNA, 27 bp, Artificial Sequence
  Description of Artificial Sequence: Synthetic oligonucleotide
cattgagcaagctgggccagccagatc

SEQ ID NO: 239461 - DNA, 27 bp, Artificial Sequence
  Description of Artificial Sequence: Synthetic oligonucleotide
attgagcaagctgggccagccagatcc

SEQ ID NO: 239462 - DNA, 27 bp, Artificial Sequence
  Description of Artificial Sequence: Synthetic oligonucleotide
ttgagcaagctgggccagccagatcct

SEQ ID NO: 239463 - DNA, 26 bp, Artificial Sequence
  Description of Artificial Sequence: Synthetic oligonucleotide
tgagcaagctgggccagccagatcct

SEQ ID NO: 239464 - DNA, 25 bp, Artificial Sequence
  Description of Artificial Sequence: Synthetic oligonucleotide
gagcaagctgggccagccagatcct

SEQ ID NO: 239465 - DNA, 26 bp, Artificial Sequence
  Description of Artificial Sequence: Synthetic oligonucleotide
agcaagctgggccagccagatcctga

SEQ ID NO: 239466 - DNA, 25 bp, Artificial Sequence
  Description of Artificial Sequence: Synthetic oligonucleotide
gcaagctgggccagccagatcctga

SEQ ID NO: 239467 - DNA, 25 bp, Artificial Sequence
  Description of Artificial Sequence: Synthetic oligonucleotide
caagctgggccagccagatcctgag

SEQ ID NO: 239468 - DNA, 26 bp, Artificial Sequence
  Description of Artificial Sequence: Synthetic oligonucleotide
aagctgggccagccagatcctgagca

SEQ ID NO: 239469 - DNA, 25 bp, Artificial Sequence
  Description of Artificial Sequence: Synthetic oligonucleotide
agctgggccagccagatcctgagca

SEQ ID NO: 239470 - DNA, 24 bp, Artificial Sequence
  Description of Artificial Sequence: Synthetic oligonucleotide
gctgggccagccagatcctgagca

SEQ ID NO: 239471 - DNA, 25 bp, Artificial Sequence
  Description of Artificial Sequence: Synthetic oligonucleotide
ctgggccagccagatcctgagcagt

SEQ ID NO: 239472 - DNA, 25 bp, Artificial Sequence
  Description of Artificial Sequence: Synthetic oligonucleotide
tgggccagccagatcctgagcagtc

SEQ ID NO: 239473 - DNA, 24 bp, Artificial Sequence
  Description of Artificial Sequence: Synthetic oligonucleotide
gggccagccagatcctgagcagtc

SEQ ID NO: 239474 - DNA, 26 bp, Artificial Sequence
  Description of Artificial Sequence: Synthetic oligonucleotide
ggccagccagatcctgagcagtcgaa

SEQ ID NO: 239475 - DNA, 27 bp, Artificial Sequence
  Description of Artificial Sequence: Synthetic oligonucleotide
gccagccagatcctgagcagtcgaaca

SEQ ID NO: 239476 - DNA, 27 bp, Artificial Sequence
  Description of Artificial Sequence: Synthetic oligonucleotide
ccagccagatcctgagcagtcgaacag

SEQ ID NO: 239477 - DNA, 27 bp, Artificial Sequence
  Description of Artificial Sequence: Synthetic oligonucleotide
cagccagatcctgagcagtcgaacagc

SEQ ID NO: 239478 - DNA, 27 bp, Artificial Sequence
  Description of Artificial Sequence: Synthetic oligonucleotide
agccagatcctgagcagtcgaacagcc

SEQ ID NO: 239479 - DNA, 26 bp, Artificial Sequence
  Description of Artificial Sequence: Synthetic oligonucleotide
gccagatcctgagcagtcgaacagcc

SEQ ID NO: 239480 - DNA, 26 bp, Artificial Sequence
  Description of Artificial Sequence: Synthetic oligonucleotide
ccagatcctgagcagtcgaacagccg

SEQ ID NO: 239481 - DNA, 26 bp, Artificial Sequence
  Description of Artificial Sequence: Synthetic oligonucleotide
cagatcctgagcagtcgaacagccgc

SEQ ID NO: 239482 - DNA, 27 bp, Artificial Sequence
  Description of Artificial Sequence: Synthetic oligonucleotide
agatcctgagcagtcgaacagccgcct

SEQ ID NO: 239483 - DNA, 26 bp, Artificial Sequence
  Description of Artificial Sequence: Synthetic oligonucleotide
gatcctgagcagtcgaacagccgcct

SEQ ID NO: 239484 - DNA, 26 bp, Artificial Sequence
  Description of Artificial Sequence: Synthetic oligonucleotide
atcctgagcagtcgaacagccgcctg

SEQ ID NO: 239485 - DNA, 25 bp, Artificial Sequence
  Description of Artificial Sequence: Synthetic oligonucleotide
tcctgagcagtcgaacagccgcctg

SEQ ID NO: 239486 - DNA, 24 bp, Artificial Sequence
  Description of Artificial Sequence: Synthetic oligonucleotide
cctgagcagtcgaacagccgcctg

SEQ ID NO: 239487 - DNA, 26 bp, Artificial Sequence
  Description of Artificial Sequence: Synthetic oligonucleotide
ctgagcagtcgaacagccgcctggat

SEQ ID NO: 239488 - DNA, 27 bp, Artificial Sequence
  Description of Artificial Sequence: Synthetic oligonucleotide
tgagcagtcgaacagccgcctggatct

SEQ ID NO: 239489 - DNA, 26 bp, Artificial Sequence
  Description of Artificial Sequence: Synthetic oligonucleotide
gagcagtcgaacagccgcctggatct

SEQ ID NO: 239490 - DNA, 27 bp, Artificial Sequence
  Description of Artificial Sequence: Synthetic oligonucleotide
agcagtcgaacagccgcctggatctca

SEQ ID NO: 239491 - DNA, 27 bp, Artificial Sequence
  Description of Artificial Sequence: Synthetic oligonucleotide
gcagtcgaacagccgcctggatctcat

SEQ ID NO: 239492 - DNA, 27 bp, Artificial Sequence
  Description of Artificial Sequence: Synthetic oligonucleotide
cagtcgaacagccgcctggatctcatg

SEQ ID NO: 239493 - DNA, 27 bp, Artificial Sequence
  Description of Artificial Sequence: Synthetic oligonucleotide
agtcgaacagccgcctggatctcatgg

SEQ ID NO: 239494 - DNA, 27 bp, Artificial Sequence
  Description of Artificial Sequence: Synthetic oligonucleotide
gtcgaacagccgcctggatctcatgga

SEQ ID NO: 239495 - DNA, 27 bp, Artificial Sequence
  Description of Artificial Sequence: Synthetic oligonucleotide
tcgaacagccgcctggatctcatggag

SEQ ID NO: 239496 - DNA, 27 bp, Artificial Sequence
  Description of Artificial Sequence: Synthetic oligonucleotide
cgaacagccgcctggatctcatggaga

SEQ ID NO: 239497 - DNA, 27 bp, Artificial Sequence
  Description of Artificial Sequence: Synthetic oligonucleotide
gaacagccgcctggatctcatggagag

SEQ ID NO: 239498 - DNA, 27 bp, Artificial Sequence
  Description of Artificial Sequence: Synthetic oligonucleotide
aacagccgcctggatctcatggagagg

SEQ ID NO: 239499 - DNA, 27 bp, Artificial Sequence
  Description of Artificial Sequence: Synthetic oligonucleotide
acagccgcctggatctcatggagagga

SEQ ID NO: 239500 - DNA, 26 bp, Artificial Sequence
  Description of Artificial Sequence: Synthetic oligonucleotide
cagccgcctggatctcatggagagga

SEQ ID NO: 239501 - DNA, 26 bp, Artificial Sequence
  Description of Artificial Sequence: Synthetic oligonucleotide
agccgcctggatctcatggagaggac

SEQ ID NO: 239502 - DNA, 25 bp, Artificial Sequence
  Description of Artificial Sequence: Synthetic oligonucleotide
gccgcctggatctcatggagaggac

SEQ ID NO: 239503 - DNA, 26 bp, Artificial Sequence
  Description of Artificial Sequence: Synthetic oligonucleotide
ccgcctggatctcatggagaggacca

SEQ ID NO: 239504 - DNA, 27 bp, Artificial Sequence
  Description of Artificial Sequence: Synthetic oligonucleotide
cgcctggatctcatggagaggaccaga

SEQ ID NO: 239505 - DNA, 27 bp, Artificial Sequence
  Description of Artificial Sequence: Synthetic oligonucleotide
gcctggatctcatggagaggaccagac

SEQ ID NO: 239506 - DNA, 28 bp, Artificial Sequence
  Description of Artificial Sequence: Synthetic oligonucleotide
cctggatctcatggagaggaccagacag

SEQ ID NO: 239507 - DNA, 28 bp, Artificial Sequence
  Description of Artificial Sequence: Synthetic oligonucleotide
ctggatctcatggagaggaccagacagg

SEQ ID NO: 239508 - DNA, 28 bp, Artificial Sequence
  Description of Artificial Sequence: Synthetic oligonucleotide
tggatctcatggagaggaccagacaggc

SEQ ID NO: 239509 - DNA, 27 bp, Artificial Sequence
  Description of Artificial Sequence: Synthetic oligonucleotide
ggatctcatggagaggaccagacaggc

SEQ ID NO: 239510 - DNA, 27 bp, Artificial Sequence
  Description of Artificial Sequence: Synthetic oligonucleotide
gatctcatggagaggaccagacaggcg

SEQ ID NO: 239511 - DNA, 27 bp, Artificial Sequence
  Description of Artificial Sequence: Synthetic oligonucleotide
atctcatggagaggaccagacaggcgg

SEQ ID NO: 239512 - DNA, 27 bp, Artificial Sequence
  Description of Artificial Sequence: Synthetic oligonucleotide
tctcatggagaggaccagacaggcggt

SEQ ID NO: 239513 - DNA, 26 bp, Artificial Sequence
  Description of Artificial Sequence: Synthetic oligonucleotide
ctcatggagaggaccagacaggcggt

SEQ ID NO: 239514 - DNA, 26 bp, Artificial Sequence
  Description of Artificial Sequence: Synthetic oligonucleotide
tcatggagaggaccagacaggcggtg

SEQ ID NO: 239515 - DNA, 25 bp, Artificial Sequence
  Description of Artificial Sequence: Synthetic oligonucleotide
catggagaggaccagacaggcggtg

SEQ ID NO: 239516 - DNA, 27 bp, Artificial Sequence
  Description of Artificial Sequence: Synthetic oligonucleotide
atggagaggaccagacaggcggtggat

SEQ ID NO: 239517 - DNA, 26 bp, Artificial Sequence
  Description of Artificial Sequence: Synthetic oligonucleotide
tggagaggaccagacaggcggtggat

SEQ ID NO: 239518 - DNA, 25 bp, Artificial Sequence
  Description of Artificial Sequence: Synthetic oligonucleotide
ggagaggaccagacaggcggtggat

SEQ ID NO: 239519 - DNA, 25 bp, Artificial Sequence
  Description of Artificial Sequence: Synthetic oligonucleotide
gagaggaccagacaggcggtggatg

SEQ ID NO: 239520 - DNA, 25 bp, Artificial Sequence
  Description of Artificial Sequence: Synthetic oligonucleotide
agaggaccagacaggcggtggatgg

SEQ ID NO: 239521 - DNA, 24 bp, Artificial Sequence
  Description of Artificial Sequence: Synthetic oligonucleotide
gaggaccagacaggcggtggatgg

SEQ ID NO: 239522 - DNA, 24 bp, Artificial Sequence
  Description of Artificial Sequence: Synthetic oligonucleotide
aggaccagacaggcggtggatggg

SEQ ID NO: 239523 - DNA, 23 bp, Artificial Sequence
  Description of Artificial Sequence: Synthetic oligonucleotide
ggaccagacaggcggtggatggg

SEQ ID NO: 239524 - DNA, 24 bp, Artificial Sequence
  Description of Artificial Sequence: Synthetic oligonucleotide
gaccagacaggcggtggatgggct

SEQ ID NO: 239525 - DNA, 25 bp, Artificial Sequence
  Description of Artificial Sequence: Synthetic oligonucleotide
accagacaggcggtggatgggctct

SEQ ID NO: 239526 - DNA, 24 bp, Artificial Sequence
  Description of Artificial Sequence: Synthetic oligonucleotide
ccagacaggcggtggatgggctct

SEQ ID NO: 239527 - DNA, 26 bp, Artificial Sequence
  Description of Artificial Sequence: Synthetic oligonucleotide
cagacaggcggtggatgggctctgta

SEQ ID NO: 239528 - DNA, 27 bp, Artificial Sequence
  Description of Artificial Sequence: Synthetic oligonucleotide
agacaggcggtggatgggctctgtaga

SEQ ID NO: 239529 - DNA, 26 bp, Artificial Sequence
  Description of Artificial Sequence: Synthetic oligonucleotide
gacaggcggtggatgggctctgtaga

SEQ ID NO: 239530 - DNA, 27 bp, Artificial Sequence
  Description of Artificial Sequence: Synthetic oligonucleotide
acaggcggtggatgggctctgtagact

SEQ ID NO: 239531 - DNA, 26 bp, Artificial Sequence
  Description of Artificial Sequence: Synthetic oligonucleotide
caggcggtggatgggctctgtagact

SEQ ID NO: 239532 - DNA, 27 bp, Artificial Sequence
  Description of Artificial Sequence: Synthetic oligonucleotide
aggcggtggatgggctctgtagactca

SEQ ID NO: 239533 - DNA, 27 bp, Artificial Sequence
  Description of Artificial Sequence: Synthetic oligonucleotide
ggcggtggatgggctctgtagactcaa

SEQ ID NO: 239534 - DNA, 27 bp, Artificial Sequence
  Description of Artificial Sequence: Synthetic oligonucleotide
gcggtggatgggctctgtagactcaac

SEQ ID NO: 239535 - DNA, 29 bp, Artificial Sequence
  Description of Artificial Sequence: Synthetic oligonucleotide
cggtggatgggctctgtagactcaactac

SEQ ID NO: 239536 - DNA, 30 bp, Artificial Sequence
  Description of Artificial Sequence: Synthetic oligonucleotide
ggtggatgggctctgtagactcaactacag

SEQ ID NO: 239537 - DNA, 30 bp, Artificial Sequence
  Description of Artificial Sequence: Synthetic oligonucleotide
gtggatgggctctgtagactcaactacagc

SEQ ID NO: 239538 - DNA, 30 bp, Artificial Sequence
  Description of Artificial Sequence: Synthetic oligonucleotide
tggatgggctctgtagactcaactacagcc

SEQ ID NO: 239539 - DNA, 29 bp, Artificial Sequence
  Description of Artificial Sequence: Synthetic oligonucleotide
ggatgggctctgtagactcaactacagcc

SEQ ID NO: 239540 - DNA, 30 bp, Artificial Sequence
  Description of Artificial Sequence: Synthetic oligonucleotide
gatgggctctgtagactcaactacagcctg

SEQ ID NO: 239541 - DNA, 30 bp, Artificial Sequence
  Description of Artificial Sequence: Synthetic oligonucleotide
atgggctctgtagactcaactacagcctgg

SEQ ID NO: 239542 - DNA, 29 bp, Artificial Sequence
  Description of Artificial Sequence: Synthetic oligonucleotide
tgggctctgtagactcaactacagcctgg

SEQ ID NO: 239543 - DNA, 28 bp, Artificial Sequence
  Description of Artificial Sequence: Synthetic oligonucleotide
gggctctgtagactcaactacagcctgg

SEQ ID NO: 239544 - DNA, 28 bp, Artificial Sequence
  Description of Artificial Sequence: Synthetic oligonucleotide
ggctctgtagactcaactacagcctggg

SEQ ID NO: 239545 - DNA, 28 bp, Artificial Sequence
  Description of Artificial Sequence: Synthetic oligonucleotide
gctctgtagactcaactacagcctgggc

SEQ ID NO: 239546 - DNA, 28 bp, Artificial Sequence
  Description of Artificial Sequence: Synthetic oligonucleotide
ctctgtagactcaactacagcctgggcg

SEQ ID NO: 239547 - DNA, 28 bp, Artificial Sequence
  Description of Artificial Sequence: Synthetic oligonucleotide
tctgtagactcaactacagcctgggcgc

SEQ ID NO: 239548 - DNA, 27 bp, Artificial Sequence
  Description of Artificial Sequence: Synthetic oligonucleotide
ctgtagactcaactacagcctgggcgc

SEQ ID NO: 239549 - DNA, 28 bp, Artificial Sequence
  Description of Artificial Sequence: Synthetic oligonucleotide
tgtagactcaactacagcctgggcgcag

SEQ ID NO: 239550 - DNA, 27 bp, Artificial Sequence
  Description of Artificial Sequence: Synthetic oligonucleotide
gtagactcaactacagcctgggcgcag

SEQ ID NO: 239551 - DNA, 27 bp, Artificial Sequence
  Description of Artificial Sequence: Synthetic oligonucleotide
tagactcaactacagcctgggcgcagc

SEQ ID NO: 239552 - DNA, 26 bp, Artificial Sequence
  Description of Artificial Sequence: Synthetic oligonucleotide
agactcaactacagcctgggcgcagc

SEQ ID NO: 239553 - DNA, 25 bp, Artificial Sequence
  Description of Artificial Sequence: Synthetic oligonucleotide
gactcaactacagcctgggcgcagc

SEQ ID NO: 239554 - DNA, 27 bp, Artificial Sequence
  Description of Artificial Sequence: Synthetic oligonucleotide
actcaactacagcctgggcgcagcctt

SEQ ID NO: 239555 - DNA, 26 bp, Artificial Sequence
  Description of Artificial Sequence: Synthetic oligonucleotide
ctcaactacagcctgggcgcagcctt

SEQ ID NO: 239556 - DNA, 27 bp, Artificial Sequence
  Description of Artificial Sequence: Synthetic oligonucleotide
tcaactacagcctgggcgcagccttca

SEQ ID NO: 239557 - DNA, 26 bp, Artificial Sequence
  Description of Artificial Sequence: Synthetic oligonucleotide
caactacagcctgggcgcagccttca

SEQ ID NO: 239558 - DNA, 27 bp, Artificial Sequence
  Description of Artificial Sequence: Synthetic oligonucleotide
aactacagcctgggcgcagccttcact

SEQ ID NO: 239559 - DNA, 26 bp, Artificial Sequence
  Description of Artificial Sequence: Synthetic oligonucleotide
actacagcctgggcgcagccttcact

SEQ ID NO: 239560 - DNA, 25 bp, Artificial Sequence
  Description of Artificial Sequence: Synthetic oligonucleotide
ctacagcctgggcgcagccttcact

SEQ ID NO: 239561 - DNA, 26 bp, Artificial Sequence
  Description of Artificial Sequence: Synthetic oligonucleotide
tacagcctgggcgcagccttcactga

SEQ ID NO: 239562 - DNA, 25 bp, Artificial Sequence
  Description of Artificial Sequence: Synthetic oligonucleotide
acagcctgggcgcagccttcactga

SEQ ID NO: 239563 - DNA, 24 bp, Artificial Sequence
  Description of Artificial Sequence: Synthetic oligonucleotide
cagcctgggcgcagccttcactga

SEQ ID NO: 239564 - DNA, 24 bp, Artificial Sequence
  Description of Artificial Sequence: Synthetic oligonucleotide
agcctgggcgcagccttcactgag

SEQ ID NO: 239565 - DNA, 23 bp, Artificial Sequence
  Description of Artificial Sequence: Synthetic oligonucleotide
gcctgggcgcagccttcactgag

SEQ ID NO: 239566 - DNA, 23 bp, Artificial Sequence
  Description of Artificial Sequence: Synthetic oligonucleotide
cctgggcgcagccttcactgagg

SEQ ID NO: 239567 - DNA, 23 bp, Artificial Sequence
  Description of Artificial Sequence: Synthetic oligonucleotide
ctgggcgcagccttcactgaggg

SEQ ID NO: 239568 - DNA, 24 bp, Artificial Sequence
  Description of Artificial Sequence: Synthetic oligonucleotide
tgggcgcagccttcactgagggga

SEQ ID NO: 239569 - DNA, 23 bp, Artificial Sequence
  Description of Artificial Sequence: Synthetic oligonucleotide
gggcgcagccttcactgagggga

SEQ ID NO: 239570 - DNA, 27 bp, Artificial Sequence
  Description of Artificial Sequence: Synthetic oligonucleotide
ggcgcagccttcactgaggggagaaat

SEQ ID NO: 239571 - DNA, 27 bp, Artificial Sequence
  Description of Artificial Sequence: Synthetic oligonucleotide
gcgcagccttcactgaggggagaaatg

SEQ ID NO: 239572 - DNA, 28 bp, Artificial Sequence
  Description of Artificial Sequence: Synthetic oligonucleotide
cgcagccttcactgaggggagaaatgtg

SEQ ID NO: 239573 - DNA, 28 bp, Artificial Sequence
  Description of Artificial Sequence: Synthetic oligonucleotide
gcagccttcactgaggggagaaatgtgc

SEQ ID NO: 239574 - DNA, 30 bp, Artificial Sequence
  Description of Artificial Sequence: Synthetic oligonucleotide
cagccttcactgaggggagaaatgtgcaac

SEQ ID NO: 239575 - DNA, 30 bp, Artificial Sequence
  Description of Artificial Sequence: Synthetic oligonucleotide
agccttcactgaggggagaaatgtgcaacc

SEQ ID NO: 239576 - DNA, 29 bp, Artificial Sequence
  Description of Artificial Sequence: Synthetic oligonucleotide
gccttcactgaggggagaaatgtgcaacc

SEQ ID NO: 239577 - DNA, 30 bp, Artificial Sequence
  Description of Artificial Sequence: Synthetic oligonucleotide
ccttcactgaggggagaaatgtgcaaccac

SEQ ID NO: 239578 - DNA, 31 bp, Artificial Sequence
  Description of Artificial Sequence: Synthetic oligonucleotide
cttcactgaggggagaaatgtgcaaccacag

SEQ ID NO: 239579 - DNA, 31 bp, Artificial Sequence
  Description of Artificial Sequence: Synthetic oligonucleotide
ttcactgaggggagaaatgtgcaaccacagg

SEQ ID NO: 239580 - DNA, 30 bp, Artificial Sequence
  Description of Artificial Sequence: Synthetic oligonucleotide
tcactgaggggagaaatgtgcaaccacagg

SEQ ID NO: 239581 - DNA, 29 bp, Artificial Sequence
  Description of Artificial Sequence: Synthetic oligonucleotide
cactgaggggagaaatgtgcaaccacagg

SEQ ID NO: 239582 - DNA, 30 bp, Artificial Sequence
  Description of Artificial Sequence: Synthetic oligonucleotide
actgaggggagaaatgtgcaaccacaggtg

SEQ ID NO: 239583 - DNA, 29 bp, Artificial Sequence
  Description of Artificial Sequence: Synthetic oligonucleotide
ctgaggggagaaatgtgcaaccacaggtg

SEQ ID NO: 239584 - DNA, 30 bp, Artificial Sequence
  Description of Artificial Sequence: Synthetic oligonucleotide
tgaggggagaaatgtgcaaccacaggtgac

SEQ ID NO: 239585 - DNA, 29 bp, Artificial Sequence
  Description of Artificial Sequence: Synthetic oligonucleotide
gaggggagaaatgtgcaaccacaggtgac

SEQ ID NO: 239586 - DNA, 30 bp, Artificial Sequence
  Description of Artificial Sequence: Synthetic oligonucleotide
aggggagaaatgtgcaaccacaggtgacag

SEQ ID NO: 239587 - DNA, 29 bp, Artificial Sequence
  Description of Artificial Sequence: Synthetic oligonucleotide
ggggagaaatgtgcaaccacaggtgacag

SEQ ID NO: 239588 - DNA, 30 bp, Artificial Sequence
  Description of Artificial Sequence: Synthetic oligonucleotide
gggagaaatgtgcaaccacaggtgacagag

SEQ ID NO: 239589 - DNA, 32 bp, Artificial Sequence
  Description of Artificial Sequence: Synthetic oligonucleotide
ggagaaatgtgcaaccacaggtgacagagtac

SEQ ID NO: 239590 - DNA, 32 bp, Artificial Sequence
  Description of Artificial Sequence: Synthetic oligonucleotide
gagaaatgtgcaaccacaggtgacagagtacc

SEQ ID NO: 239591 - DNA, 32 bp, Artificial Sequence
  Description of Artificial Sequence: Synthetic oligonucleotide
agaaatgtgcaaccacaggtgacagagtaccc

SEQ ID NO: 239592 - DNA, 31 bp, Artificial Sequence
  Description of Artificial Sequence: Synthetic oligonucleotide
gaaatgtgcaaccacaggtgacagagtaccc

SEQ ID NO: 239593 - DNA, 32 bp, Artificial Sequence
  Description of Artificial Sequence: Synthetic oligonucleotide
aaatgtgcaaccacaggtgacagagtacccag

SEQ ID NO: 239594 - DNA, 31 bp, Artificial Sequence
  Description of Artificial Sequence: Synthetic oligonucleotide
aatgtgcaaccacaggtgacagagtacccag

SEQ ID NO: 239595 - DNA, 30 bp, Artificial Sequence
  Description of Artificial Sequence: Synthetic oligonucleotide
atgtgcaaccacaggtgacagagtacccag

SEQ ID NO: 239596 - DNA, 29 bp, Artificial Sequence
  Description of Artificial Sequence: Synthetic oligonucleotide
tgtgcaaccacaggtgacagagtacccag

SEQ ID NO: 239597 - DNA, 28 bp, Artificial Sequence
  Description of Artificial Sequence: Synthetic oligonucleotide
gtgcaaccacaggtgacagagtacccag

SEQ ID NO: 239598 - DNA, 29 bp, Artificial Sequence
  Description of Artificial Sequence: Synthetic oligonucleotide
tgcaaccacaggtgacagagtacccagac

SEQ ID NO: 239599 - DNA, 28 bp, Artificial Sequence
  Description of Artificial Sequence: Synthetic oligonucleotide
gcaaccacaggtgacagagtacccagac

SEQ ID NO: 239600 - DNA, 29 bp, Artificial Sequence
  Description of Artificial Sequence: Synthetic oligonucleotide
caaccacaggtgacagagtacccagacag

SEQ ID NO: 239601 - DNA, 29 bp, Artificial Sequence
  Description of Artificial Sequence: Synthetic oligonucleotide
aaccacaggtgacagagtacccagacagg

SEQ ID NO: 239602 - DNA, 28 bp, Artificial Sequence
  Description of Artificial Sequence: Synthetic oligonucleotide
accacaggtgacagagtacccagacagg

SEQ ID NO: 239603 - DNA, 27 bp, Artificial Sequence
  Description of Artificial Sequence: Synthetic oligonucleotide
ccacaggtgacagagtacccagacagg

SEQ ID NO: 239604 - DNA, 28 bp, Artificial Sequence
  Description of Artificial Sequence: Synthetic oligonucleotide
cacaggtgacagagtacccagacaggac

SEQ ID NO: 239605 - DNA, 28 bp, Artificial Sequence
  Description of Artificial Sequence: Synthetic oligonucleotide
acaggtgacagagtacccagacaggacc

SEQ ID NO: 239606 - DNA, 27 bp, Artificial Sequence
  Description of Artificial Sequence: Synthetic oligonucleotide
caggtgacagagtacccagacaggacc

SEQ ID NO: 239607 - DNA, 27 bp, Artificial Sequence
  Description of Artificial Sequence: Synthetic oligonucleotide
aggtgacagagtacccagacaggaccc

SEQ ID NO: 239608 - DNA, 26 bp, Artificial Sequence
  Description of Artificial Sequence: Synthetic oligonucleotide
ggtgacagagtacccagacaggaccc

SEQ ID NO: 239609 - DNA, 27 bp, Artificial Sequence
  Description of Artificial Sequence: Synthetic oligonucleotide
gtgacagagtacccagacaggacccca

SEQ ID NO: 239610 - DNA, 27 bp, Artificial Sequence
  Description of Artificial Sequence: Synthetic oligonucleotide
tgacagagtacccagacaggaccccag

SEQ ID NO: 239611 - DNA, 27 bp, Artificial Sequence
  Description of Artificial Sequence: Synthetic oligonucleotide
gacagagtacccagacaggaccccagt

SEQ ID NO: 239612 - DNA, 27 bp, Artificial Sequence
  Description of Artificial Sequence: Synthetic oligonucleotide
acagagtacccagacaggaccccagtc

SEQ ID NO: 239613 - DNA, 26 bp, Artificial Sequence
  Description of Artificial Sequence: Synthetic oligonucleotide
cagagtacccagacaggaccccagtc

SEQ ID NO: 239614 - DNA, 27 bp, Artificial Sequence
  Description of Artificial Sequence: Synthetic oligonucleotide
agagtacccagacaggaccccagtcct

SEQ ID NO: 239615 - DNA, 26 bp, Artificial Sequence
  Description of Artificial Sequence: Synthetic oligonucleotide
gagtacccagacaggaccccagtcct

SEQ ID NO: 239616 - DNA, 26 bp, Artificial Sequence
  Description of Artificial Sequence: Synthetic oligonucleotide
agtacccagacaggaccccagtcctg

SEQ ID NO: 239617 - DNA, 25 bp, Artificial Sequence
  Description of Artificial Sequence: Synthetic oligonucleotide
gtacccagacaggaccccagtcctg

SEQ ID NO: 239618 - DNA, 26 bp, Artificial Sequence
  Description of Artificial Sequence: Synthetic oligonucleotide
tacccagacaggaccccagtcctgca

SEQ ID NO: 239619 - DNA, 25 bp, Artificial Sequence
  Description of Artificial Sequence: Synthetic oligonucleotide
acccagacaggaccccagtcctgca

SEQ ID NO: 239620 - DNA, 24 bp, Artificial Sequence
  Description of Artificial Sequence: Synthetic oligonucleotide
cccagacaggaccccagtcctgca

SEQ ID NO: 239621 - DNA, 24 bp, Artificial Sequence
  Description of Artificial Sequence: Synthetic oligonucleotide
ccagacaggaccccagtcctgcac

SEQ ID NO: 239622 - DNA, 25 bp, Artificial Sequence
  Description of Artificial Sequence: Synthetic oligonucleotide
cagacaggaccccagtcctgcacct

SEQ ID NO: 239623 - DNA, 25 bp, Artificial Sequence
  Description of Artificial Sequence: Synthetic oligonucleotide
agacaggaccccagtcctgcacctg

SEQ ID NO: 239624 - DNA, 24 bp, Artificial Sequence
  Description of Artificial Sequence: Synthetic oligonucleotide
gacaggaccccagtcctgcacctg

SEQ ID NO: 239625 - DNA, 27 bp, Artificial Sequence
  Description of Artificial Sequence: Synthetic oligonucleotide
acaggaccccagtcctgcacctgcata

SEQ ID NO: 239626 - DNA, 27 bp, Artificial Sequence
  Description of Artificial Sequence: Synthetic oligonucleotide
caggaccccagtcctgcacctgcataa

SEQ ID NO: 239627 - DNA, 28 bp, Artificial Sequence
  Description of Artificial Sequence: Synthetic oligonucleotide
aggaccccagtcctgcacctgcataatc

SEQ ID NO: 239628 - DNA, 27 bp, Artificial Sequence
  Description of Artificial Sequence: Synthetic oligonucleotide
ggaccccagtcctgcacctgcataatc

SEQ ID NO: 239629 - DNA, 28 bp, Artificial Sequence
  Description of Artificial Sequence: Synthetic oligonucleotide
gaccccagtcctgcacctgcataatctc

SEQ ID NO: 239630 - DNA, 28 bp, Artificial Sequence
  Description of Artificial Sequence: Synthetic oligonucleotide
accccagtcctgcacctgcataatctcc

SEQ ID NO: 239631 - DNA, 27 bp, Artificial Sequence
  Description of Artificial Sequence: Synthetic oligonucleotide
ccccagtcctgcacctgcataatctcc

SEQ ID NO: 239632 - DNA, 28 bp, Artificial Sequence
  Description of Artificial Sequence: Synthetic oligonucleotide
cccagtcctgcacctgcataatctcctg

SEQ ID NO: 239633 - DNA, 28 bp, Artificial Sequence
  Description of Artificial Sequence: Synthetic oligonucleotide
ccagtcctgcacctgcataatctcctgc

SEQ ID NO: 239634 - DNA, 29 bp, Artificial Sequence
  Description of Artificial Sequence: Synthetic oligonucleotide
cagtcctgcacctgcataatctcctgcac

SEQ ID NO: 239635 - DNA, 30 bp, Artificial Sequence
  Description of Artificial Sequence: Synthetic oligonucleotide
agtcctgcacctgcataatctcctgcactg

SEQ ID NO: 239636 - DNA, 29 bp, Artificial Sequence
  Description of Artificial Sequence: Synthetic oligonucleotide
gtcctgcacctgcataatctcctgcactg

SEQ ID NO: 239637 - DNA, 29 bp, Artificial Sequence
  Description of Artificial Sequence: Synthetic oligonucleotide
tcctgcacctgcataatctcctgcactgc

SEQ ID NO: 239638 - DNA, 28 bp, Artificial Sequence
  Description of Artificial Sequence: Synthetic oligonucleotide
cctgcacctgcataatctcctgcactgc

SEQ ID NO: 239639 - DNA, 29 bp, Artificial Sequence
  Description of Artificial Sequence: Synthetic oligonucleotide
ctgcacctgcataatctcctgcactgcac

SEQ ID NO: 239640 - DNA, 30 bp, Artificial Sequence
  Description of Artificial Sequence: Synthetic oligonucleotide
tgcacctgcataatctcctgcactgcactg

SEQ ID NO: 239641 - DNA, 29 bp, Artificial Sequence
  Description of Artificial Sequence: Synthetic oligonucleotide
gcacctgcataatctcctgcactgcactg

SEQ ID NO: 239642 - DNA, 30 bp, Artificial Sequence
  Description of Artificial Sequence: Synthetic oligonucleotide
cacctgcataatctcctgcactgcactgtg

SEQ ID NO: 239643 - DNA, 31 bp, Artificial Sequence
  Description of Artificial Sequence: Synthetic oligonucleotide
acctgcataatctcctgcactgcactgtgac

SEQ ID NO: 239644 - DNA, 30 bp, Artificial Sequence
  Description of Artificial Sequence: Synthetic oligonucleotide
cctgcataatctcctgcactgcactgtgac

SEQ ID NO: 239645 - DNA, 31 bp, Artificial Sequence
  Description of Artificial Sequence: Synthetic oligonucleotide
ctgcataatctcctgcactgcactgtgacag

SEQ ID NO: 239646 - DNA, 31 bp, Artificial Sequence
  Description of Artificial Sequence: Synthetic oligonucleotide
tgcataatctcctgcactgcactgtgacagc

SEQ ID NO: 239647 - DNA, 30 bp, Artificial Sequence
  Description of Artificial Sequence: Synthetic oligonucleotide
gcataatctcctgcactgcactgtgacagc

SEQ ID NO: 239648 - DNA, 30 bp, Artificial Sequence
  Description of Artificial Sequence: Synthetic oligonucleotide
cataatctcctgcactgcactgtgacagcc

SEQ ID NO: 239649 - DNA, 32 bp, Artificial Sequence
  Description of Artificial Sequence: Synthetic oligonucleotide
ataatctcctgcactgcactgtgacagccttc

SEQ ID NO: 239650 - DNA, 31 bp, Artificial Sequence
  Description of Artificial Sequence: Synthetic oligonucleotide
taatctcctgcactgcactgtgacagccttc

SEQ ID NO: 239651 - DNA, 30 bp, Artificial Sequence
  Description of Artificial Sequence: Synthetic oligonucleotide
aatctcctgcactgcactgtgacagccttc

SEQ ID NO: 239652 - DNA, 29 bp, Artificial Sequence
  Description of Artificial Sequence: Synthetic oligonucleotide
atctcctgcactgcactgtgacagccttc

SEQ ID NO: 239653 - DNA, 28 bp, Artificial Sequence
  Description of Artificial Sequence: Synthetic oligonucleotide
tctcctgcactgcactgtgacagccttc

SEQ ID NO: 239654 - DNA, 27 bp, Artificial Sequence
  Description of Artificial Sequence: Synthetic oligonucleotide
ctcctgcactgcactgtgacagccttc

SEQ ID NO: 239655 - DNA, 30 bp, Artificial Sequence
  Description of Artificial Sequence: Synthetic oligonucleotide
tcctgcactgcactgtgacagccttctatc

SEQ ID NO: 239656 - DNA, 29 bp, Artificial Sequence
  Description of Artificial Sequence: Synthetic oligonucleotide
cctgcactgcactgtgacagccttctatc

SEQ ID NO: 239657 - DNA, 29 bp, Artificial Sequence
  Description of Artificial Sequence: Synthetic oligonucleotide
ctgcactgcactgtgacagccttctatcc

SEQ ID NO: 239658 - DNA, 30 bp, Artificial Sequence
  Description of Artificial Sequence: Synthetic oligonucleotide
tgcactgcactgtgacagccttctatcctg

SEQ ID NO: 239659 - DNA, 29 bp, Artificial Sequence
  Description of Artificial Sequence: Synthetic oligonucleotide
gcactgcactgtgacagccttctatcctg

SEQ ID NO: 239660 - DNA, 29 bp, Artificial Sequence
  Description of Artificial Sequence: Synthetic oligonucleotide
cactgcactgtgacagccttctatcctgg

SEQ ID NO: 239661 - DNA, 29 bp, Artificial Sequence
  Description of Artificial Sequence: Synthetic oligonucleotide
actgcactgtgacagccttctatcctggg

SEQ ID NO: 239662 - DNA, 28 bp, Artificial Sequence
  Description of Artificial Sequence: Synthetic oligonucleotide
ctgcactgtgacagccttctatcctggg

SEQ ID NO: 239663 - DNA, 28 bp, Artificial Sequence
  Description of Artificial Sequence: Synthetic oligonucleotide
tgcactgtgacagccttctatcctgggg

SEQ ID NO: 239664 - DNA, 27 bp, Artificial Sequence
  Description of Artificial Sequence: Synthetic oligonucleotide
gcactgtgacagccttctatcctgggg

SEQ ID NO: 239665 - DNA, 31 bp, Artificial Sequence
  Description of Artificial Sequence: Synthetic oligonucleotide
cactgtgacagccttctatcctggggatatc

SEQ ID NO: 239666 - DNA, 33 bp, Artificial Sequence
  Description of Artificial Sequence: Synthetic oligonucleotide
actgtgacagccttctatcctggggatatctag

SEQ ID NO: 239667 - DNA, 32 bp, Artificial Sequence
  Description of Artificial Sequence: Synthetic oligonucleotide
ctgtgacagccttctatcctggggatatctag

SEQ ID NO: 239668 - DNA, 34 bp, Artificial Sequence
  Description of Artificial Sequence: Synthetic oligonucleotide
tgtgacagccttctatcctggggatatctagatc

SEQ ID NO: 239669 - DNA, 33 bp, Artificial Sequence
  Description of Artificial Sequence: Synthetic oligonucleotide
gtgacagccttctatcctggggatatctagatc

SEQ ID NO: 239670 - DNA, 35 bp, Artificial Sequence
  Description of Artificial Sequence: Synthetic oligonucleotide
tgacagccttctatcctggggatatctagatcaag

SEQ ID NO: 239671 - DNA, 34 bp, Artificial Sequence
  Description of Artificial Sequence: Synthetic oligonucleotide
gacagccttctatcctggggatatctagatcaag

SEQ ID NO: 239672 - DNA, 35 bp, Artificial Sequence
  Description of Artificial Sequence: Synthetic oligonucleotide
acagccttctatcctggggatatctagatcaagtc

SEQ ID NO: 239673 - DNA, 34 bp, Artificial Sequence
  Description of Artificial Sequence: Synthetic oligonucleotide
cagccttctatcctggggatatctagatcaagtc

SEQ ID NO: 239674 - DNA, 34 bp, Artificial Sequence
  Description of Artificial Sequence: Synthetic oligonucleotide
agccttctatcctggggatatctagatcaagtcg

SEQ ID NO: 239675 - DNA, 33 bp, Artificial Sequence
  Description of Artificial Sequence: Synthetic oligonucleotide
gccttctatcctggggatatctagatcaagtcg

SEQ ID NO: 239676 - DNA, 35 bp, Artificial Sequence
  Description of Artificial Sequence: Synthetic oligonucleotide
ccttctatcctggggatatctagatcaagtcgttc

SEQ ID NO: 239677 - DNA, 35 bp, Artificial Sequence
  Description of Artificial Sequence: Synthetic oligonucleotide
cttctatcctggggatatctagatcaagtcgttcc

SEQ ID NO: 239678 - DNA, 36 bp, Artificial Sequence
  Description of Artificial Sequence: Synthetic oligonucleotide
ttctatcctggggatatctagatcaagtcgttcctg

SEQ ID NO: 239679 - DNA, 35 bp, Artificial Sequence
  Description of Artificial Sequence: Synthetic oligonucleotide
tctatcctggggatatctagatcaagtcgttcctg

SEQ ID NO: 239680 - DNA, 34 bp, Artificial Sequence
  Description of Artificial Sequence: Synthetic oligonucleotide
ctatcctggggatatctagatcaagtcgttcctg

SEQ ID NO: 239681 - DNA, 37 bp, Artificial Sequence
  Description of Artificial Sequence: Synthetic oligonucleotide
tatcctggggatatctagatcaagtcgttcctgaaag

SEQ ID NO: 239682 - DNA, 36 bp, Artificial Sequence
  Description of Artificial Sequence: Synthetic oligonucleotide
atcctggggatatctagatcaagtcgttcctgaaag

SEQ ID NO: 239683 - DNA, 35 bp, Artificial Sequence
  Description of Artificial Sequence: Synthetic oligonucleotide
tcctggggatatctagatcaagtcgttcctgaaag

SEQ ID NO: 239684 - DNA, 34 bp, Artificial Sequence
  Description of Artificial Sequence: Synthetic oligonucleotide
cctggggatatctagatcaagtcgttcctgaaag

SEQ ID NO: 239685 - DNA, 34 bp, Artificial Sequence
  Description of Artificial Sequence: Synthetic oligonucleotide
ctggggatatctagatcaagtcgttcctgaaagg

SEQ ID NO: 239686 - DNA, 34 bp, Artificial Sequence
  Description of Artificial Sequence: Synthetic oligonucleotide
tggggatatctagatcaagtcgttcctgaaaggg

SEQ ID NO: 239687 - DNA, 33 bp, Artificial Sequence
  Description of Artificial Sequence: Synthetic oligonucleotide
ggggatatctagatcaagtcgttcctgaaaggg

SEQ ID NO: 239688 - DNA, 33 bp, Artificial Sequence
  Description of Artificial Sequence: Synthetic oligonucleotide
gggatatctagatcaagtcgttcctgaaagggc

SEQ ID NO: 239689 - DNA, 34 bp, Artificial Sequence
  Description of Artificial Sequence: Synthetic oligonucleotide
ggatatctagatcaagtcgttcctgaaagggcag

SEQ ID NO: 239690 - DNA, 34 bp, Artificial Sequence
  Description of Artificial Sequence: Synthetic oligonucleotide
gatatctagatcaagtcgttcctgaaagggcagg

SEQ ID NO: 239691 - DNA, 35 bp, Artificial Sequence
  Description of Artificial Sequence: Synthetic oligonucleotide
atatctagatcaagtcgttcctgaaagggcaggag

SEQ ID NO: 239692 - DNA, 34 bp, Artificial Sequence
  Description of Artificial Sequence: Synthetic oligonucleotide
tatctagatcaagtcgttcctgaaagggcaggag

SEQ ID NO: 239693 - DNA, 33 bp, Artificial Sequence
  Description of Artificial Sequence: Synthetic oligonucleotide
atctagatcaagtcgttcctgaaagggcaggag

SEQ ID NO: 239694 - DNA, 32 bp, Artificial Sequence
  Description of Artificial Sequence: Synthetic oligonucleotide
tctagatcaagtcgttcctgaaagggcaggag

SEQ ID NO: 239695 - DNA, 31 bp, Artificial Sequence
  Description of Artificial Sequence: Synthetic oligonucleotide
ctagatcaagtcgttcctgaaagggcaggag

SEQ ID NO: 239696 - DNA, 31 bp, Artificial Sequence
  Description of Artificial Sequence: Synthetic oligonucleotide
tagatcaagtcgttcctgaaagggcaggagc

SEQ ID NO: 239697 - DNA, 30 bp, Artificial Sequence
  Description of Artificial Sequence: Synthetic oligonucleotide
agatcaagtcgttcctgaaagggcaggagc

SEQ ID NO: 239698 - DNA, 29 bp, Artificial Sequence
  Description of Artificial Sequence: Synthetic oligonucleotide
gatcaagtcgttcctgaaagggcaggagc

SEQ ID NO: 239699 - DNA, 30 bp, Artificial Sequence
  Description of Artificial Sequence: Synthetic oligonucleotide
atcaagtcgttcctgaaagggcaggagcag

SEQ ID NO: 239700 - DNA, 29 bp, Artificial Sequence
  Description of Artificial Sequence: Synthetic oligonucleotide
tcaagtcgttcctgaaagggcaggagcag

SEQ ID NO: 239701 - DNA, 28 bp, Artificial Sequence
  Description of Artificial Sequence: Synthetic oligonucleotide
caagtcgttcctgaaagggcaggagcag

SEQ ID NO: 239702 - DNA, 29 bp, Artificial Sequence
  Description of Artificial Sequence: Synthetic oligonucleotide
aagtcgttcctgaaagggcaggagcagag

SEQ ID NO: 239703 - DNA, 28 bp, Artificial Sequence
  Description of Artificial Sequence: Synthetic oligonucleotide
agtcgttcctgaaagggcaggagcagag

SEQ ID NO: 239704 - DNA, 27 bp, Artificial Sequence
  Description of Artificial Sequence: Synthetic oligonucleotide
gtcgttcctgaaagggcaggagcagag

SEQ ID NO: 239705 - DNA, 28 bp, Artificial Sequence
  Description of Artificial Sequence: Synthetic oligonucleotide
tcgttcctgaaagggcaggagcagagag

SEQ ID NO: 239706 - DNA, 27 bp, Artificial Sequence
  Description of Artificial Sequence: Synthetic oligonucleotide
cgttcctgaaagggcaggagcagagag

SEQ ID NO: 239707 - DNA, 27 bp, Artificial Sequence
  Description of Artificial Sequence: Synthetic oligonucleotide
gttcctgaaagggcaggagcagagagc

SEQ ID NO: 239708 - DNA, 28 bp, Artificial Sequence
  Description of Artificial Sequence: Synthetic oligonucleotide
ttcctgaaagggcaggagcagagagctg

SEQ ID NO: 239709 - DNA, 27 bp, Artificial Sequence
  Description of Artificial Sequence: Synthetic oligonucleotide
tcctgaaagggcaggagcagagagctg

SEQ ID NO: 239710 - DNA, 26 bp, Artificial Sequence
  Description of Artificial Sequence: Synthetic oligonucleotide
cctgaaagggcaggagcagagagctg

SEQ ID NO: 239711 - DNA, 26 bp, Artificial Sequence
  Description of Artificial Sequence: Synthetic oligonucleotide
ctgaaagggcaggagcagagagctgc

SEQ ID NO: 239712 - DNA, 26 bp, Artificial Sequence
  Description of Artificial Sequence: Synthetic oligonucleotide
tgaaagggcaggagcagagagctgcg

SEQ ID NO: 239713 - DNA, 25 bp, Artificial Sequence
  Description of Artificial Sequence: Synthetic oligonucleotide
gaaagggcaggagcagagagctgcg

SEQ ID NO: 239714 - DNA, 26 bp, Artificial Sequence
  Description of Artificial Sequence: Synthetic oligonucleotide
aaagggcaggagcagagagctgcggt

SEQ ID NO: 239715 - DNA, 25 bp, Artificial Sequence
  Description of Artificial Sequence: Synthetic oligonucleotide
aagggcaggagcagagagctgcggt

SEQ ID NO: 239716 - DNA, 24 bp, Artificial Sequence
  Description of Artificial Sequence: Synthetic oligonucleotide
agggcaggagcagagagctgcggt

SEQ ID NO: 239717 - DNA, 23 bp, Artificial Sequence
  Description of Artificial Sequence: Synthetic oligonucleotide
gggcaggagcagagagctgcggt

SEQ ID NO: 239718 - DNA, 25 bp, Artificial Sequence
  Description of Artificial Sequence: Synthetic oligonucleotide
ggcaggagcagagagctgcggtcat

SEQ ID NO: 239719 - DNA, 26 bp, Artificial Sequence
  Description of Artificial Sequence: Synthetic oligonucleotide
gcaggagcagagagctgcggtcatgt

SEQ ID NO: 239720 - DNA, 26 bp, Artificial Sequence
  Description of Artificial Sequence: Synthetic oligonucleotide
caggagcagagagctgcggtcatgtc

SEQ ID NO: 239721 - DNA, 27 bp, Artificial Sequence
  Description of Artificial Sequence: Synthetic oligonucleotide
aggagcagagagctgcggtcatgtcga

SEQ ID NO: 239722 - DNA, 26 bp, Artificial Sequence
  Description of Artificial Sequence: Synthetic oligonucleotide
ggagcagagagctgcggtcatgtcga

SEQ ID NO: 239723 - DNA, 27 bp, Artificial Sequence
  Description of Artificial Sequence: Synthetic oligonucleotide
gagcagagagctgcggtcatgtcgact

SEQ ID NO: 239724 - DNA, 27 bp, Artificial Sequence
  Description of Artificial Sequence: Synthetic oligonucleotide
agcagagagctgcggtcatgtcgactg

SEQ ID NO: 239725 - DNA, 26 bp, Artificial Sequence
  Description of Artificial Sequence: Synthetic oligonucleotide
gcagagagctgcggtcatgtcgactg

SEQ ID NO: 239726 - DNA, 26 bp, Artificial Sequence
  Description of Artificial Sequence: Synthetic oligonucleotide
cagagagctgcggtcatgtcgactgg

SEQ ID NO: 239727 - DNA, 26 bp, Artificial Sequence
  Description of Artificial Sequence: Synthetic oligonucleotide
agagagctgcggtcatgtcgactggc

SEQ ID NO: 239728 - DNA, 25 bp, Artificial Sequence
  Description of Artificial Sequence: Synthetic oligonucleotide
gagagctgcggtcatgtcgactggc

SEQ ID NO: 239729 - DNA, 25 bp, Artificial Sequence
  Description of Artificial Sequence: Synthetic oligonucleotide
agagctgcggtcatgtcgactggcc

SEQ ID NO: 239730 - DNA, 24 bp, Artificial Sequence
  Description of Artificial Sequence: Synthetic oligonucleotide
gagctgcggtcatgtcgactggcc

SEQ ID NO: 239731 - DNA, 27 bp, Artificial Sequence
  Description of Artificial Sequence: Synthetic oligonucleotide
agctgcggtcatgtcgactggcccttt

SEQ ID NO: 239732 - DNA, 26 bp, Artificial Sequence
  Description of Artificial Sequence: Synthetic oligonucleotide
gctgcggtcatgtcgactggcccttt

SEQ ID NO: 239733 - DNA, 27 bp, Artificial Sequence
  Description of Artificial Sequence: Synthetic oligonucleotide
ctgcggtcatgtcgactggccctttca

SEQ ID NO: 239734 - DNA, 27 bp, Artificial Sequence
  Description of Artificial Sequence: Synthetic oligonucleotide
tgcggtcatgtcgactggccctttcag

SEQ ID NO: 239735 - DNA, 26 bp, Artificial Sequence
  Description of Artificial Sequence: Synthetic oligonucleotide
gcggtcatgtcgactggccctttcag

SEQ ID NO: 239736 - DNA, 27 bp, Artificial Sequence
  Description of Artificial Sequence: Synthetic oligonucleotide
cggtcatgtcgactggccctttcagga

SEQ ID NO: 239737 - DNA, 29 bp, Artificial Sequence
  Description of Artificial Sequence: Synthetic oligonucleotide
ggtcatgtcgactggccctttcaggaatg

SEQ ID NO: 239738 - DNA, 29 bp, Artificial Sequence
  Description of Artificial Sequence: Synthetic oligonucleotide
gtcatgtcgactggccctttcaggaatgc

SEQ ID NO: 239739 - DNA, 30 bp, Artificial Sequence
  Description of Artificial Sequence: Synthetic oligonucleotide
tcatgtcgactggccctttcaggaatgcag

SEQ ID NO: 239740 - DNA, 29 bp, Artificial Sequence
  Description of Artificial Sequence: Synthetic oligonucleotide
catgtcgactggccctttcaggaatgcag

SEQ ID NO: 239741 - DNA, 30 bp, Artificial Sequence
  Description of Artificial Sequence: Synthetic oligonucleotide
atgtcgactggccctttcaggaatgcagac

SEQ ID NO: 239742 - DNA, 29 bp, Artificial Sequence
  Description of Artificial Sequence: Synthetic oligonucleotide
tgtcgactggccctttcaggaatgcagac

SEQ ID NO: 239743 - DNA, 28 bp, Artificial Sequence
  Description of Artificial Sequence: Synthetic oligonucleotide
gtcgactggccctttcaggaatgcagac

SEQ ID NO: 239744 - DNA, 29 bp, Artificial Sequence
  Description of Artificial Sequence: Synthetic oligonucleotide
tcgactggccctttcaggaatgcagactg

SEQ ID NO: 239745 - DNA, 28 bp, Artificial Sequence
  Description of Artificial Sequence: Synthetic oligonucleotide
cgactggccctttcaggaatgcagactg

SEQ ID NO: 239746 - DNA, 28 bp, Artificial Sequence
  Description of Artificial Sequence: Synthetic oligonucleotide
gactggccctttcaggaatgcagactgg

SEQ ID NO: 239747 - DNA, 29 bp, Artificial Sequence
  Description of Artificial Sequence: Synthetic oligonucleotide
actggccctttcaggaatgcagactggac

SEQ ID NO: 239748 - DNA, 28 bp, Artificial Sequence
  Description of Artificial Sequence: Synthetic oligonucleotide
ctggccctttcaggaatgcagactggac

SEQ ID NO: 239749 - DNA, 28 bp, Artificial Sequence
  Description of Artificial Sequence: Synthetic oligonucleotide
tggccctttcaggaatgcagactggacg

SEQ ID NO: 239750 - DNA, 27 bp, Artificial Sequence
  Description of Artificial Sequence: Synthetic oligonucleotide
ggccctttcaggaatgcagactggacg

SEQ ID NO: 239751 - DNA, 30 bp, Artificial Sequence
  Description of Artificial Sequence: Synthetic oligonucleotide
gccctttcaggaatgcagactggacgtttc

SEQ ID NO: 239752 - DNA, 31 bp, Artificial Sequence
  Description of Artificial Sequence: Synthetic oligonucleotide
ccctttcaggaatgcagactggacgtttcag

SEQ ID NO: 239753 - DNA, 32 bp, Artificial Sequence
  Description of Artificial Sequence: Synthetic oligonucleotide
cctttcaggaatgcagactggacgtttcagac

SEQ ID NO: 239754 - DNA, 33 bp, Artificial Sequence
  Description of Artificial Sequence: Synthetic oligonucleotide
ctttcaggaatgcagactggacgtttcagactc

SEQ ID NO: 239755 - DNA, 34 bp, Artificial Sequence
  Description of Artificial Sequence: Synthetic oligonucleotide
tttcaggaatgcagactggacgtttcagactctg

SEQ ID NO: 239756 - DNA, 33 bp, Artificial Sequence
  Description of Artificial Sequence: Synthetic oligonucleotide
ttcaggaatgcagactggacgtttcagactctg

SEQ ID NO: 239757 - DNA, 32 bp, Artificial Sequence
  Description of Artificial Sequence: Synthetic oligonucleotide
tcaggaatgcagactggacgtttcagactctg

SEQ ID NO: 239758 - DNA, 31 bp, Artificial Sequence
  Description of Artificial Sequence: Synthetic oligonucleotide
caggaatgcagactggacgtttcagactctg

SEQ ID NO: 239759 - DNA, 31 bp, Artificial Sequence
  Description of Artificial Sequence: Synthetic oligonucleotide
aggaatgcagactggacgtttcagactctgg

SEQ ID NO: 239760 - DNA, 30 bp, Artificial Sequence
  Description of Artificial Sequence: Synthetic oligonucleotide
ggaatgcagactggacgtttcagactctgg

SEQ ID NO: 239761 - DNA, 31 bp, Artificial Sequence
  Description of Artificial Sequence: Synthetic oligonucleotide
gaatgcagactggacgtttcagactctggtg

SEQ ID NO: 239762 - DNA, 33 bp, Artificial Sequence
  Description of Artificial Sequence: Synthetic oligonucleotide
aatgcagactggacgtttcagactctggtgatg

SEQ ID NO: 239763 - DNA, 32 bp, Artificial Sequence
  Description of Artificial Sequence: Synthetic oligonucleotide
atgcagactggacgtttcagactctggtgatg

SEQ ID NO: 239764 - DNA, 31 bp, Artificial Sequence
  Description of Artificial Sequence: Synthetic oligonucleotide
tgcagactggacgtttcagactctggtgatg

SEQ ID NO: 239765 - DNA, 30 bp, Artificial Sequence
  Description of Artificial Sequence: Synthetic oligonucleotide
gcagactggacgtttcagactctggtgatg

SEQ ID NO: 239766 - DNA, 30 bp, Artificial Sequence
  Description of Artificial Sequence: Synthetic oligonucleotide
cagactggacgtttcagactctggtgatgc

SEQ ID NO: 239767 - DNA, 32 bp, Artificial Sequence
  Description of Artificial Sequence: Synthetic oligonucleotide
agactggacgtttcagactctggtgatgcaag

SEQ ID NO: 239768 - DNA, 31 bp, Artificial Sequence
  Description of Artificial Sequence: Synthetic oligonucleotide
gactggacgtttcagactctggtgatgcaag

SEQ ID NO: 239769 - DNA, 35 bp, Artificial Sequence
  Description of Artificial Sequence: Synthetic oligonucleotide
actggacgtttcagactctggtgatgcaagaaatg

SEQ ID NO: 239770 - DNA, 34 bp, Artificial Sequence
  Description of Artificial Sequence: Synthetic oligonucleotide
ctggacgtttcagactctggtgatgcaagaaatg

SEQ ID NO: 239771 - DNA, 35 bp, Artificial Sequence
  Description of Artificial Sequence: Synthetic oligonucleotide
tggacgtttcagactctggtgatgcaagaaatgac

SEQ ID NO: 239772 - DNA, 34 bp, Artificial Sequence
  Description of Artificial Sequence: Synthetic oligonucleotide
ggacgtttcagactctggtgatgcaagaaatgac

SEQ ID NO: 239773 - DNA, 35 bp, Artificial Sequence
  Description of Artificial Sequence: Synthetic oligonucleotide
gacgtttcagactctggtgatgcaagaaatgacac

SEQ ID NO: 239774 - DNA, 35 bp, Artificial Sequence
  Description of Artificial Sequence: Synthetic oligonucleotide
acgtttcagactctggtgatgcaagaaatgacacc

SEQ ID NO: 239775 - DNA, 34 bp, Artificial Sequence
  Description of Artificial Sequence: Synthetic oligonucleotide
cgtttcagactctggtgatgcaagaaatgacacc

SEQ ID NO: 239776 - DNA, 35 bp, Artificial Sequence
  Description of Artificial Sequence: Synthetic oligonucleotide
gtttcagactctggtgatgcaagaaatgacacctg

SEQ ID NO: 239777 - DNA, 37 bp, Artificial Sequence
  Description of Artificial Sequence: Synthetic oligonucleotide
tttcagactctggtgatgcaagaaatgacacctgaac

SEQ ID NO: 239778 - DNA, 36 bp, Artificial Sequence
  Description of Artificial Sequence: Synthetic oligonucleotide
ttcagactctggtgatgcaagaaatgacacctgaac

SEQ ID NO: 239779 - DNA, 35 bp, Artificial Sequence
  Description of Artificial Sequence: Synthetic oligonucleotide
tcagactctggtgatgcaagaaatgacacctgaac

SEQ ID NO: 239780 - DNA, 34 bp, Artificial Sequence
  Description of Artificial Sequence: Synthetic oligonucleotide
cagactctggtgatgcaagaaatgacacctgaac

SEQ ID NO: 239781 - DNA, 36 bp, Artificial Sequence
  Description of Artificial Sequence: Synthetic oligonucleotide
agactctggtgatgcaagaaatgacacctgaacttc

SEQ ID NO: 239782 - DNA, 35 bp, Artificial Sequence
  Description of Artificial Sequence: Synthetic oligonucleotide
gactctggtgatgcaagaaatgacacctgaacttc

SEQ ID NO: 239783 - DNA, 35 bp, Artificial Sequence
  Description of Artificial Sequence: Synthetic oligonucleotide
actctggtgatgcaagaaatgacacctgaacttcg

SEQ ID NO: 239784 - DNA, 34 bp, Artificial Sequence
  Description of Artificial Sequence: Synthetic oligonucleotide
ctctggtgatgcaagaaatgacacctgaacttcg

SEQ ID NO: 239785 - DNA, 35 bp, Artificial Sequence
  Description of Artificial Sequence: Synthetic oligonucleotide
tctggtgatgcaagaaatgacacctgaacttcgac

SEQ ID NO: 239786 - DNA, 34 bp, Artificial Sequence
  Description of Artificial Sequence: Synthetic oligonucleotide
ctggtgatgcaagaaatgacacctgaacttcgac

SEQ ID NO: 239787 - DNA, 36 bp, Artificial Sequence
  Description of Artificial Sequence: Synthetic oligonucleotide
tggtgatgcaagaaatgacacctgaacttcgacatg

SEQ ID NO: 239788 - DNA, 35 bp, Artificial Sequence
  Description of Artificial Sequence: Synthetic oligonucleotide
ggtgatgcaagaaatgacacctgaacttcgacatg

SEQ ID NO: 239789 - DNA, 36 bp, Artificial Sequence
  Description of Artificial Sequence: Synthetic oligonucleotide
gtgatgcaagaaatgacacctgaacttcgacatgtc

SEQ ID NO: 239790 - DNA, 38 bp, Artificial Sequence
  Description of Artificial Sequence: Synthetic oligonucleotide
tgatgcaagaaatgacacctgaacttcgacatgtcttc

SEQ ID NO: 239791 - DNA, 37 bp, Artificial Sequence
  Description of Artificial Sequence: Synthetic oligonucleotide
gatgcaagaaatgacacctgaacttcgacatgtcttc

SEQ ID NO: 239792 - DNA, 38 bp, Artificial Sequence
  Description of Artificial Sequence: Synthetic oligonucleotide
atgcaagaaatgacacctgaacttcgacatgtcttcac

SEQ ID NO: 239793 - DNA, 37 bp, Artificial Sequence
  Description of Artificial Sequence: Synthetic oligonucleotide
tgcaagaaatgacacctgaacttcgacatgtcttcac

SEQ ID NO: 239794 - DNA, 36 bp, Artificial Sequence
  Description of Artificial Sequence: Synthetic oligonucleotide
gcaagaaatgacacctgaacttcgacatgtcttcac

SEQ ID NO: 239795 - DNA, 36 bp, Artificial Sequence
  Description of Artificial Sequence: Synthetic oligonucleotide
caagaaatgacacctgaacttcgacatgtcttcacc

SEQ ID NO: 239796 - DNA, 37 bp, Artificial Sequence
  Description of Artificial Sequence: Synthetic oligonucleotide
aagaaatgacacctgaacttcgacatgtcttcacctg

SEQ ID NO: 239797 - DNA, 36 bp, Artificial Sequence
  Description of Artificial Sequence: Synthetic oligonucleotide
agaaatgacacctgaacttcgacatgtcttcacctg

SEQ ID NO: 239798 - DNA, 35 bp, Artificial Sequence
  Description of Artificial Sequence: Synthetic oligonucleotide
gaaatgacacctgaacttcgacatgtcttcacctg

SEQ ID NO: 239799 - DNA, 35 bp, Artificial Sequence
  Description of Artificial Sequence: Synthetic oligonucleotide
aaatgacacctgaacttcgacatgtcttcacctgc

SEQ ID NO: 239800 - DNA, 34 bp, Artificial Sequence
  Description of Artificial Sequence: Synthetic oligonucleotide
aatgacacctgaacttcgacatgtcttcacctgc

SEQ ID NO: 239801 - DNA, 33 bp, Artificial Sequence
  Description of Artificial Sequence: Synthetic oligonucleotide
atgacacctgaacttcgacatgtcttcacctgc

SEQ ID NO: 239802 - DNA, 32 bp, Artificial Sequence
  Description of Artificial Sequence: Synthetic oligonucleotide
tgacacctgaacttcgacatgtcttcacctgc

SEQ ID NO: 239803 - DNA, 31 bp, Artificial Sequence
  Description of Artificial Sequence: Synthetic oligonucleotide
gacacctgaacttcgacatgtcttcacctgc

SEQ ID NO: 239804 - DNA, 31 bp, Artificial Sequence
  Description of Artificial Sequence: Synthetic oligonucleotide
acacctgaacttcgacatgtcttcacctgcc

SEQ ID NO: 239805 - DNA, 30 bp, Artificial Sequence
  Description of Artificial Sequence: Synthetic oligonucleotide
cacctgaacttcgacatgtcttcacctgcc

SEQ ID NO: 239806 - DNA, 32 bp, Artificial Sequence
  Description of Artificial Sequence: Synthetic oligonucleotide
acctgaacttcgacatgtcttcacctgcctag

SEQ ID NO: 239807 - DNA, 31 bp, Artificial Sequence
  Description of Artificial Sequence: Synthetic oligonucleotide
cctgaacttcgacatgtcttcacctgcctag

SEQ ID NO: 239808 - DNA, 32 bp, Artificial Sequence
  Description of Artificial Sequence: Synthetic oligonucleotide
ctgaacttcgacatgtcttcacctgcctagtc

SEQ ID NO: 239809 - DNA, 32 bp, Artificial Sequence
  Description of Artificial Sequence: Synthetic oligonucleotide
tgaacttcgacatgtcttcacctgcctagtcg

SEQ ID NO: 239810 - DNA, 31 bp, Artificial Sequence
  Description of Artificial Sequence: Synthetic oligonucleotide
gaacttcgacatgtcttcacctgcctagtcg

SEQ ID NO: 239811 - DNA, 33 bp, Artificial Sequence
  Description of Artificial Sequence: Synthetic oligonucleotide
aacttcgacatgtcttcacctgcctagtcgatc

SEQ ID NO: 239812 - DNA, 32 bp, Artificial Sequence
  Description of Artificial Sequence: Synthetic oligonucleotide
acttcgacatgtcttcacctgcctagtcgatc

SEQ ID NO: 239813 - DNA, 31 bp, Artificial Sequence
  Description of Artificial Sequence: Synthetic oligonucleotide
cttcgacatgtcttcacctgcctagtcgatc

SEQ ID NO: 239814 - DNA, 32 bp, Artificial Sequence
  Description of Artificial Sequence: Synthetic oligonucleotide
ttcgacatgtcttcacctgcctagtcgatcac

SEQ ID NO: 239815 - DNA, 31 bp, Artificial Sequence
  Description of Artificial Sequence: Synthetic oligonucleotide
tcgacatgtcttcacctgcctagtcgatcac

SEQ ID NO: 239816 - DNA, 30 bp, Artificial Sequence
  Description of Artificial Sequence: Synthetic oligonucleotide
cgacatgtcttcacctgcctagtcgatcac

SEQ ID NO: 239817 - DNA, 31 bp, Artificial Sequence
  Description of Artificial Sequence: Synthetic oligonucleotide
gacatgtcttcacctgcctagtcgatcacac

SEQ ID NO: 239818 - DNA, 31 bp, Artificial Sequence
  Description of Artificial Sequence: Synthetic oligonucleotide
acatgtcttcacctgcctagtcgatcacacc

SEQ ID NO: 239819 - DNA, 30 bp, Artificial Sequence
  Description of Artificial Sequence: Synthetic oligonucleotide
catgtcttcacctgcctagtcgatcacacc

SEQ ID NO: 239820 - DNA, 31 bp, Artificial Sequence
  Description of Artificial Sequence: Synthetic oligonucleotide
atgtcttcacctgcctagtcgatcacaccag

SEQ ID NO: 239821 - DNA, 30 bp, Artificial Sequence
  Description of Artificial Sequence: Synthetic oligonucleotide
tgtcttcacctgcctagtcgatcacaccag

SEQ ID NO: 239822 - DNA, 29 bp, Artificial Sequence
  Description of Artificial Sequence: Synthetic oligonucleotide
gtcttcacctgcctagtcgatcacaccag

SEQ ID NO: 239823 - DNA, 29 bp, Artificial Sequence
  Description of Artificial Sequence: Synthetic oligonucleotide
tcttcacctgcctagtcgatcacaccagc

SEQ ID NO: 239824 - DNA, 28 bp, Artificial Sequence
  Description of Artificial Sequence: Synthetic oligonucleotide
cttcacctgcctagtcgatcacaccagc

SEQ ID NO: 239825 - DNA, 28 bp, Artificial Sequence
  Description of Artificial Sequence: Synthetic oligonucleotide
ttcacctgcctagtcgatcacaccagcc

SEQ ID NO: 239826 - DNA, 27 bp, Artificial Sequence
  Description of Artificial Sequence: Synthetic oligonucleotide
tcacctgcctagtcgatcacaccagcc

SEQ ID NO: 239827 - DNA, 27 bp, Artificial Sequence
  Description of Artificial Sequence: Synthetic oligonucleotide
cacctgcctagtcgatcacaccagcct

SEQ ID NO: 239828 - DNA, 27 bp, Artificial Sequence
  Description of Artificial Sequence: Synthetic oligonucleotide
acctgcctagtcgatcacaccagcctg

SEQ ID NO: 239829 - DNA, 26 bp, Artificial Sequence
  Description of Artificial Sequence: Synthetic oligonucleotide
cctgcctagtcgatcacaccagcctg

SEQ ID NO: 239830 - DNA, 27 bp, Artificial Sequence
  Description of Artificial Sequence: Synthetic oligonucleotide
ctgcctagtcgatcacaccagcctgca

SEQ ID NO: 239831 - DNA, 27 bp, Artificial Sequence
  Description of Artificial Sequence: Synthetic oligonucleotide
tgcctagtcgatcacaccagcctgcag

SEQ ID NO: 239832 - DNA, 27 bp, Artificial Sequence
  Description of Artificial Sequence: Synthetic oligonucleotide
gcctagtcgatcacaccagcctgcaga

SEQ ID NO: 239833 - DNA, 27 bp, Artificial Sequence
  Description of Artificial Sequence: Synthetic oligonucleotide
cctagtcgatcacaccagcctgcagag

SEQ ID NO: 239834 - DNA, 27 bp, Artificial Sequence
  Description of Artificial Sequence: Synthetic oligonucleotide
ctagtcgatcacaccagcctgcagagc

SEQ ID NO: 239835 - DNA, 27 bp, Artificial Sequence
  Description of Artificial Sequence: Synthetic oligonucleotide
tagtcgatcacaccagcctgcagagcc

SEQ ID NO: 239836 - DNA, 26 bp, Artificial Sequence
  Description of Artificial Sequence: Synthetic oligonucleotide
agtcgatcacaccagcctgcagagcc

SEQ ID NO: 239837 - DNA, 25 bp, Artificial Sequence
  Description of Artificial Sequence: Synthetic oligonucleotide
gtcgatcacaccagcctgcagagcc

SEQ ID NO: 239838 - DNA, 26 bp, Artificial Sequence
  Description of Artificial Sequence: Synthetic oligonucleotide
tcgatcacaccagcctgcagagccct

SEQ ID NO: 239839 - DNA, 25 bp, Artificial Sequence
  Description of Artificial Sequence: Synthetic oligonucleotide
cgatcacaccagcctgcagagccct

SEQ ID NO: 239840 - DNA, 27 bp, Artificial Sequence
  Description of Artificial Sequence: Synthetic oligonucleotide
gatcacaccagcctgcagagccctgta

SEQ ID NO: 239841 - DNA, 28 bp, Artificial Sequence
  Description of Artificial Sequence: Synthetic oligonucleotide
atcacaccagcctgcagagccctgtatc

SEQ ID NO: 239842 - DNA, 27 bp, Artificial Sequence
  Description of Artificial Sequence: Synthetic oligonucleotide
tcacaccagcctgcagagccctgtatc

SEQ ID NO: 239843 - DNA, 27 bp, Artificial Sequence
  Description of Artificial Sequence: Synthetic oligonucleotide
cacaccagcctgcagagccctgtatct

SEQ ID NO: 239844 - DNA, 27 bp, Artificial Sequence
  Description of Artificial Sequence: Synthetic oligonucleotide
acaccagcctgcagagccctgtatctg

SEQ ID NO: 239845 - DNA, 27 bp, Artificial Sequence
  Description of Artificial Sequence: Synthetic oligonucleotide
caccagcctgcagagccctgtatctgt

SEQ ID NO: 239846 - DNA, 27 bp, Artificial Sequence
  Description of Artificial Sequence: Synthetic oligonucleotide
accagcctgcagagccctgtatctgtg

SEQ ID NO: 239847 - DNA, 26 bp, Artificial Sequence
  Description of Artificial Sequence: Synthetic oligonucleotide
ccagcctgcagagccctgtatctgtg

SEQ ID NO: 239848 - DNA, 27 bp, Artificial Sequence
  Description of Artificial Sequence: Synthetic oligonucleotide
cagcctgcagagccctgtatctgtgga

SEQ ID NO: 239849 - DNA, 27 bp, Artificial Sequence
  Description of Artificial Sequence: Synthetic oligonucleotide
agcctgcagagccctgtatctgtggag

SEQ ID NO: 239850 - DNA, 27 bp, Artificial Sequence
  Description of Artificial Sequence: Synthetic oligonucleotide
gcctgcagagccctgtatctgtggaga

SEQ ID NO: 239851 - DNA, 27 bp, Artificial Sequence
  Description of Artificial Sequence: Synthetic oligonucleotide
cctgcagagccctgtatctgtggagag

SEQ ID NO: 239852 - DNA, 27 bp, Artificial Sequence
  Description of Artificial Sequence: Synthetic oligonucleotide
ctgcagagccctgtatctgtggagagg

SEQ ID NO: 239853 - DNA, 28 bp, Artificial Sequence
  Description of Artificial Sequence: Synthetic oligonucleotide
tgcagagccctgtatctgtggagaggag

SEQ ID NO: 239854 - DNA, 27 bp, Artificial Sequence
  Description of Artificial Sequence: Synthetic oligonucleotide
gcagagccctgtatctgtggagaggag

SEQ ID NO: 239855 - DNA, 28 bp, Artificial Sequence
  Description of Artificial Sequence: Synthetic oligonucleotide
cagagccctgtatctgtggagaggagag

SEQ ID NO: 239856 - DNA, 28 bp, Artificial Sequence
  Description of Artificial Sequence: Synthetic oligonucleotide
agagccctgtatctgtggagaggagagc

SEQ ID NO: 239857 - DNA, 27 bp, Artificial Sequence
  Description of Artificial Sequence: Synthetic oligonucleotide
gagccctgtatctgtggagaggagagc

SEQ ID NO: 239858 - DNA, 28 bp, Artificial Sequence
  Description of Artificial Sequence: Synthetic oligonucleotide
agccctgtatctgtggagaggagagctc

SEQ ID NO: 239859 - DNA, 27 bp, Artificial Sequence
  Description of Artificial Sequence: Synthetic oligonucleotide
gccctgtatctgtggagaggagagctc

SEQ ID NO: 239860 - DNA, 28 bp, Artificial Sequence
  Description of Artificial Sequence: Synthetic oligonucleotide
ccctgtatctgtggagaggagagctctg

SEQ ID NO: 239861 - DNA, 29 bp, Artificial Sequence
  Description of Artificial Sequence: Synthetic oligonucleotide
cctgtatctgtggagaggagagctctgtc

SEQ ID NO: 239862 - DNA, 30 bp, Artificial Sequence
  Description of Artificial Sequence: Synthetic oligonucleotide
ctgtatctgtggagaggagagctctgtctg

SEQ ID NO: 239863 - DNA, 36 bp, Artificial Sequence
  Description of Artificial Sequence: Synthetic oligonucleotide
tgtatctgtggagaggagagctctgtctgaataatc

SEQ ID NO: 239864 - DNA, 35 bp, Artificial Sequence
  Description of Artificial Sequence: Synthetic oligonucleotide
gtatctgtggagaggagagctctgtctgaataatc

SEQ ID NO: 239865 - DNA, 37 bp, Artificial Sequence
  Description of Artificial Sequence: Synthetic oligonucleotide
tatctgtggagaggagagctctgtctgaataatcttg

SEQ ID NO: 239866 - DNA, 36 bp, Artificial Sequence
  Description of Artificial Sequence: Synthetic oligonucleotide
atctgtggagaggagagctctgtctgaataatcttg

SEQ ID NO: 239867 - DNA, 35 bp, Artificial Sequence
  Description of Artificial Sequence: Synthetic oligonucleotide
tctgtggagaggagagctctgtctgaataatcttg

SEQ ID NO: 239868 - DNA, 34 bp, Artificial Sequence
  Description of Artificial Sequence: Synthetic oligonucleotide
ctgtggagaggagagctctgtctgaataatcttg

SEQ ID NO: 239869 - DNA, 34 bp, Artificial Sequence
  Description of Artificial Sequence: Synthetic oligonucleotide
tgtggagaggagagctctgtctgaataatcttgg

SEQ ID NO: 239870 - DNA, 33 bp, Artificial Sequence
  Description of Artificial Sequence: Synthetic oligonucleotide
gtggagaggagagctctgtctgaataatcttgg

SEQ ID NO: 239871 - DNA, 34 bp, Artificial Sequence
  Description of Artificial Sequence: Synthetic oligonucleotide
tggagaggagagctctgtctgaataatcttggag

SEQ ID NO: 239872 - DNA, 33 bp, Artificial Sequence
  Description of Artificial Sequence: Synthetic oligonucleotide
ggagaggagagctctgtctgaataatcttggag

SEQ ID NO: 239873 - DNA, 36 bp, Artificial Sequence
  Description of Artificial Sequence: Synthetic oligonucleotide
gagaggagagctctgtctgaataatcttggagatag

SEQ ID NO: 239874 - DNA, 38 bp, Artificial Sequence
  Description of Artificial Sequence: Synthetic oligonucleotide
agaggagagctctgtctgaataatcttggagatagatg

SEQ ID NO: 239875 - DNA, 37 bp, Artificial Sequence
  Description of Artificial Sequence: Synthetic oligonucleotide
gaggagagctctgtctgaataatcttggagatagatg

SEQ ID NO: 239876 - DNA, 37 bp, Artificial Sequence
  Description of Artificial Sequence: Synthetic oligonucleotide
aggagagctctgtctgaataatcttggagatagatgc

SEQ ID NO: 239877 - DNA, 36 bp, Artificial Sequence
  Description of Artificial Sequence: Synthetic oligonucleotide
ggagagctctgtctgaataatcttggagatagatgc

SEQ ID NO: 239878 - DNA, 37 bp, Artificial Sequence
  Description of Artificial Sequence: Synthetic oligonucleotide
gagagctctgtctgaataatcttggagatagatgctg

SEQ ID NO: 239879 - DNA, 38 bp, Artificial Sequence
  Description of Artificial Sequence: Synthetic oligonucleotide
agagctctgtctgaataatcttggagatagatgctgac

SEQ ID NO: 239880 - DNA, 37 bp, Artificial Sequence
  Description of Artificial Sequence: Synthetic oligonucleotide
gagctctgtctgaataatcttggagatagatgctgac

SEQ ID NO: 239881 - DNA, 38 bp, Artificial Sequence
  Description of Artificial Sequence: Synthetic oligonucleotide
agctctgtctgaataatcttggagatagatgctgactg

SEQ ID NO: 239882 - DNA, 37 bp, Artificial Sequence
  Description of Artificial Sequence: Synthetic oligonucleotide
gctctgtctgaataatcttggagatagatgctgactg

SEQ ID NO: 239883 - DNA, 37 bp, Artificial Sequence
  Description of Artificial Sequence: Synthetic oligonucleotide
ctctgtctgaataatcttggagatagatgctgactgg

SEQ ID NO: 239884 - DNA, 37 bp, Artificial Sequence
  Description of Artificial Sequence: Synthetic oligonucleotide
tctgtctgaataatcttggagatagatgctgactggc

SEQ ID NO: 239885 - DNA, 36 bp, Artificial Sequence
  Description of Artificial Sequence: Synthetic oligonucleotide
ctgtctgaataatcttggagatagatgctgactggc

SEQ ID NO: 239886 - DNA, 39 bp, Artificial Sequence
  Description of Artificial Sequence: Synthetic oligonucleotide
tgtctgaataatcttggagatagatgctgactggcattg

SEQ ID NO: 239887 - DNA, 38 bp, Artificial Sequence
  Description of Artificial Sequence: Synthetic oligonucleotide
gtctgaataatcttggagatagatgctgactggcattg

SEQ ID NO: 239888 - DNA, 38 bp, Artificial Sequence
  Description of Artificial Sequence: Synthetic oligonucleotide
tctgaataatcttggagatagatgctgactggcattgc

SEQ ID NO: 239889 - DNA, 37 bp, Artificial Sequence
  Description of Artificial Sequence: Synthetic oligonucleotide
ctgaataatcttggagatagatgctgactggcattgc

SEQ ID NO: 239890 - DNA, 38 bp, Artificial Sequence
  Description of Artificial Sequence: Synthetic oligonucleotide
tgaataatcttggagatagatgctgactggcattgctg

SEQ ID NO: 239891 - DNA, 37 bp, Artificial Sequence
  Description of Artificial Sequence: Synthetic oligonucleotide
gaataatcttggagatagatgctgactggcattgctg

SEQ ID NO: 239892 - DNA, 37 bp, Artificial Sequence
  Description of Artificial Sequence: Synthetic oligonucleotide
aataatcttggagatagatgctgactggcattgctgc

SEQ ID NO: 239893 - DNA, 36 bp, Artificial Sequence
  Description of Artificial Sequence: Synthetic oligonucleotide
ataatcttggagatagatgctgactggcattgctgc

SEQ ID NO: 239894 - DNA, 35 bp, Artificial Sequence
  Description of Artificial Sequence: Synthetic oligonucleotide
taatcttggagatagatgctgactggcattgctgc

SEQ ID NO: 239895 - DNA, 34 bp, Artificial Sequence
  Description of Artificial Sequence: Synthetic oligonucleotide
aatcttggagatagatgctgactggcattgctgc

SEQ ID NO: 239896 - DNA, 33 bp, Artificial Sequence
  Description of Artificial Sequence: Synthetic oligonucleotide
atcttggagatagatgctgactggcattgctgc

SEQ ID NO: 239897 - DNA, 32 bp, Artificial Sequence
  Description of Artificial Sequence: Synthetic oligonucleotide
tcttggagatagatgctgactggcattgctgc

SEQ ID NO: 239898 - DNA, 31 bp, Artificial Sequence
  Description of Artificial Sequence: Synthetic oligonucleotide
cttggagatagatgctgactggcattgctgc

SEQ ID NO: 239899 - DNA, 31 bp, Artificial Sequence
  Description of Artificial Sequence: Synthetic oligonucleotide
ttggagatagatgctgactggcattgctgcc

SEQ ID NO: 239900 - DNA, 30 bp, Artificial Sequence
  Description of Artificial Sequence: Synthetic oligonucleotide
tggagatagatgctgactggcattgctgcc

SEQ ID NO: 239901 - DNA, 29 bp, Artificial Sequence
  Description of Artificial Sequence: Synthetic oligonucleotide
ggagatagatgctgactggcattgctgcc

SEQ ID NO: 239902 - DNA, 31 bp, Artificial Sequence
  Description of Artificial Sequence: Synthetic oligonucleotide
gagatagatgctgactggcattgctgccttc

SEQ ID NO: 239903 - DNA, 31 bp, Artificial Sequence
  Description of Artificial Sequence: Synthetic oligonucleotide
agatagatgctgactggcattgctgccttcc

SEQ ID NO: 239904 - DNA, 30 bp, Artificial Sequence
  Description of Artificial Sequence: Synthetic oligonucleotide
gatagatgctgactggcattgctgccttcc

SEQ ID NO: 239905 - DNA, 32 bp, Artificial Sequence
  Description of Artificial Sequence: Synthetic oligonucleotide
atagatgctgactggcattgctgccttcctag

SEQ ID NO: 239906 - DNA, 31 bp, Artificial Sequence
  Description of Artificial Sequence: Synthetic oligonucleotide
tagatgctgactggcattgctgccttcctag

SEQ ID NO: 239907 - DNA, 30 bp, Artificial Sequence
  Description of Artificial Sequence: Synthetic oligonucleotide
agatgctgactggcattgctgccttcctag

SEQ ID NO: 239908 - DNA, 29 bp, Artificial Sequence
  Description of Artificial Sequence: Synthetic oligonucleotide
gatgctgactggcattgctgccttcctag

SEQ ID NO: 239909 - DNA, 31 bp, Artificial Sequence
  Description of Artificial Sequence: Synthetic oligonucleotide
atgctgactggcattgctgccttcctagttg

SEQ ID NO: 239910 - DNA, 30 bp, Artificial Sequence
  Description of Artificial Sequence: Synthetic oligonucleotide
tgctgactggcattgctgccttcctagttg

SEQ ID NO: 239911 - DNA, 29 bp, Artificial Sequence
  Description of Artificial Sequence: Synthetic oligonucleotide
gctgactggcattgctgccttcctagttg

SEQ ID NO: 239912 - DNA, 29 bp, Artificial Sequence
  Description of Artificial Sequence: Synthetic oligonucleotide
ctgactggcattgctgccttcctagttgg

SEQ ID NO: 239913 - DNA, 29 bp, Artificial Sequence
  Description of Artificial Sequence: Synthetic oligonucleotide
tgactggcattgctgccttcctagttggg

SEQ ID NO: 239914 - DNA, 28 bp, Artificial Sequence
  Description of Artificial Sequence: Synthetic oligonucleotide
gactggcattgctgccttcctagttggg

SEQ ID NO: 239915 - DNA, 28 bp, Artificial Sequence
  Description of Artificial Sequence: Synthetic oligonucleotide
actggcattgctgccttcctagttgggc

SEQ ID NO: 239916 - DNA, 27 bp, Artificial Sequence
  Description of Artificial Sequence: Synthetic oligonucleotide
ctggcattgctgccttcctagttgggc

SEQ ID NO: 239917 - DNA, 31 bp, Artificial Sequence
  Description of Artificial Sequence: Synthetic oligonucleotide
tggcattgctgccttcctagttgggctaaac

SEQ ID NO: 239918 - DNA, 30 bp, Artificial Sequence
  Description of Artificial Sequence: Synthetic oligonucleotide
ggcattgctgccttcctagttgggctaaac

SEQ ID NO: 239919 - DNA, 32 bp, Artificial Sequence
  Description of Artificial Sequence: Synthetic oligonucleotide
gcattgctgccttcctagttgggctaaacttc

SEQ ID NO: 239920 - DNA, 32 bp, Artificial Sequence
  Description of Artificial Sequence: Synthetic oligonucleotide
cattgctgccttcctagttgggctaaacttcc

SEQ ID NO: 239921 - DNA, 34 bp, Artificial Sequence
  Description of Artificial Sequence: Synthetic oligonucleotide
attgctgccttcctagttgggctaaacttccttc

SEQ ID NO: 239922 - DNA, 33 bp, Artificial Sequence
  Description of Artificial Sequence: Synthetic oligonucleotide
ttgctgccttcctagttgggctaaacttccttc

SEQ ID NO: 239923 - DNA, 32 bp, Artificial Sequence
  Description of Artificial Sequence: Synthetic oligonucleotide
tgctgccttcctagttgggctaaacttccttc

SEQ ID NO: 239924 - DNA, 31 bp, Artificial Sequence
  Description of Artificial Sequence: Synthetic oligonucleotide
gctgccttcctagttgggctaaacttccttc

SEQ ID NO: 239925 - DNA, 32 bp, Artificial Sequence
  Description of Artificial Sequence: Synthetic oligonucleotide
ctgccttcctagttgggctaaacttccttctc

SEQ ID NO: 239926 - DNA, 32 bp, Artificial Sequence
  Description of Artificial Sequence: Synthetic oligonucleotide
tgccttcctagttgggctaaacttccttctcg

SEQ ID NO: 239927 - DNA, 31 bp, Artificial Sequence
  Description of Artificial Sequence: Synthetic oligonucleotide
gccttcctagttgggctaaacttccttctcg

SEQ ID NO: 239928 - DNA, 32 bp, Artificial Sequence
  Description of Artificial Sequence: Synthetic oligonucleotide
ccttcctagttgggctaaacttccttctcgtg

SEQ ID NO: 239929 - DNA, 32 bp, Artificial Sequence
  Description of Artificial Sequence: Synthetic oligonucleotide
cttcctagttgggctaaacttccttctcgtgg

SEQ ID NO: 239930 - DNA, 32 bp, Artificial Sequence
  Description of Artificial Sequence: Synthetic oligonucleotide
ttcctagttgggctaaacttccttctcgtggg

SEQ ID NO: 239931 - DNA, 31 bp, Artificial Sequence
  Description of Artificial Sequence: Synthetic oligonucleotide
tcctagttgggctaaacttccttctcgtggg

SEQ ID NO: 239932 - DNA, 30 bp, Artificial Sequence
  Description of Artificial Sequence: Synthetic oligonucleotide
cctagttgggctaaacttccttctcgtggg

SEQ ID NO: 239933 - DNA, 33 bp, Artificial Sequence
  Description of Artificial Sequence: Synthetic oligonucleotide
ctagttgggctaaacttccttctcgtgggaatc

SEQ ID NO: 239934 - DNA, 33 bp, Artificial Sequence
  Description of Artificial Sequence: Synthetic oligonucleotide
tagttgggctaaacttccttctcgtgggaatcc

SEQ ID NO: 239935 - DNA, 32 bp, Artificial Sequence
  Description of Artificial Sequence: Synthetic oligonucleotide
agttgggctaaacttccttctcgtgggaatcc

SEQ ID NO: 239936 - DNA, 31 bp, Artificial Sequence
  Description of Artificial Sequence: Synthetic oligonucleotide
gttgggctaaacttccttctcgtgggaatcc

SEQ ID NO: 239937 - DNA, 32 bp, Artificial Sequence
  Description of Artificial Sequence: Synthetic oligonucleotide
ttgggctaaacttccttctcgtgggaatcctc

SEQ ID NO: 239938 - DNA, 31 bp, Artificial Sequence
  Description of Artificial Sequence: Synthetic oligonucleotide
tgggctaaacttccttctcgtgggaatcctc

SEQ ID NO: 239939 - DNA, 30 bp, Artificial Sequence
  Description of Artificial Sequence: Synthetic oligonucleotide
gggctaaacttccttctcgtgggaatcctc

SEQ ID NO: 239940 - DNA, 32 bp, Artificial Sequence
  Description of Artificial Sequence: Synthetic oligonucleotide
ggctaaacttccttctcgtgggaatcctcatc

SEQ ID NO: 239941 - DNA, 32 bp, Artificial Sequence
  Description of Artificial Sequence: Synthetic oligonucleotide
gctaaacttccttctcgtgggaatcctcatcc

SEQ ID NO: 239942 - DNA, 33 bp, Artificial Sequence
  Description of Artificial Sequence: Synthetic oligonucleotide
ctaaacttccttctcgtgggaatcctcatccag

SEQ ID NO: 239943 - DNA, 33 bp, Artificial Sequence
  Description of Artificial Sequence: Synthetic oligonucleotide
taaacttccttctcgtgggaatcctcatccagc

SEQ ID NO: 239944 - DNA, 32 bp, Artificial Sequence
  Description of Artificial Sequence: Synthetic oligonucleotide
aaacttccttctcgtgggaatcctcatccagc

SEQ ID NO: 239945 - DNA, 31 bp, Artificial Sequence
  Description of Artificial Sequence: Synthetic oligonucleotide
aacttccttctcgtgggaatcctcatccagc

SEQ ID NO: 239946 - DNA, 30 bp, Artificial Sequence
  Description of Artificial Sequence: Synthetic oligonucleotide
acttccttctcgtgggaatcctcatccagc

SEQ ID NO: 239947 - DNA, 29 bp, Artificial Sequence
  Description of Artificial Sequence: Synthetic oligonucleotide
cttccttctcgtgggaatcctcatccagc

SEQ ID NO: 239948 - DNA, 32 bp, Artificial Sequence
  Description of Artificial Sequence: Synthetic oligonucleotide
ttccttctcgtgggaatcctcatccagcaaag

SEQ ID NO: 239949 - DNA, 31 bp, Artificial Sequence
  Description of Artificial Sequence: Synthetic oligonucleotide
tccttctcgtgggaatcctcatccagcaaag

SEQ ID NO: 239950 - DNA, 30 bp, Artificial Sequence
  Description of Artificial Sequence: Synthetic oligonucleotide
ccttctcgtgggaatcctcatccagcaaag

SEQ ID NO: 239951 - DNA, 30 bp, Artificial Sequence
  Description of Artificial Sequence: Synthetic oligonucleotide
cttctcgtgggaatcctcatccagcaaagg

SEQ ID NO: 239952 - DNA, 30 bp, Artificial Sequence
  Description of Artificial Sequence: Synthetic oligonucleotide
ttctcgtgggaatcctcatccagcaaaggg

SEQ ID NO: 239953 - DNA, 29 bp, Artificial Sequence
  Description of Artificial Sequence: Synthetic oligonucleotide
tctcgtgggaatcctcatccagcaaaggg

SEQ ID NO: 239954 - DNA, 28 bp, Artificial Sequence
  Description of Artificial Sequence: Synthetic oligonucleotide
ctcgtgggaatcctcatccagcaaaggg

SEQ ID NO: 239955 - DNA, 28 bp, Artificial Sequence
  Description of Artificial Sequence: Synthetic oligonucleotide
tcgtgggaatcctcatccagcaaagggc

SEQ ID NO: 239956 - DNA, 27 bp, Artificial Sequence
  Description of Artificial Sequence: Synthetic oligonucleotide
cgtgggaatcctcatccagcaaagggc

SEQ ID NO: 239957 - DNA, 28 bp, Artificial Sequence
  Description of Artificial Sequence: Synthetic oligonucleotide
gtgggaatcctcatccagcaaagggctc

SEQ ID NO: 239958 - DNA, 29 bp, Artificial Sequence
  Description of Artificial Sequence: Synthetic oligonucleotide
tgggaatcctcatccagcaaagggctcac

SEQ ID NO: 239959 - DNA, 28 bp, Artificial Sequence
  Description of Artificial Sequence: Synthetic oligonucleotide
gggaatcctcatccagcaaagggctcac

SEQ ID NO: 239960 - DNA, 31 bp, Artificial Sequence
  Description of Artificial Sequence: Synthetic oligonucleotide
ggaatcctcatccagcaaagggctcacaaag

SEQ ID NO: 239961 - DNA, 31 bp, Artificial Sequence
  Description of Artificial Sequence: Synthetic oligonucleotide
gaatcctcatccagcaaagggctcacaaagg

SEQ ID NO: 239962 - DNA, 35 bp, Artificial Sequence
  Description of Artificial Sequence: Synthetic oligonucleotide
aatcctcatccagcaaagggctcacaaaggatatc

SEQ ID NO: 239963 - DNA, 34 bp, Artificial Sequence
  Description of Artificial Sequence: Synthetic oligonucleotide
atcctcatccagcaaagggctcacaaaggatatc

SEQ ID NO: 239964 - DNA, 33 bp, Artificial Sequence
  Description of Artificial Sequence: Synthetic oligonucleotide
tcctcatccagcaaagggctcacaaaggatatc

SEQ ID NO: 239965 - DNA, 32 bp, Artificial Sequence
  Description of Artificial Sequence: Synthetic oligonucleotide
cctcatccagcaaagggctcacaaaggatatc

SEQ ID NO: 239966 - DNA, 33 bp, Artificial Sequence
  Description of Artificial Sequence: Synthetic oligonucleotide
ctcatccagcaaagggctcacaaaggatatctg

SEQ ID NO: 239967 - DNA, 34 bp, Artificial Sequence
  Description of Artificial Sequence: Synthetic oligonucleotide
tcatccagcaaagggctcacaaaggatatctgag

SEQ ID NO: 239968 - DNA, 33 bp, Artificial Sequence
  Description of Artificial Sequence: Synthetic oligonucleotide
catccagcaaagggctcacaaaggatatctgag

SEQ ID NO: 239969 - DNA, 33 bp, Artificial Sequence
  Description of Artificial Sequence: Synthetic oligonucleotide
atccagcaaagggctcacaaaggatatctgagg

SEQ ID NO: 239970 - DNA, 32 bp, Artificial Sequence
  Description of Artificial Sequence: Synthetic oligonucleotide
tccagcaaagggctcacaaaggatatctgagg

SEQ ID NO: 239971 - DNA, 31 bp, Artificial Sequence
  Description of Artificial Sequence: Synthetic oligonucleotide
ccagcaaagggctcacaaaggatatctgagg

SEQ ID NO: 239972 - DNA, 32 bp, Artificial Sequence
  Description of Artificial Sequence: Synthetic oligonucleotide
cagcaaagggctcacaaaggatatctgaggac

SEQ ID NO: 239973 - DNA, 32 bp, Artificial Sequence
  Description of Artificial Sequence: Synthetic oligonucleotide
agcaaagggctcacaaaggatatctgaggacg

SEQ ID NO: 239974 - DNA, 31 bp, Artificial Sequence
  Description of Artificial Sequence: Synthetic oligonucleotide
gcaaagggctcacaaaggatatctgaggacg

SEQ ID NO: 239975 - DNA, 31 bp, Artificial Sequence
  Description of Artificial Sequence: Synthetic oligonucleotide
caaagggctcacaaaggatatctgaggacgc

SEQ ID NO: 239976 - DNA, 32 bp, Artificial Sequence
  Description of Artificial Sequence: Synthetic oligonucleotide
aaagggctcacaaaggatatctgaggacgctg

SEQ ID NO: 239977 - DNA, 31 bp, Artificial Sequence
  Description of Artificial Sequence: Synthetic oligonucleotide
aagggctcacaaaggatatctgaggacgctg

SEQ ID NO: 239978 - DNA, 30 bp, Artificial Sequence
  Description of Artificial Sequence: Synthetic oligonucleotide
agggctcacaaaggatatctgaggacgctg

SEQ ID NO: 239979 - DNA, 29 bp, Artificial Sequence
  Description of Artificial Sequence: Synthetic oligonucleotide
gggctcacaaaggatatctgaggacgctg

SEQ ID NO: 239980 - DNA, 31 bp, Artificial Sequence
  Description of Artificial Sequence: Synthetic oligonucleotide
ggctcacaaaggatatctgaggacgctgatg

SEQ ID NO: 239981 - DNA, 32 bp, Artificial Sequence
  Description of Artificial Sequence: Synthetic oligonucleotide
gctcacaaaggatatctgaggacgctgatgtc

SEQ ID NO: 239982 - DNA, 33 bp, Artificial Sequence
  Description of Artificial Sequence: Synthetic oligonucleotide
ctcacaaaggatatctgaggacgctgatgtctg

SEQ ID NO: 239983 - DNA, 33 bp, Artificial Sequence
  Description of Artificial Sequence: Synthetic oligonucleotide
tcacaaaggatatctgaggacgctgatgtctgg

SEQ ID NO: 239984 - DNA, 32 bp, Artificial Sequence
  Description of Artificial Sequence: Synthetic oligonucleotide
cacaaaggatatctgaggacgctgatgtctgg

SEQ ID NO: 239985 - DNA, 36 bp, Artificial Sequence
  Description of Artificial Sequence: Synthetic oligonucleotide
acaaaggatatctgaggacgctgatgtctggaaatg

SEQ ID NO: 239986 - DNA, 35 bp, Artificial Sequence
  Description of Artificial Sequence: Synthetic oligonucleotide
caaaggatatctgaggacgctgatgtctggaaatg

SEQ ID NO: 239987 - DNA, 36 bp, Artificial Sequence
  Description of Artificial Sequence: Synthetic oligonucleotide
aaaggatatctgaggacgctgatgtctggaaatgag

SEQ ID NO: 239988 - DNA, 35 bp, Artificial Sequence
  Description of Artificial Sequence: Synthetic oligonucleotide
aaggatatctgaggacgctgatgtctggaaatgag

SEQ ID NO: 239989 - DNA, 34 bp, Artificial Sequence
  Description of Artificial Sequence: Synthetic oligonucleotide
aggatatctgaggacgctgatgtctggaaatgag

SEQ ID NO: 239990 - DNA, 33 bp, Artificial Sequence
  Description of Artificial Sequence: Synthetic oligonucleotide
ggatatctgaggacgctgatgtctggaaatgag

SEQ ID NO: 239991 - DNA, 33 bp, Artificial Sequence
  Description of Artificial Sequence: Synthetic oligonucleotide
gatatctgaggacgctgatgtctggaaatgagg

SEQ ID NO: 239992 - DNA, 34 bp, Artificial Sequence
  Description of Artificial Sequence: Synthetic oligonucleotide
atatctgaggacgctgatgtctggaaatgaggtc

SEQ ID NO: 239993 - DNA, 33 bp, Artificial Sequence
  Description of Artificial Sequence: Synthetic oligonucleotide
tatctgaggacgctgatgtctggaaatgaggtc

SEQ ID NO: 239994 - DNA, 32 bp, Artificial Sequence
  Description of Artificial Sequence: Synthetic oligonucleotide
atctgaggacgctgatgtctggaaatgaggtc

SEQ ID NO: 239995 - DNA, 31 bp, Artificial Sequence
  Description of Artificial Sequence: Synthetic oligonucleotide
tctgaggacgctgatgtctggaaatgaggtc

SEQ ID NO: 239996 - DNA, 30 bp, Artificial Sequence
  Description of Artificial Sequence: Synthetic oligonucleotide
ctgaggacgctgatgtctggaaatgaggtc

SEQ ID NO: 239997 - DNA, 31 bp, Artificial Sequence
  Description of Artificial Sequence: Synthetic oligonucleotide
tgaggacgctgatgtctggaaatgaggtcac

SEQ ID NO: 239998 - DNA, 30 bp, Artificial Sequence
  Description of Artificial Sequence: Synthetic oligonucleotide
gaggacgctgatgtctggaaatgaggtcac

SEQ ID NO: 239999 - DNA, 32 bp, Artificial Sequence
  Description of Artificial Sequence: Synthetic oligonucleotide
aggacgctgatgtctggaaatgaggtcacaag

SEQ ID NO: 240000 - DNA, 31 bp, Artificial Sequence
  Description of Artificial Sequence: Synthetic oligonucleotide
ggacgctgatgtctggaaatgaggtcacaag

SEQ ID NO: 240001 - DNA, 32 bp, Artificial Sequence
  Description of Artificial Sequence: Synthetic oligonucleotide
gacgctgatgtctggaaatgaggtcacaagag

SEQ ID NO: 240002 - DNA, 32 bp, Artificial Sequence
  Description of Artificial Sequence: Synthetic oligonucleotide
acgctgatgtctggaaatgaggtcacaagagc

SEQ ID NO: 240003 - DNA, 31 bp, Artificial Sequence
  Description of Artificial Sequence: Synthetic oligonucleotide
cgctgatgtctggaaatgaggtcacaagagc

SEQ ID NO: 240004 - DNA, 32 bp, Artificial Sequence
  Description of Artificial Sequence: Synthetic oligonucleotide
gctgatgtctggaaatgaggtcacaagagctg

SEQ ID NO: 240005 - DNA, 34 bp, Artificial Sequence
  Description of Artificial Sequence: Synthetic oligonucleotide
ctgatgtctggaaatgaggtcacaagagctgatc

SEQ ID NO: 240006 - DNA, 35 bp, Artificial Sequence
  Description of Artificial Sequence: Synthetic oligonucleotide
tgatgtctggaaatgaggtcacaagagctgatctg

SEQ ID NO: 240007 - DNA, 34 bp, Artificial Sequence
  Description of Artificial Sequence: Synthetic oligonucleotide
gatgtctggaaatgaggtcacaagagctgatctg

SEQ ID NO: 240008 - DNA, 34 bp, Artificial Sequence
  Description of Artificial Sequence: Synthetic oligonucleotide
atgtctggaaatgaggtcacaagagctgatctgc

SEQ ID NO: 240009 - DNA, 33 bp, Artificial Sequence
  Description of Artificial Sequence: Synthetic oligonucleotide
tgtctggaaatgaggtcacaagagctgatctgc

SEQ ID NO: 240010 - DNA, 32 bp, Artificial Sequence
  Description of Artificial Sequence: Synthetic oligonucleotide
gtctggaaatgaggtcacaagagctgatctgc

SEQ ID NO: 240011 - DNA, 33 bp, Artificial Sequence
  Description of Artificial Sequence: Synthetic oligonucleotide
tctggaaatgaggtcacaagagctgatctgctc

SEQ ID NO: 240012 - DNA, 32 bp, Artificial Sequence
  Description of Artificial Sequence: Synthetic oligonucleotide
ctggaaatgaggtcacaagagctgatctgctc

SEQ ID NO: 240013 - DNA, 32 bp, Artificial Sequence
  Description of Artificial Sequence: Synthetic oligonucleotide
tggaaatgaggtcacaagagctgatctgctcc

SEQ ID NO: 240014 - DNA, 31 bp, Artificial Sequence
  Description of Artificial Sequence: Synthetic oligonucleotide
ggaaatgaggtcacaagagctgatctgctcc

SEQ ID NO: 240015 - DNA, 31 bp, Artificial Sequence
  Description of Artificial Sequence: Synthetic oligonucleotide
gaaatgaggtcacaagagctgatctgctccc

SEQ ID NO: 240016 - DNA, 32 bp, Artificial Sequence
  Description of Artificial Sequence: Synthetic oligonucleotide
aaatgaggtcacaagagctgatctgctcccac

SEQ ID NO: 240017 - DNA, 31 bp, Artificial Sequence
  Description of Artificial Sequence: Synthetic oligonucleotide
aatgaggtcacaagagctgatctgctcccac

SEQ ID NO: 240018 - DNA, 30 bp, Artificial Sequence
  Description of Artificial Sequence: Synthetic oligonucleotide
atgaggtcacaagagctgatctgctcccac

SEQ ID NO: 240019 - DNA, 29 bp, Artificial Sequence
  Description of Artificial Sequence: Synthetic oligonucleotide
tgaggtcacaagagctgatctgctcccac

SEQ ID NO: 240020 - DNA, 28 bp, Artificial Sequence
  Description of Artificial Sequence: Synthetic oligonucleotide
gaggtcacaagagctgatctgctcccac

SEQ ID NO: 240021 - DNA, 29 bp, Artificial Sequence
  Description of Artificial Sequence: Synthetic oligonucleotide
aggtcacaagagctgatctgctcccacag

SEQ ID NO: 240022 - DNA, 28 bp, Artificial Sequence
  Description of Artificial Sequence: Synthetic oligonucleotide
ggtcacaagagctgatctgctcccacag

SEQ ID NO: 240023 - DNA, 29 bp, Artificial Sequence
  Description of Artificial Sequence: Synthetic oligonucleotide
gtcacaagagctgatctgctcccacagtc

SEQ ID NO: 240024 - DNA, 31 bp, Artificial Sequence
  Description of Artificial Sequence: Synthetic oligonucleotide
tcacaagagctgatctgctcccacagtcatg

SEQ ID NO: 240025 - DNA, 30 bp, Artificial Sequence
  Description of Artificial Sequence: Synthetic oligonucleotide
cacaagagctgatctgctcccacagtcatg

SEQ ID NO: 240026 - DNA, 30 bp, Artificial Sequence
  Description of Artificial Sequence: Synthetic oligonucleotide
acaagagctgatctgctcccacagtcatgc

SEQ ID NO: 240027 - DNA, 29 bp, Artificial Sequence
  Description of Artificial Sequence: Synthetic oligonucleotide
caagagctgatctgctcccacagtcatgc

SEQ ID NO: 240028 - DNA, 32 bp, Artificial Sequence
  Description of Artificial Sequence: Synthetic oligonucleotide
aagagctgatctgctcccacagtcatgcaaag

SEQ ID NO: 240029 - DNA, 31 bp, Artificial Sequence
  Description of Artificial Sequence: Synthetic oligonucleotide
agagctgatctgctcccacagtcatgcaaag

SEQ ID NO: 240030 - DNA, 30 bp, Artificial Sequence
  Description of Artificial Sequence: Synthetic oligonucleotide
gagctgatctgctcccacagtcatgcaaag

SEQ ID NO: 240031 - DNA, 30 bp, Artificial Sequence
  Description of Artificial Sequence: Synthetic oligonucleotide
agctgatctgctcccacagtcatgcaaagg

SEQ ID NO: 240032 - DNA, 29 bp, Artificial Sequence
  Description of Artificial Sequence: Synthetic oligonucleotide
gctgatctgctcccacagtcatgcaaagg

SEQ ID NO: 240033 - DNA, 30 bp, Artificial Sequence
  Description of Artificial Sequence: Synthetic oligonucleotide
ctgatctgctcccacagtcatgcaaaggtc

SEQ ID NO: 240034 - DNA, 30 bp, Artificial Sequence
  Description of Artificial Sequence: Synthetic oligonucleotide
tgatctgctcccacagtcatgcaaaggtcc

SEQ ID NO: 240035 - DNA, 29 bp, Artificial Sequence
  Description of Artificial Sequence: Synthetic oligonucleotide
gatctgctcccacagtcatgcaaaggtcc

SEQ ID NO: 240036 - DNA, 30 bp, Artificial Sequence
  Description of Artificial Sequence: Synthetic oligonucleotide
atctgctcccacagtcatgcaaaggtcctc

SEQ ID NO: 240037 - DNA, 29 bp, Artificial Sequence
  Description of Artificial Sequence: Synthetic oligonucleotide
tctgctcccacagtcatgcaaaggtcctc

SEQ ID NO: 240038 - DNA, 28 bp, Artificial Sequence
  Description of Artificial Sequence: Synthetic oligonucleotide
ctgctcccacagtcatgcaaaggtcctc

SEQ ID NO: 240039 - DNA, 29 bp, Artificial Sequence
  Description of Artificial Sequence: Synthetic oligonucleotide
tgctcccacagtcatgcaaaggtcctctc

SEQ ID NO: 240040 - DNA, 28 bp, Artificial Sequence
  Description of Artificial Sequence: Synthetic oligonucleotide
gctcccacagtcatgcaaaggtcctctc

SEQ ID NO: 240041 - DNA, 29 bp, Artificial Sequence
  Description of Artificial Sequence: Synthetic oligonucleotide
ctcccacagtcatgcaaaggtcctctctg

SEQ ID NO: 240042 - DNA, 31 bp, Artificial Sequence
  Description of Artificial Sequence: Synthetic oligonucleotide
tcccacagtcatgcaaaggtcctctctgaag

SEQ ID NO: 240043 - DNA, 30 bp, Artificial Sequence
  Description of Artificial Sequence: Synthetic oligonucleotide
cccacagtcatgcaaaggtcctctctgaag

SEQ ID NO: 240044 - DNA, 30 bp, Artificial Sequence
  Description of Artificial Sequence: Synthetic oligonucleotide
ccacagtcatgcaaaggtcctctctgaagc

SEQ ID NO: 240045 - DNA, 32 bp, Artificial Sequence
  Description of Artificial Sequence: Synthetic oligonucleotide
cacagtcatgcaaaggtcctctctgaagcttg

SEQ ID NO: 240046 - DNA, 33 bp, Artificial Sequence
  Description of Artificial Sequence: Synthetic oligonucleotide
acagtcatgcaaaggtcctctctgaagcttgtc

SEQ ID NO: 240047 - DNA, 32 bp, Artificial Sequence
  Description of Artificial Sequence: Synthetic oligonucleotide
cagtcatgcaaaggtcctctctgaagcttgtc

SEQ ID NO: 240048 - DNA, 33 bp, Artificial Sequence
  Description of Artificial Sequence: Synthetic oligonucleotide
agtcatgcaaaggtcctctctgaagcttgtctc

SEQ ID NO: 240049 - DNA, 32 bp, Artificial Sequence
  Description of Artificial Sequence: Synthetic oligonucleotide
gtcatgcaaaggtcctctctgaagcttgtctc

SEQ ID NO: 240050 - DNA, 33 bp, Artificial Sequence
  Description of Artificial Sequence: Synthetic oligonucleotide
tcatgcaaaggtcctctctgaagcttgtctctc

SEQ ID NO: 240051 - DNA, 32 bp, Artificial Sequence
  Description of Artificial Sequence: Synthetic oligonucleotide
catgcaaaggtcctctctgaagcttgtctctc

SEQ ID NO: 240052 - DNA, 33 bp, Artificial Sequence
  Description of Artificial Sequence: Synthetic oligonucleotide
atgcaaaggtcctctctgaagcttgtctctctg

SEQ ID NO: 240053 - DNA, 32 bp, Artificial Sequence
  Description of Artificial Sequence: Synthetic oligonucleotide
tgcaaaggtcctctctgaagcttgtctctctg

SEQ ID NO: 240054 - DNA, 31 bp, Artificial Sequence
  Description of Artificial Sequence: Synthetic oligonucleotide
gcaaaggtcctctctgaagcttgtctctctg

SEQ ID NO: 240055 - DNA, 31 bp, Artificial Sequence
  Description of Artificial Sequence: Synthetic oligonucleotide
caaaggtcctctctgaagcttgtctctctgg

SEQ ID NO: 240056 - DNA, 32 bp, Artificial Sequence
  Description of Artificial Sequence: Synthetic oligonucleotide
aaaggtcctctctgaagcttgtctctctggtg

SEQ ID NO: 240057 - DNA, 31 bp, Artificial Sequence
  Description of Artificial Sequence: Synthetic oligonucleotide
aaggtcctctctgaagcttgtctctctggtg

SEQ ID NO: 240058 - DNA, 30 bp, Artificial Sequence
  Description of Artificial Sequence: Synthetic oligonucleotide
aggtcctctctgaagcttgtctctctggtg

SEQ ID NO: 240059 - DNA, 29 bp, Artificial Sequence
  Description of Artificial Sequence: Synthetic oligonucleotide
ggtcctctctgaagcttgtctctctggtg

SEQ ID NO: 240060 - DNA, 29 bp, Artificial Sequence
  Description of Artificial Sequence: Synthetic oligonucleotide
gtcctctctgaagcttgtctctctggtgc

SEQ ID NO: 240061 - DNA, 29 bp, Artificial Sequence
  Description of Artificial Sequence: Synthetic oligonucleotide
tcctctctgaagcttgtctctctggtgcc

SEQ ID NO: 240062 - DNA, 28 bp, Artificial Sequence
  Description of Artificial Sequence: Synthetic oligonucleotide
cctctctgaagcttgtctctctggtgcc

SEQ ID NO: 240063 - DNA, 29 bp, Artificial Sequence
  Description of Artificial Sequence: Synthetic oligonucleotide
ctctctgaagcttgtctctctggtgcctg

SEQ ID NO: 240064 - DNA, 31 bp, Artificial Sequence
  Description of Artificial Sequence: Synthetic oligonucleotide
tctctgaagcttgtctctctggtgcctgaag

SEQ ID NO: 240065 - DNA, 30 bp, Artificial Sequence
  Description of Artificial Sequence: Synthetic oligonucleotide
ctctgaagcttgtctctctggtgcctgaag

SEQ ID NO: 240066 - DNA, 32 bp, Artificial Sequence
  Description of Artificial Sequence: Synthetic oligonucleotide
tctgaagcttgtctctctggtgcctgaagttg

SEQ ID NO: 240067 - DNA, 31 bp, Artificial Sequence
  Description of Artificial Sequence: Synthetic oligonucleotide
ctgaagcttgtctctctggtgcctgaagttg

SEQ ID NO: 240068 - DNA, 32 bp, Artificial Sequence
  Description of Artificial Sequence: Synthetic oligonucleotide
tgaagcttgtctctctggtgcctgaagttgtg

SEQ ID NO: 240069 - DNA, 31 bp, Artificial Sequence
  Description of Artificial Sequence: Synthetic oligonucleotide
gaagcttgtctctctggtgcctgaagttgtg

SEQ ID NO: 240070 - DNA, 33 bp, Artificial Sequence
  Description of Artificial Sequence: Synthetic oligonucleotide
aagcttgtctctctggtgcctgaagttgtgatg

SEQ ID NO: 240071 - DNA, 32 bp, Artificial Sequence
  Description of Artificial Sequence: Synthetic oligonucleotide
agcttgtctctctggtgcctgaagttgtgatg

SEQ ID NO: 240072 - DNA, 31 bp, Artificial Sequence
  Description of Artificial Sequence: Synthetic oligonucleotide
gcttgtctctctggtgcctgaagttgtgatg

SEQ ID NO: 240073 - DNA, 32 bp, Artificial Sequence
  Description of Artificial Sequence: Synthetic oligonucleotide
cttgtctctctggtgcctgaagttgtgatgag

SEQ ID NO: 240074 - DNA, 34 bp, Artificial Sequence
  Description of Artificial Sequence: Synthetic oligonucleotide
ttgtctctctggtgcctgaagttgtgatgagttg

SEQ ID NO: 240075 - DNA, 33 bp, Artificial Sequence
  Description of Artificial Sequence: Synthetic oligonucleotide
tgtctctctggtgcctgaagttgtgatgagttg

SEQ ID NO: 240076 - DNA, 32 bp, Artificial Sequence
  Description of Artificial Sequence: Synthetic oligonucleotide
gtctctctggtgcctgaagttgtgatgagttg

SEQ ID NO: 240077 - DNA, 33 bp, Artificial Sequence
  Description of Artificial Sequence: Synthetic oligonucleotide
tctctctggtgcctgaagttgtgatgagttgtc

SEQ ID NO: 240078 - DNA, 32 bp, Artificial Sequence
  Description of Artificial Sequence: Synthetic oligonucleotide
ctctctggtgcctgaagttgtgatgagttgtc

SEQ ID NO: 240079 - DNA, 33 bp, Artificial Sequence
  Description of Artificial Sequence: Synthetic oligonucleotide
tctctggtgcctgaagttgtgatgagttgtctg

SEQ ID NO: 240080 - DNA, 32 bp, Artificial Sequence
  Description of Artificial Sequence: Synthetic oligonucleotide
ctctggtgcctgaagttgtgatgagttgtctg

SEQ ID NO: 240081 - DNA, 32 bp, Artificial Sequence
  Description of Artificial Sequence: Synthetic oligonucleotide
tctggtgcctgaagttgtgatgagttgtctgg

SEQ ID NO: 240082 - DNA, 31 bp, Artificial Sequence
  Description of Artificial Sequence: Synthetic oligonucleotide
ctggtgcctgaagttgtgatgagttgtctgg

SEQ ID NO: 240083 - DNA, 31 bp, Artificial Sequence
  Description of Artificial Sequence: Synthetic oligonucleotide
tggtgcctgaagttgtgatgagttgtctggg

SEQ ID NO: 240084 - DNA, 30 bp, Artificial Sequence
  Description of Artificial Sequence: Synthetic oligonucleotide
ggtgcctgaagttgtgatgagttgtctggg

SEQ ID NO: 240085 - DNA, 30 bp, Artificial Sequence
  Description of Artificial Sequence: Synthetic oligonucleotide
gtgcctgaagttgtgatgagttgtctgggc

SEQ ID NO: 240086 - DNA, 30 bp, Artificial Sequence
  Description of Artificial Sequence: Synthetic oligonucleotide
tgcctgaagttgtgatgagttgtctgggcc

SEQ ID NO: 240087 - DNA, 29 bp, Artificial Sequence
  Description of Artificial Sequence: Synthetic oligonucleotide
gcctgaagttgtgatgagttgtctgggcc

SEQ ID NO: 240088 - DNA, 29 bp, Artificial Sequence
  Description of Artificial Sequence: Synthetic oligonucleotide
cctgaagttgtgatgagttgtctgggccg

SEQ ID NO: 240089 - DNA, 30 bp, Artificial Sequence
  Description of Artificial Sequence: Synthetic oligonucleotide
ctgaagttgtgatgagttgtctgggccgtg

SEQ ID NO: 240090 - DNA, 30 bp, Artificial Sequence
  Description of Artificial Sequence: Synthetic oligonucleotide
tgaagttgtgatgagttgtctgggccgtgg

SEQ ID NO: 240091 - DNA, 29 bp, Artificial Sequence
  Description of Artificial Sequence: Synthetic oligonucleotide
gaagttgtgatgagttgtctgggccgtgg

SEQ ID NO: 240092 - DNA, 29 bp, Artificial Sequence
  Description of Artificial Sequence: Synthetic oligonucleotide
aagttgtgatgagttgtctgggccgtggg

SEQ ID NO: 240093 - DNA, 28 bp, Artificial Sequence
  Description of Artificial Sequence: Synthetic oligonucleotide
agttgtgatgagttgtctgggccgtggg

SEQ ID NO: 240094 - DNA, 27 bp, Artificial Sequence
  Description of Artificial Sequence: Synthetic oligonucleotide
gttgtgatgagttgtctgggccgtggg

SEQ ID NO: 240095 - DNA, 28 bp, Artificial Sequence
  Description of Artificial Sequence: Synthetic oligonucleotide
ttgtgatgagttgtctgggccgtgggtg

SEQ ID NO: 240096 - DNA, 27 bp, Artificial Sequence
  Description of Artificial Sequence: Synthetic oligonucleotide
tgtgatgagttgtctgggccgtgggtg

SEQ ID NO: 240097 - DNA, 27 bp, Artificial Sequence
  Description of Artificial Sequence: Synthetic oligonucleotide
gtgatgagttgtctgggccgtgggtga

SEQ ID NO: 240098 - DNA, 27 bp, Artificial Sequence
  Description of Artificial Sequence: Synthetic oligonucleotide
tgatgagttgtctgggccgtgggtgag

SEQ ID NO: 240099 - DNA, 26 bp, Artificial Sequence
  Description of Artificial Sequence: Synthetic oligonucleotide
gatgagttgtctgggccgtgggtgag

SEQ ID NO: 240100 - DNA, 27 bp, Artificial Sequence
  Description of Artificial Sequence: Synthetic oligonucleotide
atgagttgtctgggccgtgggtgagga

SEQ ID NO: 240101 - DNA, 27 bp, Artificial Sequence
  Description of Artificial Sequence: Synthetic oligonucleotide
tgagttgtctgggccgtgggtgaggaa

SEQ ID NO: 240102 - DNA, 27 bp, Artificial Sequence
  Description of Artificial Sequence: Synthetic oligonucleotide
gagttgtctgggccgtgggtgaggaaa

SEQ ID NO: 240103 - DNA, 28 bp, Artificial Sequence
  Description of Artificial Sequence: Synthetic oligonucleotide
agttgtctgggccgtgggtgaggaaaag

SEQ ID NO: 240104 - DNA, 27 bp, Artificial Sequence
  Description of Artificial Sequence: Synthetic oligonucleotide
gttgtctgggccgtgggtgaggaaaag

SEQ ID NO: 240105 - DNA, 27 bp, Artificial Sequence
  Description of Artificial Sequence: Synthetic oligonucleotide
ttgtctgggccgtgggtgaggaaaagg

SEQ ID NO: 240106 - DNA, 27 bp, Artificial Sequence
  Description of Artificial Sequence: Synthetic oligonucleotide
tgtctgggccgtgggtgaggaaaagga

SEQ ID NO: 240107 - DNA, 26 bp, Artificial Sequence
  Description of Artificial Sequence: Synthetic oligonucleotide
gtctgggccgtgggtgaggaaaagga

SEQ ID NO: 240108 - DNA, 27 bp, Artificial Sequence
  Description of Artificial Sequence: Synthetic oligonucleotide
tctgggccgtgggtgaggaaaaggaca

SEQ ID NO: 240109 - DNA, 27 bp, Artificial Sequence
  Description of Artificial Sequence: Synthetic oligonucleotide
ctgggccgtgggtgaggaaaaggacat

SEQ ID NO: 240110 - DNA, 28 bp, Artificial Sequence
  Description of Artificial Sequence: Synthetic oligonucleotide
tgggccgtgggtgaggaaaaggacatac

SEQ ID NO: 240111 - DNA, 27 bp, Artificial Sequence
  Description of Artificial Sequence: Synthetic oligonucleotide
gggccgtgggtgaggaaaaggacatac

SEQ ID NO: 240112 - DNA, 29 bp, Artificial Sequence
  Description of Artificial Sequence: Synthetic oligonucleotide
ggccgtgggtgaggaaaaggacatacatg

SEQ ID NO: 240113 - DNA, 30 bp, Artificial Sequence
  Description of Artificial Sequence: Synthetic oligonucleotide
gccgtgggtgaggaaaaggacatacatgag

SEQ ID NO: 240114 - DNA, 30 bp, Artificial Sequence
  Description of Artificial Sequence: Synthetic oligonucleotide
ccgtgggtgaggaaaaggacatacatgagg

SEQ ID NO: 240115 - DNA, 31 bp, Artificial Sequence
  Description of Artificial Sequence: Synthetic oligonucleotide
cgtgggtgaggaaaaggacatacatgaggtc

SEQ ID NO: 240116 - DNA, 34 bp, Artificial Sequence
  Description of Artificial Sequence: Synthetic oligonucleotide
gtgggtgaggaaaaggacatacatgaggtctatg

SEQ ID NO: 240117 - DNA, 36 bp, Artificial Sequence
  Description of Artificial Sequence: Synthetic oligonucleotide
tgggtgaggaaaaggacatacatgaggtctatgttc

SEQ ID NO: 240118 - DNA, 35 bp, Artificial Sequence
  Description of Artificial Sequence: Synthetic oligonucleotide
gggtgaggaaaaggacatacatgaggtctatgttc

SEQ ID NO: 240119 - DNA, 36 bp, Artificial Sequence
  Description of Artificial Sequence: Synthetic oligonucleotide
ggtgaggaaaaggacatacatgaggtctatgttctg

SEQ ID NO: 240120 - DNA, 36 bp, Artificial Sequence
  Description of Artificial Sequence: Synthetic oligonucleotide
gtgaggaaaaggacatacatgaggtctatgttctgg

SEQ ID NO: 240121 - DNA, 36 bp, Artificial Sequence
  Description of Artificial Sequence: Synthetic oligonucleotide
tgaggaaaaggacatacatgaggtctatgttctggc

SEQ ID NO: 240122 - DNA, 35 bp, Artificial Sequence
  Description of Artificial Sequence: Synthetic oligonucleotide
gaggaaaaggacatacatgaggtctatgttctggc

SEQ ID NO: 240123 - DNA, 40 bp, Artificial Sequence
  Description of Artificial Sequence: Synthetic oligonucleotide
aggaaaaggacatacatgaggtctatgttctggcaataac

SEQ ID NO: 240124 - DNA, 39 bp, Artificial Sequence
  Description of Artificial Sequence: Synthetic oligonucleotide
ggaaaaggacatacatgaggtctatgttctggcaataac

SEQ ID NO: 240125 - DNA, 40 bp, Artificial Sequence
  Description of Artificial Sequence: Synthetic oligonucleotide
gaaaaggacatacatgaggtctatgttctggcaataactc

SEQ ID NO: 240126 - DNA, 41 bp, Artificial Sequence
  Description of Artificial Sequence: Synthetic oligonucleotide
aaaaggacatacatgaggtctatgttctggcaataactctg

SEQ ID NO: 240127 - DNA, 40 bp, Artificial Sequence
  Description of Artificial Sequence: Synthetic oligonucleotide
aaaggacatacatgaggtctatgttctggcaataactctg

SEQ ID NO: 240128 - DNA, 39 bp, Artificial Sequence
  Description of Artificial Sequence: Synthetic oligonucleotide
aaggacatacatgaggtctatgttctggcaataactctg

SEQ ID NO: 240129 - DNA, 38 bp, Artificial Sequence
  Description of Artificial Sequence: Synthetic oligonucleotide
aggacatacatgaggtctatgttctggcaataactctg

SEQ ID NO: 240130 - DNA, 37 bp, Artificial Sequence
  Description of Artificial Sequence: Synthetic oligonucleotide
ggacatacatgaggtctatgttctggcaataactctg

SEQ ID NO: 240131 - DNA, 39 bp, Artificial Sequence
  Description of Artificial Sequence: Synthetic oligonucleotide
gacatacatgaggtctatgttctggcaataactctgttc

SEQ ID NO: 240132 - DNA, 39 bp, Artificial Sequence
  Description of Artificial Sequence: Synthetic oligonucleotide
acatacatgaggtctatgttctggcaataactctgttcc

SEQ ID NO: 240133 - DNA, 38 bp, Artificial Sequence
  Description of Artificial Sequence: Synthetic oligonucleotide
catacatgaggtctatgttctggcaataactctgttcc

SEQ ID NO: 240134 - DNA, 38 bp, Artificial Sequence
  Description of Artificial Sequence: Synthetic oligonucleotide
atacatgaggtctatgttctggcaataactctgttccc

SEQ ID NO: 240135 - DNA, 37 bp, Artificial Sequence
  Description of Artificial Sequence: Synthetic oligonucleotide
tacatgaggtctatgttctggcaataactctgttccc

SEQ ID NO: 240136 - DNA, 36 bp, Artificial Sequence
  Description of Artificial Sequence: Synthetic oligonucleotide
acatgaggtctatgttctggcaataactctgttccc

SEQ ID NO: 240137 - DNA, 35 bp, Artificial Sequence
  Description of Artificial Sequence: Synthetic oligonucleotide
catgaggtctatgttctggcaataactctgttccc

SEQ ID NO: 240138 - DNA, 36 bp, Artificial Sequence
  Description of Artificial Sequence: Synthetic oligonucleotide
atgaggtctatgttctggcaataactctgttccctg

SEQ ID NO: 240139 - DNA, 35 bp, Artificial Sequence
  Description of Artificial Sequence: Synthetic oligonucleotide
tgaggtctatgttctggcaataactctgttccctg

SEQ ID NO: 240140 - DNA, 34 bp, Artificial Sequence
  Description of Artificial Sequence: Synthetic oligonucleotide
gaggtctatgttctggcaataactctgttccctg

SEQ ID NO: 240141 - DNA, 36 bp, Artificial Sequence
  Description of Artificial Sequence: Synthetic oligonucleotide
aggtctatgttctggcaataactctgttccctgatg

SEQ ID NO: 240142 - DNA, 35 bp, Artificial Sequence
  Description of Artificial Sequence: Synthetic oligonucleotide
ggtctatgttctggcaataactctgttccctgatg

SEQ ID NO: 240143 - DNA, 35 bp, Artificial Sequence
  Description of Artificial Sequence: Synthetic oligonucleotide
gtctatgttctggcaataactctgttccctgatgc

SEQ ID NO: 240144 - DNA, 37 bp, Artificial Sequence
  Description of Artificial Sequence: Synthetic oligonucleotide
tctatgttctggcaataactctgttccctgatgcttg

SEQ ID NO: 240145 - DNA, 36 bp, Artificial Sequence
  Description of Artificial Sequence: Synthetic oligonucleotide
ctatgttctggcaataactctgttccctgatgcttg

SEQ ID NO: 240146 - DNA, 36 bp, Artificial Sequence
  Description of Artificial Sequence: Synthetic oligonucleotide
tatgttctggcaataactctgttccctgatgcttgg

SEQ ID NO: 240147 - DNA, 35 bp, Artificial Sequence
  Description of Artificial Sequence: Synthetic oligonucleotide
atgttctggcaataactctgttccctgatgcttgg

SEQ ID NO: 240148 - DNA, 34 bp, Artificial Sequence
  Description of Artificial Sequence: Synthetic oligonucleotide
tgttctggcaataactctgttccctgatgcttgg

SEQ ID NO: 240149 - DNA, 33 bp, Artificial Sequence
  Description of Artificial Sequence: Synthetic oligonucleotide
gttctggcaataactctgttccctgatgcttgg

SEQ ID NO: 240150 - DNA, 34 bp, Artificial Sequence
  Description of Artificial Sequence: Synthetic oligonucleotide
ttctggcaataactctgttccctgatgcttggag

SEQ ID NO: 240151 - DNA, 33 bp, Artificial Sequence
  Description of Artificial Sequence: Synthetic oligonucleotide
tctggcaataactctgttccctgatgcttggag

SEQ ID NO: 240152 - DNA, 32 bp, Artificial Sequence
  Description of Artificial Sequence: Synthetic oligonucleotide
ctggcaataactctgttccctgatgcttggag

SEQ ID NO: 240153 - DNA, 32 bp, Artificial Sequence
  Description of Artificial Sequence: Synthetic oligonucleotide
tggcaataactctgttccctgatgcttggagg

SEQ ID NO: 240154 - DNA, 31 bp, Artificial Sequence
  Description of Artificial Sequence: Synthetic oligonucleotide
ggcaataactctgttccctgatgcttggagg

SEQ ID NO: 240155 - DNA, 32 bp, Artificial Sequence
  Description of Artificial Sequence: Synthetic oligonucleotide
gcaataactctgttccctgatgcttggaggac

SEQ ID NO: 240156 - DNA, 32 bp, Artificial Sequence
  Description of Artificial Sequence: Synthetic oligonucleotide
caataactctgttccctgatgcttggaggacc

SEQ ID NO: 240157 - DNA, 32 bp, Artificial Sequence
  Description of Artificial Sequence: Synthetic oligonucleotide
aataactctgttccctgatgcttggaggaccc

SEQ ID NO: 240158 - DNA, 31 bp, Artificial Sequence
  Description of Artificial Sequence: Synthetic oligonucleotide
ataactctgttccctgatgcttggaggaccc

SEQ ID NO: 240159 - DNA, 30 bp, Artificial Sequence
  Description of Artificial Sequence: Synthetic oligonucleotide
taactctgttccctgatgcttggaggaccc

SEQ ID NO: 240160 - DNA, 29 bp, Artificial Sequence
  Description of Artificial Sequence: Synthetic oligonucleotide
aactctgttccctgatgcttggaggaccc

SEQ ID NO: 240161 - DNA, 28 bp, Artificial Sequence
  Description of Artificial Sequence: Synthetic oligonucleotide
actctgttccctgatgcttggaggaccc

SEQ ID NO: 240162 - DNA, 27 bp, Artificial Sequence
  Description of Artificial Sequence: Synthetic oligonucleotide
ctctgttccctgatgcttggaggaccc

SEQ ID NO: 240163 - DNA, 27 bp, Artificial Sequence
  Description of Artificial Sequence: Synthetic oligonucleotide
tctgttccctgatgcttggaggacccc

SEQ ID NO: 240164 - DNA, 26 bp, Artificial Sequence
  Description of Artificial Sequence: Synthetic oligonucleotide
ctgttccctgatgcttggaggacccc

SEQ ID NO: 240165 - DNA, 27 bp, Artificial Sequence
  Description of Artificial Sequence: Synthetic oligonucleotide
tgttccctgatgcttggaggaccccga

SEQ ID NO: 240166 - DNA, 27 bp, Artificial Sequence
  Description of Artificial Sequence: Synthetic oligonucleotide
gttccctgatgcttggaggaccccgaa

SEQ ID NO: 240167 - DNA, 27 bp, Artificial Sequence
  Description of Artificial Sequence: Synthetic oligonucleotide
ttccctgatgcttggaggaccccgaac

SEQ ID NO: 240168 - DNA, 27 bp, Artificial Sequence
  Description of Artificial Sequence: Synthetic oligonucleotide
tccctgatgcttggaggaccccgaact

SEQ ID NO: 240169 - DNA, 26 bp, Artificial Sequence
  Description of Artificial Sequence: Synthetic oligonucleotide
ccctgatgcttggaggaccccgaact

SEQ ID NO: 240170 - DNA, 27 bp, Artificial Sequence
  Description of Artificial Sequence: Synthetic oligonucleotide
cctgatgcttggaggaccccgaactgt

SEQ ID NO: 240171 - DNA, 29 bp, Artificial Sequence
  Description of Artificial Sequence: Synthetic oligonucleotide
ctgatgcttggaggaccccgaactgtttc

SEQ ID NO: 240172 - DNA, 30 bp, Artificial Sequence
  Description of Artificial Sequence: Synthetic oligonucleotide
tgatgcttggaggaccccgaactgtttctg

SEQ ID NO: 240173 - DNA, 29 bp, Artificial Sequence
  Description of Artificial Sequence: Synthetic oligonucleotide
gatgcttggaggaccccgaactgtttctg

SEQ ID NO: 240174 - DNA, 29 bp, Artificial Sequence
  Description of Artificial Sequence: Synthetic oligonucleotide
atgcttggaggaccccgaactgtttctgg

SEQ ID NO: 240175 - DNA, 28 bp, Artificial Sequence
  Description of Artificial Sequence: Synthetic oligonucleotide
tgcttggaggaccccgaactgtttctgg

SEQ ID NO: 240176 - DNA, 27 bp, Artificial Sequence
  Description of Artificial Sequence: Synthetic oligonucleotide
gcttggaggaccccgaactgtttctgg

SEQ ID NO: 240177 - DNA, 28 bp, Artificial Sequence
  Description of Artificial Sequence: Synthetic oligonucleotide
cttggaggaccccgaactgtttctggag

SEQ ID NO: 240178 - DNA, 28 bp, Artificial Sequence
  Description of Artificial Sequence: Synthetic oligonucleotide
ttggaggaccccgaactgtttctggagc

SEQ ID NO: 240179 - DNA, 27 bp, Artificial Sequence
  Description of Artificial Sequence: Synthetic oligonucleotide
tggaggaccccgaactgtttctggagc

SEQ ID NO: 240180 - DNA, 27 bp, Artificial Sequence
  Description of Artificial Sequence: Synthetic oligonucleotide
ggaggaccccgaactgtttctggagca

SEQ ID NO: 240181 - DNA, 27 bp, Artificial Sequence
  Description of Artificial Sequence: Synthetic oligonucleotide
gaggaccccgaactgtttctggagcac

SEQ ID NO: 240182 - DNA, 28 bp, Artificial Sequence
  Description of Artificial Sequence: Synthetic oligonucleotide
aggaccccgaactgtttctggagcactg

SEQ ID NO: 240183 - DNA, 27 bp, Artificial Sequence
  Description of Artificial Sequence: Synthetic oligonucleotide
ggaccccgaactgtttctggagcactg

SEQ ID NO: 240184 - DNA, 28 bp, Artificial Sequence
  Description of Artificial Sequence: Synthetic oligonucleotide
gaccccgaactgtttctggagcactgtg

SEQ ID NO: 240185 - DNA, 30 bp, Artificial Sequence
  Description of Artificial Sequence: Synthetic oligonucleotide
accccgaactgtttctggagcactgtgttc

SEQ ID NO: 240186 - DNA, 29 bp, Artificial Sequence
  Description of Artificial Sequence: Synthetic oligonucleotide
ccccgaactgtttctggagcactgtgttc

SEQ ID NO: 240187 - DNA, 30 bp, Artificial Sequence
  Description of Artificial Sequence: Synthetic oligonucleotide
cccgaactgtttctggagcactgtgttctc

SEQ ID NO: 240188 - DNA, 31 bp, Artificial Sequence
  Description of Artificial Sequence: Synthetic oligonucleotide
ccgaactgtttctggagcactgtgttctcag

SEQ ID NO: 240189 - DNA, 33 bp, Artificial Sequence
  Description of Artificial Sequence: Synthetic oligonucleotide
cgaactgtttctggagcactgtgttctcagatc

SEQ ID NO: 240190 - DNA, 35 bp, Artificial Sequence
  Description of Artificial Sequence: Synthetic oligonucleotide
gaactgtttctggagcactgtgttctcagatcatg

SEQ ID NO: 240191 - DNA, 35 bp, Artificial Sequence
  Description of Artificial Sequence: Synthetic oligonucleotide
aactgtttctggagcactgtgttctcagatcatgc

SEQ ID NO: 240192 - DNA, 34 bp, Artificial Sequence
  Description of Artificial Sequence: Synthetic oligonucleotide
actgtttctggagcactgtgttctcagatcatgc

SEQ ID NO: 240193 - DNA, 33 bp, Artificial Sequence
  Description of Artificial Sequence: Synthetic oligonucleotide
ctgtttctggagcactgtgttctcagatcatgc

SEQ ID NO: 240194 - DNA, 35 bp, Artificial Sequence
  Description of Artificial Sequence: Synthetic oligonucleotide
tgtttctggagcactgtgttctcagatcatgcttc

SEQ ID NO: 240195 - DNA, 34 bp, Artificial Sequence
  Description of Artificial Sequence: Synthetic oligonucleotide
gtttctggagcactgtgttctcagatcatgcttc

SEQ ID NO: 240196 - DNA, 35 bp, Artificial Sequence
  Description of Artificial Sequence: Synthetic oligonucleotide
tttctggagcactgtgttctcagatcatgcttctc

SEQ ID NO: 240197 - DNA, 34 bp, Artificial Sequence
  Description of Artificial Sequence: Synthetic oligonucleotide
ttctggagcactgtgttctcagatcatgcttctc

SEQ ID NO: 240198 - DNA, 33 bp, Artificial Sequence
  Description of Artificial Sequence: Synthetic oligonucleotide
tctggagcactgtgttctcagatcatgcttctc

SEQ ID NO: 240199 - DNA, 32 bp, Artificial Sequence
  Description of Artificial Sequence: Synthetic oligonucleotide
ctggagcactgtgttctcagatcatgcttctc

SEQ ID NO: 240200 - DNA, 32 bp, Artificial Sequence
  Description of Artificial Sequence: Synthetic oligonucleotide
tggagcactgtgttctcagatcatgcttctcc

SEQ ID NO: 240201 - DNA, 31 bp, Artificial Sequence
  Description of Artificial Sequence: Synthetic oligonucleotide
ggagcactgtgttctcagatcatgcttctcc

SEQ ID NO: 240202 - DNA, 31 bp, Artificial Sequence
  Description of Artificial Sequence: Synthetic oligonucleotide
gagcactgtgttctcagatcatgcttctccc

SEQ ID NO: 240203 - DNA, 32 bp, Artificial Sequence
  Description of Artificial Sequence: Synthetic oligonucleotide
agcactgtgttctcagatcatgcttctcccac

SEQ ID NO: 240204 - DNA, 31 bp, Artificial Sequence
  Description of Artificial Sequence: Synthetic oligonucleotide
gcactgtgttctcagatcatgcttctcccac

SEQ ID NO: 240205 - DNA, 31 bp, Artificial Sequence
  Description of Artificial Sequence: Synthetic oligonucleotide
cactgtgttctcagatcatgcttctcccacc

SEQ ID NO: 240206 - DNA, 31 bp, Artificial Sequence
  Description of Artificial Sequence: Synthetic oligonucleotide
actgtgttctcagatcatgcttctcccaccg

SEQ ID NO: 240207 - DNA, 30 bp, Artificial Sequence
  Description of Artificial Sequence: Synthetic oligonucleotide
ctgtgttctcagatcatgcttctcccaccg

SEQ ID NO: 240208 - DNA, 32 bp, Artificial Sequence
  Description of Artificial Sequence: Synthetic oligonucleotide
tgtgttctcagatcatgcttctcccaccgatc

SEQ ID NO: 240209 - DNA, 31 bp, Artificial Sequence
  Description of Artificial Sequence: Synthetic oligonucleotide
gtgttctcagatcatgcttctcccaccgatc

SEQ ID NO: 240210 - DNA, 32 bp, Artificial Sequence
  Description of Artificial Sequence: Synthetic oligonucleotide
tgttctcagatcatgcttctcccaccgatctg

SEQ ID NO: 240211 - DNA, 31 bp, Artificial Sequence
  Description of Artificial Sequence: Synthetic oligonucleotide
gttctcagatcatgcttctcccaccgatctg

SEQ ID NO: 240212 - DNA, 31 bp, Artificial Sequence
  Description of Artificial Sequence: Synthetic oligonucleotide
ttctcagatcatgcttctcccaccgatctgc

SEQ ID NO: 240213 - DNA, 30 bp, Artificial Sequence
  Description of Artificial Sequence: Synthetic oligonucleotide
tctcagatcatgcttctcccaccgatctgc

SEQ ID NO: 240214 - DNA, 29 bp, Artificial Sequence
  Description of Artificial Sequence: Synthetic oligonucleotide
ctcagatcatgcttctcccaccgatctgc

SEQ ID NO: 240215 - DNA, 29 bp, Artificial Sequence
  Description of Artificial Sequence: Synthetic oligonucleotide
tcagatcatgcttctcccaccgatctgcc

SEQ ID NO: 240216 - DNA, 28 bp, Artificial Sequence
  Description of Artificial Sequence: Synthetic oligonucleotide
cagatcatgcttctcccaccgatctgcc

SEQ ID NO: 240217 - DNA, 28 bp, Artificial Sequence
  Description of Artificial Sequence: Synthetic oligonucleotide
agatcatgcttctcccaccgatctgccc

SEQ ID NO: 240218 - DNA, 27 bp, Artificial Sequence
  Description of Artificial Sequence: Synthetic oligonucleotide
gatcatgcttctcccaccgatctgccc

SEQ ID NO: 240219 - DNA, 29 bp, Artificial Sequence
  Description of Artificial Sequence: Synthetic oligonucleotide
atcatgcttctcccaccgatctgccctac

SEQ ID NO: 240220 - DNA, 28 bp, Artificial Sequence
  Description of Artificial Sequence: Synthetic oligonucleotide
tcatgcttctcccaccgatctgccctac

SEQ ID NO: 240221 - DNA, 27 bp, Artificial Sequence
  Description of Artificial Sequence: Synthetic oligonucleotide
catgcttctcccaccgatctgccctac

SEQ ID NO: 240222 - DNA, 28 bp, Artificial Sequence
  Description of Artificial Sequence: Synthetic oligonucleotide
atgcttctcccaccgatctgccctactc

SEQ ID NO: 240223 - DNA, 27 bp, Artificial Sequence
  Description of Artificial Sequence: Synthetic oligonucleotide
tgcttctcccaccgatctgccctactc

SEQ ID NO: 240224 - DNA, 26 bp, Artificial Sequence
  Description of Artificial Sequence: Synthetic oligonucleotide
gcttctcccaccgatctgccctactc

SEQ ID NO: 240225 - DNA, 26 bp, Artificial Sequence
  Description of Artificial Sequence: Synthetic oligonucleotide
cttctcccaccgatctgccctactcc

SEQ ID NO: 240226 - DNA, 27 bp, Artificial Sequence
  Description of Artificial Sequence: Synthetic oligonucleotide
ttctcccaccgatctgccctactccct

SEQ ID NO: 240227 - DNA, 27 bp, Artificial Sequence
  Description of Artificial Sequence: Synthetic oligonucleotide
tctcccaccgatctgccctactccctt

SEQ ID NO: 240228 - DNA, 26 bp, Artificial Sequence
  Description of Artificial Sequence: Synthetic oligonucleotide
ctcccaccgatctgccctactccctt

SEQ ID NO: 240229 - DNA, 27 bp, Artificial Sequence
  Description of Artificial Sequence: Synthetic oligonucleotide
tcccaccgatctgccctactcccttct

SEQ ID NO: 240230 - DNA, 27 bp, Artificial Sequence
  Description of Artificial Sequence: Synthetic oligonucleotide
cccaccgatctgccctactcccttctt

SEQ ID NO: 240231 - DNA, 27 bp, Artificial Sequence
  Description of Artificial Sequence: Synthetic oligonucleotide
ccaccgatctgccctactcccttcttc

SEQ ID NO: 240232 - DNA, 27 bp, Artificial Sequence
  Description of Artificial Sequence: Synthetic oligonucleotide
caccgatctgccctactcccttcttcg

SEQ ID NO: 240233 - DNA, 28 bp, Artificial Sequence
  Description of Artificial Sequence: Synthetic oligonucleotide
accgatctgccctactcccttcttcgtg

SEQ ID NO: 240234 - DNA, 27 bp, Artificial Sequence
  Description of Artificial Sequence: Synthetic oligonucleotide
ccgatctgccctactcccttcttcgtg

SEQ ID NO: 240235 - DNA, 29 bp, Artificial Sequence
  Description of Artificial Sequence: Synthetic oligonucleotide
cgatctgccctactcccttcttcgtgtac

SEQ ID NO: 240236 - DNA, 31 bp, Artificial Sequence
  Description of Artificial Sequence: Synthetic oligonucleotide
gatctgccctactcccttcttcgtgtacatg

SEQ ID NO: 240237 - DNA, 37 bp, Artificial Sequence
  Description of Artificial Sequence: Synthetic oligonucleotide
atctgccctactcccttcttcgtgtacatgattaatc

SEQ ID NO: 240238 - DNA, 36 bp, Artificial Sequence
  Description of Artificial Sequence: Synthetic oligonucleotide
tctgccctactcccttcttcgtgtacatgattaatc

SEQ ID NO: 240239 - DNA, 35 bp, Artificial Sequence
  Description of Artificial Sequence: Synthetic oligonucleotide
ctgccctactcccttcttcgtgtacatgattaatc

SEQ ID NO: 240240 - DNA, 35 bp, Artificial Sequence
  Description of Artificial Sequence: Synthetic oligonucleotide
tgccctactcccttcttcgtgtacatgattaatcc

SEQ ID NO: 240241 - DNA, 34 bp, Artificial Sequence
  Description of Artificial Sequence: Synthetic oligonucleotide
gccctactcccttcttcgtgtacatgattaatcc

SEQ ID NO: 240242 - DNA, 34 bp, Artificial Sequence
  Description of Artificial Sequence: Synthetic oligonucleotide
ccctactcccttcttcgtgtacatgattaatccc

SEQ ID NO: 240243 - DNA, 34 bp, Artificial Sequence
  Description of Artificial Sequence: Synthetic oligonucleotide
cctactcccttcttcgtgtacatgattaatcccg

SEQ ID NO: 240244 - DNA, 37 bp, Artificial Sequence
  Description of Artificial Sequence: Synthetic oligonucleotide
ctactcccttcttcgtgtacatgattaatcccgattg

SEQ ID NO: 240245 - DNA, 37 bp, Artificial Sequence
  Description of Artificial Sequence: Synthetic oligonucleotide
tactcccttcttcgtgtacatgattaatcccgattgc

SEQ ID NO: 240246 - DNA, 36 bp, Artificial Sequence
  Description of Artificial Sequence: Synthetic oligonucleotide
actcccttcttcgtgtacatgattaatcccgattgc

SEQ ID NO: 240247 - DNA, 35 bp, Artificial Sequence
  Description of Artificial Sequence: Synthetic oligonucleotide
ctcccttcttcgtgtacatgattaatcccgattgc

SEQ ID NO: 240248 - DNA, 35 bp, Artificial Sequence
  Description of Artificial Sequence: Synthetic oligonucleotide
tcccttcttcgtgtacatgattaatcccgattgcc

SEQ ID NO: 240249 - DNA, 34 bp, Artificial Sequence
  Description of Artificial Sequence: Synthetic oligonucleotide
cccttcttcgtgtacatgattaatcccgattgcc

SEQ ID NO: 240250 - DNA, 36 bp, Artificial Sequence
  Description of Artificial Sequence: Synthetic oligonucleotide
ccttcttcgtgtacatgattaatcccgattgccaag

SEQ ID NO: 240251 - DNA, 36 bp, Artificial Sequence
  Description of Artificial Sequence: Synthetic oligonucleotide
cttcttcgtgtacatgattaatcccgattgccaagc

SEQ ID NO: 240252 - DNA, 36 bp, Artificial Sequence
  Description of Artificial Sequence: Synthetic oligonucleotide
ttcttcgtgtacatgattaatcccgattgccaagcg

SEQ ID NO: 240253 - DNA, 35 bp, Artificial Sequence
  Description of Artificial Sequence: Synthetic oligonucleotide
tcttcgtgtacatgattaatcccgattgccaagcg

SEQ ID NO: 240254 - DNA, 34 bp, Artificial Sequence
  Description of Artificial Sequence: Synthetic oligonucleotide
cttcgtgtacatgattaatcccgattgccaagcg

SEQ ID NO: 240255 - DNA, 34 bp, Artificial Sequence
  Description of Artificial Sequence: Synthetic oligonucleotide
ttcgtgtacatgattaatcccgattgccaagcgc

SEQ ID NO: 240256 - DNA, 33 bp, Artificial Sequence
  Description of Artificial Sequence: Synthetic oligonucleotide
tcgtgtacatgattaatcccgattgccaagcgc

SEQ ID NO: 240257 - DNA, 32 bp, Artificial Sequence
  Description of Artificial Sequence: Synthetic oligonucleotide
cgtgtacatgattaatcccgattgccaagcgc

SEQ ID NO: 240258 - DNA, 35 bp, Artificial Sequence
  Description of Artificial Sequence: Synthetic oligonucleotide
gtgtacatgattaatcccgattgccaagcgcattg

SEQ ID NO: 240259 - DNA, 36 bp, Artificial Sequence
  Description of Artificial Sequence: Synthetic oligonucleotide
tgtacatgattaatcccgattgccaagcgcattgtc

SEQ ID NO: 240260 - DNA, 35 bp, Artificial Sequence
  Description of Artificial Sequence: Synthetic oligonucleotide
gtacatgattaatcccgattgccaagcgcattgtc

SEQ ID NO: 240261 - DNA, 35 bp, Artificial Sequence
  Description of Artificial Sequence: Synthetic oligonucleotide
tacatgattaatcccgattgccaagcgcattgtcc

SEQ ID NO: 240262 - DNA, 34 bp, Artificial Sequence
  Description of Artificial Sequence: Synthetic oligonucleotide
acatgattaatcccgattgccaagcgcattgtcc

SEQ ID NO: 240263 - DNA, 33 bp, Artificial Sequence
  Description of Artificial Sequence: Synthetic oligonucleotide
catgattaatcccgattgccaagcgcattgtcc

SEQ ID NO: 240264 - DNA, 34 bp, Artificial Sequence
  Description of Artificial Sequence: Synthetic oligonucleotide
atgattaatcccgattgccaagcgcattgtcctg

SEQ ID NO: 240265 - DNA, 33 bp, Artificial Sequence
  Description of Artificial Sequence: Synthetic oligonucleotide
tgattaatcccgattgccaagcgcattgtcctg

SEQ ID NO: 240266 - DNA, 32 bp, Artificial Sequence
  Description of Artificial Sequence: Synthetic oligonucleotide
gattaatcccgattgccaagcgcattgtcctg

SEQ ID NO: 240267 - DNA, 35 bp, Artificial Sequence
  Description of Artificial Sequence: Synthetic oligonucleotide
attaatcccgattgccaagcgcattgtcctgaaac

SEQ ID NO: 240268 - DNA, 34 bp, Artificial Sequence
  Description of Artificial Sequence: Synthetic oligonucleotide
ttaatcccgattgccaagcgcattgtcctgaaac

SEQ ID NO: 240269 - DNA, 33 bp, Artificial Sequence
  Description of Artificial Sequence: Synthetic oligonucleotide
taatcccgattgccaagcgcattgtcctgaaac

SEQ ID NO: 240270 - DNA, 32 bp, Artificial Sequence
  Description of Artificial Sequence: Synthetic oligonucleotide
aatcccgattgccaagcgcattgtcctgaaac

SEQ ID NO: 240271 - DNA, 31 bp, Artificial Sequence
  Description of Artificial Sequence: Synthetic oligonucleotide
atcccgattgccaagcgcattgtcctgaaac

SEQ ID NO: 240272 - DNA, 30 bp, Artificial Sequence
  Description of Artificial Sequence: Synthetic oligonucleotide
tcccgattgccaagcgcattgtcctgaaac

SEQ ID NO: 240273 - DNA, 29 bp, Artificial Sequence
  Description of Artificial Sequence: Synthetic oligonucleotide
cccgattgccaagcgcattgtcctgaaac

SEQ ID NO: 240274 - DNA, 30 bp, Artificial Sequence
  Description of Artificial Sequence: Synthetic oligonucleotide
ccgattgccaagcgcattgtcctgaaactc

SEQ ID NO: 240275 - DNA, 30 bp, Artificial Sequence
  Description of Artificial Sequence: Synthetic oligonucleotide
cgattgccaagcgcattgtcctgaaactcc

SEQ ID NO: 240276 - DNA, 30 bp, Artificial Sequence
  Description of Artificial Sequence: Synthetic oligonucleotide
gattgccaagcgcattgtcctgaaactccc

SEQ ID NO: 240277 - DNA, 30 bp, Artificial Sequence
  Description of Artificial Sequence: Synthetic oligonucleotide
attgccaagcgcattgtcctgaaactcccg

SEQ ID NO: 240278 - DNA, 29 bp, Artificial Sequence
  Description of Artificial Sequence: Synthetic oligonucleotide
ttgccaagcgcattgtcctgaaactcccg

SEQ ID NO: 240279 - DNA, 28 bp, Artificial Sequence
  Description of Artificial Sequence: Synthetic oligonucleotide
tgccaagcgcattgtcctgaaactcccg

SEQ ID NO: 240280 - DNA, 27 bp, Artificial Sequence
  Description of Artificial Sequence: Synthetic oligonucleotide
gccaagcgcattgtcctgaaactcccg

SEQ ID NO: 240281 - DNA, 28 bp, Artificial Sequence
  Description of Artificial Sequence: Synthetic oligonucleotide
ccaagcgcattgtcctgaaactcccgtg

SEQ ID NO: 240282 - DNA, 29 bp, Artificial Sequence
  Description of Artificial Sequence: Synthetic oligonucleotide
caagcgcattgtcctgaaactcccgtgag

SEQ ID NO: 240283 - DNA, 30 bp, Artificial Sequence
  Description of Artificial Sequence: Synthetic oligonucleotide
aagcgcattgtcctgaaactcccgtgagac

SEQ ID NO: 240284 - DNA, 29 bp, Artificial Sequence
  Description of Artificial Sequence: Synthetic oligonucleotide
agcgcattgtcctgaaactcccgtgagac

SEQ ID NO: 240285 - DNA, 28 bp, Artificial Sequence
  Description of Artificial Sequence: Synthetic oligonucleotide
gcgcattgtcctgaaactcccgtgagac

SEQ ID NO: 240286 - DNA, 28 bp, Artificial Sequence
  Description of Artificial Sequence: Synthetic oligonucleotide
cgcattgtcctgaaactcccgtgagacc

SEQ ID NO: 240287 - DNA, 31 bp, Artificial Sequence
  Description of Artificial Sequence: Synthetic oligonucleotide
gcattgtcctgaaactcccgtgagacctttc

SEQ ID NO: 240288 - DNA, 32 bp, Artificial Sequence
  Description of Artificial Sequence: Synthetic oligonucleotide
cattgtcctgaaactcccgtgagacctttctc

SEQ ID NO: 240289 - DNA, 32 bp, Artificial Sequence
  Description of Artificial Sequence: Synthetic oligonucleotide
attgtcctgaaactcccgtgagacctttctcc

SEQ ID NO: 240290 - DNA, 31 bp, Artificial Sequence
  Description of Artificial Sequence: Synthetic oligonucleotide
ttgtcctgaaactcccgtgagacctttctcc

SEQ ID NO: 240291 - DNA, 30 bp, Artificial Sequence
  Description of Artificial Sequence: Synthetic oligonucleotide
tgtcctgaaactcccgtgagacctttctcc

SEQ ID NO: 240292 - DNA, 29 bp, Artificial Sequence
  Description of Artificial Sequence: Synthetic oligonucleotide
gtcctgaaactcccgtgagacctttctcc

SEQ ID NO: 240293 - DNA, 31 bp, Artificial Sequence
  Description of Artificial Sequence: Synthetic oligonucleotide
tcctgaaactcccgtgagacctttctccttc

SEQ ID NO: 240294 - DNA, 30 bp, Artificial Sequence
  Description of Artificial Sequence: Synthetic oligonucleotide
cctgaaactcccgtgagacctttctccttc

SEQ ID NO: 240295 - DNA, 30 bp, Artificial Sequence
  Description of Artificial Sequence: Synthetic oligonucleotide
ctgaaactcccgtgagacctttctccttcc

SEQ ID NO: 240296 - DNA, 31 bp, Artificial Sequence
  Description of Artificial Sequence: Synthetic oligonucleotide
tgaaactcccgtgagacctttctccttccac

SEQ ID NO: 240297 - DNA, 30 bp, Artificial Sequence
  Description of Artificial Sequence: Synthetic oligonucleotide
gaaactcccgtgagacctttctccttccac

SEQ ID NO: 240298 - DNA, 30 bp, Artificial Sequence
  Description of Artificial Sequence: Synthetic oligonucleotide
aaactcccgtgagacctttctccttccacc

SEQ ID NO: 240299 - DNA, 29 bp, Artificial Sequence
  Description of Artificial Sequence: Synthetic oligonucleotide
aactcccgtgagacctttctccttccacc

SEQ ID NO: 240300 - DNA, 28 bp, Artificial Sequence
  Description of Artificial Sequence: Synthetic oligonucleotide
actcccgtgagacctttctccttccacc

SEQ ID NO: 240301 - DNA, 27 bp, Artificial Sequence
  Description of Artificial Sequence: Synthetic oligonucleotide
ctcccgtgagacctttctccttccacc

SEQ ID NO: 240302 - DNA, 27 bp, Artificial Sequence
  Description of Artificial Sequence: Synthetic oligonucleotide
tcccgtgagacctttctccttccaccc

SEQ ID NO: 240303 - DNA, 26 bp, Artificial Sequence
  Description of Artificial Sequence: Synthetic oligonucleotide
cccgtgagacctttctccttccaccc

SEQ ID NO: 240304 - DNA, 26 bp, Artificial Sequence
  Description of Artificial Sequence: Synthetic oligonucleotide
ccgtgagacctttctccttccacccc

SEQ ID NO: 240305 - DNA, 27 bp, Artificial Sequence
  Description of Artificial Sequence: Synthetic oligonucleotide
cgtgagacctttctccttccaccccca

SEQ ID NO: 240306 - DNA, 30 bp, Artificial Sequence
  Description of Artificial Sequence: Synthetic oligonucleotide
gtgagacctttctccttccacccccaaatc

SEQ ID NO: 240307 - DNA, 35 bp, Artificial Sequence
  Description of Artificial Sequence: Synthetic oligonucleotide
tgagacctttctccttccacccccaaatcttttac

SEQ ID NO: 240308 - DNA, 34 bp, Artificial Sequence
  Description of Artificial Sequence: Synthetic oligonucleotide
gagacctttctccttccacccccaaatcttttac

SEQ ID NO: 240309 - DNA, 38 bp, Artificial Sequence
  Description of Artificial Sequence: Synthetic oligonucleotide
agacctttctccttccacccccaaatcttttacttttg

SEQ ID NO: 240310 - DNA, 37 bp, Artificial Sequence
  Description of Artificial Sequence: Synthetic oligonucleotide
gacctttctccttccacccccaaatcttttacttttg

SEQ ID NO: 240311 - DNA, 38 bp, Artificial Sequence
  Description of Artificial Sequence: Synthetic oligonucleotide
acctttctccttccacccccaaatcttttacttttgtg

SEQ ID NO: 240312 - DNA, 37 bp, Artificial Sequence
  Description of Artificial Sequence: Synthetic oligonucleotide
cctttctccttccacccccaaatcttttacttttgtg

SEQ ID NO: 240313 - DNA, 38 bp, Artificial Sequence
  Description of Artificial Sequence: Synthetic oligonucleotide
ctttctccttccacccccaaatcttttacttttgtgtg

SEQ ID NO: 240314 - DNA, 38 bp, Artificial Sequence
  Description of Artificial Sequence: Synthetic oligonucleotide
tttctccttccacccccaaatcttttacttttgtgtgg

SEQ ID NO: 240315 - DNA, 37 bp, Artificial Sequence
  Description of Artificial Sequence: Synthetic oligonucleotide
ttctccttccacccccaaatcttttacttttgtgtgg

SEQ ID NO: 240316 - DNA, 36 bp, Artificial Sequence
  Description of Artificial Sequence: Synthetic oligonucleotide
tctccttccacccccaaatcttttacttttgtgtgg

SEQ ID NO: 240317 - DNA, 35 bp, Artificial Sequence
  Description of Artificial Sequence: Synthetic oligonucleotide
ctccttccacccccaaatcttttacttttgtgtgg

SEQ ID NO: 240318 - DNA, 36 bp, Artificial Sequence
  Description of Artificial Sequence: Synthetic oligonucleotide
tccttccacccccaaatcttttacttttgtgtggtc

SEQ ID NO: 240319 - DNA, 35 bp, Artificial Sequence
  Description of Artificial Sequence: Synthetic oligonucleotide
ccttccacccccaaatcttttacttttgtgtggtc

SEQ ID NO: 240320 - DNA, 35 bp, Artificial Sequence
  Description of Artificial Sequence: Synthetic oligonucleotide
cttccacccccaaatcttttacttttgtgtggtcc

SEQ ID NO: 240321 - DNA, 36 bp, Artificial Sequence
  Description of Artificial Sequence: Synthetic oligonucleotide
ttccacccccaaatcttttacttttgtgtggtccac

SEQ ID NO: 240322 - DNA, 35 bp, Artificial Sequence
  Description of Artificial Sequence: Synthetic oligonucleotide
tccacccccaaatcttttacttttgtgtggtccac

SEQ ID NO: 240323 - DNA, 34 bp, Artificial Sequence
  Description of Artificial Sequence: Synthetic oligonucleotide
ccacccccaaatcttttacttttgtgtggtccac

SEQ ID NO: 240324 - DNA, 34 bp, Artificial Sequence
  Description of Artificial Sequence: Synthetic oligonucleotide
cacccccaaatcttttacttttgtgtggtccacc

SEQ ID NO: 240325 - DNA, 34 bp, Artificial Sequence
  Description of Artificial Sequence: Synthetic oligonucleotide
acccccaaatcttttacttttgtgtggtccaccc

SEQ ID NO: 240326 - DNA, 33 bp, Artificial Sequence
  Description of Artificial Sequence: Synthetic oligonucleotide
cccccaaatcttttacttttgtgtggtccaccc

SEQ ID NO: 240327 - DNA, 33 bp, Artificial Sequence
  Description of Artificial Sequence: Synthetic oligonucleotide
ccccaaatcttttacttttgtgtggtccacccc

SEQ ID NO: 240328 - DNA, 35 bp, Artificial Sequence
  Description of Artificial Sequence: Synthetic oligonucleotide
cccaaatcttttacttttgtgtggtccacccctac

SEQ ID NO: 240329 - DNA, 36 bp, Artificial Sequence
  Description of Artificial Sequence: Synthetic oligonucleotide
ccaaatcttttacttttgtgtggtccacccctactc

SEQ ID NO: 240330 - DNA, 36 bp, Artificial Sequence
  Description of Artificial Sequence: Synthetic oligonucleotide
caaatcttttacttttgtgtggtccacccctactcc

SEQ ID NO: 240331 - DNA, 41 bp, Artificial Sequence
  Description of Artificial Sequence: Synthetic oligonucleotide
aaatcttttacttttgtgtggtccacccctactccaataag

SEQ ID NO: 240332 - DNA, 40 bp, Artificial Sequence
  Description of Artificial Sequence: Synthetic oligonucleotide
aatcttttacttttgtgtggtccacccctactccaataag

SEQ ID NO: 240333 - DNA, 39 bp, Artificial Sequence
  Description of Artificial Sequence: Synthetic oligonucleotide
atcttttacttttgtgtggtccacccctactccaataag

SEQ ID NO: 240334 - DNA, 38 bp, Artificial Sequence
  Description of Artificial Sequence: Synthetic oligonucleotide
tcttttacttttgtgtggtccacccctactccaataag

SEQ ID NO: 240335 - DNA, 37 bp, Artificial Sequence
  Description of Artificial Sequence: Synthetic oligonucleotide
cttttacttttgtgtggtccacccctactccaataag

SEQ ID NO: 240336 - DNA, 38 bp, Artificial Sequence
  Description of Artificial Sequence: Synthetic oligonucleotide
ttttacttttgtgtggtccacccctactccaataagtc

SEQ ID NO: 240337 - DNA, 37 bp, Artificial Sequence
  Description of Artificial Sequence: Synthetic oligonucleotide
tttacttttgtgtggtccacccctactccaataagtc

SEQ ID NO: 240338 - DNA, 36 bp, Artificial Sequence
  Description of Artificial Sequence: Synthetic oligonucleotide
ttacttttgtgtggtccacccctactccaataagtc

SEQ ID NO: 240339 - DNA, 35 bp, Artificial Sequence
  Description of Artificial Sequence: Synthetic oligonucleotide
tacttttgtgtggtccacccctactccaataagtc

SEQ ID NO: 240340 - DNA, 34 bp, Artificial Sequence
  Description of Artificial Sequence: Synthetic oligonucleotide
acttttgtgtggtccacccctactccaataagtc

SEQ ID NO: 240341 - DNA, 33 bp, Artificial Sequence
  Description of Artificial Sequence: Synthetic oligonucleotide
cttttgtgtggtccacccctactccaataagtc

SEQ ID NO: 240342 - DNA, 35 bp, Artificial Sequence
  Description of Artificial Sequence: Synthetic oligonucleotide
ttttgtgtggtccacccctactccaataagtcatc

SEQ ID NO: 240343 - DNA, 34 bp, Artificial Sequence
  Description of Artificial Sequence: Synthetic oligonucleotide
tttgtgtggtccacccctactccaataagtcatc

SEQ ID NO: 240344 - DNA, 33 bp, Artificial Sequence
  Description of Artificial Sequence: Synthetic oligonucleotide
ttgtgtggtccacccctactccaataagtcatc

SEQ ID NO: 240345 - DNA, 32 bp, Artificial Sequence
  Description of Artificial Sequence: Synthetic oligonucleotide
tgtgtggtccacccctactccaataagtcatc

SEQ ID NO: 240346 - DNA, 31 bp, Artificial Sequence
  Description of Artificial Sequence: Synthetic oligonucleotide
gtgtggtccacccctactccaataagtcatc

SEQ ID NO: 240347 - DNA, 33 bp, Artificial Sequence
  Description of Artificial Sequence: Synthetic oligonucleotide
tgtggtccacccctactccaataagtcatcatc

SEQ ID NO: 240348 - DNA, 32 bp, Artificial Sequence
  Description of Artificial Sequence: Synthetic oligonucleotide
gtggtccacccctactccaataagtcatcatc

SEQ ID NO: 240349 - DNA, 33 bp, Artificial Sequence
  Description of Artificial Sequence: Synthetic oligonucleotide
tggtccacccctactccaataagtcatcatctc

SEQ ID NO: 240350 - DNA, 32 bp, Artificial Sequence
  Description of Artificial Sequence: Synthetic oligonucleotide
ggtccacccctactccaataagtcatcatctc

SEQ ID NO: 240351 - DNA, 32 bp, Artificial Sequence
  Description of Artificial Sequence: Synthetic oligonucleotide
gtccacccctactccaataagtcatcatctcc

SEQ ID NO: 240352 - DNA, 35 bp, Artificial Sequence
  Description of Artificial Sequence: Synthetic oligonucleotide
tccacccctactccaataagtcatcatctccaaac

SEQ ID NO: 240353 - DNA, 34 bp, Artificial Sequence
  Description of Artificial Sequence: Synthetic oligonucleotide
ccacccctactccaataagtcatcatctccaaac

SEQ ID NO: 240354 - DNA, 34 bp, Artificial Sequence
  Description of Artificial Sequence: Synthetic oligonucleotide
cacccctactccaataagtcatcatctccaaacc

SEQ ID NO: 240355 - DNA, 37 bp, Artificial Sequence
  Description of Artificial Sequence: Synthetic oligonucleotide
acccctactccaataagtcatcatctccaaacctttc

SEQ ID NO: 240356 - DNA, 36 bp, Artificial Sequence
  Description of Artificial Sequence: Synthetic oligonucleotide
cccctactccaataagtcatcatctccaaacctttc

SEQ ID NO: 240357 - DNA, 37 bp, Artificial Sequence
  Description of Artificial Sequence: Synthetic oligonucleotide
ccctactccaataagtcatcatctccaaacctttctg

SEQ ID NO: 240358 - DNA, 38 bp, Artificial Sequence
  Description of Artificial Sequence: Synthetic oligonucleotide
cctactccaataagtcatcatctccaaacctttctgtc

SEQ ID NO: 240359 - DNA, 40 bp, Artificial Sequence
  Description of Artificial Sequence: Synthetic oligonucleotide
ctactccaataagtcatcatctccaaacctttctgtcatc

SEQ ID NO: 240360 - DNA, 40 bp, Artificial Sequence
  Description of Artificial Sequence: Synthetic oligonucleotide
tactccaataagtcatcatctccaaacctttctgtcatcc

SEQ ID NO: 240361 - DNA, 39 bp, Artificial Sequence
  Description of Artificial Sequence: Synthetic oligonucleotide
actccaataagtcatcatctccaaacctttctgtcatcc

SEQ ID NO: 240362 - DNA, 38 bp, Artificial Sequence
  Description of Artificial Sequence: Synthetic oligonucleotide
ctccaataagtcatcatctccaaacctttctgtcatcc

SEQ ID NO: 240363 - DNA, 40 bp, Artificial Sequence
  Description of Artificial Sequence: Synthetic oligonucleotide
tccaataagtcatcatctccaaacctttctgtcatccaac

SEQ ID NO: 240364 - DNA, 39 bp, Artificial Sequence
  Description of Artificial Sequence: Synthetic oligonucleotide
ccaataagtcatcatctccaaacctttctgtcatccaac

SEQ ID NO: 240365 - DNA, 40 bp, Artificial Sequence
  Description of Artificial Sequence: Synthetic oligonucleotide
caataagtcatcatctccaaacctttctgtcatccaactg

SEQ ID NO: 240366 - DNA, 40 bp, Artificial Sequence
  Description of Artificial Sequence: Synthetic oligonucleotide
aataagtcatcatctccaaacctttctgtcatccaactgc

SEQ ID NO: 240367 - DNA, 39 bp, Artificial Sequence
  Description of Artificial Sequence: Synthetic oligonucleotide
ataagtcatcatctccaaacctttctgtcatccaactgc

SEQ ID NO: 240368 - DNA, 38 bp, Artificial Sequence
  Description of Artificial Sequence: Synthetic oligonucleotide
taagtcatcatctccaaacctttctgtcatccaactgc

SEQ ID NO: 240369 - DNA, 37 bp, Artificial Sequence
  Description of Artificial Sequence: Synthetic oligonucleotide
aagtcatcatctccaaacctttctgtcatccaactgc

SEQ ID NO: 240370 - DNA, 36 bp, Artificial Sequence
  Description of Artificial Sequence: Synthetic oligonucleotide
agtcatcatctccaaacctttctgtcatccaactgc

SEQ ID NO: 240371 - DNA, 35 bp, Artificial Sequence
  Description of Artificial Sequence: Synthetic oligonucleotide
gtcatcatctccaaacctttctgtcatccaactgc

SEQ ID NO: 240372 - DNA, 36 bp, Artificial Sequence
  Description of Artificial Sequence: Synthetic oligonucleotide
tcatcatctccaaacctttctgtcatccaactgctg

SEQ ID NO: 240373 - DNA, 35 bp, Artificial Sequence
  Description of Artificial Sequence: Synthetic oligonucleotide
catcatctccaaacctttctgtcatccaactgctg

SEQ ID NO: 240374 - DNA, 36 bp, Artificial Sequence
  Description of Artificial Sequence: Synthetic oligonucleotide
atcatctccaaacctttctgtcatccaactgctgtc

SEQ ID NO: 240375 - DNA, 35 bp, Artificial Sequence
  Description of Artificial Sequence: Synthetic oligonucleotide
tcatctccaaacctttctgtcatccaactgctgtc

SEQ ID NO: 240376 - DNA, 34 bp, Artificial Sequence
  Description of Artificial Sequence: Synthetic oligonucleotide
catctccaaacctttctgtcatccaactgctgtc

SEQ ID NO: 240377 - DNA, 35 bp, Artificial Sequence
  Description of Artificial Sequence: Synthetic oligonucleotide
atctccaaacctttctgtcatccaactgctgtctc

SEQ ID NO: 240378 - DNA, 34 bp, Artificial Sequence
  Description of Artificial Sequence: Synthetic oligonucleotide
tctccaaacctttctgtcatccaactgctgtctc

SEQ ID NO: 240379 - DNA, 33 bp, Artificial Sequence
  Description of Artificial Sequence: Synthetic oligonucleotide
ctccaaacctttctgtcatccaactgctgtctc

SEQ ID NO: 240380 - DNA, 33 bp, Artificial Sequence
  Description of Artificial Sequence: Synthetic oligonucleotide
tccaaacctttctgtcatccaactgctgtctcc

SEQ ID NO: 240381 - DNA, 32 bp, Artificial Sequence
  Description of Artificial Sequence: Synthetic oligonucleotide
ccaaacctttctgtcatccaactgctgtctcc

SEQ ID NO: 240382 - DNA, 33 bp, Artificial Sequence
  Description of Artificial Sequence: Synthetic oligonucleotide
caaacctttctgtcatccaactgctgtctccac

SEQ ID NO: 240383 - DNA, 34 bp, Artificial Sequence
  Description of Artificial Sequence: Synthetic oligonucleotide
aaacctttctgtcatccaactgctgtctccacac

SEQ ID NO: 240384 - DNA, 33 bp, Artificial Sequence
  Description of Artificial Sequence: Synthetic oligonucleotide
aacctttctgtcatccaactgctgtctccacac

SEQ ID NO: 240385 - DNA, 32 bp, Artificial Sequence
  Description of Artificial Sequence: Synthetic oligonucleotide
acctttctgtcatccaactgctgtctccacac

SEQ ID NO: 240386 - DNA, 31 bp, Artificial Sequence
  Description of Artificial Sequence: Synthetic oligonucleotide
cctttctgtcatccaactgctgtctccacac

SEQ ID NO: 240387 - DNA, 32 bp, Artificial Sequence
  Description of Artificial Sequence: Synthetic oligonucleotide
ctttctgtcatccaactgctgtctccacactc

SEQ ID NO: 240388 - DNA, 34 bp, Artificial Sequence
  Description of Artificial Sequence: Synthetic oligonucleotide
tttctgtcatccaactgctgtctccacactcttc

SEQ ID NO: 240389 - DNA, 33 bp, Artificial Sequence
  Description of Artificial Sequence: Synthetic oligonucleotide
ttctgtcatccaactgctgtctccacactcttc

SEQ ID NO: 240390 - DNA, 32 bp, Artificial Sequence
  Description of Artificial Sequence: Synthetic oligonucleotide
tctgtcatccaactgctgtctccacactcttc

SEQ ID NO: 240391 - DNA, 31 bp, Artificial Sequence
  Description of Artificial Sequence: Synthetic oligonucleotide
ctgtcatccaactgctgtctccacactcttc

SEQ ID NO: 240392 - DNA, 32 bp, Artificial Sequence
  Description of Artificial Sequence: Synthetic oligonucleotide
tgtcatccaactgctgtctccacactcttcag

SEQ ID NO: 240393 - DNA, 31 bp, Artificial Sequence
  Description of Artificial Sequence: Synthetic oligonucleotide
gtcatccaactgctgtctccacactcttcag

SEQ ID NO: 240394 - DNA, 33 bp, Artificial Sequence
  Description of Artificial Sequence: Synthetic oligonucleotide
tcatccaactgctgtctccacactcttcagaac

SEQ ID NO: 240395 - DNA, 32 bp, Artificial Sequence
  Description of Artificial Sequence: Synthetic oligonucleotide
catccaactgctgtctccacactcttcagaac

SEQ ID NO: 240396 - DNA, 33 bp, Artificial Sequence
  Description of Artificial Sequence: Synthetic oligonucleotide
atccaactgctgtctccacactcttcagaacac

SEQ ID NO: 240397 - DNA, 32 bp, Artificial Sequence
  Description of Artificial Sequence: Synthetic oligonucleotide
tccaactgctgtctccacactcttcagaacac

SEQ ID NO: 240398 - DNA, 31 bp, Artificial Sequence
  Description of Artificial Sequence: Synthetic oligonucleotide
ccaactgctgtctccacactcttcagaacac

SEQ ID NO: 240399 - DNA, 35 bp, Artificial Sequence
  Description of Artificial Sequence: Synthetic oligonucleotide
caactgctgtctccacactcttcagaacacaaatg

SEQ ID NO: 240400 - DNA, 35 bp, Artificial Sequence
  Description of Artificial Sequence: Synthetic oligonucleotide
aactgctgtctccacactcttcagaacacaaatgc

SEQ ID NO: 240401 - DNA, 34 bp, Artificial Sequence
  Description of Artificial Sequence: Synthetic oligonucleotide
actgctgtctccacactcttcagaacacaaatgc

SEQ ID NO: 240402 - DNA, 33 bp, Artificial Sequence
  Description of Artificial Sequence: Synthetic oligonucleotide
ctgctgtctccacactcttcagaacacaaatgc

SEQ ID NO: 240403 - DNA, 34 bp, Artificial Sequence
  Description of Artificial Sequence: Synthetic oligonucleotide
tgctgtctccacactcttcagaacacaaatgctg

SEQ ID NO: 240404 - DNA, 33 bp, Artificial Sequence
  Description of Artificial Sequence: Synthetic oligonucleotide
gctgtctccacactcttcagaacacaaatgctg

SEQ ID NO: 240405 - DNA, 34 bp, Artificial Sequence
  Description of Artificial Sequence: Synthetic oligonucleotide
ctgtctccacactcttcagaacacaaatgctgag

SEQ ID NO: 240406 - DNA, 34 bp, Artificial Sequence
  Description of Artificial Sequence: Synthetic oligonucleotide
tgtctccacactcttcagaacacaaatgctgagg

SEQ ID NO: 240407 - DNA, 33 bp, Artificial Sequence
  Description of Artificial Sequence: Synthetic oligonucleotide
gtctccacactcttcagaacacaaatgctgagg

SEQ ID NO: 240408 - DNA, 35 bp, Artificial Sequence
  Description of Artificial Sequence: Synthetic oligonucleotide
tctccacactcttcagaacacaaatgctgaggtag

SEQ ID NO: 240409 - DNA, 34 bp, Artificial Sequence
  Description of Artificial Sequence: Synthetic oligonucleotide
ctccacactcttcagaacacaaatgctgaggtag

SEQ ID NO: 240410 - DNA, 35 bp, Artificial Sequence
  Description of Artificial Sequence: Synthetic oligonucleotide
tccacactcttcagaacacaaatgctgaggtagtc

SEQ ID NO: 240411 - DNA, 34 bp, Artificial Sequence
  Description of Artificial Sequence: Synthetic oligonucleotide
ccacactcttcagaacacaaatgctgaggtagtc

SEQ ID NO: 240412 - DNA, 35 bp, Artificial Sequence
  Description of Artificial Sequence: Synthetic oligonucleotide
cacactcttcagaacacaaatgctgaggtagtcag

SEQ ID NO: 240413 - DNA, 36 bp, Artificial Sequence
  Description of Artificial Sequence: Synthetic oligonucleotide
acactcttcagaacacaaatgctgaggtagtcagtg

SEQ ID NO: 240414 - DNA, 35 bp, Artificial Sequence
  Description of Artificial Sequence: Synthetic oligonucleotide
cactcttcagaacacaaatgctgaggtagtcagtg

SEQ ID NO: 240415 - DNA, 38 bp, Artificial Sequence
  Description of Artificial Sequence: Synthetic oligonucleotide
actcttcagaacacaaatgctgaggtagtcagtgtttc

SEQ ID NO: 240416 - DNA, 37 bp, Artificial Sequence
  Description of Artificial Sequence: Synthetic oligonucleotide
ctcttcagaacacaaatgctgaggtagtcagtgtttc

SEQ ID NO: 240417 - DNA, 37 bp, Artificial Sequence
  Description of Artificial Sequence: Synthetic oligonucleotide
tcttcagaacacaaatgctgaggtagtcagtgtttcc

SEQ ID NO: 240418 - DNA, 36 bp, Artificial Sequence
  Description of Artificial Sequence: Synthetic oligonucleotide
cttcagaacacaaatgctgaggtagtcagtgtttcc

SEQ ID NO: 240419 - DNA, 40 bp, Artificial Sequence
  Description of Artificial Sequence: Synthetic oligonucleotide
ttcagaacacaaatgctgaggtagtcagtgtttccttatc

SEQ ID NO: 240420 - DNA, 39 bp, Artificial Sequence
  Description of Artificial Sequence: Synthetic oligonucleotide
tcagaacacaaatgctgaggtagtcagtgtttccttatc

SEQ ID NO: 240421 - DNA, 38 bp, Artificial Sequence
  Description of Artificial Sequence: Synthetic oligonucleotide
cagaacacaaatgctgaggtagtcagtgtttccttatc

SEQ ID NO: 240422 - DNA, 39 bp, Artificial Sequence
  Description of Artificial Sequence: Synthetic oligonucleotide
agaacacaaatgctgaggtagtcagtgtttccttatcac

SEQ ID NO: 240423 - DNA, 38 bp, Artificial Sequence
  Description of Artificial Sequence: Synthetic oligonucleotide
gaacacaaatgctgaggtagtcagtgtttccttatcac

SEQ ID NO: 240424 - DNA, 39 bp, Artificial Sequence
  Description of Artificial Sequence: Synthetic oligonucleotide
aacacaaatgctgaggtagtcagtgtttccttatcactg

SEQ ID NO: 240425 - DNA, 38 bp, Artificial Sequence
  Description of Artificial Sequence: Synthetic oligonucleotide
acacaaatgctgaggtagtcagtgtttccttatcactg

SEQ ID NO: 240426 - DNA, 37 bp, Artificial Sequence
  Description of Artificial Sequence: Synthetic oligonucleotide
cacaaatgctgaggtagtcagtgtttccttatcactg

SEQ ID NO: 240427 - DNA, 47 bp, Artificial Sequence
  Description of Artificial Sequence: Synthetic oligonucleotide
acaaatgctgaggtagtcagtgtttccttatcactgtttataaaaac

SEQ ID NO: 240428 - DNA, 46 bp, Artificial Sequence
  Description of Artificial Sequence: Synthetic oligonucleotide
caaatgctgaggtagtcagtgtttccttatcactgtttataaaaac

SEQ ID NO: 240429 - DNA, 46 bp, Artificial Sequence
  Description of Artificial Sequence: Synthetic oligonucleotide
aaatgctgaggtagtcagtgtttccttatcactgtttataaaaacc

SEQ ID NO: 240430 - DNA, 45 bp, Artificial Sequence
  Description of Artificial Sequence: Synthetic oligonucleotide
aatgctgaggtagtcagtgtttccttatcactgtttataaaaacc

SEQ ID NO: 240431 - DNA, 44 bp, Artificial Sequence
  Description of Artificial Sequence: Synthetic oligonucleotide
atgctgaggtagtcagtgtttccttatcactgtttataaaaacc

SEQ ID NO: 240432 - DNA, 43 bp, Artificial Sequence
  Description of Artificial Sequence: Synthetic oligonucleotide
tgctgaggtagtcagtgtttccttatcactgtttataaaaacc

SEQ ID NO: 240433 - DNA, 42 bp, Artificial Sequence
  Description of Artificial Sequence: Synthetic oligonucleotide
gctgaggtagtcagtgtttccttatcactgtttataaaaacc

SEQ ID NO: 240434 - DNA, 49 bp, Artificial Sequence
  Description of Artificial Sequence: Synthetic oligonucleotide
ctgaggtagtcagtgtttccttatcactgtttataaaaacctattattg

SEQ ID NO: 240435 - DNA, 50 bp, Artificial Sequence
  Description of Artificial Sequence: Synthetic oligonucleotide
tgaggtagtcagtgtttccttatcactgtttataaaaacctattattgtc

SEQ ID NO: 240436 - DNA, 49 bp, Artificial Sequence
  Description of Artificial Sequence: Synthetic oligonucleotide
gaggtagtcagtgtttccttatcactgtttataaaaacctattattgtc

SEQ ID NO: 240437 - DNA, 58 bp, Artificial Sequence
  Description of Artificial Sequence: Synthetic oligonucleotide
aggtagtcagtgtttccttatcactgtttataaaaacctattattgtcatataaaatg

SEQ ID NO: 240438 - DNA, 57 bp, Artificial Sequence
  Description of Artificial Sequence: Synthetic oligonucleotide
ggtagtcagtgtttccttatcactgtttataaaaacctattattgtcatataaaatg

SEQ ID NO: 240439 - DNA, 57 bp, Artificial Sequence
  Description of Artificial Sequence: Synthetic oligonucleotide
gtagtcagtgtttccttatcactgtttataaaaacctattattgtcatataaaatgg

SEQ ID NO: 240440 - DNA, 58 bp, Artificial Sequence
  Description of Artificial Sequence: Synthetic oligonucleotide
tagtcagtgtttccttatcactgtttataaaaacctattattgtcatataaaatggtg

SEQ ID NO: 240441 - DNA, 57 bp, Artificial Sequence
  Description of Artificial Sequence: Synthetic oligonucleotide
agtcagtgtttccttatcactgtttataaaaacctattattgtcatataaaatggtg

SEQ ID NO: 240442 - DNA, 56 bp, Artificial Sequence
  Description of Artificial Sequence: Synthetic oligonucleotide
gtcagtgtttccttatcactgtttataaaaacctattattgtcatataaaatggtg

SEQ ID NO: 240443 - DNA, 59 bp, Artificial Sequence
  Description of Artificial Sequence: Synthetic oligonucleotide
tcagtgtttccttatcactgtttataaaaacctattattgtcatataaaatggtgatac

SEQ ID NO: 240444 - DNA, 26 bp, Artificial Sequence
  Description of Artificial Sequence: Synthetic oligonucleotide
atggctagcactaggtgtcgcgctcc

SEQ ID NO: 240445 - DNA, 25 bp, Artificial Sequence
  Description of Artificial Sequence: Synthetic oligonucleotide
tggctagcactaggtgtcgcgctcc

SEQ ID NO: 240446 - DNA, 24 bp, Artificial Sequence
  Description of Artificial Sequence: Synthetic oligonucleotide
ggctagcactaggtgtcgcgctcc

SEQ ID NO: 240447 - DNA, 24 bp, Artificial Sequence
  Description of Artificial Sequence: Synthetic oligonucleotide
gctagcactaggtgtcgcgctccc

SEQ ID NO: 240448 - DNA, 24 bp, Artificial Sequence
  Description of Artificial Sequence: Synthetic oligonucleotide
ctagcactaggtgtcgcgctcccc

SEQ ID NO: 240449 - DNA, 24 bp, Artificial Sequence
  Description of Artificial Sequence: Synthetic oligonucleotide
tagcactaggtgtcgcgctccccg

SEQ ID NO: 240450 - DNA, 23 bp, Artificial Sequence
  Description of Artificial Sequence: Synthetic oligonucleotide
agcactaggtgtcgcgctccccg

SEQ ID NO: 240451 - DNA, 22 bp, Artificial Sequence
  Description of Artificial Sequence: Synthetic oligonucleotide
gcactaggtgtcgcgctccccg

SEQ ID NO: 240452 - DNA, 22 bp, Artificial Sequence
  Description of Artificial Sequence: Synthetic oligonucleotide
cactaggtgtcgcgctccccgg

SEQ ID NO: 240453 - DNA, 22 bp, Artificial Sequence
  Description of Artificial Sequence: Synthetic oligonucleotide
actaggtgtcgcgctccccggg

SEQ ID NO: 240454 - DNA, 21 bp, Artificial Sequence
  Description of Artificial Sequence: Synthetic oligonucleotide
ctaggtgtcgcgctccccggg

SEQ ID NO: 240455 - DNA, 21 bp, Artificial Sequence
  Description of Artificial Sequence: Synthetic oligonucleotide
taggtgtcgcgctccccgggg

SEQ ID NO: 240456 - DNA, 20 bp, Artificial Sequence
  Description of Artificial Sequence: Synthetic oligonucleotide
aggtgtcgcgctccccgggg

SEQ ID NO: 240457 - DNA, 20 bp, Artificial Sequence
  Description of Artificial Sequence: Synthetic oligonucleotide
ggtgtcgcgctccccggggt

SEQ ID NO: 240458 - DNA, 20 bp, Artificial Sequence
  Description of Artificial Sequence: Synthetic oligonucleotide
gtgtcgcgctccccgggggt

SEQ ID NO: 240459 - DNA, 20 bp, Artificial Sequence
  Description of Artificial Sequence: Synthetic oligonucleotide
tgtcgcgctccccgggggtg

SEQ ID NO: 240460 - DNA, 20 bp, Artificial Sequence
  Description of Artificial Sequence: Synthetic oligonucleotide
gtcgcgctccccgggggtgt

SEQ ID NO: 240461 - DNA, 20 bp, Artificial Sequence
  Description of Artificial Sequence: Synthetic oligonucleotide
tcgcgctccccgggggtgct

SEQ ID NO: 240462 - DNA, 20 bp, Artificial Sequence
  Description of Artificial Sequence: Synthetic oligonucleotide
cgcgctccccgggggtgctt

SEQ ID NO: 240463 - DNA, 20 bp, Artificial Sequence
  Description of Artificial Sequence: Synthetic oligonucleotide
gcgctccccgggggtgcctt

SEQ ID NO: 240464 - DNA, 20 bp, Artificial Sequence
  Description of Artificial Sequence: Synthetic oligonucleotide
cgctccccgggggtgccgtt

SEQ ID NO: 240465 - DNA, 20 bp, Artificial Sequence
  Description of Artificial Sequence: Synthetic oligonucleotide
gctccccgggggtgccgcat

SEQ ID NO: 240466 - DNA, 20 bp, Artificial Sequence
  Description of Artificial Sequence: Synthetic oligonucleotide
ctccccgggggtgccgcagt

SEQ ID NO: 240467 - DNA, 20 bp, Artificial Sequence
  Description of Artificial Sequence: Synthetic oligonucleotide
tccccgggggtgccgcagct

SEQ ID NO: 240468 - DNA, 20 bp, Artificial Sequence
  Description of Artificial Sequence: Synthetic oligonucleotide
ccccgggggtgccgcagctt

SEQ ID NO: 240469 - DNA, 20 bp, Artificial Sequence
  Description of Artificial Sequence: Synthetic oligonucleotide
cccgggggtgccgcagcctt

SEQ ID NO: 240470 - DNA, 20 bp, Artificial Sequence
  Description of Artificial Sequence: Synthetic oligonucleotide
ccgggggtgccgcagcctct

SEQ ID NO: 240471 - DNA, 20 bp, Artificial Sequence
  Description of Artificial Sequence: Synthetic oligonucleotide
cgggggtgccgcagcctcct

SEQ ID NO: 240472 - DNA, 20 bp, Artificial Sequence
  Description of Artificial Sequence: Synthetic oligonucleotide
gggggtgccgcagcctccct

SEQ ID NO: 240473 - DNA, 20 bp, Artificial Sequence
  Description of Artificial Sequence: Synthetic oligonucleotide
ggggtgccgcagcctcccct

SEQ ID NO: 240474 - DNA, 20 bp, Artificial Sequence
  Description of Artificial Sequence: Synthetic oligonucleotide
gggtgccgcagcctccccgt

SEQ ID NO: 240475 - DNA, 20 bp, Artificial Sequence
  Description of Artificial Sequence: Synthetic oligonucleotide
ggtgccgcagcctccccgca

SEQ ID NO: 240476 - DNA, 20 bp, Artificial Sequence
  Description of Artificial Sequence: Synthetic oligonucleotide
gtgccgcagcctccccgcag

SEQ ID NO: 240477 - DNA, 22 bp, Artificial Sequence
  Description of Artificial Sequence: Synthetic oligonucleotide
tgccgcagcctccccgcagctt

SEQ ID NO: 240478 - DNA, 21 bp, Artificial Sequence
  Description of Artificial Sequence: Synthetic oligonucleotide
gccgcagcctccccgcagctt

SEQ ID NO: 240479 - DNA, 22 bp, Artificial Sequence
  Description of Artificial Sequence: Synthetic oligonucleotide
ccgcagcctccccgcagcttct

SEQ ID NO: 240480 - DNA, 23 bp, Artificial Sequence
  Description of Artificial Sequence: Synthetic oligonucleotide
cgcagcctccccgcagcttctct

SEQ ID NO: 240481 - DNA, 23 bp, Artificial Sequence
  Description of Artificial Sequence: Synthetic oligonucleotide
gcagcctccccgcagcttctctg

SEQ ID NO: 240482 - DNA, 23 bp, Artificial Sequence
  Description of Artificial Sequence: Synthetic oligonucleotide
cagcctccccgcagcttctctgg

SEQ ID NO: 240483 - DNA, 25 bp, Artificial Sequence
  Description of Artificial Sequence: Synthetic oligonucleotide
agcctccccgcagcttctctggcat

SEQ ID NO: 240484 - DNA, 24 bp, Artificial Sequence
  Description of Artificial Sequence: Synthetic oligonucleotide
gcctccccgcagcttctctggcat

SEQ ID NO: 240485 - DNA, 24 bp, Artificial Sequence
  Description of Artificial Sequence: Synthetic oligonucleotide
cctccccgcagcttctctggcatg

SEQ ID NO: 240486 - DNA, 24 bp, Artificial Sequence
  Description of Artificial Sequence: Synthetic oligonucleotide
ctccccgcagcttctctggcatgg

SEQ ID NO: 240487 - DNA, 25 bp, Artificial Sequence
  Description of Artificial Sequence: Synthetic oligonucleotide
tccccgcagcttctctggcatggct

SEQ ID NO: 240488 - DNA, 24 bp, Artificial Sequence
  Description of Artificial Sequence: Synthetic oligonucleotide
ccccgcagcttctctggcatggct

SEQ ID NO: 240489 - DNA, 24 bp, Artificial Sequence
  Description of Artificial Sequence: Synthetic oligonucleotide
cccgcagcttctctggcatggctg

SEQ ID NO: 240490 - DNA, 24 bp, Artificial Sequence
  Description of Artificial Sequence: Synthetic oligonucleotide
ccgcagcttctctggcatggctgc

SEQ ID NO: 240491 - DNA, 24 bp, Artificial Sequence
  Description of Artificial Sequence: Synthetic oligonucleotide
cgcagcttctctggcatggctgcg

SEQ ID NO: 240492 - DNA, 25 bp, Artificial Sequence
  Description of Artificial Sequence: Synthetic oligonucleotide
gcagcttctctggcatggctgcgga

SEQ ID NO: 240493 - DNA, 26 bp, Artificial Sequence
  Description of Artificial Sequence: Synthetic oligonucleotide
cagcttctctggcatggctgcggaca

SEQ ID NO: 240494 - DNA, 27 bp, Artificial Sequence
  Description of Artificial Sequence: Synthetic oligonucleotide
agcttctctggcatggctgcggacagt

SEQ ID NO: 240495 - DNA, 27 bp, Artificial Sequence
  Description of Artificial Sequence: Synthetic oligonucleotide
gcttctctggcatggctgcggacagta

SEQ ID NO: 240496 - DNA, 27 bp, Artificial Sequence
  Description of Artificial Sequence: Synthetic oligonucleotide
cttctctggcatggctgcggacagtac

SEQ ID NO: 240497 - DNA, 28 bp, Artificial Sequence
  Description of Artificial Sequence: Synthetic oligonucleotide
ttctctggcatggctgcggacagtacag

SEQ ID NO: 240498 - DNA, 27 bp, Artificial Sequence
  Description of Artificial Sequence: Synthetic oligonucleotide
tctctggcatggctgcggacagtacag

SEQ ID NO: 240499 - DNA, 26 bp, Artificial Sequence
  Description of Artificial Sequence: Synthetic oligonucleotide
ctctggcatggctgcggacagtacag

SEQ ID NO: 240500 - DNA, 27 bp, Artificial Sequence
  Description of Artificial Sequence: Synthetic oligonucleotide
tctggcatggctgcggacagtacagct

SEQ ID NO: 240501 - DNA, 27 bp, Artificial Sequence
  Description of Artificial Sequence: Synthetic oligonucleotide
ctggcatggctgcggacagtacagcta

SEQ ID NO: 240502 - DNA, 27 bp, Artificial Sequence
  Description of Artificial Sequence: Synthetic oligonucleotide
tggcatggctgcggacagtacagctac

SEQ ID NO: 240503 - DNA, 27 bp, Artificial Sequence
  Description of Artificial Sequence: Synthetic oligonucleotide
ggcatggctgcggacagtacagctact

SEQ ID NO: 240504 - DNA, 28 bp, Artificial Sequence
  Description of Artificial Sequence: Synthetic oligonucleotide
gcatggctgcggacagtacagctacttc

SEQ ID NO: 240505 - DNA, 29 bp, Artificial Sequence
  Description of Artificial Sequence: Synthetic oligonucleotide
catggctgcggacagtacagctacttctg

SEQ ID NO: 240506 - DNA, 29 bp, Artificial Sequence
  Description of Artificial Sequence: Synthetic oligonucleotide
atggctgcggacagtacagctacttctgg

SEQ ID NO: 240507 - DNA, 28 bp, Artificial Sequence
  Description of Artificial Sequence: Synthetic oligonucleotide
tggctgcggacagtacagctacttctgg

SEQ ID NO: 240508 - DNA, 27 bp, Artificial Sequence
  Description of Artificial Sequence: Synthetic oligonucleotide
ggctgcggacagtacagctacttctgg

SEQ ID NO: 240509 - DNA, 27 bp, Artificial Sequence
  Description of Artificial Sequence: Synthetic oligonucleotide
gctgcggacagtacagctacttctggc

SEQ ID NO: 240510 - DNA, 27 bp, Artificial Sequence
  Description of Artificial Sequence: Synthetic oligonucleotide
ctgcggacagtacagctacttctggcc

SEQ ID NO: 240511 - DNA, 27 bp, Artificial Sequence
  Description of Artificial Sequence: Synthetic oligonucleotide
tgcggacagtacagctacttctggccg

SEQ ID NO: 240512 - DNA, 27 bp, Artificial Sequence
  Description of Artificial Sequence: Synthetic oligonucleotide
gcggacagtacagctacttctggccga

SEQ ID NO: 240513 - DNA, 27 bp, Artificial Sequence
  Description of Artificial Sequence: Synthetic oligonucleotide
cggacagtacagctacttctggccgac

SEQ ID NO: 240514 - DNA, 28 bp, Artificial Sequence
  Description of Artificial Sequence: Synthetic oligonucleotide
ggacagtacagctacttctggccgactg

SEQ ID NO: 240515 - DNA, 28 bp, Artificial Sequence
  Description of Artificial Sequence: Synthetic oligonucleotide
gacagtacagctacttctggccgactgg

SEQ ID NO: 240516 - DNA, 28 bp, Artificial Sequence
  Description of Artificial Sequence: Synthetic oligonucleotide
acagtacagctacttctggccgactggc

SEQ ID NO: 240517 - DNA, 27 bp, Artificial Sequence
  Description of Artificial Sequence: Synthetic oligonucleotide
cagtacagctacttctggccgactggc

SEQ ID NO: 240518 - DNA, 28 bp, Artificial Sequence
  Description of Artificial Sequence: Synthetic oligonucleotide
agtacagctacttctggccgactggctg

SEQ ID NO: 240519 - DNA, 27 bp, Artificial Sequence
  Description of Artificial Sequence: Synthetic oligonucleotide
gtacagctacttctggccgactggctg

SEQ ID NO: 240520 - DNA, 27 bp, Artificial Sequence
  Description of Artificial Sequence: Synthetic oligonucleotide
tacagctacttctggccgactggctgc

SEQ ID NO: 240521 - DNA, 27 bp, Artificial Sequence
  Description of Artificial Sequence: Synthetic oligonucleotide
acagctacttctggccgactggctgct

SEQ ID NO: 240522 - DNA, 26 bp, Artificial Sequence
  Description of Artificial Sequence: Synthetic oligonucleotide
cagctacttctggccgactggctgct

SEQ ID NO: 240523 - DNA, 26 bp, Artificial Sequence
  Description of Artificial Sequence: Synthetic oligonucleotide
agctacttctggccgactggctgctg

SEQ ID NO: 240524 - DNA, 25 bp, Artificial Sequence
  Description of Artificial Sequence: Synthetic oligonucleotide
gctacttctggccgactggctgctg

SEQ ID NO: 240525 - DNA, 26 bp, Artificial Sequence
  Description of Artificial Sequence: Synthetic oligonucleotide
ctacttctggccgactggctgctgct

SEQ ID NO: 240526 - DNA, 26 bp, Artificial Sequence
  Description of Artificial Sequence: Synthetic oligonucleotide
tacttctggccgactggctgctgctc

SEQ ID NO: 240527 - DNA, 25 bp, Artificial Sequence
  Description of Artificial Sequence: Synthetic oligonucleotide
acttctggccgactggctgctgctc

SEQ ID NO: 240528 - DNA, 24 bp, Artificial Sequence
  Description of Artificial Sequence: Synthetic oligonucleotide
cttctggccgactggctgctgctc

SEQ ID NO: 240529 - DNA, 24 bp, Artificial Sequence
  Description of Artificial Sequence: Synthetic oligonucleotide
ttctggccgactggctgctgctcc

SEQ ID NO: 240530 - DNA, 23 bp, Artificial Sequence
  Description of Artificial Sequence: Synthetic oligonucleotide
tctggccgactggctgctgctcc

SEQ ID NO: 240531 - DNA, 22 bp, Artificial Sequence
  Description of Artificial Sequence: Synthetic oligonucleotide
ctggccgactggctgctgctcc

SEQ ID NO: 240532 - DNA, 22 bp, Artificial Sequence
  Description of Artificial Sequence: Synthetic oligonucleotide
tggccgactggctgctgctccc

SEQ ID NO: 240533 - DNA, 21 bp, Artificial Sequence
  Description of Artificial Sequence: Synthetic oligonucleotide
ggccgactggctgctgctccc

SEQ ID NO: 240534 - DNA, 22 bp, Artificial Sequence
  Description of Artificial Sequence: Synthetic oligonucleotide
gccgactggctgctgctcccga

SEQ ID NO: 240535 - DNA, 22 bp, Artificial Sequence
  Description of Artificial Sequence: Synthetic oligonucleotide
ccgactggctgctgctcccgac

SEQ ID NO: 240536 - DNA, 22 bp, Artificial Sequence
  Description of Artificial Sequence: Synthetic oligonucleotide
cgactggctgctgctcccgacc

SEQ ID NO: 240537 - DNA, 22 bp, Artificial Sequence
  Description of Artificial Sequence: Synthetic oligonucleotide
gactggctgctgctcccgaccg

SEQ ID NO: 240538 - DNA, 22 bp, Artificial Sequence
  Description of Artificial Sequence: Synthetic oligonucleotide
actggctgctgctcccgaccgc

SEQ ID NO: 240539 - DNA, 21 bp, Artificial Sequence
  Description of Artificial Sequence: Synthetic oligonucleotide
ctggctgctgctcccgaccgc

SEQ ID NO: 240540 - DNA, 21 bp, Artificial Sequence
  Description of Artificial Sequence: Synthetic oligonucleotide
tggctgctgctcccgaccgcg

SEQ ID NO: 240541 - DNA, 20 bp, Artificial Sequence
  Description of Artificial Sequence: Synthetic oligonucleotide
ggctgctgctcccgaccgcg

SEQ ID NO: 240542 - DNA, 21 bp, Artificial Sequence
  Description of Artificial Sequence: Synthetic oligonucleotide
gctgctgctcccgaccgcgct

SEQ ID NO: 240543 - DNA, 21 bp, Artificial Sequence
  Description of Artificial Sequence: Synthetic oligonucleotide
ctgctgctcccgaccgcgctc

SEQ ID NO: 240544 - DNA, 21 bp, Artificial Sequence
  Description of Artificial Sequence: Synthetic oligonucleotide
tgctgctcccgaccgcgctcc

SEQ ID NO: 240545 - DNA, 20 bp, Artificial Sequence
  Description of Artificial Sequence: Synthetic oligonucleotide
gctgctcccgaccgcgctcc

SEQ ID NO: 240546 - DNA, 20 bp, Artificial Sequence
  Description of Artificial Sequence: Synthetic oligonucleotide
ctgctcccgaccgcgctccc

SEQ ID NO: 240547 - DNA, 20 bp, Artificial Sequence
  Description of Artificial Sequence: Synthetic oligonucleotide
tgctcccgaccgcgctcccc

SEQ ID NO: 240548 - DNA, 20 bp, Artificial Sequence
  Description of Artificial Sequence: Synthetic oligonucleotide
gctcccgaccgcgctcccct

SEQ ID NO: 240549 - DNA, 20 bp, Artificial Sequence
  Description of Artificial Sequence: Synthetic oligonucleotide
ctcccgaccgcgctccccct

SEQ ID NO: 240550 - DNA, 20 bp, Artificial Sequence
  Description of Artificial Sequence: Synthetic oligonucleotide
tcccgaccgcgctcccccgt

SEQ ID NO: 240551 - DNA, 20 bp, Artificial Sequence
  Description of Artificial Sequence: Synthetic oligonucleotide
cccgaccgcgctcccccgtt

SEQ ID NO: 240552 - DNA, 23 bp, Artificial Sequence
  Description of Artificial Sequence: Synthetic oligonucleotide
ccgaccgcgctcccccgcataat

SEQ ID NO: 240553 - DNA, 24 bp, Artificial Sequence
  Description of Artificial Sequence: Synthetic oligonucleotide
cgaccgcgctcccccgcataatct

SEQ ID NO: 240554 - DNA, 24 bp, Artificial Sequence
  Description of Artificial Sequence: Synthetic oligonucleotide
gaccgcgctcccccgcataatctc

SEQ ID NO: 240555 - DNA, 24 bp, Artificial Sequence
  Description of Artificial Sequence: Synthetic oligonucleotide
accgcgctcccccgcataatctcc

SEQ ID NO: 240556 - DNA, 23 bp, Artificial Sequence
  Description of Artificial Sequence: Synthetic oligonucleotide
ccgcgctcccccgcataatctcc

SEQ ID NO: 240557 - DNA, 24 bp, Artificial Sequence
  Description of Artificial Sequence: Synthetic oligonucleotide
cgcgctcccccgcataatctccct

SEQ ID NO: 240558 - DNA, 24 bp, Artificial Sequence
  Description of Artificial Sequence: Synthetic oligonucleotide
gcgctcccccgcataatctccctg

SEQ ID NO: 240559 - DNA, 25 bp, Artificial Sequence
  Description of Artificial Sequence: Synthetic oligonucleotide
cgctcccccgcataatctccctgca

SEQ ID NO: 240560 - DNA, 25 bp, Artificial Sequence
  Description of Artificial Sequence: Synthetic oligonucleotide
gctcccccgcataatctccctgcag

SEQ ID NO: 240561 - DNA, 26 bp, Artificial Sequence
  Description of Artificial Sequence: Synthetic oligonucleotide
ctcccccgcataatctccctgcaggt

SEQ ID NO: 240562 - DNA, 26 bp, Artificial Sequence
  Description of Artificial Sequence: Synthetic oligonucleotide
tcccccgcataatctccctgcaggtg

SEQ ID NO: 240563 - DNA, 25 bp, Artificial Sequence
  Description of Artificial Sequence: Synthetic oligonucleotide
cccccgcataatctccctgcaggtg

SEQ ID NO: 240564 - DNA, 25 bp, Artificial Sequence
  Description of Artificial Sequence: Synthetic oligonucleotide
ccccgcataatctccctgcaggtgc

SEQ ID NO: 240565 - DNA, 25 bp, Artificial Sequence
  Description of Artificial Sequence: Synthetic oligonucleotide
cccgcataatctccctgcaggtgcc

SEQ ID NO: 240566 - DNA, 26 bp, Artificial Sequence
  Description of Artificial Sequence: Synthetic oligonucleotide
ccgcataatctccctgcaggtgccca

SEQ ID NO: 240567 - DNA, 26 bp, Artificial Sequence
  Description of Artificial Sequence: Synthetic oligonucleotide
cgcataatctccctgcaggtgcccac

SEQ ID NO: 240568 - DNA, 26 bp, Artificial Sequence
  Description of Artificial Sequence: Synthetic oligonucleotide
gcataatctccctgcaggtgcccacg

SEQ ID NO: 240569 - DNA, 26 bp, Artificial Sequence
  Description of Artificial Sequence: Synthetic oligonucleotide
cataatctccctgcaggtgcccacgg

SEQ ID NO: 240570 - DNA, 26 bp, Artificial Sequence
  Description of Artificial Sequence: Synthetic oligonucleotide
ataatctccctgcaggtgcccacggc

SEQ ID NO: 240571 - DNA, 25 bp, Artificial Sequence
  Description of Artificial Sequence: Synthetic oligonucleotide
taatctccctgcaggtgcccacggc

SEQ ID NO: 240572 - DNA, 24 bp, Artificial Sequence
  Description of Artificial Sequence: Synthetic oligonucleotide
aatctccctgcaggtgcccacggc

SEQ ID NO: 240573 - DNA, 23 bp, Artificial Sequence
  Description of Artificial Sequence: Synthetic oligonucleotide
atctccctgcaggtgcccacggc

SEQ ID NO: 240574 - DNA, 22 bp, Artificial Sequence
  Description of Artificial Sequence: Synthetic oligonucleotide
tctccctgcaggtgcccacggc

SEQ ID NO: 240575 - DNA, 21 bp, Artificial Sequence
  Description of Artificial Sequence: Synthetic oligonucleotide
ctccctgcaggtgcccacggc

SEQ ID NO: 240576 - DNA, 21 bp, Artificial Sequence
  Description of Artificial Sequence: Synthetic oligonucleotide
tccctgcaggtgcccacggcg

SEQ ID NO: 240577 - DNA, 20 bp, Artificial Sequence
  Description of Artificial Sequence: Synthetic oligonucleotide
ccctgcaggtgcccacggcg

SEQ ID NO: 240578 - DNA, 21 bp, Artificial Sequence
  Description of Artificial Sequence: Synthetic oligonucleotide
cctgcaggtgcccacggcgct

SEQ ID NO: 240579 - DNA, 21 bp, Artificial Sequence
  Description of Artificial Sequence: Synthetic oligonucleotide
ctgcaggtgcccacggcgctg

SEQ ID NO: 240580 - DNA, 21 bp, Artificial Sequence
  Description of Artificial Sequence: Synthetic oligonucleotide
tgcaggtgcccacggcgctgc

SEQ ID NO: 240581 - DNA, 20 bp, Artificial Sequence
  Description of Artificial Sequence: Synthetic oligonucleotide
gcaggtgcccacggcgctgc

SEQ ID NO: 240582 - DNA, 21 bp, Artificial Sequence
  Description of Artificial Sequence: Synthetic oligonucleotide
caggtgcccacggcgctgcca

SEQ ID NO: 240583 - DNA, 22 bp, Artificial Sequence
  Description of Artificial Sequence: Synthetic oligonucleotide
aggtgcccacggcgctgccagt

SEQ ID NO: 240584 - DNA, 21 bp, Artificial Sequence
  Description of Artificial Sequence: Synthetic oligonucleotide
ggtgcccacggcgctgccagt

SEQ ID NO: 240585 - DNA, 21 bp, Artificial Sequence
  Description of Artificial Sequence: Synthetic oligonucleotide
gtgcccacggcgctgccagtg

SEQ ID NO: 240586 - DNA, 22 bp, Artificial Sequence
  Description of Artificial Sequence: Synthetic oligonucleotide
tgcccacggcgctgccagtgct

SEQ ID NO: 240587 - DNA, 21 bp, Artificial Sequence
  Description of Artificial Sequence: Synthetic oligonucleotide
gcccacggcgctgccagtgct

SEQ ID NO: 240588 - DNA, 21 bp, Artificial Sequence
  Description of Artificial Sequence: Synthetic oligonucleotide
cccacggcgctgccagtgctc

SEQ ID NO: 240589 - DNA, 21 bp, Artificial Sequence
  Description of Artificial Sequence: Synthetic oligonucleotide
ccacggcgctgccagtgctcc

SEQ ID NO: 240590 - DNA, 21 bp, Artificial Sequence
  Description of Artificial Sequence: Synthetic oligonucleotide
cacggcgctgccagtgctccg

SEQ ID NO: 240591 - DNA, 21 bp, Artificial Sequence
  Description of Artificial Sequence: Synthetic oligonucleotide
acggcgctgccagtgctccgg

SEQ ID NO: 240592 - DNA, 20 bp, Artificial Sequence
  Description of Artificial Sequence: Synthetic oligonucleotide
cggcgctgccagtgctccgg

SEQ ID NO: 240593 - DNA, 21 bp, Artificial Sequence
  Description of Artificial Sequence: Synthetic oligonucleotide
ggcgctgccagtgctccggga

SEQ ID NO: 240594 - DNA, 22 bp, Artificial Sequence
  Description of Artificial Sequence: Synthetic oligonucleotide
gcgctgccagtgctccgggact

SEQ ID NO: 240595 - DNA, 22 bp, Artificial Sequence
  Description of Artificial Sequence: Synthetic oligonucleotide
cgctgccagtgctccgggactg

SEQ ID NO: 240596 - DNA, 22 bp, Artificial Sequence
  Description of Artificial Sequence: Synthetic oligonucleotide
gctgccagtgctccgggactgg

SEQ ID NO: 240597 - DNA, 22 bp, Artificial Sequence
  Description of Artificial Sequence: Synthetic oligonucleotide
ctgccagtgctccgggactggg

SEQ ID NO: 240598 - DNA, 22 bp, Artificial Sequence
  Description of Artificial Sequence: Synthetic oligonucleotide
tgccagtgctccgggactgggc

SEQ ID NO: 240599 - DNA, 21 bp, Artificial Sequence
  Description of Artificial Sequence: Synthetic oligonucleotide
gccagtgctccgggactgggc

SEQ ID NO: 240600 - DNA, 21 bp, Artificial Sequence
  Description of Artificial Sequence: Synthetic oligonucleotide
ccagtgctccgggactgggcg

SEQ ID NO: 240601 - DNA, 22 bp, Artificial Sequence
  Description of Artificial Sequence: Synthetic oligonucleotide
cagtgctccgggactgggcggt

SEQ ID NO: 240602 - DNA, 22 bp, Artificial Sequence
  Description of Artificial Sequence: Synthetic oligonucleotide
agtgctccgggactgggcggtc

SEQ ID NO: 240603 - DNA, 21 bp, Artificial Sequence
  Description of Artificial Sequence: Synthetic oligonucleotide
gtgctccgggactgggcggtc

SEQ ID NO: 240604 - DNA, 21 bp, Artificial Sequence
  Description of Artificial Sequence: Synthetic oligonucleotide
tgctccgggactgggcggtcg

SEQ ID NO: 240605 - DNA, 20 bp, Artificial Sequence
  Description of Artificial Sequence: Synthetic oligonucleotide
gctccgggactgggcggtcg

SEQ ID NO: 240606 - DNA, 20 bp, Artificial Sequence
  Description of Artificial Sequence: Synthetic oligonucleotide
ctccgggactgggcggtcgg

SEQ ID NO: 240607 - DNA, 20 bp, Artificial Sequence
  Description of Artificial Sequence: Synthetic oligonucleotide
tccgggactgggcggtcggc

SEQ ID NO: 240608 - DNA, 20 bp, Artificial Sequence
  Description of Artificial Sequence: Synthetic oligonucleotide
ccgggactgggcggtcggct

SEQ ID NO: 240609 - DNA, 20 bp, Artificial Sequence
  Description of Artificial Sequence: Synthetic oligonucleotide
cgggactgggcggtcggcct

SEQ ID NO: 240610 - DNA, 21 bp, Artificial Sequence
  Description of Artificial Sequence: Synthetic oligonucleotide
gggactgggcggtcggcctga

SEQ ID NO: 240611 - DNA, 21 bp, Artificial Sequence
  Description of Artificial Sequence: Synthetic oligonucleotide
ggactgggcggtcggcctgag

SEQ ID NO: 240612 - DNA, 21 bp, Artificial Sequence
  Description of Artificial Sequence: Synthetic oligonucleotide
gactgggcggtcggcctgagc

SEQ ID NO: 240613 - DNA, 21 bp, Artificial Sequence
  Description of Artificial Sequence: Synthetic oligonucleotide
actgggcggtcggcctgagcg

SEQ ID NO: 240614 - DNA, 20 bp, Artificial Sequence
  Description of Artificial Sequence: Synthetic oligonucleotide
ctgggcggtcggcctgagcg

SEQ ID NO: 240615 - DNA, 20 bp, Artificial Sequence
  Description of Artificial Sequence: Synthetic oligonucleotide
tgggcggtcggcctgagcgg

SEQ ID NO: 240616 - DNA, 20 bp, Artificial Sequence
  Description of Artificial Sequence: Synthetic oligonucleotide
gggcggtcggcctgagcggt

SEQ ID NO: 240617 - DNA, 20 bp, Artificial Sequence
  Description of Artificial Sequence: Synthetic oligonucleotide
ggcggtcggcctgagcggct

SEQ ID NO: 240618 - DNA, 20 bp, Artificial Sequence
  Description of Artificial Sequence: Synthetic oligonucleotide
gcggtcggcctgagcggctg

SEQ ID NO: 240619 - DNA, 20 bp, Artificial Sequence
  Description of Artificial Sequence: Synthetic oligonucleotide
cggtcggcctgagcggctgg

SEQ ID NO: 240620 - DNA, 20 bp, Artificial Sequence
  Description of Artificial Sequence: Synthetic oligonucleotide
ggtcggcctgagcggctggg

SEQ ID NO: 240621 - DNA, 20 bp, Artificial Sequence
  Description of Artificial Sequence: Synthetic oligonucleotide
gtcggcctgagcggctgggc

SEQ ID NO: 240622 - DNA, 20 bp, Artificial Sequence
  Description of Artificial Sequence: Synthetic oligonucleotide
tcggcctgagcggctgggcc

SEQ ID NO: 240623 - DNA, 20 bp, Artificial Sequence
  Description of Artificial Sequence: Synthetic oligonucleotide
cggcctgagcggctgggcct

SEQ ID NO: 240624 - DNA, 20 bp, Artificial Sequence
  Description of Artificial Sequence: Synthetic oligonucleotide
ggcctgagcggctgggccga

SEQ ID NO: 240625 - DNA, 20 bp, Artificial Sequence
  Description of Artificial Sequence: Synthetic oligonucleotide
gcctgagcggctgggccgag

SEQ ID NO: 240626 - DNA, 21 bp, Artificial Sequence
  Description of Artificial Sequence: Synthetic oligonucleotide
cctgagcggctgggccgagct

SEQ ID NO: 240627 - DNA, 22 bp, Artificial Sequence
  Description of Artificial Sequence: Synthetic oligonucleotide
ctgagcggctgggccgagctct

SEQ ID NO: 240628 - DNA, 22 bp, Artificial Sequence
  Description of Artificial Sequence: Synthetic oligonucleotide
tgagcggctgggccgagctctg

SEQ ID NO: 240629 - DNA, 21 bp, Artificial Sequence
  Description of Artificial Sequence: Synthetic oligonucleotide
gagcggctgggccgagctctg

SEQ ID NO: 240630 - DNA, 21 bp, Artificial Sequence
  Description of Artificial Sequence: Synthetic oligonucleotide
agcggctgggccgagctctgg

SEQ ID NO: 240631 - DNA, 20 bp, Artificial Sequence
  Description of Artificial Sequence: Synthetic oligonucleotide
gcggctgggccgagctctgg

SEQ ID NO: 240632 - DNA, 21 bp, Artificial Sequence
  Description of Artificial Sequence: Synthetic oligonucleotide
cggctgggccgagctctggct

SEQ ID NO: 240633 - DNA, 21 bp, Artificial Sequence
  Description of Artificial Sequence: Synthetic oligonucleotide
ggctgggccgagctctggctc

SEQ ID NO: 240634 - DNA, 21 bp, Artificial Sequence
  Description of Artificial Sequence: Synthetic oligonucleotide
gctgggccgagctctggctcg

SEQ ID NO: 240635 - DNA, 21 bp, Artificial Sequence
  Description of Artificial Sequence: Synthetic oligonucleotide
ctgggccgagctctggctcgg

SEQ ID NO: 240636 - DNA, 21 bp, Artificial Sequence
  Description of Artificial Sequence: Synthetic oligonucleotide
tgggccgagctctggctcggg

SEQ ID NO: 240637 - DNA, 20 bp, Artificial Sequence
  Description of Artificial Sequence: Synthetic oligonucleotide
gggccgagctctggctcggg

SEQ ID NO: 240638 - DNA, 20 bp, Artificial Sequence
  Description of Artificial Sequence: Synthetic oligonucleotide
ggccgagctctggctcgggg

SEQ ID NO: 240639 - DNA, 20 bp, Artificial Sequence
  Description of Artificial Sequence: Synthetic oligonucleotide
gccgagctctggctcggggc

SEQ ID NO: 240640 - DNA, 21 bp, Artificial Sequence
  Description of Artificial Sequence: Synthetic oligonucleotide
ccgagctctggctcggggcct

SEQ ID NO: 240641 - DNA, 21 bp, Artificial Sequence
  Description of Artificial Sequence: Synthetic oligonucleotide
cgagctctggctcggggcctg

SEQ ID NO: 240642 - DNA, 21 bp, Artificial Sequence
  Description of Artificial Sequence: Synthetic oligonucleotide
gagctctggctcggggcctgc

SEQ ID NO: 240643 - DNA, 21 bp, Artificial Sequence
  Description of Artificial Sequence: Synthetic oligonucleotide
agctctggctcggggcctgcc

SEQ ID NO: 240644 - DNA, 20 bp, Artificial Sequence
  Description of Artificial Sequence: Synthetic oligonucleotide
gctctggctcggggcctgcc

SEQ ID NO: 240645 - DNA, 20 bp, Artificial Sequence
  Description of Artificial Sequence: Synthetic oligonucleotide
ctctggctcggggcctgccg

SEQ ID NO: 240646 - DNA, 20 bp, Artificial Sequence
  Description of Artificial Sequence: Synthetic oligonucleotide
tctggctcggggcctgccgg

SEQ ID NO: 240647 - DNA, 20 bp, Artificial Sequence
  Description of Artificial Sequence: Synthetic oligonucleotide
ctggctcggggcctgccggt

SEQ ID NO: 240648 - DNA, 20 bp, Artificial Sequence
  Description of Artificial Sequence: Synthetic oligonucleotide
tggctcggggcctgccgggt

SEQ ID NO: 240649 - DNA, 20 bp, Artificial Sequence
  Description of Artificial Sequence: Synthetic oligonucleotide
ggctcggggcctgccgggtt

SEQ ID NO: 240650 - DNA, 20 bp, Artificial Sequence
  Description of Artificial Sequence: Synthetic oligonucleotide
gctcggggcctgccgggtct

SEQ ID NO: 240651 - DNA, 20 bp, Artificial Sequence
  Description of Artificial Sequence: Synthetic oligonucleotide
ctcggggcctgccgggtcct

SEQ ID NO: 240652 - DNA, 21 bp, Artificial Sequence
  Description of Artificial Sequence: Synthetic oligonucleotide
tcggggcctgccgggtcctca

SEQ ID NO: 240653 - DNA, 20 bp, Artificial Sequence
  Description of Artificial Sequence: Synthetic oligonucleotide
cggggcctgccgggtcctca

SEQ ID NO: 240654 - DNA, 20 bp, Artificial Sequence
  Description of Artificial Sequence: Synthetic oligonucleotide
ggggcctgccgggtcctcac

SEQ ID NO: 240655 - DNA, 20 bp, Artificial Sequence
  Description of Artificial Sequence: Synthetic oligonucleotide
gggcctgccgggtcctcacg

SEQ ID NO: 240656 - DNA, 20 bp, Artificial Sequence
  Description of Artificial Sequence: Synthetic oligonucleotide
ggcctgccgggtcctcacgg

SEQ ID NO: 240657 - DNA, 22 bp, Artificial Sequence
  Description of Artificial Sequence: Synthetic oligonucleotide
gcctgccgggtcctcacggcaa

SEQ ID NO: 240658 - DNA, 22 bp, Artificial Sequence
  Description of Artificial Sequence: Synthetic oligonucleotide
cctgccgggtcctcacggcaac

SEQ ID NO: 240659 - DNA, 22 bp, Artificial Sequence
  Description of Artificial Sequence: Synthetic oligonucleotide
ctgccgggtcctcacggcaacg

SEQ ID NO: 240660 - DNA, 24 bp, Artificial Sequence
  Description of Artificial Sequence: Synthetic oligonucleotide
tgccgggtcctcacggcaacggta

SEQ ID NO: 240661 - DNA, 23 bp, Artificial Sequence
  Description of Artificial Sequence: Synthetic oligonucleotide
gccgggtcctcacggcaacggta

SEQ ID NO: 240662 - DNA, 23 bp, Artificial Sequence
  Description of Artificial Sequence: Synthetic oligonucleotide
ccgggtcctcacggcaacggtag

SEQ ID NO: 240663 - DNA, 23 bp, Artificial Sequence
  Description of Artificial Sequence: Synthetic oligonucleotide
cgggtcctcacggcaacggtagg

SEQ ID NO: 240664 - DNA, 24 bp, Artificial Sequence
  Description of Artificial Sequence: Synthetic oligonucleotide
gggtcctcacggcaacggtaggct

SEQ ID NO: 240665 - DNA, 24 bp, Artificial Sequence
  Description of Artificial Sequence: Synthetic oligonucleotide
ggtcctcacggcaacggtaggctc

SEQ ID NO: 240666 - DNA, 26 bp, Artificial Sequence
  Description of Artificial Sequence: Synthetic oligonucleotide
gtcctcacggcaacggtaggctccaa

SEQ ID NO: 240667 - DNA, 27 bp, Artificial Sequence
  Description of Artificial Sequence: Synthetic oligonucleotide
tcctcacggcaacggtaggctccaagt

SEQ ID NO: 240668 - DNA, 26 bp, Artificial Sequence
  Description of Artificial Sequence: Synthetic oligonucleotide
cctcacggcaacggtaggctccaagt

SEQ ID NO: 240669 - DNA, 26 bp, Artificial Sequence
  Description of Artificial Sequence: Synthetic oligonucleotide
ctcacggcaacggtaggctccaagtg

SEQ ID NO: 240670 - DNA, 26 bp, Artificial Sequence
  Description of Artificial Sequence: Synthetic oligonucleotide
tcacggcaacggtaggctccaagtgc

SEQ ID NO: 240671 - DNA, 25 bp, Artificial Sequence
  Description of Artificial Sequence: Synthetic oligonucleotide
cacggcaacggtaggctccaagtgc

SEQ ID NO: 240672 - DNA, 27 bp, Artificial Sequence
  Description of Artificial Sequence: Synthetic oligonucleotide
acggcaacggtaggctccaagtgcgaa

SEQ ID NO: 240673 - DNA, 27 bp, Artificial Sequence
  Description of Artificial Sequence: Synthetic oligonucleotide
cggcaacggtaggctccaagtgcgaaa

SEQ ID NO: 240674 - DNA, 28 bp, Artificial Sequence
  Description of Artificial Sequence: Synthetic oligonucleotide
ggcaacggtaggctccaagtgcgaaaac

SEQ ID NO: 240675 - DNA, 28 bp, Artificial Sequence
  Description of Artificial Sequence: Synthetic oligonucleotide
gcaacggtaggctccaagtgcgaaaacg

SEQ ID NO: 240676 - DNA, 28 bp, Artificial Sequence
  Description of Artificial Sequence: Synthetic oligonucleotide
caacggtaggctccaagtgcgaaaacgg

SEQ ID NO: 240677 - DNA, 29 bp, Artificial Sequence
  Description of Artificial Sequence: Synthetic oligonucleotide
aacggtaggctccaagtgcgaaaacggag

SEQ ID NO: 240678 - DNA, 28 bp, Artificial Sequence
  Description of Artificial Sequence: Synthetic oligonucleotide
acggtaggctccaagtgcgaaaacggag

SEQ ID NO: 240679 - DNA, 27 bp, Artificial Sequence
  Description of Artificial Sequence: Synthetic oligonucleotide
cggtaggctccaagtgcgaaaacggag

SEQ ID NO: 240680 - DNA, 27 bp, Artificial Sequence
  Description of Artificial Sequence: Synthetic oligonucleotide
ggtaggctccaagtgcgaaaacggagg

SEQ ID NO: 240681 - DNA, 28 bp, Artificial Sequence
  Description of Artificial Sequence: Synthetic oligonucleotide
gtaggctccaagtgcgaaaacggaggtg

SEQ ID NO: 240682 - DNA, 28 bp, Artificial Sequence
  Description of Artificial Sequence: Synthetic oligonucleotide
taggctccaagtgcgaaaacggaggtgc

SEQ ID NO: 240683 - DNA, 27 bp, Artificial Sequence
  Description of Artificial Sequence: Synthetic oligonucleotide
aggctccaagtgcgaaaacggaggtgc

SEQ ID NO: 240684 - DNA, 26 bp, Artificial Sequence
  Description of Artificial Sequence: Synthetic oligonucleotide
ggctccaagtgcgaaaacggaggtgc

SEQ ID NO: 240685 - DNA, 26 bp, Artificial Sequence
  Description of Artificial Sequence: Synthetic oligonucleotide
gctccaagtgcgaaaacggaggtgcc

SEQ ID NO: 240686 - DNA, 27 bp, Artificial Sequence
  Description of Artificial Sequence: Synthetic oligonucleotide
ctccaagtgcgaaaacggaggtgccca

SEQ ID NO: 240687 - DNA, 27 bp, Artificial Sequence
  Description of Artificial Sequence: Synthetic oligonucleotide
tccaagtgcgaaaacggaggtgcccac

SEQ ID NO: 240688 - DNA, 26 bp, Artificial Sequence
  Description of Artificial Sequence: Synthetic oligonucleotide
ccaagtgcgaaaacggaggtgcccac

SEQ ID NO: 240689 - DNA, 26 bp, Artificial Sequence
  Description of Artificial Sequence: Synthetic oligonucleotide
caagtgcgaaaacggaggtgcccacg

SEQ ID NO: 240690 - DNA, 26 bp, Artificial Sequence
  Description of Artificial Sequence: Synthetic oligonucleotide
aagtgcgaaaacggaggtgcccacgg

SEQ ID NO: 240691 - DNA, 25 bp, Artificial Sequence
  Description of Artificial Sequence: Synthetic oligonucleotide
agtgcgaaaacggaggtgcccacgg

SEQ ID NO: 240692 - DNA, 24 bp, Artificial Sequence
  Description of Artificial Sequence: Synthetic oligonucleotide
gtgcgaaaacggaggtgcccacgg

SEQ ID NO: 240693 - DNA, 25 bp, Artificial Sequence
  Description of Artificial Sequence: Synthetic oligonucleotide
tgcgaaaacggaggtgcccacggct

SEQ ID NO: 240694 - DNA, 24 bp, Artificial Sequence
  Description of Artificial Sequence: Synthetic oligonucleotide
gcgaaaacggaggtgcccacggct

SEQ ID NO: 240695 - DNA, 24 bp, Artificial Sequence
  Description of Artificial Sequence: Synthetic oligonucleotide
cgaaaacggaggtgcccacggctg

SEQ ID NO: 240696 - DNA, 24 bp, Artificial Sequence
  Description of Artificial Sequence: Synthetic oligonucleotide
gaaaacggaggtgcccacggctgg

SEQ ID NO: 240697 - DNA, 25 bp, Artificial Sequence
  Description of Artificial Sequence: Synthetic oligonucleotide
aaaacggaggtgcccacggctggct

SEQ ID NO: 240698 - DNA, 24 bp, Artificial Sequence
  Description of Artificial Sequence: Synthetic oligonucleotide
aaacggaggtgcccacggctggct

SEQ ID NO: 240699 - DNA, 23 bp, Artificial Sequence
  Description of Artificial Sequence: Synthetic oligonucleotide
aacggaggtgcccacggctggct

SEQ ID NO: 240700 - DNA, 22 bp, Artificial Sequence
  Description of Artificial Sequence: Synthetic oligonucleotide
acggaggtgcccacggctggct

SEQ ID NO: 240701 - DNA, 21 bp, Artificial Sequence
  Description of Artificial Sequence: Synthetic oligonucleotide
cggaggtgcccacggctggct

SEQ ID NO: 240702 - DNA, 21 bp, Artificial Sequence
  Description of Artificial Sequence: Synthetic oligonucleotide
ggaggtgcccacggctggctg

SEQ ID NO: 240703 - DNA, 21 bp, Artificial Sequence
  Description of Artificial Sequence: Synthetic oligonucleotide
gaggtgcccacggctggctgc

SEQ ID NO: 240704 - DNA, 22 bp, Artificial Sequence
  Description of Artificial Sequence: Synthetic oligonucleotide
aggtgcccacggctggctgcct

SEQ ID NO: 240705 - DNA, 21 bp, Artificial Sequence
  Description of Artificial Sequence: Synthetic oligonucleotide
ggtgcccacggctggctgcct

SEQ ID NO: 240706 - DNA, 21 bp, Artificial Sequence
  Description of Artificial Sequence: Synthetic oligonucleotide
gtgcccacggctggctgcctg

SEQ ID NO: 240707 - DNA, 24 bp, Artificial Sequence
  Description of Artificial Sequence: Synthetic oligonucleotide
tgcccacggctggctgcctgcttt

SEQ ID NO: 240708 - DNA, 23 bp, Artificial Sequence
  Description of Artificial Sequence: Synthetic oligonucleotide
gcccacggctggctgcctgcttt

SEQ ID NO: 240709 - DNA, 25 bp, Artificial Sequence
  Description of Artificial Sequence: Synthetic oligonucleotide
cccacggctggctgcctgctttgat

SEQ ID NO: 240710 - DNA, 25 bp, Artificial Sequence
  Description of Artificial Sequence: Synthetic oligonucleotide
ccacggctggctgcctgctttgatg

SEQ ID NO: 240711 - DNA, 25 bp, Artificial Sequence
  Description of Artificial Sequence: Synthetic oligonucleotide
cacggctggctgcctgctttgatgc

SEQ ID NO: 240712 - DNA, 27 bp, Artificial Sequence
  Description of Artificial Sequence: Synthetic oligonucleotide
acggctggctgcctgctttgatgccat

SEQ ID NO: 240713 - DNA, 27 bp, Artificial Sequence
  Description of Artificial Sequence: Synthetic oligonucleotide
cggctggctgcctgctttgatgccatt

SEQ ID NO: 240714 - DNA, 28 bp, Artificial Sequence
  Description of Artificial Sequence: Synthetic oligonucleotide
ggctggctgcctgctttgatgccattag

SEQ ID NO: 240715 - DNA, 28 bp, Artificial Sequence
  Description of Artificial Sequence: Synthetic oligonucleotide
gctggctgcctgctttgatgccattagc

SEQ ID NO: 240716 - DNA, 29 bp, Artificial Sequence
  Description of Artificial Sequence: Synthetic oligonucleotide
ctggctgcctgctttgatgccattagcag

SEQ ID NO: 240717 - DNA, 29 bp, Artificial Sequence
  Description of Artificial Sequence: Synthetic oligonucleotide
tggctgcctgctttgatgccattagcagc

SEQ ID NO: 240718 - DNA, 28 bp, Artificial Sequence
  Description of Artificial Sequence: Synthetic oligonucleotide
ggctgcctgctttgatgccattagcagc

SEQ ID NO: 240719 - DNA, 28 bp, Artificial Sequence
  Description of Artificial Sequence: Synthetic oligonucleotide
gctgcctgctttgatgccattagcagcg

SEQ ID NO: 240720 - DNA, 28 bp, Artificial Sequence
  Description of Artificial Sequence: Synthetic oligonucleotide
ctgcctgctttgatgccattagcagcgg

SEQ ID NO: 240721 - DNA, 28 bp, Artificial Sequence
  Description of Artificial Sequence: Synthetic oligonucleotide
tgcctgctttgatgccattagcagcggc

SEQ ID NO: 240722 - DNA, 27 bp, Artificial Sequence
  Description of Artificial Sequence: Synthetic oligonucleotide
gcctgctttgatgccattagcagcggc

SEQ ID NO: 240723 - DNA, 28 bp, Artificial Sequence
  Description of Artificial Sequence: Synthetic oligonucleotide
cctgctttgatgccattagcagcggcac

SEQ ID NO: 240724 - DNA, 29 bp, Artificial Sequence
  Description of Artificial Sequence: Synthetic oligonucleotide
ctgctttgatgccattagcagcggcactg

SEQ ID NO: 240725 - DNA, 29 bp, Artificial Sequence
  Description of Artificial Sequence: Synthetic oligonucleotide
tgctttgatgccattagcagcggcactgc

SEQ ID NO: 240726 - DNA, 28 bp, Artificial Sequence
  Description of Artificial Sequence: Synthetic oligonucleotide
gctttgatgccattagcagcggcactgc

SEQ ID NO: 240727 - DNA, 28 bp, Artificial Sequence
  Description of Artificial Sequence: Synthetic oligonucleotide
ctttgatgccattagcagcggcactgcg

SEQ ID NO: 240728 - DNA, 28 bp, Artificial Sequence
  Description of Artificial Sequence: Synthetic oligonucleotide
tttgatgccattagcagcggcactgcgc

SEQ ID NO: 240729 - DNA, 27 bp, Artificial Sequence
  Description of Artificial Sequence: Synthetic oligonucleotide
ttgatgccattagcagcggcactgcgc

SEQ ID NO: 240730 - DNA, 27 bp, Artificial Sequence
  Description of Artificial Sequence: Synthetic oligonucleotide
tgatgccattagcagcggcactgcgct

SEQ ID NO: 240731 - DNA, 27 bp, Artificial Sequence
  Description of Artificial Sequence: Synthetic oligonucleotide
gatgccattagcagcggcactgcgctt

SEQ ID NO: 240732 - DNA, 27 bp, Artificial Sequence
  Description of Artificial Sequence: Synthetic oligonucleotide
atgccattagcagcggcactgcgcttg

SEQ ID NO: 240733 - DNA, 26 bp, Artificial Sequence
  Description of Artificial Sequence: Synthetic oligonucleotide
tgccattagcagcggcactgcgcttg

SEQ ID NO: 240734 - DNA, 25 bp, Artificial Sequence
  Description of Artificial Sequence: Synthetic oligonucleotide
gccattagcagcggcactgcgcttg

SEQ ID NO: 240735 - DNA, 25 bp, Artificial Sequence
  Description of Artificial Sequence: Synthetic oligonucleotide
ccattagcagcggcactgcgcttgg

SEQ ID NO: 240736 - DNA, 25 bp, Artificial Sequence
  Description of Artificial Sequence: Synthetic oligonucleotide
cattagcagcggcactgcgcttggc

SEQ ID NO: 240737 - DNA, 25 bp, Artificial Sequence
  Description of Artificial Sequence: Synthetic oligonucleotide
attagcagcggcactgcgcttggcc

SEQ ID NO: 240738 - DNA, 24 bp, Artificial Sequence
  Description of Artificial Sequence: Synthetic oligonucleotide
ttagcagcggcactgcgcttggcc

SEQ ID NO: 240739 - DNA, 23 bp, Artificial Sequence
  Description of Artificial Sequence: Synthetic oligonucleotide
tagcagcggcactgcgcttggcc

SEQ ID NO: 240740 - DNA, 22 bp, Artificial Sequence
  Description of Artificial Sequence: Synthetic oligonucleotide
agcagcggcactgcgcttggcc

SEQ ID NO: 240741 - DNA, 21 bp, Artificial Sequence
  Description of Artificial Sequence: Synthetic oligonucleotide
gcagcggcactgcgcttggcc

SEQ ID NO: 240742 - DNA, 22 bp, Artificial Sequence
  Description of Artificial Sequence: Synthetic oligonucleotide
cagcggcactgcgcttggccca

SEQ ID NO: 240743 - DNA, 22 bp, Artificial Sequence
  Description of Artificial Sequence: Synthetic oligonucleotide
agcggcactgcgcttggcccag

SEQ ID NO: 240744 - DNA, 21 bp, Artificial Sequence
  Description of Artificial Sequence: Synthetic oligonucleotide
gcggcactgcgcttggcccag

SEQ ID NO: 240745 - DNA, 21 bp, Artificial Sequence
  Description of Artificial Sequence: Synthetic oligonucleotide
cggcactgcgcttggcccagc

SEQ ID NO: 240746 - DNA, 21 bp, Artificial Sequence
  Description of Artificial Sequence: Synthetic oligonucleotide
ggcactgcgcttggcccagcc

SEQ ID NO: 240747 - DNA, 21 bp, Artificial Sequence
  Description of Artificial Sequence: Synthetic oligonucleotide
gcactgcgcttggcccagccg

SEQ ID NO: 240748 - DNA, 21 bp, Artificial Sequence
  Description of Artificial Sequence: Synthetic oligonucleotide
cactgcgcttggcccagccgg

SEQ ID NO: 240749 - DNA, 22 bp, Artificial Sequence
  Description of Artificial Sequence: Synthetic oligonucleotide
actgcgcttggcccagccggga

SEQ ID NO: 240750 - DNA, 21 bp, Artificial Sequence
  Description of Artificial Sequence: Synthetic oligonucleotide
ctgcgcttggcccagccggga

SEQ ID NO: 240751 - DNA, 23 bp, Artificial Sequence
  Description of Artificial Sequence: Synthetic oligonucleotide
tgcgcttggcccagccgggacta

SEQ ID NO: 240752 - DNA, 22 bp, Artificial Sequence
  Description of Artificial Sequence: Synthetic oligonucleotide
gcgcttggcccagccgggacta

SEQ ID NO: 240753 - DNA, 22 bp, Artificial Sequence
  Description of Artificial Sequence: Synthetic oligonucleotide
cgcttggcccagccgggactag

SEQ ID NO: 240754 - DNA, 22 bp, Artificial Sequence
  Description of Artificial Sequence: Synthetic oligonucleotide
gcttggcccagccgggactagc

SEQ ID NO: 240755 - DNA, 24 bp, Artificial Sequence
  Description of Artificial Sequence: Synthetic oligonucleotide
cttggcccagccgggactagcctt

SEQ ID NO: 240756 - DNA, 26 bp, Artificial Sequence
  Description of Artificial Sequence: Synthetic oligonucleotide
ttggcccagccgggactagccttgtt

SEQ ID NO: 240757 - DNA, 25 bp, Artificial Sequence
  Description of Artificial Sequence: Synthetic oligonucleotide
tggcccagccgggactagccttgtt

SEQ ID NO: 240758 - DNA, 24 bp, Artificial Sequence
  Description of Artificial Sequence: Synthetic oligonucleotide
ggcccagccgggactagccttgtt

SEQ ID NO: 240759 - DNA, 24 bp, Artificial Sequence
  Description of Artificial Sequence: Synthetic oligonucleotide
gcccagccgggactagccttgttc

SEQ ID NO: 240760 - DNA, 24 bp, Artificial Sequence
  Description of Artificial Sequence: Synthetic oligonucleotide
cccagccgggactagccttgttcg

SEQ ID NO: 240761 - DNA, 25 bp, Artificial Sequence
  Description of Artificial Sequence: Synthetic oligonucleotide
ccagccgggactagccttgttcgga

SEQ ID NO: 240762 - DNA, 26 bp, Artificial Sequence
  Description of Artificial Sequence: Synthetic oligonucleotide
cagccgggactagccttgttcggaga

SEQ ID NO: 240763 - DNA, 26 bp, Artificial Sequence
  Description of Artificial Sequence: Synthetic oligonucleotide
agccgggactagccttgttcggagag

SEQ ID NO: 240764 - DNA, 25 bp, Artificial Sequence
  Description of Artificial Sequence: Synthetic oligonucleotide
gccgggactagccttgttcggagag

SEQ ID NO: 240765 - DNA, 26 bp, Artificial Sequence
  Description of Artificial Sequence: Synthetic oligonucleotide
ccgggactagccttgttcggagagct

SEQ ID NO: 240766 - DNA, 27 bp, Artificial Sequence
  Description of Artificial Sequence: Synthetic oligonucleotide
cgggactagccttgttcggagagctga

SEQ ID NO: 240767 - DNA, 28 bp, Artificial Sequence
  Description of Artificial Sequence: Synthetic oligonucleotide
gggactagccttgttcggagagctgaac

SEQ ID NO: 240768 - DNA, 29 bp, Artificial Sequence
  Description of Artificial Sequence: Synthetic oligonucleotide
ggactagccttgttcggagagctgaactc

SEQ ID NO: 240769 - DNA, 31 bp, Artificial Sequence
  Description of Artificial Sequence: Synthetic oligonucleotide
gactagccttgttcggagagctgaactcatg

SEQ ID NO: 240770 - DNA, 31 bp, Artificial Sequence
  Description of Artificial Sequence: Synthetic oligonucleotide
actagccttgttcggagagctgaactcatgg

SEQ ID NO: 240771 - DNA, 30 bp, Artificial Sequence
  Description of Artificial Sequence: Synthetic oligonucleotide
ctagccttgttcggagagctgaactcatgg

SEQ ID NO: 240772 - DNA, 30 bp, Artificial Sequence
  Description of Artificial Sequence: Synthetic oligonucleotide
tagccttgttcggagagctgaactcatggg

SEQ ID NO: 240773 - DNA, 29 bp, Artificial Sequence
  Description of Artificial Sequence: Synthetic oligonucleotide
agccttgttcggagagctgaactcatggg

SEQ ID NO: 240774 - DNA, 28 bp, Artificial Sequence
  Description of Artificial Sequence: Synthetic oligonucleotide
gccttgttcggagagctgaactcatggg

SEQ ID NO: 240775 - DNA, 28 bp, Artificial Sequence
  Description of Artificial Sequence: Synthetic oligonucleotide
ccttgttcggagagctgaactcatgggg

SEQ ID NO: 240776 - DNA, 29 bp, Artificial Sequence
  Description of Artificial Sequence: Synthetic oligonucleotide
cttgttcggagagctgaactcatggggtg

SEQ ID NO: 240777 - DNA, 29 bp, Artificial Sequence
  Description of Artificial Sequence: Synthetic oligonucleotide
ttgttcggagagctgaactcatggggtgc

SEQ ID NO: 240778 - DNA, 28 bp, Artificial Sequence
  Description of Artificial Sequence: Synthetic oligonucleotide
tgttcggagagctgaactcatggggtgc

SEQ ID NO: 240779 - DNA, 27 bp, Artificial Sequence
  Description of Artificial Sequence: Synthetic oligonucleotide
gttcggagagctgaactcatggggtgc

SEQ ID NO: 240780 - DNA, 27 bp, Artificial Sequence
  Description of Artificial Sequence: Synthetic oligonucleotide
ttcggagagctgaactcatggggtgcc

SEQ ID NO: 240781 - DNA, 26 bp, Artificial Sequence
  Description of Artificial Sequence: Synthetic oligonucleotide
tcggagagctgaactcatggggtgcc

SEQ ID NO: 240782 - DNA, 25 bp, Artificial Sequence
  Description of Artificial Sequence: Synthetic oligonucleotide
cggagagctgaactcatggggtgcc

SEQ ID NO: 240783 - DNA, 25 bp, Artificial Sequence
  Description of Artificial Sequence: Synthetic oligonucleotide
ggagagctgaactcatggggtgccc

SEQ ID NO: 240784 - DNA, 25 bp, Artificial Sequence
  Description of Artificial Sequence: Synthetic oligonucleotide
gagagctgaactcatggggtgcccc

SEQ ID NO: 240785 - DNA, 25 bp, Artificial Sequence
  Description of Artificial Sequence: Synthetic oligonucleotide
agagctgaactcatggggtgccccc

SEQ ID NO: 240786 - DNA, 24 bp, Artificial Sequence
  Description of Artificial Sequence: Synthetic oligonucleotide
gagctgaactcatggggtgccccc

SEQ ID NO: 240787 - DNA, 24 bp, Artificial Sequence
  Description of Artificial Sequence: Synthetic oligonucleotide
agctgaactcatggggtgcccccg

SEQ ID NO: 240788 - DNA, 23 bp, Artificial Sequence
  Description of Artificial Sequence: Synthetic oligonucleotide
gctgaactcatggggtgcccccg

SEQ ID NO: 240789 - DNA, 23 bp, Artificial Sequence
  Description of Artificial Sequence: Synthetic oligonucleotide
ctgaactcatggggtgcccccgg

SEQ ID NO: 240790 - DNA, 24 bp, Artificial Sequence
  Description of Artificial Sequence: Synthetic oligonucleotide
tgaactcatggggtgcccccggga

SEQ ID NO: 240791 - DNA, 23 bp, Artificial Sequence
  Description of Artificial Sequence: Synthetic oligonucleotide
gaactcatggggtgcccccggga

SEQ ID NO: 240792 - DNA, 23 bp, Artificial Sequence
  Description of Artificial Sequence: Synthetic oligonucleotide
aactcatggggtgcccccgggac

SEQ ID NO: 240793 - DNA, 22 bp, Artificial Sequence
  Description of Artificial Sequence: Synthetic oligonucleotide
actcatggggtgcccccgggac

SEQ ID NO: 240794 - DNA, 21 bp, Artificial Sequence
  Description of Artificial Sequence: Synthetic oligonucleotide
ctcatggggtgcccccgggac

SEQ ID NO: 240795 - DNA, 21 bp, Artificial Sequence
  Description of Artificial Sequence: Synthetic oligonucleotide
tcatggggtgcccccgggacc

SEQ ID NO: 240796 - DNA, 20 bp, Artificial Sequence
  Description of Artificial Sequence: Synthetic oligonucleotide
catggggtgcccccgggacc

SEQ ID NO: 240797 - DNA, 20 bp, Artificial Sequence
  Description of Artificial Sequence: Synthetic oligonucleotide
atggggtgcccccgggaccg

SEQ ID NO: 240798 - DNA, 20 bp, Artificial Sequence
  Description of Artificial Sequence: Synthetic oligonucleotide
tggggtgcccccgggaccgt

SEQ ID NO: 240799 - DNA, 20 bp, Artificial Sequence
  Description of Artificial Sequence: Synthetic oligonucleotide
ggggtgcccccgggaccgtt

SEQ ID NO: 240800 - DNA, 20 bp, Artificial Sequence
  Description of Artificial Sequence: Synthetic oligonucleotide
gggtgcccccgggaccgctt

SEQ ID NO: 240801 - DNA, 20 bp, Artificial Sequence
  Description of Artificial Sequence: Synthetic oligonucleotide
ggtgcccccgggaccgcgtt

SEQ ID NO: 240802 - DNA, 21 bp, Artificial Sequence
  Description of Artificial Sequence: Synthetic oligonucleotide
gtgcccccgggaccgcggata

SEQ ID NO: 240803 - DNA, 21 bp, Artificial Sequence
  Description of Artificial Sequence: Synthetic oligonucleotide
tgcccccgggaccgcggatac

SEQ ID NO: 240804 - DNA, 20 bp, Artificial Sequence
  Description of Artificial Sequence: Synthetic oligonucleotide
gcccccgggaccgcggatac

SEQ ID NO: 240805 - DNA, 21 bp, Artificial Sequence
  Description of Artificial Sequence: Synthetic oligonucleotide
cccccgggaccgcggatacca

SEQ ID NO: 240806 - DNA, 21 bp, Artificial Sequence
  Description of Artificial Sequence: Synthetic oligonucleotide
ccccgggaccgcggataccac

SEQ ID NO: 240807 - DNA, 22 bp, Artificial Sequence
  Description of Artificial Sequence: Synthetic oligonucleotide
cccgggaccgcggataccacca

SEQ ID NO: 240808 - DNA, 22 bp, Artificial Sequence
  Description of Artificial Sequence: Synthetic oligonucleotide
ccgggaccgcggataccaccag

SEQ ID NO: 240809 - DNA, 22 bp, Artificial Sequence
  Description of Artificial Sequence: Synthetic oligonucleotide
cgggaccgcggataccaccagg

SEQ ID NO: 240810 - DNA, 24 bp, Artificial Sequence
  Description of Artificial Sequence: Synthetic oligonucleotide
gggaccgcggataccaccaggctt

SEQ ID NO: 240811 - DNA, 24 bp, Artificial Sequence
  Description of Artificial Sequence: Synthetic oligonucleotide
ggaccgcggataccaccaggcttc

SEQ ID NO: 240812 - DNA, 24 bp, Artificial Sequence
  Description of Artificial Sequence: Synthetic oligonucleotide
gaccgcggataccaccaggcttcc

SEQ ID NO: 240813 - DNA, 24 bp, Artificial Sequence
  Description of Artificial Sequence: Synthetic oligonucleotide
accgcggataccaccaggcttccg

SEQ ID NO: 240814 - DNA, 23 bp, Artificial Sequence
  Description of Artificial Sequence: Synthetic oligonucleotide
ccgcggataccaccaggcttccg

SEQ ID NO: 240815 - DNA, 24 bp, Artificial Sequence
  Description of Artificial Sequence: Synthetic oligonucleotide
cgcggataccaccaggcttccgca

SEQ ID NO: 240816 - DNA, 25 bp, Artificial Sequence
  Description of Artificial Sequence: Synthetic oligonucleotide
gcggataccaccaggcttccgcact

SEQ ID NO: 240817 - DNA, 25 bp, Artificial Sequence
  Description of Artificial Sequence: Synthetic oligonucleotide
cggataccaccaggcttccgcactg

SEQ ID NO: 240818 - DNA, 25 bp, Artificial Sequence
  Description of Artificial Sequence: Synthetic oligonucleotide
ggataccaccaggcttccgcactgg

SEQ ID NO: 240819 - DNA, 25 bp, Artificial Sequence
  Description of Artificial Sequence: Synthetic oligonucleotide
gataccaccaggcttccgcactggc

SEQ ID NO: 240820 - DNA, 27 bp, Artificial Sequence
  Description of Artificial Sequence: Synthetic oligonucleotide
ataccaccaggcttccgcactggcgaa

SEQ ID NO: 240821 - DNA, 26 bp, Artificial Sequence
  Description of Artificial Sequence: Synthetic oligonucleotide
taccaccaggcttccgcactggcgaa

SEQ ID NO: 240822 - DNA, 25 bp, Artificial Sequence
  Description of Artificial Sequence: Synthetic oligonucleotide
accaccaggcttccgcactggcgaa

SEQ ID NO: 240823 - DNA, 24 bp, Artificial Sequence
  Description of Artificial Sequence: Synthetic oligonucleotide
ccaccaggcttccgcactggcgaa

SEQ ID NO: 240824 - DNA, 25 bp, Artificial Sequence
  Description of Artificial Sequence: Synthetic oligonucleotide
caccaggcttccgcactggcgaagt

SEQ ID NO: 240825 - DNA, 26 bp, Artificial Sequence
  Description of Artificial Sequence: Synthetic oligonucleotide
accaggcttccgcactggcgaagtca

SEQ ID NO: 240826 - DNA, 25 bp, Artificial Sequence
  Description of Artificial Sequence: Synthetic oligonucleotide
ccaggcttccgcactggcgaagtca

SEQ ID NO: 240827 - DNA, 25 bp, Artificial Sequence
  Description of Artificial Sequence: Synthetic oligonucleotide
caggcttccgcactggcgaagtcac

SEQ ID NO: 240828 - DNA, 25 bp, Artificial Sequence
  Description of Artificial Sequence: Synthetic oligonucleotide
aggcttccgcactggcgaagtcacc

SEQ ID NO: 240829 - DNA, 24 bp, Artificial Sequence
  Description of Artificial Sequence: Synthetic oligonucleotide
ggcttccgcactggcgaagtcacc

SEQ ID NO: 240830 - DNA, 26 bp, Artificial Sequence
  Description of Artificial Sequence: Synthetic oligonucleotide
gcttccgcactggcgaagtcaccgta

SEQ ID NO: 240831 - DNA, 26 bp, Artificial Sequence
  Description of Artificial Sequence: Synthetic oligonucleotide
cttccgcactggcgaagtcaccgtac

SEQ ID NO: 240832 - DNA, 26 bp, Artificial Sequence
  Description of Artificial Sequence: Synthetic oligonucleotide
ttccgcactggcgaagtcaccgtacc

SEQ ID NO: 240833 - DNA, 25 bp, Artificial Sequence
  Description of Artificial Sequence: Synthetic oligonucleotide
tccgcactggcgaagtcaccgtacc

SEQ ID NO: 240834 - DNA, 24 bp, Artificial Sequence
  Description of Artificial Sequence: Synthetic oligonucleotide
ccgcactggcgaagtcaccgtacc

SEQ ID NO: 240835 - DNA, 24 bp, Artificial Sequence
  Description of Artificial Sequence: Synthetic oligonucleotide
cgcactggcgaagtcaccgtaccg

SEQ ID NO: 240836 - DNA, 24 bp, Artificial Sequence
  Description of Artificial Sequence: Synthetic oligonucleotide
gcactggcgaagtcaccgtaccgc

SEQ ID NO: 240837 - DNA, 26 bp, Artificial Sequence
  Description of Artificial Sequence: Synthetic oligonucleotide
cactggcgaagtcaccgtaccgcctt

SEQ ID NO: 240838 - DNA, 26 bp, Artificial Sequence
  Description of Artificial Sequence: Synthetic oligonucleotide
actggcgaagtcaccgtaccgccttg

SEQ ID NO: 240839 - DNA, 25 bp, Artificial Sequence
  Description of Artificial Sequence: Synthetic oligonucleotide
ctggcgaagtcaccgtaccgccttg

SEQ ID NO: 240840 - DNA, 26 bp, Artificial Sequence
  Description of Artificial Sequence: Synthetic oligonucleotide
tggcgaagtcaccgtaccgccttggt

SEQ ID NO: 240841 - DNA, 25 bp, Artificial Sequence
  Description of Artificial Sequence: Synthetic oligonucleotide
ggcgaagtcaccgtaccgccttggt

SEQ ID NO: 240842 - DNA, 25 bp, Artificial Sequence
  Description of Artificial Sequence: Synthetic oligonucleotide
gcgaagtcaccgtaccgccttggtc

SEQ ID NO: 240843 - DNA, 26 bp, Artificial Sequence
  Description of Artificial Sequence: Synthetic oligonucleotide
cgaagtcaccgtaccgccttggtcgt

SEQ ID NO: 240844 - DNA, 27 bp, Artificial Sequence
  Description of Artificial Sequence: Synthetic oligonucleotide
gaagtcaccgtaccgccttggtcgtca

SEQ ID NO: 240845 - DNA, 27 bp, Artificial Sequence
  Description of Artificial Sequence: Synthetic oligonucleotide
aagtcaccgtaccgccttggtcgtcag

SEQ ID NO: 240846 - DNA, 27 bp, Artificial Sequence
  Description of Artificial Sequence: Synthetic oligonucleotide
agtcaccgtaccgccttggtcgtcagt

SEQ ID NO: 240847 - DNA, 27 bp, Artificial Sequence
  Description of Artificial Sequence: Synthetic oligonucleotide
gtcaccgtaccgccttggtcgtcagta

SEQ ID NO: 240848 - DNA, 29 bp, Artificial Sequence
  Description of Artificial Sequence: Synthetic oligonucleotide
tcaccgtaccgccttggtcgtcagtaatg

SEQ ID NO: 240849 - DNA, 28 bp, Artificial Sequence
  Description of Artificial Sequence: Synthetic oligonucleotide
caccgtaccgccttggtcgtcagtaatg

SEQ ID NO: 240850 - DNA, 28 bp, Artificial Sequence
  Description of Artificial Sequence: Synthetic oligonucleotide
accgtaccgccttggtcgtcagtaatgc

SEQ ID NO: 240851 - DNA, 27 bp, Artificial Sequence
  Description of Artificial Sequence: Synthetic oligonucleotide
ccgtaccgccttggtcgtcagtaatgc

SEQ ID NO: 240852 - DNA, 28 bp, Artificial Sequence
  Description of Artificial Sequence: Synthetic oligonucleotide
cgtaccgccttggtcgtcagtaatgcag

SEQ ID NO: 240853 - DNA, 28 bp, Artificial Sequence
  Description of Artificial Sequence: Synthetic oligonucleotide
gtaccgccttggtcgtcagtaatgcagc

SEQ ID NO: 240854 - DNA, 28 bp, Artificial Sequence
  Description of Artificial Sequence: Synthetic oligonucleotide
taccgccttggtcgtcagtaatgcagcg

SEQ ID NO: 240855 - DNA, 27 bp, Artificial Sequence
  Description of Artificial Sequence: Synthetic oligonucleotide
accgccttggtcgtcagtaatgcagcg

SEQ ID NO: 240856 - DNA, 26 bp, Artificial Sequence
  Description of Artificial Sequence: Synthetic oligonucleotide
ccgccttggtcgtcagtaatgcagcg

SEQ ID NO: 240857 - DNA, 26 bp, Artificial Sequence
  Description of Artificial Sequence: Synthetic oligonucleotide
cgccttggtcgtcagtaatgcagcgg

SEQ ID NO: 240858 - DNA, 27 bp, Artificial Sequence
  Description of Artificial Sequence: Synthetic oligonucleotide
gccttggtcgtcagtaatgcagcggga

SEQ ID NO: 240859 - DNA, 27 bp, Artificial Sequence
  Description of Artificial Sequence: Synthetic oligonucleotide
ccttggtcgtcagtaatgcagcgggac

SEQ ID NO: 240860 - DNA, 28 bp, Artificial Sequence
  Description of Artificial Sequence: Synthetic oligonucleotide
cttggtcgtcagtaatgcagcgggactg

SEQ ID NO: 240861 - DNA, 28 bp, Artificial Sequence
  Description of Artificial Sequence: Synthetic oligonucleotide
ttggtcgtcagtaatgcagcgggactgc

SEQ ID NO: 240862 - DNA, 27 bp, Artificial Sequence
  Description of Artificial Sequence: Synthetic oligonucleotide
tggtcgtcagtaatgcagcgggactgc

SEQ ID NO: 240863 - DNA, 26 bp, Artificial Sequence
  Description of Artificial Sequence: Synthetic oligonucleotide
ggtcgtcagtaatgcagcgggactgc

SEQ ID NO: 240864 - DNA, 26 bp, Artificial Sequence
  Description of Artificial Sequence: Synthetic oligonucleotide
gtcgtcagtaatgcagcgggactgcc

SEQ ID NO: 240865 - DNA, 26 bp, Artificial Sequence
  Description of Artificial Sequence: Synthetic oligonucleotide
tcgtcagtaatgcagcgggactgccc

SEQ ID NO: 240866 - DNA, 25 bp, Artificial Sequence
  Description of Artificial Sequence: Synthetic oligonucleotide
cgtcagtaatgcagcgggactgccc

SEQ ID NO: 240867 - DNA, 25 bp, Artificial Sequence
  Description of Artificial Sequence: Synthetic oligonucleotide
gtcagtaatgcagcgggactgcccg

SEQ ID NO: 240868 - DNA, 26 bp, Artificial Sequence
  Description of Artificial Sequence: Synthetic oligonucleotide
tcagtaatgcagcgggactgcccgct

SEQ ID NO: 240869 - DNA, 25 bp, Artificial Sequence
  Description of Artificial Sequence: Synthetic oligonucleotide
cagtaatgcagcgggactgcccgct

SEQ ID NO: 240870 - DNA, 25 bp, Artificial Sequence
  Description of Artificial Sequence: Synthetic oligonucleotide
agtaatgcagcgggactgcccgctg

SEQ ID NO: 240871 - DNA, 24 bp, Artificial Sequence
  Description of Artificial Sequence: Synthetic oligonucleotide
gtaatgcagcgggactgcccgctg

SEQ ID NO: 240872 - DNA, 25 bp, Artificial Sequence
  Description of Artificial Sequence: Synthetic oligonucleotide
taatgcagcgggactgcccgctgca

SEQ ID NO: 240873 - DNA, 24 bp, Artificial Sequence
  Description of Artificial Sequence: Synthetic oligonucleotide
aatgcagcgggactgcccgctgca

SEQ ID NO: 240874 - DNA, 23 bp, Artificial Sequence
  Description of Artificial Sequence: Synthetic oligonucleotide
atgcagcgggactgcccgctgca

SEQ ID NO: 240875 - DNA, 22 bp, Artificial Sequence
  Description of Artificial Sequence: Synthetic oligonucleotide
tgcagcgggactgcccgctgca

SEQ ID NO: 240876 - DNA, 21 bp, Artificial Sequence
  Description of Artificial Sequence: Synthetic oligonucleotide
gcagcgggactgcccgctgca

SEQ ID NO: 240877 - DNA, 21 bp, Artificial Sequence
  Description of Artificial Sequence: Synthetic oligonucleotide
cagcgggactgcccgctgcag

SEQ ID NO: 240878 - DNA, 21 bp, Artificial Sequence
  Description of Artificial Sequence: Synthetic oligonucleotide
agcgggactgcccgctgcagc

SEQ ID NO: 240879 - DNA, 20 bp, Artificial Sequence
  Description of Artificial Sequence: Synthetic oligonucleotide
gcgggactgcccgctgcagc

SEQ ID NO: 240880 - DNA, 20 bp, Artificial Sequence
  Description of Artificial Sequence: Synthetic oligonucleotide
cgggactgcccgctgcagcc

SEQ ID NO: 240881 - DNA, 21 bp, Artificial Sequence
  Description of Artificial Sequence: Synthetic oligonucleotide
gggactgcccgctgcagccct

SEQ ID NO: 240882 - DNA, 22 bp, Artificial Sequence
  Description of Artificial Sequence: Synthetic oligonucleotide
ggactgcccgctgcagccctga

SEQ ID NO: 240883 - DNA, 22 bp, Artificial Sequence
  Description of Artificial Sequence: Synthetic oligonucleotide
gactgcccgctgcagccctgag

SEQ ID NO: 240884 - DNA, 22 bp, Artificial Sequence
  Description of Artificial Sequence: Synthetic oligonucleotide
actgcccgctgcagccctgagg

SEQ ID NO: 240885 - DNA, 21 bp, Artificial Sequence
  Description of Artificial Sequence: Synthetic oligonucleotide
ctgcccgctgcagccctgagg

SEQ ID NO: 240886 - DNA, 22 bp, Artificial Sequence
  Description of Artificial Sequence: Synthetic oligonucleotide
tgcccgctgcagccctgaggca

SEQ ID NO: 240887 - DNA, 21 bp, Artificial Sequence
  Description of Artificial Sequence: Synthetic oligonucleotide
gcccgctgcagccctgaggca

SEQ ID NO: 240888 - DNA, 24 bp, Artificial Sequence
  Description of Artificial Sequence: Synthetic oligonucleotide
cccgctgcagccctgaggcacaaa

SEQ ID NO: 240889 - DNA, 25 bp, Artificial Sequence
  Description of Artificial Sequence: Synthetic oligonucleotide
ccgctgcagccctgaggcacaaaca

SEQ ID NO: 240890 - DNA, 25 bp, Artificial Sequence
  Description of Artificial Sequence: Synthetic oligonucleotide
cgctgcagccctgaggcacaaacac

SEQ ID NO: 240891 - DNA, 25 bp, Artificial Sequence
  Description of Artificial Sequence: Synthetic oligonucleotide
gctgcagccctgaggcacaaacacg

SEQ ID NO: 240892 - DNA, 25 bp, Artificial Sequence
  Description of Artificial Sequence: Synthetic oligonucleotide
ctgcagccctgaggcacaaacacgg

SEQ ID NO: 240893 - DNA, 26 bp, Artificial Sequence
  Description of Artificial Sequence: Synthetic oligonucleotide
tgcagccctgaggcacaaacacggga

SEQ ID NO: 240894 - DNA, 25 bp, Artificial Sequence
  Description of Artificial Sequence: Synthetic oligonucleotide
gcagccctgaggcacaaacacggga

SEQ ID NO: 240895 - DNA, 25 bp, Artificial Sequence
  Description of Artificial Sequence: Synthetic oligonucleotide
cagccctgaggcacaaacacgggag

SEQ ID NO: 240896 - DNA, 25 bp, Artificial Sequence
  Description of Artificial Sequence: Synthetic oligonucleotide
agccctgaggcacaaacacgggagc

SEQ ID NO: 240897 - DNA, 24 bp, Artificial Sequence
  Description of Artificial Sequence: Synthetic oligonucleotide
gccctgaggcacaaacacgggagc

SEQ ID NO: 240898 - DNA, 25 bp, Artificial Sequence
  Description of Artificial Sequence: Synthetic oligonucleotide
ccctgaggcacaaacacgggagcct

SEQ ID NO: 240899 - DNA, 26 bp, Artificial Sequence
  Description of Artificial Sequence: Synthetic oligonucleotide
cctgaggcacaaacacgggagcctgt

SEQ ID NO: 240900 - DNA, 26 bp, Artificial Sequence
  Description of Artificial Sequence: Synthetic oligonucleotide
ctgaggcacaaacacgggagcctgtg

SEQ ID NO: 240901 - DNA, 26 bp, Artificial Sequence
  Description of Artificial Sequence: Synthetic oligonucleotide
tgaggcacaaacacgggagcctgtgg

SEQ ID NO: 240902 - DNA, 25 bp, Artificial Sequence
  Description of Artificial Sequence: Synthetic oligonucleotide
gaggcacaaacacgggagcctgtgg

SEQ ID NO: 240903 - DNA, 26 bp, Artificial Sequence
  Description of Artificial Sequence: Synthetic oligonucleotide
aggcacaaacacgggagcctgtgggt

SEQ ID NO: 240904 - DNA, 25 bp, Artificial Sequence
  Description of Artificial Sequence: Synthetic oligonucleotide
ggcacaaacacgggagcctgtgggt

SEQ ID NO: 240905 - DNA, 25 bp, Artificial Sequence
  Description of Artificial Sequence: Synthetic oligonucleotide
gcacaaacacgggagcctgtgggtg

SEQ ID NO: 240906 - DNA, 25 bp, Artificial Sequence
  Description of Artificial Sequence: Synthetic oligonucleotide
cacaaacacgggagcctgtgggtgc

SEQ ID NO: 240907 - DNA, 25 bp, Artificial Sequence
  Description of Artificial Sequence: Synthetic oligonucleotide
acaaacacgggagcctgtgggtgcc

SEQ ID NO: 240908 - DNA, 24 bp, Artificial Sequence
  Description of Artificial Sequence: Synthetic oligonucleotide
caaacacgggagcctgtgggtgcc

SEQ ID NO: 240909 - DNA, 24 bp, Artificial Sequence
  Description of Artificial Sequence: Synthetic oligonucleotide
aaacacgggagcctgtgggtgccc

SEQ ID NO: 240910 - DNA, 23 bp, Artificial Sequence
  Description of Artificial Sequence: Synthetic oligonucleotide
aacacgggagcctgtgggtgccc

SEQ ID NO: 240911 - DNA, 22 bp, Artificial Sequence
  Description of Artificial Sequence: Synthetic oligonucleotide
acacgggagcctgtgggtgccc

SEQ ID NO: 240912 - DNA, 21 bp, Artificial Sequence
  Description of Artificial Sequence: Synthetic oligonucleotide
cacgggagcctgtgggtgccc

SEQ ID NO: 240913 - DNA, 21 bp, Artificial Sequence
  Description of Artificial Sequence: Synthetic oligonucleotide
acgggagcctgtgggtgcccc

SEQ ID NO: 240914 - DNA, 20 bp, Artificial Sequence
  Description of Artificial Sequence: Synthetic oligonucleotide
cgggagcctgtgggtgcccc

SEQ ID NO: 240915 - DNA, 20 bp, Artificial Sequence
  Description of Artificial Sequence: Synthetic oligonucleotide
gggagcctgtgggtgccccg

SEQ ID NO: 240916 - DNA, 20 bp, Artificial Sequence
  Description of Artificial Sequence: Synthetic oligonucleotide
ggagcctgtgggtgccccgc

SEQ ID NO: 240917 - DNA, 20 bp, Artificial Sequence
  Description of Artificial Sequence: Synthetic oligonucleotide
gagcctgtgggtgccccgcg

SEQ ID NO: 240918 - DNA, 21 bp, Artificial Sequence
  Description of Artificial Sequence: Synthetic oligonucleotide
agcctgtgggtgccccgcggt

SEQ ID NO: 240919 - DNA, 20 bp, Artificial Sequence
  Description of Artificial Sequence: Synthetic oligonucleotide
gcctgtgggtgccccgcggt

SEQ ID NO: 240920 - DNA, 21 bp, Artificial Sequence
  Description of Artificial Sequence: Synthetic oligonucleotide
cctgtgggtgccccgcggtca

SEQ ID NO: 240921 - DNA, 21 bp, Artificial Sequence
  Description of Artificial Sequence: Synthetic oligonucleotide
ctgtgggtgccccgcggtcag

SEQ ID NO: 240922 - DNA, 21 bp, Artificial Sequence
  Description of Artificial Sequence: Synthetic oligonucleotide
tgtgggtgccccgcggtcagg

SEQ ID NO: 240923 - DNA, 20 bp, Artificial Sequence
  Description of Artificial Sequence: Synthetic oligonucleotide
gtgggtgccccgcggtcagg

SEQ ID NO: 240924 - DNA, 20 bp, Artificial Sequence
  Description of Artificial Sequence: Synthetic oligonucleotide
tgggtgccccgcggtcaggc

SEQ ID NO: 240925 - DNA, 20 bp, Artificial Sequence
  Description of Artificial Sequence: Synthetic oligonucleotide
gggtgccccgcggtcaggct

SEQ ID NO: 240926 - DNA, 20 bp, Artificial Sequence
  Description of Artificial Sequence: Synthetic oligonucleotide
ggtgccccgcggtcaggcct

SEQ ID NO: 240927 - DNA, 20 bp, Artificial Sequence
  Description of Artificial Sequence: Synthetic oligonucleotide
gtgccccgcggtcaggccgt

SEQ ID NO: 240928 - DNA, 20 bp, Artificial Sequence
  Description of Artificial Sequence: Synthetic oligonucleotide
tgccccgcggtcaggccggt

SEQ ID NO: 240929 - DNA, 20 bp, Artificial Sequence
  Description of Artificial Sequence: Synthetic oligonucleotide
gccccgcggtcaggccggtt

SEQ ID NO: 240930 - DNA, 20 bp, Artificial Sequence
  Description of Artificial Sequence: Synthetic oligonucleotide
ccccgcggtcaggccggctt

SEQ ID NO: 240931 - DNA, 20 bp, Artificial Sequence
  Description of Artificial Sequence: Synthetic oligonucleotide
cccgcggtcaggccggctct

SEQ ID NO: 240932 - DNA, 20 bp, Artificial Sequence
  Description of Artificial Sequence: Synthetic oligonucleotide
ccgcggtcaggccggctctg

SEQ ID NO: 240933 - DNA, 23 bp, Artificial Sequence
  Description of Artificial Sequence: Synthetic oligonucleotide
cgcggtcaggccggctctggtaa

SEQ ID NO: 240934 - DNA, 23 bp, Artificial Sequence
  Description of Artificial Sequence: Synthetic oligonucleotide
gcggtcaggccggctctggtaac

SEQ ID NO: 240935 - DNA, 23 bp, Artificial Sequence
  Description of Artificial Sequence: Synthetic oligonucleotide
cggtcaggccggctctggtaacc

SEQ ID NO: 240936 - DNA, 24 bp, Artificial Sequence
  Description of Artificial Sequence: Synthetic oligonucleotide
ggtcaggccggctctggtaaccct

SEQ ID NO: 240937 - DNA, 25 bp, Artificial Sequence
  Description of Artificial Sequence: Synthetic oligonucleotide
gtcaggccggctctggtaaccctgt

SEQ ID NO: 240938 - DNA, 25 bp, Artificial Sequence
  Description of Artificial Sequence: Synthetic oligonucleotide
tcaggccggctctggtaaccctgtg

SEQ ID NO: 240939 - DNA, 24 bp, Artificial Sequence
  Description of Artificial Sequence: Synthetic oligonucleotide
caggccggctctggtaaccctgtg

SEQ ID NO: 240940 - DNA, 24 bp, Artificial Sequence
  Description of Artificial Sequence: Synthetic oligonucleotide
aggccggctctggtaaccctgtgg

SEQ ID NO: 240941 - DNA, 23 bp, Artificial Sequence
  Description of Artificial Sequence: Synthetic oligonucleotide
ggccggctctggtaaccctgtgg

SEQ ID NO: 240942 - DNA, 24 bp, Artificial Sequence
  Description of Artificial Sequence: Synthetic oligonucleotide
gccggctctggtaaccctgtgggt

SEQ ID NO: 240943 - DNA, 24 bp, Artificial Sequence
  Description of Artificial Sequence: Synthetic oligonucleotide
ccggctctggtaaccctgtgggtc

SEQ ID NO: 240944 - DNA, 24 bp, Artificial Sequence
  Description of Artificial Sequence: Synthetic oligonucleotide
cggctctggtaaccctgtgggtcg

SEQ ID NO: 240945 - DNA, 24 bp, Artificial Sequence
  Description of Artificial Sequence: Synthetic oligonucleotide
ggctctggtaaccctgtgggtcgg

SEQ ID NO: 240946 - DNA, 26 bp, Artificial Sequence
  Description of Artificial Sequence: Synthetic oligonucleotide
gctctggtaaccctgtgggtcggctt

SEQ ID NO: 240947 - DNA, 27 bp, Artificial Sequence
  Description of Artificial Sequence: Synthetic oligonucleotide
ctctggtaaccctgtgggtcggcttca

SEQ ID NO: 240948 - DNA, 28 bp, Artificial Sequence
  Description of Artificial Sequence: Synthetic oligonucleotide
tctggtaaccctgtgggtcggcttcaag

SEQ ID NO: 240949 - DNA, 27 bp, Artificial Sequence
  Description of Artificial Sequence: Synthetic oligonucleotide
ctggtaaccctgtgggtcggcttcaag

SEQ ID NO: 240950 - DNA, 27 bp, Artificial Sequence
  Description of Artificial Sequence: Synthetic oligonucleotide
tggtaaccctgtgggtcggcttcaagg

SEQ ID NO: 240951 - DNA, 26 bp, Artificial Sequence
  Description of Artificial Sequence: Synthetic oligonucleotide
ggtaaccctgtgggtcggcttcaagg

SEQ ID NO: 240952 - DNA, 27 bp, Artificial Sequence
  Description of Artificial Sequence: Synthetic oligonucleotide
gtaaccctgtgggtcggcttcaaggct

SEQ ID NO: 240953 - DNA, 27 bp, Artificial Sequence
  Description of Artificial Sequence: Synthetic oligonucleotide
taaccctgtgggtcggcttcaaggctg

SEQ ID NO: 240954 - DNA, 26 bp, Artificial Sequence
  Description of Artificial Sequence: Synthetic oligonucleotide
aaccctgtgggtcggcttcaaggctg

SEQ ID NO: 240955 - DNA, 25 bp, Artificial Sequence
  Description of Artificial Sequence: Synthetic oligonucleotide
accctgtgggtcggcttcaaggctg

SEQ ID NO: 240956 - DNA, 24 bp, Artificial Sequence
  Description of Artificial Sequence: Synthetic oligonucleotide
ccctgtgggtcggcttcaaggctg

SEQ ID NO: 240957 - DNA, 24 bp, Artificial Sequence
  Description of Artificial Sequence: Synthetic oligonucleotide
cctgtgggtcggcttcaaggctgc

SEQ ID NO: 240958 - DNA, 25 bp, Artificial Sequence
  Description of Artificial Sequence: Synthetic oligonucleotide
ctgtgggtcggcttcaaggctgcct

SEQ ID NO: 240959 - DNA, 25 bp, Artificial Sequence
  Description of Artificial Sequence: Synthetic oligonucleotide
tgtgggtcggcttcaaggctgcctc

SEQ ID NO: 240960 - DNA, 24 bp, Artificial Sequence
  Description of Artificial Sequence: Synthetic oligonucleotide
gtgggtcggcttcaaggctgcctc

SEQ ID NO: 240961 - DNA, 24 bp, Artificial Sequence
  Description of Artificial Sequence: Synthetic oligonucleotide
tgggtcggcttcaaggctgcctcg

SEQ ID NO: 240962 - DNA, 23 bp, Artificial Sequence
  Description of Artificial Sequence: Synthetic oligonucleotide
gggtcggcttcaaggctgcctcg

SEQ ID NO: 240963 - DNA, 23 bp, Artificial Sequence
  Description of Artificial Sequence: Synthetic oligonucleotide
ggtcggcttcaaggctgcctcgg

SEQ ID NO: 240964 - DNA, 24 bp, Artificial Sequence
  Description of Artificial Sequence: Synthetic oligonucleotide
gtcggcttcaaggctgcctcggct

SEQ ID NO: 240965 - DNA, 24 bp, Artificial Sequence
  Description of Artificial Sequence: Synthetic oligonucleotide
tcggcttcaaggctgcctcggctc

SEQ ID NO: 240966 - DNA, 23 bp, Artificial Sequence
  Description of Artificial Sequence: Synthetic oligonucleotide
cggcttcaaggctgcctcggctc

SEQ ID NO: 240967 - DNA, 23 bp, Artificial Sequence
  Description of Artificial Sequence: Synthetic oligonucleotide
ggcttcaaggctgcctcggctcg

SEQ ID NO: 240968 - DNA, 24 bp, Artificial Sequence
  Description of Artificial Sequence: Synthetic oligonucleotide
gcttcaaggctgcctcggctcgga

SEQ ID NO: 240969 - DNA, 25 bp, Artificial Sequence
  Description of Artificial Sequence: Synthetic oligonucleotide
cttcaaggctgcctcggctcggagt

SEQ ID NO: 240970 - DNA, 25 bp, Artificial Sequence
  Description of Artificial Sequence: Synthetic oligonucleotide
ttcaaggctgcctcggctcggagtc

SEQ ID NO: 240971 - DNA, 24 bp, Artificial Sequence
  Description of Artificial Sequence: Synthetic oligonucleotide
tcaaggctgcctcggctcggagtc

SEQ ID NO: 240972 - DNA, 23 bp, Artificial Sequence
  Description of Artificial Sequence: Synthetic oligonucleotide
caaggctgcctcggctcggagtc

SEQ ID NO: 240973 - DNA, 23 bp, Artificial Sequence
  Description of Artificial Sequence: Synthetic oligonucleotide
aaggctgcctcggctcggagtcg

SEQ ID NO: 240974 - DNA, 22 bp, Artificial Sequence
  Description of Artificial Sequence: Synthetic oligonucleotide
aggctgcctcggctcggagtcg

SEQ ID NO: 240975 - DNA, 21 bp, Artificial Sequence
  Description of Artificial Sequence: Synthetic oligonucleotide
ggctgcctcggctcggagtcg

SEQ ID NO: 240976 - DNA, 21 bp, Artificial Sequence
  Description of Artificial Sequence: Synthetic oligonucleotide
gctgcctcggctcggagtcgc

SEQ ID NO: 240977 - DNA, 21 bp, Artificial Sequence
  Description of Artificial Sequence: Synthetic oligonucleotide
ctgcctcggctcggagtcgcg

SEQ ID NO: 240978 - DNA, 21 bp, Artificial Sequence
  Description of Artificial Sequence: Synthetic oligonucleotide
tgcctcggctcggagtcgcgc

SEQ ID NO: 240979 - DNA, 20 bp, Artificial Sequence
  Description of Artificial Sequence: Synthetic oligonucleotide
gcctcggctcggagtcgcgc

SEQ ID NO: 240980 - DNA, 20 bp, Artificial Sequence
  Description of Artificial Sequence: Synthetic oligonucleotide
cctcggctcggagtcgcgcc

SEQ ID NO: 240981 - DNA, 20 bp, Artificial Sequence
  Description of Artificial Sequence: Synthetic oligonucleotide
ctcggctcggagtcgcgccg

SEQ ID NO: 240982 - DNA, 20 bp, Artificial Sequence
  Description of Artificial Sequence: Synthetic oligonucleotide
tcggctcggagtcgcgccgc

SEQ ID NO: 240983 - DNA, 20 bp, Artificial Sequence
  Description of Artificial Sequence: Synthetic oligonucleotide
cggctcggagtcgcgccgct

SEQ ID NO: 240984 - DNA, 20 bp, Artificial Sequence
  Description of Artificial Sequence: Synthetic oligonucleotide
ggctcggagtcgcgccgcca

SEQ ID NO: 240985 - DNA, 21 bp, Artificial Sequence
  Description of Artificial Sequence: Synthetic oligonucleotide
gctcggagtcgcgccgccact

SEQ ID NO: 240986 - DNA, 21 bp, Artificial Sequence
  Description of Artificial Sequence: Synthetic oligonucleotide
ctcggagtcgcgccgccactc

SEQ ID NO: 240987 - DNA, 21 bp, Artificial Sequence
  Description of Artificial Sequence: Synthetic oligonucleotide
tcggagtcgcgccgccactcg

SEQ ID NO: 240988 - DNA, 20 bp, Artificial Sequence
  Description of Artificial Sequence: Synthetic oligonucleotide
cggagtcgcgccgccactcg

SEQ ID NO: 240989 - DNA, 21 bp, Artificial Sequence
  Description of Artificial Sequence: Synthetic oligonucleotide
ggagtcgcgccgccactcgct

SEQ ID NO: 240990 - DNA, 23 bp, Artificial Sequence
  Description of Artificial Sequence: Synthetic oligonucleotide
gagtcgcgccgccactcgctgtt

SEQ ID NO: 240991 - DNA, 23 bp, Artificial Sequence
  Description of Artificial Sequence: Synthetic oligonucleotide
agtcgcgccgccactcgctgttg

SEQ ID NO: 240992 - DNA, 22 bp, Artificial Sequence
  Description of Artificial Sequence: Synthetic oligonucleotide
gtcgcgccgccactcgctgttg

SEQ ID NO: 240993 - DNA, 23 bp, Artificial Sequence
  Description of Artificial Sequence: Synthetic oligonucleotide
tcgcgccgccactcgctgttgct

SEQ ID NO: 240994 - DNA, 22 bp, Artificial Sequence
  Description of Artificial Sequence: Synthetic oligonucleotide
cgcgccgccactcgctgttgct

SEQ ID NO: 240995 - DNA, 22 bp, Artificial Sequence
  Description of Artificial Sequence: Synthetic oligonucleotide
gcgccgccactcgctgttgctg

SEQ ID NO: 240996 - DNA, 23 bp, Artificial Sequence
  Description of Artificial Sequence: Synthetic oligonucleotide
cgccgccactcgctgttgctggt

SEQ ID NO: 240997 - DNA, 23 bp, Artificial Sequence
  Description of Artificial Sequence: Synthetic oligonucleotide
gccgccactcgctgttgctggtc

SEQ ID NO: 240998 - DNA, 24 bp, Artificial Sequence
  Description of Artificial Sequence: Synthetic oligonucleotide
ccgccactcgctgttgctggtcct

SEQ ID NO: 240999 - DNA, 24 bp, Artificial Sequence
  Description of Artificial Sequence: Synthetic oligonucleotide
cgccactcgctgttgctggtcctg

SEQ ID NO: 241000 - DNA, 25 bp, Artificial Sequence
  Description of Artificial Sequence: Synthetic oligonucleotide
gccactcgctgttgctggtcctgct

SEQ ID NO: 241001 - DNA, 25 bp, Artificial Sequence
  Description of Artificial Sequence: Synthetic oligonucleotide
ccactcgctgttgctggtcctgctg

SEQ ID NO: 241002 - DNA, 26 bp, Artificial Sequence
  Description of Artificial Sequence: Synthetic oligonucleotide
cactcgctgttgctggtcctgctggt

SEQ ID NO: 241003 - DNA, 26 bp, Artificial Sequence
  Description of Artificial Sequence: Synthetic oligonucleotide
actcgctgttgctggtcctgctggtc

SEQ ID NO: 241004 - DNA, 25 bp, Artificial Sequence
  Description of Artificial Sequence: Synthetic oligonucleotide
ctcgctgttgctggtcctgctggtc

SEQ ID NO: 241005 - DNA, 26 bp, Artificial Sequence
  Description of Artificial Sequence: Synthetic oligonucleotide
tcgctgttgctggtcctgctggtcct

SEQ ID NO: 241006 - DNA, 25 bp, Artificial Sequence
  Description of Artificial Sequence: Synthetic oligonucleotide
cgctgttgctggtcctgctggtcct

SEQ ID NO: 241007 - DNA, 26 bp, Artificial Sequence
  Description of Artificial Sequence: Synthetic oligonucleotide
gctgttgctggtcctgctggtcctct

SEQ ID NO: 241008 - DNA, 26 bp, Artificial Sequence
  Description of Artificial Sequence: Synthetic oligonucleotide
ctgttgctggtcctgctggtcctctg

SEQ ID NO: 241009 - DNA, 27 bp, Artificial Sequence
  Description of Artificial Sequence: Synthetic oligonucleotide
tgttgctggtcctgctggtcctctgct

SEQ ID NO: 241010 - DNA, 26 bp, Artificial Sequence
  Description of Artificial Sequence: Synthetic oligonucleotide
gttgctggtcctgctggtcctctgct

SEQ ID NO: 241011 - DNA, 27 bp, Artificial Sequence
  Description of Artificial Sequence: Synthetic oligonucleotide
ttgctggtcctgctggtcctctgctct

SEQ ID NO: 241012 - DNA, 26 bp, Artificial Sequence
  Description of Artificial Sequence: Synthetic oligonucleotide
tgctggtcctgctggtcctctgctct

SEQ ID NO: 241013 - DNA, 25 bp, Artificial Sequence
  Description of Artificial Sequence: Synthetic oligonucleotide
gctggtcctgctggtcctctgctct

SEQ ID NO: 241014 - DNA, 27 bp, Artificial Sequence
  Description of Artificial Sequence: Synthetic oligonucleotide
ctggtcctgctggtcctctgctctctt

SEQ ID NO: 241015 - DNA, 27 bp, Artificial Sequence
  Description of Artificial Sequence: Synthetic oligonucleotide
tggtcctgctggtcctctgctctcttg

SEQ ID NO: 241016 - DNA, 26 bp, Artificial Sequence
  Description of Artificial Sequence: Synthetic oligonucleotide
ggtcctgctggtcctctgctctcttg

SEQ ID NO: 241017 - DNA, 26 bp, Artificial Sequence
  Description of Artificial Sequence: Synthetic oligonucleotide
gtcctgctggtcctctgctctcttgg

SEQ ID NO: 241018 - DNA, 26 bp, Artificial Sequence
  Description of Artificial Sequence: Synthetic oligonucleotide
tcctgctggtcctctgctctcttggc

SEQ ID NO: 241019 - DNA, 25 bp, Artificial Sequence
  Description of Artificial Sequence: Synthetic oligonucleotide
cctgctggtcctctgctctcttggc

SEQ ID NO: 241020 - DNA, 26 bp, Artificial Sequence
  Description of Artificial Sequence: Synthetic oligonucleotide
ctgctggtcctctgctctcttggcga

SEQ ID NO: 241021 - DNA, 27 bp, Artificial Sequence
  Description of Artificial Sequence: Synthetic oligonucleotide
tgctggtcctctgctctcttggcgaga

SEQ ID NO: 241022 - DNA, 27 bp, Artificial Sequence
  Description of Artificial Sequence: Synthetic oligonucleotide
gctggtcctctgctctcttggcgagat

SEQ ID NO: 241023 - DNA, 27 bp, Artificial Sequence
  Description of Artificial Sequence: Synthetic oligonucleotide
ctggtcctctgctctcttggcgagatg

SEQ ID NO: 241024 - DNA, 27 bp, Artificial Sequence
  Description of Artificial Sequence: Synthetic oligonucleotide
tggtcctctgctctcttggcgagatgg

SEQ ID NO: 241025 - DNA, 26 bp, Artificial Sequence
  Description of Artificial Sequence: Synthetic oligonucleotide
ggtcctctgctctcttggcgagatgg

SEQ ID NO: 241026 - DNA, 26 bp, Artificial Sequence
  Description of Artificial Sequence: Synthetic oligonucleotide
gtcctctgctctcttggcgagatggc

SEQ ID NO: 241027 - DNA, 27 bp, Artificial Sequence
  Description of Artificial Sequence: Synthetic oligonucleotide
tcctctgctctcttggcgagatggcct

SEQ ID NO: 241028 - DNA, 27 bp, Artificial Sequence
  Description of Artificial Sequence: Synthetic oligonucleotide
cctctgctctcttggcgagatggcctt

SEQ ID NO: 241029 - DNA, 28 bp, Artificial Sequence
  Description of Artificial Sequence: Synthetic oligonucleotide
ctctgctctcttggcgagatggcctttc

SEQ ID NO: 241030 - DNA, 28 bp, Artificial Sequence
  Description of Artificial Sequence: Synthetic oligonucleotide
tctgctctcttggcgagatggcctttcc

SEQ ID NO: 241031 - DNA, 27 bp, Artificial Sequence
  Description of Artificial Sequence: Synthetic oligonucleotide
ctgctctcttggcgagatggcctttcc

SEQ ID NO: 241032 - DNA, 30 bp, Artificial Sequence
  Description of Artificial Sequence: Synthetic oligonucleotide
tgctctcttggcgagatggcctttccattc

SEQ ID NO: 241033 - DNA, 29 bp, Artificial Sequence
  Description of Artificial Sequence: Synthetic oligonucleotide
gctctcttggcgagatggcctttccattc

SEQ ID NO: 241034 - DNA, 33 bp, Artificial Sequence
  Description of Artificial Sequence: Synthetic oligonucleotide
ctctcttggcgagatggcctttccattctatac

SEQ ID NO: 241035 - DNA, 33 bp, Artificial Sequence
  Description of Artificial Sequence: Synthetic oligonucleotide
tctcttggcgagatggcctttccattctatacg

SEQ ID NO: 241036 - DNA, 32 bp, Artificial Sequence
  Description of Artificial Sequence: Synthetic oligonucleotide
ctcttggcgagatggcctttccattctatacg

SEQ ID NO: 241037 - DNA, 32 bp, Artificial Sequence
  Description of Artificial Sequence: Synthetic oligonucleotide
tcttggcgagatggcctttccattctatacgg

SEQ ID NO: 241038 - DNA, 31 bp, Artificial Sequence
  Description of Artificial Sequence: Synthetic oligonucleotide
cttggcgagatggcctttccattctatacgg

SEQ ID NO: 241039 - DNA, 31 bp, Artificial Sequence
  Description of Artificial Sequence: Synthetic oligonucleotide
ttggcgagatggcctttccattctatacggg

SEQ ID NO: 241040 - DNA, 30 bp, Artificial Sequence
  Description of Artificial Sequence: Synthetic oligonucleotide
tggcgagatggcctttccattctatacggg

SEQ ID NO: 241041 - DNA, 29 bp, Artificial Sequence
  Description of Artificial Sequence: Synthetic oligonucleotide
ggcgagatggcctttccattctatacggg

SEQ ID NO: 241042 - DNA, 29 bp, Artificial Sequence
  Description of Artificial Sequence: Synthetic oligonucleotide
gcgagatggcctttccattctatacgggc

SEQ ID NO: 241043 - DNA, 29 bp, Artificial Sequence
  Description of Artificial Sequence: Synthetic oligonucleotide
cgagatggcctttccattctatacgggcc

SEQ ID NO: 241044 - DNA, 29 bp, Artificial Sequence
  Description of Artificial Sequence: Synthetic oligonucleotide
gagatggcctttccattctatacgggccg

SEQ ID NO: 241045 - DNA, 29 bp, Artificial Sequence
  Description of Artificial Sequence: Synthetic oligonucleotide
agatggcctttccattctatacgggccgg

SEQ ID NO: 241046 - DNA, 28 bp, Artificial Sequence
  Description of Artificial Sequence: Synthetic oligonucleotide
gatggcctttccattctatacgggccgg

SEQ ID NO: 241047 - DNA, 28 bp, Artificial Sequence
  Description of Artificial Sequence: Synthetic oligonucleotide
atggcctttccattctatacgggccggc

SEQ ID NO: 241048 - DNA, 27 bp, Artificial Sequence
  Description of Artificial Sequence: Synthetic oligonucleotide
tggcctttccattctatacgggccggc

SEQ ID NO: 241049 - DNA, 27 bp, Artificial Sequence
  Description of Artificial Sequence: Synthetic oligonucleotide
ggcctttccattctatacgggccggct

SEQ ID NO: 241050 - DNA, 27 bp, Artificial Sequence
  Description of Artificial Sequence: Synthetic oligonucleotide
gcctttccattctatacgggccggctc

SEQ ID NO: 241051 - DNA, 28 bp, Artificial Sequence
  Description of Artificial Sequence: Synthetic oligonucleotide
cctttccattctatacgggccggctcac

SEQ ID NO: 241052 - DNA, 29 bp, Artificial Sequence
  Description of Artificial Sequence: Synthetic oligonucleotide
ctttccattctatacgggccggctcactg

SEQ ID NO: 241053 - DNA, 30 bp, Artificial Sequence
  Description of Artificial Sequence: Synthetic oligonucleotide
tttccattctatacgggccggctcactgac

SEQ ID NO: 241054 - DNA, 29 bp, Artificial Sequence
  Description of Artificial Sequence: Synthetic oligonucleotide
ttccattctatacgggccggctcactgac

SEQ ID NO: 241055 - DNA, 28 bp, Artificial Sequence
  Description of Artificial Sequence: Synthetic oligonucleotide
tccattctatacgggccggctcactgac

SEQ ID NO: 241056 - DNA, 27 bp, Artificial Sequence
  Description of Artificial Sequence: Synthetic oligonucleotide
ccattctatacgggccggctcactgac

SEQ ID NO: 241057 - DNA, 28 bp, Artificial Sequence
  Description of Artificial Sequence: Synthetic oligonucleotide
cattctatacgggccggctcactgacag

SEQ ID NO: 241058 - DNA, 28 bp, Artificial Sequence
  Description of Artificial Sequence: Synthetic oligonucleotide
attctatacgggccggctcactgacagg

SEQ ID NO: 241059 - DNA, 27 bp, Artificial Sequence
  Description of Artificial Sequence: Synthetic oligonucleotide
ttctatacgggccggctcactgacagg

SEQ ID NO: 241060 - DNA, 27 bp, Artificial Sequence
  Description of Artificial Sequence: Synthetic oligonucleotide
tctatacgggccggctcactgacagga

SEQ ID NO: 241061 - DNA, 27 bp, Artificial Sequence
  Description of Artificial Sequence: Synthetic oligonucleotide
ctatacgggccggctcactgacaggat

SEQ ID NO: 241062 - DNA, 28 bp, Artificial Sequence
  Description of Artificial Sequence: Synthetic oligonucleotide
tatacgggccggctcactgacaggattc

SEQ ID NO: 241063 - DNA, 27 bp, Artificial Sequence
  Description of Artificial Sequence: Synthetic oligonucleotide
atacgggccggctcactgacaggattc

SEQ ID NO: 241064 - DNA, 27 bp, Artificial Sequence
  Description of Artificial Sequence: Synthetic oligonucleotide
tacgggccggctcactgacaggattct

SEQ ID NO: 241065 - DNA, 27 bp, Artificial Sequence
  Description of Artificial Sequence: Synthetic oligonucleotide
acgggccggctcactgacaggattcta

SEQ ID NO: 241066 - DNA, 26 bp, Artificial Sequence
  Description of Artificial Sequence: Synthetic oligonucleotide
cgggccggctcactgacaggattcta

SEQ ID NO: 241067 - DNA, 27 bp, Artificial Sequence
  Description of Artificial Sequence: Synthetic oligonucleotide
gggccggctcactgacaggattctact

SEQ ID NO: 241068 - DNA, 28 bp, Artificial Sequence
  Description of Artificial Sequence: Synthetic oligonucleotide
ggccggctcactgacaggattctactag

SEQ ID NO: 241069 - DNA, 30 bp, Artificial Sequence
  Description of Artificial Sequence: Synthetic oligonucleotide
gccggctcactgacaggattctactagatg

SEQ ID NO: 241070 - DNA, 30 bp, Artificial Sequence
  Description of Artificial Sequence: Synthetic oligonucleotide
ccggctcactgacaggattctactagatgg

SEQ ID NO: 241071 - DNA, 30 bp, Artificial Sequence
  Description of Artificial Sequence: Synthetic oligonucleotide
cggctcactgacaggattctactagatggc

SEQ ID NO: 241072 - DNA, 31 bp, Artificial Sequence
  Description of Artificial Sequence: Synthetic oligonucleotide
ggctcactgacaggattctactagatggctc

SEQ ID NO: 241073 - DNA, 32 bp, Artificial Sequence
  Description of Artificial Sequence: Synthetic oligonucleotide
gctcactgacaggattctactagatggctctg

SEQ ID NO: 241074 - DNA, 32 bp, Artificial Sequence
  Description of Artificial Sequence: Synthetic oligonucleotide
ctcactgacaggattctactagatggctctgc

SEQ ID NO: 241075 - DNA, 32 bp, Artificial Sequence
  Description of Artificial Sequence: Synthetic oligonucleotide
tcactgacaggattctactagatggctctgcc

SEQ ID NO: 241076 - DNA, 31 bp, Artificial Sequence
  Description of Artificial Sequence: Synthetic oligonucleotide
cactgacaggattctactagatggctctgcc

SEQ ID NO: 241077 - DNA, 31 bp, Artificial Sequence
  Description of Artificial Sequence: Synthetic oligonucleotide
actgacaggattctactagatggctctgccg

SEQ ID NO: 241078 - DNA, 30 bp, Artificial Sequence
  Description of Artificial Sequence: Synthetic oligonucleotide
ctgacaggattctactagatggctctgccg

SEQ ID NO: 241079 - DNA, 33 bp, Artificial Sequence
  Description of Artificial Sequence: Synthetic oligonucleotide
tgacaggattctactagatggctctgccgatac

SEQ ID NO: 241080 - DNA, 32 bp, Artificial Sequence
  Description of Artificial Sequence: Synthetic oligonucleotide
gacaggattctactagatggctctgccgatac

SEQ ID NO: 241081 - DNA, 32 bp, Artificial Sequence
  Description of Artificial Sequence: Synthetic oligonucleotide
acaggattctactagatggctctgccgatacc

SEQ ID NO: 241082 - DNA, 31 bp, Artificial Sequence
  Description of Artificial Sequence: Synthetic oligonucleotide
caggattctactagatggctctgccgatacc

SEQ ID NO: 241083 - DNA, 33 bp, Artificial Sequence
  Description of Artificial Sequence: Synthetic oligonucleotide
aggattctactagatggctctgccgataccatc

SEQ ID NO: 241084 - DNA, 32 bp, Artificial Sequence
  Description of Artificial Sequence: Synthetic oligonucleotide
ggattctactagatggctctgccgataccatc

SEQ ID NO: 241085 - DNA, 33 bp, Artificial Sequence
  Description of Artificial Sequence: Synthetic oligonucleotide
gattctactagatggctctgccgataccatcac

SEQ ID NO: 241086 - DNA, 34 bp, Artificial Sequence
  Description of Artificial Sequence: Synthetic oligonucleotide
attctactagatggctctgccgataccatcactc

SEQ ID NO: 241087 - DNA, 33 bp, Artificial Sequence
  Description of Artificial Sequence: Synthetic oligonucleotide
ttctactagatggctctgccgataccatcactc

SEQ ID NO: 241088 - DNA, 32 bp, Artificial Sequence
  Description of Artificial Sequence: Synthetic oligonucleotide
tctactagatggctctgccgataccatcactc

SEQ ID NO: 241089 - DNA, 31 bp, Artificial Sequence
  Description of Artificial Sequence: Synthetic oligonucleotide
ctactagatggctctgccgataccatcactc

SEQ ID NO: 241090 - DNA, 31 bp, Artificial Sequence
  Description of Artificial Sequence: Synthetic oligonucleotide
tactagatggctctgccgataccatcactcg

SEQ ID NO: 241091 - DNA, 30 bp, Artificial Sequence
  Description of Artificial Sequence: Synthetic oligonucleotide
actagatggctctgccgataccatcactcg

SEQ ID NO: 241092 - DNA, 29 bp, Artificial Sequence
  Description of Artificial Sequence: Synthetic oligonucleotide
ctagatggctctgccgataccatcactcg

SEQ ID NO: 241093 - DNA, 32 bp, Artificial Sequence
  Description of Artificial Sequence: Synthetic oligonucleotide
tagatggctctgccgataccatcactcgaatc

SEQ ID NO: 241094 - DNA, 31 bp, Artificial Sequence
  Description of Artificial Sequence: Synthetic oligonucleotide
agatggctctgccgataccatcactcgaatc

SEQ ID NO: 241095 - DNA, 30 bp, Artificial Sequence
  Description of Artificial Sequence: Synthetic oligonucleotide
gatggctctgccgataccatcactcgaatc

SEQ ID NO: 241096 - DNA, 34 bp, Artificial Sequence
  Description of Artificial Sequence: Synthetic oligonucleotide
atggctctgccgataccatcactcgaatcttaac

SEQ ID NO: 241097 - DNA, 33 bp, Artificial Sequence
  Description of Artificial Sequence: Synthetic oligonucleotide
tggctctgccgataccatcactcgaatcttaac

SEQ ID NO: 241098 - DNA, 32 bp, Artificial Sequence
  Description of Artificial Sequence: Synthetic oligonucleotide
ggctctgccgataccatcactcgaatcttaac

SEQ ID NO: 241099 - DNA, 33 bp, Artificial Sequence
  Description of Artificial Sequence: Synthetic oligonucleotide
gctctgccgataccatcactcgaatcttaactc

SEQ ID NO: 241100 - DNA, 34 bp, Artificial Sequence
  Description of Artificial Sequence: Synthetic oligonucleotide
ctctgccgataccatcactcgaatcttaactctg

SEQ ID NO: 241101 - DNA, 36 bp, Artificial Sequence
  Description of Artificial Sequence: Synthetic oligonucleotide
tctgccgataccatcactcgaatcttaactctgatg

SEQ ID NO: 241102 - DNA, 35 bp, Artificial Sequence
  Description of Artificial Sequence: Synthetic oligonucleotide
ctgccgataccatcactcgaatcttaactctgatg

SEQ ID NO: 241103 - DNA, 36 bp, Artificial Sequence
  Description of Artificial Sequence: Synthetic oligonucleotide
tgccgataccatcactcgaatcttaactctgatgtc

SEQ ID NO: 241104 - DNA, 35 bp, Artificial Sequence
  Description of Artificial Sequence: Synthetic oligonucleotide
gccgataccatcactcgaatcttaactctgatgtc

SEQ ID NO: 241105 - DNA, 35 bp, Artificial Sequence
  Description of Artificial Sequence: Synthetic oligonucleotide
ccgataccatcactcgaatcttaactctgatgtcc

SEQ ID NO: 241106 - DNA, 38 bp, Artificial Sequence
  Description of Artificial Sequence: Synthetic oligonucleotide
cgataccatcactcgaatcttaactctgatgtccattg

SEQ ID NO: 241107 - DNA, 39 bp, Artificial Sequence
  Description of Artificial Sequence: Synthetic oligonucleotide
gataccatcactcgaatcttaactctgatgtccattgtc

SEQ ID NO: 241108 - DNA, 40 bp, Artificial Sequence
  Description of Artificial Sequence: Synthetic oligonucleotide
ataccatcactcgaatcttaactctgatgtccattgtcac

SEQ ID NO: 241109 - DNA, 39 bp, Artificial Sequence
  Description of Artificial Sequence: Synthetic oligonucleotide
taccatcactcgaatcttaactctgatgtccattgtcac

SEQ ID NO: 241110 - DNA, 38 bp, Artificial Sequence
  Description of Artificial Sequence: Synthetic oligonucleotide
accatcactcgaatcttaactctgatgtccattgtcac

SEQ ID NO: 241111 - DNA, 37 bp, Artificial Sequence
  Description of Artificial Sequence: Synthetic oligonucleotide
ccatcactcgaatcttaactctgatgtccattgtcac

SEQ ID NO: 241112 - DNA, 37 bp, Artificial Sequence
  Description of Artificial Sequence: Synthetic oligonucleotide
catcactcgaatcttaactctgatgtccattgtcacc

SEQ ID NO: 241113 - DNA, 40 bp, Artificial Sequence
  Description of Artificial Sequence: Synthetic oligonucleotide
atcactcgaatcttaactctgatgtccattgtcaccatag

SEQ ID NO: 241114 - DNA, 39 bp, Artificial Sequence
  Description of Artificial Sequence: Synthetic oligonucleotide
tcactcgaatcttaactctgatgtccattgtcaccatag

SEQ ID NO: 241115 - DNA, 38 bp, Artificial Sequence
  Description of Artificial Sequence: Synthetic oligonucleotide
cactcgaatcttaactctgatgtccattgtcaccatag

SEQ ID NO: 241116 - DNA, 38 bp, Artificial Sequence
  Description of Artificial Sequence: Synthetic oligonucleotide
actcgaatcttaactctgatgtccattgtcaccatagg

SEQ ID NO: 241117 - DNA, 37 bp, Artificial Sequence
  Description of Artificial Sequence: Synthetic oligonucleotide
ctcgaatcttaactctgatgtccattgtcaccatagg

SEQ ID NO: 241118 - DNA, 37 bp, Artificial Sequence
  Description of Artificial Sequence: Synthetic oligonucleotide
tcgaatcttaactctgatgtccattgtcaccataggc

SEQ ID NO: 241119 - DNA, 36 bp, Artificial Sequence
  Description of Artificial Sequence: Synthetic oligonucleotide
cgaatcttaactctgatgtccattgtcaccataggc

SEQ ID NO: 241120 - DNA, 37 bp, Artificial Sequence
  Description of Artificial Sequence: Synthetic oligonucleotide
gaatcttaactctgatgtccattgtcaccataggcag

SEQ ID NO: 241121 - DNA, 38 bp, Artificial Sequence
  Description of Artificial Sequence: Synthetic oligonucleotide
aatcttaactctgatgtccattgtcaccataggcagtg

SEQ ID NO: 241122 - DNA, 37 bp, Artificial Sequence
  Description of Artificial Sequence: Synthetic oligonucleotide
atcttaactctgatgtccattgtcaccataggcagtg

SEQ ID NO: 241123 - DNA, 36 bp, Artificial Sequence
  Description of Artificial Sequence: Synthetic oligonucleotide
tcttaactctgatgtccattgtcaccataggcagtg

SEQ ID NO: 241124 - DNA, 35 bp, Artificial Sequence
  Description of Artificial Sequence: Synthetic oligonucleotide
cttaactctgatgtccattgtcaccataggcagtg

SEQ ID NO: 241125 - DNA, 35 bp, Artificial Sequence
  Description of Artificial Sequence: Synthetic oligonucleotide
ttaactctgatgtccattgtcaccataggcagtgc

SEQ ID NO: 241126 - DNA, 34 bp, Artificial Sequence
  Description of Artificial Sequence: Synthetic oligonucleotide
taactctgatgtccattgtcaccataggcagtgc

SEQ ID NO: 241127 - DNA, 33 bp, Artificial Sequence
  Description of Artificial Sequence: Synthetic oligonucleotide
aactctgatgtccattgtcaccataggcagtgc

SEQ ID NO: 241128 - DNA, 32 bp, Artificial Sequence
  Description of Artificial Sequence: Synthetic oligonucleotide
actctgatgtccattgtcaccataggcagtgc

SEQ ID NO: 241129 - DNA, 31 bp, Artificial Sequence
  Description of Artificial Sequence: Synthetic oligonucleotide
ctctgatgtccattgtcaccataggcagtgc

SEQ ID NO: 241130 - DNA, 32 bp, Artificial Sequence
  Description of Artificial Sequence: Synthetic oligonucleotide
tctgatgtccattgtcaccataggcagtgcag

SEQ ID NO: 241131 - DNA, 31 bp, Artificial Sequence
  Description of Artificial Sequence: Synthetic oligonucleotide
ctgatgtccattgtcaccataggcagtgcag

SEQ ID NO: 241132 - DNA, 32 bp, Artificial Sequence
  Description of Artificial Sequence: Synthetic oligonucleotide
tgatgtccattgtcaccataggcagtgcagtc

SEQ ID NO: 241133 - DNA, 31 bp, Artificial Sequence
  Description of Artificial Sequence: Synthetic oligonucleotide
gatgtccattgtcaccataggcagtgcagtc

SEQ ID NO: 241134 - DNA, 31 bp, Artificial Sequence
  Description of Artificial Sequence: Synthetic oligonucleotide
atgtccattgtcaccataggcagtgcagtcc

SEQ ID NO: 241135 - DNA, 30 bp, Artificial Sequence
  Description of Artificial Sequence: Synthetic oligonucleotide
tgtccattgtcaccataggcagtgcagtcc

SEQ ID NO: 241136 - DNA, 29 bp, Artificial Sequence
  Description of Artificial Sequence: Synthetic oligonucleotide
gtccattgtcaccataggcagtgcagtcc

SEQ ID NO: 241137 - DNA, 30 bp, Artificial Sequence
  Description of Artificial Sequence: Synthetic oligonucleotide
tccattgtcaccataggcagtgcagtcctg

SEQ ID NO: 241138 - DNA, 29 bp, Artificial Sequence
  Description of Artificial Sequence: Synthetic oligonucleotide
ccattgtcaccataggcagtgcagtcctg

SEQ ID NO: 241139 - DNA, 29 bp, Artificial Sequence
  Description of Artificial Sequence: Synthetic oligonucleotide
cattgtcaccataggcagtgcagtcctgg

SEQ ID NO: 241140 - DNA, 30 bp, Artificial Sequence
  Description of Artificial Sequence: Synthetic oligonucleotide
attgtcaccataggcagtgcagtcctggag

SEQ ID NO: 241141 - DNA, 29 bp, Artificial Sequence
  Description of Artificial Sequence: Synthetic oligonucleotide
ttgtcaccataggcagtgcagtcctggag

SEQ ID NO: 241142 - DNA, 28 bp, Artificial Sequence
  Description of Artificial Sequence: Synthetic oligonucleotide
tgtcaccataggcagtgcagtcctggag

SEQ ID NO: 241143 - DNA, 27 bp, Artificial Sequence
  Description of Artificial Sequence: Synthetic oligonucleotide
gtcaccataggcagtgcagtcctggag

SEQ ID NO: 241144 - DNA, 29 bp, Artificial Sequence
  Description of Artificial Sequence: Synthetic oligonucleotide
tcaccataggcagtgcagtcctggagttc

SEQ ID NO: 241145 - DNA, 28 bp, Artificial Sequence
  Description of Artificial Sequence: Synthetic oligonucleotide
caccataggcagtgcagtcctggagttc

SEQ ID NO: 241146 - DNA, 28 bp, Artificial Sequence
  Description of Artificial Sequence: Synthetic oligonucleotide
accataggcagtgcagtcctggagttcc

SEQ ID NO: 241147 - DNA, 27 bp, Artificial Sequence
  Description of Artificial Sequence: Synthetic oligonucleotide
ccataggcagtgcagtcctggagttcc

SEQ ID NO: 241148 - DNA, 28 bp, Artificial Sequence
  Description of Artificial Sequence: Synthetic oligonucleotide
cataggcagtgcagtcctggagttcctg

SEQ ID NO: 241149 - DNA, 28 bp, Artificial Sequence
  Description of Artificial Sequence: Synthetic oligonucleotide
ataggcagtgcagtcctggagttcctgg

SEQ ID NO: 241150 - DNA, 27 bp, Artificial Sequence
  Description of Artificial Sequence: Synthetic oligonucleotide
taggcagtgcagtcctggagttcctgg

SEQ ID NO: 241151 - DNA, 26 bp, Artificial Sequence
  Description of Artificial Sequence: Synthetic oligonucleotide
aggcagtgcagtcctggagttcctgg

SEQ ID NO: 241152 - DNA, 25 bp, Artificial Sequence
  Description of Artificial Sequence: Synthetic oligonucleotide
ggcagtgcagtcctggagttcctgg

SEQ ID NO: 241153 - DNA, 26 bp, Artificial Sequence
  Description of Artificial Sequence: Synthetic oligonucleotide
gcagtgcagtcctggagttcctgggt

SEQ ID NO: 241154 - DNA, 27 bp, Artificial Sequence
  Description of Artificial Sequence: Synthetic oligonucleotide
cagtgcagtcctggagttcctgggtga

SEQ ID NO: 241155 - DNA, 27 bp, Artificial Sequence
  Description of Artificial Sequence: Synthetic oligonucleotide
agtgcagtcctggagttcctgggtgac

SEQ ID NO: 241156 - DNA, 26 bp, Artificial Sequence
  Description of Artificial Sequence: Synthetic oligonucleotide
gtgcagtcctggagttcctgggtgac

SEQ ID NO: 241157 - DNA, 26 bp, Artificial Sequence
  Description of Artificial Sequence: Synthetic oligonucleotide
tgcagtcctggagttcctgggtgacg

SEQ ID NO: 241158 - DNA, 25 bp, Artificial Sequence
  Description of Artificial Sequence: Synthetic oligonucleotide
gcagtcctggagttcctgggtgacg

SEQ ID NO: 241159 - DNA, 25 bp, Artificial Sequence
  Description of Artificial Sequence: Synthetic oligonucleotide
cagtcctggagttcctgggtgacgc

SEQ ID NO: 241160 - DNA, 27 bp, Artificial Sequence
  Description of Artificial Sequence: Synthetic oligonucleotide
agtcctggagttcctgggtgacgcgat

SEQ ID NO: 241161 - DNA, 26 bp, Artificial Sequence
  Description of Artificial Sequence: Synthetic oligonucleotide
gtcctggagttcctgggtgacgcgat

SEQ ID NO: 241162 - DNA, 27 bp, Artificial Sequence
  Description of Artificial Sequence: Synthetic oligonucleotide
tcctggagttcctgggtgacgcgatct

SEQ ID NO: 241163 - DNA, 27 bp, Artificial Sequence
  Description of Artificial Sequence: Synthetic oligonucleotide
cctggagttcctgggtgacgcgatcta

SEQ ID NO: 241164 - DNA, 30 bp, Artificial Sequence
  Description of Artificial Sequence: Synthetic oligonucleotide
ctggagttcctgggtgacgcgatctataag

SEQ ID NO: 241165 - DNA, 32 bp, Artificial Sequence
  Description of Artificial Sequence: Synthetic oligonucleotide
tggagttcctgggtgacgcgatctataagaac

SEQ ID NO: 241166 - DNA, 31 bp, Artificial Sequence
  Description of Artificial Sequence: Synthetic oligonucleotide
ggagttcctgggtgacgcgatctataagaac

SEQ ID NO: 241167 - DNA, 32 bp, Artificial Sequence
  Description of Artificial Sequence: Synthetic oligonucleotide
gagttcctgggtgacgcgatctataagaacac

SEQ ID NO: 241168 - DNA, 32 bp, Artificial Sequence
  Description of Artificial Sequence: Synthetic oligonucleotide
agttcctgggtgacgcgatctataagaacacc

SEQ ID NO: 241169 - DNA, 31 bp, Artificial Sequence
  Description of Artificial Sequence: Synthetic oligonucleotide
gttcctgggtgacgcgatctataagaacacc

SEQ ID NO: 241170 - DNA, 33 bp, Artificial Sequence
  Description of Artificial Sequence: Synthetic oligonucleotide
ttcctgggtgacgcgatctataagaacaccatg

SEQ ID NO: 241171 - DNA, 32 bp, Artificial Sequence
  Description of Artificial Sequence: Synthetic oligonucleotide
tcctgggtgacgcgatctataagaacaccatg

SEQ ID NO: 241172 - DNA, 31 bp, Artificial Sequence
  Description of Artificial Sequence: Synthetic oligonucleotide
cctgggtgacgcgatctataagaacaccatg

SEQ ID NO: 241173 - DNA, 31 bp, Artificial Sequence
  Description of Artificial Sequence: Synthetic oligonucleotide
ctgggtgacgcgatctataagaacaccatgc

SEQ ID NO: 241174 - DNA, 31 bp, Artificial Sequence
  Description of Artificial Sequence: Synthetic oligonucleotide
tgggtgacgcgatctataagaacaccatgcg

SEQ ID NO: 241175 - DNA, 30 bp, Artificial Sequence
  Description of Artificial Sequence: Synthetic oligonucleotide
gggtgacgcgatctataagaacaccatgcg

SEQ ID NO: 241176 - DNA, 31 bp, Artificial Sequence
  Description of Artificial Sequence: Synthetic oligonucleotide
ggtgacgcgatctataagaacaccatgcgtc

SEQ ID NO: 241177 - DNA, 32 bp, Artificial Sequence
  Description of Artificial Sequence: Synthetic oligonucleotide
gtgacgcgatctataagaacaccatgcgtcac

SEQ ID NO: 241178 - DNA, 32 bp, Artificial Sequence
  Description of Artificial Sequence: Synthetic oligonucleotide
tgacgcgatctataagaacaccatgcgtcacg

SEQ ID NO: 241179 - DNA, 31 bp, Artificial Sequence
  Description of Artificial Sequence: Synthetic oligonucleotide
gacgcgatctataagaacaccatgcgtcacg

SEQ ID NO: 241180 - DNA, 32 bp, Artificial Sequence
  Description of Artificial Sequence: Synthetic oligonucleotide
acgcgatctataagaacaccatgcgtcacgtg

SEQ ID NO: 241181 - DNA, 31 bp, Artificial Sequence
  Description of Artificial Sequence: Synthetic oligonucleotide
cgcgatctataagaacaccatgcgtcacgtg

SEQ ID NO: 241182 - DNA, 31 bp, Artificial Sequence
  Description of Artificial Sequence: Synthetic oligonucleotide
gcgatctataagaacaccatgcgtcacgtgc

SEQ ID NO: 241183 - DNA, 32 bp, Artificial Sequence
  Description of Artificial Sequence: Synthetic oligonucleotide
cgatctataagaacaccatgcgtcacgtgctc

SEQ ID NO: 241184 - DNA, 33 bp, Artificial Sequence
  Description of Artificial Sequence: Synthetic oligonucleotide
gatctataagaacaccatgcgtcacgtgctcag

SEQ ID NO: 241185 - DNA, 33 bp, Artificial Sequence
  Description of Artificial Sequence: Synthetic oligonucleotide
atctataagaacaccatgcgtcacgtgctcagc

SEQ ID NO: 241186 - DNA, 32 bp, Artificial Sequence
  Description of Artificial Sequence: Synthetic oligonucleotide
tctataagaacaccatgcgtcacgtgctcagc

SEQ ID NO: 241187 - DNA, 31 bp, Artificial Sequence
  Description of Artificial Sequence: Synthetic oligonucleotide
ctataagaacaccatgcgtcacgtgctcagc

SEQ ID NO: 241188 - DNA, 31 bp, Artificial Sequence
  Description of Artificial Sequence: Synthetic oligonucleotide
tataagaacaccatgcgtcacgtgctcagcc

SEQ ID NO: 241189 - DNA, 30 bp, Artificial Sequence
  Description of Artificial Sequence: Synthetic oligonucleotide
ataagaacaccatgcgtcacgtgctcagcc

SEQ ID NO: 241190 - DNA, 29 bp, Artificial Sequence
  Description of Artificial Sequence: Synthetic oligonucleotide
taagaacaccatgcgtcacgtgctcagcc

SEQ ID NO: 241191 - DNA, 28 bp, Artificial Sequence
  Description of Artificial Sequence: Synthetic oligonucleotide
aagaacaccatgcgtcacgtgctcagcc

SEQ ID NO: 241192 - DNA, 27 bp, Artificial Sequence
  Description of Artificial Sequence: Synthetic oligonucleotide
agaacaccatgcgtcacgtgctcagcc

SEQ ID NO: 241193 - DNA, 27 bp, Artificial Sequence
  Description of Artificial Sequence: Synthetic oligonucleotide
gaacaccatgcgtcacgtgctcagcca

SEQ ID NO: 241194 - DNA, 27 bp, Artificial Sequence
  Description of Artificial Sequence: Synthetic oligonucleotide
aacaccatgcgtcacgtgctcagccac

SEQ ID NO: 241195 - DNA, 27 bp, Artificial Sequence
  Description of Artificial Sequence: Synthetic oligonucleotide
acaccatgcgtcacgtgctcagccact

SEQ ID NO: 241196 - DNA, 27 bp, Artificial Sequence
  Description of Artificial Sequence: Synthetic oligonucleotide
caccatgcgtcacgtgctcagccactt

SEQ ID NO: 241197 - DNA, 27 bp, Artificial Sequence
  Description of Artificial Sequence: Synthetic oligonucleotide
accatgcgtcacgtgctcagccacttc

SEQ ID NO: 241198 - DNA, 26 bp, Artificial Sequence
  Description of Artificial Sequence: Synthetic oligonucleotide
ccatgcgtcacgtgctcagccacttc

SEQ ID NO: 241199 - DNA, 27 bp, Artificial Sequence
  Description of Artificial Sequence: Synthetic oligonucleotide
catgcgtcacgtgctcagccacttcca

SEQ ID NO: 241200 - DNA, 27 bp, Artificial Sequence
  Description of Artificial Sequence: Synthetic oligonucleotide
atgcgtcacgtgctcagccacttccag

SEQ ID NO: 241201 - DNA, 26 bp, Artificial Sequence
  Description of Artificial Sequence: Synthetic oligonucleotide
tgcgtcacgtgctcagccacttccag

SEQ ID NO: 241202 - DNA, 25 bp, Artificial Sequence
  Description of Artificial Sequence: Synthetic oligonucleotide
gcgtcacgtgctcagccacttccag

SEQ ID NO: 241203 - DNA, 25 bp, Artificial Sequence
  Description of Artificial Sequence: Synthetic oligonucleotide
cgtcacgtgctcagccacttccagg

SEQ ID NO: 241204 - DNA, 26 bp, Artificial Sequence
  Description of Artificial Sequence: Synthetic oligonucleotide
gtcacgtgctcagccacttccaggga

SEQ ID NO: 241205 - DNA, 27 bp, Artificial Sequence
  Description of Artificial Sequence: Synthetic oligonucleotide
tcacgtgctcagccacttccagggaga

SEQ ID NO: 241206 - DNA, 26 bp, Artificial Sequence
  Description of Artificial Sequence: Synthetic oligonucleotide
cacgtgctcagccacttccagggaga

SEQ ID NO: 241207 - DNA, 26 bp, Artificial Sequence
  Description of Artificial Sequence: Synthetic oligonucleotide
acgtgctcagccacttccagggagag

SEQ ID NO: 241208 - DNA, 25 bp, Artificial Sequence
  Description of Artificial Sequence: Synthetic oligonucleotide
cgtgctcagccacttccagggagag

SEQ ID NO: 241209 - DNA, 26 bp, Artificial Sequence
  Description of Artificial Sequence: Synthetic oligonucleotide
gtgctcagccacttccagggagagct

SEQ ID NO: 241210 - DNA, 27 bp, Artificial Sequence
  Description of Artificial Sequence: Synthetic oligonucleotide
tgctcagccacttccagggagagctgt

SEQ ID NO: 241211 - DNA, 27 bp, Artificial Sequence
  Description of Artificial Sequence: Synthetic oligonucleotide
gctcagccacttccagggagagctgtt

SEQ ID NO: 241212 - DNA, 28 bp, Artificial Sequence
  Description of Artificial Sequence: Synthetic oligonucleotide
ctcagccacttccagggagagctgtttg

SEQ ID NO: 241213 - DNA, 28 bp, Artificial Sequence
  Description of Artificial Sequence: Synthetic oligonucleotide
tcagccacttccagggagagctgtttgg

SEQ ID NO: 241214 - DNA, 27 bp, Artificial Sequence
  Description of Artificial Sequence: Synthetic oligonucleotide
cagccacttccagggagagctgtttgg

SEQ ID NO: 241215 - DNA, 27 bp, Artificial Sequence
  Description of Artificial Sequence: Synthetic oligonucleotide
agccacttccagggagagctgtttggg

SEQ ID NO: 241216 - DNA, 26 bp, Artificial Sequence
  Description of Artificial Sequence: Synthetic oligonucleotide
gccacttccagggagagctgtttggg

SEQ ID NO: 241217 - DNA, 26 bp, Artificial Sequence
  Description of Artificial Sequence: Synthetic oligonucleotide
ccacttccagggagagctgtttgggg

SEQ ID NO: 241218 - DNA, 27 bp, Artificial Sequence
  Description of Artificial Sequence: Synthetic oligonucleotide
cacttccagggagagctgtttgggggt

SEQ ID NO: 241219 - DNA, 27 bp, Artificial Sequence
  Description of Artificial Sequence: Synthetic oligonucleotide
acttccagggagagctgtttgggggtg

SEQ ID NO: 241220 - DNA, 27 bp, Artificial Sequence
  Description of Artificial Sequence: Synthetic oligonucleotide
cttccagggagagctgtttgggggtgt

SEQ ID NO: 241221 - DNA, 27 bp, Artificial Sequence
  Description of Artificial Sequence: Synthetic oligonucleotide
ttccagggagagctgtttgggggtgtc

SEQ ID NO: 241222 - DNA, 26 bp, Artificial Sequence
  Description of Artificial Sequence: Synthetic oligonucleotide
tccagggagagctgtttgggggtgtc

SEQ ID NO: 241223 - DNA, 25 bp, Artificial Sequence
  Description of Artificial Sequence: Synthetic oligonucleotide
ccagggagagctgtttgggggtgtc

SEQ ID NO: 241224 - DNA, 26 bp, Artificial Sequence
  Description of Artificial Sequence: Synthetic oligonucleotide
cagggagagctgtttgggggtgtcct

SEQ ID NO: 241225 - DNA, 26 bp, Artificial Sequence
  Description of Artificial Sequence: Synthetic oligonucleotide
agggagagctgtttgggggtgtcctg

SEQ ID NO: 241226 - DNA, 25 bp, Artificial Sequence
  Description of Artificial Sequence: Synthetic oligonucleotide
gggagagctgtttgggggtgtcctg

SEQ ID NO: 241227 - DNA, 25 bp, Artificial Sequence
  Description of Artificial Sequence: Synthetic oligonucleotide
ggagagctgtttgggggtgtcctgc

SEQ ID NO: 241228 - DNA, 25 bp, Artificial Sequence
  Description of Artificial Sequence: Synthetic oligonucleotide
gagagctgtttgggggtgtcctgcg

SEQ ID NO: 241229 - DNA, 25 bp, Artificial Sequence
  Description of Artificial Sequence: Synthetic oligonucleotide
agagctgtttgggggtgtcctgcgg

SEQ ID NO: 241230 - DNA, 24 bp, Artificial Sequence
  Description of Artificial Sequence: Synthetic oligonucleotide
gagctgtttgggggtgtcctgcgg

SEQ ID NO: 241231 - DNA, 25 bp, Artificial Sequence
  Description of Artificial Sequence: Synthetic oligonucleotide
agctgtttgggggtgtcctgcggca

SEQ ID NO: 241232 - DNA, 24 bp, Artificial Sequence
  Description of Artificial Sequence: Synthetic oligonucleotide
gctgtttgggggtgtcctgcggca

SEQ ID NO: 241233 - DNA, 24 bp, Artificial Sequence
  Description of Artificial Sequence: Synthetic oligonucleotide
ctgtttgggggtgtcctgcggcag

SEQ ID NO: 241234 - DNA, 25 bp, Artificial Sequence
  Description of Artificial Sequence: Synthetic oligonucleotide
tgtttgggggtgtcctgcggcagga

SEQ ID NO: 241235 - DNA, 24 bp, Artificial Sequence
  Description of Artificial Sequence: Synthetic oligonucleotide
gtttgggggtgtcctgcggcagga

SEQ ID NO: 241236 - DNA, 25 bp, Artificial Sequence
  Description of Artificial Sequence: Synthetic oligonucleotide
tttgggggtgtcctgcggcaggaga

SEQ ID NO: 241237 - DNA, 24 bp, Artificial Sequence
  Description of Artificial Sequence: Synthetic oligonucleotide
ttgggggtgtcctgcggcaggaga

SEQ ID NO: 241238 - DNA, 23 bp, Artificial Sequence
  Description of Artificial Sequence: Synthetic oligonucleotide
tgggggtgtcctgcggcaggaga

SEQ ID NO: 241239 - DNA, 22 bp, Artificial Sequence
  Description of Artificial Sequence: Synthetic oligonucleotide
gggggtgtcctgcggcaggaga

SEQ ID NO: 241240 - DNA, 22 bp, Artificial Sequence
  Description of Artificial Sequence: Synthetic oligonucleotide
ggggtgtcctgcggcaggagac

SEQ ID NO: 241241 - DNA, 22 bp, Artificial Sequence
  Description of Artificial Sequence: Synthetic oligonucleotide
gggtgtcctgcggcaggagacg

SEQ ID NO: 241242 - DNA, 23 bp, Artificial Sequence
  Description of Artificial Sequence: Synthetic oligonucleotide
ggtgtcctgcggcaggagacgca

SEQ ID NO: 241243 - DNA, 27 bp, Artificial Sequence
  Description of Artificial Sequence: Synthetic oligonucleotide
gtgtcctgcggcaggagacgcagtttt

SEQ ID NO: 241244 - DNA, 28 bp, Artificial Sequence
  Description of Artificial Sequence: Synthetic oligonucleotide
tgtcctgcggcaggagacgcagtttttc

SEQ ID NO: 241245 - DNA, 27 bp, Artificial Sequence
  Description of Artificial Sequence: Synthetic oligonucleotide
gtcctgcggcaggagacgcagtttttc

SEQ ID NO: 241246 - DNA, 27 bp, Artificial Sequence
  Description of Artificial Sequence: Synthetic oligonucleotide
tcctgcggcaggagacgcagtttttcc

SEQ ID NO: 241247 - DNA, 27 bp, Artificial Sequence
  Description of Artificial Sequence: Synthetic oligonucleotide
cctgcggcaggagacgcagtttttcct

SEQ ID NO: 241248 - DNA, 28 bp, Artificial Sequence
  Description of Artificial Sequence: Synthetic oligonucleotide
ctgcggcaggagacgcagtttttcctac

SEQ ID NO: 241249 - DNA, 29 bp, Artificial Sequence
  Description of Artificial Sequence: Synthetic oligonucleotide
tgcggcaggagacgcagtttttcctacag

SEQ ID NO: 241250 - DNA, 28 bp, Artificial Sequence
  Description of Artificial Sequence: Synthetic oligonucleotide
gcggcaggagacgcagtttttcctacag

SEQ ID NO: 241251 - DNA, 30 bp, Artificial Sequence
  Description of Artificial Sequence: Synthetic oligonucleotide
cggcaggagacgcagtttttcctacagaac

SEQ ID NO: 241252 - DNA, 30 bp, Artificial Sequence
  Description of Artificial Sequence: Synthetic oligonucleotide
ggcaggagacgcagtttttcctacagaacc

SEQ ID NO: 241253 - DNA, 31 bp, Artificial Sequence
  Description of Artificial Sequence: Synthetic oligonucleotide
gcaggagacgcagtttttcctacagaaccac

SEQ ID NO: 241254 - DNA, 32 bp, Artificial Sequence
  Description of Artificial Sequence: Synthetic oligonucleotide
caggagacgcagtttttcctacagaaccacac

SEQ ID NO: 241255 - DNA, 33 bp, Artificial Sequence
  Description of Artificial Sequence: Synthetic oligonucleotide
aggagacgcagtttttcctacagaaccacacag

SEQ ID NO: 241256 - DNA, 32 bp, Artificial Sequence
  Description of Artificial Sequence: Synthetic oligonucleotide
ggagacgcagtttttcctacagaaccacacag

SEQ ID NO: 241257 - DNA, 32 bp, Artificial Sequence
  Description of Artificial Sequence: Synthetic oligonucleotide
gagacgcagtttttcctacagaaccacacagg

SEQ ID NO: 241258 - DNA, 35 bp, Artificial Sequence
  Description of Artificial Sequence: Synthetic oligonucleotide
agacgcagtttttcctacagaaccacacaggtaac

SEQ ID NO: 241259 - DNA, 34 bp, Artificial Sequence
  Description of Artificial Sequence: Synthetic oligonucleotide
gacgcagtttttcctacagaaccacacaggtaac

SEQ ID NO: 241260 - DNA, 36 bp, Artificial Sequence
  Description of Artificial Sequence: Synthetic oligonucleotide
acgcagtttttcctacagaaccacacaggtaacttc

SEQ ID NO: 241261 - DNA, 35 bp, Artificial Sequence
  Description of Artificial Sequence: Synthetic oligonucleotide
cgcagtttttcctacagaaccacacaggtaacttc

SEQ ID NO: 241262 - DNA, 37 bp, Artificial Sequence
  Description of Artificial Sequence: Synthetic oligonucleotide
gcagtttttcctacagaaccacacaggtaacttcatg

SEQ ID NO: 241263 - DNA, 38 bp, Artificial Sequence
  Description of Artificial Sequence: Synthetic oligonucleotide
cagtttttcctacagaaccacacaggtaacttcatgtc

SEQ ID NO: 241264 - DNA, 39 bp, Artificial Sequence
  Description of Artificial Sequence: Synthetic oligonucleotide
agtttttcctacagaaccacacaggtaacttcatgtctc

SEQ ID NO: 241265 - DNA, 38 bp, Artificial Sequence
  Description of Artificial Sequence: Synthetic oligonucleotide
gtttttcctacagaaccacacaggtaacttcatgtctc

SEQ ID NO: 241266 - DNA, 38 bp, Artificial Sequence
  Description of Artificial Sequence: Synthetic oligonucleotide
tttttcctacagaaccacacaggtaacttcatgtctcc

SEQ ID NO: 241267 - DNA, 37 bp, Artificial Sequence
  Description of Artificial Sequence: Synthetic oligonucleotide
ttttcctacagaaccacacaggtaacttcatgtctcc

SEQ ID NO: 241268 - DNA, 36 bp, Artificial Sequence
  Description of Artificial Sequence: Synthetic oligonucleotide
tttcctacagaaccacacaggtaacttcatgtctcc

SEQ ID NO: 241269 - DNA, 35 bp, Artificial Sequence
  Description of Artificial Sequence: Synthetic oligonucleotide
ttcctacagaaccacacaggtaacttcatgtctcc

SEQ ID NO: 241270 - DNA, 34 bp, Artificial Sequence
  Description of Artificial Sequence: Synthetic oligonucleotide
tcctacagaaccacacaggtaacttcatgtctcc

SEQ ID NO: 241271 - DNA, 33 bp, Artificial Sequence
  Description of Artificial Sequence: Synthetic oligonucleotide
cctacagaaccacacaggtaacttcatgtctcc

SEQ ID NO: 241272 - DNA, 33 bp, Artificial Sequence
  Description of Artificial Sequence: Synthetic oligonucleotide
ctacagaaccacacaggtaacttcatgtctccg

SEQ ID NO: 241273 - DNA, 33 bp, Artificial Sequence
  Description of Artificial Sequence: Synthetic oligonucleotide
tacagaaccacacaggtaacttcatgtctccgg

SEQ ID NO: 241274 - DNA, 32 bp, Artificial Sequence
  Description of Artificial Sequence: Synthetic oligonucleotide
acagaaccacacaggtaacttcatgtctccgg

SEQ ID NO: 241275 - DNA, 31 bp, Artificial Sequence
  Description of Artificial Sequence: Synthetic oligonucleotide
cagaaccacacaggtaacttcatgtctccgg

SEQ ID NO: 241276 - DNA, 34 bp, Artificial Sequence
  Description of Artificial Sequence: Synthetic oligonucleotide
agaaccacacaggtaacttcatgtctccggtaac

SEQ ID NO: 241277 - DNA, 33 bp, Artificial Sequence
  Description of Artificial Sequence: Synthetic oligonucleotide
gaaccacacaggtaacttcatgtctccggtaac

SEQ ID NO: 241278 - DNA, 34 bp, Artificial Sequence
  Description of Artificial Sequence: Synthetic oligonucleotide
aaccacacaggtaacttcatgtctccggtaacag

SEQ ID NO: 241279 - DNA, 33 bp, Artificial Sequence
  Description of Artificial Sequence: Synthetic oligonucleotide
accacacaggtaacttcatgtctccggtaacag

SEQ ID NO: 241280 - DNA, 32 bp, Artificial Sequence
  Description of Artificial Sequence: Synthetic oligonucleotide
ccacacaggtaacttcatgtctccggtaacag

SEQ ID NO: 241281 - DNA, 33 bp, Artificial Sequence
  Description of Artificial Sequence: Synthetic oligonucleotide
cacacaggtaacttcatgtctccggtaacagac

SEQ ID NO: 241282 - DNA, 33 bp, Artificial Sequence
  Description of Artificial Sequence: Synthetic oligonucleotide
acacaggtaacttcatgtctccggtaacagacg

SEQ ID NO: 241283 - DNA, 32 bp, Artificial Sequence
  Description of Artificial Sequence: Synthetic oligonucleotide
cacaggtaacttcatgtctccggtaacagacg

SEQ ID NO: 241284 - DNA, 33 bp, Artificial Sequence
  Description of Artificial Sequence: Synthetic oligonucleotide
acaggtaacttcatgtctccggtaacagacgac

SEQ ID NO: 241285 - DNA, 32 bp, Artificial Sequence
  Description of Artificial Sequence: Synthetic oligonucleotide
caggtaacttcatgtctccggtaacagacgac

SEQ ID NO: 241286 - DNA, 33 bp, Artificial Sequence
  Description of Artificial Sequence: Synthetic oligonucleotide
aggtaacttcatgtctccggtaacagacgacac

SEQ ID NO: 241287 - DNA, 32 bp, Artificial Sequence
  Description of Artificial Sequence: Synthetic oligonucleotide
ggtaacttcatgtctccggtaacagacgacac

SEQ ID NO: 241288 - DNA, 32 bp, Artificial Sequence
  Description of Artificial Sequence: Synthetic oligonucleotide
gtaacttcatgtctccggtaacagacgacacg

SEQ ID NO: 241289 - DNA, 33 bp, Artificial Sequence
  Description of Artificial Sequence: Synthetic oligonucleotide
taacttcatgtctccggtaacagacgacacgtc

SEQ ID NO: 241290 - DNA, 32 bp, Artificial Sequence
  Description of Artificial Sequence: Synthetic oligonucleotide
aacttcatgtctccggtaacagacgacacgtc

SEQ ID NO: 241291 - DNA, 31 bp, Artificial Sequence
  Description of Artificial Sequence: Synthetic oligonucleotide
acttcatgtctccggtaacagacgacacgtc

SEQ ID NO: 241292 - DNA, 30 bp, Artificial Sequence
  Description of Artificial Sequence: Synthetic oligonucleotide
cttcatgtctccggtaacagacgacacgtc

SEQ ID NO: 241293 - DNA, 30 bp, Artificial Sequence
  Description of Artificial Sequence: Synthetic oligonucleotide
ttcatgtctccggtaacagacgacacgtcc

SEQ ID NO: 241294 - DNA, 29 bp, Artificial Sequence
  Description of Artificial Sequence: Synthetic oligonucleotide
tcatgtctccggtaacagacgacacgtcc

SEQ ID NO: 241295 - DNA, 28 bp, Artificial Sequence
  Description of Artificial Sequence: Synthetic oligonucleotide
catgtctccggtaacagacgacacgtcc

SEQ ID NO: 241296 - DNA, 29 bp, Artificial Sequence
  Description of Artificial Sequence: Synthetic oligonucleotide
atgtctccggtaacagacgacacgtcctc

SEQ ID NO: 241297 - DNA, 28 bp, Artificial Sequence
  Description of Artificial Sequence: Synthetic oligonucleotide
tgtctccggtaacagacgacacgtcctc

SEQ ID NO: 241298 - DNA, 27 bp, Artificial Sequence
  Description of Artificial Sequence: Synthetic oligonucleotide
gtctccggtaacagacgacacgtcctc

SEQ ID NO: 241299 - DNA, 27 bp, Artificial Sequence
  Description of Artificial Sequence: Synthetic oligonucleotide
tctccggtaacagacgacacgtcctcc

SEQ ID NO: 241300 - DNA, 26 bp, Artificial Sequence
  Description of Artificial Sequence: Synthetic oligonucleotide
ctccggtaacagacgacacgtcctcc

SEQ ID NO: 241301 - DNA, 27 bp, Artificial Sequence
  Description of Artificial Sequence: Synthetic oligonucleotide
tccggtaacagacgacacgtcctccct

SEQ ID NO: 241302 - DNA, 26 bp, Artificial Sequence
  Description of Artificial Sequence: Synthetic oligonucleotide
ccggtaacagacgacacgtcctccct

SEQ ID NO: 241303 - DNA, 27 bp, Artificial Sequence
  Description of Artificial Sequence: Synthetic oligonucleotide
cggtaacagacgacacgtcctccctga

SEQ ID NO: 241304 - DNA, 27 bp, Artificial Sequence
  Description of Artificial Sequence: Synthetic oligonucleotide
ggtaacagacgacacgtcctccctgag

SEQ ID NO: 241305 - DNA, 28 bp, Artificial Sequence
  Description of Artificial Sequence: Synthetic oligonucleotide
gtaacagacgacacgtcctccctgagtg

SEQ ID NO: 241306 - DNA, 31 bp, Artificial Sequence
  Description of Artificial Sequence: Synthetic oligonucleotide
taacagacgacacgtcctccctgagtgtttc

SEQ ID NO: 241307 - DNA, 30 bp, Artificial Sequence
  Description of Artificial Sequence: Synthetic oligonucleotide
aacagacgacacgtcctccctgagtgtttc

SEQ ID NO: 241308 - DNA, 29 bp, Artificial Sequence
  Description of Artificial Sequence: Synthetic oligonucleotide
acagacgacacgtcctccctgagtgtttc

SEQ ID NO: 241309 - DNA, 28 bp, Artificial Sequence
  Description of Artificial Sequence: Synthetic oligonucleotide
cagacgacacgtcctccctgagtgtttc

SEQ ID NO: 241310 - DNA, 29 bp, Artificial Sequence
  Description of Artificial Sequence: Synthetic oligonucleotide
agacgacacgtcctccctgagtgtttctc

SEQ ID NO: 241311 - DNA, 28 bp, Artificial Sequence
  Description of Artificial Sequence: Synthetic oligonucleotide
gacgacacgtcctccctgagtgtttctc

SEQ ID NO: 241312 - DNA, 29 bp, Artificial Sequence
  Description of Artificial Sequence: Synthetic oligonucleotide
acgacacgtcctccctgagtgtttctctg

SEQ ID NO: 241313 - DNA, 28 bp, Artificial Sequence
  Description of Artificial Sequence: Synthetic oligonucleotide
cgacacgtcctccctgagtgtttctctg

SEQ ID NO: 241314 - DNA, 29 bp, Artificial Sequence
  Description of Artificial Sequence: Synthetic oligonucleotide
gacacgtcctccctgagtgtttctctgag

SEQ ID NO: 241315 - DNA, 30 bp, Artificial Sequence
  Description of Artificial Sequence: Synthetic oligonucleotide
acacgtcctccctgagtgtttctctgagag

SEQ ID NO: 241316 - DNA, 29 bp, Artificial Sequence
  Description of Artificial Sequence: Synthetic oligonucleotide
cacgtcctccctgagtgtttctctgagag

SEQ ID NO: 241317 - DNA, 30 bp, Artificial Sequence
  Description of Artificial Sequence: Synthetic oligonucleotide
acgtcctccctgagtgtttctctgagagag

SEQ ID NO: 241318 - DNA, 29 bp, Artificial Sequence
  Description of Artificial Sequence: Synthetic oligonucleotide
cgtcctccctgagtgtttctctgagagag

SEQ ID NO: 241319 - DNA, 32 bp, Artificial Sequence
  Description of Artificial Sequence: Synthetic oligonucleotide
gtcctccctgagtgtttctctgagagagaatc

SEQ ID NO: 241320 - DNA, 33 bp, Artificial Sequence
  Description of Artificial Sequence: Synthetic oligonucleotide
tcctccctgagtgtttctctgagagagaatctg

SEQ ID NO: 241321 - DNA, 32 bp, Artificial Sequence
  Description of Artificial Sequence: Synthetic oligonucleotide
cctccctgagtgtttctctgagagagaatctg

SEQ ID NO: 241322 - DNA, 33 bp, Artificial Sequence
  Description of Artificial Sequence: Synthetic oligonucleotide
ctccctgagtgtttctctgagagagaatctgtg

SEQ ID NO: 241323 - DNA, 33 bp, Artificial Sequence
  Description of Artificial Sequence: Synthetic oligonucleotide
tccctgagtgtttctctgagagagaatctgtgc

SEQ ID NO: 241324 - DNA, 32 bp, Artificial Sequence
  Description of Artificial Sequence: Synthetic oligonucleotide
ccctgagtgtttctctgagagagaatctgtgc

SEQ ID NO: 241325 - DNA, 38 bp, Artificial Sequence
  Description of Artificial Sequence: Synthetic oligonucleotide
cctgagtgtttctctgagagagaatctgtgcttatttc

SEQ ID NO: 241326 - DNA, 39 bp, Artificial Sequence
  Description of Artificial Sequence: Synthetic oligonucleotide
ctgagtgtttctctgagagagaatctgtgcttatttcag

SEQ ID NO: 241327 - DNA, 40 bp, Artificial Sequence
  Description of Artificial Sequence: Synthetic oligonucleotide
tgagtgtttctctgagagagaatctgtgcttatttcagtg

SEQ ID NO: 241328 - DNA, 39 bp, Artificial Sequence
  Description of Artificial Sequence: Synthetic oligonucleotide
gagtgtttctctgagagagaatctgtgcttatttcagtg

SEQ ID NO: 241329 - DNA, 39 bp, Artificial Sequence
  Description of Artificial Sequence: Synthetic oligonucleotide
agtgtttctctgagagagaatctgtgcttatttcagtgg

SEQ ID NO: 241330 - DNA, 38 bp, Artificial Sequence
  Description of Artificial Sequence: Synthetic oligonucleotide
gtgtttctctgagagagaatctgtgcttatttcagtgg

SEQ ID NO: 241331 - DNA, 40 bp, Artificial Sequence
  Description of Artificial Sequence: Synthetic oligonucleotide
tgtttctctgagagagaatctgtgcttatttcagtggtac

SEQ ID NO: 241332 - DNA, 39 bp, Artificial Sequence
  Description of Artificial Sequence: Synthetic oligonucleotide
gtttctctgagagagaatctgtgcttatttcagtggtac

SEQ ID NO: 241333 - DNA, 39 bp, Artificial Sequence
  Description of Artificial Sequence: Synthetic oligonucleotide
tttctctgagagagaatctgtgcttatttcagtggtacc

SEQ ID NO: 241334 - DNA, 38 bp, Artificial Sequence
  Description of Artificial Sequence: Synthetic oligonucleotide
ttctctgagagagaatctgtgcttatttcagtggtacc

SEQ ID NO: 241335 - DNA, 37 bp, Artificial Sequence
  Description of Artificial Sequence: Synthetic oligonucleotide
tctctgagagagaatctgtgcttatttcagtggtacc

SEQ ID NO: 241336 - DNA, 36 bp, Artificial Sequence
  Description of Artificial Sequence: Synthetic oligonucleotide
ctctgagagagaatctgtgcttatttcagtggtacc

SEQ ID NO: 241337 - DNA, 37 bp, Artificial Sequence
  Description of Artificial Sequence: Synthetic oligonucleotide
tctgagagagaatctgtgcttatttcagtggtacctc

SEQ ID NO: 241338 - DNA, 36 bp, Artificial Sequence
  Description of Artificial Sequence: Synthetic oligonucleotide
ctgagagagaatctgtgcttatttcagtggtacctc

SEQ ID NO: 241339 - DNA, 36 bp, Artificial Sequence
  Description of Artificial Sequence: Synthetic oligonucleotide
tgagagagaatctgtgcttatttcagtggtacctcg

SEQ ID NO: 241340 - DNA, 35 bp, Artificial Sequence
  Description of Artificial Sequence: Synthetic oligonucleotide
gagagagaatctgtgcttatttcagtggtacctcg

SEQ ID NO: 241341 - DNA, 36 bp, Artificial Sequence
  Description of Artificial Sequence: Synthetic oligonucleotide
agagagaatctgtgcttatttcagtggtacctcgtg

SEQ ID NO: 241342 - DNA, 35 bp, Artificial Sequence
  Description of Artificial Sequence: Synthetic oligonucleotide
gagagaatctgtgcttatttcagtggtacctcgtg

SEQ ID NO: 241343 - DNA, 35 bp, Artificial Sequence
  Description of Artificial Sequence: Synthetic oligonucleotide
agagaatctgtgcttatttcagtggtacctcgtgc

SEQ ID NO: 241344 - DNA, 34 bp, Artificial Sequence
  Description of Artificial Sequence: Synthetic oligonucleotide
gagaatctgtgcttatttcagtggtacctcgtgc

SEQ ID NO: 241345 - DNA, 34 bp, Artificial Sequence
  Description of Artificial Sequence: Synthetic oligonucleotide
agaatctgtgcttatttcagtggtacctcgtgcg

SEQ ID NO: 241346 - DNA, 33 bp, Artificial Sequence
  Description of Artificial Sequence: Synthetic oligonucleotide
gaatctgtgcttatttcagtggtacctcgtgcg

SEQ ID NO: 241347 - DNA, 34 bp, Artificial Sequence
  Description of Artificial Sequence: Synthetic oligonucleotide
aatctgtgcttatttcagtggtacctcgtgcgag

SEQ ID NO: 241348 - DNA, 33 bp, Artificial Sequence
  Description of Artificial Sequence: Synthetic oligonucleotide
atctgtgcttatttcagtggtacctcgtgcgag

SEQ ID NO: 241349 - DNA, 32 bp, Artificial Sequence
  Description of Artificial Sequence: Synthetic oligonucleotide
tctgtgcttatttcagtggtacctcgtgcgag

SEQ ID NO: 241350 - DNA, 31 bp, Artificial Sequence
  Description of Artificial Sequence: Synthetic oligonucleotide
ctgtgcttatttcagtggtacctcgtgcgag

SEQ ID NO: 241351 - DNA, 31 bp, Artificial Sequence
  Description of Artificial Sequence: Synthetic oligonucleotide
tgtgcttatttcagtggtacctcgtgcgagg

SEQ ID NO: 241352 - DNA, 30 bp, Artificial Sequence
  Description of Artificial Sequence: Synthetic oligonucleotide
gtgcttatttcagtggtacctcgtgcgagg

SEQ ID NO: 241353 - DNA, 30 bp, Artificial Sequence
  Description of Artificial Sequence: Synthetic oligonucleotide
tgcttatttcagtggtacctcgtgcgaggc

SEQ ID NO: 241354 - DNA, 29 bp, Artificial Sequence
  Description of Artificial Sequence: Synthetic oligonucleotide
gcttatttcagtggtacctcgtgcgaggc

SEQ ID NO: 241355 - DNA, 29 bp, Artificial Sequence
  Description of Artificial Sequence: Synthetic oligonucleotide
cttatttcagtggtacctcgtgcgaggcg

SEQ ID NO: 241356 - DNA, 32 bp, Artificial Sequence
  Description of Artificial Sequence: Synthetic oligonucleotide
ttatttcagtggtacctcgtgcgaggcgtatg

SEQ ID NO: 241357 - DNA, 31 bp, Artificial Sequence
  Description of Artificial Sequence: Synthetic oligonucleotide
tatttcagtggtacctcgtgcgaggcgtatg

SEQ ID NO: 241358 - DNA, 30 bp, Artificial Sequence
  Description of Artificial Sequence: Synthetic oligonucleotide
atttcagtggtacctcgtgcgaggcgtatg

SEQ ID NO: 241359 - DNA, 29 bp, Artificial Sequence
  Description of Artificial Sequence: Synthetic oligonucleotide
tttcagtggtacctcgtgcgaggcgtatg

SEQ ID NO: 241360 - DNA, 28 bp, Artificial Sequence
  Description of Artificial Sequence: Synthetic oligonucleotide
ttcagtggtacctcgtgcgaggcgtatg

SEQ ID NO: 241361 - DNA, 27 bp, Artificial Sequence
  Description of Artificial Sequence: Synthetic oligonucleotide
tcagtggtacctcgtgcgaggcgtatg

SEQ ID NO: 241362 - DNA, 27 bp, Artificial Sequence
  Description of Artificial Sequence: Synthetic oligonucleotide
cagtggtacctcgtgcgaggcgtatgt

SEQ ID NO: 241363 - DNA, 27 bp, Artificial Sequence
  Description of Artificial Sequence: Synthetic oligonucleotide
agtggtacctcgtgcgaggcgtatgtc

SEQ ID NO: 241364 - DNA, 27 bp, Artificial Sequence
  Description of Artificial Sequence: Synthetic oligonucleotide
gtggtacctcgtgcgaggcgtatgtct

SEQ ID NO: 241365 - DNA, 27 bp, Artificial Sequence
  Description of Artificial Sequence: Synthetic oligonucleotide
tggtacctcgtgcgaggcgtatgtctc

SEQ ID NO: 241366 - DNA, 27 bp, Artificial Sequence
  Description of Artificial Sequence: Synthetic oligonucleotide
ggtacctcgtgcgaggcgtatgtctct

SEQ ID NO: 241367 - DNA, 28 bp, Artificial Sequence
  Description of Artificial Sequence: Synthetic oligonucleotide
gtacctcgtgcgaggcgtatgtctctag

SEQ ID NO: 241368 - DNA, 28 bp, Artificial Sequence
  Description of Artificial Sequence: Synthetic oligonucleotide
tacctcgtgcgaggcgtatgtctctagg

SEQ ID NO: 241369 - DNA, 27 bp, Artificial Sequence
  Description of Artificial Sequence: Synthetic oligonucleotide
acctcgtgcgaggcgtatgtctctagg

SEQ ID NO: 241370 - DNA, 26 bp, Artificial Sequence
  Description of Artificial Sequence: Synthetic oligonucleotide
cctcgtgcgaggcgtatgtctctagg

SEQ ID NO: 241371 - DNA, 26 bp, Artificial Sequence
  Description of Artificial Sequence: Synthetic oligonucleotide
ctcgtgcgaggcgtatgtctctaggg

SEQ ID NO: 241372 - DNA, 27 bp, Artificial Sequence
  Description of Artificial Sequence: Synthetic oligonucleotide
tcgtgcgaggcgtatgtctctagggga

SEQ ID NO: 241373 - DNA, 27 bp, Artificial Sequence
  Description of Artificial Sequence: Synthetic oligonucleotide
cgtgcgaggcgtatgtctctaggggat

SEQ ID NO: 241374 - DNA, 27 bp, Artificial Sequence
  Description of Artificial Sequence: Synthetic oligonucleotide
gtgcgaggcgtatgtctctaggggatc

SEQ ID NO: 241375 - DNA, 29 bp, Artificial Sequence
  Description of Artificial Sequence: Synthetic oligonucleotide
tgcgaggcgtatgtctctaggggatcatc

SEQ ID NO: 241376 - DNA, 28 bp, Artificial Sequence
  Description of Artificial Sequence: Synthetic oligonucleotide
gcgaggcgtatgtctctaggggatcatc

SEQ ID NO: 241377 - DNA, 28 bp, Artificial Sequence
  Description of Artificial Sequence: Synthetic oligonucleotide
cgaggcgtatgtctctaggggatcatcc

SEQ ID NO: 241378 - DNA, 29 bp, Artificial Sequence
  Description of Artificial Sequence: Synthetic oligonucleotide
gaggcgtatgtctctaggggatcatcctc

SEQ ID NO: 241379 - DNA, 30 bp, Artificial Sequence
  Description of Artificial Sequence: Synthetic oligonucleotide
aggcgtatgtctctaggggatcatcctctg

SEQ ID NO: 241380 - DNA, 29 bp, Artificial Sequence
  Description of Artificial Sequence: Synthetic oligonucleotide
ggcgtatgtctctaggggatcatcctctg

SEQ ID NO: 241381 - DNA, 29 bp, Artificial Sequence
  Description of Artificial Sequence: Synthetic oligonucleotide
gcgtatgtctctaggggatcatcctctgg

SEQ ID NO: 241382 - DNA, 29 bp, Artificial Sequence
  Description of Artificial Sequence: Synthetic oligonucleotide
cgtatgtctctaggggatcatcctctggg

SEQ ID NO: 241383 - DNA, 29 bp, Artificial Sequence
  Description of Artificial Sequence: Synthetic oligonucleotide
gtatgtctctaggggatcatcctctgggg

SEQ ID NO: 241384 - DNA, 31 bp, Artificial Sequence
  Description of Artificial Sequence: Synthetic oligonucleotide
tatgtctctaggggatcatcctctggggaac

SEQ ID NO: 241385 - DNA, 30 bp, Artificial Sequence
  Description of Artificial Sequence: Synthetic oligonucleotide
atgtctctaggggatcatcctctggggaac

SEQ ID NO: 241386 - DNA, 29 bp, Artificial Sequence
  Description of Artificial Sequence: Synthetic oligonucleotide
tgtctctaggggatcatcctctggggaac

SEQ ID NO: 241387 - DNA, 28 bp, Artificial Sequence
  Description of Artificial Sequence: Synthetic oligonucleotide
gtctctaggggatcatcctctggggaac

SEQ ID NO: 241388 - DNA, 29 bp, Artificial Sequence
  Description of Artificial Sequence: Synthetic oligonucleotide
tctctaggggatcatcctctggggaacag

SEQ ID NO: 241389 - DNA, 28 bp, Artificial Sequence
  Description of Artificial Sequence: Synthetic oligonucleotide
ctctaggggatcatcctctggggaacag

SEQ ID NO: 241390 - DNA, 29 bp, Artificial Sequence
  Description of Artificial Sequence: Synthetic oligonucleotide
tctaggggatcatcctctggggaacagtg

SEQ ID NO: 241391 - DNA, 28 bp, Artificial Sequence
  Description of Artificial Sequence: Synthetic oligonucleotide
ctaggggatcatcctctggggaacagtg

SEQ ID NO: 241392 - DNA, 29 bp, Artificial Sequence
  Description of Artificial Sequence: Synthetic oligonucleotide
taggggatcatcctctggggaacagtgtc

SEQ ID NO: 241393 - DNA, 28 bp, Artificial Sequence
  Description of Artificial Sequence: Synthetic oligonucleotide
aggggatcatcctctggggaacagtgtc

SEQ ID NO: 241394 - DNA, 27 bp, Artificial Sequence
  Description of Artificial Sequence: Synthetic oligonucleotide
ggggatcatcctctggggaacagtgtc

SEQ ID NO: 241395 - DNA, 27 bp, Artificial Sequence
  Description of Artificial Sequence: Synthetic oligonucleotide
gggatcatcctctggggaacagtgtcc

SEQ ID NO: 241396 - DNA, 27 bp, Artificial Sequence
  Description of Artificial Sequence: Synthetic oligonucleotide
ggatcatcctctggggaacagtgtccc

SEQ ID NO: 241397 - DNA, 28 bp, Artificial Sequence
  Description of Artificial Sequence: Synthetic oligonucleotide
gatcatcctctggggaacagtgtcccac

SEQ ID NO: 241398 - DNA, 29 bp, Artificial Sequence
  Description of Artificial Sequence: Synthetic oligonucleotide
atcatcctctggggaacagtgtcccacac

SEQ ID NO: 241399 - DNA, 28 bp, Artificial Sequence
  Description of Artificial Sequence: Synthetic oligonucleotide
tcatcctctggggaacagtgtcccacac

SEQ ID NO: 241400 - DNA, 27 bp, Artificial Sequence
  Description of Artificial Sequence: Synthetic oligonucleotide
catcctctggggaacagtgtcccacac

SEQ ID NO: 241401 - DNA, 27 bp, Artificial Sequence
  Description of Artificial Sequence: Synthetic oligonucleotide
atcctctggggaacagtgtcccacacc

SEQ ID NO: 241402 - DNA, 27 bp, Artificial Sequence
  Description of Artificial Sequence: Synthetic oligonucleotide
tcctctggggaacagtgtcccacacca

SEQ ID NO: 241403 - DNA, 27 bp, Artificial Sequence
  Description of Artificial Sequence: Synthetic oligonucleotide
cctctggggaacagtgtcccacaccat

SEQ ID NO: 241404 - DNA, 27 bp, Artificial Sequence
  Description of Artificial Sequence: Synthetic oligonucleotide
ctctggggaacagtgtcccacaccatg

SEQ ID NO: 241405 - DNA, 27 bp, Artificial Sequence
  Description of Artificial Sequence: Synthetic oligonucleotide
tctggggaacagtgtcccacaccatgg

SEQ ID NO: 241406 - DNA, 27 bp, Artificial Sequence
  Description of Artificial Sequence: Synthetic oligonucleotide
ctggggaacagtgtcccacaccatggt

SEQ ID NO: 241407 - DNA, 27 bp, Artificial Sequence
  Description of Artificial Sequence: Synthetic oligonucleotide
tggggaacagtgtcccacaccatggtg

SEQ ID NO: 241408 - DNA, 27 bp, Artificial Sequence
  Description of Artificial Sequence: Synthetic oligonucleotide
ggggaacagtgtcccacaccatggtga

SEQ ID NO: 241409 - DNA, 27 bp, Artificial Sequence
  Description of Artificial Sequence: Synthetic oligonucleotide
gggaacagtgtcccacaccatggtgac

SEQ ID NO: 241410 - DNA, 27 bp, Artificial Sequence
  Description of Artificial Sequence: Synthetic oligonucleotide
ggaacagtgtcccacaccatggtgacc

SEQ ID NO: 241411 - DNA, 27 bp, Artificial Sequence
  Description of Artificial Sequence: Synthetic oligonucleotide
gaacagtgtcccacaccatggtgaccc

SEQ ID NO: 241412 - DNA, 28 bp, Artificial Sequence
  Description of Artificial Sequence: Synthetic oligonucleotide
aacagtgtcccacaccatggtgaccctg

SEQ ID NO: 241413 - DNA, 27 bp, Artificial Sequence
  Description of Artificial Sequence: Synthetic oligonucleotide
acagtgtcccacaccatggtgaccctg

SEQ ID NO: 241414 - DNA, 26 bp, Artificial Sequence
  Description of Artificial Sequence: Synthetic oligonucleotide
cagtgtcccacaccatggtgaccctg

SEQ ID NO: 241415 - DNA, 27 bp, Artificial Sequence
  Description of Artificial Sequence: Synthetic oligonucleotide
agtgtcccacaccatggtgaccctggt

SEQ ID NO: 241416 - DNA, 26 bp, Artificial Sequence
  Description of Artificial Sequence: Synthetic oligonucleotide
gtgtcccacaccatggtgaccctggt

SEQ ID NO: 241417 - DNA, 27 bp, Artificial Sequence
  Description of Artificial Sequence: Synthetic oligonucleotide
tgtcccacaccatggtgaccctggtct

SEQ ID NO: 241418 - DNA, 26 bp, Artificial Sequence
  Description of Artificial Sequence: Synthetic oligonucleotide
gtcccacaccatggtgaccctggtct

SEQ ID NO: 241419 - DNA, 26 bp, Artificial Sequence
  Description of Artificial Sequence: Synthetic oligonucleotide
tcccacaccatggtgaccctggtctc

SEQ ID NO: 241420 - DNA, 25 bp, Artificial Sequence
  Description of Artificial Sequence: Synthetic oligonucleotide
cccacaccatggtgaccctggtctc

SEQ ID NO: 241421 - DNA, 25 bp, Artificial Sequence
  Description of Artificial Sequence: Synthetic oligonucleotide
ccacaccatggtgaccctggtctcc

SEQ ID NO: 241422 - DNA, 26 bp, Artificial Sequence
  Description of Artificial Sequence: Synthetic oligonucleotide
cacaccatggtgaccctggtctccct

SEQ ID NO: 241423 - DNA, 26 bp, Artificial Sequence
  Description of Artificial Sequence: Synthetic oligonucleotide
acaccatggtgaccctggtctccctg

SEQ ID NO: 241424 - DNA, 25 bp, Artificial Sequence
  Description of Artificial Sequence: Synthetic oligonucleotide
caccatggtgaccctggtctccctg

SEQ ID NO: 241425 - DNA, 25 bp, Artificial Sequence
  Description of Artificial Sequence: Synthetic oligonucleotide
accatggtgaccctggtctccctgc

SEQ ID NO: 241426 - DNA, 24 bp, Artificial Sequence
  Description of Artificial Sequence: Synthetic oligonucleotide
ccatggtgaccctggtctccctgc

SEQ ID NO: 241427 - DNA, 25 bp, Artificial Sequence
  Description of Artificial Sequence: Synthetic oligonucleotide
catggtgaccctggtctccctgcct

SEQ ID NO: 241428 - DNA, 26 bp, Artificial Sequence
  Description of Artificial Sequence: Synthetic oligonucleotide
atggtgaccctggtctccctgcctca

SEQ ID NO: 241429 - DNA, 25 bp, Artificial Sequence
  Description of Artificial Sequence: Synthetic oligonucleotide
tggtgaccctggtctccctgcctca

SEQ ID NO: 241430 - DNA, 24 bp, Artificial Sequence
  Description of Artificial Sequence: Synthetic oligonucleotide
ggtgaccctggtctccctgcctca

SEQ ID NO: 241431 - DNA, 24 bp, Artificial Sequence
  Description of Artificial Sequence: Synthetic oligonucleotide
gtgaccctggtctccctgcctcag

SEQ ID NO: 241432 - DNA, 27 bp, Artificial Sequence
  Description of Artificial Sequence: Synthetic oligonucleotide
tgaccctggtctccctgcctcagcttt

SEQ ID NO: 241433 - DNA, 27 bp, Artificial Sequence
  Description of Artificial Sequence: Synthetic oligonucleotide
gaccctggtctccctgcctcagctttt

SEQ ID NO: 241434 - DNA, 27 bp, Artificial Sequence
  Description of Artificial Sequence: Synthetic oligonucleotide
accctggtctccctgcctcagcttttc

SEQ ID NO: 241435 - DNA, 26 bp, Artificial Sequence
  Description of Artificial Sequence: Synthetic oligonucleotide
ccctggtctccctgcctcagcttttc

SEQ ID NO: 241436 - DNA, 27 bp, Artificial Sequence
  Description of Artificial Sequence: Synthetic oligonucleotide
cctggtctccctgcctcagcttttcct

SEQ ID NO: 241437 - DNA, 28 bp, Artificial Sequence
  Description of Artificial Sequence: Synthetic oligonucleotide
ctggtctccctgcctcagcttttcctac

SEQ ID NO: 241438 - DNA, 29 bp, Artificial Sequence
  Description of Artificial Sequence: Synthetic oligonucleotide
tggtctccctgcctcagcttttcctactg

SEQ ID NO: 241439 - DNA, 28 bp, Artificial Sequence
  Description of Artificial Sequence: Synthetic oligonucleotide
ggtctccctgcctcagcttttcctactg

SEQ ID NO: 241440 - DNA, 28 bp, Artificial Sequence
  Description of Artificial Sequence: Synthetic oligonucleotide
gtctccctgcctcagcttttcctactgc

SEQ ID NO: 241441 - DNA, 28 bp, Artificial Sequence
  Description of Artificial Sequence: Synthetic oligonucleotide
tctccctgcctcagcttttcctactgcc

SEQ ID NO: 241442 - DNA, 27 bp, Artificial Sequence
  Description of Artificial Sequence: Synthetic oligonucleotide
ctccctgcctcagcttttcctactgcc

SEQ ID NO: 241443 - DNA, 27 bp, Artificial Sequence
  Description of Artificial Sequence: Synthetic oligonucleotide
tccctgcctcagcttttcctactgccc

SEQ ID NO: 241444 - DNA, 27 bp, Artificial Sequence
  Description of Artificial Sequence: Synthetic oligonucleotide
ccctgcctcagcttttcctactgccca

SEQ ID NO: 241445 - DNA, 28 bp, Artificial Sequence
  Description of Artificial Sequence: Synthetic oligonucleotide
cctgcctcagcttttcctactgcccaag

SEQ ID NO: 241446 - DNA, 30 bp, Artificial Sequence
  Description of Artificial Sequence: Synthetic oligonucleotide
ctgcctcagcttttcctactgcccaagtag

SEQ ID NO: 241447 - DNA, 30 bp, Artificial Sequence
  Description of Artificial Sequence: Synthetic oligonucleotide
tgcctcagcttttcctactgcccaagtagg

SEQ ID NO: 241448 - DNA, 29 bp, Artificial Sequence
  Description of Artificial Sequence: Synthetic oligonucleotide
gcctcagcttttcctactgcccaagtagg

SEQ ID NO: 241449 - DNA, 30 bp, Artificial Sequence
  Description of Artificial Sequence: Synthetic oligonucleotide
cctcagcttttcctactgcccaagtaggtg

SEQ ID NO: 241450 - DNA, 30 bp, Artificial Sequence
  Description of Artificial Sequence: Synthetic oligonucleotide
ctcagcttttcctactgcccaagtaggtgg

SEQ ID NO: 241451 - DNA, 30 bp, Artificial Sequence
  Description of Artificial Sequence: Synthetic oligonucleotide
tcagcttttcctactgcccaagtaggtggg

SEQ ID NO: 241452 - DNA, 29 bp, Artificial Sequence
  Description of Artificial Sequence: Synthetic oligonucleotide
cagcttttcctactgcccaagtaggtggg

SEQ ID NO: 241453 - DNA, 34 bp, Artificial Sequence
  Description of Artificial Sequence: Synthetic oligonucleotide
agcttttcctactgcccaagtaggtgggaatatg

SEQ ID NO: 241454 - DNA, 33 bp, Artificial Sequence
  Description of Artificial Sequence: Synthetic oligonucleotide
gcttttcctactgcccaagtaggtgggaatatg

SEQ ID NO: 241455 - DNA, 33 bp, Artificial Sequence
  Description of Artificial Sequence: Synthetic oligonucleotide
cttttcctactgcccaagtaggtgggaatatgg

SEQ ID NO: 241456 - DNA, 35 bp, Artificial Sequence
  Description of Artificial Sequence: Synthetic oligonucleotide
ttttcctactgcccaagtaggtgggaatatggtac

SEQ ID NO: 241457 - DNA, 34 bp, Artificial Sequence
  Description of Artificial Sequence: Synthetic oligonucleotide
tttcctactgcccaagtaggtgggaatatggtac

SEQ ID NO: 241458 - DNA, 33 bp, Artificial Sequence
  Description of Artificial Sequence: Synthetic oligonucleotide
ttcctactgcccaagtaggtgggaatatggtac

SEQ ID NO: 241459 - DNA, 32 bp, Artificial Sequence
  Description of Artificial Sequence: Synthetic oligonucleotide
tcctactgcccaagtaggtgggaatatggtac

SEQ ID NO: 241460 - DNA, 31 bp, Artificial Sequence
  Description of Artificial Sequence: Synthetic oligonucleotide
cctactgcccaagtaggtgggaatatggtac

SEQ ID NO: 241461 - DNA, 31 bp, Artificial Sequence
  Description of Artificial Sequence: Synthetic oligonucleotide
ctactgcccaagtaggtgggaatatggtacc

SEQ ID NO: 241462 - DNA, 32 bp, Artificial Sequence
  Description of Artificial Sequence: Synthetic oligonucleotide
tactgcccaagtaggtgggaatatggtaccac

SEQ ID NO: 241463 - DNA, 31 bp, Artificial Sequence
  Description of Artificial Sequence: Synthetic oligonucleotide
actgcccaagtaggtgggaatatggtaccac

SEQ ID NO: 241464 - DNA, 30 bp, Artificial Sequence
  Description of Artificial Sequence: Synthetic oligonucleotide
ctgcccaagtaggtgggaatatggtaccac

SEQ ID NO: 241465 - DNA, 32 bp, Artificial Sequence
  Description of Artificial Sequence: Synthetic oligonucleotide
tgcccaagtaggtgggaatatggtaccacttg

SEQ ID NO: 241466 - DNA, 31 bp, Artificial Sequence
  Description of Artificial Sequence: Synthetic oligonucleotide
gcccaagtaggtgggaatatggtaccacttg

SEQ ID NO: 241467 - DNA, 31 bp, Artificial Sequence
  Description of Artificial Sequence: Synthetic oligonucleotide
cccaagtaggtgggaatatggtaccacttgc

SEQ ID NO: 241468 - DNA, 32 bp, Artificial Sequence
  Description of Artificial Sequence: Synthetic oligonucleotide
ccaagtaggtgggaatatggtaccacttgctg

SEQ ID NO: 241469 - DNA, 32 bp, Artificial Sequence
  Description of Artificial Sequence: Synthetic oligonucleotide
caagtaggtgggaatatggtaccacttgctgg

SEQ ID NO: 241470 - DNA, 34 bp, Artificial Sequence
  Description of Artificial Sequence: Synthetic oligonucleotide
aagtaggtgggaatatggtaccacttgctggaac

SEQ ID NO: 241471 - DNA, 33 bp, Artificial Sequence
  Description of Artificial Sequence: Synthetic oligonucleotide
agtaggtgggaatatggtaccacttgctggaac

SEQ ID NO: 241472 - DNA, 32 bp, Artificial Sequence
  Description of Artificial Sequence: Synthetic oligonucleotide
gtaggtgggaatatggtaccacttgctggaac

SEQ ID NO: 241473 - DNA, 33 bp, Artificial Sequence
  Description of Artificial Sequence: Synthetic oligonucleotide
taggtgggaatatggtaccacttgctggaactg

SEQ ID NO: 241474 - DNA, 32 bp, Artificial Sequence
  Description of Artificial Sequence: Synthetic oligonucleotide
aggtgggaatatggtaccacttgctggaactg

SEQ ID NO: 241475 - DNA, 31 bp, Artificial Sequence
  Description of Artificial Sequence: Synthetic oligonucleotide
ggtgggaatatggtaccacttgctggaactg

SEQ ID NO: 241476 - DNA, 31 bp, Artificial Sequence
  Description of Artificial Sequence: Synthetic oligonucleotide
gtgggaatatggtaccacttgctggaactgc

SEQ ID NO: 241477 - DNA, 32 bp, Artificial Sequence
  Description of Artificial Sequence: Synthetic oligonucleotide
tgggaatatggtaccacttgctggaactgcag

SEQ ID NO: 241478 - DNA, 31 bp, Artificial Sequence
  Description of Artificial Sequence: Synthetic oligonucleotide
gggaatatggtaccacttgctggaactgcag

SEQ ID NO: 241479 - DNA, 31 bp, Artificial Sequence
  Description of Artificial Sequence: Synthetic oligonucleotide
ggaatatggtaccacttgctggaactgcagg

SEQ ID NO: 241480 - DNA, 32 bp, Artificial Sequence
  Description of Artificial Sequence: Synthetic oligonucleotide
gaatatggtaccacttgctggaactgcaggtg

SEQ ID NO: 241481 - DNA, 32 bp, Artificial Sequence
  Description of Artificial Sequence: Synthetic oligonucleotide
aatatggtaccacttgctggaactgcaggtgc

SEQ ID NO: 241482 - DNA, 31 bp, Artificial Sequence
  Description of Artificial Sequence: Synthetic oligonucleotide
atatggtaccacttgctggaactgcaggtgc

SEQ ID NO: 241483 - DNA, 30 bp, Artificial Sequence
  Description of Artificial Sequence: Synthetic oligonucleotide
tatggtaccacttgctggaactgcaggtgc

SEQ ID NO: 241484 - DNA, 29 bp, Artificial Sequence
  Description of Artificial Sequence: Synthetic oligonucleotide
atggtaccacttgctggaactgcaggtgc

SEQ ID NO: 241485 - DNA, 28 bp, Artificial Sequence
  Description of Artificial Sequence: Synthetic oligonucleotide
tggtaccacttgctggaactgcaggtgc

SEQ ID NO: 241486 - DNA, 27 bp, Artificial Sequence
  Description of Artificial Sequence: Synthetic oligonucleotide
ggtaccacttgctggaactgcaggtgc

SEQ ID NO: 241487 - DNA, 27 bp, Artificial Sequence
  Description of Artificial Sequence: Synthetic oligonucleotide
gtaccacttgctggaactgcaggtgcc

SEQ ID NO: 241488 - DNA, 27 bp, Artificial Sequence
  Description of Artificial Sequence: Synthetic oligonucleotide
taccacttgctggaactgcaggtgccg

SEQ ID NO: 241489 - DNA, 26 bp, Artificial Sequence
  Description of Artificial Sequence: Synthetic oligonucleotide
accacttgctggaactgcaggtgccg

SEQ ID NO: 241490 - DNA, 25 bp, Artificial Sequence
  Description of Artificial Sequence: Synthetic oligonucleotide
ccacttgctggaactgcaggtgccg

SEQ ID NO: 241491 - DNA, 27 bp, Artificial Sequence
  Description of Artificial Sequence: Synthetic oligonucleotide
cacttgctggaactgcaggtgccggaa

SEQ ID NO: 241492 - DNA, 28 bp, Artificial Sequence
  Description of Artificial Sequence: Synthetic oligonucleotide
acttgctggaactgcaggtgccggaatc

SEQ ID NO: 241493 - DNA, 27 bp, Artificial Sequence
  Description of Artificial Sequence: Synthetic oligonucleotide
cttgctggaactgcaggtgccggaatc

SEQ ID NO: 241494 - DNA, 28 bp, Artificial Sequence
  Description of Artificial Sequence: Synthetic oligonucleotide
ttgctggaactgcaggtgccggaatctc

SEQ ID NO: 241495 - DNA, 27 bp, Artificial Sequence
  Description of Artificial Sequence: Synthetic oligonucleotide
tgctggaactgcaggtgccggaatctc

SEQ ID NO: 241496 - DNA, 27 bp, Artificial Sequence
  Description of Artificial Sequence: Synthetic oligonucleotide
gctggaactgcaggtgccggaatctct

SEQ ID NO: 241497 - DNA, 27 bp, Artificial Sequence
  Description of Artificial Sequence: Synthetic oligonucleotide
ctggaactgcaggtgccggaatctctc

SEQ ID NO: 241498 - DNA, 27 bp, Artificial Sequence
  Description of Artificial Sequence: Synthetic oligonucleotide
tggaactgcaggtgccggaatctctcg

SEQ ID NO: 241499 - DNA, 26 bp, Artificial Sequence
  Description of Artificial Sequence: Synthetic oligonucleotide
ggaactgcaggtgccggaatctctcg

SEQ ID NO: 241500 - DNA, 27 bp, Artificial Sequence
  Description of Artificial Sequence: Synthetic oligonucleotide
gaactgcaggtgccggaatctctcgca

SEQ ID NO: 241501 - DNA, 29 bp, Artificial Sequence
  Description of Artificial Sequence: Synthetic oligonucleotide
aactgcaggtgccggaatctctcgcaaag

SEQ ID NO: 241502 - DNA, 28 bp, Artificial Sequence
  Description of Artificial Sequence: Synthetic oligonucleotide
actgcaggtgccggaatctctcgcaaag

SEQ ID NO: 241503 - DNA, 27 bp, Artificial Sequence
  Description of Artificial Sequence: Synthetic oligonucleotide
ctgcaggtgccggaatctctcgcaaag

SEQ ID NO: 241504 - DNA, 28 bp, Artificial Sequence
  Description of Artificial Sequence: Synthetic oligonucleotide
tgcaggtgccggaatctctcgcaaagtc

SEQ ID NO: 241505 - DNA, 27 bp, Artificial Sequence
  Description of Artificial Sequence: Synthetic oligonucleotide
gcaggtgccggaatctctcgcaaagtc

SEQ ID NO: 241506 - DNA, 27 bp, Artificial Sequence
  Description of Artificial Sequence: Synthetic oligonucleotide
caggtgccggaatctctcgcaaagtcc

SEQ ID NO: 241507 - DNA, 28 bp, Artificial Sequence
  Description of Artificial Sequence: Synthetic oligonucleotide
aggtgccggaatctctcgcaaagtcctg

SEQ ID NO: 241508 - DNA, 27 bp, Artificial Sequence
  Description of Artificial Sequence: Synthetic oligonucleotide
ggtgccggaatctctcgcaaagtcctg

SEQ ID NO: 241509 - DNA, 27 bp, Artificial Sequence
  Description of Artificial Sequence: Synthetic oligonucleotide
gtgccggaatctctcgcaaagtcctgc

SEQ ID NO: 241510 - DNA, 27 bp, Artificial Sequence
  Description of Artificial Sequence: Synthetic oligonucleotide
tgccggaatctctcgcaaagtcctgcc

SEQ ID NO: 241511 - DNA, 27 bp, Artificial Sequence
  Description of Artificial Sequence: Synthetic oligonucleotide
gccggaatctctcgcaaagtcctgcca

SEQ ID NO: 241512 - DNA, 27 bp, Artificial Sequence
  Description of Artificial Sequence: Synthetic oligonucleotide
ccggaatctctcgcaaagtcctgccag

SEQ ID NO: 241513 - DNA, 27 bp, Artificial Sequence
  Description of Artificial Sequence: Synthetic oligonucleotide
cggaatctctcgcaaagtcctgccagg

SEQ ID NO: 241514 - DNA, 28 bp, Artificial Sequence
  Description of Artificial Sequence: Synthetic oligonucleotide
ggaatctctcgcaaagtcctgccaggtg

SEQ ID NO: 241515 - DNA, 28 bp, Artificial Sequence
  Description of Artificial Sequence: Synthetic oligonucleotide
gaatctctcgcaaagtcctgccaggtgg

SEQ ID NO: 241516 - DNA, 28 bp, Artificial Sequence
  Description of Artificial Sequence: Synthetic oligonucleotide
aatctctcgcaaagtcctgccaggtggg

SEQ ID NO: 241517 - DNA, 27 bp, Artificial Sequence
  Description of Artificial Sequence: Synthetic oligonucleotide
atctctcgcaaagtcctgccaggtggg

SEQ ID NO: 241518 - DNA, 26 bp, Artificial Sequence
  Description of Artificial Sequence: Synthetic oligonucleotide
tctctcgcaaagtcctgccaggtggg

SEQ ID NO: 241519 - DNA, 25 bp, Artificial Sequence
  Description of Artificial Sequence: Synthetic oligonucleotide
ctctcgcaaagtcctgccaggtggg

SEQ ID NO: 241520 - DNA, 27 bp, Artificial Sequence
  Description of Artificial Sequence: Synthetic oligonucleotide
tctcgcaaagtcctgccaggtgggcat

SEQ ID NO: 241521 - DNA, 27 bp, Artificial Sequence
  Description of Artificial Sequence: Synthetic oligonucleotide
ctcgcaaagtcctgccaggtgggcatt

SEQ ID NO: 241522 - DNA, 27 bp, Artificial Sequence
  Description of Artificial Sequence: Synthetic oligonucleotide
tcgcaaagtcctgccaggtgggcattg

SEQ ID NO: 241523 - DNA, 27 bp, Artificial Sequence
  Description of Artificial Sequence: Synthetic oligonucleotide
cgcaaagtcctgccaggtgggcattga

SEQ ID NO: 241524 - DNA, 27 bp, Artificial Sequence
  Description of Artificial Sequence: Synthetic oligonucleotide
gcaaagtcctgccaggtgggcattgag

SEQ ID NO: 241525 - DNA, 27 bp, Artificial Sequence
  Description of Artificial Sequence: Synthetic oligonucleotide
caaagtcctgccaggtgggcattgagg

SEQ ID NO: 241526 - DNA, 28 bp, Artificial Sequence
  Description of Artificial Sequence: Synthetic oligonucleotide
aaagtcctgccaggtgggcattgaggtg

SEQ ID NO: 241527 - DNA, 27 bp, Artificial Sequence
  Description of Artificial Sequence: Synthetic oligonucleotide
aagtcctgccaggtgggcattgaggtg

SEQ ID NO: 241528 - DNA, 26 bp, Artificial Sequence
  Description of Artificial Sequence: Synthetic oligonucleotide
agtcctgccaggtgggcattgaggtg

SEQ ID NO: 241529 - DNA, 25 bp, Artificial Sequence
  Description of Artificial Sequence: Synthetic oligonucleotide
gtcctgccaggtgggcattgaggtg

SEQ ID NO: 241530 - DNA, 26 bp, Artificial Sequence
  Description of Artificial Sequence: Synthetic oligonucleotide
tcctgccaggtgggcattgaggtgct

SEQ ID NO: 241531 - DNA, 25 bp, Artificial Sequence
  Description of Artificial Sequence: Synthetic oligonucleotide
cctgccaggtgggcattgaggtgct

SEQ ID NO: 241532 - DNA, 26 bp, Artificial Sequence
  Description of Artificial Sequence: Synthetic oligonucleotide
ctgccaggtgggcattgaggtgctgt

SEQ ID NO: 241533 - DNA, 26 bp, Artificial Sequence
  Description of Artificial Sequence: Synthetic oligonucleotide
tgccaggtgggcattgaggtgctgtc

SEQ ID NO: 241534 - DNA, 25 bp, Artificial Sequence
  Description of Artificial Sequence: Synthetic oligonucleotide
gccaggtgggcattgaggtgctgtc

SEQ ID NO: 241535 - DNA, 25 bp, Artificial Sequence
  Description of Artificial Sequence: Synthetic oligonucleotide
ccaggtgggcattgaggtgctgtcg

SEQ ID NO: 241536 - DNA, 25 bp, Artificial Sequence
  Description of Artificial Sequence: Synthetic oligonucleotide
caggtgggcattgaggtgctgtcgg

SEQ ID NO: 241537 - DNA, 25 bp, Artificial Sequence
  Description of Artificial Sequence: Synthetic oligonucleotide
aggtgggcattgaggtgctgtcggc

SEQ ID NO: 241538 - DNA, 24 bp, Artificial Sequence
  Description of Artificial Sequence: Synthetic oligonucleotide
ggtgggcattgaggtgctgtcggc

SEQ ID NO: 241539 - DNA, 26 bp, Artificial Sequence
  Description of Artificial Sequence: Synthetic oligonucleotide
gtgggcattgaggtgctgtcggcctt

SEQ ID NO: 241540 - DNA, 26 bp, Artificial Sequence
  Description of Artificial Sequence: Synthetic oligonucleotide
tgggcattgaggtgctgtcggccttg

SEQ ID NO: 241541 - DNA, 25 bp, Artificial Sequence
  Description of Artificial Sequence: Synthetic oligonucleotide
gggcattgaggtgctgtcggccttg

SEQ ID NO: 241542 - DNA, 25 bp, Artificial Sequence
  Description of Artificial Sequence: Synthetic oligonucleotide
ggcattgaggtgctgtcggccttgc

SEQ ID NO: 241543 - DNA, 27 bp, Artificial Sequence
  Description of Artificial Sequence: Synthetic oligonucleotide
gcattgaggtgctgtcggccttgccta

SEQ ID NO: 241544 - DNA, 27 bp, Artificial Sequence
  Description of Artificial Sequence: Synthetic oligonucleotide
cattgaggtgctgtcggccttgcctac

SEQ ID NO: 241545 - DNA, 28 bp, Artificial Sequence
  Description of Artificial Sequence: Synthetic oligonucleotide
attgaggtgctgtcggccttgcctacag

SEQ ID NO: 241546 - DNA, 27 bp, Artificial Sequence
  Description of Artificial Sequence: Synthetic oligonucleotide
ttgaggtgctgtcggccttgcctacag

SEQ ID NO: 241547 - DNA, 27 bp, Artificial Sequence
  Description of Artificial Sequence: Synthetic oligonucleotide
tgaggtgctgtcggccttgcctacaga

SEQ ID NO: 241548 - DNA, 27 bp, Artificial Sequence
  Description of Artificial Sequence: Synthetic oligonucleotide
gaggtgctgtcggccttgcctacagat

SEQ ID NO: 241549 - DNA, 27 bp, Artificial Sequence
  Description of Artificial Sequence: Synthetic oligonucleotide
aggtgctgtcggccttgcctacagatc

SEQ ID NO: 241550 - DNA, 26 bp, Artificial Sequence
  Description of Artificial Sequence: Synthetic oligonucleotide
ggtgctgtcggccttgcctacagatc

SEQ ID NO: 241551 - DNA, 27 bp, Artificial Sequence
  Description of Artificial Sequence: Synthetic oligonucleotide
gtgctgtcggccttgcctacagatcga

SEQ ID NO: 241552 - DNA, 28 bp, Artificial Sequence
  Description of Artificial Sequence: Synthetic oligonucleotide
tgctgtcggccttgcctacagatcgaag

SEQ ID NO: 241553 - DNA, 27 bp, Artificial Sequence
  Description of Artificial Sequence: Synthetic oligonucleotide
gctgtcggccttgcctacagatcgaag

SEQ ID NO: 241554 - DNA, 27 bp, Artificial Sequence
  Description of Artificial Sequence: Synthetic oligonucleotide
ctgtcggccttgcctacagatcgaagc

SEQ ID NO: 241555 - DNA, 30 bp, Artificial Sequence
  Description of Artificial Sequence: Synthetic oligonucleotide
tgtcggccttgcctacagatcgaagcttag

SEQ ID NO: 241556 - DNA, 29 bp, Artificial Sequence
  Description of Artificial Sequence: Synthetic oligonucleotide
gtcggccttgcctacagatcgaagcttag

SEQ ID NO: 241557 - DNA, 29 bp, Artificial Sequence
  Description of Artificial Sequence: Synthetic oligonucleotide
tcggccttgcctacagatcgaagcttagc

SEQ ID NO: 241558 - DNA, 28 bp, Artificial Sequence
  Description of Artificial Sequence: Synthetic oligonucleotide
cggccttgcctacagatcgaagcttagc

SEQ ID NO: 241559 - DNA, 28 bp, Artificial Sequence
  Description of Artificial Sequence: Synthetic oligonucleotide
ggccttgcctacagatcgaagcttagcc

SEQ ID NO: 241560 - DNA, 30 bp, Artificial Sequence
  Description of Artificial Sequence: Synthetic oligonucleotide
gccttgcctacagatcgaagcttagccaac

SEQ ID NO: 241561 - DNA, 30 bp, Artificial Sequence
  Description of Artificial Sequence: Synthetic oligonucleotide
ccttgcctacagatcgaagcttagccaacg

SEQ ID NO: 241562 - DNA, 31 bp, Artificial Sequence
  Description of Artificial Sequence: Synthetic oligonucleotide
cttgcctacagatcgaagcttagccaacgag

SEQ ID NO: 241563 - DNA, 31 bp, Artificial Sequence
  Description of Artificial Sequence: Synthetic oligonucleotide
ttgcctacagatcgaagcttagccaacgagc

SEQ ID NO: 241564 - DNA, 30 bp, Artificial Sequence
  Description of Artificial Sequence: Synthetic oligonucleotide
tgcctacagatcgaagcttagccaacgagc

SEQ ID NO: 241565 - DNA, 29 bp, Artificial Sequence
  Description of Artificial Sequence: Synthetic oligonucleotide
gcctacagatcgaagcttagccaacgagc

SEQ ID NO: 241566 - DNA, 30 bp, Artificial Sequence
  Description of Artificial Sequence: Synthetic oligonucleotide
cctacagatcgaagcttagccaacgagcag

SEQ ID NO: 241567 - DNA, 30 bp, Artificial Sequence
  Description of Artificial Sequence: Synthetic oligonucleotide
ctacagatcgaagcttagccaacgagcagg

SEQ ID NO: 241568 - DNA, 30 bp, Artificial Sequence
  Description of Artificial Sequence: Synthetic oligonucleotide
tacagatcgaagcttagccaacgagcaggg

SEQ ID NO: 241569 - DNA, 29 bp, Artificial Sequence
  Description of Artificial Sequence: Synthetic oligonucleotide
acagatcgaagcttagccaacgagcaggg

SEQ ID NO: 241570 - DNA, 28 bp, Artificial Sequence
  Description of Artificial Sequence: Synthetic oligonucleotide
cagatcgaagcttagccaacgagcaggg

SEQ ID NO: 241571 - DNA, 28 bp, Artificial Sequence
  Description of Artificial Sequence: Synthetic oligonucleotide
agatcgaagcttagccaacgagcagggc

SEQ ID NO: 241572 - DNA, 27 bp, Artificial Sequence
  Description of Artificial Sequence: Synthetic oligonucleotide
gatcgaagcttagccaacgagcagggc

SEQ ID NO: 241573 - DNA, 27 bp, Artificial Sequence
  Description of Artificial Sequence: Synthetic oligonucleotide
atcgaagcttagccaacgagcagggcg

SEQ ID NO: 241574 - DNA, 27 bp, Artificial Sequence
  Description of Artificial Sequence: Synthetic oligonucleotide
tcgaagcttagccaacgagcagggcga

SEQ ID NO: 241575 - DNA, 27 bp, Artificial Sequence
  Description of Artificial Sequence: Synthetic oligonucleotide
cgaagcttagccaacgagcagggcgaa

SEQ ID NO: 241576 - DNA, 27 bp, Artificial Sequence
  Description of Artificial Sequence: Synthetic oligonucleotide
gaagcttagccaacgagcagggcgaag

SEQ ID NO: 241577 - DNA, 27 bp, Artificial Sequence
  Description of Artificial Sequence: Synthetic oligonucleotide
aagcttagccaacgagcagggcgaagg

SEQ ID NO: 241578 - DNA, 26 bp, Artificial Sequence
  Description of Artificial Sequence: Synthetic oligonucleotide
agcttagccaacgagcagggcgaagg

SEQ ID NO: 241579 - DNA, 25 bp, Artificial Sequence
  Description of Artificial Sequence: Synthetic oligonucleotide
gcttagccaacgagcagggcgaagg

SEQ ID NO: 241580 - DNA, 25 bp, Artificial Sequence
  Description of Artificial Sequence: Synthetic oligonucleotide
cttagccaacgagcagggcgaaggc

SEQ ID NO: 241581 - DNA, 26 bp, Artificial Sequence
  Description of Artificial Sequence: Synthetic oligonucleotide
ttagccaacgagcagggcgaaggcca

SEQ ID NO: 241582 - DNA, 25 bp, Artificial Sequence
  Description of Artificial Sequence: Synthetic oligonucleotide
tagccaacgagcagggcgaaggcca

SEQ ID NO: 241583 - DNA, 24 bp, Artificial Sequence
  Description of Artificial Sequence: Synthetic oligonucleotide
agccaacgagcagggcgaaggcca

SEQ ID NO: 241584 - DNA, 23 bp, Artificial Sequence
  Description of Artificial Sequence: Synthetic oligonucleotide
gccaacgagcagggcgaaggcca

SEQ ID NO: 241585 - DNA, 25 bp, Artificial Sequence
  Description of Artificial Sequence: Synthetic oligonucleotide
ccaacgagcagggcgaaggccagaa

SEQ ID NO: 241586 - DNA, 27 bp, Artificial Sequence
  Description of Artificial Sequence: Synthetic oligonucleotide
caacgagcagggcgaaggccagaagtt

SEQ ID NO: 241587 - DNA, 29 bp, Artificial Sequence
  Description of Artificial Sequence: Synthetic oligonucleotide
aacgagcagggcgaaggccagaagttaag

SEQ ID NO: 241588 - DNA, 28 bp, Artificial Sequence
  Description of Artificial Sequence: Synthetic oligonucleotide
acgagcagggcgaaggccagaagttaag

SEQ ID NO: 241589 - DNA, 27 bp, Artificial Sequence
  Description of Artificial Sequence: Synthetic oligonucleotide
cgagcagggcgaaggccagaagttaag

SEQ ID NO: 241590 - DNA, 27 bp, Artificial Sequence
  Description of Artificial Sequence: Synthetic oligonucleotide
gagcagggcgaaggccagaagttaagg

SEQ ID NO: 241591 - DNA, 27 bp, Artificial Sequence
  Description of Artificial Sequence: Synthetic oligonucleotide
agcagggcgaaggccagaagttaaggg

SEQ ID NO: 241592 - DNA, 27 bp, Artificial Sequence
  Description of Artificial Sequence: Synthetic oligonucleotide
gcagggcgaaggccagaagttaaggga

SEQ ID NO: 241593 - DNA, 30 bp, Artificial Sequence
  Description of Artificial Sequence: Synthetic oligonucleotide
cagggcgaaggccagaagttaagggaaaag

SEQ ID NO: 241594 - DNA, 30 bp, Artificial Sequence
  Description of Artificial Sequence: Synthetic oligonucleotide
agggcgaaggccagaagttaagggaaaagg

SEQ ID NO: 241595 - DNA, 29 bp, Artificial Sequence
  Description of Artificial Sequence: Synthetic oligonucleotide
gggcgaaggccagaagttaagggaaaagg

SEQ ID NO: 241596 - DNA, 30 bp, Artificial Sequence
  Description of Artificial Sequence: Synthetic oligonucleotide
ggcgaaggccagaagttaagggaaaaggtg

SEQ ID NO: 241597 - DNA, 30 bp, Artificial Sequence
  Description of Artificial Sequence: Synthetic oligonucleotide
gcgaaggccagaagttaagggaaaaggtgc

SEQ ID NO: 241598 - DNA, 32 bp, Artificial Sequence
  Description of Artificial Sequence: Synthetic oligonucleotide
cgaaggccagaagttaagggaaaaggtgcaag

SEQ ID NO: 241599 - DNA, 39 bp, Artificial Sequence
  Description of Artificial Sequence: Synthetic oligonucleotide
gaaggccagaagttaagggaaaaggtgcaagaaaaaaag

SEQ ID NO: 241600 - DNA, 40 bp, Artificial Sequence
  Description of Artificial Sequence: Synthetic oligonucleotide
aaggccagaagttaagggaaaaggtgcaagaaaaaaagac

SEQ ID NO: 241601 - DNA, 39 bp, Artificial Sequence
  Description of Artificial Sequence: Synthetic oligonucleotide
aggccagaagttaagggaaaaggtgcaagaaaaaaagac

SEQ ID NO: 241602 - DNA, 38 bp, Artificial Sequence
  Description of Artificial Sequence: Synthetic oligonucleotide
ggccagaagttaagggaaaaggtgcaagaaaaaaagac

SEQ ID NO: 241603 - DNA, 39 bp, Artificial Sequence
  Description of Artificial Sequence: Synthetic oligonucleotide
gccagaagttaagggaaaaggtgcaagaaaaaaagacac

SEQ ID NO: 241604 - DNA, 40 bp, Artificial Sequence
  Description of Artificial Sequence: Synthetic oligonucleotide
ccagaagttaagggaaaaggtgcaagaaaaaaagacactg

SEQ ID NO: 241605 - DNA, 42 bp, Artificial Sequence
  Description of Artificial Sequence: Synthetic oligonucleotide
cagaagttaagggaaaaggtgcaagaaaaaaagacactgaac

SEQ ID NO: 241606 - DNA, 42 bp, Artificial Sequence
  Description of Artificial Sequence: Synthetic oligonucleotide
agaagttaagggaaaaggtgcaagaaaaaaagacactgaacc

SEQ ID NO: 241607 - DNA, 41 bp, Artificial Sequence
  Description of Artificial Sequence: Synthetic oligonucleotide
gaagttaagggaaaaggtgcaagaaaaaaagacactgaacc

SEQ ID NO: 241608 - DNA, 42 bp, Artificial Sequence
  Description of Artificial Sequence: Synthetic oligonucleotide
aagttaagggaaaaggtgcaagaaaaaaagacactgaaccag

SEQ ID NO: 241609 - DNA, 41 bp, Artificial Sequence
  Description of Artificial Sequence: Synthetic oligonucleotide
agttaagggaaaaggtgcaagaaaaaaagacactgaaccag

SEQ ID NO: 241610 - DNA, 40 bp, Artificial Sequence
  Description of Artificial Sequence: Synthetic oligonucleotide
gttaagggaaaaggtgcaagaaaaaaagacactgaaccag

SEQ ID NO: 241611 - DNA, 42 bp, Artificial Sequence
  Description of Artificial Sequence: Synthetic oligonucleotide
ttaagggaaaaggtgcaagaaaaaaagacactgaaccagaag

SEQ ID NO: 241612 - DNA, 41 bp, Artificial Sequence
  Description of Artificial Sequence: Synthetic oligonucleotide
taagggaaaaggtgcaagaaaaaaagacactgaaccagaag

SEQ ID NO: 241613 - DNA, 40 bp, Artificial Sequence
  Description of Artificial Sequence: Synthetic oligonucleotide
aagggaaaaggtgcaagaaaaaaagacactgaaccagaag

SEQ ID NO: 241614 - DNA, 39 bp, Artificial Sequence
  Description of Artificial Sequence: Synthetic oligonucleotide
agggaaaaggtgcaagaaaaaaagacactgaaccagaag

SEQ ID NO: 241615 - DNA, 38 bp, Artificial Sequence
  Description of Artificial Sequence: Synthetic oligonucleotide
gggaaaaggtgcaagaaaaaaagacactgaaccagaag

SEQ ID NO: 241616 - DNA, 38 bp, Artificial Sequence
  Description of Artificial Sequence: Synthetic oligonucleotide
ggaaaaggtgcaagaaaaaaagacactgaaccagaagc

SEQ ID NO: 241617 - DNA, 39 bp, Artificial Sequence
  Description of Artificial Sequence: Synthetic oligonucleotide
gaaaaggtgcaagaaaaaaagacactgaaccagaagcag

SEQ ID NO: 241618 - DNA, 39 bp, Artificial Sequence
  Description of Artificial Sequence: Synthetic oligonucleotide
aaaaggtgcaagaaaaaaagacactgaaccagaagcagg

SEQ ID NO: 241619 - DNA, 38 bp, Artificial Sequence
  Description of Artificial Sequence: Synthetic oligonucleotide
aaaggtgcaagaaaaaaagacactgaaccagaagcagg

SEQ ID NO: 241620 - DNA, 37 bp, Artificial Sequence
  Description of Artificial Sequence: Synthetic oligonucleotide
aaggtgcaagaaaaaaagacactgaaccagaagcagg

SEQ ID NO: 241621 - DNA, 36 bp, Artificial Sequence
  Description of Artificial Sequence: Synthetic oligonucleotide
aggtgcaagaaaaaaagacactgaaccagaagcagg

SEQ ID NO: 241622 - DNA, 35 bp, Artificial Sequence
  Description of Artificial Sequence: Synthetic oligonucleotide
ggtgcaagaaaaaaagacactgaaccagaagcagg

SEQ ID NO: 241623 - DNA, 35 bp, Artificial Sequence
  Description of Artificial Sequence: Synthetic oligonucleotide
gtgcaagaaaaaaagacactgaaccagaagcaggc

SEQ ID NO: 241624 - DNA, 36 bp, Artificial Sequence
  Description of Artificial Sequence: Synthetic oligonucleotide
tgcaagaaaaaaagacactgaaccagaagcaggctg

SEQ ID NO: 241625 - DNA, 35 bp, Artificial Sequence
  Description of Artificial Sequence: Synthetic oligonucleotide
gcaagaaaaaaagacactgaaccagaagcaggctg

SEQ ID NO: 241626 - DNA, 36 bp, Artificial Sequence
  Description of Artificial Sequence: Synthetic oligonucleotide
caagaaaaaaagacactgaaccagaagcaggctgtg

SEQ ID NO: 241627 - DNA, 36 bp, Artificial Sequence
  Description of Artificial Sequence: Synthetic oligonucleotide
aagaaaaaaagacactgaaccagaagcaggctgtgg

SEQ ID NO: 241628 - DNA, 35 bp, Artificial Sequence
  Description of Artificial Sequence: Synthetic oligonucleotide
agaaaaaaagacactgaaccagaagcaggctgtgg

SEQ ID NO: 241629 - DNA, 34 bp, Artificial Sequence
  Description of Artificial Sequence: Synthetic oligonucleotide
gaaaaaaagacactgaaccagaagcaggctgtgg

SEQ ID NO: 241630 - DNA, 34 bp, Artificial Sequence
  Description of Artificial Sequence: Synthetic oligonucleotide
aaaaaaagacactgaaccagaagcaggctgtggg

SEQ ID NO: 241631 - DNA, 33 bp, Artificial Sequence
  Description of Artificial Sequence: Synthetic oligonucleotide
aaaaaagacactgaaccagaagcaggctgtggg

SEQ ID NO: 241632 - DNA, 32 bp, Artificial Sequence
  Description of Artificial Sequence: Synthetic oligonucleotide
aaaaagacactgaaccagaagcaggctgtggg

SEQ ID NO: 241633 - DNA, 31 bp, Artificial Sequence
  Description of Artificial Sequence: Synthetic oligonucleotide
aaaagacactgaaccagaagcaggctgtggg

SEQ ID NO: 241634 - DNA, 30 bp, Artificial Sequence
  Description of Artificial Sequence: Synthetic oligonucleotide
aaagacactgaaccagaagcaggctgtggg

SEQ ID NO: 241635 - DNA, 29 bp, Artificial Sequence
  Description of Artificial Sequence: Synthetic oligonucleotide
aagacactgaaccagaagcaggctgtggg

SEQ ID NO: 241636 - DNA, 28 bp, Artificial Sequence
  Description of Artificial Sequence: Synthetic oligonucleotide
agacactgaaccagaagcaggctgtggg

SEQ ID NO: 241637 - DNA, 27 bp, Artificial Sequence
  Description of Artificial Sequence: Synthetic oligonucleotide
gacactgaaccagaagcaggctgtggg

SEQ ID NO: 241638 - DNA, 27 bp, Artificial Sequence
  Description of Artificial Sequence: Synthetic oligonucleotide
acactgaaccagaagcaggctgtgggc

SEQ ID NO: 241639 - DNA, 27 bp, Artificial Sequence
  Description of Artificial Sequence: Synthetic oligonucleotide
cactgaaccagaagcaggctgtgggct

SEQ ID NO: 241640 - DNA, 29 bp, Artificial Sequence
  Description of Artificial Sequence: Synthetic oligonucleotide
actgaaccagaagcaggctgtgggctatg

SEQ ID NO: 241641 - DNA, 28 bp, Artificial Sequence
  Description of Artificial Sequence: Synthetic oligonucleotide
ctgaaccagaagcaggctgtgggctatg

SEQ ID NO: 241642 - DNA, 28 bp, Artificial Sequence
  Description of Artificial Sequence: Synthetic oligonucleotide
tgaaccagaagcaggctgtgggctatgc

SEQ ID NO: 241643 - DNA, 27 bp, Artificial Sequence
  Description of Artificial Sequence: Synthetic oligonucleotide
gaaccagaagcaggctgtgggctatgc

SEQ ID NO: 241644 - DNA, 28 bp, Artificial Sequence
  Description of Artificial Sequence: Synthetic oligonucleotide
aaccagaagcaggctgtgggctatgcag

SEQ ID NO: 241645 - DNA, 27 bp, Artificial Sequence
  Description of Artificial Sequence: Synthetic oligonucleotide
accagaagcaggctgtgggctatgcag

SEQ ID NO: 241646 - DNA, 27 bp, Artificial Sequence
  Description of Artificial Sequence: Synthetic oligonucleotide
ccagaagcaggctgtgggctatgcagt

SEQ ID NO: 241647 - DNA, 27 bp, Artificial Sequence
  Description of Artificial Sequence: Synthetic oligonucleotide
cagaagcaggctgtgggctatgcagtg

SEQ ID NO: 241648 - DNA, 29 bp, Artificial Sequence
  Description of Artificial Sequence: Synthetic oligonucleotide
agaagcaggctgtgggctatgcagtgaac

SEQ ID NO: 241649 - DNA, 28 bp, Artificial Sequence
  Description of Artificial Sequence: Synthetic oligonucleotide
gaagcaggctgtgggctatgcagtgaac

SEQ ID NO: 241650 - DNA, 29 bp, Artificial Sequence
  Description of Artificial Sequence: Synthetic oligonucleotide
aagcaggctgtgggctatgcagtgaactc

SEQ ID NO: 241651 - DNA, 28 bp, Artificial Sequence
  Description of Artificial Sequence: Synthetic oligonucleotide
agcaggctgtgggctatgcagtgaactc

SEQ ID NO: 241652 - DNA, 27 bp, Artificial Sequence
  Description of Artificial Sequence: Synthetic oligonucleotide
gcaggctgtgggctatgcagtgaactc

SEQ ID NO: 241653 - DNA, 27 bp, Artificial Sequence
  Description of Artificial Sequence: Synthetic oligonucleotide
caggctgtgggctatgcagtgaactcc

SEQ ID NO: 241654 - DNA, 28 bp, Artificial Sequence
  Description of Artificial Sequence: Synthetic oligonucleotide
aggctgtgggctatgcagtgaactcctg

SEQ ID NO: 241655 - DNA, 27 bp, Artificial Sequence
  Description of Artificial Sequence: Synthetic oligonucleotide
ggctgtgggctatgcagtgaactcctg

SEQ ID NO: 241656 - DNA, 27 bp, Artificial Sequence
  Description of Artificial Sequence: Synthetic oligonucleotide
gctgtgggctatgcagtgaactcctgg

SEQ ID NO: 241657 - DNA, 28 bp, Artificial Sequence
  Description of Artificial Sequence: Synthetic oligonucleotide
ctgtgggctatgcagtgaactcctggtc

SEQ ID NO: 241658 - DNA, 28 bp, Artificial Sequence
  Description of Artificial Sequence: Synthetic oligonucleotide
tgtgggctatgcagtgaactcctggtcc

SEQ ID NO: 241659 - DNA, 27 bp, Artificial Sequence
  Description of Artificial Sequence: Synthetic oligonucleotide
gtgggctatgcagtgaactcctggtcc

SEQ ID NO: 241660 - DNA, 28 bp, Artificial Sequence
  Description of Artificial Sequence: Synthetic oligonucleotide
tgggctatgcagtgaactcctggtccac
